United States Patent 7,468,248 (METHODS AND SYSTEMS FOR INFERRING BOVINE TRAITS) - sequence listing, part 7

SEQ ID NO: 32281 - DNA, 1429 bp, Bovine  19866881391783
atgcttcagttatgttatgaaattcatattagcacaggaaatgaatagcaatgcaatcctatgtactaagccacagaccttattctggttattcaggtttcaccagtggcccaaccaatagtccaggattcaatccaggatccacccattgcatttagttgtcacgtcccctcaattgtcaccagtctgggacagaccatgggcctttctttaaattctgtgcccttgacccctttaaagcgtccttactaattattctgtagaatgcctctcataggttttccagatatttgctggatcactgagttgggttctgtgtttcttttcgtagcttgcccagaagggatgatacccctcctgggcatcacagcagaaggtacgggatgttagtatgatttatcactagtgatgtgaactttgaacacttagttatagtggtgtctgcctggtttcccagttactctcttacctttcgtattaagaagtatctttgcgactatgcgaataacttgattctcattacactttctgtctctgacatccttagatgattcttgcctgcaacagttattactttggtgtttgccaaatagtgatttcctatttctgtcattctttgtacatttattagttggaattctactgtagaaagagctttcctttcttcctcatttattcatttatttatttatacaggtttaactcctggctgtttattttatggattataatccattactatcatattctattgctgaaattgttccagatttggccagtgacagccccttcatgcaggctcctctgtccttttgacaaatgcccattattctttgagcttgtccttacactcagcaaggtattcagggcttgtcttgtgctgtcccagccctggaaacaacctttattctatgaaggcaggcaggggttttgtctgtgttcttcattctgttgcatcctggtgctcacagggtctggcatgtagtaggatcacctcaaataatttttggatgaatggatgaatcctgggaaggaagattccataagctaggtacagaggcgacctacaattcatactttgcctagtctcctcctgatgagcctgaatgaatgatttagaaagggaggggtcttttccctgttttcctctcctgtgagcctcaggggctttgacagacccgttttgtcactttcagcctgttctccttgctgcacagtgtgaaaaggatcccagggcatccccgatcttgtagaaatagatcttgtcgagtagaaagagccaaaggcggggaaagcagccaagaggagcaggctggctggagagttagctggggctggcagagccgagcctgcttgctgctaatgacttggttgaacaccagccgtggcaggcaggaggctccagcagttgacggcagaggtctgggga

SEQ ID NO: 32282 - DNA, 749 bp, Bovine  19866881493299
ctgggtggtcatgcaaggaaaggaggacccagagtatggtgctgggtcggagggagggtcccagggcaggagcagagagagagactcatctgggtcttgagttgccttgctcatcagaacctgtgtagaggaggtcgtgagacatggttctgacccgagacatgatttactgtagaacagacctttggaagtcaacggacctctcagatccagagacagaacggctaatgatgcaatttcagactctatgacagtcactaatgaggtattctaggtgaggaattccaacccagaacacctaaaacaaccccacagggaaacctcctatgtcctgtcctgccttgctgtcacctccttgcctatctgaagaagacagctaccttctggaactttctagaagggaacactgcactggagagtgtattagacatgagcatctccaagggtcatccaagtggaaggttctgcggttcctagatcacttgagccataaaatttcatgcccaaagtgttcaacttctcatgccttttggtgccggagctctgaggctctaaaatcctggaatcctacctggcgctgcctttcggcttctatgattccatgcttctaaggctaagagttctgtgatccttcaaccctgtgacctacttcagggtagacaaggacctcacacaaggggagcattcattcccggcagggactatgctcagagacgccccgtgtggctgcctgaccactatgatgggca

SEQ ID NO: 32283 - DNA, 668 bp, Bovine  19866881496833
aagtgttgtctaacgaaactctagtttatttacatatgctgatgggtgtgcacgattaagtcctactgtgaggtatggttaaaagaatttgacagttgctggtccagatgatcgacgatgatgtgctccaggaatcctgcatattgctgcttatacttcattttcttattaccccagtagactttcacgtgaaccctttgggatcagtgtcctgggtcacattttttttttttattctctggttgagcttacctgaagggccagctgtgaagaagtctcaaccacgtagctggcagtcaggcacgtaccccagcttgttggccttggatgagacaggaagggcaggtgctgttagcttgtccttccagagtgaagtggcatcttggccaggtcctctggctgggaaggagactgtataagtagtgtgggatcccagtcttggtcactgggagagcagccccagttacttttattcctcacttacttcacattgccagaggactttttttggagttaagaaagttcatgtctgtgctatatttaaatacctatcagactctgagtgaatgtctgtgtttttgtgtgtatgcgcttcctaaaaaactccagaattgctgtcttggtcttctcatcttttaaatgtgtcaggccagtgctgtccaatcgaa

SEQ ID NO: 32284 - DNA, 765 bp, Bovine  19866881585107
gggaaaacaggctgcttggggtgggcttgtctccagggagaatttgaaggaggccaggatgctgatcaaattctggtgtcacacagatcggacccactaatgaaggaaagagctgattcactcaggggctggggagtagaagctgcacccacggtctcggaaaggtgacaaagaccccggaaggtgccgacaggctcgtcggcttctgtcttcggctgagcagaaccatcttccggatgctgagtccaccaatccaaacaaaacccaaagatgggggagcagaccccagagctgtccagggacccgggagggagccaaagggcaaaatgaagaacttctttgctacaagtagcagggtgaccctgaggaggccaccctcaccctgctcagtcactcagctccctcctctgcaaagggtggtggtgactgtatctccctcgctggccgtggtggccgttcagccagctcccatcctgaagatgcgatgcagccccctggcacaaggcagtgcctaataaaacgagggagcccggctttccactcgcactagccagactgctgggaaacccggcctctaagagaagtttttttccacagtgaccaggggaaggaatcagggccatggaagagaggccaagtccatttgtctaaagatagggctgtgtcaaggccaaagtcaacacagtggaaagtagaacttgtggcttttaggaaacactccctcatccatccgggcgataccaggagtggtctttggaaggatgg

SEQ ID NO: 32285 - DNA, 1481 bp, Bovine  19866881679592
tgtgcgaaataggcagcaactggttccaacccatctacctaggggccatgttctccttgaatgaaggggacaagctgatggtgaatgtcagcgatatctctttggtagattacacaaaagaagataaaaccttcttcggagccttcttgctttagtggtaagacagatgtcattgtatggaggtcctctgcttcttaggtcctaattttcctcacttgtaattataaccaggaggctttgtcggaggatagagacggcagttaagaaatttaggggccaaaagttcatactttatgtacctgactgatgagaatactaatcagaaaaaggcagaagagagcagacctattatcagaactgcttggaagagtggtgagtttctaaacattaaaacactgatcaccaaatgaatggaacatttccatgcctggctcctatgcatttgtcaagaagagggcctaggtactgttcaattttattatgcagcatttgcttcagtttaggaaacttaaaaacaaaattcaaagccccagaaatagtccaaacacttcagacgcaaaatcctgcatcagttcccccaaacacatacttcaatgccttaccagaaaaaaaaaagaaaaaagaactgatatttcttataaatgttcttcaagaaaaggaattaattttcatgccatctatgcccaatgagaaaaactacctttctatttcttatgtacacatgcatcaaaacaagcaactgtgagttccacatgcatattgaaaacacaacagcacctgctcagcacagtgttcttgagcaccttttgtgtgtgtgctaaaccaaaacacactatgaagaatgagacagactctacccaaatgtatatgaatacctggctcctggtcaaatgccgctcaacgtatttcaaggtctaattccaactcctaacaagtatcactggatactgttaaacagaagatttctggagctctcctcactatgttagacaaccagctgattaggccactcaagaaacttgaagacaagagttctagaaaacagaccaaccatataacaaagttgattgatcccaagagatgatggacttattccctggagggaaaatgccaatcaccaaatctggagatgttaactgagatctgctttgaggtttgactcactttatgtgcagagtgttatatgggtactttgaaaatattcaaagggatttaaatgtggaattggctcatcagcccagccaaggcgtctttcctgaagaagaggcagaacactctcctgtgcttctatgagttcatatcctctatgatcctcaaatctgtatgattttcctgcaaccatatgtcaaaggttggagggacattcttgttctcttagcctctgttgatttgtctgtaaaggaggaatccatcaatttgtttcccaggatcaaatgcgctcatagggatgaaacatgttagctttgagcattctgtgaagc

SEQ ID NO: 32286 - DNA, 715 bp, Bovine  19866881853778
actgggggataggggattaggggaaaggccggggaaactgaaggctcacttcccaccacccaactcccctggcccaggagtcgcagtgagtggactcagacccaggttctggcggagatgctgaccaaggagaaagtgatgccctctgcacctcccctgcccgcggggccgctaaacgcatcaccagtgctgagaggtgaagaaaggcgcgagaggagggctgttagcgttctctgtgatcttgggccggaactcacctccaaaccttagtcttcccatttctgaaatagggggcggattaagtggtgagagtctacgatctttctatttctcaaacctagaattctctcccagatgtattctggggcccgtggtgtgcatggcagattgagctgggagggccatctgagacttccccagaggctgctgggaccctgatgggcctgggtgggcaaggcccaaggaggtgatggcctcaagccgcaccatgtgccctttaggtggggctgcagttccaaacctggcccggagactggaggccctcagagaccaaattggcacctccctgcgacgtggccggagccagccaccccctcgctgagggcacacggagccctagccaggccctccgtgcctgtgtgggcagcgtgggaacccaggagaccttcatgtggccttgggctgggctctgcatgctgggtttcagtctctccat

SEQ ID NO: 32287 - DNA, 1788 bp, Bovine  19866881910767
cttcccagggatcctcgactctgccatgaacgggaaaggcctgctccttcccacacggggaaggggctgaggaacagcaggctcagctccagccctgcttcacaactcagaaaggtctctgtcttccctgctcagctgactgggcagctagctgaggtctctactgaacgagtgtgcctgtggtcgcctcaggccaggttcccacacctcctgcccattcctttgcttggtcatctaagttaaacctgtgtgtgtgtgtgtgtgtgtgttcttgcttagtcactcagtcacatccgactctttgtgaccctttggactgtagccctccaggctcctctgtccatgggattctctaaaaatactggagtgggttgtcatttcctcctccaggggatctttactacccagagactgaaccctctcctcctgtatctcctgtattgcaggcggattctttatccactgagccattcctctccctaaatcccacacttgttagtgtgattgaggaggatccaggggttctcaatctggggtccctgtaaggctccatggatgcatttcaggggtccgtgaacttgagggaaaaactacagctgtcattttcgccagcctctagttgaagctgagcactcccctcaaacatgagcttaaggcatgtaggcaacatatctacagcactggtaacagtcacagatctttacacatcacattacagtcactgctgcagagagctccaaatgtatcggtgaggccggtcaccacttcaaaattgaagtcattatcggacctgccattagatctcgttattcaaggcaagaataaagaagcaaatctttgaggagatcacaatttaacataatctcacgtttgtatttcaatataattcatttccttcgtagtcttttgttttgtattttgtcatttaaaagaagttctctattctgagatggctagatagcatcaccgactcaatggacatgaatttgatcaaaccccggtagacaagaaaggacagaggagcctggcgtgctgcagtccacgcagtcgcaaagagtcgaacacaacttagtgactgaacaacaaattctgagaaggggtctatgatcttctccagcctgccaaaagggtctaaggaacaaaataaaaggttagaactccaggatagagggatttcagaggaagctttgtgctctaccatcctaggattccaagtatctatttcccaagggccctaccatgagcataactatgaaattaaatttgctgaacgtattgccttttttttccaatcaggaaatacatccaggccgcggcagcccttccaaactcccgggcttcccacagaatgtgctcgaatgacactggaaaggtttcaaaaatccagtcctccccttgctttaattcctttcttccccccaacagatgttgtaggcctggtgaggaagctcctcgtgtgcgtgactctcacggcattgatggcgtttcttgggagagacaaattcttctgggtccccagcatcattccccttccagcccgaggcagccccttgctgggttcagaggatggggtccttctttaaaggagtggacgagactgctaccttccgacctgagctacgagcccagagcttatgctttcaggaggcgccgggctgcagaagagggactaaggccggtcatccactcatcagcctccagtgccaagggccctggacctcaacactgaaggttatgtttctccaacttccttttcaggatcacgtgcaacctcctctccgcttcaga

SEQ ID NO: 32288 - DNA, 1727 bp, Bovine  19866880349440
ctgcttgaggacaagaactccatccgatccattctggcccagtggtgaacacaggctttagagacagagagcttacctagtctggaatccgaactttgccactggcgtgctagtaactcaacctcttttgaacctcccttcatctgtaagatacaaatgatcctacctgtcgcacatgcctgtgatgatgggcagatacgacaacgcccacaggcgctttactcagcctagcatgcagtaacagaaagtcactctcatcctgttaggatttgcgtgcctcaaatctcacacagccttgcccagctcaggctctcaggatgaagcctgtagccaggctgggaagcggtcaggtcttctggattctcccctcctggtccaagatcatctctggatccctgactaagtgctcagcctgccaggcgcccatgtgggcctcacagcctggccccagacatcaagccccaagcccactgtgggaggcagtccaatttgacgaacatcaattatcaagtgccagttggccaaaaatcaatgtgtcaaatgaccaattcatcaaaagccaattagccacaaattacttcgccaagtggctacattcccaaattatcccaacagttacccaaaacttatttatttcaaccatttataaagatgacaaccatttgtgttggaagagatggttttagttttagttaataagttctgattttgtgttcagtgcagcatttaaaaaaaaaatattaaggaggtcaaaatcaaggaccatgggttggtttagtcatcttatttagtatgcactaagggactgcaaggagatccaaccagtccatcctaaagaagatcagccctgggatttctttggaaggactgaggctgaagctgaaactccaatactttggccacctcatgcgaagagttgactcattggaaaacaccctgatgctgggagggattgggggcaggaggagaaggggacgacagaggatgagatggctggatggcatcactgacttgatggacatgagtttgagtgaactccgggagttggtgatggacagggaggcctggcgtgctgcaattcatggggtcgaaaagagtcggacatgactgagcaactgaactgaactgattcggtgtatttcattatgagttaccgaacgtcagtgcttcacacaggaaatcttgaagttactctctgcagtaggttgaatggtggctcctgaaaagacatgtctgtcaaatttccagaacctgggaatgtgaccttatttgaaaaaaaggtctctgccaatgtaatgaagttaaggattttgagatgaggacataatcctggtggaccctaaatccagtgagaagggtccatatgaggagagacacagagagaaggagacaacaggaccacaggtacacggactggaggctgctgctgctgctgctaagtcgcttcagtcctgtccgactctgtacgaccccacagaaggcagcccaccaggctccccccccatccctgggattctccaggcaagaacactggagtgggttgccatttccttctccaatgcatgaaagtgaaaagtgaaagtgaagctgctcagtcgtgcctactcttagtgaccccatggactgcagcccaccaggctcttctgtctatgggattttccaggcaagagtactggagaggggtgccactgccttctacaatgcgtgaaagtgaaaagggaaagtga

SEQ ID NO: 32289 - DNA, 673 bp, Bovine  19866880435108
tgggagtgtgcgtctcggtgcgtgtatgggttcacgttgcgggagtgagcacacatccgccgactcccttttcgcagcttgtgtggtggtggtatctcagagggtctgcccacgggcctgcgggtgcgtagtcggctgtccctgcgctcagccggatcccagagcgcccacgaggcgaggtgtgcagcccgtgacccattccgagtagtctccgcggctttgccagtaccctgctccgggaatctctgccgtcagctccgtgtcccactgggtgacgcgcacaggcgctctcccttctccaggcctcagtttccccttcgtccaaagaggactggatgggggcagattgggtagctgggccttccgcgagtcggggaaggacatgctagatgttcctgcgccctggaggggacttttccgtggatcaggtaggtttgtcacgttagggtgagtgtggtggcgctaaggaggaataaacggagggatggtgacctgctcaaacatcgccccctggaccagaaggggatcgctccgctcattctgacgcgcctgtgctttctcacctccgcagaagcccggcgagaccccccagcggtgcgccccgccccggcgccatgcacttgcgaagtggccgaggcgcactcagacaagaggccgaaggaggcccccggcg

SEQ ID NO: 32290 - DNA, 922 bp, Bovine  19866880510328
ttatttttatttatttatttatttattttccagatttgggtaactttatttgcatttaatagtgatttttaagccctatatccaatgaaaccatttttaaaagctttatgaggaatggaaatttagatgtctattccacttttctttaaaaaaaaagaagcttaaatttctgaatgagcaagattcacttttgcaggtagaggccctgcttcttcatgatcttcagctttagatctaacaaccacaagagaagaagctggatatctgtttagcttttgttcattcataaattccaagtcaccatagatactcagcttctcagagggaacatactgctgcacagctgtagcaacagttgcacagcaaatccagagcaacaccatcacagagaggacaagagtcacggttaaaatccacccagagttaagagccaggcatcttaaaaagccgtcactttctccatcttcaagatagtttctatgtgcttgtgaacttctcatttgcagatctgaggacattttgcttagtgatgagtctttcaattttgtaggctcctgctccaactgtggtgcatactggatttctggcttagactggaatataactatttttccatcatcagcttgaagataaaaagtccacgaagaggttatgaagctctgtgcagagtccaccatatcactccagaatgatcttaccagagttagagggaagagtagatgcatttttggcatcagggacatgagttgttcttgtctcaattctgtgtatggcagctgattctggcaaccaagatggcaagcatattgctcatcagattgggaatatgccttctgtacatgcagattcacattccaatttggtccgatttaaatcaattccatcatcacaaactgacaaattaaaacagcctgcaacctct

SEQ ID NO: 32291 - DNA, 3237 bp, Bovine  19866880651449
tgatgtacaaataaagacgggtctcggccggcccagacgagacgtctcccagggcctggcccctgctctggcctggggtgccatgcagaggaccctcacttctcgcttgctctcacaccatccctggggcctgctgcgcccttcccccttctttgctgtcacatcaagaagcgcccaggccctctccccctcccccaggggagaagcaaggtctctggtggctgcttccacctcctcgctgtgaggtgtggggcctcagtctccttacatgtgttgttactgttgttcagtcgctcagttgtgtccgactctttgcggccccatggactgcagcacgccaggcttccctgtccctcaccatctcccagagcctgctcaaactcatgacctttgagtcggtgacaccatccaaccttcttgtcctctgtctcccccttctcctcctgttgtccccttctcctgcctcatgtgtaaaatggggataataacgtcttcctgccagaagtgttatgagaacagaagcacctgaagtccctactcttagatcctggcacttaggaaacagaccccctgttccccagtaccatcaggtttccaggaaatgtactggctgtggactaccggaagttcagtcaagcctgtcctcccaaacttctgggggttataagtgcctccagcattcccaactatgctccccagcagatcaggccctggagacagtctgcactctttcctggggattcacaccacgtgtagcaccacacccccaaggagcctgccttgtcatcaggaaccttgctgcagaactgtcttcaaacacaaaggccacccgtcagtcctggcagctcaggctgctccccaagcacacagaggaagaaaccgaggcccggagaggtgagatcacttgcctggcatcaggcagaaagcctctagactcccagccccaatatgtttcagttcacaccagtgagaaagaggtggtacttgccacccccaagcagtgatggggaggtcacggcaggacacattgatggcacctcagcccacagcctgcacaagtgcccagttcccttgggacttaaggctctgtcttccagagccactcatttgaatggaacctcactgagggtgtgcttgggtcagtcatcccagtgctatcagctgggacacagacagaatcggctgggagcagagtaagagtgaaacctcccatcctggggaagtgagccctcactctctgagcctcagtctccttaagtgtaaaaggaaagcactggacccgatgaccctcagggcccacgctagccagaaacttactgggatccagctctccaggccacccctgctataaagcagggtatgtctgtggtcctgataaccaggcctggctgctccttccctagcgacccgtcctcagcccgagaggtcattccccatcactgtgtcttcctccccagacccaagtccaaaactgacctcctggtcactgcagcccctcgagttcttagctacatcagcgacctgggagggagcggcccgacacctcactttatctcccactacgacctccagggcatcttgggcccctggtggggaggagtcagggtccacacgaagcggggtgaggaggcagcagccacgaatgtccccagcagcagctgcatggctgtgggagctgggcccgcaattaaaataaaccccctgaacagccttaaaataactacaaggcatttcaagaagattgtactgttgaatttactgtttgtttactgagacaatctgagtcgggtttcagatgaaagtaggagggagaccagatgtgaggctgaacgtctgacctgcagcatctgccgccagggcaggagccccgcacggccagggggcaggggcgcccacccagaggagacaaggaagaccagagactcagaacccctgacccaaaccaggccggccagggcccagaaggccacattccagctccactggtcggcttccaccactgacacagagggctgcgtggagccaaggcgtcccagagagaagcctgtcctccagaatctgagatgaaagttcacatgccagctgcgcctccctggacaggtcactatgccactctaagccgatgtcctcagctggaaagcacacttcctacacgtctgaggagatctggaaagggcctggccacagacggtaaggccagcccacttccctccttctccctccagcttaacagtcttttcttataaagagtggcccctaggctgcccgcctgaggcagcctggcctgaggagcgccacagccacgttctagcatctccccaaggtcagtaaacaggtaggattctcccggtccccagtcccagcccagagctgaatacagggcagcagtccccagccctctgctgaatgaaggagggagacggcagggagtgagggagcctccactcgctccaggaagggtcagactatccgtcagggctcagctaatagatttaaaaccttttcctgttaatgacagcatctgctcttcatgtcctcctggaaaaggcaaggagagagatttctatcacacaaatgtcatcatggaaacaccaaggcccaaagagattacgataatttacttccctgtccacaatccctgttctttggcagtgagtgggtgctatctgtgtggtgagcatgggacctactcacccaaggacaccaggaccaggcaggcaggggacactgcagggagaggggacagccatggacctctgctgctgacagagctgtgtcatcctgggcaggacacttaacttctctgagcctcggtttccttctttacaaaacaaacgcaataaaaccccctcaggacttcccggtggtccagtggttcaaactctgcattccaatacaggagatgtaggttcaatctgtggttgggggaactaagatcctgcatgccccagggtgtggccaaaaatatttttaaaagattaattaaaaaaaaaaccaccccccccttatgaacattaagtgaaataatggaagggaagatgttctgtgagctctaaacagcacggaaccatgagagttaccatgctattattatcagagaaggttttaaaattcacatggtcagaaaataaatccatcctacttggggaagggtaagatataggcaagtgtatgtgatgttcctgatatgggctgagtgaagaataaacaaatgatactccaaaagaagctgtcagg

SEQ ID NO: 32292 - DNA, 1112 bp, Bovine  19866880675317
accgggagctgactgtggctcagatcatgagctccttattgccaaattcagacttaaattgaagaaagtagggaaaaccactagaccattcaggtatgacctaaatcaaatcccttatgattatacagtggaagtgagaaatagatttaagggcctagatctgatagatagagtctcccctcagcatcatctaattaagggctggtcccagtatggagcccagaagatcgggtcagcagggctgtcctggaacactgggtcccagcccatggagtggagaaggcagatggggtccaggccatggtgagctggcttgcggaaagggagagcggagtcgtatgcttggacccgagtccatgggggctgtgaacctcgtcttttgctacatcatctctctgtgtcacctccttcccagcaccacaggtctccttactctgaaagcaacacactgcttctgtctctgcactttctcccatgctcttctctctgcctgaagggccctccccttctttatttgactaactgctgctagtcttttaaggctcatttcaggccctggggagacctgctctgacccccaggctgggtcacagctccttctcggggcacctacagccccctgagcacccttttgcacagcctgcctcaccagtctggtgatcacttgttcacggtccatctcctccaccaggcagcagatcttgggcgtgaggactgtgtttactcctgtctgggtccctagtgcctttcatcaggcctggcacactggggaaagcttgtccaatttgattagtaatgatggtcccctcgtgtttgaaaatgtttgtttttcaaagcacgttcacgatccttttgagccacccagccgttgcagagggaggcaaggcagtgctgacaaggtttggaagcagaggctcagtaagctgcctactgtaatggccgcagagcctggcctccaagtctaaggctcgcttgcgctgtctccccctactgcctgagtaaaagctgtgggtggcgcccacacccttggcgaccctgaggccaggactgcttgtaatcagattgccttcctccccactgagctcatgctgctgagggaatggaaatttgga

SEQ ID NO: 32293 - DNA, 1711 bp, Bovine  19866880706746
tcctggcagcctctgccggcacgtgtaatttatttacagggttggaaagtcggcaaaatacatcatcaactcttatacaaacttctattaggtattaaatacccaagcctcagagaagtaattcatatagtccaacaacgttccaaaataaacccaatctccagccctccggagagcttaaaacagcaaatgggatctgtgtttttaaagccgagtttataatactccctggtttcttgctaaagctttgccatcaaacctgttacttaaaaacaaaagcaacaacatctaagagagtaatccggttgctaaaaaagacataaataggaagaagctgagccacaggcaaccaggccatccttgacacctcttccggctctcgctttcacacgcggggtcaatatctaaaggcaaaggacctttgggcaagccaaaagcctcctacaatttccacttcagaaaaaatatgaccccttgagaacgtccacgttcacatacattctcacaaacacatacacgcccccgtgcaaggccacagacccaagccagcagtgggacctcctccttccagagaggggcatttgactcattcatcatttgacacaaaagacccatttcccacaaactctagttcactctgatccctggcttgctctcccccacaagcctttcttcatcccaccaggcgttgaataagaaataattagttaatagatctccagccatcatgcccagggaagcatgcattctacacaccaagtgtagtgggattatgaggaattctcttcaaacagaagtcttcactaccagcagaagggggatcacagccagggcctgggcaacagagctcccacgcacagtatgacaggctcaaatggggacttgaacctgcagtaaccagtggggtgtgtgtatgctgcttctgagaggggtctgcctcctgggtctccagtctcaggctccttgcctgaggacccccatgtcacaactgggaaccactgtcctttccccatttctgcaacagagagtagtggggagagccccagtggaggcagagtctccccttaaagtcatacctcagcctgtgagctgagactgcagtctgcccgagggactgattgtctgtacctgcctgtggccttccactgctgtcccccagggttcggagacacacgctagagccaccacgactcttagctgctgcatgggttttaaaagctgtagctgagagctctgtgctctagagtagcagtcccctacctttttggtgccagggacctgtctcgtggaagacgattcttccacggaccaggagaaatgcagggtggtctggcgatgattcaagcgcatcacatttattgtgcacattatttctattattacatcagctccacctcagatcatcaggtgttagatcccagaggctgaggatccctgcttcagaaggagagcaccggcttcgctgtcagacagagctgggttcaaatcccaggctctgctatctactttctgtacagtgagtcactgcaaaattaaatatggagctcactgtttagacaaattgctcaacttttccaagcctcatttccctgatctgtaaattcagaataatgcctccttttctcatagggttattgggctttattaaatgcaatgacagctatgaactgcttgacctggcacagagtaggtgctcagtaaaggttagttg

SEQ ID NO: 32294 - DNA, 1219 bp, Bovine  19866880719396
ggcaagtgggggtggaactggcttttggaggcaagagcttggaacctggagtatgaacaaagtaggggaaacagcctaaagaagtgtgcagccctgggacccatcaactggcacttattgagcaccactgaatactagagtattctgtttacatatagtgtctccttcagccctagcaagtacccctaaaaatgaaaactccccatctgtaaaatgggagattaagcaacacagccgagtttacccgtcttaggagagacccagatgtgacccagggaccgtgatcctttcctctgccctccctgacctccattccccatgtcggggaacaaaacaagggctgaacccgccgtcaggaggctgcactccaagtacagagatgcctgaaatgcaagactccctggggccacttggatcccagcagtaaccctcgctttacaaggtgggaccattcagagggttttcctcccctcggggagccagcaagctccaaatggctaatgctgtgttcgacagagggttgagtttaataaagctagaagcagctaatggctaacaataaaaaataatatttttccttcaagcaattaaattgtaatatagagctcactaattccttcctgttctttcccaagggatctcagatcaagcaccaggagaaataaattacgtgtcgctattccctgcttgaaacccaagttttaaagaatctatgggagaaaaactgcttccttcattaaggcagaaatctctgaggatttttataatggtttcattccaagttacttttctgcaaatgcgagatcccctacccacccccatcttaaagactgaaaacttcacttcttgccccttcttctccgaagaaccaaagtatataaaagttagggttaccagagcaaaaaagctctccatagctccctgtgtctacagggaaacaaacaaaacttcctacccccgcccctctcttggcctggaacccaaggccttccaaccttatttctctctgttcccgccacagacccttctctccaggcaagcagaacccaccactgctcctcatgcacatgctctgctctcccctctccaggcctttggctgtaccaatggtgttgcctggaattcccttcccaccagtgcccaattcccaagttggagcaggtcatccacgcgtggaactcccccagcaccctctgtctcgtgaagaccttctcctttt

SEQ ID NO: 32295 - DNA, 745 bp, Bovine  19866880808338
tacatctgtaaaatgggaagaatatcttgtaaggattagagatatttaaatcacttggcaaagagcaggtattcaagaagtgtttcctgttttatatgggcactctgtgattctgttttagagcttatgaaaattccgtttggggacaatgtgggtcattagctctgctttgatatgttaattcagaatgtgccctgacacataatagaacctatgtaaaaatctgttggatgaatgaacacattttaacttttttaaagtataacaaataagagaacataaaagtctacatctggccctgtggaaagacctactgttccactcaagttagcagggagaacacagcaaaagtgtaataatgatttcaagacagaaatgttggcctggactacaaaaggacctaggagatggacttcatagtggttgtatgctctataatgtcaaaatggttttacagtctacttccagttgtttctgactttatggcttagatattgaactgagaattgtctaagcaaattctggccctgaggatttctagattggtttcttcaacttgtacattttctttcacagtattttaatggtaaagaaaaagtatctcatacaaatgagataaattgatttaacctcagctttcataaagtaactggtgacctgtgttgctgctgctgctgctgctgcatcgattcagtcgtgtccgactctgtgcgatcccatagaggcagcccaccaggctcccccg

SEQ ID NO: 32296 - DNA, 3338 bp, Bovine  19866880856543
acctgtgagtgtgtgctcactcgggaactttctctctttctcattgtttctgccctgctgtcctagtcagggccctggcctctgaggccttccagccccccagcaggggaccctgccttgtaagaggcggggaacagccagcgggtggccagacgaggtccagatgaaggtcactgggctcaggccaggcctgggtaaggatagggcagacccagcagcagagggtggcaccgtcctgtgccctgaggaactttctgggagaccagactcacaggctggacacaagcaaggaatgcaaggaggcagttgccctgacggccagagctgtcaggccgggttccaagctaaaaggagtgggagagtctggactgcaggtgggcggacatcaccaagagcttgtgggaaacccagggcgggctctaggaaggttcatttctgaggtcagtggcttggacagagaacccctgagcggacagagcctaggccagaccctccctcccctaccttcctggcaggcccgtttccacccagcacctcctgggccttcagagcagatcattcccttgagcttcctgaaacaaaacactttttccccttttgaagattaagaaattgatttcaggaaggaagagaagctgggagaaggtcactcggccttcgtctgagcttgcaggtgacagactccccccaggctctgccctgaaaagtcccagaagaaggaagttatggaaaagaggatagggcggcaggaacatctgagcctaggcgccctaccggagactactaacctgctgaactctcttctctcttgtcttttgcatgacactccaaagagacgtatgtacgcatgtgtttgtgtctctgtgctggtgagagaccagtgtctgtatccatgactccttctcggaggaaggcaagggagttgcatcgtgtgtctctgtgtggctgccatgtctgtgtgaatgtgcctgtgcatgtgagctggtgtgtgagcatgtagatgtgtgcatgcaggtgggcactagtgctgggggcactgccccttccttccgtggggaccccaaatgctcctcaggcctctctggaccactttccctccctccctctgctacaggccccagcagactcacctccagggtagatcaaactgggaaggcccagactcccctcttctgcctccatgctgactctccagggctgagggaccctctacctgttctctgaccctgactcacctcaaccctggaggactctgcgccttcgtctttcatggaagcctaagtcacgtggcactctccccttccccatcagagccatctggcacctcctgctccacccagtgctcagtaaatacggtggttgaactgccactcctgcagaaggagggggaggaagtgagtgatggtgactgaggccatgagtgagcaggtgaacaagtgaacggatggtgctgagggagcagtatgcagtgtgctatgggagaggtcagggagggctgggagtgatgggaagacccgaaggtgatgccctccagagaccaccccagagctaccgtggctcagcccaccctgaggtgctggggcttcccagtgttgggcctggccgagtcatccccagcccgccagtcatggggttgccatggtcttgttctttcagttctgccaacgtcccagagaaacaggaggcggcccaggggtaaaggggaatattcccccagcatggctcaggcttggggggggggggggcacccacagctatgcatggcctggggtgggaagctcagaccggctgtgtgcatggccctggctggctcggcacagctctgcttggcttggctggagtggcggggcaggggtctaatgggcagagggtggcacggcaccttcccctggcttgaagagttaaccttctgtgattctaaagcccagaagatgctgtgagaacttggtgagccttggtcctggcctctctgacctccactaggaccctgccagacgtggtgagggagtggaggatgggggaaccagatcccttcatcccttgcagcagtcggtaatcttgggaccagacttgtgaccaagtgtaggaatagggacaggggctgagaggagaggagtggggaaaaagtccaccatagttcacagtgggagagaactgacttagcaacagtgccatggagatagaggcctggcagtcttaaataaccacaggctcagtagagggcagcccttgtagtagttcagacccctctgggtggtagactagctctgggccccgtccagagagggacatggacagaaagagtgcatccagagaaagacacctgaaagccaggggaccaggaatcagtgctttaaggaaattctgagggagccattggactctggccaaccctgcatggcaccagctgcctcagggggaagtgggcttcccgagactggaggtggttaagcaagggcatttcacaggggattcttaaggtacttgatggttggacatggcacatgcttactgaggtcatgaggaaggagatgtaagaaacgtgtttgtgaaaggaaagaccttaggcagcctggctgcctccaggctggtgatggacagagtcctggcctgggaggcaaaggacccgagttctggttccaccctgtcctgtctgtgtgtctggccttaagcaaggaccctctctgagcctcctcttgcccagtcacctggctgacgaggctgtggctcgatgaggctctgagggaggctgaggctgccctgaatctctgcttcaactccaggcccatccatgtcctgcccccaccccagtctcaattcctggaccctcaggagcccatgtccctctctaggcctgaacgagtgtctgcacaacaatggcgggctgttcccacatctgcactgaccttaagattggctttgagtgcacgtgccctgcgggctaccagctcctggaccagaagacctgtggcggtggagcacccccaccccagcccctcaagcagaggcagttcctcctgctggttctgacctctgctcctccccacagacatcgatgagtgcgaggacccagatgcctgcagccagatctgtgtcaattacaagggctactttaaatgcgagtgccaccctggctacgagatggacacactgaccaagaactgcaaggccgttggtcagtatggacactacaaggtgggggcaggggagcagctctgagcaagtccaggaagcagcgtgcttaatgcgaggagtaggtgtgcacacataccccctcacacactcagataggaagttgcaatatatagcacacacacagtgcaaccgtgcacacaaca

SEQ ID NO: 32297 - DNA, 1471 bp, Bovine  19866881017614
agtgtgtaagcagagtcccttgggggtgctttagtaaggcagccagccatttgtaggatggctgcaccactgcttttccttgcagcctccggattccatgatttctgttccataggcctcacaagctgtagctcacaggcacggagggttccctggagggggtagagagggaagctcagatgggcaggacaccccagaaggacagtaccatccagttcaagcacgctcaggaaaaggccccatagttggtaggtggagtaagacctcttcccaacccagccctgtcatgtaccgtcttgttccccagtacggggagctcctcatgctggctgctggcaccggcctggcccccatggtgcccatcctccagagcatcacagacaatgcagaggacgagaccttcatcaccctggtcggctgcttcaagacctttgagggcatctacctgaaaaccttcctccaggagcaggcccgtttctggaatgtccgcaccttctttgtcctcagccaggtgagcccaggggatgacttccgtccctgatggagactctgctgcccccttgcacccctcccgagggcccgctgtgggctctctcacccgtgccgtaataatcattctcatcactggtggcagccacagcgtgtgcctgtgttatcatgttcgtcatgcagatgaggaagctgacgctcagaggtgaaggcaccagcttgtgtcacgctgccagacggggtgaggccaggatctgagcccaaggctgtctgcttccagagcaccagctctcacccagcatgctttgctgcctgccatccaccctccggcatcctgcgttgtgtgggcaaggggcctggtggtggaagcagtgggccaggcacagacgtcctctggctgtcatggctgattgaggcagggacatatttctaggttaccagtctctcagtgctccacccagtgccaggcacggaggaggcactcaccctgtcaacagctggtggagtaaactagatccgagttcatggcatttgttagagtcttttccacatcccttttctgtgcaagccccagccactctagctagaaatggctttgcttcctgagccctcttccctttggttccctgtcccgccgttcattcaagggacccctccgggccctcccttcagggccacagcttgggggtggggggatgtcttgcctcttacctcaagctaggccttcaggtgtctttgtttgtgtgccttcccctagtctgtagcttcatttctctttcctgcacaccctgggttggggtcccctgctggtgtctcccctccgttctcttgctcagggtcagcctcattgccctgtacttagagtgtccctaaagacttccatgatccttgacattgtgggtgggaggctgtcaggaaaccagagatcttgaggtccccaggagccagagtccacaggcctgtctatcaggaggaatgctca

SEQ ID NO: 32298 - DNA, 2938 bp, Bovine  19866881036813
ccctcccatggggatccctgccctcaggagcccaggcggtccacagggctcatgggagaagaggaactggagacggaacgtccccccatcgggggggctcctgcacccaagatgcatcgtggcattgaaggtctagtctcccaagagacattctctggctttgaagtcagctagacccagattcaaactcctgctctgccgctcaccaacacgggcaagttacctcaccactgtcagattcagccacattcaacgtaaaaagtaattccgtataaactggtgcagctactatggaaaacagtatggaggttccttaaaaaactaaaagtcgatcagcaatcccactgctgggcatacagccagaaaaagctatgatttgaaaagatacacgcacgccaatgttcgtagcagcactatttacaattgccaagacatagaagtaatctaaatgtccatcagcagatgaatggatagagaaaatgtggtctgtatacaatggaatactatttggtcattaaaaagaatgatacaatgccatttgcagcattataggtagacctagagattatcatactgagtcagaaagacatatatctatgatatcacttagatgtggaatttaaatatgacacaagtgaacatacttatgaaacagaatcagactcacagacatagaaaacaaacttatggttatcaaagggaatggggatttaggagggataaattaggtgctcgagattagcagatagaaactactctatataaaataaacaacaaggtcctgctgtataaaacaggaaactacatttaatgtcttataataaaccataatggaaaaaaaccaattcattccatggctcctggcaaggtcctcatgggaactgctgttactgtgcatttaccctgtgccctgcatgttctgagctctatgcattagttcactttacctgcaccaccaccctatgaagcaggcactgttaggatccccactttatagaggagaaaacaagacagagatgtgtacaggagacgcaaatgcagggcacctggaactggccatggcatccagagccgctcaaagtatgaatccttcctctttgaacggatgggggcagggcttggggtccctgagaccaacaggacagcccttgtcccaaggagtccacacaccaaactggtctccacacagccctcaacacaaacctcctgatcccaggcatccagaaccaggagtgctgtggattccgcctgcccaggggaaggctccccagttccccatcgggggtgctagatgctccaatcactgtctcaggccctgtgcagcctctgattccaagaccatggccagggagacccagggcagggaaggcactccggatccctccaaaccacacacgtttaaagcctcttagattttccgattttaatcaagcctagccccgagcaacattctacaataaggagggatttgtttagcttgttctgagaatcatttacctactaaagaaacaaaatcctttgccccaccccccagtctcacttgtgcatttaagaccattcgtggtctttaaaaatccttctccagccacttgttagaaatgcccgctcacaaccaaggctgcaaaatattgggccttctcccaggatcgatgtgccataaggacaccctgtgcaacaactcctttacctgggcccacctgctcactgtcctcagcactacttttaacccattggaacagatctgcggcagaaataaagcagatattaccaatcctatttactgatggagaaatcaaggcacagagaggggaagtaacttgcccaaggacacacagagttagcagccatacacagagtttttaattcagtcgactcaacatcttgcactactcagtcacatcaccctaaacccgggtgagtgggtggactatgatgaagaagggggaggggaaaggatgagaaaagaggagggggggaaagggagagctctttgaggatggagagaaccagaggagcctcctgcttaatgagccattccaactccagcagtgcagggcccctccaagagaggggcttcagagtggggatggaacaggcctgacctgcagtgggacaggtctcaggttagctcctggctctgtgggacctcgtagcccccaaatcttgagcaactcatttccccctatacctcaccccccagaactgcctcatagtgagagatatgacagtagccctgggggagtgctgtcaagtcaaaggagagggtgctctctgtaactttcccatgggaagcacaatcactgttatcattattttatttataaggtctgcagttttccaagggctctcataagcactgtctcttgggaggcagaagagggattctcagcccgattctgcagatgagtaaaaggaggccaggggaggggaatgagcagggggagcttgcactcacacccactccctgcacacacctaatggcactgggaaatgaaggaaggaggctttggctccttggggctttcctaggtccctgctgcctcctgggaagatctgcagattctaacgtggtgtcggccccagttcagaagcttcatatatactgtggcatctgactcgcataacaactatttatcctacgaggatactgaggcccagagggagaaagtgacctgcccaagatgcccagctggccagtgacaaggccagggggtgaatccaactggcagatttcagagccagcctccccacaactccacagatccctgccttaccccttcatcgagatgaaaatcagctgtccagtctccagggagagggcagatgagagtccataaagactcttgcacagagaggaaggcaatgtttccaagagcaagcttttctattgcgggaagtggaaaggggctggcatttgtccttctctcctccttgtcag

SEQ ID NO: 32299 - DNA, 1206 bp, Bovine  19866881096518
ccccaagtatgcaccaggccccacgccaggcagtgagcatgcagtgggtacagcacagacatgtgatgtccctggtgggggtgagggtggacagagaggaacacagtgtcgattccggcagcttctgtccagctcccatctcttcccccagagtcctctaacttcaaactccttccttcctaccctctacacagctaccccaggaggctctgatgtatgaaagagaccctgctgctcttgcctaaatgcgggcctggcattcaaacacccaggccctccacacttccgggcccctctcgactccccacccaaggctcacagcagcaggggtctgccaggtaatgccaagtctttgtttctgtaagacactcagcaaggaatgtcctatctctctcatcacagtctgtccaacccctgtcagcctgcaagatccttcgcccacagacccgaggcgcattccctggtccccgtgtgactggctgccctttcctgcttctcctcactgtccaccttccattcccaaggctcttgccacgggcaggaggaggaggtgccctggcctgcctctgctccctctgtccaggagtgatgctagaggtttaaccacacacgacagtcagaaagtgagcggccccaacatccccacctcagagacggaggcttcctagggtggtcccgcgttgggacaggacacaggccacgtctggtgccaaagcccaggtgtctcctctgtgctcgctgtcttcccaggggcagggggcagggggaggcgattcttaagaagaaatcagaggaggccgggctccctctcttgagccactggttccatcgtctaggccaggacagacgacgtgagacaaggactcagagacaacggccggtctggtgcgggcactcccggcgcctgtcccttaaaggcctggccgcaactgcaggccgcgctctgcttggggctggcccaaggcaaggcgcccgcagctgggttttcgaaagctgttccacttcctatttccagatgttatgccttttccatgcatcaaaaccagaaggaaatcctgttggggagtaaataggccacaagccacgcccccaccccctgcaaggcctgggccaggttcacgcatagtgaggccgagcagctgaagggcaggctgcttctcggcccgagctggtcccctttgttcctctccagcccttgccggggag

SEQ ID NO: 32300 - DNA, 2718 bp, Bovine  19866881145030
attttatgagagacaaggagacacatgagctaaagaaaatggaaaattaaagctctaacctatttctaattgtagaatcccaagacaatgaaaaggaggtgctttgaagagataaccactgtaaaacttctacaaatgaacataaatccgcaggtccaggaagaagaatatatctaggttaaatttaaagaaacacatgctgtgatagccagtctacaagacagccccagtgatcctcacctcttggtgttcataacccacgtgtagttgtctcccaagctgtacccaggttggtctgtgtgatcaacagaatataatggaagcaatggtatgtcacttccaagataagatgataaaagatactgtggtttccatcttggttattctctcttggatcacttactctggagaaagtcaaccatgatgccatgagcagccctataaagatataagcccaggcatagggctgataagaaactgaggccttctataagcaatcctgtaagtgacccattaggagcagatcttcaagccctgctcaagctttcagatgattacagccccagtcaacagcttgattgtaacctcttaacagaccatgagtcagaagtactcagataaacagctcccagattcttgaccctcagaaaacctgtgtgagacgacaaatactttagctgctaaacatgggggtaatttttacacagagacaggtaactaatacacatgctaagacaacattttcgggtttttttcccactgtgcaacccacttcagtgcctgcagcctacagacagaggccaggcaatggtttggggccagtttgctctgtcatgggatgctatgagaggcctgggggacagcctgccataaacccaaactcatgcctaagaccaaacagtttcaaatgacttacaaagagtcttttccatctgatccagactctctaactgattacatttcaaatataccagactgcttttagtctctgcaatgcaccatgctctctctgtacagctcacatgacatagtcctgcatgacacattctttaacatcttctctactctcaacacacgtactccttgatctaacttctcctcatcatcagagcactcacagaaatctcatgggacagggacaggaaggactctaaaggtgggagaatgtaaacattctcaggcaatgatacaaatgaatcttcaggctagcacctaacataactacaaaggaaccgaggaacccttatattccacacaaccttaggcaaggcccgggataaggtcaagactcaaatgttggatggtttccaggtcctcctaagtcatacccccttgctgtggtttcattatgatccttgaattgaaattcctgaacatcagacacgcccattcttgaaagcatactcgtaattgtacttagcatacttgcaactgtactcaaaggacaaacagaaatgatttttaaaactgtcatctgttctgtagtgtaggataattccagtctattatgtcgatatttaagatctgattgtaagtgtatttgcggtgtgcctaaatatgaacatatatatacacatatgtacatgtacacatcataaaatattaaccactagtaccctctactggtggaaataccttatctgctcatatgaatggtcttattgccctctagtgaccacaacctataaagagaaaatccagcagcagatgggagaatctccttggctataatgatagggttttatgttctttaagcatctaattttctcagattctggtttatattacaggggtgcaactctcaagactcttgggggaacctctgggggatttcacacagctcttgccagctgttagcgccagtctgaagctactctctctcctgcttctcatgaacaagaggtcaaggggaggcagagaaggcaatggctgcacgggtgagggcaagcacagcagctgtgaatgactaccctggactccctggggacttgggagcagcttgaggaacacatgttggccctccctcgcatattattcacagttgtgtactgtactagaacggtaattcgatgtagttcctgacttacctcttaagataactccaatgctgtaataagtgatgtaagatgctatcattttgcttttacaaaccatgctttggaagttacttctacttaagacagaaaagccaagatttaagtgacctgttgcctcttctacggagttttttctgaattccccagatgtaagactactctgttctctgtgccagcatacaccttgcacagatcagaatggtaccacagacattattcatatattttaatttttaatctaaactattttactacttacacttgtctacttgctggtttctccaccaaaccctaaattccttgacgtcacaatcatgtcttcttcatttttgcacacccagcatcaagcacactcaaaacattacccacagatcatgcaataagtacagaaacctgaagtaagcatttagaaacttttatagtagtctgacaaagtacttccacatctgttgaatctaatttttttagaaatagggcttgcactctgcatattttaatttcatttaattgttaattttattatactataaaagtattagtctacaatcaatgggagaattttttaaacaatggtctctcaccacagatagtttggagaagtactgatatgatagataactat

SEQ ID NO: 32301 - DNA, 1402 bp, Bovine  19866881257306
ctctggaacttgtgatttcattattaagggaaaccactagagataggcatgcagacaagcatcaggagacccatacaaaaatgttcacagtgatgccatttacaatggcaaaaacctggaaaccaagctaatgtccttagaagaaaaaatgaattaataaattatgtcatctgcatataatgaaatcctgtatggcagtggaaatgaagcagataacaactgcagtcagctctagaagggaatcttaggagcataatggaagcttagaaacataagctgagggagaacagcgtattcagaagacttcagaccacacaatccaacatttagagggctcaaaacaggcaaaaacaaactgtattgtttaggttttcatacatatgtgatacaagctttactgaggaaatgactcaacaaaatccgagataatggttacttctataaggaaggcagattggaaatgggataaggaagaggcccacagtgttaatcatgttctcacgtttaagttgggttcaaaggtgttcattacgatcccttattcccagggttgccatacatccggtgtttccaggatagtccgggtttatacctgttgtctcatataatttcactgcaattcctttctttctcagaaagttctggtttggataataatgtatatgactactctatttgtttcttataaagtacaacatgcatctctcttgtatataacttttattatatcatatatgtaatgtataatgccagggccacagcctggccacgatctaaggggttttttgtggtttggccctggtatccttctgaaccagcctgggtatctgtcctcagggcctcagatgacccctgcagccatttggattccccagtgcctgagtccttataccccaccccacccagggtcccactccccaactcccatccacttgtgactctgtgtaggaccatcctccagtgtccctgaaacctcgcctgcaatcaagggtcactgacatccccttggtgctaggccctgtgctgggcaacactgggctcccaatccaggccctgccctagaagacctgtcaaggttcagatggagatggagatgtgataacccaggggaccagaggagagacacggctccgggctacatatggcactgcaagaaacgtgggccaacctggagaccctgggatggctgcctggagctgatcgagctcacgggaaaggtggggagagagctccaagcagacagaaagaatgcagagagccatgctgtgggaatgagcgggctgggctcggggaaggcaattcacatccttcactctaagtagagcagagggcacaggacaacggggcagtgcagcggcgggaagcagggcttggaaagggcacctcctgggggcccctgaat

SEQ ID NO: 32302 - DNA, 916 bp, Bovine  19866881280758
aaatgatatttctaaattatgtttttaatatatgtatatctgtatgtctagctttcctgccataaagaaatataacatgttttcagaaaataatagtaaaatttggtcttctgaaagagatgctgtgtgttgaaagaactctgcccctttgcaaggctggtaatccacatacacgtaattgttagtcttcagatatgaatcgtgagctgctgacagggtgattgtccgtttttaagaggatggatggaaacctggcaaagaaccatggtcttttcatctctaatactgcttgaattctggctgtagttacatcttactcccagatatgaggatttgttggtgtaatcattgtctcataccttaatgtctcccctgacccttaccaagaatatgaagctttttgattgtgctaaatcagtatcattcatcttatttatctgtgtggtgttttgaaagttttgctttttcaggtcattacctatgtctgataagtgctgttaccaatatttttagcaaccatttagtgtaccaagcgttgtgctaagtacatacaatgtatcatttagaatcactttgtgagtttcttacttatataaattaaggattttttgtttttgtttttggctgcaagtaacacaaaatctattacacaacaagataaaccatcaagacacggatttttaacaagaaatctggagacaagtggaccaaggttggttcagcattatcggtgttgtccccagggactcaggctcttccagctggtccttctcctctgccgtctgttgcgtgtcttgatgtttccccttgtgttcaagagatggttgccacaacatcaaacatcacgtctcagccacagcatcaggatcaggaagcaaggcaggcaaaagcagatgggctctcttcacatgtctct

SEQ ID NO: 32303 - DNA, 3098 bp, Bovine  19866881325899
aaatagaatgtgtaacttccaagacatgagaggaaaaacaagattaaggagaactcgggctgttaaataaaatataagaaaggaagaaaaaaggcgaagagaaagtatgtccagtatatcaggaatgatgataaatgcaaatggattaaccatgcctattaaaaaatagaaattttcagattggatggggaaggaggagcaaaataaagcagccataagttactaaagcatgacccagaaaagttgaaagtgaaggatagaagacatacgaatatataataggcaggagttcactaaagcagtgtttataataggaaaaatatgagggggagaaaatgctaaatatgcattaggggaatagattttaatacgctgagacattgtatataaaaataatggaataatattcaatactatcaaaatggatcaactgggtttatacacatcagtatgggtgagtcaaactatattgagtgagaagtgcaagttgcataatatatttatatctacttcctactgaaaatatcccttgctgctgctaagtcgcttcagttgtgtccaactctgtgcgaccccatagacagcagcccaccaggctccaccatccatgggattctccaggcaagaacactggagtgggttgccatttctttctgcaatgaatgaaagtgaaaaatgaaagtgaagtcgctcagtcatgtctgactctttagcgaccccatggactcctaccaggctcctctgtccatggcattctccaggcaagagtactggagtgggtcttcagtattttgccttctccgaaaatatcccttacctagcttcattcatttgtctttcatgccatttaacaccaatgttattttatattgtaacaggccatagaaaagtcctgtgtctcaattttggttagggttcctaaggactgaaaacaaagtgtgtgtgtgtgcatgccaagtcgcttcagtcgtgtctgactctgcgaccccatggaatgtagtctgccgagctcctatgtccacgggattctccaggcaagaatactggagtggattgccataccctcctccaggggatcttccccacccagggattgaacccatgtctcttaggtctcctgcactagcagatgggttctttactactagcgtcacctgggaagccttgagaacaaagcattaggtataaagtggtgttcccaaaagttattctaaaccatctgtgcagaacttgtgaaggcaggatgtgaagaccggttttggaatcctgaacctatcacctatcttaggtaataaggaaagttgaaggtaaagaaaggaatgaaaattcctttggataaaatgggatggctgtggtattttcttttggagaacttgacctcagttcctggcgttggtagacaagagaccagacctgtgcctgggaaagtctaaaaccagaaggtttttactgatgccactgaaagggaagtggttgcatttggaaggctgttatgctcagagtttttcagggcaaagatgcgggcatagcagagataatactggttaacctggagttgaattaaaggggcttggttcacaaggatccttggaagggtaatgggaccccttcagagaatgtatgaagctggttgccagaagctggagacttaggggtagacctgtatgtggctggctggaagagaccttgccagtgctgtgggaataccacaggtgagagctcaaccctgggagctgccatgggaccacagaaacagctcacgagagagagtcagcttttgactatctgccaagtctagagagtactgaaacctggtgagcacagcatcgcaaccaaaagtaaggcttttcctgtctgttactgtacctccttttcccagtttcaaacctggaaggatcagagactaaagcaaacaagcagctggggaaggaggagaagcaaagatggggaaatagagaagtccccagacaaccccttctcccagcacaggcagctaggctagaccctgcccagggcggtaaatgaagactttttggggtttctttttattaaactatcacaggcatgtagcaaagtagacaaatcatgagtgtacatcttaaagattttcacaacacatttgtgtcaccagtatccagatcaagaaacaggacatgaaccagaagcccctgtgccccttcccagaccctaaccggcccaccaccccaaggtataatgatacaaaacaagaaacaaaacttttttgttattataaaagcaactttattttttgtctcccagtttattttaaaaaattattagtgaaaataattttaagtgcaacatagtacaaagacattcctcatccctttcacctggattgcttgttaatattttacagttaatggaaagattcatgtcaactttaagatggtagttttttctagatatggaaggaagggattaaagggtaaagggtgtaaggagacttgaactatacagtgttttattgttttatgtgaaatggcaaaatgtaactctttcattataagtggtcgagttactctaactttttgtgtttgaagttttaaaaattcttcatacaagagaaggtttgagttttaccatctgggaagtaggaagctgttgaagtgtgctttttattgttgaaataactatgtctttatgaattctctgctctctgtcctcccctatggattgagacacttaagtgagctatagggttggttcacctcagcatcgtttttcttttcttctcttcctttttgcctctcagtgctaagtgccccgtggtgtccgacatggtaagattaaaacttgcacttttcctaatagatgtaactctcttcctgatttgcagtaagcaggggctgcttttaagcaattacccatcatttggggccatcaatatactgtgctttggttcaggtcataatcaataattcatatgtcagtaggagccccattagctcaggtgaaggcagatgtctttctaatgaaaatgttccattttccaaatgacttttctttttcccagagagttgtggttatagaagacataaaaagatggaaaactatgttggagcttcctgatcaaa

SEQ ID NO: 32304 - DNA, 821 bp, Bovine  19866881365532
taggcactcaacaaacactgtctttcaccatctcagaagctgtcaactcaattcagccaactctccccagaaaggccttccactttctgccctctcacacagaaacctcctgagaccccaccgccacctccctccctcccgcctccctcccaggtcctgcctgtccccagcagctcctacctttcatggcttgggctctgaggtctgggcccagcagcgccactgccagcagcagacagaataccagctccaccagcatctcctcatcaggtccccacaggtctgcagagctcagggcaggccaggacttgagggtctgaagtgggggaaagagaggtgaggctgcaagggcctccaagttaatggtggtgtgaataattcatcaggccctcgaattagtaagctgatcccctgcgcttccttcactccaccctaaggtgacggatctagtgtcaccgggttgacacttctgagctctgcactggccacactgggtggggagagggctgggagagaatctggcggtggagaaagagcaggggtttgggggctaggcagatctggaatcgtcctgggttggcctccaccttgccaggtgaccttgaacaaagtcatccaacccctctaggtctcgatctgactcctctatctggtggggccactcagccctgcctatagggttactgtggaaatgaaatgtggtaacacatgctaaaaaacacagtcggcgcttgctacaggtttccccatcgcctatccatgtgggaggggacaaggacccctgagacatgcatagatgagctcagagggagagcgaaggg

SEQ ID NO: 32305 - DNA, 1370 bp, Bovine  19866881738705
tgtcttagctcttgtacctcattttaccttaccctcataaaggaacctggcttggtattcgtacttcacaggggctaagagagatgaagttgctggactaagaccacacagtttttaaagggtggtgccaggatcaaaccttgataggcccaagcccagcacccactacctccactccttgatggctcactctttcttagccaggactccctagaacagaaagctggagcctgcgccgggggaggcagcctgtcaacaggaggtggctggtgctggccgaagagtggtgtttgttcttttctggtttattggttcttcttttcagaaagaagcaggtgctgtagcaacctcccaaacagcattccataagctagtccaggaagccgcagagcccagggtgatcagccaggcccctcccttggttcacatcaacagaacaggggatttaatgtcacagcctgcagagagaactcaggcagccagcgtcaatatttgccatgtcccagcctccctggccccagctccaagatcagtacattaagtacaacaggttcttctctgtgcaaatacacagggatagataaatggaatttaaaatggctcaggcttcgccacagggtctggactggaaatctggcctggtttaaccttctgccatcactgtttgcctggggctctccattcatccttaaattcaccaaaccacatacatcagagctggtaagaagctcagagtccagccagatttctggtaggaagacactgcttcctggagaagtagagagggaggggaccagcccaaactggaactgcctggtagccatctctgggattctgagggccacccagcaattccaggccaggcagaagcgatttctcttcgaaaaagagcgatttctcttctaaaaaaaaaagcagtttctcttttttaaaaaagttatttaaaaaacacacatttatagttatatttacatttagtgaaatacacagatcttgagtgtatagttcagtgaggttttttttttaattgggcttcgttgggtcagttgtggcatggaggatctttcatcatggctcatggactctctgattgcagcacgagtctcagtagttgtggtgtacaggtttagttgcttcgtggcttgtgggaacttagttccctgaccagggaacaaacctgtgtcccctgcattgcaaggtggattcttaacaactggaccatcgggggagtccctcagtgagttcttttaaaaaaaaaaaaaacaggtttattgaagtatgattgacaaacagtaagctatacatatttaaaatgtactctttcataagttttggcacacatatatacccatgaaactatcacataattt

SEQ ID NO: 32306 - DNA, 1727 bp, Bovine  19866881807454
ctagagcaggcctgggcaggcttcgtgttacccccaggtgcccctctcatccacaatgccgcctcagagactctgtttctcatctgcagcatgggctcactggggactggatgaaatgatgttggaaagtgaccagcccgagaaggtgctcaagagatgttactggtcctgactgctctccccgggacaagccctgggctagtacctgggagaacaggcttccaaatgggatctgttgctgacctttctggatgaccttaggccagtctttttcctgcccagacctgagtcctcccatggtggaaacgatgcagctgtaggacctctgaccctctgtcccagggcagccattgttaaccagtcccagccctctttcctgctaagcctcagaagccttctcaacacagagctccagccccaggcagctggcgtttgagacacaaaccttcatccctagattgggtcaactctagggcctcttccctactagggtccctctattttagcaactctgaccctatgagctgcagccatggcagaagggacccctagttggaggcaggtgggtatggtccctcctccatggacccatcctcctggggtgtcctcatcctgtggatctgtctgagcacagaccctgtgtagggctacctagagaaagggaaaataccttcttttcccaaggctatttggtaagtgctttgatggagttttaaatatgctacaactttaaggctgagggggaagaattttaaaaaactagaaaataaaaaatgtttaaaatagttggggtaattcaagaaatcccagaggacgggaaaagctttctgctctgatactgtggtttcttcgggggtggggaaaggggcagagcacaggaattgtcagctggaatccacaggctacactgccctttgctgggctgggttcccaagaagccaggaattcctgccggggcctgagacctgccccgtggctgctggcaggggcaggcacgctgcctcagctgcactggaggctctgagcatctagatagatgggtggcagggtcccaggggtctagggggggccctatcttatgatgagctggaagcaattacagccaagctgcccatcctctcagagcttcggttttctcttctgaagtaaggagtcgtggtggggagtacatgggactttaagttggggcccaggcatgaaccctgaggtgggtcctgaagaaagtgcaggacctgtcatagtgaaggtgcagggagtggaggctggcaaggtgtgtacagtggttcccaggcaagagggagcctggtgtgttcagggaaccgcatccaatgtgccaaggttggggcaggaggccattaggaatgcctaggccccaggaggcctgggcggagcctgggcttcatcccacaggcaatggtgagtcaaagaggagtgggtatgaaggaacgtacacctggggagataagctgcctgggcaatgaagttcaagggagtgggcacctccagcaggttgtgcccacatggcccctgttgctcatggagcacggctgtctgcctgcagggctgggtgcagaaagggcccccccggccctgcctccccgcttgcctacctgggagcagttcctggcctagggcgcggccacccttcccgtcgctggcagccagctgtgttggacgtgtggagctgctgcagggccagacactcggtcaggatgtcagcctcagcg

SEQ ID NO: 32307 - DNA, 1552 bp, Bovine  19866880472492
tattcattcattcacccagccaacaccattaagcatctactgtgtgccagatatggagtttagaaatgggggtgtaagtcaaattagtcatgatccctgcactcagggccccagattcaaggcatacggatgggtgaggcagatccacaaatcagagtacagtgtattttcttaaatgcaacagacctcagttcatagttaagccttgttaaccacaagtgtgtgatcttgggcgagttacataaattctcagtctcattttctgtaggtgtaaaatatgtattttaaggggacgtacctcttggggcagttgagaggatgaaatgaaatctatgcatctgtgtgtacctctgtatctagcactgtgtaccacagatgttaactgtctgtgtccatcttctgtgtgcaccatcgggttgatactgcctcctcttaaagtactgggtagctcagacaaccagtgtttggggcccatcttcccttctcttcccctgaccaccccatttgtgggactgtccaacctggagttgtggttcagctcctgagagatgtcatctaccatgtcgttctcagaagcctcgtgggccatggctttgcagagcttacaggccaccagggccttggccatggcctcctcgccatgctgccagaagaacagggccatcttctgccgcttcatcaggacggcccacaccatcagttcatgaaaagggaaagggaagtggttgatctcagggtcatccaagtcaatgtccacctcttcttcacgcttcttggttgtctttcttcctcgcctcaagggaacatcatcctgtaattttagggaaaaagcatagagatgaagttagaaatgaatccaatcaattcagtaaatagttcctgtgtatctgctactagcccagccctgggatagatacagaaagaaatgaactatcctagcttctattctaaaagaactcacaagttcatgcatgcctaactttaaaacaagctataataaatgcagaagcacagtcctatgagaacatgtcagtgttaagactttaattttaaacaagtctttctcaatggactttttaaaaaacaaaacaaaactttcatctattcgtttcctctacaggtagggtcatttgtacctcgtgatggacagcattaccctttctgctgaaagcacaaggacatcctatacttgcaactggatatagggtaataaccacatgaacagaagatgggagacagatactctgtctcgagtttctgcatacttcattagatgcatttgtgaagaatttctggcctttgggtctgttgccatttgtaagcacccatgagtagatttcacttactggaacctatatgctttcttggttttcaagttagtatttcaaatatgatttatttttgtttgcaatgctaatataacctcatgatagaattttcaaagctactgtgactacccccttgtcaccgggaaaaatgtcacttccttattttagaatcatgtactaagtcctaccactggaatgaacatatatatatttaaaacatgtaa

SEQ ID NO: 32308 - DNA, 367 bp, Bovine  19866880478276
aaccagatccaaaacatttttaaatatttggggcagccagtgattctctcctgagtagaccacaggatccagctttacaaaatcacagtccttgaagcaaaggaatggagtctgtggcatgccctttttaatattctgaacaagggctttataaataaaatgccactgtgaattgagtggttgcagtgcggctccaggaaagccagttgctgacaagtactgcaaagtcaaggatgccacctgaggaacatagcgttcagcagccagaggaactgtgtacggcgtatgcggttctatcatacagcgagaacttgaatatacaggacggggactaaaagacgagattcttttcagtgaatttaagatt

SEQ ID NO: 32309 - DNA, 2052 bp, Bovine  19866880506131
aaaatctgtttaagaaagcatgttattcattttagcatcccgcagcatttcgtattatccagcagtaacacacacacacacacacacacacacacacgggctctgtatcactatgagaagccccctgcaccacgccccaggaggcccagcactgtgtttcactaccaagcacatgagagatccagaacctcattgtttcccgggaccaagtttctgacacctgatttgtgcttcctaaatcttctcccatctcttccctcaatcccaaaatggtttatgtacaagcttctgagtacaaccttccttgaagaaagtgtaccaacatgacgggctaagagaggccataaagggcaagtaaaaatgatcctcaagtaaggaggcaaggacagcctgtgcttcagtgcccagggacttgagagcagctaagggaaaggggagagtggtgaccctgcctcagggtgcctggcaggcctgggaaggctcagatggcaggcctggcagccttcagggcacatgacaccctgtcctcagagctgagagccagttttggcattgtttgtagtgtggtgctggaatgcccatgacccacttcatggaacccttctgtgactctgggccaagatcccacagacagggtgggtgggggagaggtgctggttctatcagggtggtgtcagcagattgctctggtttggtggcccttttgttttgggctgacctcagagtcacctagatcaggttgttctaggtaaatataagcctggctggtttcagttgcaacagctacaaactaaacaaataaagcattttaaacattctttcaatctcctcctttccccattttgtcttttaaaaaactctttcagtttaatgttttccttgtaaaacacagaagaaaacataaaaaaatcgaaagccattgattatcctatttcttatattttcaacccagggataagcactacaaaaagcttactgtgtatcctttttgtttttttaaaatatgaagttatatggatagaactatacctgtacatgcactttaaaaaacaacaaaatatggtctcaggctacatattggtctgcaacttgtttttcttcactgaagaatagatcaggattatctggcagcatctttacatataaatctatctcatttttatttcattaaaaaaatgtcttaagtttagctgataggagccagtgtctctttatgacatggtgccaagggagggccaaggtgttcaggcttgcatggaggtaaaaggttgtccaggtaagtgtctcctggtgtagcatggcttgtgacagagtaaatggtaccttctatggtaccggtgtgtgattgtcacctgtgggtattctgagaaatattactgtctatgcatactatctctagaggctctttttttttgtttttttcctcttggtctggccacacggcaggtgggatcttagttttccaacaagggatcaaaccggtgccccctgcagtggaagcatggagtcctaaccactggactggcaggaagtcctacctagatgttctgatttagcagaatttggggttggccctcatttccatactttacaaaagcccaattatacagaagattctgatgcataggtggggcttagaagtcccctcctgagttaagaggacacctactaccactgcagatttggcttggaaaactcccaccaacccctgggcctcatagctgacagagccttctgggagcactgaccttgaggcctgagttcttgcgcatccggagccgacccatccacatgtctgtgagcaacatctggctgcacgtgtgcgcgatgaagtcacggtgcttggcagctaccgcaagctgcaggcacgtggcattgctccagttcttcagttcatacgtcagcagtttcatggccagctgctcatcctgcttgtaggactggtccaggagctccacggccagctggccaaagtccctgaaagagagagcataagggagctgtcttttggcgatcttggagacttagatgatgaaagtggcaacccgatgg

SEQ ID NO: 32310 - DNA, 2812 bp, Bovine  19866880514307
tttataaactatatattaacatgtctctctgtgtaaatgcatataagcagcatatactacagaactctttatatgtttatttgctttctattttagtctaccgcatcttttttatagctctgtgtataagaaaaatattcatggtatgcctgctactgatggcttgggttgataccaaactcccagtcaattctaaggttatttatggttttgaaacttccctaaaaagtgctttggaacatttccataaaaaagataccagcccttgaaaaattccaattaaatttatgctgagctcagattaaatggcaaaactctaggtatgaaaatatccacatgtaaccagatattcatatacaaaatggtcatgtgataggtggtgtggaaaattggcagttacatcctggagatgttcagaagacatggtggattcatacacataatgagggtcacacaagcagcatcacacataacatagatggtgggaatatagcagtatctcatatggcagttttaggtgagttctgcctactattttttttttagttcactattatattcagtgagtggcttcattgatgataggtgagatacaaaataaattaaaaaatataaaattatttaattacattcatcctgagcttacttgactatacttgaatgcccactgtatataataaaccacttgacaattgtttttaacatcaactcttctttcattttgattgcaatacaaaaaggcatttcttttccctttattttcttcaaaagagataaaagttgcggcaccagaaatgaatatataagagacaggtgaactatgactgttaccttgttttttctttataatgatcaattacagaagtgttggcatgagaaggatgtgggacgttaggtagaactgcttgctgccggcttatactgaataaaaaggatgctcttcatcagtcaccagtgatggagccaatgtgaaaagaaaacagaattgaagtttagaatatctcatttatatgctggctactttattttattttgcaatttagccctgcatcctaaaactcttgataatggtcagaaatggaaagatgccgcctggcatggagcatgcttgatgccccaatcattcccagagctcatggctttctgaaatgactagttatacacattcatctcaacccttcttctcctctttcccctccctacccatcaagtgtgaacatgacttaaatcccctgcattttgcactgggccagatcaaatgttttcttgatctgtgacccagaagtcaccttttagttaacaactcccaaggaatgacttgttttgctcagctaagaataaagcaggtgagtttcaagaaacaggaataggtgaatttcagggagaatttgagggctggattcttgagcctcctgcaaagcttattagaaggtttagttgtgcttgctttcaaagctgtgaaaagcagacattctggagagtctcctcatggacagactgtcccctcggccctctggcttagaggacttactcctctggaagggatttctcaggcttgctgtgttccgctgcctgtcgagtttgtcactgatggagaagctcttcctggtgtgggcatatggtgtgcttggctcctctgctgagtagctgttggcacgctctatcttgggaactgtgatgttgttcgacagggttctgtctgaattatcaccctcctgggggggcattgtgatggtggctctccggcccttggcctcattctcctcaccatcagagctggggtgactcagttctgcctctcgctcgggatggcagcacaacgattcctccactttccctccaagacctcccaggaatgtggttctgtcagcaatcacttgaggagcattgacacatctcgtgtcaatacagtctgtaatacttgtatattctgctgttttcacgggcaccccaaagttggcataacagctcctcgaaggagaaaacataaagctatgtgatttcacgatggaggcttcttctagaagaaagggggtggtggctaggtagcggctacttttggaacgctcaatggtgtggtacattggagggtcagtgtcccatggattttggcattctgggatgtgggtatagtctgaagaaaaagatctagtgtccatggaagtgatgtcctcaaaatcagtgctccggcttggcagtctgtctgtgggtgcaagagttgcataggcactacttgaaggagctgcggaaggtactggagccgaaaagcttggttctcccagcccaaggatgttcatggaattgtccagtgggtctatatcacagtggagctcatccatggcagagacatagatgtctatacatgaggatggtcttctggagtcgggaacaatggccaaggtgtttgcaggggctgcaggagctttggattcttttgctacagagtgggaactagtagctcggtgtaggctcagggacctttctttaaaaagactctccaacttttctatcccacctttgtctttcatattgactgaatagaaagaatggcttcgcatacggggcattaaggttggagaagttggggacaaggtctcctcacctgcagggtctatactctcttggagcttgaaggtgttcccctcctggctgttgaagctgctctggcggacaatgtaggctgcatctgtgcagtccgaggaggtccgcgagcggattttgttggactcagcccgctctagacctgtcaggcgctccagggctgtggccatgcgcccgatgaggtcttcgagctgcgccagccggatgtcca

SEQ ID NO: 32311 - DNA, 1764 bp, Bovine  19866880541050
aaaagttatttattaatggacatattagccatgtagttcccataaaattgtgccatatggacactttgtccattactcaggcatatttgcaaagcatgtgtccaggatcctttgcaatggctttttgtattcagaaaaccgcagacctgggagaaaagaaagatagggggaggagtattaagatgcagagaagtccttgtctctctggggaactagcatgagaggtgcagacaccagggcgtgcaaactgtggcctgtcataaagcccctttgaatgggaacatggaggagctagagcacctccacctgaggctctcaccccacatttacagatgcttccaggagacttcttccccgaggccctcttcctctctggggagttaccgagccccacccttcaggaaggtgaccaagatgaacaattcccagaaatcaggacagagtgcagggcagccctccctgtgacctaggccttagctgaccttctggagtaacagggcccagagggccagggtgagttcacagctaagcccaggtgccagagaagtgaatctaagcccaggcctcattctgcttctgtagcttctgtctgtgtttatttgaagttctgcttttggtggtgatggtagtagttttgcatctgcaaatgtaccaaaaacaatgtctttaaacactagaattatactcagtacaatagaaacaccatgaggtgcatcagggaacggagatcaaccaagggagggaggggatccatattacccatttcacacattctccaggacatgtcctttctaagtggagtggcaggtgaaatcacctgtcctgttttacatgagctagctggctagctaggtaaatagatagatgggtagagagatgatagataagtatgtataaactcacatttgaatacatatgttaaatttatataagttaacttcatatattatatattttatacttttctcctcatattagataacctcaatacagagatttgaaatcagaaaacttaagagctggttctttgctctgtttctccccttgctactacctttaaaatacagttaatttattcaagttctatttgcatgaatctctttagaagtaaaagtgtacttctataattgtctatttaaatggataattattaaattatgtttttgtcaccaaatagtatgtataggaaggacccaatacaatattcaggagatcattaacaccttggaggaactgattctgagaaactcttgtctttgccatttttatatagcaatgaccatgatgtatctaaagcaatacaattccaaaatatagtgagctaattgattgtaaccaatgccgttacttatttgggacaatatctagctagtgataattatattaaaatagccaaaattttaagctgttaagcaacattggtaactaccttcttttctgaggattttttaccctggcttacaataaccaatccttggagtttgtgccatcaaattctgtgctcatcatcctttaactagtgggttctgtttcaatacatgtatactggggcttttactgtgtaccaggcaataaggcagagctctgtcctcaaaaagcacagtctcactgagttctagtgtacacccaaggcaggaacagccagaaacatctaactcacagttgtcaaaccttagaaggccgtaaaatcatctggaaagcttgttacaagacaggtttctgggcatccacctacatccttgggttcttttatatatatatata

SEQ ID NO: 32312 - DNA, 809 bp, Bovine  19866880677657
tgaattcttgtacttctagaggtagaattccatgggttctgttgctaaatgatttaaccaaagccacaattttagtcagttgtgaaattggactagaaagtataagatgcttagtgtctttagctctcctaaccactgaggcccacaatccactaagttgcacatcatttctcagtttttacaaagtgacaaactacataccagtgacagacagatccttcaaaagttaatgacctcagggaactgggatttcattacaaatggttagcaatagaaaacagattttgggttgttgtcagaattaaacacctgcagatgagtggttggatctatcaagtggctaatcagaagagtctcttctgttgttaatcatgtgtaacatttatgtacactttatattgcaaaaatctctagactcacccacacaggttacctgtcaagtagacatttgcccgggtatatctcatgtcttgactcttccagaaaatcaattggttatgagtggtatatctcatttatctctgtagctttagcattcatcacaatgtctggcactaaatagataccactaaaacgaagatcatggcatctggtcccatcacttcatgggaaatagatggggaaacagtgtcagactttatttttctgggctccaaaatcactgcagatggtgactgcagccatgaaattaaaagacacttaatccttggaagaaaagttatgaccaacctagatagcatattcaaaagcagagacattactttgccaacaaaggttcatctagtcaaggctatggtttttccagtggt

SEQ ID NO: 32313 - DNA, 2147 bp, Bovine  19866880835250
gtaaaaaaaaatcagaattcaaaaatcaattggaaatatgttgatcaatagaagaaaaatatggatcaattgtgccaccacctggagccattaaaaatgattaaatgtttgtatattgtcactggcttcccccatggcacaatggtaaagaatttgcctgccactgcaggagatgaggaccctcagcttcaatccctgggtcagaaagatcctctggaggagggcatggaaacccactccagtattcttgtctggaaaattccatggacagagaagcctggcaggctacagtccatggggtcacaaagagtcagagcatgcactcgcattttgacattaaaaaatgtcactggtatattgtctttttaaaaggaaatacaaagcatcatatagggtgtaatcccaatgtttataaaaactaaaccaagtatacagatatagatatatatatacagtatatatactatatatactgtatacagatatacagatacagtatataaatagtaaaaagactagaagaatacagaaaaagggagagaaaggaataagttttgcaacagaatttttttcagaaattcaaatactgttgaagagtaacctaaagtggcctaagtaaagttggttcaagtaccagtagacatcaaccaagagggttttctttgacttctttctgtcctgggtgctgcaataatcacaaactctgtaatagcaagtcctctccactaaaaaatgataaaggtggaagaaaagaaaaatgttagcaatgatttaactattagtgtcatgaaactgtaattttaggcacaaatacaatcagtgcctttctagcaggtactttgttcctctggaagaactgaaaattttattaaaaaggcaagactgtcatgacttaaaagataattacatactccagttatttaattagagctgctgagaaaaatggaatgagcagcccaagtttagctcatcaacactagaagtgttcatgtagcagcagcatggccaccaggaaggcagtgtgtggatggttttacattcaggcaggaaacagggctgtgttatgtactctgagaatctgcatagaacagcacagagatgctcttaaaagtaagaggtcagaaagagtattgtagctaggcagggcttcaaggaatgttcaggactgaaaagacaggaggtgaggggaaggctgaggtccaaggcaaaacaaacatgtagccatgagaacacataagacactgggagaactctgggaagccaacctaaaagggtagagggtccacgctggagacttgtgcgaaagaagaactatccctaatactcacttaatcttctcaacacatctgtgaaattgacattcttcttcttccccagacaggaaaagatgactcagcattttatacataaatgccaggtttgagtttgaattccattctgtattaaaaagaaagcgactgaagaattctggggaaaactgtgatgtgtaaaaacatggtatggtcaagaagggagaggagcagtcaggggaactgcaggattaggcaaaaggagattaaacccccttgatgaaaagacattctgaagaaatttcacaactccctaattccagaaatatttcatgggtactgtttgagaaacactcaaccaagtgttggcgcattctgtttgaaatgtcatcctcttacttcattccctggtgaacaactagtcatcctttctagaggattattttctagtgtgtgcccagctgagaaccctttgagatacctccttgctggcagttgttttgtacaatgtggacaagctgtacccttcctctcaggcacaattttggctacatctttgagaatttggaatagaggcaggggtagggacaatcgctgcctataaccataatttgcagactcagaaattgtctacagtcatcttcctacatgggcttccctgtagctcagctggtaaagaatccacctgcaatgcaggagaacctggttcgattcctgggttaggatgatcttctagagagaagagataggccacccactccagtattcttgggcttccctggtggctcagctggcaaagaatctgcctgcaatgtgggagacctggggtttgatccctgggttggggaagatcccctg

SEQ ID NO: 32314 - DNA, 1066 bp, Bovine  19866881050870
actttgccctctccctgtaactcccagggtgctggggtaagttaaagtgttgatgaccatacctcacaggggaggcatagagtgagaaggtgggaaagttggttagtagaggaagccagtagccaaaagattggaagctaaatgtgatcttaagcaagtctcatgtggatccaatggccagtttcctatatgaaacatggaaagttaaaaaaaataaaagtcacctccctgaagttatcacagtgctaagaaaatgcctaagtggtttttatattaaaggctacaaaaatcagctgggggtatattttaacttgttgaatcaactgctagctaaattatgggtctatctatttctgaccacaggtgatcagcttgattatggatttttaacatataacggtcataataaattacctaggggatatagcatctgccatttgccatcattctgtcctttactatagggtgagttgccaggcacatgatgggcaaacattggttgaattcagctgaattaaggaatttcatctatttacactgagtcaatagacactgctgttttcaagtaaaaaattaccctaacatcagcacttatgtatgttcaatctaacataataaagagaagtactgaaaacaaatgtccataagagacatgaagagaaaagaaagtgaaagaaaagtgaaagtgttagtctctcagtcatgtcctactctgcaaccccatggactgtagcctgccaggcttctctctctgtccatggaattctccaggcaagaatagtggagtgggcagccattcccttctcaaggagatcttcctgacccagggatcaaccctaggtctccctcattgtaggcagattctttactatctgtgccaccagggaagtccatgagaaacaaattagttttcaagtgacacctcaagttatcatcattggtgaatgaataacttcttttgttcaatttggtgtcacgttgtattttttcactctatcttgtcagtatagttagaaaaatgggcagttccataaaaatgagatgttttgtaaggtacacaaagcag

SEQ ID NO: 32315 - DNA, 1337 bp, Bovine  19866881087173
aataaaatttaaaattcaatttcttagtcactctagccacaattcaatggctcagtgcctatctgattggacagcagagataataggacatttccatcatcacagaaagttctattggacagcgtactcttgaggcagacagaagtgccgagtcctcagcctgaggcacggacctaacaggacactaaggtggaaaatcctgaacagtgttggctgcatctctacaacgtttcttcttccccttgcctttggttatgaatgtgcccaagagttgaaactgaattgttgccaaaggatacagagactgccacatggtcaggtagcttctctgttgccaaaattgtaaggaaaaaacactctgatttcattccaagtgaaatcccatcagtgaatactgcacatagccaagcaagaggaacagtcaaacttttattgctttaggccctgtataaaagacagaatcagagctggcttgagatgtataggctccttgggcaggcaaaaatgttggcacctctcaactgacctgctttaaatgctggtccaatgtttaattcaaaggagaagttaaccagcatgcaaagcaagaaggagaatatggaagctgggtgcagacccctctgttgtctggagtaacgcagatctgaggcaagtaaacctcttgcagtttctggatctcattttcactatgggacaagacatgcagctcctaagagctgacattccagccacatctgcctggacagaccactcaagctgtttgatgctgaactttcctcacctctcctcaatttcctcattcataaaattgagataatcatcatagctaactcaaaatgtttatgtatctagatcaggctcttgtatgtagatctttacaaaaatagcaacttaaatccctcaagtatgcacttgtggggagggtcagggatgtggaggaaaagaagtgtagtagctcagtcatgtctgactctttgcaactctatggactgtagcccaccaggtttctctatccatggggattccccaggcaagaatattggagtgggttgctatgcccttctccaggggatctccccaaaccagggatcaaacccaggtctcccacattgcaggcagattctttaccatctgagcctccagggaagcctggaggaaaaggaataggaaataccaattctcttctaaagtaattgtaaaaatattccttctaaccccacatcctacgctatgagatgttgggacaaatgtaattttatctatttttgtatgtattctgtgatgaattagttcctagctttaaaaaaaaagtattcttttttctagcaaatagccat

SEQ ID NO: 32316 - DNA, 907 bp, Bovine  19866881106873
atggccacttgtagacggacgggacagaatcccactcgtaaagcacacctaacacctccctctttctcccatcccaaaatgtcatattgtcaacagacctatgggggcttaatctcataggggaagaaaggagagataggaaaagcaaaataatgtaagtggaaaagcaaattgttggggaaaaatagcacatttaattgctgagaagaatgatcacaggtgggctttcgagtgttatgttgccttcagggaccatttgaaagaatcaattcaaaagagttttccccagtccctggaaagctgtcttggtgaaggctgcacattgtcaaagatattccaactgggagatggagttagaatttttgctcagtgagttggctaagtcttatgaaatgggtatttgttccaattaggtgttccaaaaaaaccttcttgcctcagataactcattttgagaagaaaagagtatttgttcaaaactcatcatggaagggaaaatgacagactagtgtgttctgtggctactgtacacatactcttcacaggcctgtaggactcacacttttaggtcatttgtccttatttccctagtcttagtcctacctaaaactggcaggggtgggtgttgggggatgccgactagtttttgctcctgttctttataagctatactatctagttatataactgtaatccgtgtccacagtccagagctcagatggctggcctgtcagcaaaaaatgttagaaaaatgttaattcaacaatggtggaaggatgttatttctagagctaaactcctcagggaaaatgagaaatggttgctcctgggattcaactcctccacaatgaaagatatttcttttctgaagtttcttcccaaataatttcccaatgcttggtgtgcc

SEQ ID NO: 32317 - DNA, 2622 bp, Bovine  19866881152601
aaaaaaaaaaagaaaagaaaaggattatgggacaatggatagcctcagggaaagaatagctaacatttattgagtgctatagttatagaaacacttataaacacttcatcatttagtcctaacaaaaaccctaccagataagtggtattattatactcactttagagataataagactgagacacagttaagcagtttgtccatggtcacagccggtaagtggcagggccagatttggagacaagcattctgactccaaagtttgaaggtttaatctctacagaatactgcattcctcagtggaaaaagagttctgatgagtatgtctgcctgaaggggctagtagtcgaggcagtacacagggattgtcttgaatacttgaatgtgttccaacagtgcttaaggatttaccatcactgttcaagatcttccaacacagtcaccagatttagcaaataaaaatatagaattcccagttagatgtgaatttaagaaaaacaacaaataatttttagtatgtctcaattattgcatgagacatactcaaaattatttgttgttattggtcaaaatgtacaaatttccaaatttatttataaagtaagtcatgataatgtaatgtacaacacagtgactatagttagtaatattatattgcatatttgaaagttgctaagggagtagatctttatggtccttagtacaagaaaaaaattgggaattatgtatggtgacagatactaaagaaacactgtaatgatcattttgccacatatgcaaataacaaatcatttacattgtatgcctgaaactaatatgttatatgtcagttatacctctatttaaaaaggaaaagatgagaaaacataaaaacaaaagttgtaaatcaaaaaattaagagatgtagttacatttaaaacttttaatttgatacataaaaaatacatgaatacaaaagagaactaccaaatagaccatcaatatgacaaagaaaaaaacagttcaacattaagaattaataaaatgaatgaaagttaaaacaaataaaaagaaattattcattgtctatctggaattcagatttaactgggcatcctctatttcatctggaattcctatcctgaaagacaagaggatagcaaaccacttacttcactcttaccttaagcaaacaaacatttttttttcgcacaatggcagagttgaatgttgggatgaagactgtatggcccacaaagtctaagatattaaccatctggctgtttacagaaaaagtctgccaagccctgccttagccagtttctcattcattatgtgtaataaacaagttgcaattggcagtgtgccaaagtataattctaaagcactaaattggcccttgtgtctccccctgctccacaactaacctcttgaataatgtttgacccagctgtcatcagagttgatggcctgttttgcaaagtttgaacctagaacctcaaatgctttttcttgaggagccacaatccaaaaacctgccccagtgttggtttagaaaagacaggtacaactgagcaactagaacaaggttcatctgatgaactgcccctccaccagaaaccctccctccagatccttctttccttgccaatgagagcccctgcctagcaaaaccatttgattcttctttattgttttcagagacatgggccctcaaacacattgtaccacttggtcagggatgtcaaaaaggtaagaaccctctggactgcaggtcggaggctctgtcttgactgcttcctgtgattagaaagtgcctgttttgcatgagctgccggagtattcctgtccctctcagaaccccctcatttctggacacggtgtgcgcgtttgtcttttaactctgagacatctctgcttctgatgcagctgcagttttattgccagtctctgtgattttagatgctttcactggacataatgctttgggatagtggaactctaggctttccccccatgctgtgtggatttatgccattacctgtattttcccatctgctcctcacgtttgcggagctcatttccatgccatccaaccgaccatgaaaggcgtatttatttactagctcctgatacagtgtatcactgccacttcttagcatgacacagtataagcatagctcaaaaagtctcagaaaaacagagactacaacacaaatatacattccattctgttaacactttattttctctaatatattttttcacattcatcatccagtttgatgggggtgggggaaagtcaattggtttgggtctagtaggtttattcccaatttagaaatgaggttgaaacacaaggaggtgagaactattttgagtggttagtaaggagctagaattagaactcagatcctttaataatcattattattattattaattggagaaggaaatggcaacccactccagtactcttgcctggaaaatcccatggatggagaagcctgataggctacagtccacggtgtcgcaaagagttgggcgaagtaaaatggtacctaaggtttagtgatgactaagtgtgtgacattaatctgagctttctatgtgtcttatcttatttcatcttcacaaaaatta

SEQ ID NO: 32318 - DNA, 2081 bp, Bovine  19866880678264
ccagtggctccatgcgcagctcctcctccagccccagccccagccccagccccagcccagctgctgacacctcgaagcctggcactccggccagggccggattagcagccttctaagcagaggaagagacagagggatggggcagacacccagaagccaagaagagaggccctcagaagaaactgatagctgacagcttgatcatgaactctcgcctccagaaatgtgagaagataagatcctgttgttcagggtacccagcctgtggtttgctgttacagcagccctaggagacagctatacttagtactctccatttctcctttcctaaattatatggtgtttaaatataaacacataaatactatttaagtgtcatcacttaaaagaaacctccttttggaaaactggttaaattgtttttatcagactacaaataattttctgattgtttggttttcctataatgacaaaaagtcatatgcacagcgcatggcatttatttttaaaatgattggcaagcaatgaaataacattctcttccatcaccccaccctaaaaataatctttggttgaagaaaatcttttttctctgttgacaaaggtttaacaggatgagatgcttaccgaatcgatctgatctaaagaaatcttgccagcattgccctgtgtactgtagtcttgaccagtgtaggaatgactaaaaaaaaaaaaaagaataaaatatcaaaatcgaatttataaaacatactttgatcacctcaaaggaaattttcaaaattctgacaaaaagtcacgagaaaacatttcatacgtaaaccttaggagaaacatagccaagtgttttaaaggtatttcatagaatatgtttaagtaactttccccataaataatacagaaatatagtgctcatctgtgtctcccgattcctaatctagagtactgtttccttaagagcaatatgcaaactgttgttaaagttcacactcctctactactgaccccttataacatcacagcacagtggtggtggtggtttagtcactaagtcatgtccaactcttgtgaccccatggactgtagcccaccaggctcctctgtccgtgggattctccaagcaagaatactggagtgggttaccacttccttctccaacagcacagcacaaagctagggataaacagagcttatgtctgaagtcattgctcagcaggccctagagtgagtcaccaagactctccacactctggatgcctgtctgtcaaatggagacggcactgcctgcctgcagtgttgacggcaggttggagttgaaatatttttcgttaaaggacctaacataccgtaatcactattcattaaaataagtaacatgtgaacagcacctacatgtgcagagtcctcatccatatccttacaacagccccaaacgagtgagtttactgtatatctgagaagaggggaacttctggggtcagagagcaaggcagcagtgcagcaggaattcaaacttttgactcccaacttcctgtttgttcactacactacactactctactactctcttccctgtgatacactgtcgtcttatatatttagaaatgaggaaatgcaacatggttcattctacctaaaggctccacctgtacactttatcacctccttgatacaactccacacccacagctccatcaacagggactcagatgcagacatccagaaaaccacagtcaaacaggggttcatgcagacctaacaactaaaggaagttctggactaaagtatcattacaatcacaggggattccagatgctctactctctacccctcggcactagagcttcttgctgctggttaacatatgacctcaagatgctctcaagtgctgccctcaagggcttccctggtggctcagatggtaaagcatctgcctgcaatgtgggagacctgggttcaatccctggtcaggaagataccctggagaatgaaatggcaacccactccagtactcttgcctggaaaatcccatggatgaaggagcctggtaggctatagtgccatggggtcacaaagagtcagaa

SEQ ID NO: 32319 - DNA, 1399 bp, Bovine  19866880955101
atggaggagcctggtaggctgcagtccacagggtcgctaagagtcagacatgactgattgacttcactttcacttttcactttcatgcattggagaaggaaatggcaacccactccagtgttcttgccaggagaatcccagggacaggggagcctggtgggctgccgtctatggggtcacacagagttggacatgactgaagtgactcagcagttagcaatgatgagagtgtgagcacatttgtaacctctgtgtgtgctctgagttgagatagggggtaacgactttgcctacagtgagggtttaattagtgaatgtatgtggagagtgtaaagcaatgtctggctcacagtgctgttcagagtgtggctgcagcatcagcagctcattaaaaatgtaggttcttaggccctatctctgatctccaacatcagaattgcatttcaacaaaattctgatggacattaaaggtttgagaagcattgctgtgtaaatggtgttggtatttctagctggcactaactagttgaagagatcagggtaagaggggcaaccccgctgattcacctgtccaggccaggttctgagctccaggaagtctttgttcttctccctgattgtcctggctgcttggtgaccagtggactgcattctgggagcctctgcctatatcatcctcagcctccaggtcaaccttgaatgtttcccttacatccatatgctgaagtttctgactccaccaacttatttaaccccaagtccctgtgagtgcctctgttggtcagctatactggaggtattaattagataccacaagctgaggactttctagctcagctggaaggttctaacccatgcgcctttctgatcaaaacaaaagtataaggaacatgatagaaggaataagaaacttggtattatttaacacttccctcctaggttccacatcacacagaaacatttatagtcagctccaagaagcaattttctaccagattttatagcagagaagagagctcagcctttaaggaatgcaaagatcaacaaagcaaaattcattctatttatggtattggtgtgacatttggacctcctagcagccaatattcttttcgctttaggaaagggttcattaccatacctgcttgctttatttcatattaaatggtatttagtaaagagagatggatgcagagaccttccattggtattcatgccaagcttatcacagttccatgatgcttggccaatagcacaatgagaaaggatgatacaaggatgccagagccctggtgtgatgaactgaagggaatataattgtaagtgaaatggatagaaatttcaggggcacacggctccgactcacagggcagaacaacccggcaagggcaggaattca

SEQ ID NO: 32320 - DNA, 1237 bp, Bovine  19866880993743
tgtgtaagcagttctttgatttagtggcaatttaatctccttattataaaagtttcccaaatgtgatagtctcttaatgaagctactgcaaagatctctacccttgatctgctgtttatcaattactttacaatttcaaatacctttattttagcactttttcaggttatcttctggagtctggtaactgctcctatattttgcatctgttctcatctaactgaatatttaaaatctggttgtttttctttggccagactttcaattaggtttaatctctcctttgatgccaacttaaaaaatcttttactacccttacattaataaagtacattacttcaagcactataagatgtgggttgtgacaaacaagtatttattaaaaatttgtcttggtcttttaattaaaccccagagagctaacctgactaaacaggcagcaaaagaatctcttaatttctgggagtatctgatgtttaaattaaatccacattttgtttttttgtttttcttataattcactgaagtaaatgcacttttttacaatccatgctggctaaaacacacccatctctacttctgtacccatccactcacagctggcctcatatacaaagattcctggtcagtccaaagtcaaaatgcaagaatgccactcctaagaaataaggtattaaaaagaaaatactcagaacatagaatgaacatatcctgatggggcttcagtcaagccaaaaccttgtgggatacaagcacccccatgtgcacccacaggcatgcctgcagcacacagagacccaggcacacacaaggaggaccttccaacagagccaaaggtctaagtgcaccctcagacagactcaccaagctcctgcaccgctgggatgactggccactaacctgccaccgtcagcagagctctaggagctcctccacgacagccctggaccttcagcactaagctactcattccagcaacgcagagcctctgatggctgtgcatggacccagtttagtttgcttcttcatcacctcaaaaggatttgacagagaccaccttaggccctgcaccttcaccttaacccctacgggtgcagtgactgtggacctcttaccagacccaactctgtagccctcaggcttcccaactgtgccacaacctcaccttaccacgttcattttattccaaacttccaagggtcctaccctcaaccccactcagggaaacagggtttaa

SEQ ID NO: 32321 - DNA, 4026 bp, Bovine  19866880995792
gagtcctgggaagattatttctctggatgcttttcctttgaactctcagaaaagccatgcttactagacagattcagttttctcctaggtgtaatcctctttaatttctccagcctgtcagtaaaatcaaatactcctgaacagctgtgtgtgggaattgttctgaataaagtgaggataaatgggcatgtgaattgcattagttctcaagagctataatgagggaacaacttcaatgtcaggggcttggggggtgtcaggcaggtccactttgctgctctcaatgttaggggcagcatttacggtaaccgtctggggagtaggcaggacaggaagggcttacagaaaactgcttcttctctctccagatggtggcagggagtggtggtggtggtgatttatggtttcatggagggagggtgataattggaagtaaactttgaggtaaagtgcttgtttatttgtccatcttttgcattgtcataattttattaccagtctcctagtaagattaaaaaataatggttagctagatttattgtaatcatttcactatacatatatatataaatagtatcaaacacctaaaattaatataattctatatgtcaattatatacctcaatacacttttttaaagattaaaagataggtggtttcttctgataatcatcatcacaaaaacttgcctgggtaaaatattattacttttctctatacatgtttgtacaaagaaatacattttaaagagatttctgataagggcatttgtgcacagaataaatgttcatacgtctttttacaaatacaattctggctaaaaaacaatatgcttagattagcatttatagtgcaattcaaagataacgacatgttcctaacatataccaggcctgctggaaaccgggagagtttgtaaataatttaacagtcttcagtagtataggctgtggaacatctggaatctcattcttctttttggattgcacactttcagatttgttttgccatctttcctgtttttcccctaaactacccaataaggaaaactgaaaatctgaaatgtgctcatcctcctgactgcttttttctccctctaactttcctggcaccagatgacagaaggaagtttattcccatcatcaggacatgctggtcctattgagaagccattctcaagactaacctcttactgatgccccctgccagaagagttacttagctccactgaaagccatgttgtgcttttcctggctacagctgctgcacataaatgaggtagggaaggtcttagagtcattttatggctattcttcatgttctagagttgagaaatctctgagtccttattaacatgctctctccactacccttagggtccaaattgccgatttaaagtatacatcacatcttggaaattcctgcctcattggaggagaataagtgctgttctgatgaggaaattccatttgcagcagctgcacaggccctgtcctcatctgtcacatccgagtctcctgtgggaagtgaagggttgcagctatccacagctttcccacatggccttcagggcaactgttctggtaaatgtgctggaaagtggtcctgttgggagctgtgcatgtccacagtcctgactgagagtcattttccttctttgtcctgtcctaaaacagcagaatttttgagatttacagggacagtgaacacagagattattgtatcttttctagagttgcctggtgatttgaatcctgtgcaatttagattatgagattttgcatactgtcacaggcattggtaaggaaaatatttttagagtgattccattataaagtgacatatttccagtttggagcccagctaagactaagaatgactaaccaaaaacacagagaatattatcgatggattttgggtcttccaaggaaagcaattctcagtgttgtaacaggcagtcctaaaatccctgtcacattgtacagttaaatcccatttttcaatcacatgaaatctactggaggagaaagagctttgttacatggtataatttgagaattcagacttctttcactttgtggggcagcatgttcagtaaacctgtatgcagatcaagaagcaacatttagaaccctgtatggaacaaatgattgattcaagatcaagaaaggagtacggcaggactgtctgctgtcaccctgtttaacctatacactgaccacatcatgagaaatgtccaactggatgagtcacaagctggaatcaagataggtcggagaaatatcaaccaccccaaatatgcagatcagctcagttcagttactcagtcttatccaaatctttgtgaccccgtggactgcaacactccaggcttccctgtatattatcaaatcatggagcttgctcgaaaactcatgtccattgagtcgagatgccatccaactatttcatcctctgtcatccccctctcatcaaggtcttttccagtgagtcagttcttcacatcagtggccaaagtattggagcttcagtttcagcatcagtccttccaatgaatattcaggactgatcttctttacaattaactggattgatctccttgcagtccaaaggattctcaagagtcttctccaacaccacagttcaaaggaatcaattcttcagcactcagcattctttatggtccgactctcacatccatacatggctactgggaaaaccatacctttgactatatggacctttgttggcaaagtaatgtctctgctttttaatatgctgtctaggttggtcatagtttttcttccaaggagcaagcgtcttttaatttcatagctgcagccaccatcttcggtgattttggagcccgagaaagtaaagtctgtcactgtttccattatttcctcatctatttgccatgaagtgatgggactggatgccatgatcttagttttttgaatgctgagtttcaagccagcttttccactctcctctttcactttcatcaagaggctcatttagttcctttttgctttctccataagggtggtgtcatctgcatatctgaggtaattgatatttctccctgcaatcttgattccagcttgtgcttcatccagcctggcatttcactttatttactctgcatggaagttaaataagcagggtgacaatatacagccttgatgtactcctttcccaattttttgaacctgtttgttgttccatttccgattctagctgttacttcgtggcctacatacaggtttctcaggaggcaagtaaggtggtcaggtattcccatctctttaagaattttccacagtttgttgtaatctacagagtcaaaggctttagcacagtcaatgaagcagaagtagatgtttttctgaagttctcttgttgtttctatgatctaatggatggtggcaatttgatttctggttcctctgccttttctaaatccagatttaatattgggaagttctcagttcacatattgttgaagactagcttggagaattttgagcattactttgctagcatgtgaaatgagtgcaattgtgcagcagtttgaacattctttgcattgcctttctttagatttgcaatgaaaactgacttttttcactcctctaacccatgttgagttttccaaactttctggcattttgagtgcagcactttcacagcatcatcttttagaatttgaaaatgctcagctggaactcttatcacctccactagtgatgcttcctaaggccaacttgacttcccagtcaaggatgtctggttctaggtgagtgatcacaccatcaaggttatctgtgtcattaagatcttttttgtatagttctgtgtatctcttgccacctcttcttgatatcttctgcttctgttaggtccataccgtttctgtcctttattgtgctcatctttgcatgaaatattcccttggtatctctaatcttcttgaagagatctttagtctttccatttctattgttttcctctatttctttgcat

SEQ ID NO: 32322 - DNA, 1797 bp, Bovine  19866881926493
ctgaggtacgtgctgttttgggaatctattctcaccttctggttccagcttgactggtgtctatgcacttgtggatagtatgcagctaacttcctccacctgatgggggtttctgcaaaacagctcatggatatggctccggatattgctttcagtccctcaggaggaactataagtctttgactttgttttatggctaaggtactattattttgtcttatttgactattttctttgtttatgcattttttcacttctctgattaaatctgatctttggaacttggggaaggcataagaggctaaagcttttttcttttatgaaaaaaaggtctgaaaaaaagatcctgtctgtcctggggaaggcccttcagggtcctgctcagttttactattgacttggactcttcaaaaactgtcagtcatgaaaagcaaacaaaaaagctgataatgtctaaggtaaaggagactaaagaggcatgactgctaaatgaaatttgtaattcttgactggatcttgttaaaaaaaatacagctagaaaggacatctttgtagaccgtaaactgtatattaaacattattgcacccgctgttaaatttctgggttatggtaatggtgtgtttatgtaagagaatgtcctggttcaaagagatgtttggaatgtgactagtggtgaggtgtcatgaaatgcaaggtgtgtgttctgtgtgtgagagagatgcagggcagctgggtacagcacaggtgggaaaatgttaacaattggtgggtctaggtgaaggatatgtggtgttcactgagccgttctttcagtttctcatcgttgttcagttactcaatcgtgtccgactctgtgaccccatggactgcaggcataccaggcttccctgtccttcaccatctcccaaaggctgctcaaactcatgtccattgagtcggtgatgccatccaaccatcttgtagctttgcaatttttcaaaataaaaagtggaggaataaaagacaaaaaatttcaccataaaatcatcatttatatatacatggatatttatagatcatgcaattacttcaaattccttacaaattaaggcaaatataaggaataaaaatctaagtacattaaggaataaatgatgttagtagaaaccatttgtctctacttgacagatgaagatgtagatccatgaataaattaactctcataaggtcacccactagtgtgtataagattctacttctgtgagctttatacagcaactgaacatcaaatacgggcctttgaatacttgaaatgttatttccatgttgctagcttaaaaaagctcattctattgtcctttatcagagagaacagagttttcaagaattttgtttttattctttatatatctgctattttttgctcacattttaacagggattaaaatatcagtagggatgctttctatttaacccagttctccctaacctggtaacatagttggaagtccattagatctattgaataaggcaataatgatggtgaaatgaacaatacagcaagaatgttaaaacggattctaaccaagagttaatgttttgtaaatgtacagaatcttctctgtttctctgagctaagccaggactcatataaaactctggaccatcatggattaaccccatatgcctggaggaggaagctgacagagggcttgttcctcaactgttcttgtgtttcagggtacagatcctgctctgtcccctactggctgggtgactaggggcaagtttctcagcctctggcttcaatttccgca

SEQ ID NO: 32323 - DNA, 1551 bp, Bovine  19866880464724
tcctctgctccaagggaaagtttatgagctatatgtagttcttacctcagtcagagcaaagctatctattccatagaggcattaacaggatgtagaacaagatgtctctttgggtccccacatggtgatttagtctaatgtaaaattctagatcagaagtccatgatgaaaaaaacgtattcaagtcccaaatatttccttctaccatgttaggttacttgtgcctattatattctctacatatactccttatgccaaagtattatgaaatattttaatgaagtgattacatttccataataacagtttttctaatttatgtcaaatggtatgagatttcataagccttgctttgattacactaccagaacccaaatcctcagagttacccagagcattaggtgactgctaggggagccacctgaaaagggaatgttgaaccattcaatggcaagcatggcaatggaaccaaccatggcaatggtcaccattgccactctgagcgacacatgcgtgactctagtcgtccagaacagttgacactgaggtattgttgactttgcttttcacagaagaggctgaagtcagctggatgctcttatggagagcagggactcgtccaccaacaatttcattcatgttcttctttggcctcagcaaaataatgaagcacttgggagcaaatgtacagccaaataaaccatagctggatgccaagattgcaaatgtttccacagctactttaaacttgcctttggtgctcaagtaagcagggacaatccagatgataagaacgaccagcattccaaaggtgatgctttttccttcatagtaattatcctgtggcaactggtgtgccacaaaggttgtgagaaagcccagtaaggccaagaagacatccatcccaaacatagagcacaaaggttctatagaaccttcattacattccagaataatctttatattttgagattccatgttcttgtacacccttggggggttcaatactaaataggctaaagaagaagaagagtcgctcagtcgtgtctgactctttgcgaccccatggactgtagcctaccaggctcctctgtccatgggattttccaggcaatagtactggagtgaattgccatttccttctccaggggatcttcccaacccagggatcaaacccgggtctcccgcattgtagacagacactttaccgtctgagccaccacgccaatttcaactagaacagaggttagcacaatgattttccgataaagagggtggatggatataagttgagttttggatttggaaattctgtaggctgaaaacagtgaaatagtcttaccaagaatgcaagacaggcagagagaaaaccccagtaccagagtgatctgacaggccatgcaagaccagttgtagggcttgctgatgaagagcatggaagacagcagtgtgatgacaagagaaacctgaataagaaagctcaactcccagccattagccatcaccagcgggagtatgtctgtgtatcacataaacagttgtgactgccca

SEQ ID NO: 32324 - DNA, 861 bp, Bovine  19866880478143
tctcagtccatctatattgttgcaaatgatgatatttctttctttttaaaggcagaatgctgtaaccaaaaaaaatgtggatggagatgggcagagggctaaactcttttttagtgcactctagagatatagtagagacagttggggggggggggaatcacacctatgttgctttcttggaattgtgaggggaaaaaactaatatctaaaagaagaaaaatgagcattgtatgagaattaacagacatcttcaacttggaacacttctcagcatttattataagcaactaaaagccaagaacctatgcttttaaaaatgtaacattagcacatgcaaatatcatttaaaatcttctggaagaagagcctttctaatatatgaacacttataaacctcagacatgagagaatgtaaaccctgcattttgaggttctagatattctgaatagaactgggttcattccaggcaaatgaacatgaggaggctgccacagaagtgtttcatatttactgaagtaattacccccactcagggaaaatactttacaacagcagtggggcagtgaggcaaaatcctggaagttaaaatgccttcaagtataaccaaaggcctggagaccccagagaagaaagccatatgctaaggaactgtgcagcttggcaacgtttaggaaacattctacgagcaggaactttctggccgtttcaactgccttaacaagggcgtcctgcatggtatctgctgccattctcggctgcgggactgaagatagaaaaatgcattagattctaaggagattatagattttatccacaaaactagagtcggcagggggctgggaaatgggcagaaatggtta

SEQ ID NO: 32325 - DNA, 3091 bp, Bovine  19866880555760
ctaaattagcctttccctaactatcgaccacagaacactgttcctaaaatgctaatacatatgctaggagagaaatgcactagcacaaaataagtttgaaatagagggtttcattacatacatttatcagcatgtcaaaagcacattagcatagaaaagactaagttgttctgtggtgaagaaacctattttgtcctttaatctatatttttccaaaattacttgagtttggaatccagttttcccagctctctgttagcatcatacagaatacagtttgccagattccagtttggggacacagtaagtacattttggcagggttcatcttgtaattaatagaaaggctatcaaactaaaaattgtcagtgtttcatgtatcaataataatagataccacttatggaacagttagtaaatcttaggaaaatgcttcttccccactccttgagcagaatttcccctcaatacccctaactttctgtctcactctctgaactcttcttggaggtggagagctatcggtggctatcataatagccattggtcaacatttctcagttagacgaagctaacatgtcaaaagtgggaaggaacaaagacactaagcctgttgtctttcctctgcatctggaccaggggcagttagtaccctgggttctgtcttctgttcagagttagtacccctgctcccgtgaaatacaacttccctcagatagattcttccaaggtcaagaatgggaagaagttagcaagcccattttgttggtccaaccaagttgcgtctagcaacttagtcctcatctttgttaatgctgatatcttagttcttcgtggactaactttattatattttaactagctcagaacctgggcagtgaagagaggtgctgttttgagtcctgctcataacctcaacagaaggtatcatgaattcttcatgatattttacatacatgatctcatttaagcttcaacaacctttcaaggtggatacttatgtatccccattttacagactaggaaattgaaacagagaaattaaatagcttaccaaaggttacatagtaagtgactggatctcaacattttaatgaatgtaacagtgcacactatttaattgtactattgtaactattactagtgaatctcataagatggtatttatgtttggatccctttattatttatctctcactccttttctatgatggaggaggaaatgggtacccattccagtaaccttgcagggaaaatgccatggatggagtagcctggagggctacagtccatgggatcacaaagagctggacatgactgagcaactgggtacacctcttctatgatgcaacatgcatatttttatgtttttttaaatgcatttattttcaattcgaagataattgctttacaatattgtgcaacatgcatattgatctatgagaaacatatggaagaaacattaaaaaaaaaaacacataatcttcatcagtgagtaagatgcttggggaagttgaaagtgagaaaggtttaaatctgaaatttcaaactttcagccagcccacagacttattttgtttgactctcaaaatgctaaagagttgagttagttattaggataagaacataaatttctggcttctctgaaacatgtgaacatctgggaagccatgaacctgagttgatgcattctttggatggagcatgtgcggcacagttcaccttggtccccactgtgtcacttcattttaatgctttgtctgcatgtgctgctgtaaatgctttagtttgccaccctggtgtgagataggatggctccaccctctccccatcctcccctgggaacatcacagccactgcaagaatcctgaggctgactgtcaatgtctgtgatcagggcactaagtggacagtaggtgccttgatgtgaaacagtcaagctggaagcagcagattttcagaagggagaccacttagtgcagatgcttatctcagtccctctagaaaaaatgtgccaggtacaccctagaaagacttcagagagtgaggagagcagctggaataaggggcatgagtctaccacacatgctcgccagacagcatctgctttaggtgtgggatatctgtgcaaatgttattaaagtatcagtttctttcacctctaaaaacattgtaaaataatttgcctgagccctctatcatctaatcttcagtactaacctttctttctacaccattgtctgttacgtaacagttgctcgataagtcttttaaatgagtaaatgaatagacagactttgtaaattctaagcagataattgtccttcccttaagaagtatgtgtttaaatgagtgaagaatgcccatcaaggcctctttccacctttttgatgtctctcttcttgaatctcaccctcactccattaccaggaggaccaaggctttttctcgttaaggttaggtattaactcttccaaaggaatcaacatttaaacaactttctaaagatgacatgagaaagctgtcccttctagtagggagttcaagagtcagaaatcagggtaaatattggggttggacaccttattactccaaaaacgggtcttgaacttaagattaaatgaaatccaacaaactaaatttcaataaatcataggtcatattcaaaaatgaaaaaccatagaatcacaaaacattagctggaactggaaggaagtgttgcaagaaaccatcaaacccaaaattccatcatggtaatcatgacattaaaatgccacctgcaccagattactataaatttcaatttgctgaatggttgtgcaatgttaagtgttgtatatttcttgaaaaagctggtcatcaaagagtgatcaacatagaattttaataggggaaatatttatattgtgctttaatgcattataggcttcccttgtggctcagtggtaaagaatccgcctgcaatgcaggagacctgggtttgatccctgggttaagaagatcccctggagaagggagaggctatccatgagattgcaaagggttggacacaactgagcaactttcactttcactttagtgcattataaat

SEQ ID NO: 32326 - DNA, 2858 bp, Bovine  19866880568738
gtgtttacattaagaaagaagaaaaattactgagaatcaacttggtaaatatgtttataggtacagcacaaaatggataagcaaatgaaactctgctctccttatcaaaggcaagaatggctagactcagggtgttttcctgtcacggtaagacctctgtgaagcaacattttcaaaggttttgtttaccactgttgactatgggagatgttgaaaagtgcaatcatcaaaacaagctaaatggcacaatatcaactccatcatctgtagtaatttggatttcaatttcactaaaggttacttcattctctccaaccccacccttactgaaacagacctggtaccatcacctccagagctctttctttgctctttgatgcaatgaggtaagttgtttccagaatattttgcatgactaggaagaaagggattgaataaaatattatattgataatttacaaatgtcccttgggaaaacaagtgcatttaaattgacagttctggtaaaggcccccaaatccttttaatctcccactgaattcactcagtgttccacctatgaatacattcagaggaataatgcattttgaaagtgactcacttgctaaaagtagtcaaaacataattcaacaagacaaggccagctttacgtctcatttgggtcctcaaggcagaggtaggatcagtcataactgcttatcctaaagctgctaaggtgaagacctaagggaaaaagacatctagtctttagccatagaagcagcaccattctactgaaaaaagggactctttataggcacacactcatacacattctagaagacagtgtgacaaaatgaacagaatctggacagggatgagtagggatctgtacatgagtttttatcatggttaaaaccatttaactgtgttgaaatgcaagtccttcatctggataatgaagataataatatccacctcctatagttttgcgagggtaagtaagctattatgtgtccatgaacctggcacatagtaggttcacatcctaccacggtggtcatcacaccttcatcctcccaactccccagttattataggctggcaaggaataataaaagaactccagtactagttattaaattatatccagtttttcatctctatgtcctctgcctaggaaaaaaatcacatatattcctgaaaccccagtatttttggcttcttgtggaaagagtggagtagtaaagtctagatctaaattatcttactattaacctatcagacacatagagccccaaagaatatataaaacagtgtatttcctcagatttcactttttaccggagtgggaccttagttcttaacgcttaagacacacacccacatagccaccaccttagagacaggagagaaacctcctctcctattccagttttaacttctccaaggctccttggacactgaaaagatttctctttaattttgaactttagcatattctcatttaatgtgcaggtaatccttgagcgccaaagaattcatgcttttgaactgtgatgttggagaagactcttgcgagtcccttggactgcaaggagatccaaccagtccattctgaaggagatcagccctgggatgtctttggaaggaatgatgctaaagctgaaactccagttctttggccacctcatgcgaagagttgactcattggaaaagactctgatgctgggagggattgggggcaggaggagaaagggacaacagaggatgagatggctggatggcatcactgactcgatggacatgagtttgggtaaactctgggagttggtaatggacagggaggacctggcgtgctgtggctcatggggttgcaaggagtcggacatgactgagtgactgaactgaatccttcctccaccccaccaaatgccatctagatggttcttgggcagggcattttgggagggagaagagacaagggatagagggaaagagccatgtatagcttcctggtacgttcaatgctcagaaatcctgtgggcattttcaatgtgttcttatgtgtttttccaccgatgagaatgagagtaagagaaaacagacccatccgactatgcccccctccacagaaacctccgtcctcacagaggtcagtatcccttcctgtccccacttctgggtgaaaggtcctgaggtttctccacacatgctttgcctacaccatttggtcctggaaccaagagctcacacaacactccaccactccttttgccacacccacacacatcctaggtcactctgtttccagtgtaccatttgcagcccccatctggacactgttggctccagattaagttcttaacaaggggtgtacttcttctttgtttaggaatggtagaaatctccccatgcatctgagaggagggattctgagctcatgccctcaattcaaatgtcaccctcccaccgtacatctctctgtagtcctacggagactagacgggactatcctggtttagtagcagaaaccactaacctcttcatgagaggcaagtcagcctcttgggaagcagcagacactctctctgccagatccaagctgaatagaagagcaaccccagccctggtttggtgcaactttgaagcaaactctataaacgtggtggtatcctagctggccttttgtcagactgaatattgagttcaaatactgtttgctgctgctgctgctgctgctaagtcacttcagtcgtgaccaactctgtgcgaccccatagatggcagcccatcaggctccaccatccctgggattctccaggcaagaacactggagcgggttgccatttccttctccaatgcatgaaagtgaaaag

SEQ ID NO: 32327 - DNA, 925 bp, Bovine  19866880650554
gagatgatgatgaaagtgttttaagaaggaggtctgtcacctagtttgaaagttttagtaaatactggaaggtcaagatacttcatataaaaatgtaggttttcagtctttcacgaagaatcagcaactctgaaaacacaggactcacaatctgcttggtaaaaagcagctaccggccgctggagcctgagctcatcagtgcgcatgcgctgtgcatcttcgcagtctcccacccactgcctcttgtctccctgactatcaggatttgtcagtctgcatttatcatcatgcttacattactgaaagtcccacaggagagggactgtctccccatcaaagccaggaaaacaaaagatagccccaacgagctgtgtgttttaaaagcaaagttggagagagcatatttctgtgaggaagggatgaatagtctatgtgtttaataagaaaataaagcctcttcaaaagaaacagctctgttttactcgattataatctactacctccatgtcttctgcaggcttttgagttgacccgattttaaattcatttgcaaattctgtttccagaaaaaaatatttctcagatgtttcatcatgtcatttttcatatttaattaacctcagtgagtcctgttggtgtccatattgtctgaacacagaatatatgcactgactgaggatgtttttcaaatctaaattcacacttaggagcatttttccactgtcctttgctggctctcctcccagccgccaatttggcgcctagaggtacgtgtgacaaggcctgacaacaccagttcaaatcctaccccagaggatcattttctaatcaacaaggcagtgcctgtgtggcaaggaggagttcacccctggtcccttcaagagccctggctggtatggagctatagggagcatcagtgctggga

SEQ ID NO: 32328 - DNA, 1935 bp, Bovine  19866880678330
tttgtaactaaaaactggggaaagaagcaatacatggttttagtcctctaacttaaaaaaagtattggaaatgtctagtggtttgttatggtcttcacttttctaaggaatctgcatacattatctcttagctgctgctttaatcttttatggctatctttgaggtctataatactcctttgacctccctaaattttgaaccttttatttaacataccaagttcaaatttcatagcatccttctcaatcacccattcatccacccctggttccatctattcctccacctgctaactcactcagttgtccttaaatcatagcacatgaggaagattctcccataagagtcatttgctgtggtacataattttaaataaatttagaaactaaataggaaaaaaagaactaggttatggagaagagagcagagaattggagtgactagctgatctgacaaatacacagtgtactgcttattttttaaaagattttttttaatgtgacccattttcaaagtctttgttgaatttgttacaatattgcttctgttttatgtttgggttctttgaccatgaggcaagtaggatcttagctccccaaccaggaatcaaggcagcactccctgcagtggaaggcgaagtcttaaccactgggccaccagggaagtactaaagagggaccactttaaagagttaacttccacaactaaaggtattcatctgtggttttacaaaatggtagttttaaaatttttatccctagaaatgaaaaatgttctaaatgtcctttggattcatggagtcaacactttaccagatagtaaattaccagatagtgaaatcattacttgatctaaatgctacatggattatatgactatttgtaaagttcagcacctggttccccacagagagttcagttcagttcagttcagtcgctcagtcatatctgactctttgcaaccccatgaatcgcagcacgccagggcctccctgtcactaaccatttattagccatgaagacgcaaaaaagtcagttggatgtccccagatgaggagaggcctgtctcacagagccctgctgccctcagtgatggaggaaccgatgcacgatgctcaggccctcctacagcagccctgcaatgaacacttcatactcacctggccaacacaaagagattttaacatgctttcaggtaaaactgatttcatgtcacaatattccaacgctattaaaaagatctaaccatttcccataatcagaaaatacagaggtttgcaagatttatctcacagaaaatccacttagagtttcataacgctcagtcagatcataaagcccagttgagttggattggcagaatgctggctttttgaattaacccttctactagatggttgaatatgaatatgctttctcatctctgaaggagagtggttttagtcaaaggtttacagtgttcagaaggggcaaggagtaacagatcactttgaaatatgatgaaagctaaggactttgttcataggaggcgatgaacaaatgtatatccatataaacacagagtgtctggaataatgttttcagagattttacaacgtcctgaagcccagctacaggttctgcttagaattccccatgagatggcttctcaaatcctttctagctctgctatgccatgcatgctgtagactggggtgttgctcatatccttaactacacacacaagtttccatcttctcagtgtgttggttggtgtcattctcttcctctaaccccattcttctaacctgttcctcgaagaaaaaggactaatctctcactcatgaggacaagcccagtacatctctcagagcagtgctgccccctctttactgtgctcgcaaaccacctagatctggggaaattgcagattccaactcagcaggttcaggaggg

SEQ ID NO: 32329 - DNA, 1032 bp, Bovine  19866880788489
cttgatgtaaacgaatgaattttataaaacatatttgttatattatgaaaaaatttgaataaggactttgtattaaataatattaagaaccaaaaattaagaataaagcaagaagattaagtacattaaaaccaaaaggatgttttgggggggttgttactgtcatcactgttcattgttatttaggattagtgtaggctgtaattgagtaccaggattttagaactgtcaagacagaaaaactttaaatcttaatcagatctttaaagtctcttgtagtatcacattccaccagcaagattcctgaagtagttctcaagaatttgttagagatacagatgaatgtaagcaacacctctccattataaagtagaacaagaaatggatttcaaaaacgtattttggcaatgagtagcttcagttcataaaattattttgagcaactgttgcttttttattaatatcactttgaaaatgagaatctctgaatactgatattcttgttctaatattaaagaaaagccagccacagccagttttgtgtaaaaactgggatttctccattttagacaaaaggtcttaacttggattttaaaactgatttgtccaatttggagaacactatccattaagaattaatttaggtacaactctatggaggatgtaagaatatatgttaataaaacaaatctataaagataattagcacagttacaagaaatgataataaaccacatatgcacattaactgacaccagcctacatttcatagatttaatgcagttagggagaaatgtgatttttaaagaaaaatgaactgtccacctaagtgggttatacccaaaacatgggaaaacccaaagaaagaaagaaagtgactaaaatttaagttttctagtctttcaggaagctgaatgaaaactcacctggttttttgtaaagcagaagatttataaatgattctagaaagctaatgaacagctcattcaccaatctttaaatacattagagctaatacacctaaactattat

SEQ ID NO: 32330 - DNA, 1048 bp, Bovine  19866880837944
ggagaggagcagaagtccttttatctctggaagggtgtgagaatagagagagaactgttaagttccctccttctccaatacaaatactaagagatggtataatttgaggttcgtctattactttctaataactgcatgaatactttcaatcctaggtgggctatgcctctaccagcttacttcttagtgacaaataccagtttccatcttatcttcgcacagtggccagtgataagatccagtcggaggccatggtacaacttatccaacattttggttgggtctggataggcaccatagcagctgatgatgattacgaaaaatatggaataaaaatttttaaggaacaaatggagagtgtcaacctctgtgttgcattttccaaaaccattcccaaagtccattcttccttgtttgttttaatgaacagaatagttttcataaatattggtcataaaatgttttaaaatttacatttgtctaatttctcttccctggtggctcagatggttaagcatctgcctgcaatgtgggacacccgggtttgattcctgagtcgggaagatcccctggagaaggaaatggcaatccactccagcactcttgcctggaaaatcgtgtggatggaggaacctgataggctacagtccatggggtcgcaaagagttggacaggattgagcgacttcactttcactttcacttttcctcatgattacatttaggttatgcatttttggcaagactactgcaaaagtgatacatatccttttttatgtctcttataggatgccactgtgtctcattaatgacacattaatatcattatatattctgttgctcaaaatttcccaggtttgacaattgggagtcactttgagttggctcctatttcttttgagcaaatcaccgtaatttctgattaatttactttctgaaacactaagatattgcagattcatcttgtatttctctatccggtcttgtagtagccatttctcctgagtcctatttacatttagaatggaattagaatcaagatctgagta

SEQ ID NO: 32331 - DNA, 1415 bp, Bovine  19866880865756
ggctttgcacagagaggatgctcaatcagtagctgttcagtgtttgttccctgactgcagacttgattctcaacaaccagatcttcatacataagcccaagccatagggatcatctgctgccaggaactgaatccaccaaaactcacctgggagctctgtcctcccataggaccacatctgatcctctgaaaatacatagaagtaaataacttcaaagaaggcaggaagtttgggcagcagagacaaaatattagaaatgtaactactcgtcaggtaataaacatttattaagatggtagaaatcactattgaaatgccatagctcaacaatcattcatatgttgtcttgtcctactaaatgtccagtcagttcaaatgaataggtcagccctggtttggaatgttaattctgatagtatataaaagctctttctattctgtctctaagtcacttttccctaggagggtggtgatcatatgaatccctagaaagtctctgtaagcacacacaatgggctctcataaatattaattgagcacaacggggatcctcagctgtcaggtgccagatgaagtgcacatttttgctagatattttgaggtcaccctaactttacttatcttcataagcctaaatataccaaggaaagcatggggtcttgtcttaacccttattccaaagtgtatgaaagcgaaaatacattagttttcaaatcatttctacattatctcaagagtcctttataatgttattagtcctctttgcagttgaagaaactgaaattcaggaaagttaattaacccacccaactctttgttaaactttaaaactcaagctttacaaacactatgtagtataaaaaagcaatgagataaccactctagaatattatcagagagaatgtacactgagaaaatattttcagaaagcaagtacattaagaataaatatatatgtatgtatgtataaatactattgtatatataatatttacccattaattccacttctagaaatagagcctaagaaataatcagagatatgattttttaatctcaaataaagatgttttttataatattacttatgataatgataaatagtaaaataagaatagctaagcaataatatagctataatatgtagtccttggaaacttttaagtggtttttaaggtaataaaataatctgacatactattaagtgaaaaaatatagtatgattccaattcaaaaggctagggtaaagcatggcaaaatattagcagcgattgccctttcatttttatgtttctgttttcaaaaattttctaccaagttcagatgttacttttgtaatctgaaaaaaaaagttatttaaaaacaacaaataaattaaaaatcacatccacagttacacaagaaataaagtcag

SEQ ID NO: 32332 - DNA, 1380 bp, Bovine  19866880887981
tatagcctgccaggctccttcatccgcgggattttccaggcaagaatactggagtgggttgccattgccttctccaggggatctgcctgacccagggattgaacccaggtctcctgcattacaggcagactctttaccatctgagctaccagggaatccccagtagccaagatgtctatgtaataaaatggtgggtagaataagaataaaaaagaaaaaggatgcagtgctgggctggacttcctttgagggctctgggagccacttaagggctttaagcagagtgactcatatttgggaatcatctttacaaacaccaccctgagaatgggttccaatggagcaagactgcagtgaagagggttttgtgatagtttaacagtgcacggtaccaaggaagtatctgttgctaatgtgcaatgctgcctgctggcataatttaaacaggataggctacttcttttcaaaggaacatgttttatgtaagctctctctaaacacaaaactcgttctttgtcaccccagcacaatgagttattagaatgttagtgtaaatctttatgagtgtgtaattaaatcattaggattagagattaagtcaccagagtctccattattcaatagtgctgtattttggaatcgcccagaaagaatatcactctactgcttttagcagacgctaacatttcttcctgaatgttgttgttctctttcctaagtttttcaaagtaatttcaacacatatatccatatagtaatacttggtggcagatatttttactaatttcacaggttgtccctaaatcccttaagactgggggctttgtacacttctaaatataatgattgttaagatggcttagagagagggagaacacagggtagatactgaaatggggaccatcgtggctctgcaataaacatgaacttcactttttctacaattcaagatctacagcaggtgcagctcatggaacacattttaaaaactgattttcatgctaaaaaataaatcacgaaaacaaatatttaagattctttcactgccactaacatttatcctttttaattagaaatgttgaggattcaagtcaatgttttccataacttgtccttatagaattttgttcagagttaaatggccagatctgatgttatactgacttatatttctacctgtttaataagcccaaatactccctaactatgcttgatccattctgaggtcaaaatttggggcaggggtgatcttcgtcaaatctgaagtttagggcacctaaatcttgctaacagaaaattcatactaaaccttcccccaaaatctgttttattcggcagaaaagttattaaacactatcagccaaaaatttaataaaacca

SEQ ID NO: 32333 - DNA, 1801 bp, Bovine  19866880899459
ctattgtattccttttacccttctaccataattttatatctttttttttttttctcagacaaataatagtcatgatccttcaagcatgcagaccagaactattcttagaagggagctgcaggaggtttattatgtcatgaaacacagagccagaacaaaggactactgaatcactcaccttatcttcatctaagaaacctgagaattacagggtttctcttttcctcccaaattcaagaactgcacttgccaagactgcaggttttatggttgagactgtattacaaaaaatgtaaaaagacagatgcacataatgtttcttactgtatatatgactcatctaaaatgcttaaaaacaaggttcaggatattttttatcaaagtttaagcctttgtttccgaatctagatgtctgattgcttggcacttatttaagcgctctccttaagagtgccacagatagcatcttttccctgaaaacctgaaacaggattaaaattatttcacagattaagtcacaattcttagttcactgagaacacaaatctaggtttacttatctatatcttatatatcactttgttgtatatcttatatataactggttttcaatactgttgactaaatgaataaattaaataggaaggatttaagagttttcccagtatattatagcaccctaatataagccacctttatcatattctatttctgtaactgtctttataattatttagaaaactgattctaaaaataagtttaattgatgttggtgatgtggggaaatgtatcaaacagaagcaatgactgtaacagcttttatgaataatctggtgcagctataaatcctggctctgcccatcaaccttccctccctttgtctcatcccatggcttctccccagccttcccccaagcactcccagtctcattatcccatgatctgctaaactgcagtttacctcctggaaccagcagaaacacatgtcactgagaattagggaattggagccagttacaagccacaaaatagggtcacaaagtatctgaacctgaaaattaagagtttttatatttttaatgataaaaaacttaattggacacttctaaacgtttgagccagatggattgcataatgtctcggcattcataatgaatgggatgggaaagagaactttaacagcatgttatttgttaatcatctgaaaagtcatattaccgttgacttcatttgctgatggtggaaggatattgtctgaatactactactaataaacatttgctattcttgaaggcaaattacttaaaaataggatatagcaagacagtgctcatgtattactacacttacggtattttttatgctgcactttatcccagaaagagtaattccattttcatacatttattagcagttaattcttaccaatgtttatttaatagcaagtaagtataccaatcacgctgccaaatactgttgtaacttaagaagtgtactacaagaagctacagctccttctgcataacccttaagatgtgtacccttgccaaatgctaacctgtgcgtaaacaagtgaaactcttaaagggcaatggagttgtcaagactcaattttaagaaaaagtgactctctcaacagaaagcttgagggatctgactggttcgtgtctaagtttcttgaaacattccctgcagatgattaaccccagaagtgatcaaaacgcctgagcaactggaaaaacaatcacttctgggaaagcctttgtttcttttcattgccattttacgttggtccacttcg

SEQ ID NO: 32334 - DNA, 1019 bp, Bovine  19866880909194
taatcagacacaagatgaaacacagcatttgtagaattgcacttgctgaacagttgatggaacttaactgtatttatgaggcaattggtgggtggggtggctaaccatcttataaataaaccactttatgagtttttaatgtgttccttattaaaaacgcattactttccatactaaattaaatagcatttgaagccaatgtttctttttttacctttatttaaatgagatttctgcttgctttagttatatgattaagtagcaaaagctacttgagatgcagactaatagaggaaaatatccctttaaagataaaaaaaggattttagagcaagaggagaactaagaaacagatccaagttcagggaatggagacagctcacaggtggttaaaagtggagtagcctcatccccaatttccagatacttgactaactggaaacttactgctatgatctctttgccattccagcttaggattcattggttccctctaaatatgatcagtagagaatatggtcaacacacacaattgatactgcctcaccataatggacttcccttttctcatatcaagagtagtctgcctttccatcctccataaggggttgagcatgaagctacagaagtcaggtagcttcttccatcacctagatctgggaagtggtccagagtggacaggtcatccactcaaaaccaaggttaatgaaaaaaatggaacttctaggaaaagaaagctactctttccttctttccttctagaagtgaatgagagctttgtcatccatcttgaagaggagagaagaacttgaggctgccacagaccatcgtatggagctgacttggagccatagcgaaaaagaaaaacacgaatgcgaagaaagagaaactagatcctgtccacagtgtttgtaccttaaatctacccttccctgaagttttccctatctctggactttttaattatgtgtggcagttagttttctttattacttaagccagcttgagcatatatgtgt

SEQ ID NO: 32335 - DNA, 1136 bp, Bovine  19866880968941
ctttgagaattccatccagcttacactgctccaagacatctagaaagttcaaagttagaacattaacattgtgcattcaagaatattgtaagggaaaaataattacccatttattagttgcatgacacatttattagttgtgtattttgatactttgtgctatgacttggagaaatgagaaatgtattcattcataaagggctcaaatttaacaaaaaattcacatgtatgaaaatatgagtgaacaaataataagtcattaatacttcatgtaattaaaaagtatgatgtaatataagctcatacaaagtgctgattttctgttgtagcaataaacaggaatatgattgaggtttaccaatataagctgtcattgatcagggtcttatgtaccagagaagtaatgcctacatagactcacacatatatatgataggtatgtttctaaacttctgtgatgacaaaaatcacctggggaatttatttcttaataggccttctcttgacctactgagatgaactctccagagcagaagtttgagaatctgtctttttaataaatgattcaattgtttaagttcaggcaggcttagcaaacattgcagtcttcacaacaattccatgaaaacattcttcttcttcttttatagttgagaaaactaaggttagaaagattaattaactcctcaaaggactcctaaactagaatacaacaatctgactttcagaacttttgttcttttcaccgcactaaaattttctttgttctctgagcaaatgatctggttggatatgaaaacatagcattaaaataattatagaaaaattcatttctactactgcttgaaaacaacattacaatctgttttaaagtgttaaagaatattgagctcttaaagtaagaaagactttgttcaaggtggaaagttaagatgtgtgggaatgctgaagcttttgtgtttcagggaaaagttggacacacatttgaacaagaaacgagatatcctgtagcttcaaaaaactaaggaaaaggcccagcatgtagggaggaaaaatactccagactaaagaaaagaaagttgttctgacaaagtacataggttacctcaatcttgttttctaactttctaatctaa

SEQ ID NO: 32336 - DNA, 1227 bp, Bovine  19866880973776
tgggcagatgaatgggtaaagaatatgtggtacatatatacagtggaatattactcaaccattaaataggaacacatttcagtcagtgctaatgaggtggatgaacttagagcctattatacagagtgaagtcagaaagagaaaaacaaatacattgtgtattaacatatatatatggaatctagaaagatggtactgatgaacctatttgtagggcagcagtggaaatgcagatatagaaagcagacttatggacagggtagcgggggcaggaaggagagggtgggacgaacagaaacaggattgtggaaacatatgcactaacatatgtaaaatgggacaaccaacaggaatttgctgtataactcaggaaacacaaaccagggctctgtgacatcctagagggctgggatgggtgggaggtgtgagggaggggacacatgtatacctatggctgatccgtgttgaagtatggctggaaaccaaacacaatattgcaattaaccttcgattaaaaataagtatttttttaaaagagttcgttatttacattccaatacataatttttctcgtttttaaaaatcatgttgcaaaacactgaggcactctgcttttccgagtgctccttcagtaaaggtgtcttgcattcagaggtaagactatgaaatcaatacacacctttgcacatctgctggggtttgagaacgtagccgcaattgccgtttgtcttgaatttggctcgatttaactgcatcattcgcccttcagactggtagttcagtgccactgtgcaagttcaaagtttaagagaattaggtaacatagcagcctagactcaagacccacggagaactgctcctcccagaggtatacacacctagctggcaacctgcgttccagtagggcagagggttgaagttactggaatcgatgcggtaggcagagggataaatcctcgtgagctgcttttggttataaatcatgaactgctctgatttctgctgaaccacttgatgtgctcttgtttcactgaaggataacacatttcctgtggttcctaacacagtttttaacaaagaaaacagaaaagtgagaactgcagcaaagaaaataccactcatgaaagatcctgaggccgattacaccaataataaaaggcagagcaaaagagcgaattcaaccggaagaggctcagctcctgagcaagaaagatctataaaatccta

SEQ ID NO: 32337 - DNA, 1831 bp, Bovine  19866880976238
cagttcagcaggcatctgatatggtacaatgataggaacagtgacattattaagggatcaggcttctaaatctgagaaatacaccatggccccatattagcctgctttaaaaatgcaacattaatgtgttaaggtcaaagctatgtatccattactggccttttaattacaagaggttgtggtttgaaaacaaattgatctaacttgttcttgtggatatttcaccactcttgaaatagaaaataaagaatgcaaaaaaatcatgaagatatgcactatttttatgttttccactctttaaggcttagaaactttttcagtttgtgttgtgatgagtagcatcaaaacacaggcaggaaaaagggctgacattttacgtaaccaccattacagttcacggtaagccatccataaatgattcatcctgcattctcttgactgctgcaaaattacggaatgtttacccattagtccaggagagcaggcaactacagaaactaaaaagaacaaaatactgatatggaacaatagctcctcctatatatacatttttattgataaaccatgaaagttatttgattgagccccttatcatgagctagagttaggtaggaactctcttccctcctgtattgaggaagctcaactagtctaatcatctcccctgcttactcaacctgaagggaagtcgagtgacacagttgaactcagatgctgtatctgtcattgtctttgggtatgagatgctcataggatgtgggagttttcccttgctttccccaatccaagctttacctggcaagtttctcactgtggggaggcctgtcccaatcccaattgcttgtgactagaagggtaagttgacttaattcttgggatcagatttaggaaacccacttgactctcacagtaagttacatcctcaacttggtgtttatcctaataagtaaattttggtctcaaatttgctattgtttgacatattttaatttgttctaaacccaaaaggaagaggagagttttttggcatcttttcaatgcaacatatcataatgtgggaattgaaaactgagaggccacaacactcatgccggtaagcttttggtagggccaggacatgtggtggtgagccttgaacttcagtgagtaggcatggcactttgaacttagtggtttgtagaggtttatattaaaccagtgtatctgccactgggccactggatggaaaaccccaagtcagcaaattgttatattgaccttgatgggtgactatggcttgcggttgtttatccataggctaaagactgtttctccagaggcaagtgatctcagattccgttatgatgttttacgtacctggtagtatggcatttatacagagcagggccatgtttgaggaacgtccaatataaccacgtgctaagttgcttcagtcatgtccaactatttgcgatcccatggactgtagcccatcaggctcctctgtccatgggagtctccaggcaagaatactggagtgggttgccatttcctcttccaggggatcttcccaacccagggactgaactcgcatctcttctgtctcctgcattggcaggcaggttctttaccactagcaccacccacaatcgtggactaaaatacaaactgatatcagtgccacttagaaactttaaaaatgaacaaaaacttattaagcacagttccttctgtattttgattgtggtggtggtggtttagtcactaagtcgtatgtgactcttacaacctgttggattatagcccgccaagctcctctgtccatggtgtttctcaggcaagaataccggaa

SEQ ID NO: 32338 - DNA, 1019 bp, Bovine  19866880995731
actgtctcttgggctatagtcttcaataagttcccaaacagaactgaactcacagctgtcacactgtgctttctttactttttcagttgacactatcaatttttattcctttgccagtatcctgtttttccatttggaagcttgtggagttttcctttgtttttggagttcagaattttcaccatgtatgtttttctgttaaccttattcaacatttattaggtctttttgaacaaagtttagaatttttcatgaatttagggaaattttcttttataatacatttgatttttcccttctttctttcctcttcattaactcttcctggaaatccagttgtttactggatttctctctctagcctttcttgttactgaaagtagggtctgggtgctcgctgctcgaaagccagtaaagaagccagattggtgaaaagaaaaatttgctttctttcagacaaccagggtagtggtcggggaagagacacatgtctgtccaaaggctgactctgcctatcctcaacaattaggagacgagcttttatagacggagtgggctacaggcagaaatagcagtcagctcagacagtcaccttagtctgaccagagtcatcttgattattttaagtagagttaatcttcagctacagggtcagtttgtttccatttctttgaggtcgattcttggaattgtggcagcttatatcatggctacagtctggtcatgtagttaacatctcacttggtggaggtttcagtatccataagatggctcatgggatatggctcagaatattatctatagcccttgagaaagaactaaaggtccttgatcttgcttattgaccaaactattattgcattgtcctttctgactgcttttctttgcttttgcattttctcacttctctgattaaatttattctttggctaaagtttttccacagacaaaaggcaagcggaggacatgcgtgggggtgggggggcaaggaccataaggtcctgctccatttcattctc

SEQ ID NO: 32339 - DNA, 2501 bp, Bovine  19866881020435
cccccctctcctgtgcccttctctctatctaatagtcatcccccattattccacccccctaattcttgctcatcctagcagactgcttaggcattgtccctttggcaaacttacccatgccacaatttatttaaatgctccttttcactgtccttagcactctgagcatatttctgccatatcatacagcactttcttgcaattgttggtgacttgcctccttttatgtctttaggatcatgagctcattgaaaatatgtggctatgtcttattctttaaaaaaaaaaaacttttcttttttggcgggggagggagtgctgtttatgacttgtgggatctcagttccctgaccagggagtgaacgagaaaggaaggaacctggggcaccacagcaaaagcccagaatcctaatcctaaccactaggccactgggaaactcccctgtattcattctgtagtgcctgcaatataccagatattcaataaatgacttctgcattaaaaagaggcaagttaaaattaacagttgcataaagttagtcttatagaccttgctgctgctgctgctgctaagtcacttcagtcgtgtccgactctgtgcgactccatagacggcagcccaccaggctcccccgtccctgggattctccaggcaagaacactggagtgggttgccatttccttctccaatgcatgaaagtgaaaagtgaaagtagtggcctttaaaatttctaatgtttggtcttctcattaattaaatatgaagttaaaatgctgttctgataagagacacttgctgcatagcaggtttggattctggtgtcttctacatggaagaatctcgaggactcaattatgatggatcaatttaccctgattgctcctcaacttagccaggttgctgaaggatttgcccctgaaatagagccttgagaagacctgctatctatgtactctggtgacgaccatgctaacttcaagtttggaagaaaacttaggaaaaaaggacttcaaatgaaagtagtcaataaagttgttaacaccttttatttatttatttttaattttattttatttttaaactttacaatattgtattagttttgccaaatatcgaaatgaatccgccacaggtatacatgtgttccccatcctgaaccctcctccctcctccctccccataccatccctctgggtcatcccagtgcaccagccccaagcatccagtatcgtgcattgaacctggactggcaactcgtttcatacatgatattatacatgtttcaatggctactgtttttaaaagtcatctgtgacggttcattctatccactgtgagccctcagctgtgaatgagagcatagcttcctgcccgcggtctaatcagacatcgggagggcaatcacgcccccctagtgtcagagttttaggttgcatgttgcgttagatgaggaaggcacctccaaaggcaagaaatctaatcatttaatagaatttgaatccacggacagcattgctttcagcagcttggtggtctatcccaatggggggcttcatagagaaagaggcagaggggaacaggggaagggtctgactctgtcatcggatcaatacaagactcttcaaccattagatagagtggatctttgtccttaaagagtacagattgcaatcccaccttctgatgtttcgatgttttgatatattaatattccagtattttgctggcataatgctaccattatggtaatttaaaaaatctgaaacgcatcttgagatacatttagagagttaagacactgagggaattttcaaatggtaaagtttactcatctgcaaagtgttgttttatgcctgtataacattcaagaagagaaaaaaaatcaactgacagagaatctcttgcaagaatgagtctctattatcagactttagaaacttcatttctcatattatcccaggagaaggaaatggcaacctactccagtattcctgcctggaaaaccccatggacagagaagcctcataggctacagtcaatggggttgcaaagagtcagacactacttagcaactcaaaaacaacaacacagacttctgtttgactttgctgtgtgaatatgtaaacaaacaaacaaaaaacatttaaatgtaaaaacactcatatattgtgtttcagtgaaaacacaaaatatttgggcccctgtgcttgagaaaacaccgggaggaagagtccctttagggctttgactccaggtacccatgtaggaaacaactgagctctcaaactaaccaatagctttaagcagtagccatgccagtctgaattttcctcatgcttctggaattcggaaatgacagacacaggataactatgcggccaccactaatacatgacgagctcagtatcaagccaaaaaagacggaggcctttgtggatgcttttggatggttagctttgactatgagagacacgcctgtctttaactggcacttccagc

SEQ ID NO: 32340 - DNA, 839 bp, Bovine  19866881165040
ctgttttagtaattggtgaaaaataaaacaactttgtgtatatgctacaataaattgagaatgctcaataagcaagttataaatggaatgcccatcatgaagaaaggggggaagaggagtaaaaataatgaattttgaattttgatataaaaagcatttcactgaggttttgagaattttctctgtctccaagagatgaaggaagaacatcatgtgaccataagattatagagtaagtctgcctcaccagctcacaataaagtttatgtctaactacacacaagtgtctacttttgttaaggcctgaatggcgaactctaacttgtcacaagcgaggattaagtacgtagaccaatttggttggttgctgctgttgttcagtcatgttcaactctttgcaggccaggtttccctgtcgctcaccatctcccggagtttgctcaaacttatgtctactgagtcgttgatggtcagttaattcatagcaaattcctcaaacagcctctatttaaaagtggcctgaggaggggaggtggggaaacaagcatttcttgacattttaacacataggaagatgtttagaggttatctgtcctaaatagcagcatttgctgacatggaaacttggtccaaagcacaaagttcacagcaacccagtgggagggtgacccctgcaagaggcctccctctttttgctgagccttcactgcctctggctatttgcaagatgcccttaacatcacagacccgtcctccatgctttctgcctgagtatggggctaaagaggaatccactgggcaaagctgcttccaaaattagttctattaaatttacaaca

SEQ ID NO: 32341 - DNA, 695 bp, Bovine  19866881201210
ttcgaattctgaaagggcacatgatccaaatgaggataaattacctcttccaggcagaaatattctcattttcatttagatatgttggagtttgtgttttttccctctttctgttgttacagcttgagcaatgttctatcatgtgaaacagaattggctctgtgcaagcatctggaagaatattaaagccacatttcagcctggtatggcatgttgcttactttgagggtggggctggggggaattgtagttcatggttttaataatcaaatactccgagatgaatatcaaatctgatctagaaagaacatcaaattatgctctcccattctcctttccccctttccatccctccccattgagcttaaagattttcaagtaactttttcctgagtttctaccaaagtttctatatgaaatgctaacacacctgaaagagagtccttgcctccacaggacagtcacatggagtgtccaactacacatcaagtatctatcacatgaaggagagccatagcaagggctttaatggagaaatgaaatgtgatgaaatccagtgtaggtaaagtttacatcagcctgagggtatcagagaagatatcacagagaaagagacatctgagcttgggttaaacagtaagcaagaatgtgactagtagaaaaaatattaggtaagaatttcaagcttccaagta

SEQ ID NO: 32342 - DNA, 850 bp, Bovine  19866881254276
ctctgggcacacgagcaaggccagccattttttgtgacagcatctattgtatgaagttattatgtgtggaaacttgtaatcatgtgagcacagcactggaccagttctagagattaatagctgtgattatgagaggccctgggattaatttttgtgatgaatattactctgtaatgggattttctgcatctcaaagaataagatttgctaatggaattaaaagcacaaacaagggaaatgcttattagtttatgagcctgaatttgcatttaaacaatgaataggctaattacaactctgatctgttcaagtacaaggctttcttattcccttctcaaccagcattatctttcttccttgggagtaatgagactgtatttcttttgaaatactctcagattcaccagataaacatttgtcctcatatagggaaaacttgcaggactttataatttaaaaaattttattattactttccaaagcagaaataaattcacagaccttaagggaaaagataggggagggataagttaggagtttgggattaacagatatacactactattataaaacagataaacaacaaggacctactgtacagcccagggaactatattcaatatcttataaagacctgtaatgaaacagaatctgagaaagaatatatacatgtgtacgtgtgtgttagttgctcagttgtgtccaactctttgcaaccctatggactgtagcccgctaggtttctctttccttgggattctccaggcaagaatactggagtggtttgccatttccttctccaatatatatatgtgtgtgtgtatgcatatatatatatatgacagggctt

SEQ ID NO: 32343 - DNA, 1021 bp, Bovine  19866881396787
tgtttaggaaatgaactttcaatttgcaaaatgtgaggattagtctagatgaattccaggtttcctttcagctctatgtttctctcaaactagctgacaattttgctcagggttggttgggaaaagctcttctattctttccatatgctgagagaagacaggattaaggaagcagaatggcccacggtgggcactgactcctggacaggtaacagaaatgttctgtacaatccctgccaggtttagataagacgacgcagccagaggaggcaccatgtgccagacttggcaaaaagcactgtcgtgtagcaaggagcagtcacagggcagcgtgttacatgtgaatgtgattgtgcttgggaagtggtcattccaaaactgtagcagcaaaggtgataatcagagaaagctagttaagttgcctataaaagtaggtgctggaccagattcctgggtgtagtgtgattaaaatgactgtgtatttgtcttcctgtatgtaaaatgtaatgccttttttgaacaagttttccaagggatagtcatttgtttacctcttttcaaagaaccagtcttccctttaagtatgttattttaagtggcagccaggttttgccacttgatgtagttaaaatgggcagaagctttgcatttgttcctgcaaattgctgaggacctgcctgtaccctagactgctataggcttctggcaaaacctgttttgtattgtgatatgaggtgacccagtatcaaaaccttatcccctctgtaggtaaagaagatgatattagaaactgaggagatctgggccactgaattatatcatttacaattagcttgagggtagcccagctgcctggccttcaggttgtcagttaatataagaaagttgcatctgctggataatgaacccctgtgacaatgatcatctcctgggtatccatcattgaaaaataaatcctttcagcatggatcagatgctgctggtgtttaactttcatgggctggaccattttctggtccta

SEQ ID NO: 32344 - DNA, 4091 bp, Bovine  19866881521455
gatttgcacttgttgactagcgaggaagcctgccatctgcttggctcatgaaatcattcagaaagcaaaatgaggtttgtgttacatttgcctcttacagtcatcagtaacctaagatgtttactgagattggggttccttgggtctgatctgccaggctctgattcactctttagttttctcttttgtggagacttcacagcaaacctactggtgccaaaatgatacgtgatacgtttcacatctgtatggagtagtgacatgggatgtgcattccagttactaagaagggtagggaagaaggaacttgaaaacaccatatcttgtttacttaaaaaaacaaatagcatactttccttccagccatgatgttgtaatagggactggatgctatcttcaacataaaaaacaaaacaaaacaaaacccagaaaatcagataaaatatgtgaaacaaagactcccatgaattagccaagggcagtgcaggactgtgatatttgagaaaaaaacagtcaaatcaataaaatgaactccacaatcggctcaatgtaccacccaaaggcagtttccagtttgcagagcccagagatccggctgagtagagaagatagaaatcggaattttgagagagaaagtgcctagaatttgtggaagagaagcccagagaagagagtgtgacccggagaattcctgagatgggcagatgggtcctctccagtggttggctgagtcttgacctgcagaagtctgagaaaaaactccccgaggctggggaaagcccattgacagcaacaagtcaaatatttcccagagctcatgctgggctagaaatagttcatggtcccatcagccagagtggggaagccttgtaagacctgggcattgagtagagggcaaagaagggtgttagcactagactaaaactttgaaaacaagtttcgggaattccttggcagtccaatggttaagattttgcatatccactgccaggtttgatctctggtttggaaactaagatcctgcaagccacatggcatggccaaaaaaaaaaaatagtaataataataaataaaatgaagtttaaaaaaacaaatttcaccaagatgagactgttcctaaaataatttaattgcatgctggaaccgagtccaatacttcttaaatccagtacccaaacattcaaaaatcacaatatccagcatgcaatccaacttggcaagtgtgctggtttcccagggatgctgtaactaaggaacacaaactaggtggcttacagcaacagaaatggattctgtcacagtcttagaggctagaaggatgaaaccaagggctctgcaggactgtcctccctctaggactctgggtagagccctcttcttgccatttctgagcttctggtggtggttgtcaacccctggcactccttggcttttaagtgtagaatcccagcttctgcctctgtcatgtgatgctctccttgtgtgtttctgccctgtcctcttttaaggacaccagtcatattggattaagggtccacccatgtccagtatgaccttatcttaaataattacacccacaaccagcctatttctaaataagatcacactctaaagtacgaggtgtaatgtgctaagcctcttcagtcctgtctgactcttagtgaccctatagaccacaggctgccaggctcctctgtccatgtgaactcttcaggcaagaatattggagtggattgccatgccctcctccaagggattttcccaacccagggaagatccaacccatgtctcttatgtctcctgctttggcaagtgggttctttaccactagtgccacctgggaagctcaccagaggttaggacttcaacttatcttattgggaacaaaattcagccccaaataccagacattcaaagcagtaggaaaataagacctataaccagaagaaaaattcatgagtagacacagagtagaaagtgttgtggtaacggaattagcagacacaggtggtggccccagtggtaaagaactagcctgccaatgcaggagacatgggttcagtctctggatggggaagatcccccggaggaggaaatgtcaacgcactccagtattcttgcctgggaaatcccatggacagatgaacctggcaagatgcaatccatggggttgcagagaattggatatgactgaagcaactgagcatgcagatgctatcacaactataataaaaatgcaccatatgctttattttggatagttttattgctatgcgtttttgggttttttttttggttattttttagataattccactaatctctataatagcataaagaacagagataaatactagaaatcataaagtaactcctaaaaaagatctctatgaaagtgagtgatggatattttcagaactgcttcttcatctctaaaatgggaataatacttcccagataaggtgcaataatcaaataaaatttttataacttacctggtacataatcaactcataataaatagcagcaattcttgttactaaagcctgaggcaatgattaaagcaattataggtcaaacgattacagacctatgatggatgaggctgaacacagtcagtgtaattataatgggcttgattcattgctcttggtaagaactttactaatttggacaagttgggatagggaaaaagtcaaatctgactgatgagccatcttaattacagaatatttttgaagaaatggcttttgattacttttaactgtatgcagtaattagaaccaggctacaaagttttgcctagtatatatccttaagggactggttttaatgattacataaaaatgatttttcattagcataacaaggctttcagctgttgtaaatgagtttattttcataagccatttttctttagcagtagagtaagttctattggaatttgtccatcaatgaccatgtggcaattccctcatggttttgggtatcagtcacaaggctccagctgagggttctagccttggctgttggcacatctacatcctggggagcattcctgtgactgcacagcctccagtgacaccacttctttcctgtggtcctctcacctgtgatggtggctgcttcctgaaatgagtaatctctgggtcatttctgcctgctactttttgctctttcagtgttccaataaccatataaccaagtccttgaattaaattccctctgttttattttttaaaattttaaattggaggataattgctttacaatattgttcatttctgctatacaacaaagtgagtcagtcttgagtatacatatatcccctctctcttgcgcctccaccctcccccatcccactcctctagatcatcacagagcattgagctgagcttcctgtgttatacagcagcttcccaggagctatctattttacacatggtggtatatatattggagaaggcaatggcaacccattccagtactcttgcctggaaaatcccatggacggagaagcctggtaggctgcactccatggggtcgctagagtcggacatgactgagcaacttcactttcacttttcactttcatgcactggagaaggaaatggcaacccactccagtgttcttgcctggagaatcccagggatggtggagcctggtgggctgccatctatggggtcgcacagagtcggacacggctgaagtaacttagcagcagcagtatatatatatgtctgtgctactctctcagttcatcccacctttatcttcccctgggggcttccctggtggctcagatggtaaagaatctacctgcaatacaggagactcagatttgatccctgggttgggaagatcccctggagaagggaacagctacccactccagtattcttgcctggagaattccatgggcagaggagcgtggtgggctatagtccatggggttgtaaagaatctgacatgactgagtggctttcactcactcactcccctttccgctctgtgtacacacgtctgtcttctgctcctgcccagtagggaaatcccctctgttttaaataccggccaactatcccttcca

SEQ ID NO: 32345 - DNA, 1073 bp, Bovine  19866881532499
atttcaacttgatttaaaaacaatgtaagtagctttcacataaggaccctgaaaaagggagaaagggggaaataactgtcccatatcatttccattaactaaaatattttagtttaattataaaagaacaatgaagttttactgtttatttacaaacagggctacatgaattcaggagaaaggggaatttaaaagaatgggctcagagtcacatatttagggaaaagagttagatctgtaaaacatttcttttcacgcttaattctactttaagaaaacattataactacattaacccactaactggcactcacacaatttttagtagaattactgacaccttttctggtttccatttaacttcaaatcctaatcacagaaaagaaaccttactccttccctatcctcccaagcctttccccctagaaactcacttgatgatcatgtaaacaaagacaaacttaatataatctatttatgaatagtatttcaaaaatgagaactatattatagtcacatgcttttacaattggaaagactgcacaacaaatactgaaaatgttagttgtacattatcacagctcagaggaagagagaagacatgctgaagaggcagaggacacggctttaaggaaaacacaagccgagaacaggcatccagggcctttcctgcagtcagagacttctaaagccacagaacatttcacatcaagaaggataaatgaggacatgacctctcagttcctgtccttcaaagcaaaagcaagccaatcctatgacaattcattctttgaagttttactattggttatagatgataggtgtttcgaaactacaaaatctcagcctgaatatttagttcctacaaccttattcactccataagcattcataaaatattacctttttacatttttaaacttgtatacactttcatatttcttttttgtaagtcattcttatttcaatattagcagaaagagcagaagttatgtcacaggtcagtgaattcacacaactcacctgcacacccacagttttaattggtagcaggaaggcattcagtgagtgca

SEQ ID NO: 32346 - DNA, 662 bp, Bovine  19866881884153
cacagagtcggacatgactgaagcgacttagcaggagcagcaggagaagcgacttagcaggagcagcaggagaagcgacttagcacagcatagcacaagtgagaatagtacacaccaagccctcactgtgagctaaataaaatcattgctttattgccactaataaattttagattaattatccagcagaaatagtaaacatcattaaaggtttatatccttattataaacttttaacaaaatataaactacttagaacagggtttagcatatattagcatttaataagcattaatatttattctccaggttagatactattgcagcactaagtttcaaacttctgcgtatggttcccttttaaatttttgaaaaactaagcatcaacttaaatattttaaatatgcaacctttatcatcttaaatttaaatagtcacaaaagatgccacatccagcatattataagtattgttgtttttaaaataacattgttaacatcactatcttaaatgcacccaatggaacttatatcccacagctatttgatatctatcatcatccatttaaaaaattcatgagcatgctctttagcagttggaaattttacattctccctttttctctctgaacttgtttttccagtcttttcctcagccagaat

SEQ ID NO: 32347 - DNA, 1194 bp, Bovine  19866882038479
gagatcagtaaatcatcaaggaagcatcatttcaaagaactgttggctaaagggtggcttctttctgtcctgtgaaacaaagcaaaattaaatatgggtaatactctgtttgttttagaattcagatgtttaaaaatgtgtaacaattgcttccaactgagggtatgtcaggattttgctgtagggcaagtccaaatcggtttatttgaaaagcatgtgtgatctataggacatgttctatgtcattctctccaatgatgaataaacagctaatgttaattaagactaatgtctaaaacccttgtttctgccattttcagtattagtttaataggcactgaatggaaacctccaaggtctttctctactcttcgctgaaatttttgttgtacactgtgtttgcagtttaagtttttggttgcactgtgttgtctagcagctaaggattgttggcaatcatctgttaagcgcatacccagggtgtgcaggaagagctactgctgctgctaagtcacttcaatcatgtccaactctgtgcgaccccatagatggcagcccaccagggtctgccgtccctgggattctccaggcaagaacactggagtgggttgccatttccttctccaatgcaggaaagtgaaaagtgaaagtgaagtcactcagttgtgtcccacttgaagcgactccatggactgcagcctaccaggctcctccgtccatggggttttccaggcaagagtactggagtgggttgccattgccttctccgtgcaggaagagcacgacgttattattgaggctataggtactttgtatacaccttcgtctctggagtgccttaactcctgccttgaaaaatgaactcatggtagcatttcattttgtttggtgggactggaggcaaaaattctagcaatttttcatcatagtcctgacagcgttttctaagcctttacataaaggcgagtccctcaaataggcctcaaataggtgatgaataggccacaggcatgtactgtgctggtttgtttgaattgatgtatgatctctactcttttaatccatttaactccaaatttgcagcgactgcataagctttaatctagtgagttgagtccattgtaaatataaactgagagcaggttttcagtgccaccccctagattaatagacattcagaggctaaagtctcta

SEQ ID NO: 32348 - DNA, 1262 bp, Bovine  19866880363375
tgttttccatggattaagttaaaataaaatgtgctaatagtatctgtggctggtctgtatacaattaattaatttgacgttgttaggaatcagattttacaggccacaaacaccatatatttgagagaaagatgttcatgtttctttttttttttattttattttatttttaaactttacataattgtattagttttgccaaatatcaaaatgaatccaccacaggcatacatgtgttccccatcctgaaccctcctccctcctccctccccacaccatccctctgggtcgtcccagtgcaccagccccaagcatctagtatcgcgcatcgaacctggactggcaactcgtttcttacatgatattctacatgtttcaatgtcactctcccaaatcttcccaccctctccctctcccacagagtccataagactgttctatacatcagtgtctcttttgctgtctcgtacaccaggttattgttaccatctttctaaattccatatatatgcgttagtatactgtatttatgtttttccttctggcttacttcactctgtataatttctgattttcaaccagttgatcagtctcttggcttaaaaaaaaatttttccccccaggaaagggacagcaattgaattgtattgtgttggtggtgttctagtttttacaaaatcaagctagtatgcaggaatagtaactttctttcagctgaaagtctggtatagattttaacatttggacattggagccccttcaaatcccatctggctgttaatcagtgaaggatgaaggatttacaccaagaacctcaattccaaggtgtcattaagttctatagggtcaataattcctgaaagtgaatttaaacaacaaagaccaataattctatagacattgctagcctgcttctttggagaaaaaaaagaggttgagaggaggaagggcaggggcttatgtatgagagatcagaaaaatggttagaaaagaagaaacagtccccaccctccatgaattctagactttcctttgagctcagaaggtgcccacttttctgtggtaaaaaatgctttcaaatatgtggttgtattttgggatcagtcccaggtagacaggtttcttcctttccaatgggtctggtcctgagattagttaacacccctttatgatgtcattcagctccctagaaaggagttggggcagagaaatgaacacccagtgtagtgagagagcggacacattgcatgcctcagttacat

SEQ ID NO: 32349 - DNA, 2177 bp, Bovine  19866880374412
tattaacagaatgtatcaagttgcttgtgaggcttcattcacagtaatcaggaaaagaagtcaagtagacacatttatcatggtgacctcggagtctgtaggtgaggtgctccaaagggagaagatacctttgattaagttaagacaaactataatggatgagagttctgctcaagtccaataaatcaccagagccttcccaggctagcagggataggaatcattggtaaattaaaacttgctgcaatggctatgctgatgcctttagtgtgggctctgcctggacaactctgcgaaggaaagctggaaaaggaagtctaaatagtcttgagaggatctctgtgattgatgactataaaatgtattacccagtggactttttcagggctatactttaataaacctctgtcccttttaagtgtgggatatggtgaaaggtcactgggctcaattttagcaatcaaactggcaggctgaatggaagtggtgttgggaccatttgtgtatgtgggatcagtctctcctctgagggtctgagagtcagaaggtgtcattggaaataagaaagtgtgagtctttttgttttggatggtctctgtgcctataaatttttgaacttttttccctgggattctgaggccatgaataaaatatgagtatgttctatttctttttttacttaatgagagattgcctcggatggtaggccagtccctgcacagagaaagccacacatggatttattaactcttcggaaatgtttgttcggtgctgagtaatgaggaggtttgccagggcagcaagataaaaggcttccccactttgtgtttatcctctgggtaatgaaaaaacaaattggtgattttgtatttttcctgttggaaattcgtaaggtcaccggaggaaaacagagaaggttaactggcatgaacatttgcctgtaagcatggtgtcaggaaagaaaggtcacaaatggatgaaatacccccacaccacaaccagtgccactgcaaatgcagagccctaggacaagaaatttcattcaatgaaagcagaattttgggaatagcactgactggtatacaaagaatccttcattttcagcatgcatgcactgggggggaaaaaaaaaaaccttttgtaaaccagtaggataatatcttcctttcaaaagtttttcactttttgccatgttccattatctcccactctgttggcgtttttttccttcctgcctttgtgtcctgttcctctactccttttgcttttatatctctcactgcggagaaaagctacgtgctgacggtcaaagggaggagaagctggtaaaactgaagctgataatctccgcagagttcaggacattcagacctgccttaagcttcatctgataacttttcttaacgtggagcaagataagtcctttgtttcctttgtgagactcatgaggaaccagagaaatgcgattgctggcatgtttgcagagaatctcagttgaatattttgctgcaaagttacatctgtcattccctttggatgaatatatcagtttggctaaggattctgttaagttagaaggcaaaggccatggtcatttcttaccagctattttattctagtcctttaggaatccctagtctgtttcatgacaatctagatgaggagaaaatgggaagaagaaaactcttctggctgactgttccccagaatataaaataatccccatccttgatggggacctgtcaccaggataggaaaactgaaggaagaatgagagaaagaaagacaatggaagatggaagagggaaaactggcaggaggaatggaaagatgaggggaataaaggaccagtcttaaaaaattaggaaaattacagaaaagagaaagtaactaggaaaaactgaactagaaagtgaagtaggtataagctagggtagacaaaggtcttgggaagtaagttcatccagaaaacaataatgttggatttcagttactccattagtttcttctgtccttcccaagtggaaaattgcagggttctgactggaaaaataacacctcttcattctctacaggaaggacaagaagactgggaggtgctcagaggaaaaggtctgtgcatgtgttgactctcagctttaaagctttaagaacacgatacggtcacagaatcatca

SEQ ID NO: 32350 - DNA, 2075 bp, Bovine  19866880491210
aattttctgtaacctgtgtatggtaaatggcgtgctgagtagaaatggatgaagaaactagataatgcccagagaagaaacaagtcaaaagaagtgacaggtgaccttaagtatttaggggattgattcaaaggataggcaacagactgactttacattgttctgaatatgggactagatgggagattggaattgatacgtatgcactactctatatatagataactaataagaacctgctgtatagcacagggaactctactcaagattctgtaatgaccaactggaaaaagaatctaaaaaagaatgaatatatgtataactgattcactttgctatacagcagaaactaaccaacattgtaaatccacttcaattaaaaaaaaaatgggaatagaagcaggagtgatagctttttaaaaaggagatttcagctcaagacagggaattttcgaggtagatgaacctaaagcctattttacagagtgaagtaaatcagaaaaacaaatatcatatattaacatgtacgtgtgtgtatatatatatatatgaaacctagaaagatggtatggatgaacaactggacagcaatagagaaacagacacagtggacagacttgtggagacagtgggggaagaagagggtgggatgaattgggagagtagcattgaagcataaaaattaccatacgtaaaatagatagctagtggatattggctgaatgacacaaggagctccaacctggcgcgctgggaaacctctgtacactttgtactacacaacaaaatgaatcatctagacatatgcacgtgcgttttggtgtacatgtgtcaagtcgtttcagtcctgtctgactctttgcaaccttatggactgtagcctgccgggctcgtctgtccatgggattctccaggcaagaatactggagtggatgccatgccctcctccagggaatctctctgacccagggatcaaacccacgtcttgtctcttatgcctcctggattggcaggcaggttctttaccactagcaccacatagaaagcccctacttatacatatattccctctcttgaacttccttcctgttcaggccaacacagtacattaaatagagttccatacattatacagtatgttatcagtccattctgaaggagatcagccctgggatttctttggaaggaatgatgctaaagctgaaactccagtactttggctacctcatacgaagagttgactcattggaaaagactctgatgctgggagggattgggggcagggacgacagaggatgagatggctggatggcatcactgactcgatggacgtgagtctgagtgaactctgggagttggtgatggacagggaggcctggcgtgctgcgattcatggggtcgcaaagagtcagacacgactgagtgactgaactgaactgaactttatacatatatgctatacttcaaaaaaagccccggagccagtatatttccaatgagagtatatctgtctttatggtttcgtacaattttgcaactctagaagtatctctttacctggtaagttttatagggaaagaaaaagaaactttttctatttatcaaccatattcaagaaatgttttcctggtctgtaatttcacttttgttttttaaaatggcaaccccttggagattcgcctgtctaaatccattttcttgtcaggattggagatgacaggttattctaatatctaaatattaatttctatggcatatctatgtatttcatgggctaatcttctgtgaattttctggatttcgattagcttgtcctaaactcctggcaagctaaatttctctaacagttttcaattcgttgcattaaatgcctgttcagccttggaagatatattgattttttttttctcagcaaagtgacaaataccattttcatgactataatagagattgattacattttatggcacacagagagaatgctgatcttagtgagacaacattggggcttacaaaaatgaaaaaatcatttgaattaataatgaagttaatgaattcattggttgtagatgaag

SEQ ID NO: 32351 - DNA, 706 bp, Bovine  19866880524109
aggaggaagggaaggaaagagcacacagtctctctttaagaagacatagggtagatggcacaccctgcttcctctcaccacccattgtccttggccacaccctttacaaaagaggccgaaacaggaagtcattattctaagcagccatggggccatctatcacggagtgattatgttagagcaggagaaaaggagaatggattttaaaggagaatcagcaaactcagccacactattcctgaataaaacaattacttttatgtgttatttcccaccttgggataactattctggtatactgtacattttccaaatgttactttttctatcagaaggagaataaaaaagcaaaacagttttcaactatttctagtattcaagagatattgggcattgtatttggtgctttcacatttgttatctcctttaattctcacaacaaggtattgtcctcattcggggaaattaagattcacagcactgatatgagaaatgggagtatttaaagcttaagcctctcctaattttctcccctatgaaacgtatttagctaagttcttttcctccttagaatctaatcaatgaccccctattcaactctctccatgaccaaaacctttttctgaagcaccagtaaataagtcaggattctgctgtgcatctgtagaaaggtaattaccaacatttgaaatgagaaatagaaatt

SEQ ID NO: 32352 - DNA, 1954 bp, Bovine  19866880597717
atctgttttaaatatttacattgccttaaaatgttgaaatacttaacttggggatcagttgctttcccataaaatgttgtaactgtgtattatatttccaactaaaaatatagaggaggatttgtaaaatatttaggttgaagaaaccatagcacaaacctaatttataaaatgttataaataataatgaagcagttttctcattagaagctgtttcctcaaataaaggcatacaaagtagtttatttctgtagtccttttgaaaaaaaaaaatcagttcatcagcatatctgaaatccatacactgaactggcagaaaatcaaaatattaatttatgtgggagaggaaaacccctaaagattttcatttaaatatctatatcttggactcattttaggttctgatttaaaatcaggggttcaatatttcacggccgattataaggcagaatccagagaattagatgagacattttctgactcgtattatctccttgatgaaccaaaaccttactttcagattcattttccgtatgatttccctgttggatacgtcctggatgctgcggtgagaagccagcaggaaaaccccagggaagaggtcagaaacgatgctatcagagacagaaatgtcaagggacaaggactgaaaattggaaacaatgagagagggagagggagggagggagagagggagaggaaaaaaagagggcgcgagactgagagaggatttgtatgcaagggagcaccatgtaagaaataatacatggagtactgccaccaacatgatcgttttggttcctcttatttaaaccctctttaagccttcacttgtaattaataagaactgctatttaaaaaaatttcagaaggacttctgtttagtgttgaaatataaaagaaaaaatattggcctttcatcatctccaaaaagaaaaagaaaaaaaaaaatcccacacgatttatgtacatactttgtaatcaaagccccttttatgtctcttggtgctgatcataaacagaagccaaatctgatcgccccaaataataaaacagtggagaaaaagataatgcacccttaccatttaaacacttggacctcatcattaaaagtggtccaagtaagtgctatgaaattaatcctaagaatgtaggacactgaaatttgtatagtaggggctggttttcagtatagaagcaactactgagccatcagtaatagtacactttttatggttgttttctcaaaagaggtgctggcctacagagctaccatgctggccaccaactctccctaacccattctcttgggactaatgctgttttctatgtttgtttgtttgtttgttttggtaaaagtggaaaaaacacaaattatatatatcagtgctagtattcaattgagaaggttacttagcagatagtagagttctgatgaaagtgacaacttatcctgagaggaagaaattagctgtaaatttggtgaagaaggcagctgaatttttatccagaaaggccaattgacatatacaacctgaagcataatagcaaacatgtgatggagagccagctgaaacttaataagtttccccactgaagtgcatttgggaggttgttgggggcgggggttcaaatagagataaacagcaatccaagacgggggaagcatccttagaggcaatcattttttaaacaaaaaacataaaggcttatgtatacaactggtatttacatgaattcctcccactaatgcctgggactttggaagacacaccaagagataggaggtaagcacctgcctgtgcagatattgtcaacaaagaggatttggaattctgatctattatgtaaaagcctataactggtgacttttacctggggatgtggggaagacgggcatctagctgacctctaaatgctagtgtgttcagggcttaatcctagcctccttctt

SEQ ID NO: 32353 - DNA, 1485 bp, Bovine  19866880614831
gtggccttttgctacaaattcttgcttcctaatggtgatgcagaaagcgaggaaaacggtgtttggaaaaggttttgtttcgccttctaacagatgtatggagctgcccttctcaaatgaaaaaacaagcaattcccccacaaataccaccacctgttgttataaataaatccaagctgtaaaatggaacacactcttaatggcaaaatcattacaggcatcctacccccctcttgccaacccttcattatagcctcttaacaacttgtttctcagtcatgtacctttttaagctttcgaccggccatcaggccccatccctaaccaagaaagatggcctgtggatttgtggctaaaaataaaaagttaccaacctcagggagaatgatcacacatccctttgcacagtttaagcggctagaaactggctacgtgccactccatatttagggttctcttaaaatcttaatccagacatccagtggcgtatttcacagctaatgaacctaaccttcaagtaggagcataaaatcctaattaaatcaggacaacgtgaggttattggcaggctgtttataattcggcagagtcttgtttctatgagtagttataggaaaattataaagcattagaaccagaatgttgtatcctttaattactgtctccaaactcctttagtctacagactgtgtcactctgtctataaacattgattgtttagcaggcccaggatattatacttactaaaatattgtgtttctcacctgaaactcagcttcttgcctccaatctcctgggagaagtttcatatgaattatttcttctgatgaaagaggtcttgaggttataaatttgggggaaaagctttgaaaacaaaaaggttcagagattttctgtgtacaggaaattcaaatagggaaaggaagagaaaatattagagatgaatgctaacttatttttttcttccaaggaaaggttggagggagggggaatgttcctgcaaagattgcaaaactccatttcataaaagatttattagcaatgacagagggagattgctgagtggaaccctgataaatgccttgccttttttcactgctttaaaattatgggttctgtccataaagtactgattaattcatattcattcaatgacatactctctttttctcccccaagcaaagattgtaagcattttacttcaacaaataaagaactctgggtgggatgcatactaattcatttagctctggaattcgcactacaatttatgcagctaatcacagcaaagcaggagagattcttttcttttcctgtgacaagtcctgcctacctttcagcattttttacccccaaaggtattattaatctctaaacttcaaaaaattgaagacttatctcagaccctttaaaacagagtggcatcatacgtagcaactcccaaagaggagaagttgctttgcctttcgaaaagattgactgtag

SEQ ID NO: 32354 - DNA, 1650 bp, Bovine  19866880679137
tcatagcagagtctaagagtcatactccaaaaccctcccttaatgtctctgtcagttttctctatggaatttgggaaagaccttatgcccttgtttttttctcacatcattgtccctggccctgatcttcatttggttgctattttacaaaacatgctgatgaggcatgagacactatcctttgttggagatggtgatttgcttttctttctcctctctgcaggtccaagttcttcctttccttcaagctccaaatcagtttttaccttccgtatgcagtcttccttgtctttctttggctgaattcctgtagtacttaggatctatattcgaaaacttgattaccatcactactgtcttttccccttctagtaatagtgttagttgtgcaaactacgtctttaaagagcctttctgttttttgatggatataaggacatttgtgtctttcctttactgcctgcaggacccagattagttctgaaaatacaggagggactgaacacattttttgtcactgattgatttattgagacttcagaatgtcatggatgttaaaccaaacacgggcaagtaattttgcaattctaaataatatgaaataattcaatggggacttggagttgggggtggaaaggtagattttgagagaagtcaggaggaaaaaaaaagtatttggcttgaactatgatgaatggccaggagaaatatcaataacctcagatatgcagatgatataacccttatggcagaaagcaaagaggaactgaagagcttcttgatgaaagtgaaagaggagagtgaaaagctgggttaaaactcaacatttaaaaaaggaagatcatggcatccagtcatcacttcatggcaaacagatggggaaacaatggaaacaatgagagactttattttcttgggctccaaaatcactgcagatggtgactgcagccatgaaattaaaagacacttgctccttggaagaaaagctgtaacaaacctagacagcatattaaaaagcagagacgttactttactgacaaagggctgtctagtcaaagctatggtttttccagtagtcatgtatgggtgtaagagttggaccaaaaagaaggctgagtgcctaagaattgatgcttttgaactgtggtgttggagatgactcttgagagtcccttggaccacaaggagatcaaaccagtgaattgtaaaggaaatcagtcctgaatattcatttgaaggactgatgctgaagctgaaactccaatagtttggccaactgatgcgaagaactgactcattggaaaagacactgatgctgggcaagattgaaggcaggaggagaaggtgacaacagaagatgagatggttggatggcatcaccgactcaatggacatgagtgtgagcaggctccaggagttggtgatggacagggaggcctggcatgctgcagtccatggggttgcagagttggacacgactgagcgactgaactgaactgaactgatgatgaatggataaaggcagccctgtgtggaagagatgatgggttctctacaaacaatgctagagtcctagttttgggttttcattctatcactaccggttgtgtaacgtggagaaaaccgtgtaacctctctggacccctgttt

SEQ ID NO: 32355 - DNA, 2045 bp, Bovine  19866880682760
gtgtggattgattatatccttatctggaggcttggttggggaaagctctgtttccacacaccctcagattgttcagttcagttcagtttagtcgctcagttgtgtccgactctttgtgaccccgtgaatcgcagcacgccaggcctccctgtccatcaccaactctcagagttcattcaaactcatgtccatcgagtcggtgatgccatccatccatctcatcctccgtcatccccttttcctcctgccccccaaatcccctccagcatcagattgttagcagaattcatttccttgcagctgtagaactaaaatccccattggcttgctggctgtcactggggactgctctcagctcttagaggtggccctcaggtccttcaccagttgggattaaagccatggcttgcagatggagtcctgtgaagcactgcttccaggggcttctcccctgatcttcacacccaaaactctggttgtataaacctctgattctctctattaaaatgtttctatttgtgtaccttagagttgcttctgttttcttgcccaaactctgatacagttgttttgcaagtaataaggaaagagggctgtcaagtagacaatcaacattgttggccatgtttctgatataagcacaccacatacaccattgaagacttgattagttgacagtgagtaggcaaatcagattaaaagtgttttgaatgtctcaaaattatgtaacatcatttaaggtgcagtgatcaatccatcagtaaaacaggggtagaagataaggattatattttataagaatgaaatatctgaccagaatcagcaaaagtttcagagtttggctttagaaataaagttaagacaatggagtaagagtttgattaaattcacagctggaatcaggtatatcacattaatattaatagcaaaaaagtcaggaaagaaaatacttccaaaggggaaagtaggacatttgaagttttggggggaatttctacttttgaaagaaatggttctcagttggtgaaaaagtcagtagacctctctacatagctgaggagggtagccagtcctgctgcttttgatgaattatttgaagactcatccacttagaaaaaaatctgtgtgcatttaaaataaatcattaatgataaaattgattggagcttgtgaaaaaccaaacaaacaggtattggcagttccttttgaaatatttgttctgaagttcttaaggaattgtgccaagttgggtttttagtcccgtgtaactgaacttactctagccagtttcaataggaacataacttattaaagtctgattgatagctcagagaaactctgagggggtcagagttagacttggtagcctcacaaaggtcaaagtcaaagtgaagtcgctcagtcgtgtccgactctttgcggccccatggactgcagcctcccaggcttctccatccatgggattttccaggcaagagtactggagtgggttgccattttcttttccaggggatcttcctgactcagggattgaacccaggtctcccaaattgcaggtggacgctttaccctctaagccaccagtggtagcctcacagccagaaacaaaagactacacggaagactgcttcacagcatcagccactgaagaccctgctggagcagccacactgggacatctgcagccttcacgctggccacctccccctctcccagaataatcctgtacactacctgttgcctcctattgttctgcaagttgaatttacatatgggtgtatctgatcagcaaagcctatgtcacacgtcggcaagcctagctgcaagagagggccaagaaagtgagtttctgatttctgcctttgagagtggtgctcataatgtggataaaaagccaaacctgcgaaaaatgtaaaatagatgctgggctgccctgaagagggcatatgccaagtggaaagaggacagacagggctaagagccgtggactttggaatcagatggaccttagtccaagtggagttgcacagcttcccctaagttca

SEQ ID NO: 32356 - DNA, 1287 bp, Bovine  19866880754225
cagtatgtagtccactttgtcacacccccagagaatgtataaatgacaaagctttttctatttgaaggcagacttcaacgaatttctgagacaggaaattaaaggtttgacttaagactgccaacagaagaagaaactctattcctacaattcctacaactctattcctataaaagctgtattcctacaatgcaattattctaaataaatttataattatcccttcttaaaggtttatctttatcatctcttactaaccagaatgcaagtgtgaattcaggcaattacaaagatagctgttgagacaaagtaatgatggtctcctggttaaaatcctattcaaatgatgaactttctgagaactcattttactacaaaaactcaagaaaattaagccaacaagtgtaggtttcctccacttatgctgccttacacaatgatgaatctagaagggaaggcaagctgatttctgtctaaatatttgtcttcttttagagctgacttagaataaattaagtttttctgcctaaaagcgccaagatagaagcaaaatagaaacaatgttacaaatcttgattatttagtctctccttccctatataattacatgatcactttcagacttcaatattttgccttactgtccttctcatacccctggatcaatttctaacttaggataatttaactaatacctctactctattcctgcttcaatgctattcaatgatactcaaaaaacttacactactgggcaggttgatgccactgcaaagggataactttagagctcctttgcttacacttattcatctctctgtcctagtcctccaggcaggctgtgatgtatcttttctactcttcctctcttgtcaactgtcagctgactaccttgcttcctaccttctaaagaatgaaagagccaaagaggtagaagcctcttccttttaccatctgacaattgtattaagcttcttccttcctctctgggcggagagaggttctttttccaagatcccttttccgggtggactgtatccttgtccatctccaccaggagttgctccatcaggtaatctgcttctgttctgtttctctttcattacaaacatcactcccaacaaaatgttctcaaatcacttactttttcaagagccttcctttgatcccagcagtactggtagctaccattctatttccctcctttccttcaataccaaatgcgtagaaaatgtaggtggcctgcctttacgactcactttctcaagttatatttatattccaccc

SEQ ID NO: 32357 - DNA, 1236 bp, Bovine  19866880795370
tctctggcaggggcaccatgctctgactagcaaagtgttaacagaatctcaggtcacagatgtggtgtcagatagcagagctttgatagaagggagaattatgtatgaagatatacaaatgcattcaactcatatttaccctcattagtgttaggaggaaattacccctgcatcttttggatctggaatgccttgtataaacaaccaaaaaactcccactttttatagctgataacttatgtggacctgttcagatctgtattatgatggcttagcaattcctgagcatgtatcagtggagggaaggaccatgctgagtgggagggggaggcgagcttggcatgcatatcggccaaagaccatttgtaaagtgcataatccacagtgcatagttgagagctgggttttgtaatggatagttctctggttgagctagagaaaggaagttagcacagggctcttaaaggtccctgcactgcctgctcctccacaccccaaccttctgtgccacgctgctgtgcttagccgcccagtcatgtcctactctttgcgaccctatggactatagcccaccagggtcctctgtgcatgggattttccaggcaagaataccttcttctagagtttcccaaaaggagggaaatcaagtaagtaggaagaaatagaaaatgacaacaggagaatgaaagtcaagagactgtttgggtttctatttttatttttggaaggagagaaaaataaattacctaagatgaatcaaggagaaaaacattaaaaaataaaagagatgagtgatgaagagaggaaggaaatctctttggtagataaaacagatttgccaaatatattacattcattaagatttttctctgcttacaacgtgtgcttttcagaggcttttcttagcattaacggacgctctgggagagaagaaagttggcagagagaagcctagcaaatatataaataagctttggagctttcagaagtttcatttcccataatagaacgttctccagcctgggcaaactttttcttacttaaacaaatgctttgaaagacaaagatttcatattgtcagtggaacattcagactaataattgcctctgttctttctgccttgaagtctcaacagccagcagatttatgattcacttttggcaataagctccttcaaataaatatcactttcccaggctgcaaattgggtttctaaatacacagagatcaactcc

SEQ ID NO: 32358 - DNA, 1932 bp, Bovine  19866880795686
attacaatgactcattcacagatatttaaattcaaaaccagagtgaatttttttttactttgtttatgaaaattgaaacaagctagggcattggtacacaggccaattgatcatctgtctgttcttagctttttgtctaacagtgatcaaccaatgatttcatcagaaaatgagcagtttggttagaccaatcaacaaagcctaaaatatactctgaggacacaggtctcaggtatttcttttcaaagcaatatagagtaataatacttcaatatgactacaaggaacttcaatattaaactctggccttgcttgggaacctacctccaagcagtcctctccctatttctttgagattcatattggacatattccagctcattttccagagccatgtccagcagccagagatggggagcatattgtaagactgcatcttttttctctgagtgtgaatttacactttaggatcactttgtcctcctggaagatgaaattgatgatgataacctttattgagcacttactgtatgccaggcacagaactaagaaatttttattattaatgtttaatcttgatgacaaccctatgatacagatattattgttgccatttccatttaacagataaggagaaatagaaacttaaaagcctcagccttctctgagatcatacccttattaaatgagataatcagaaccacaacccagatttggctgagtccagaatatatgctcataaccactataaaaagtgaaagtaaaaaagtaaaagtgaagtcactcagtcgtgtccaactcttagcgaccccatggactgcagcccaccaggctcctccatccatgggattttccaggcaagagtactggagtggggtgccattgccttctctgttaacagcggctaggcatattatatttacttagagctggtatacttgtgacagccttagtgccctcggactcggcgtgcttggccagctccccaggtagcagcaagcgcacggtggtctggatctccctggatgtgatagtcgagcgcttgttgtaatgcaccaggcgcgatgtcttgccagtgatgcgctcgaaaatgtcgttgaggaaggagttcatgattcccaaggccttggacgagatgccggtgtccggatggacttgcttcagcaccttgtacacatacacagagtagctctccttgcggctgcgcttgcgcttcttgctgtccttcttctgggccttggtcacagcttttttagagccctttttaggggcaggagcagacttagccggttcaggcatgtctataataacaacacccaacaacacagaaaggtcttgaaatgcctgctggtaaatagaatctcgtcttttataggcggtctatgcaaataaggtggttacgaatattcatacctgatttgacaaggcattcgtgacgagattatgtaaacttacctccaccagatctcttttcttattggttagacacaaaacagaaggttttaaccaatcctatctcgcatgcggcaattccacccagcactataactgccatcttgttgctgcttatagatcactttttttctgcttttcctgtggcggttctgattttgctcaacgcttgtcatgtctgggcgagggaagcaaggaggaaaagcccgagcaaaagcgaagacccgctcttcgcgggccggacttcagttccccgtgggccgagttcaccggctgcttcgcaagggtaactactccgagcggggtcggtgccggggcccccggtgtacctggcggcggtgttggagtacctgaccgccgagattctagagctggcaggcaatgcggcccgggacaacaagaagacccgtattatcccgcgtcacctacagctggccatccgcaacgacgaggagctcaacaagctgctgggtcgtgtga

SEQ ID NO: 32359 - DNA, 2063 bp, Bovine  19866880811237
tagagataataaagctagctggaagaaatgactgtttacctgcaaataaacaacaatcagactgacaacaggccttgtcatccacaaaaacaggttccagaaatcaaaggagaaacatactcagtgttctaagtaaaataactgtcaaccttgaatcatctgcccagtgaaactaacattcaaaagagtgagaataaaataaaggcattttcagacatacaaagaataaaggagttcgctacttacagactactctgcccaccactgaaagaaccactaaaagctaaacctgaccaaaaagcaaagatagaattacaacagaatataagaaacagtggtttaaaaatagaacttggttttcactttcatatctaaataaatatagactgtataaaataataataaagtaactaatttgaggatgatctaaaaccacagtggagctaaaataagagactaacaataataatggaagataggatgggttcagaggaaaactaaagcattctaaggttcttgctttttttttttttttcaggaaaatgaaggggggaaattaacccaatagcacaagagagaaaggattatgccatagttgtgtttttatgagtgggaaaaagataattaagattttcttttcataaagtttcaagcaataagatttaatccttctcaaatgagattaatataaatcactttaaaggtgtttttcaaatactctttcctttaattagaagtaactaccatttttctagaaattcagacaatgactttgatccagaactgagaaaagttacctgtttgtgacccagttcatgcagaattaatgttgacattcagttcccaagattaatatttgtttctttgagtttctatgcgctctaaaatccccatcaaagtagataaattatctccgtaattccacatactttacaaattaaaaataaaaatattttccatgagaactgaaagtcctaaaaactcctcagaaatagtatcttttatattctcctaaaaaacttctcaagtatcccttcattcttcctgggagaaaaatccatagacaattgatgttaaccataatttatgaataaataattatcaggctccatgctgccttataacaaaggaatcaacctggaaatcaacctcagagtctacattcacttaaggggaaaaagtccatctataaaatgatattttaaggatttattgcactaactagccactgtcgcctcaaagaatcatttttacttgaacacaagtgctaaaaacttaaccgcttttttatttagtgcttttgagagactaaattgcaactcacaaagacagttattaaggtctgaatggaaaattatttagattaaatatcatgttcacattcaagaatcattgtaattggtccattaaacagaagcattgtaatggggtctatatttttatttgctccattacttaaaactaaatagcagttattatgtatattacagtggttaaagattctaccatttacattgttgatgttgaaatttagctttgtatcaactcattggcaatttcttctatttgtttattaaacaatagatgataggttagctgaattctctgcctttatatcaagttttttaaaataaagaatacaatcaacaaggtatttatataagtcaaaatataatggttattagcaataacaaacatgtccaaaatctcaacaaaaacaagggtttatttcttctttgtactatatatccattgctgcttggccatggatctgctccatgtcaatttcactgtaggaccggaaaactccctgaggcaacatagatcttcatagtggagagaaaaaacaaaaaaacaaggcaaactatgagacggttacataagcttctattagaagtgcctcacatcacctctattcttattttattggccagagcaagtcacatgaccaagcctcccttaacaagaaaaaaactgtgtaatcctcccaaagaatgacaccacaggaagggcatcaaaatatatggtaagcagtcatacaatacatcacagtgaccatgcca

SEQ ID NO: 32360 - DNA, 944 bp, Bovine  19866880862897
taacgagtcctgtttgggcactgagagttaagatgagagggatttacttgtcaatttcttttcattaacttaattttagtaaaattaaggctttctaggcattttcataaagttgaccttatatttattcacctaaaaacagagaaggtagaataaagactgaataaaacagtaatatttctatacagagtgcccagacctctggtgtttgttgtgtccttgctcataaagtataattgtcagtaattttaccagttctcccttcacttctggaagcaaggcaaagaggaattaaaacagaaaaggaaacactgtgataaagggtattcaatttgaatttctgctggcctcactctaaatccaaagataaacacagaaaaatagatagctcctaataatatcaaaagacgatctagaaactctattcgcctaggtattggtttaattttgatcccaatgttgatatttctgactataatattacagtaggccatggtggttatgctctatgtctatatggatatattgcctcgccaaggaaaggaaatcccacagggcatcagtggggttccaattaagtaataataaggattgctgaatctcaacaataaggggagattgcctctgtatcacagaaggacagataggggcccaccattcagtctacagatttaaagccgatgctgccttttccctcccttcagcagtgatggaaggatgaactgcgtgcagcggatcatttcagaacaatctattcttgtttgtttatattattttgagtttgtttgcaataaaggtgatagtgggactcggagggtccttgtgcaaaacagaaagggtttcatgaaagaactctgaactgggatcacatgcatattccagagacctcagagggagaaagggatcttgaaattatatttctgtctaaggctttactgcctttc

SEQ ID NO: 32361 - DNA, 1443 bp, Bovine  19866880884479
caatagccccaaaaaaataaataaataaataaaaaataaagtctacttctatcaacataaaaataaataaataaattagatttcaaccaattggaactttgtctgtaaatgaggtcataataaataaaatactctagattctcttggaggtgaagcagcagtttcatcatcttttatcagaggcagtcttctataagccttcttgatgagttttgtgaaaacaaaatccatgtggactggaatttctcaaacttagtttcaagttaaaattaaaggtaaacatttactgagagttaatgtcttgcaaaaaaaattaaaaaaaaaacctttcagagtctttcacgattcaagaaaaattggcatgctttctgaaattcaaactttcatgcattctcctccccaagccacggtgatgcagcttgcctgaaaagaactgacttaggaataatatttaagcaatcaaattggtaaccttttcaatgctggcaaatcagtttagcaaatcctgtggcaggtgtcatgtgtgacggttgaggcgtctaggtgggacatcagctaatggtcatatctgtcactgacccatcattccagtgggagagaaactagagtcactgttccacagctctacagacacactccactgaagttaagcccgccatatcaattatattttttaaaaagttatagcttattttatcttatctactcaccaataaaaatattgtaaaaagatgtaaaaaacagaacaaaactacctgttgtaaaagggactttgcggggttgagaaggtagaataataatgttatgattaatgaaggactgatatatatatataaaatctagtagtgccagttgttccaaagtcacaatctatgaacttaaacactgttgacagaaatgttcccgcaagagcttaattttggcacgctgcatttaccatgtataagagacaaagcatttgtctccatattggcttcattctcacagaaggtccctagagagcttcctaccttctagcaatgtttcaaaatttgaatggtggcaggtccagacactgtgaaatctattcagtattttggtctccaccaaatcttatgagtgttttgattgtatgctgccgtatacgctgacactgattctcatcttggaattgctcagacctgagagaacttcttcccaagaagccttctactttttaatgtaatgattaaatctaaagtcagtttgaattcctgtggggtgtcttttgcaggatgaagctgccttgcaaatttaaggtgaattacctctcttagccatgaaagcagttcaaggcaatgtaaaagaggaacagcattttatccagccattctccccatatttaccaggtgagatcaattatttcatccccataggggcaaagtgaggaaaggagctgaaagagtcctccccctcatcatggaa

SEQ ID NO: 32362 - DNA, 1591 bp, Bovine  19866880900084
aacagccgatcgttctcccaccagactgacttcacttgagggtcatccttattccccacacctagcattttgcctaacccattgcacagaccttattcactgatgacaaaaggaatgaactacttaagaaatctaaacatatattcgttatttgtatataatgtgcagacttgatccagagctgtcgttttgatactgtactcatcataaaacacgttcttctagtcctgttgtctatctttcatgtgtgttttaaggcaagcaaagagcttagcaatttctctcccttcccccaccacagttcacttttgcatgaatgatttgaaatgcccatgtttaaaatcatcactgtgtcagaatgaagttgaaatttcgccacaattttcagtgaaaagcaaaacagaagccaaaacataccttcctcaacccaaccgccttttgctttttgatcagtttgaagggctttgttctctctaatacaagtgttttctgttcatgcatagcaaagacataatctaatctccaaggtttatttgccaaaagaattgctagatgtgggaaggagctagggtttgaatttttattaatttgggatgcacgtgcacctgagaattggtgtgcgtgtctctcagaggagtcttttcaaaataaaagcataactaaggggaagttcatagacattttccaacctgtgaacttacgaagtttggttagccaaacactcacattgtgaagactgtgaatggaatagaagcaaacccagtttcaaggtaaatcttcatgctttgaaatgctcaatgccttccttttagagagaacaacagatgctttcagctattttataaattttgagaataccatggggtgtgagctctctactctctcttgtgattggccaattcctctctccttcagctatgtctattctgtggtctagtttaacaaacaaaatgctgcactgctttcaaagaagggacaaaacatgctactgtattttccaatactctaatatcaaggcaagtaaccacagggatcatgccctagaatgttctgcaaatgagatgaaacaataccttccacattcattaaaaaaatcttctcctgcttctggttaacagtaaaaccaacatctcttattctttttggtggctgtatgatttacacaagtctgaagccaaaaaagcattctacaagaaaagaaaggcatacaccaaccatgtttcccaggggatcaagcacattaaaatcaagaggcattctcactgtaggatttaattgaactatttttcagtagctggtatttagtttgctttatttatatttaatgcaactgtaagtgggaagactgtgagttgggtctctgggctaatcatgctgaagtgttcaggatgaaaagggtggggcggggtgggggtggctttctatagtggagttctgtggtcaggtcagcactgcgttgttgagtttctgaggttgaggatggactgtgtcagtgtacacttttacagataagggaaagaaaattacacctggtggcaacaagaagagtcaagagtaatttgcagtgagcgagcaaaaggaaatcctgtag

SEQ ID NO: 32363 - DNA, 1123 bp, Bovine  19866880951246
ttatgaatcaaagcctgggtatggatgttgtcctattcaatcgcactgaataagaaatcatgctctatgtgttttggggtttgggctctgggcttatttaaactgcacagatgttgtaggttcctaaattaacagtggtctccagggagatggtcatcaggctgcatgcatatactgaaaaaggcatggctagaatctcgagccacaccattcagaaagcacttttgctactgtttcctcttctctaataaaatgatctttcctgtttctaaattctgttagcacctatgggggctggacccttttagaattctctagttgctctaggtatgtgtatatccattccaactactttaatgtccctcgagcggaagagcattcacattcaagaaatcatagcactcaggtgtgccctgcaacatgggaagtgtcttctctatattataaattctccaatcaatctttttatgatcaatccaattttatagataagcaagctcaagattcaaataatttgccccacctataattagaggagcattaaatggcttccctggtacctaagacagtaaaaaattcgcctgcaatgtgggagacctaggtttgatccctgggttggggaagatcccctggagaagggcatggcaacccactccagtattcttgcctggagaatccccatggtcagaggagcctgtcaggctacagtccacggggtcgcaaagagttggacacgactgaagtgactgagcacgcaagcatgcacatctaccctgcaggacttttcagaacctttaatatctaatgtgacttaccatattaaatccatgtgcaaataatatactaatatacatctccacgatgctggagggagggtgaaccaggcctcggtttctcaaactcttttaacctagaaacccattttgcaatgtgaaaatcagcctctggtgatgacaggaataatccaccttcagaagaggctccatgccgcctagaggatttgactgctgctgctgagtcgctcagtcatgtccggctctctgccaccccatggactgcagcccgccaggctcctctgtccatgggattctccatgcaagaatactggagtgggttgccatgc

SEQ ID NO: 32364 - DNA, 1148 bp, Bovine  19866880977339
agaaacttagacgcatctttgcattgggaaatttctatcaattattttttgcagggctctcttttcttattctaaacaggcttggtaaattatggtgaatgagaaagaagagaaatctggtctttgactccaggttctataacttgctagctgtgtgatctcaatcaagcatcttaggtgctcaaatcctctattttcttctctgtgaagtgggggtaatagtaactgcattgcagagttgttgggaatttataaataatatatatgcagctcttgcagcagaaaatctggagagttgttcaataaaatgcagccattcctgcttttataccgagtagatatttacctggtgatatggaaaacaattaactccaattgattctaatattttgaaccagaacaacagaatgtctccttcataaggagctggacaaagaaatggctgagaaataatgtcttcatacacataactgctagcaattttagtagatgttgaagaatcactaatgcaacctgcaaggcaaataggtatgtaaaagatcaaaataacaaatgcattctttcactttctcaagcttaaaatgcctcgggtaaaaagaaatttgtagttttccactaagcctttttattcattccttattttttttaaagtcatgccataaacacaacagttcctaaactataagttagagtaatttttaaagtggtaggccaaattacatgcatgtcacctagtagcatttttctgaaagcactaatattgctctaaatagggtcaaaatagccagtttctgaaaaagcagaaaataaatgttgcaagcatttttattatcacattcgatagtcttctggctggagactttcaaactgggattattctgggtgataaaagtcagtgaaagcaaataaacatccctctatagacggcttctctttccttttattccttaggagcagcaaatatgcataagacactgaaaatcttcactgcaggcttttatcacagtgaaaatcactgggtactctgcctaatgaaaatcgttgcacccaactagaggaaatcaacagtcaaaactctaaccttgaattttagaacccttggacccttagaagtgcatttccctatactgacgtataacaccatagga

SEQ ID NO: 32365 - DNA, 1957 bp, Bovine  19866881024069
aggcgaaatattccccccacccattactcacacacttgtcactcaaaggggactgagcacatattcaccgtatttggcaacatttcactctgagactgaaaacaaacatgataaatttatcctctaaagaaaattttggtgatgtgtataggccaccgaaaatgagaatgttatgactttagtgctgtgataatatatggtagtaattatattaacaagggaaattacatcccttttcagcaatttaagctcataccacccacatgaaaagtgggcagaagcaaaaatgctgaaatggcactagtcatatagagggagcaatatttgctgaatttagaacctattttaatcacttttttaatctattgagctcctactatgtgccaagcaccatgtgagcacagtggggaattaatgcaatatagcctctgatcgtaagatgctcaccaagtaataagggattttagctatgtacataaatcattgtaatgccaggtgggaagtgagagatgacaaaagaggggtacagatagagttctacagggtttaaaaagaggaagctatcacttctagataaagctctgatgaagatctggcttgcccagaaagcaatcagacacccaggaggtaaggagtaagcagcaccccacagttttccagtatcgagataaactgcagccaattaacactggaaattctgccaatgacctggcctcagaaaacatccaccagcagcctccataatcagataaccatgaaagcaaaccccatatcctatggctccagaaatccttctaaaaactcttctgccaagaacttataaatgtgtggattaatgaaatataaatagagattaaaagcatgagtaaatctctataattcattttgaaattttattgggatcaaatttgagatactcattctgtttatctctaccaatctgattggcttttgttccctttctcccatgtacaagaaggtatagaggtttcgaagagaaatagcacacaaccagatcgtgaggtgtcttggaatctcatatgggagaggaagagttacaaaataactgtaaaaatgatctgctgtttcatcaacatgatctggtggaaaaaataattttgaatcagatagacttacgttgaattcctagtttgtagcctactagctctgtgacctaaaaaagaagtattgactctttctctaggttaacattcatttatctataactgttcaaatcacagggctgtggtgagggttaaataatacaatattgtgaaaacattttgtctaatgcctacaaacatctaatgaatctgtagaataacatgcatcagaaagctgctgtgtgtcagaaggtttttctttttaacgtttaaagacaagaatctcaattactatggtctacacctgaaactaacagaatattgtaaatccactatatgccaataaaatttttaattaaaaataaataataggctccagtttcatccaccttatagaactgattcaaatgtattctattaatggctgagtaatactccattgcggagaaggcaatggcaccccactccagtactcttgcctggaatatcccatggatggaggagcctggtaggctgtagtccatgggttcactgagggtcggacatgactgagcgacttcactttcccttttcactttcatgcattggagaagaaaatggcaacccactccagtgttcttgcctggagaataccagggatgggggagcctggtgggctgccgtctatggggtcgcacagagtcagacacgactgaagcgacttagcagcagcagtagcagcagcagcaatactccattgtgtatatgtaccacagctttttttatccattcatctgctgatggacattctagggttgcctattatacagagtgaagtaagccagaaagaaaaacaccaatacagtatactaacg

SEQ ID NO: 32366 - DNA, 1120 bp, Bovine  19866881171735
ctgttcttgacatatattagatgcacaacaactattagtgctcattattattaaaggagaaaccttgaaatgtccaatgtatcaattaattttggtaaaaaatgaacttgagtctcacatattatatgtgacaattcctaaggtcagacaccatggcatagtctacactctcattgaatcacacagtccaaccctggtaactgagtcaacttgatccccttttggctctattccaggcactggtactaattttgtctccaaataagacaaataggatgggctgtctgtgaacagggtgtcttatggagtcagtcatgattcattctgtttctaccagcggctgagtcccccatttggcttctcaagttttcagttgcaaagatcaaccttctcagtagctaaacacagaatcttatgtgtcagccctcaatggctaggtttcctgtccctcggtgctggtcaccagctccctagctgctgatccctggctttaccagtgctcactgccaatctgatcagaacccagctttttcaaagctgagtctcaggcaaatctatttcccagatcttgcatcctcagtagatcctggattaaaaggcttaggaatcccacatattctttcccttggacttagctccccacggtggattttctaaacctctctatgtgaaaaccctggatatgctgctatctgtggtccctgtcattttttgacctagactccaggtagtaaagcagggtggtttatgagcatagtgttgaagttacccaaaggagagttcgaaccccaggtctgccacttactaaggttttgagtaattttttattctttttgaaccaaattataaaatggagataaaaatacatacttctgagagttgctctaagaggggtaggttaaacttggttccatagctggcacagataagcattccacagtcttatttttgatggaaagccgcactccccctctactgcaacttgatgtctgatcattttctatttatttaaactagatccttaataaaactacctggaaattactagaaagtctaggcagctgctcacaccaaattaccttttcctggcctctcaatcaaaattgtccaaaatcaaatt

SEQ ID NO: 32367 - DNA, 1587 bp, Bovine  19866881176310
ctcgtataacatgtttgacatgtggaatatctccttaaacaacacagtgagtaaactgcaaatctcctggacacacacatagcatgaaatagccactattgtaagaagttaatgcttattcttctcagcaagtatcataacactgtagggtagccactgtcactgaatgttagcagcaggtgcccgtctgtgtacccatccatcattccatcccagcagctggattgctcatcatttttcttcctgtggtggccctgatctgcagaaagctgcttctgctgctaagtcacttcagtcgtgtctgactctgtgtgaccccatagacagaagcccaccaggctcccccatccctgggattctccaggaaaaatccagaatttacctgtggttacagtatgcttcagtcaggttttatatgtacacacacacacacatatattactcaaataatattcaatatactacttagagtgggcctcttctgcttctgtttcctctcaactataacataacacgcaataagcaataagtctgcgcaataagtaaccatgcactccagagcgaccaggatcgtacagaaggaagaagtgataatttaattgttttcttttccttcaaataaacacattgaatttctttcataaaaatttgagaaattgagactctgctagttctattgtttatctctgttgaataaagttaaaagagatcttttccaagttggttgagttttatccatgttccctatcaattggtctgtttcaacatgcatttctagtgtttggcatactaaaaaattacccccatcacttctacatctactatttggtccttattctgcccaagctttctttttaagaataaaagtaaatgaaaatatttctcttggtgaagcgtcattttcttaatgctattttcatttttttttttgcttgtaatccaagttagtgataatttagtcatttattatgatgatagcctcaatatttgagatgcctatcagagtgaaatgaaagtgcctctgtagaattcaatagaccagagaagaaaataatcaaagtactgtttattcattcacttatcaacaaacatttattgaacatttagttgccttggtatcctctctttttttctgctttttcattctctttcttcctctctcctacaaaattgacatcatatttcagaaactgaaaattcagagatgaataaaatatagctcccatccttaaggacttagagacagtaacaatacaacacagtgcaactgttctgttacgaaaaggagcaagaggtgccgtgggcatatcagaagggagaggccacttgtgcctgggagcatcacggaaggcttcgcaaaagaggtgacactttaatagaggtttgagtaggagttcaccaggagaacagggttgggggtgtattagctttctatctttaagtaacaaattaccacaacctcagtggcataaacatttactatctcacagtttttgtgggtcaggagtctgggcatggattatttgggttctctgttcaaggtcagggcttccttgaggttttgtaggtaaagaatctgcatgccag

SEQ ID NO: 32368 - DNA, 867 bp, Bovine  19866881231899
ttcactagcttggacttacaccccccaagtgagaaataaagcttttattttgctttacagactctttgatattcttcgtttcaatagtgtgtgtgtgtgtgtgtgtgtgtgttagtcacttagtcgtgtccaattctttgcaaccccatgtactatatagcccgccaggctcctctgcccatggaattttccaggcaagaatactggagtgggttgcatgcccttctccagggatctacctgacccagggatcaaatctgggtctcctgcattacagaagaattctttactctctgagccaccaaaagaaaccccactcttctctgatgtatatcccgccagaaagttactttctggtgaggagacaaatcactgctttcagaggggtggcttttctaaacatctacttttgtgaagttctgttgtagaatgtgtatcacatacagattctttacaaaagcctagtaaaggaagaaatttcctgaatcataatttttcacaaaaattgtagtgtctttaatttaggccagtgtttctaaatctctcaagattgtagataaatactcctcattttcaagatcaaatctgtctttggctaatgaaggcccagtcgtaattccaaaagattgttagaatgggcctggagctggccttttgtttcatattctggaatacgatttttgtatacaattcccaggcttcagggtagaacaagctctcagacactttattgggttttgattgagaatatttgcaggagcaatttccaggggaacacttaggtgatcagcctcaggagcctgcaatctcaggtcccaaggggacagaaatcaccagtggaaacatgactattactggggaaaatcg

SEQ ID NO: 32369 - DNA, 705 bp, Bovine  19866881250579
tcctaaaggaaatcaccctgaatatttattggaaggactgatgctaaagctgaagctctaatactttagccacctgatgcaaagagacaactcattggaaaagaccctgatgctgggaaagactgaagacaaaaggggaagtcagaggatgagacggttagatagcatcatagactcaatggacatgaatctgagcaaactccaggagatttgtaggatggaggagcctgacatgctgcagtccatggcgtcacaaagagtcagacttagcgatggaacaacaacaacacatatcagcttcaacacatgactgaaaaaaaagtagatggagatctcactctctatttaccattttagaaatgacacatgtctctctctctctctctctctctctctctctcacaatttattcatgcatagttcactttacttacagtcaaattaggtcaaaattagtcacatggccttcctaactgctaaggtatctagaaggcaaaaataggatactgatgagcacatcaaagcccaatccttgggcatcctctttcttacctggcaaaaccattatatactttcctcaagcaaaaattattctctcaataaaagaaattctaccactagcttcaaaataattatttgctctcacttattatatatataatacacagatacaaagaaaaaagcaaaattattttctgagtaata

SEQ ID NO: 32370 - DNA, 1061 bp, Bovine  19866881278641
cattagagagagtacagtgtagtcggcaagagcatagactctggtgtcaggctgccaggttctgtcctggctcttccattcactagttgtatgtcctggatcagattgctaacctatgggtttctcccattcctaacctgtgaaacagggatgcgatatttctacagttgtgtggcaggcactgagaataaggcagtaacaaaacagataacattcctgttgggatagactttccattctagcaaagaagacaaaacacacaaaaaataaatatatgatttttttgcatagtgatcagagcaaagaagaaaagccatacaaggtaaagagatagagagtgttggaagatgtactagtgtagggagcaatcaggtaaagcctttgtgaggaatgatgtttcagccaagaccttgtatatacctgggagacaaatgtccaaactgagggaacatcaggtgtaaggtcccaaagagagaaacttccccgagtgtttaaggagcggcaaggagaccagcagaaactggagtaaagtgaggaaggaggtggtgccaggagatgaagccaggaagtagacagagcacagatcattttggccataggccatggtacagacgtcagatggtcttctaagtgaaacaaattccctggagaggagttagaggtgactgagaagtattttgctggtgcagttagagttttgcataaagttgtcatttactgagggagaatcagaatggggagatcaagagtttataaccagacacattaaatttgaggtgcctattaaatttttaattggaaaagtgaaatagaaagtttaatatatatcttcgtagttcaaatgctgctgtgagtccataggaaatgagaattaaacattgaccattcagtttgataaaaaaaaaagaggtcactagtgacctggacaggaatatttcaatgttttaatatttcaatatttcaatgttaggacgaaagcctgacagcagggagttagagagagaatagaaagagtctgcttctggctatgatgattgagcttgtatcaaaccagcctcctg

SEQ ID NO: 32371 - DNA, 1450 bp, Bovine  19866881287806
atctctgacattccagcccactccgagcagcggggataggagcctgactgtgatgggtgttgatgtcaaatttccaactgctcatggatgccgtctgtgttttagagcatcaccctttccagatcatcattctgtctcataagcaaaggtatttacctattaagaactgtcgaaggctgagattccatgggctgtctggctgccagcaacaactcctttcagatagagctttgatggggcagtatttagcttctaatggcccttaaaagctgcaaggtgcaaatgtgaagcgatgaaatccaggccgcaatggccatttgcagaatgatcctggctgagctgcagagagatttggcagctgatgaggcatctccatcaaaaatgtgctcccagaaacgcatcctccgtgatacctgtttcatttaatggtgatcattctcaccctccacccccacttcccacaactgaagatgattactctgacagcaagctgtgtctcacccatcattttctgtcaattttcttgcctctggaaaggattctgtttgggttcttagattaattctctaggcaaaacacttgcctcctattcttgctattctgtttaaaatagatatcctgggagagttaacagcaaacacaacttagactatgatttaaacacaatacaccaattacaagtttcagtgggggagtaggaaaagattcaagggtaactttgctgaggaaacaatgtatactagacatggagcattacctggattctgcaatactcatcagggggctaagaggcaggacctcccatccaataatctggatggatctgtagccaacatccacagcattggctgtgcatccctgatgggtgtttacactcaggaatgagaagataataataaccacacacaagccacataaccattagcaagtggtttttaccaacccattaggatttgctcttctcttatgccactcaagaagccccagaatgacatttgaaatatttccttcgagtaaattaatgattttcagggatttcactgaccctgctctaaaggccttgctctgtggcttttctttctagcactgagcagattcaacatctataaagatgatgaatccttggtgcccaagacgtcatcttggctgagacggggaagcatcctgacctatgcaaaacatagtgagtgatgcaggcagatgtgacatttaaagggacgatggagaggcccaaaggcaacagagatggaattcagcttcatttcgaaaaggaaatcggtttcagttgcagagccctcatctcttcatcagaggaccttctaggagggcacccacatctcactcctcttcttcccaagacaatcaatttgggggggaagagccagctctgagaaactagaaagagggcttttgtcggtgatgcttgtcaaggatgaggtcgaattggacc

SEQ ID NO: 32372 - DNA, 1053 bp, Bovine  19866881326295
attgtggttccagggaagaaagggtgccctgccccatccctagtccccgggggtggaagcctttggtggggtaagatctggcataagccctgttgtctcctctgaggtaggatgaacaggccagttggctctgttcttggtaacgactatatatagcaagctggcacagtttttagacagagatttctcacaagaccttggcaaacattccatgtttcctttgctgcaatatgtagaattgatatttctgacaaaattgctcacacatcttagtgtaacctgtttagtagttacactttgttattcttttttcccaagcaaaaggaagaaaatgattaattatatgattttggaggctggggaggggaatctgaccacaggccccctggaaaatcaaggcctgacaaattgtctttgctggcatctctcacagcaaaccttctatccagcgtcccacccatccttgaatcacaaccacatacccaccagtaatgctggaattgaaagaccccaactagctcagagcttccacctttccattcattctgcagcaccctaccaacttcatcttctaaaatacaaaggctaatatgtaaatattagcatccaagtgaaaggaaggtccttggcaaataatatacttttcccccctcactttgccttatatttgaaatatttaactaaatattttaaaataaattgataaatattaaactgagtctcatataatattgaggactaaagccactccctcacacataattaaatgattaagttgattttttttaaacttcatttaaaattaaaaaactttggagttccctcaaattccaaattcctttgcccaacactcaagattctaaagcttcacactctcctttcactgatttcatctctcaattctggcctttagaaatcatattattcttgtgtagttatcaaacaactaccattattgtcaatggctttatgaattttcttatttagttttaaaaactatcctatgagacggttgttacttttcccattttacagatgaagaaaaagatattt

SEQ ID NO: 32373 - DNA, 1662 bp, Bovine  19866881378030
aaaatggtgaggaattattcctcttcctataggatacccttttgtgatgtggctttgcagcaactcctgtcaagagatggtatcaatttctctacatccggaacctgggcttggggatatgatttgctttgccagtggaacattaacacctatgatgtgagtagaacatttcaaaacatagcacacaggaccctccctggctgctcttggtaaccctgggactactactaattacctgctggatgatgacatatggccagttacctttttttgctactagcaatagacaatcaaccacaagacacaccagtgaggctactttcagctgacacatgattgagcctgaccaacaacatgtgaactggagatgaaccatgtcagctgagacttaactcacattgcttttttggggagctttgcaaaagtcatctcattagcataagcccagttgcaagtggaaaggggcttgttacgaataacaagaccccatttcacctttatggctaagaggtgatttcaggaagaagactagagaccaaatatcgccaaagatgttcccattgctcttatagctcaagaaattgctagggttttgggaattgtgagccaggaaccatggatgaagattaaatatatatgagaaatgtattttgggcatctgagtgactaatatatctatactgtaaaccacaatattgcagactagtccccctacacccacttttctctttttctttattaataaacctccacacttcctccacttctccatatgtgagttttatctgggcacctgactgtccagctggagactaaatttcccagcttctcttgcagctaagctgtgatcaaacacagctttttttttcttctgatctttgacacagatcaaagtgtctgtgtcaaaacagacaaagttttgacctgtggattgtgaatgggagaaatgtgtggtaaaaaagctgctgctttccattctcctttctttcctttccttttcccctccccattttctcaggctgggaaatggagtcaccttagacccagagatggaagccacatgttaagggtggcagagataacccacaaactcagatcccagaatgactttgtaaattcgatctcttattcatcctgaaccgcttgcctatgactggtctgttatgtgagagaaaaatgcacttctatcttaagtatgccactgtattttgaggcctctaccctaactcatacattaatactgcagacataaacacataaacacacactacctctatagtacttagaactcaggagttcaataaatgctaaattcttgcatttattcaataacagtgactgagctcctattgtgtattaggcagaaagttgcatggataattacttttgggggagcagttaggagctaacaaatgagaagagaaagatagaaaaaaactaacaaaaaagggaaattaaaggtgaagagtaccataacagactactctgtcaggggtgctatacagagaaaatgaaaggatttggatatctcttaaaagtttgctgcagtagatgaaatacaaatcatgaaacgaaccatccattcaatgcacctgtacaatttctttcacagagtttggaggcctcctttcactttgtgtctgggtcactgaccttgagctg

SEQ ID NO: 32374 - DNA, 975 bp, Bovine  19866881411684
tccctatctgaattttttaaattctgtaaaaactatgaatacatctcatatagtagttataatgaatgctgataccattataaaattgttaaaaggataattcagtacagtttctctgtttcctgaaattaccttatctattagggtaagattccaacttgggaggcacataaatattcgagaacaaaaccatctatttgtgaaatgtgaagatgaaaaacatgccaaactatctattctttatgaccatcaagctcctttactttacaatattattttcaattacatcctcaagtggcacttttattttataatttaaaatagcacactggataatatataaacctgagagtagctttactacatcatagtcagtgaaaataaattctgccccttgccactctagtgtacttatcttgcaaatctccgttaactacatggaggcattatgcatatgagaagtggcatttgttattttattaccacttggttggagctcatgcagacttcctctgcgtactggtttcagcacacactgtataagtggaatctttccaaatcacgtcctctctcggcttcagtgtgggctcgcctgttgctctccctgcgatttttccttggtttccaaataccctcctgctggcccctggtagagcaactccagagaacagcatcctcccatcagtttagtgaacagctgggtttccaaagcagaccttttggttgtgagtaactgtgtgaactccggtgactcacacatccataattatgtgcacgcaggggctctccatcctgcatttgctttttcacctcctgtagtgtttaagtcataaagagaagactattctccattttctaaacccgaaacaacctgcttggggcagccttcgcaagtccttttgcatgtttctgttttccttgttcctgctgatccctctggctttcaaccaaggtttaaccataaaactctcatca

SEQ ID NO: 32375 - DNA, 666 bp, Bovine  19866881861563
tacaaaaaacatatgaatatatctccagttgagtaaaatattcacattaatactggaataaggcagaagaaccctggctgacatcccatctgttcttacgaattaaatttagaaatcatatgtaatatagacatttctgtctgaatatcataaagccctgacacatccaggctttcattagaaagccctacgatgtgacttgaataacaatctgtcttagctaattagtattttcagtttagcatattcacttccagacatattgctgtttgcacatggtaatttaggtaaacagataccatccgcagctgcatcaattaacactgctaatcaaaactgaattcaggtaattaggcacatttatgcaaaaaaatgtataattttggagaaaaactagattcttcagtattatgtcaataagtaaaaatccgcttttgcttaagaagatgaagaatgagaggatagacatccttattaatatatacatcatgcagacagcataaaaaaacctcaaactttaattggcctgtattttcagaaattggatcatatttttcataaatgttttcctcaatgtttccacatagtaaagttgattcacatctgcctaagggggttaatcatcattaaacaggactcaaatgggtaatgaatgctcaagtattt

SEQ ID NO: 32376 - DNA, 772 bp, Bovine  19866881935445
tttttctattattggaaaattttgactggctaattttaaatcgcgggtttctttcctctacaaatatgcagtctctgcacacatacccagtggtagctgtgaaacagttggagaattccccatattcagtgacctcagagtcacacttcaagctgtgcagtgatctcttgctagtacaataaaacatataagttgtgactggctgcagagtcaggagtgggtattttagtgttttaataatctggggccattaattggggtggttgctatacttgtttctatttttgtctcccagttagaactgtcaagaaaggaatcaagcagatttctgcagatgcttttgtaaaactctcatttgcacaatcaaatgtccaagatgtggaccacactttaacagtgatacatgcctatcacatgctttcctgtaaatgactacccaagagcctgagcagagagcaaggatgaagcaggaagtaggagagcaagtcataaggccacagagtttggctttcacaaacaagtcctttctctaattgctccctcctgtcacagccaccacagcagcagaggcagcctctgaccccagctgctctggtctactccggtaacgaggagccacatatcagcaaacagaggagcaggaccttcatggacataaacgtcaaaatcatatactgtagcagaatcccatgaatggaggagcgtggtaggctgcagtccatggagttgtaaagagtcagacacgactgacagacttccctttcacttttca

SEQ ID NO: 32377 - DNA, 978 bp, Bovine  19866882163384
tgggcttcaatagttgtagcaaataggatcggtagttgcagtgagtgtttgggttgacacctgtctcctccaccagctaggctgggagctataaggaccgggacagcaacatgtacaaagtggggtgggagcacagagaagaggactttgaagaaaatattaacaattaccatgtctaccttgctttccatgcctaccttgttcaaaacacttccatatgttatttaattttattcttgtcttcgaaagtagttatcactgtttccatttaacggaagtagaaaccaaggctcaagttcacttgtcactcaaaatcacttggccagttatagtgcagaaaagatttgaatacctctctggctgactccaaagcctgtgtctatctcaactataccgaagagtgaagaggagctggcattttgtttggatcattaaggatgagcaggcatttctaggtggacagaatatgcaaacatttttcttggcaccttgacttttgggtctttccgaaggaccataatttttattcattcactgacatcaaatatgtttacccagaattttctctggctggatgctagaaattcaaacactaagagataaggtccctgtcttccaggggttataatgccatcgcacatgttggctatgtacatatatggtacccataatcagatgggtagtaatagtaggttgctaaattacattccaggaaaatgatacaggtatccagtgagtccagaggagggagtgatcaccaagggttctgtggtcagaggcagcactgaggaatagtgggactcaaatgtacattgaaacaaagagggttttgggcggggcacttggattaggcacagcagtgtcatgtcttatgcaaaagttgcagttaaaagaggggcatataagcataaattcatggaaagttagatttttactcttacaacttctttaaatagacaacgaagtgtaggctcttat

SEQ ID NO: 32378 - DNA, 2624 bp, Bovine  19866881142176
atcatgaagcagttaaaaccccctaaaaacacagaactcggggctgtggttgtcacttttctactttttaccaagttcactaagaatcccattaattaaatgctaagcattttcacaccgctagagagaatattctatacagaaaatgctgcattctgagtggtatgatcagtgaagtcctgtaccaactgtcttgggaatttaaataatccctacaggctgatgaggttgttgtgggctaattcctgcactagaaaagtgccttccttgaatttctgacttctgagatctttcccaactttaaacaactaagaatgaaacctacaatataaacattaattctttgttttcctgttacctaatttacatgccttctcaattgaaaggtcttcattttccaaaaatacagctccaatatggtcgataatatagcaaaatataaacagtgacatttttatgacataaaatcaggagctgacatttgaaatttctaaacatggtacctggtttagctgtgtcaaaacaaattgtcatgaggcaaaaacctcagaatgtgaaaaaaatataggaactagtctttccatacagtgtaagtaactaagtatcatattcctgaacatgaaagaaaatgtaagagacttacttttcctatacatgatgataagagaaactaatttgttcagaaatacattaacaacatttatctgaaacaaaaatctcaagactcatgggagtttttcatgacttctctcagctaaagccactagatactttccaatggacatattccaaaggcttctaaattgtaggtctacagaagactgaccaccaagcctcagaggtctgtgaaggaagatttaatgattacccagagattttgattcattgatgtctttctcctcccttcttctacgaatatagaaggaggtcattaatatagtttcctaaagccacacagaaaaatggtaaaaatgtaacagccttttctgagaagtcattgagaacacagtagttggtaatgagaagctcaagataaacaactaatttcttttcagtcctcattgctataggataggagagagaacctttcttatagaaaataaaagcagacaaagaagtgagggtggtttgctaacatgatcgtccatcaaggggagcaaacagaaatctgtactaatgcagtatcagccactaaggagttcaagtttaatgtgtcctgcaatccttctcactatagataacaaaagcaagtaaaaccaaagaataattttcaatctgtgaaactaagaactttgtttttggacatcatcttgcaggtattttctttgatgaagatctctatcttctttgcttgcccttagcagaccttggtatgctgcttaaaataatatttgtggctttatctgccattcttttacccagacatgttgattttattaaagtaagttgggtctgcattctttctttactattattacaggtagacttgacagacataggacctttgttttaaaatgctctgctatggaggaaaccttatgaaataagttccattttacctgccgggcaattgcattctgaaggtgcttctctcgcgattcttattttagccatatgttcataggacttctggaggaaaagaagaggtattaacaatcatcagtagcattgcggagaaatggattctttagggactctctggctatatgcctgatttaccagcctgcataactaacgtttacatatgtatttggactctagtcaaaaggtaacagtacccaggccctaaaaaaaagaaaacgaccattgagatggtatcaaggctgtgggacttgcataacatctttcttcattcttcaactaccatcaccctccctctcagctcaggcatatgcagtcattgtacagaatcagtattaacacgctgcagttttaggtaagctaagagttttaaaacaaccaatattttacccataaatgtcaactacttatcatgctgtgctgccactactgccaaccaacctctctgttggaagagcaagtcccagaaaatcccctaaatggactctaaagcactcctggttttgatgaacataacacagattcctttcaactctcaactccaatggctctgcattcacaaacacccgtggcactgcatcctttaccaaaaataaataaacagggcgactatttttttcttttaaacatttaacatgaaaatattcaatgtgtgaagtaataaaatcacatgtagttatttcacttttaggagtgatttccaatcctatcgctatgttaatgacacaaatgaccctaaccttcctatactgtatgaaggatttaacagatgttatctctgcaagaaatattctccacaatattgggaaagatccacacacagcttcagaaactaaaaagagcttaaatgccaacctaggtgccattctagccacctttcccccttttagacttccatatatgtttagcatgcaaacattaagaagagtaagggaagatgatacagagagggtggtaagagaggatgtgcatatacaaatatatgctacagtaagcagagatggggcctaacacatatgtgtgcacaagccatactacatctg

SEQ ID NO: 32379 - DNA, 1185 bp, Bovine  19866880363680
atatatgagattatcagatcctaacgtctatttagttttattttataataattcactagatacaaaatcctctcacaacaaatgatttttccttcataagaaaatttcctgaaattgtaattgccttaagatattctcattatcacaggcaacttttctcttaggcttacaaatgagtaaatatgttactttaaacaaatgttaggttatcttccctccttctgcttcaaattcgtaatgtgccattttgaggtaattcaagcattttttcagctttcaccacttaatttgtatgaattttgaatcttggggcaaactgaggtcaaggaaaaaaagtccctgtggatattgctgtaaaagatcttttaatacttttaatattagatctacttgtagagtgtccatggtacaatttaataaattctggttttgttgcctttagtaaaaagtttcttatatcagtccataaggaattttttggataaattcctttcttggtcaaattatcccattaactgcactgtctactgctgagagactctgttgtgaaaatgagacttaagtaactttaagtgtctaaaattgatctctttcccagcatatagatttactgctgccaagctataaaagaacctttatctcatatcttgtgcccaaagggaatcttttaggctcaactttccaaattggctcagagatgctctataagatactttccttgctctcatgtgttttcactgtctgattttatagacttaagtttttcgacatttccaacttccagcttactttctccctcccctcaaatctccatttccctttgttccatgcccccaaatcctcaggcaactcaaatcacccccaacttttacctagttccccaagaccacactcaatgtagggaaagaatggcttgtagaaaccatacatgcagttatttaaggaaagaagactgtaatttcagtataatgccattaaaaatgatcaataatagtactcaaacacagactctatgctcctggtatggcttatgtgtgcttgtattttttctttaattttaaaaaccatttttacatggaataaaatgataattaaatgtatagtttaggagatgaacattcttcttttaaagaaggaaaatcaaacaaaagacttcttcattaaacattgtggataggttagtcg

SEQ ID NO: 32380 - DNA, 1436 bp, Bovine  19866880545831
tatgctatcagcaaaacctgagattgtgaaaagtcatctcccccctgtcctccctgttttttttttgtctctgggtatcagattatgattgctgagaaaaagtatgttcctgtaaaagaaagtttaagatagatagcagttgctattacattttatttttaatctcaatatatttaatgagtataaatgttttagcacatggtacttttgaatttatagccaaatgaatcaacagaaaacatatcatcttattagatagtctgcttagcatggttatatcactgaaagttattcagtgccccaggagcattcagacttaacctggtataatagctatcactatgtattaatattaaaatggctttaaaatattttactcaaaaataatcttttccaaatatttaattccttgtgactagctaaatactttttataagctgaagtgcttctatccaacacatataagttggaagtgacatttaaatgctcatatgttaaaaagcaacagtcacacagagtacttatttcatttttttttaaaggcaacacactaagatatttttttctgagaacaaatatttgcttacataaatacaaccacataagtggtttgcttgttgaaagagaattgattatttgcttgtatgacatggttcctaacaaaaataaaaaaccacataactactagcaaatacataaaaataagtagtcctaaaaggagaaaaaagaatctatagagttatgtgaacataaaaataagtcttttaaaacttgcaaatataatacaatgaaaaggtataggtgactactgagtacaataaaaacattagtatctatatgttttgctacaaaataatttattttttataatactttattaaaatgttgatgtcctaaatatattgaaacactgttttcaatactgacttttaaaacactattatatccaaaatttattgaattacatgtacatattctggacaactctaacatctcgttcataaagtcaaatcttttttttatctattgggaagaaaaggcagtcttctgaaattctcttattatatatttatggatcatctttatattttttaagtaaagatggatctggagcctgtagacagaaaatacgtgttctgtacatctgtgaagcagctaagatgtaggtaattttcaaagttgagaacagcaaccaaactaataataatagtaaaacaaaagtaaaatataagtaaatttgacaacagctatagttttatcaaaacttccccaagagaacaaattcaggggtcattaccaaaaggaaatatggaatcacaataaataacatccttccacctgaaagagagccacagcccttggtgcataacacggtcaccgtctatacaattcatccgagattcagtttcaatatttttcatcacatttcagccaag

SEQ ID NO: 32381 - DNA, 2338 bp, Bovine  19866880572120
tggtgattgcagcctgaaattaaaagacacttgctccttggaagaaaaactgtgaccaacctagacagcatattaaaaagcagagacattactttgctgacaaagttttgtctagccaaagctatatggtttttccagtagtcatgtatggatgtgagagttagaccttaaagaaagctgagtgccaaagaatttatgcttttgagctgtggtgttgcagaagactcttgagagtctcttggactgcaaggacatcaaaccagtcaatcctacaggaaatcagtcctgaatattcattggaaggactgatgtagaagctgaaactccaatacttgggccacctgatatgaagaactgactctttggaaaagaccctgatgctgggaaagattgaaggcaggagaagaggatgacagaggatgagatggttagatggcatcaccaacctgatggacatgagtttgagcaaactctgggagctggtgaaggaccggaaaagccgggggtgctgcagtccatgggcttgcaaagagtcagacataactgagcgattgaacaatgacaacagaaatcctgttaattctgacaactgacctcttaattctattagatttgtgttctgtacaatttgacaataatgaaaaaacatcgtagtgaacaccaggataaaattctaagtggtacaaaaccctgtacattgtatgatgctatgaatctgctgtgatgaaatgagggaaatagcacctttaatttgcacagaagacattttcatatacacaaaggattttgggaaaataggcgcttgatgttaagatattgacaaatgaattcaccagacattggcttttgaagctgggacatattagtttagggctgtacagccttggtatatcccagagtaagtcaatgtggtagcctcagatgtggactcagaccaaactgtagctcactctctcaatttactgtctctctccccactgccctctcccacactcttgctatcttttgcttaactctgaaccttagcattattgcaataatatagtttgcttgtaccaataactttcttgtcaagagacatctgttctgttatgaacagtctcttagtaaagcatcaatcatgtcttacttgtaaagcaaaacacatttttggggtccctagatagcaaaatactgctgaaaaaacaaactgtgcagaaatattaactgtggcacattaatatatgcattctgagctctttttgtttgtctaccattggtgccatgtgattctgacagtatgagctgctgacctcttgtctctggaaccacagaggactcatcaatgtcctccctagaagcttgtaatgggctgattgccatggagattcacacaataataggatgctatattttaggtgctttggtccaaaatgctacaagcacaactgataaaatgttgcagttgttctgagtgactttcgaagcttgaacccatagtgtcaagctacctgtgaacttcgagtcagtcatctgggttgctttgcttcatggacataagacatatgcatggtggacctgagcttctgattaacattctgatggctttgtattttgctgttgggctcactgcttgcatttataagacgagattctctgctttggggccagattattactttctaagcgcccatcaacttcacgtgtaacagcttatattggatgtgttgttctttgcgtacatcaaggcttgaagtgaggtataagagagaaattattatagtttgggtaaatatttctgtaccagaagccaaccttggatgttgttagggctaaaagtaatgtgtcaatcagtgttcagttagggaaaaaaatcatgttatgtatttcaagtgggagggactaggtacaaaggacttaggactggtggagcaaagggagggagagaaggagccaagggagtaaaaaggaaggagtgatgtgcaaagatcaggatcctgccagtgctcttagctcagccgccagaacttgcacctgcagcttcctggagcttccagagccgcaggcaccactcgggggctgcggggacagcccatccccaccgccccgacagcaaaaatccccagctgccagcagcatccactgcagtgggaaccagagcaggaaacttctctgtccctcctgctttctgatctcttgaccatgctttccaatgacagaactcaacagggagctgaatgaccagggaagggagtgtggggagcatagtctgcagaaccccggaagccaacacagacattggggggcggggtggaactagagacaaggggtgaataacagcaccagggcccaacagagt

SEQ ID NO: 32382 - DNA, 926 bp, Bovine  19866880580881
cagaaggtgagcccatgttatacccaaggagaaaaggaaaatcctgccaaaagttccagtgaacctcatttagcagttgcactcatcatatcttactcctcctttgggcccaaaggatcaaaagtttcattttcacctcattttagggagctggtttggattgaagtcacatacaaaatgaaccgtctccaacatctatcatcaggaagtaactcaagctcaagataaaggtcactggtggggcaacaggcttgtgttgcttattctggcttctctctcctgtcttggagatcatctggaagagccaccatgacttattctttataagctttacaagttggaatgagagctcttgcatgttgatgagcccttgataaagtacacaagtgtaatataaagcaaaatggactctgctcatgatggatttgaacagtcattccacagaggtatccttgagccaagcccacaacattttggctcctacttactcatggaaacttctaactgattgcttaaaatcacttgccaattattgctctgaagaacaatcccttgaagtagaacttatgagggtccatgcatctcaaatgctaaaatttatttgaactctattgtgtctaggattttacccactgaatttatttggaagcttcatgagatatttattaggagattatatttggagaggtattagtataacatgtgaaattctaaataatcatcttttaaaatgatcatttgattacaccatttgaaagtcattaaaacacaatattcataagagggatatttttcagatgtagaatgtttaattattttaagtgaattataaaaaatatctaatgatagttaaattgattttaaagttactcagtgaaaatccttaatataagaagcagtttatgtaggtattaaactatgcaatt

SEQ ID NO: 32383 - DNA, 1188 bp, Bovine  19866880630858
ctttcagtgctttctctaaaaaaagctccttggtattatatctttgtgtgatttttttttttttttttttttaacattgccatagaaagttgaaaatgtttgcatggtttactctctgagtttgttctcctgagcatgcttagtgccaccgagtggtaattatttaaatttttttctaggtccacattttaataattattggggtaataataatcaatattgttggtgtgcttttctatttacaagcactcacgtatatttgactgtatgtgattctcaataatataatgaggtaggtagtgcaaatgttagctctttgaagataaagaaactgacccagaagtttattggattgcttccaggttattacatagccagcaaggaagggcactgacccttgaactcagatctctttctctgagcatgtccgtccttctatacctcagatgacaagactagtcaaaattcacttctgtaatttttaatacagtttttgttaccctggacgccctttctattagaagagttccttttctaaatgaaagtgactgattttcaagttgccaacaatttatatagtaatatgtcactcattctctgcataaattaattctcacattaaaagtaaaagaatccaaacgtatgtaaaaataatttagagattgattatataatcatatttaatcatgtttttttctacagtggacaaataaatatcctcaaaggaagcaactgcagatcaatcatccctaaaagctagaccaaacactgcaggaacagtgtcagcagtaaccaaaaagggctaatgttttctaagcatcgtttacaccagtggctgatgtttgtcatgagaaacacatctccatttacttacattgcctggaacagcttggcttgtaagggcatgtgttctgtggaggccagaggtacagtgtcatgaatactagactgggtttggctcgcagctttttcattaaacttttcagggtctccgtttctttatctgtaaaatgacaagagttggactagttaacttaaatagtgatttttttataccatacacatcagtaaaattcgttgtatttctttggccgattgaacagaaaagcaccttagtaatgagagggcagatgtaataaggtgactgagatgaattaacatataattcatattgatctgactttattt

SEQ ID NO: 32384 - DNA, 3723 bp, Bovine  19866880653326
ataagcttactcttattgggaactggctacacaattatgtctactaataaattatttttaatttttttgaacacacctggtgattccaggccatcagagggtgatttagagtgagtcctgggtccagtcttgcctttctgtttaataactgtatgaccacagacaacttctccattttattactaacaaagaattaaaaagagtttctacttcattatattgctgtgaaaattaaatgagaaaatgtgtaatgtaattcatacagtagctgaaatatagtaaatgctcaataaacattagctcttatcatcaggggcttccctggtagctcagctggtaaaaaatcttcctgcaatgcaggagaccccggtttgagagggataggatacccactaggagataggataggataggaagggataggctacccactccagtattcttgggcttccctggtggcttagctggtaaagactccacctgcaatgtgggagacctggatttgatccctggattggaaagattcccttggaaaagggaactggctacccactccagtaatctagcctagagaattccatatttttgtcggctctttggaaggggaatgtgtacttatttgtaagagttcatctaatttagtcatgcattggctatattgaaacaattttttttcagtttaatttcctttgaacacaattgttctacaagctcaaacatgtacattaaatttttcttgacatttcattacttttacattccttgggctaacagcaggtttttaatctcagacagatttttgtgccttgatcatcttaaaatatttactgaaattagtattcaaagaaattaatgtaacgacactaaaatgctttagatagaggttttcatttcacacagtacgggggatgaactgactggaccattttcaacctaaggtaaatttggagtcacattgattcattttggagctcccttaacagcttccttgataacaaatttatgcttagtgtttaaagttaatcagaagcaatatcatttttccaaaagtacttaattttttctacagttcttactgttcagtatcttaggtctcataggatacaaacaaaaacaaaaaacaactccattaacttactccatttcagccaagtactctctattccttgcggacgagacatctcattttaacttccgtattctacttctctgctatcttcatactagaatcgtttaatgtcataaaagatgtcatttttatgtactttccttgcaattggtaaacaaacccaccattcttgtcactgttcccagaagaatcattcacaagtctgttcttttacttccaaggaaacatgaatcatcccgtgaagtactgtcactgacactttaatctttgctactggagaagttgatcctttcgccttagattattccctccatgtgttcttccatcttccagttaattccccaattaatcctcagtgggaaatcattgctatcgctttatatttctagagtactttattttaatctctagttatgctcctaatgcatatgatttggtattataatgggcttgattcaagtttacctggctctcagtatagggacattgctagaattataacatttcttatagcccttgcacacaatttgagtataataggaacttattgaatgttaatcgaattgattgttgtctttgaaacatctattactgattcagccactaaaatttcttggtcatctactatgtgccaaccacactgaggtaaaattgtgccctgtatatctagtactttaacaatagtgtattatgttgctctttcttgaatctcatcctccttttgcagaaggtaaaattaaataatgaatgaacttgactttcatacaagcctctattcaattgttcgtataaaatttactagacaataaacttaggagcctgaacattttgtatacatttatactgactgtaaactttttttagccaaaggacttccctggtggctcaggcggtaaagtgcctgcctacagtgcgggagacctgggttcaatccctgggtcaggaagatcctctggagaaggaaatggcaccccactccagtactcttgcctggaaaatcccatggacggaggagcgtagtaggctacagtccatggggttgcagagtcggacacgactgagcgacttcacttcactttatttcatactgactgtaacatttttgtagctaaagggcacccagttactgattacccaattttaacctttgaatcttccatatttagtatgattaaaatttgttaataatttttgaataatatggttaagcaaggagagtttgaaatacatttttttcatcttgtctactgtttattctacttaaaagcatgttagaaacttgaacaaatagtgcaaaacttgggtgcaggtcaagaaacttcccttcaaaatgacagaaaccagtgtcataacacaatgggtgcacacagctcccactgataaggttctgctacacaaaaatgctatgtattcatatatctatagccaaaatgttggttttccctcatgaaaacactttctccaaaatttcactgtttctgaaaaacaattaacctgtcaagtttaaattttttcgttcataatttggactgtatcctgccattgatatttattttaatctcctattgatttctgtgggaattcttcttgtagaattaaggcaggatatagtctcaaaggagtttctgcaaagaagtttcccactttcatctctttgtgttgggtttttattaagtttaggtcatgacgttgtatgcctaaaaataggcctacaggctaaagctatgataaagtcttctatttttgtgtcaggctgaaaggtcagtgagaagtctcacagggaagaacaacattataaacgatttctaacgtgttttggtccagtttctaaacaattgaaagctattcatattaaaatcttttttactttgtatatccccaaaagtctatctcccatgagatttgtctttaaactatcctttcaaaccatgtttaaaacattttaaaacactagatataatattatattaggtagtcatttaaaattacagttatggtgactatagaattatggatcttgggaaatcctttggaatgattttaagtttgaaaaaagaaaaagtagaaaattatatatatatataaatatttatagcaatgtaaaaatacacataaataaagatggatagcaaacagaaatttaaaatttgtgttgtaattggtggattttgtgtcttatcaaatttcctaatgctctgtattttatatgttaatattaaaattcaagtgcaaacaaataatataacttagcttttaaaaattaatttctttattttaattggaggctaattactttacaatattgtggtggtttttgccatacattgacatgaatcagccacaggtgtatatgtgtcctccatcccgaacccccctgccacctccctccccatcccatccctctgagttgttccagtgcaccggctttgaagatcctgtttcatgcatcaaacttggactggtggtctattttacatatggtaatatacatgtatcaatgctatcctctcaagtcatctcaccctcgctctctcccacaaattccaaaagtctgttctttctgtgtctcttttgctatctcgcatataggatca

SEQ ID NO: 32385 - DNA, 813 bp, Bovine  19866880664292
aataatcccccatgagaaaagaaaaggaaataaccaaaggcagtgacagcagaagtacaaaaagggaatgcaatcaaaagatagtccagagtcagaacccaccatgtcaccagcagtaaaatatacacggcccaatttctcggcatccatcactgtattaagggcaccacacacttttatctctttaaatcttcataacagtcccatgaggcatgttctgttcctcatacgtgctttacagattcaggaaatgaggattagagaagtgaagtagcttgctcgagatcacagagctgtgaaacgggagaggtgggactgaactcagcacgacaaatgcgtatgataaataccctccagcctgcctagatgagcaagacaaatgaggaaaatgtggaaatgaaagatgaccatcttgtttatgacctgcattacttgaaaaatgtgaattccattgactgaagaaagaatgggcttcccacgtagcactagtggtaaagaacctgcctgccaatgcaggtagacttaaaggacacaggttcaatccctgggttgggaagatcccctggaggagggcatggcaacccactccagtattcttgcctggaaaatcccatggacagaggagcctggcaggctgcagcccatagggtcacacagagtcaggcacagaagttgttgcttcttgactagaaatatccttgccatgggatacacagaagaaaccacaacagatgtcagtggctgcagcagtcttagtgctgaagggcagctgaggcaagaattagggttatagagagaattggagctttccta

SEQ ID NO: 32386 - DNA, 1062 bp, Bovine  19866880679003
gttttttggagccttgatgtggttgttactgcttagaagaattctcatatcaggagggacgattgaaagccaatgctgagggatggccaacattcagtcgttgatagtcccatctgtttctctctttggttttgtaacttcatgcccttctccaacctgaagaatccactcaggtttttttttataggaaaagggagaatttgaatttgaattcaattaagcaagtgtggcgaagcacctactatgcagtgcctatcaagaaggttcacaaaccaaggagagcaagacatgaaactgctgaaggcactgtttctgtctttgacatttgacctaatataattatctgttttattttcagagtagtataaatgggagcatgtgatgattgttttcaaacataaaaggaagtttcttactggtattttctgaagaagaaaaaaaaaaggttttgtttcgttacaggaattccagacatcttttggcaccaaatcaccaactagaatcatataaactgtaaggacaatgtaccttaagtaatgtacaacccaagtttttagtagaaatttacagagcatttttatggtgcttcacgaagggggcaggttatcagcatatgtgaggaagccagccgtgagctgcaaagtaaaaccacatgcactaagcattccagagtgagctaatcgacaacaactgcttcaaagtcctccccaaacaatatctaagcaactttgaaaagtcacacagatcggatgtcctcctgacctcgttcctaaacatatgcttcaagtgtattttctcatgagaagttgtatgtttaagacagataaccaaaaagcagaaagtaggttttgaggaatgtaaattatttgatggcagaaacagaaggcatctgctttcgagccaacatttgaataaaaagttatttaaatgttggtattgccattaagcagcttcactgaagatgggaatgaaaaaagaattgctaaatccatgggtttcccgtggacatcttggagttagaaccaaagaaacagtgcatgttcattcatgctgacagaagaa

SEQ ID NO: 32387 - DNA, 1614 bp, Bovine  19866880680411
ttgagatttcctgtgcactgcttccaaacctcagtcagaggcacacatactgtatttcatccaggcaaggctgttgaagcgaaactgacttctgacagtgtttccatctgggattctgatgataggatttgattaggaactgggcctgtagtatcaggatctggcatctacatgttcgtaagtccagaagtcaaaacacttggtgctgcccatggattgtctacagaggcaactgtaaatgttttgagttgaaagaaatggttgtctcactaatcataggcgtggtgcttccctgaagttcttaaaagttgttctttttacctcccctctgaaggtagcttagtacagtgtctgtaaccctagagttggacataatgcacaatttcattcaacttactactttcacagattaagaaactgagactcagattttggtgatttgctcaaggacaaagcagaaaatcaggattaaaaacctggctcacaattcccagtccagtcctctttctgttatgacattttttttttttttttttaaagcaatgggttgttggctatagaatgaagaaaaaagagcatgtgaaactttttttttgtttcaaaccatcaaactccacctattagtacatgtctataagttaacagatagctattctctgcctacaaaatagccaatatcttaaaaattcaaacacaaacagatagagcagtacttactttataacatatgtgccatggactttcctaagcagttctctgggtggactctatgcttctttaggatacaaacattgcatttattcacaactttttacagttcatctaaaaaatcagacacatcaacacactcttctactgcagtgaagggaaatactatttttatgttatactctgttctaaaggtaaaatcactaaaaagcatcctttgaaaagcctgctattgggagctcagaccttgggggatggcatagaattgcagatgaagtggagtcaagggagcttggttcagtgctttgccccagcatttcctgggaaggcgaatatagaaatttggttacttaaggagatgtgtaaaccttaacaaaataccaaaacaagtgcttcggtatgacctccctcacctgttgaatctgctgcttctctctccttcactgagtaaaattcctgctgagcagggtacccctggaggaagcctggactgtgtggtcagtgagtgatgttctcccttctctgaaagaagtgcacacagggctcaccactaatgctcacttctgctttgagcagtgtggaagtggagggcagagttgatttttagaaatcctaataatggaatctgtttcccccaagaagttagcaaatgtcaaaaggtcaaaacctccttctaaaaaaaaaaaaaatatgtggaagctaaatcttgtaactgctcaccaaaatactttgttccttgagtcttttaaacagagcatatacagtgttacagagaaggtgatagcaccccactccagtactcttgcctggaaaaccccatggacggaggagcctggtaggctgcagtccatggggtcatgaagagtcggacacgactgagcgactaactttcacttttcactttca

SEQ ID NO: 32388 - DNA, 849 bp, Bovine  19866880690855
agttaaggtgtagccaaacatattagtgtttcaaacaatagattctttatactttaatacaataaaaatctttgtactatcgtcagattgtttaatgtgtgcacaacagtactttctactttaaatttaaactcatagagtgcaaagtttatgcactgtgttcagttttagctaataattctatgaatatacatatacctagtaaatactaattgatgatgataattataatttgatattttggacatgagtttcccaaaatagtttgatgtcatacagtgaattgttcttgaacaatggatgtttagcttgtatataatttcacatctaaataataataaaactcaccatggggattgatgctatactatcagtatatgcctttcattaagagtcacgggtttgagaagatgaaaagaatttacataaagatggcatttaaacatggatggaaattgaaaaaacttttttgattgcgtattcagtaaaactgtaataggaggaaatgacaaacatttccaactgagaggtcctcatttgttatcaactggaattctttaataagaatatttaatggtccattcccaccaacaagaatggacttcaaataaagctttaaacaataggttgtttaccccagcgtagcaacagttgtaaagcaacaattcctttttctacttctcttgcaggctatgtaagataaaggtatgctgctgctgctaagtcgcttcagtcgtgtccaactctgtgtgaccccatacacggcagcctactaggctcccctgtccctgggactctccaggcaagaacactggagtgggttgccatttccttctccaatgcagaaaa

SEQ ID NO: 32389 - DNA, 1417 bp, Bovine  19866880723334
ttcccagaatagtcagccgtgattttcctggttcttcagatccctgccttctgcagacccgccccgcccgccccttccaaagcggccggtgtgcgctgatgctgtcacaggtgggtcctagccctgtctcaggaactgtgagcacatactggctttctgcctgcagacacaagcccgcagggagcgagtcgcctcactttcacacaaacgcccgcctcccccagggccgcccctctcccaggagtgctttctcaccgtatagcagtcactaacttcctatctaaaatatgactgtccacgtgcttctgatttccttctcccaaacagctgctaggctttccctccccctgctggctcacatctggcagctttatggggcccagagacagaggagggaaatactgtatttcccctttcccatcttttgttttcattcagtgcttggcagcaggtgaaggaaaacagtaagggattggtgcgaacagtcttgctcagctccagggtggtgtgacttccttttctcttctcctgtttgcataaagatgctttcaacatcaccctgtttttctacactgtacttaaaaaaaaaaaatctgtaccttttgttggagtagatgggtttgaagaccaagcattttcacacccccgatagcaatggaaactgacattggtaaattagactcctacttgttaataaccatcagaaggcatataattgtgcattgctgttgtttagtccctaagttctgttaaactctttgtgaccctacggactatagcccaccaggctcctctggccatgagatttctaggcaagaatactggagagggttgtcatttccttcaccaggggatcttccccacccaaggatcaaacccacatctcttgcattggcagatggattatttaccactgagccactagggaagccctaattgtgcattagtgccatgcaaaatttctccatataggaatttactttaaaaatactgtttatatccagtgactgagctactaggaagctcttctcagaagtgttgatattaataaaaagattaaaaaatacctcagtatacaagacttaagaaactagctaaaaatttatgtaatccctaaaatggaatactacgtagcattaatataatgtgtggtaattttgagagatctttacaacgcattgttaaatgaaaaaaaatctataccttaaaattcccattgacataaatatacccctaaaagttcaagattaagtgctccaatacgtaagagcctactatgtgtcaggagatgctggttcattacctctcagcctggtaaccactgtccttggctatctatcatctttattctgcaaatgatgaaactaagagtcagggagggtgagtaactttcccagcatcacatgctagtaagtag

SEQ ID NO: 32390 - DNA, 1046 bp, Bovine  19866880739508
actcatgccagtgtgtctgtaaaaacaaactcttccccagctcatgtggggccaacagagaatttgatgaaaacacatgccagtgcatatgtaaaaaaacctgcccaagaaatcagcccttaaaccctggaaaatgtgcctgtgaatgtacagaaaatccacagaaatgcttcttaaaaggaaagaagtttcagcatcaaacatgcaggtgagaaaccttcataaagagtattaatttatcttatattggggatagttttctcaattcaaagcaattttctcagccaaaatactggtttattagaatgggaccatttaagttctgtaagatgaattatgatattttgtaaacaatgctaaatttgggggagactgtttgctcctgaaaaagcaagatgagatccctggaaaccaaaatgagatccaagctcagactgcactaagtccttgtcccagaggctaagagagcagctcgcaacaggagttagatgacagatgcataggacagtcatttctggagcatcttcaacatacacccaggcagcacacacctacccccaccaaaaatgacagtgcagtcagatgtaattttggacaaatgttctaagtgcagaaaatgttgtgcgaagttcacaaaggacaggataataccatttactgtggaattgtatctagaaatgaaaatagtaaggctaagtatttaatgagaattagagaaatatattaacatattgttaaaggttactcaaggcattccttaaacctgatttggcttccttcatcacagaaaaaaaaaaaaaaagtctcctggactcagaccctttcagtgttcatccctgaccttcttcctctgatccaagaataagccagctctaggtgtttgacacagcctcccactttgcttcagcatcgctccaccaatcacaccccttctcttccacacctttaatgtcctcaactctgtagtcttctccctccaatttaaaaacgttctcaaatttctttattggcatcttactgcaatgtgaactttcttcagcaactat

SEQ ID NO: 32391 - DNA, 1433 bp, Bovine  19866880774455
atgccagccaatatatgttcttcatggaatatgactatcattaaatagattctagcattttcttcagtgagataatcagattacttatgaaatctttgcatttagaatatggcaatagaattggaacaacaaaagttttatatatatatatatgtcttctgaatagtaaccaaaatgttagatgttagatttaaaaaaaaaaaaagcaaaaaggtaaggctaaaattaaacaaaccttaattttagattccagtttgttacaaacaactttgaaggtcaaaatttgttctagatcattcactgatctgaaggaatttgaggaagttggagcggtttcagggttaacaaaggaattcaggcctttgggtttagttcagcacgtgaccccacagagcccctgcagaataactcagaatcgactggggctgagattctgaggccgacctggttcatggcagttcagactagtgtccccaaaccacgagagcatctgtggcatggcttgactgacaaggaaccgttcagcaccactctttccccctctactgcggacagcgttctgggctatgtggtaaatctcttcctgcgagaccctgaggtctggaatttgtactacaacacttctttgtgttgtgtctttctcatgtttgtgtcagttaggacagagcacaaatgtttagcaaaggattccaaactcttagcaatacttaagcaatactaaaagtatgtggaatgtaatcttagtttctcaattgcacacttatttctaaatataaaatccttctaagatttttttttctcaagggttcgattcctgtaatgaagactgtagtttagagtcacacacagctgcaatgaaggctgggcgctgccacgctgctgtgtgtagtgacaggcacgtcgtctggcagcgtgaactgtccaggtattagtttcctcacctgcaaagtggaattagtggtaataccctttgggttaatttaaaaacgtaaagtaaaataatgcattccagggcttagcagaatgcacctagtaattcctaataaattgtaggcatttttctttgttactaccaatcattctttgtctccaggtcttgtttccattcaaaacaatttaatatttttatcaaccttaaattctgacagtttttgtgctttctatttatctaaaatcaactttagtggaatataatttacatacaataaaatgtatctattttggtatacattttgacagatttatacacaccttggtaaccactacaaccattcagacacagaacatttttatggctccaatcacattccttgagacttttccaaataattttcccacttcagccccaagcaaaggcaaccattggctacccttctgtcactatagattatatttgcctttctagagattcacataaatggaattctacaata

SEQ ID NO: 32392 - DNA, 3425 bp, Bovine  19866880851865
tttaggttgtttaagtaataataaaaatttttcttaatattattcaattggctgattgacttaataataaggaatttattttaaacatcgtgctaaatgctgtgtatttaaagaccagtaaaaaaataaaaactggtttcaaggagtttgctatattatttgttgtaaagtctttttcatatttagaatgattctgttaggatggatttccagatgtaaaaaatataagtatgaatacagtaaagtctcttgatttcttaaaaggatataccagttcacaattctttaaaaatatatgaaatttattttttcccatcattcaatccagatccttatatttaagaagtcaattaacatttagtgaacatttaatctatgctacatgtcaggtcctgcacaatgaaataagaatatagaaattaagaaataactgccttgcctaatcgagtggggagaacttgtatggaaactattacttagtgccatagctgagctatttagaaccatgggaaccagaggaagagatgattaattctatctgacaagttatggttcataaagcttatgatattttgagtttggtctttggggactgagagggggtttttctgagttggcatggggataggaatttcattaaagagtagataaagtgcatgaggtccaaattgtgaaagtttatggcatctttaaggcaactgtgaattgtctgttttaggccagagtccaggaggaagaaagagcaagatgataacaaaactaaaaggtgtcctggggccagatcctggctaaacttataaatatgctaaggtaactgaactgaaaaaaggagtttaggaaagagggttgatgtaatcagatgtgtacttagtaagttaatactaccttcattgttgaggatcgtcaggagagagtagaaggagtcacggattagtataaggcaccaagcgtgagcgatgaggataagagccatgtagaaattttaggaaaatcaggactactgagattgagataatttctgaggtaaatttcaagactcaggtaacaagtgactgcaagtgcattgagaaagaggagcctgggattctgtctctctcatttgaaaccccaaagggatacaggtatgcaacagtcttattaggaacagtgaagtgaagtgaagtgagtgaagtcgctcagtcgtgtccgactctttgcgaccccatggacagtagcctaccaggctccaccgaccatgggattttccaggcaagaatactggagtgggctgccatttccttctccaggggatcttcccaactcagggattgaacctgggtctcctgcattgcagacagacactttactgtctgagccaccagggaagccctctttgtgaccccatggactgtagcccaccaggcttctccatccatggaattttccaggcatgagtactggagtgggttgccatttccttctccaggggatcttccctacccagggattgaacccgggtctcccacatcgcaggcagatgctttaccatctgagccaccagggaatctaagggaatcttaggaacagtacaagagtacaacaacaaaaatcgtttttcatgagggggaataggaagtaagttcacatgtgggtctctggatgataatatctagcagagattatataagggaagttcagataaaaattatggtcctggaagatatgagagaacgagggagtctgacatacaaattttcatgccattaatgtaggggtgatatttgacgttattgggaaaaacaggaacgttcagtgaaagcatggaatgtgaaacaagaaataagcctgaagccaaaattttgagacctccacatcttcaaggggctgagtgaaggaagaaggggcaataagcttgtggggaaaattagcacaacagtctcagagtctctcagaggatggagactttcaacaatactctaaggcagttttcagtagtagctataaaaacaagcatagaattattttttgagtgcaacaaaaatctgaatgctgaatttaaccgggaaagttcccatggtggacatgatttgaaaggtctccttgttaaagatgggaggtacactaagtcaattgattgaaaggacaattctttcaggaacaccagctcatttcaaatcgccaaggcactgtgccctcaaatacgtctgcacagtctctgatacaacctgaacacactcccacccagtaagaaaggctacctgtcagtaaggacttgggggaagcttggtgttccaaggtgtttacctgtgttgtgtgatgaatgctctcactgtctgaatctatctccctttcagacgagtgtgagggcttccagcactcttgagattggtggctgctgacactccctggacagtcttctcaatcttcccaagttttccttgtgagaatttcttggtatggacttattgggataccatccttccttccacttactgactggaggagtggtgccagagagcaacacagattgtaactggtttaagtaaacctccatttctctggactataccctcagtactcttcagctcatcaggagctgacctcctctcttcttaaaaagatggggagcaagtagacacagaagagatcaacctggagagtagaaaatatcatggaatctgagactaccattgccaaaaatgtctttaatttcagatgtgagaaagggtaaaaactggcatcaaagaaattgatgagcagactcagtatggcatatggccagacgcctcaccacgccttcatcaagagaggcagtctggttgctctccctggcatccaggctggctgcaagcatttgtctggtcaaacgaatgtggtagatgtgaagccaggtcagaagatgacttgcggcttctactcagacctcttggggcactcatttctgaaccccatctgccttgaggatagggaaacctcaggggaaggcgatgatgcctttgccagcaaaagcccagccagcagttacaccaactgccagccatgttcagggctaccccggaagtggatccttcagttcctgctgagcagccttgtcgggtgatggtgcgtggaacaaagacacacaatcacccaggagccctgtcccaaatgtgcatcatgagcaaaacaagctaaattcttgatttaatttaccaaatatatgaatggtttgttacatggcagtatataacttggtccaaatatttccaattgcctaacaatctttccaaaaaattagaagctaacagctaaagttgtaacttttccaaagactaacaaatctaaagccataaagactcagcaatggaagatgtaagatatgaagtatattctattaataccattccttcttaacaactttccagttattctttatgaatttatatcctgaaggaggaaaaaaaaat

SEQ ID NO: 32393 - DNA, 3536 bp, Bovine  19866880866184
taggaacatagggatactgtctttaaagtaacttttttgaagcaacgattccatgcatcagagatgtgaaccatggtggagagggctattaacctatgtattcacaccattctcaggaatatgatacaaaagtgaaagtgaagtcactcagtcgtgtctgactctctgcgaccccatggactgtagcctgccaggctcctccgtccatgggattttccatgcaagaatactggggtgagtggccatttccttctcaaggggattttcccgatgcagggatcgaacccgggtctctcgtattgcaggcagactctttaccgtttgagctacgagggaatccctgatgtctaaataatctgcttaaatgaaaattgtagtgtcatatattgacaatagtcataatgaatttttaagaaaaaatgttgtgtttgtattttatagaatggtttgcagtcaaaccaacagtgggagaatctactctcgatcatcgtcctgccaaagcctctgggaacaagagcaattcagtcgtttcaaaggaaagacccgctcctgtgtgttgtaagttttttagaaggttttttctttttttttttttttaacttgttaaaattgatatttttcttttattttgttcatttaaaatttttaaaatagtaaaaaatgttggtctaggcattcagtctagaactgtgcaggaggttgacgtgctgtgtttttctgtaggtgctgcgagtgtgagtacatcgagggctaagaaacagtcaaaacaggggaaacccccaagccagggtgcccctactttcttctatatgagccatcccaatactgatttctgcttaaaaaagtgagtctgatacaggggaagcgcattggcagagctcaaaacttagttctctagcaggtggatgatgaatcagtcctaaggcagacacagacaacctgcacacctggactttccaatcacttgttttacaaaaagccacaagtttaaatcctgtgaattcagaaagcactgtataccacagtatgctgtagccacaccacaggctaaagtcagtctctgcctgacaattttgtatagcctgcaaatgaagaatggcttttacatcttcaaatggttggaaacacaccaaaagaaaaacggtacctcctgacacgagaaaatgcgatggaattccagtttccatgttggtaagtagagctgtactggggacacagccacgcctgtgcctttgtgccttgtctgtggctgcttctcatcgagagcagcaggctggtactggctacagagactgtctggcccacaacgtactcagcaaataaaaagatgagggcaatacaaccaatactttttaagacatgttgaggacatttgctaaaaaaaatattcactatgtatcagaaattcaaatttaacagtgtcccatttttatctgaaaacactactcaaagcttgaaatataatatttactgtcatgcccttgatgaaaactatcctgtggactctctacagagcaggctgactaaagtgtgaagacagatttcttgggcaagatggggtgaagagggatttcttgggcaggatggggtggaagttcctggcttatataagctctgggaaagcaatgtcaacagattctttgtgtttttttttttttaaatgacttctcagaacctttcatatgctaatatgcattatgaatattaaaagggaaaggtatagaatgaagtgttttcaaactctatctgatcacatggggcttccctggtggctcagcagtaaagaatctgcctgtaatgcaggagacgtgggttccatccctgagtccggaagatcccctgaagaaggaaatggcaacccactccagcattcttgccgggagaatcccatggacagaggagcctggtgggctacagtctgtggggtcacaaaggagttggacacgacttagcaacttaacaacaacaatttgatcatacatcactattatttagttttgttttgttatggcttgatagctcggtcggtaaagaatcttcctgcagtgcaggagaccccgggtttgatctctgggtcgggaagatcccctggagaaggaaatggcaacccactccagtatccttgcctggaaaatctcatggacagaggagcctggtgggctgcattccagggggtcacaaaatgttgggcacgactgagcgacttcactttcacgtttcacgcattggagaaggaaacggcaacccactccagtattcttgactgtagaatcccagggacccgggagcctggtgggctgccatccatgggatcgcacagagtcggacacgactgaagcgacttagcagcagcagcagagcaactaacacttatggcttggtagaacaactgttccccagagcacactttttaatattgagaccttaggccagccagtgcctcaaaatacatcaccacataatctaacagaagtgaattccaatgcttctatgaggaaaaaaaaaaaagagcagttcatagtttcccttttagattctgagaacacatcctccccttccgcctacctcgggctccttccatcagggatgtttgcagtaaacgttccagcagggtgggagctggaaccccgcgggctggggtggggaggggtgtggtgggcagggaggagattgcagtggcctctctctgttcacctgcctgcctccacccctgtaatagagctcaaagggccagactggagactggggatgaccaaagcaaaggtagaaatgagccaaagcaaggctttctgcctgtataacaaacagatgtcaggtgccacgcttaaaaaaaaaaaaaaaatgacagttgcctactgatatctgagttgctaaagagtattcttcatttctgttgtcttttcaggaaactttcaagactcagaggtgagtttttcgaaaaactgtatgctatcgttatttcagatcgggactcctagtagcatggcctcttgctgttccgtgtttaacaacggacgaactgctataaataactcgtcccccatcttgcgctctcatgaggcctgattccctcccatttccgcggtcttgtcttctctttttcaagatggccgccaggtgccctcatggggccgggcagcacaggatgggaagacatgagcttttctttctccttgactccagcctgttgtagatcctggggctctctcaaccgaggcacaacaggaattaatggtttgggtttgactttggtaattatatggatgagagccccttttcctgggctttacgtcatttctccccacatttgtgagatggatgccgttttcggtcatttctgataagagcagagtgattagtttggataagctaacagaactgggaaattaacaggagcagaggcaacaaccctccactgaaggaatttaaccctattttaccacctgagatggcacttggcactgaatggtactgaaatcacaggctgttcatctggaaaagtttctcaatatattgatgccgggggtaaaaattaa

SEQ ID NO: 32394 - DNA, 1304 bp, Bovine  19866880869980
ctaacgctttttacagataaaataaggcaattatagcattataaaatgttcagtttttactcacattaagagacacagggagtcattgcaaaacaccaaattaattccattgtatccttgccaataaagcaaagatatttagatcataaatttgtcgtgcacgttcctttgggggaaaaatctaaatagctacatcacaaacactgaaagccctatcccagcatctctaagtgtgtttgtgtgtatgcttgtgcatgaaagagagagaaactattacctaaacacacttaaaaaccactacatcttaactcaggcagggttggcaccacttaactggctttggtcatgtggttaaaatgactacttagctgtgtttaaaatcagagcttcctatgttggctgctcatgcagattccgcctagagaagcaaaaacaatgacccgatagctgagacaagacgttagggatgggtgttgatgaaaagatttccttgtattattttcattagatttcctgcttgcctcatcaatgcttcatacactgggtgccaaaaagtagagattacttttatggagcatcttgtgaaattatttcctgtaaaatttgatgatcttcgccttagtgatataacagagcatggtcttttctgcaattagagacaaatgagccgggatgtgcgtaatcacaaaatgccctagggacactcgcttgaggcaagcttagataagctcatgtccatctgtggtcattgccttccaagttcaagcatgatgccacccaccactgtgttgatagtcctgctatcagtgttccaaaagatagtcatctttgctccgctatgtgaaaaggatatatatctactttttattagtagcccctatcatcaagttctgtgtgtttctcctttggcctaatcctgacacccaagcggccccatttcactctatcttgaggtttctcaatgacagcatttttgacattttgagctcgataactctttgttaaagaaaactgctgctgctgctgctgctactaagtcacttcagtcatgtccaactctgtgtgatcccaaagacagcagcccaccaggctcctccatccctgggattctccaggcaagaacactggagcgggttgccatttccttctccaatgcatgcatgcaaagtcccttcagtcgtgtacgactctgtgtgagtcccagagacggcaggccaccaggctcctctgtccacaggattctctaggcaagaatactggagagggttgccatttccttctccaaaaaaaagcgaggccaaaga

SEQ ID NO: 32395 - DNA, 1799 bp, Bovine  19866880870886
tcatttttaaattcattttctctatcttattttaaaaccaaaatcccagttcaatgacaaggtcacctagctgaaaatactcaacttcattttggttctttaggattaattttatcagctgatattggttttgagctttcgggagctattgtatgttattttctctttatcacccaacttttcactcagtaggagcaaatccagattctggtctagattattttagtatttagctactgtttagggaaagtccttgtcatgtaccccaagtgtctgagaatgccatctgatttagaaggcacacctaaaaccaaggaacaaatgaccgatttccccctcagctcactgtgactaagagggagtgtttcatcttcacaataagaggaaatctcatttctttggaaaaaaaattttcagtgttatctctactcacattgcctaagaagaaattataatagcagattattttgttttaaaagaaaggatgatatgacgttataaaaaaattgtctcttaaaaaaaaaaaaaagatctctgagtcagcattaagggcagatttatttgaaatggcaatgcaatcagagaagcttgaaaagttctcagcaatgtgtccatggagtgtttataaagtccatttcaagtctcatcttcatgccctactgcagagttaaaatttgtgactaattacattcactatctgaattcggtttcttttttaaaattcaaagcagtttgattacttttgtctttcttaagactcagaagaaaaagcatgttcatatgctcaatgttttataataggacattttcttgtaacgaactgaactaataggcttaagaaactattataatagagaagcaatttctcagttaggtgacttttatgtgaaaatgataatacataacaatttcctttaaatgattttttttcttcccagaatggatcacagacagacatcagttattggcatattcatgcatacatatatatttttgcctgattggctatagtgaaatttgtcaaatatatttattgttacattttgagaaagcaatgtaagataggaagagagaaattatgtagacaagcaaagatagagtcaatcctcaaaagagtaatatgatgaaaaagctaacataatggtagcttaacatgtaaactatgacctagagaaaaataatgggaaacacaagcaaattcactggttagttgggttagaaataataacgcatatagttgtgttacatgaataacatgactgaaatagtcactttcaacaagttgtgctaatattgccaaagtgggaaggacaaaacaccctttaaattttttactttgttttttagccaatattatctggaattgctcatagaatatttattataaattaagcacttgtaatatgaatgatagggccattatgcacaattattctttttcctagaggaaattttgtttatggcatcaaacatagataaatcacaccatagtacagtcagcagtctttatcagcactctgagaaccaggaaatgaagcaactcaacacagtttgggctttaggatattattcatattgaaaagcatgtttggttggaaagaaaactgaggtagcactacttcttatttattataataacatgatgcaatgtcttcaccctacaggtctattagattgctggggaggactcacaattcaaggtgcaaacaggaagaagcacatccattgccatctgtagataaacctgagtcgggagtcatctattgtgcatcaaaggagaacaattatctgcaggacat

SEQ ID NO: 32396 - DNA, 748 bp, Bovine  19866880882741
tctgcagagctggcatagagagcttggggtggctgtaagaaacgtgaaagtatttgtttattaaaatcaaaatggatttttctgtgttgtaagacacatgaaatcaaaccacaaaaaaaaagacagtgctttgcaataaattagggcagtataaccattgtgcgtttgtacatgctcagttttgtctgactctttgccaccccatggactgtggctcaccaagttcctctgtccatggaatttccaggcaagaacactggagtgggttgccatttcctcctccaggggatcttcacaacccagggaccgaacccggcaatgtaagtgtacactttaccactacaccacctgggaaacccattaacctagggatatttatataagcatatgtgtattgcttttatttgtaagactttattataattgagatataatccatgcatgttctttaaaatattttactcttcgggcttatgaaattattgttgtttataaagcctcaaaaacaaggctttttgctttttgaaggagatataaatctcctgctttatgaaggacatataaatcaaaagctccaagaagtgttatgcactaaaaggggaattaaaaaaactttttttcctcaaattagattaactatttaagccaaaacaaatttttctctagtgtctagaccaggctttagaatttctgttttagaataaaaatacttcagattatgtttctataacacactattatagcacat

SEQ ID NO: 32397 - DNA, 1004 bp, Bovine  19866880906442
atgtgttttttctccatttcatgtccttaatttcccaaacttgtttgtgatctgtcaaagcagtgacttgaaaggattgtctgactcctagggttttaccataacaaaatttctgtttctcctaggatcttgctctgaagagcacataagtctaaaaccttgcattgagtttcaagggctttaaataatagggttgtcttagcaaaagaggtgattttccttagggaagagtcttgtccaggagaggttggactcctgtgtctatccacttgtatcattttgtctgatttaagattttaacagttccctcaaagtgagattcatcatataaataagactttatttaccaatacatctgaagtgaccgagatgctaattgctattgaattatctaattaatttttattttaatgcaggctctgaaccaggttgtcctttgggacaagattgttctgagaggtgataatccgaagctgctgttaaaagatatgaaaacaaagtattttttctttgatgacggaaatggtctcaagtgagcaaccctttgtcattttttacatgcgatgctatgtgaaggggagagaaagacatgatgtgtttttaaagaaaaatgttacaggctaaaaagaaaagttgatagagaagaaaagtatttacttagctctgaactggaagattgagcagaaacagtgctgtgcaagccggagcctaagcgctcggctctcttgccctctgggaactgaatagtcagactgggagggcctggggcttctgctctcagcagtgcagtgtcctgggctgctgatcctgaggtgggactgttatccccagagggctcctgtagggctgtcagaggaactgccagggaacctgaaagaggaagcagcctgttggtccaggatttgatactgaggttcctggttttggttcacttaacctctctgaacctcagcttctttttgtacaaaataaagaagatctttgggtccgcttggctcaagtct

SEQ ID NO: 32398 - DNA, 2783 bp, Bovine  19866881013248
aattttaaaatgcacacatacactgcctttctattttaacatgggaaatttaaatcagcagaatagaaaagtgtaactgtttgcacattacattctgtcaaggataaaactattatcatttcttagtttcagaattggacttactatagcagggacaaggtggactccatcgtttctttatcactgacaccctataactgcaaataaaaacatacatctgaaatgaagatgtttcatcacacacacacacacacacacacgtattagtagaacaggaaaatattctataaacagtagtggaattcacaagaatctatgctgaacaatcatgctgctaagtcactttagtcgtgtccgactctgtgtgaccccatagacggcagcccagtaggctccctcatccctgggattctccaggcaagaacactggagtggttgccatttccttctccaggattgctgaacgatcatagtagggcataaatttatcatcgctaatcaacttgaagcataaaaaaataaagttagtaatttcatgatgaatatgtttatcatattttcattattacccttttgatgtcattaaaggaaactcatggtgaaaatgttaacatttaggatatgtatcctatataagtagttggcatgaaagacttctcatctatttttaattcttcttgactgtgaacacattggaaaaatgttctacttttgaaagaaggagaaagatttgaaaatatttccttgaacacgaagtgtataaatgatacatatttcagaaactgggaatcacaactcaatagttaaaaagcaatatagagcagtaggaccaatagttaatagttttataaatatctacaatattttataatttaaattttcttatatggttatctatgtaatatttatagacatatctaaatcttatatatctatatactacaacacatattttataggtatagatatatctataatatttttaatcattggtctaattactttgaaattttcagctattgaattgagattttcattttatttatatacaacgctatattttatacccaattttatatacaagcttatatttatataagcctttcacttgcctttttatgaaatatactacttaagttcctacatgtatgcatggttatacaatatttatttatttatgcaatcccagtggcctttaattttctgatgtctagggtgtcaatgttatctgcagtcaagcaaaggtgtctaggttaggactggatgaatatacacagcacactggtccacaggggcctgggattccacaaatgcctcattcccagtccacgtgatctgtcttgaaaatctactgggttccagtgggtacaccattttagtttctccaaaagaccttaaaagtatagtccctgttggtaagatttcacaaggtttagtgtggagttcgttcataagagcactggcttcagactgatcttcagaaaagttgtttgttgtaggcaattattcttatttttaaaatgaaggaggagggaaagtgggaggagagtgagagacggtaaatcagaatggggaaatcagtgatttatcttactgagctctgagttctcatttgatgagtgaaggaccttaatcaggtcatgatttattgcttcacttctgttattttattaatatgtccagagctatatatcaattcctaatctgttagaatataggatggattttactacctggtaagtaatttgacctatatggagaattatttacataggatacagttacaataattaatacaatatttagaagtattttttccaaatgtgttaaataaattttattataaaaaataccccatcactaagtatcttccacaagttagttaccttatcctttattttaaaggatattttaaaatatattctattaatatctgtcagcaagtatgaaaagcagcaaatcaatcaaattagactgaaggaaaatagccccaaagagctgtataatcaaaactgaaagggatccccattttttatcccagataaattatatgcagggacttgagctccaagaatgcattcctaagaaaaaacaaaagagttctgatatagacatttagtacaaaatcacacttaaaattaccagtgatcttgatatccagagttgaagagaatgtatatcttttaaagaagttggccttcttatttatgtgacactaaatggctcagattcaaaattgccggcagctcctcattccaaggagcatttggcaactcacaagtctgacagtttccaagtgcactgtgttataatggatcttttcagcccaattcgaagcaaattttcccacataaacttaaatttctgctcttcaccctgatctcattttcagagagcaactgtctgagctgaaattaatatatccactttctaaaagacattcactgtgttatatacgtgaaagttgctgagaagagatcataaacattcttaccaccaaaaaaaaaaaaaagtaattatatgaggggattaatgttttaactaatgctgtggtaacagtgtagtaacagatatgtgcatcttatcatcatattatatatctgaaacttacacaatgttatatctcaataatatctcactaaagctgtgtgttgggggagacattcacacatgataaaatgtaatcttccacagaaatcaatcatgggagggtgcatgctcagtcgctcaggcatgtccaactttgattgactatatggactgtagtggccaggctcctctgt

SEQ ID NO: 32399 - DNA, 1485 bp, Bovine  19866881054396
agaggactcctacactccctcaggccaaattatttgcttcctccctgatactaatatatttttaccgtggcagagcttttcagatatttatatctctgtaccttctataaataagccagtgcacagccacccaatggaacttcccgcaatgacagcatggtgtctatgctgtaccaagtgatggccactagccagtcccatgtggctactgagaagttgaaatgcagccagtgttgcccactttattttaatttgttaatatttaaatctgaacagctacatagggctagtggctagcatattgaatagtgatgatctagtacacagcaaagaacagaacaataactcctcaaaaagttcactgaatgaaataattatccatgaaaaacatattgggcaaagaaaaaacacttgtatagccccatttctggttttctttttcaccatatacagactcacattggtttactatattaataaacatgttcagtaaaatattgctttactctcaagtctatcccatatttatcttgcataataatatgtatatatgaaccacattgattttatcttttactgtaaaagtttttaaaggatgttaataattctgatgtgcaaatatttaatttataattgtgcctggtctgcaatccttttttaatctatatctttcactgataaatctcaagcgactagctcagggcctagaagggattcaataaatacttgtccaatgaatgaatgaatcatgcacactggggcatccttgtgaagtgtgatgatctaatttacaagttaccttcaaatattatgcaatttttatgaacacaatgtaataattaaggaaataggtacattaaattttgtagacattaagcatctattcatcttaattttgaagatttttttccattggaagtttggaaaaaaatctctattgtttccattttccaaacaaaaacagtctttgtcttctgaaacgtcctcaacctcctcaaaatgattgactacagaaaccacaacattcaaaatgtcagtttctaagggaaagccggatgggagtgagagtgttctaatcggttacttcttaaagggtaaaacggagattgaaagctccgtccaaagtttaagctcctggaacccagtcctttcccagtgggacccgggatgcgcgtccaccaatccagggtagcaggaccccaagctggagcacccgtgaggccgggcgttcgccctgaggccccgcccacactaggccccgccccagcagaggccccgcccctaacggtgctgccatagaaacccagaaaggccattggctgccgccggccctagaggagggcttttgacacagccggcggcagcccgccctaagacacggtcagttttgccatgtcaagcagctcccaatggagagaagcctaagaagtgtctggtctatcctcatcccccgaagagctcccgcctgtctcggtcggttctgcg

SEQ ID NO: 32400 - DNA, 453 bp, Bovine  19866881077099
aattattaaaagatattattactcagcaagaaaatcaactattatatcccactccaatttgaaatgagtatgccaagtttcataggtgactcatgacataaaccttagtaaccttttcaatacaaggaaacaagctgccaacccagcacatggccacacacgcatatacagagaaatccaagatctcaggaatacacctcttcaaacaaacttttcaacagttaaaagtgtcagtgattgctaatttaccttttccaactgtgcccagttatccaacttgacttttaaagaagttccatttttaaaggatgacaatttaaggtcccaggggtaataggtagtaaatatttctgctatcaggaagccatttgaaaaatccctgttccatagcgataaggaaataaattaagtgcagttacttatacaatttgtatttagtgttaattcagttca

SEQ ID NO: 32401 - DNA, 808 bp, Bovine  19866881122842
gaatgtcttggtcaacatctacaccccaggactatcaggatttccaggcattcgtggtgacctgccaacacaaagtacaggtgagtttgcgtctcctgaagacctgtccccccacctccaacacacagctgcccacccccgccccgccccaggcttctccctgcagcctcattcactatgcctgtggctgaaggagctttctccccttgtcccttcaccgggtcacagtcacctttgctggctgcctcgtgtgtaggggaaggaaggcaggactccagctggggtttggcgccgtattccaggagcagctctgtgcagctggtgctgccctgtgagcacgcgttgaataagggggtcacgccatctatggtgatcgcgtttacctaaaccaaaccagagctctgagaatgagagtcacagaaccactcgccattcctgtcaggcatttaaaacaggtatgtgcgtagaaacagatattaactgagaaggtgtgtgcagcaaacgtgacagcaaacatattaactgagaaggtgtgtgcagcaaacgtgagctatttaagctcacacacacatccgtaagcagagcttgaaaatgctaagggataaatagaaacatgatgtggtggataatccacaggagtgggcatgcaactagtggaattctgagaaaaaaaaatactctagaatcaaatacacagaaatgagttaaataattaggtactttatagttagggaaaaaatgtacaaatgtaatagtgatgaagccactttgctggctggcagcatgaaattggaaatcttatttctga

SEQ ID NO: 32402 - DNA, 1518 bp, Bovine  19866881172119
aaattcagcccagtctaaaactagactttctctccttgctcaagcaagcacagacatattccccggatttttcctaatatgaatttgaaaattgctccaattctttgggtgggaaaattacatcctgtggctttgtaatctccctttctctgtcccagtgtgaagagactaattaagttgtagatttaggtatcagggtggtgatgaaatgtaattccttccactgaaatgtaattccttccaagcaatgagattctgagtctttaaacaaggcaggaacaaactctctgatatggaaagataattggagttagatccctttcctttacttagaagtcatactagataatccagttccactgccagaagttccattattactagctgtagccctaactgtctcacaagattctgctaaggttataaagtcaactggtgtggaaacccacaatctgaagaaatatatagcacatttgctattcagctattttagttctgctcttgataagaaattatctagcagtcctgggaagccccttggatttagtctatatcttgagagttttaaaaactggctaatcactttctgtttttaatctttaatcttttaattgtccatagaatcagctatcaaacccataacataaatgctatttcttggcaatggcaactcagcccctcacctccttgcctttgatggatacttctgattgtatctggtttagctgtttgccactgcatgccataagcaaacacgtttccataccttaatactatctggatgccacactgccttcaagctcagatgactaaataacccatttcagatacctttccatcctctggggcttctgactgcaaccactcctgatcaatttctaagtccacgaaaatatttgtatttagggggaaaaaaagaaaccactccaacgctagtgcaaatagtttaggatctcacacaaaaggaaatccataaggagtacaggcttcagaatcacttaatcccctgaagcaggaatgtcagccaggtcttggattatttgtttcttctctctcctttgcagagttctggattcctcctaaagctatctcacttgaggttctgggaagtatcagtacaggttctgcaagaaaaagagtgactttctttggctccacgttgtgaataagatcttgggtggaagcctctagcagactttcctcctgtcgttttgccatgtgagtaagttaaatcccttaatgtacattcatcattgtgagttctgcttgtaaaaaatcttttctatttgaaacaactcactggagtaggaatttctcttttccctctgggctctttattttttgttataaccatgcagccaggttagggtatgttctattaagacacataccgcataatgttttcaatgtgataattcctaatgttcaaaagataataaataaatgtggaatgagtgacaaagactgctgtttgagaaatcttccctgtagcacccagagatgccaggatatgggcca

SEQ ID NO: 32403 - DNA, 1968 bp, Bovine  19866881197561
caatacttctttttttgtgttacgtggtagctcagggccagatctgaatcctatcgctatactgtgcactaaattaattttacctcttacattatcagattttctattcaaattttacttgtaacatgataatacctatttgtcttccctgacaatatttatgtttgtaaaccacttttaattagacttttaatttttcttatgggttactgggaactctttaagggtattagctgttacatgttagcagatgatatgataatgttataattctattttttatctttaaaaaaaatttaataaaaaaatctttattttttttaggtaccctgtgctgcatgtgatatcctagttctctgatcagggatggaaaccatgttcccgacgcgtgctgcaattcatggggttgcaaagagtcagacatgactgagcgactgaactgaaatgactgaactgaacattggaaatgcaaagtcttaaccactggactgccagggaagtccaatcatgttagaattttagaccaattactattagtccatggggtcacaaagaatcggacacaactgagcgactgaactgaactaaactgttaggacaacaagagaaataggttagggataaaggaactagagaaaagaagactgaagagaaaatgacaacaaaatccagtgaattagaaaatgaattcagagaagtaagtgctggtagacagagaggagaagacagaagttagaaatgttcatgggatagcagtcaaatggtttggttgccagttggatgtgtttattcaagataaaggaaatgaaagaaggcaactctagtgtctgccttggaaaatctagtggttggcagatcagggacatagagggatcagtgtgggaagaacatttggagcttgagatgatctggaacaagtcagtaaacacattcattgggaagctggatatacagaatgggaatggggagaggcatcctggagatagagtcaccatcctatgattaaggatcaaagttatgatagtggatgaggttgtccagggagaccaagtagaattagaattagtggaggactgtgttttgggggaaattgatatttaagggattggcagacagagctgacttcatgatataaattaaaaataaaaagaccaaagaaggaaagtctagacaaaatcaagtttcaagaagaaaagggctcttaaatatatcacccagtagacaaaagttcaagtaggaggaaaggtgaatggggtctattgcatgattagaagactgtgcgtaacttggaccagagtggttccatggattggtgacaaaaaagactgattacatgaacgtgaagataaattaggtactcagtgcatttatttacagaaccacttgaagacaattacaaacctagaccgagatcaacataaaaaagaaaacttttgaccgctataacatgaaatcgatacaaaattctcctaataagatatgatttaagatcctttaaaagtataatcttaaggtacctattactcaaatactgcatacagtgggccaaaggagaaacatcataaccactttagtttcaagaagacattaatgtcactaagtttctctcataaaaattctgagtaaatctgaattaacttagagttgaaggaaaattccttaacactgaaagaataattcaatcccaaagcccaataattcaatatcatatttaatagcaaatataacctggttttataatattaaatcacagaaataaagtaatacatattaacagaaagaaagctgaatataattccactttctggaaacacaactattttctcaaataaagaagactgagcgtttactttccatggaggcttcatttggttaccatttgatgttggtgtagatagttctgttcatgtttttctggccagggcagaaagacttaatatcgtctcttctattatcatgccagcttca

SEQ ID NO: 32404 - DNA, 1570 bp, Bovine  19866881222929
tcaaatgagtcagttctttgcatcagttggccaaagttttggaacttcagctatatttttcaagttaataagataaaacataacacattctatgctgtatctcattaatttgaaaaaatacagcagtttcatggttaacttttattaagtaatgttcatagttaaaatttattattttattgagttttattaggcctctcatgtccatactgtgaacatactcatatggacacattatatttatcaatatatgcaattaacacccaatagaatccacaagtttgataattttaaaacttagaatcagcgagaataatgaaaaaattcattttcatcactaaacagctgtttaactgagcaaatctttactctcagtaggtggcagatatgatagtgatctaagcttgagccagtcagtcataggtgaaccattagtaatctacaggctgtcatagatggttccttgaagtttattctaagtctaacacactgtgaatccaatttaataggattccccgaaagaaagtatctcaaccagtctttttttttttttttttgcagccagtcgaatataagaaatgcctcatttcttccataatttgcttgagtgatcaaattatgaattaattgaaaacagatgactatttctggctttcccagaatcaaatgtatcgactttcctttgtctggttaagttctgcttagttcttgctaagccataattaataagctatgactcaaattttcccagacatgttaatcgcatggcagatgtttgctgcctaaagggatactgtcttgtaaaggatagctgtaaatagaagagttaattaagcctaaaatccacttgttagattgacatgaaagtgtggacttaatactattgtacaatctagcaggacttgtgctttgaccatattttattaagtaaagcttaaaaaccttcattcaaaaaggcaaattattttttattataaacttatttgttttaattggaggctaattacaatattgtattggttttgccatacatcaacatgaatccaccacgggtatacacatgttccccatccttaacccccctcccaccttcctccccgtatcatccctctgggtcatcccagtgcaccagccccaagcatcctgtatcctgtatcgaacctggactggcgattcgtttcttatatgatattatacatgtttcaacgcaattctcccaaatcatcccaccctctccctcttcttttctttccctttgaggtacattttgattatagagcacgtttgcacttattttctttcatgctttccggaatattaacccatgaaatgaaaagacacttactccttggaaagaaagttatgaccaacctagatagcatattcaaaagcagagacattactttgccaacaaggtccatctagttaaggctatggtttttccagtagtcatgtttggatgtgagagttggactgtgaagaaagctgagcaccaaagaagtgatgcttttgaactgtggtgttggagaagattcttgagagtctcttggactgcaaggagatccaacca

SEQ ID NO: 32405 - DNA, 1023 bp, Bovine  19866881234491
tagctgttgagaatgagcaagtcttctgttcttaaaaacttgaacaaaattggaaactcagaaacattattgacatttttatttgatttaagataatttctttcacagtcacttaagctttcatttacacttaaaagctgaggaagctgttcccaagtaaatcctgcaaagctctgatacagaagtatttcagttcagttcaactaggatttcctgattccacggctggagagtccagaaaattataggaggattatgaacctactctcaaaggttaatgtaaatggaaagacatagcatatacatgcatggttccttcacacaggtttatgtgttgagaaccctgtgtggtgctggaacataaactaatgtaatggtatgcttgaattcctgttcaatggacaggaatttatttaaatcttggggaaatcttaatagaaaaagaattagagttatgagtattgaaactataaagcataaagtaagatgttctactattcaaaattgtaaaagattagatatcaaaatcaaaacaaagtcaaggaaatggcacagtggctcaaaaattcaggaacatgccactaaaatgaatttgcaaatatcaacagataagaggaaaacaaggagatccaaccagtccattctgaaggagatcagccctgggatttctttggagggaatgatgctgaagctgaaactccagtactttggccacctcatgcgaagagttgactcattggaaaagactctgatgctgggagggattgggggcatgaggagaagggaacgacagaggatgagatggctggatggcatcactgactcgatggacgtgagtccgggtaaactccgggagttggtgatggacagggaggcctggcgtgctgcgattcatggggttgcaaagagtcggacacgactgagcgactgaactgaactgaactgaatgggcaccacaaaatcatatgttactgatattgagatgggccaatctgcaaaaaaggataagagtataatgatttg

SEQ ID NO: 32406 - DNA, 1849 bp, Bovine  19866881310820
ttagaaacatacagatttctgttttggatttgtgtggtatcagaatgtaagttatgttggatagaatggattttaactcatggatgtgttagagagggcatttcacaatgaaagaaaacaacatttttaccctctaacttttctgaactactttgggaactttgagagctgtcgttatggaagaaattctgatgtttagtttctgaagcaatgattctatcgggggcctccatttctgcagagagtgtgcctggaaggagtatatgctttggagagatgccacggggacagagcagacgcactgagacagagaagggggctgtctgcccgcaggggactacatccccctgttttgtgtgctgtccttcttgctgggcatgatgtcgcttcagacgacctgtcagacactgtaatttctcttactccactgagcacaggagttcattgccaatgcctagacgctgcactgtgccaatctgtatatagggccaggtaaatatggagaactgtgggtctacagggacggagaatgacttttactccttgtctttaacatgtcagtattatttgaatctcattgttttaacattttagaaaaatgactctgtttttaaatgaatctctttcttcctctcccttccttcctgatacatacctgtatccagagggctagttttcaagctggttgacataactacagttgtagtcatggcacagacaattgaccttcatacatttactttgtccctaagttaagctcataaaacctcattccttctctggtatgataataactaactaatcatgcttattatgtatcaagacatctttgagtaattttatgctaaataattattttaccatataacaattaggtaagagctgatattattctgtttttacaggtgaagaaactgagataaaaggttaagtacaagatcacaaaactggtaagggacagagccaggatacaacctcaaagaaccactcaactctgctttgaacagacttctggctatgcaggtatcatatcaacacacgggatgacttctaatctccttgatcccaaggtgcgtgtgtgctaagttgcttcagttgtgaccaactctctgtgacccaacatactatagcctgctaggctcctctgttcatgatattctccaggtaagaatactggagtgggttgccatggccccctcaaggggatcttcctgatccaggggtcaaacctgcgtctcttacgtctcccgcattggcaggagggttctttaccactaacaccacctgggaagcccaaggtaggatttttaaaatgtaagctatggctcagatgatacctacagtagtttccatctcctccctaagaatattcatgttttcaccacagttatttacataattgacaacacatattttggcaatttaaaatattttatgcaattacaaaataatcattctttttcttgtaacttgaactgtgtctcaatctgacatctacaagtgcagttaattatctgtactcagaatgtctgctcagacctgttgataccattaaaatattttaaacacaagtagttacaagttctttaaagaattttatataattacttaaaaattccaagaatgagtttacggggtcatttaatgctcatgcactttccaagacatttgattccctgctccaggaaagaaggatctgttccatttcatacccccatcatttcccttcactttcctgcagctatatttgatagttattatttgtattttgtttacaggataattaaaaaaaatacatttaaacctctaaattttatttcaattatttaagtcatgtctcccatttccc

SEQ ID NO: 32407 - DNA, 1610 bp, Bovine  19866881404256
aggagttgcaccggtgactggttggcaggatttggtccgaccacatcaagaaggatccagagaaatctcctggcaagtgacctctttcatgaggccattttcaggttgggaaaattggtcaaaatttataacagatgaaattatgagatcagagttatggtgagcatggaatacaccattattagaggtaatataaaaatgtcactatgaattcatttctcagccatcaacacattttatcttttcatggatttatttagcaaagagaacatcatccagttctctttttattatctttagggtcagcaatttttctggtttacagtgctgccagtataataaagagcacttcctttcacacttaaaaaagatgcgccaattagaacaataaattatatggtcactcaaatcatcatccttaattgtcaaatccaaagccttcaattggaattttaaagtgtgcctgtgttcacgcatgtgtgaaagtgaaagtgtatgtgtgtgcttgtgtatatgtgagtgtgtatgtgtgtgtgcatgtgcaaagtccacatcgttcataaaactatgtttgaatgtaacatctttgagaatatttctgagttccattggagctatgttctattacttgccaagacttttctggctccctaaaagtttttttttaatcaaaccaggagtgcagatggtcagttctctgcttagtgacaggggagttaaagcttgtttctacatgactacaatctgctgaaatttaactatgacaggaagcttacccaaaatattgcattaacaaaacattacggattctgaaactctccaaagattacagattctgaaactctccaaagagtacagatgaactaggggagaatcctgttttatttatatttaatttctgtggtatcgctgttctactcctgtacaggtcagattttgtaatatggtgaggaaacataaaaaaatgatcactttcagctgactccaaaatacttatctcaaagatagaaatatgctgatttgatttgtatttaatcaagaaagtgggcttcctgtttagaggtataattagaattttctttagatattacctaaatattttttcataatacaaagtttacctatattgtctgctgctgctgctgctgctaagtcgcttcagtcgtgtccgactctgtgcgaccccatagatggcagcccaccaggcttccgccgtccctgggattctccaggcaagaacactggagtgggttgccatttccttctccaatgcaggaaagtgaaaagtaaaagtgaagtcactcagttgtgtctgactcttcgtgaccccatggactgcagcctaccaagctcctctgtccatgggattttccaggcaagagtactggagtggggtgccattaccttctccgacctatattgtcttagaagttggtaaatgtgattagatggggtttggagtagaaagtaatggagtaaagtaattagctctgaaatttctcaaacccactatttccttttaattaataagaaaaatatatctaaataaaattaaaatcccataatacataataacacttattatacattatgtaaaaataaaataaaaa

SEQ ID NO: 32408 - DNA, 1604 bp, Bovine  19866881412468
ttttataacttagaggaaagatgaagatattttaaatattctgaagaaattaagaaagatactaattgaaaaactattgaaaaatgttccctttcttaaacagtttcaaatacttttagtttatcatattctcctctcatactcaactatggagtgaaaagttatgtacgagagaaaaattatttacaactcatttattgcataacctaaagaaatttaggcctccaaactttagtctttcttaataacagaagtagctaattgaccattatttacaaccaaaacctaattatttggaagatgtgacaatagtatttttttcagaattatattttgatatttttctaagagattttgtaatctaaacaaaacttttataatgatacaaagttataaatacaatttagcatatgaatcatcgtgttagttatgctaaatcattatggctaattctcctctgaaaactttccaggaagagtttgatctttccttcttagaagatgatcctgtatttagagaatttaagggccctctagttgagtaacaaaaactgaacagctgatgttttgatggcagttgaactaaatattttgtagctatttcataaaaaagaaactctagggatttccaactagtaagtgaaggataagtaaaatatgaaaccttttggtctaagaggtcagaaattatatctcaagttgtctaaagctatgattgcttctcagatatgaaaactgtggatatgggaagacattataatagatttctaaaaactcatggttgtttggtagaaatatttgaacttcttcttgagtatatagttactcttataacaaaagggtataagctttgtatatttcttaatgatttatgtcctattaaaagttttaaaatataatattattttacacgcattttgagaaaaggtgaaactgaataggggtaaattttcagggtgtattatgaacaaaatattcaaaatcctagattcctaacctctgactaattaagctatgctgccttggtgaatcaatttagaaagtaaggagaaaaacttcgttttaaattactcactaggtgtgtattgtggggaaagtgtcttgattgctttaagtctcaattttcttaagtatacaatggatatattaaggtaccagtagataaactaatttgttgataagatagcagttattttaatcagcagaatcataggcaataccttaaatgcattcttaaaattaaaaagtgcttatttctatgaatatcaattcacctatagtgatgtttcagaaccttgggggaatatgggaattcattgggagctttagaaatcaccggtgcctgggactcaaaccagagatttgtgttcagttgtccttattattatgtggacatcaggagttttagagattgacttaaacgattaattattagaatttatccttgcatagttttgaataagagtatgtatttacttttaaacttgatttgtaaatatcagatttaaacagcttaaagtataactagatacagcagtacatctatatttatttatatacacatataattaaatatatttaatattttattaactaaaaatgcat

SEQ ID NO: 32409 - DNA, 1014 bp, Bovine  19866881525819
tggaaaaaaaaaaaaatactgcatgcttaatggcaaccctgaaaccaaatttctgaaatctcaagcacaaatattgtaccagatgattcctcatacattctatattctatatcaagcctcaactatgaaaggagtgctgaggaggctgggtgtcacgagattgtttttcaggcagcttcatggagtcattacctcgatgaattttccacactctaaaatttggtccatggccttgcaggcttggaaatctgatctgtcggcaaagctggagcaaagtcacatctccgaggtggacttacaactcaaagagcacagtgcaccaaagagtgatgtcaagatgcaaacatattaatttaccacgagaatcataaatgtcagatggactgaaaccctcccagggcaagccagcacattctctctctgtggacagagccagagggggagccaagtcataaccgtaaggttacttggtgatgaaaaagtggaacaaagggaataaacagtaaataaatcaaaaacaagacaggaattcagagtctagagctatgatttcccgactcaccctgacatttcacactagaagaggtgacccatcagacttgccaggcagctgaggacccagctctcagggtggcattacctgggaactacagacccacctgggtgggtaattagtccttcttctgattgacagacttttcctttaggtatgtcactgtctaattctgggagaccctaaggtaaccactactctctccgctggtggatttaaaggtaccatcaggttcattcatttcttatttttgtttattttttgttgtcattcttttctttccattcaggccactaccactaccagaaaatctagggcctcatctcctgatgacagggtctaactgatctaccaacttcaaccctgtcccctacccaactccaaagaccactactgtataaattgaccttaaattagcattttatatgttttccaaacttccctcataccagacactccca

SEQ ID NO: 32410 - DNA, 1498 bp, Bovine  19866881746683
atgtttatgaattaatccccccaaagtaaggcaccattcaggttaaaatagaaactagaaatggtatcagtatagtccctgggttgggaagatgccctggagaagggcatggcaacccactccagtatatataaaataagtcattaatgttctgcaagaaactagacactaactctacctttatttaaattatgttagcatctttggtttctatgttcaactgtttattggtatctatgtaattattttggagaaggcaatggcaacccactccagtgttcttgcctggagaatcccaggcctggtgggctgctgtctacggggtcgcacagagtcgggcacgacggaagcaacttagcagcagcagcaggtatttaattagctgcttgtttaatgaagccatttattactgcccaaatagccataatcaagggtataatgcaaataaagtatgaaaaggattaaaataaattcatcagccaaatatgagctcctcctgtacaatggagagatttattatttcaggtctggtattgaggttagcctgattgactttttggctctgaatcaacagtctattatctcattttgagataaaatctggtgagtgagagccatatcatttgttttgcaggcataatcaaggagaggtatattcatttacctaccatggcacctggcaaaacaaattactgcagcaagattcaacatactgtagtttttactcattaaacttcatactaattttctgcactgttccaggttttaaggagaactagagctttggattgttcatgttatttagacagaaagtggtttcttttacattatgacttaccccaacaaaccacagtgttttggaaaacacttatgaattgcaggagaaaaagaaaaaagaaaaagaaaaaaaacttctctttgtttctttcccaaaataatttttagaaggagatatacagataagaataattaaaatattacacagttttagaaaactcaaacatatgaccaaaatatggacatttaaatacagtaatcactagcaaatgattttaaaagttaatgccaatttatttttgcttctttggctccccgttcctacaaaatgaagtctgcatcctatccatggcttatctgcctgagtttcttgttaccaactcttcccaatatgttcacccccaaggcacgcaaaacagtctgaactctccatatcgtgtcatatcacttccacgatgggactggccccactgctcccactcaaaatctgagttaatttcattaagaagatgtttttcctaaagaagaaaagagtcaactgtggaggtgcaaggaattaggaagtagaaaggcatgtgatggaaggattaggaggcacttgcgttgcaatccaaaaaggaaaacttcaaagagtttaattttattttaacatattttatttcatgtggttttaactaatcagaagcatttgatacctagaaatatggtgttatataaacca

SEQ ID NO: 32411 - DNA, 701 bp, Bovine  19866881753151
tctatagtaaatgcaacttttacactgtagggggatagggggttatttttatctctaaatctgcacttccaacattaagtctaacatcaaccatattgacgttttacgaaagtgcacactttttcttttaaaaaataattcccttacacagttcttttttggcactgtgctcattctcctccacggctttcatatttttattattaaaactaagagctctatggcagggcactttaaggaagtgcttctgttcagttttcttgccttctaccttaaatgtttcaaaattcccatatttaatttcttggaaatactcttttcctgctcaatagcagctttcctggctcccacaccaacttacaaacacctgctgaaccggaaaggtaagcaacccagggactactgagtttacccgggtgtttaacacacagtcctaagaatgagtctgcaggggcattttccagacgctctaaggtgaaggacacagtgcagcccttggccatgccatacatttccaggtcagagtccacattctggaaagcacccacagcttcaagttagtacttgcaaagacaatatcgttttttcaggacaccaacagacttgcaatggccactctactaaccttgactggtcagaataccccagctagcttttcgcttagaagaacattcttctacgctcgctagccttcttttcgg

SEQ ID NO: 32412 - DNA, 1347 bp, Bovine  19866881758757
ccagaagattaaaagactataaactattagaccccttataccagaagagcaagtggaagagacagcctgactgatcccaaagagagataagaagaccagggacacactcccagcaggacagaagagttgggggtgggagggaggcaatgataagactgcagggggagaggaaacccccaggagactccataaatgcaaacatctttctcaatatcttcacttgttcaatccaaagcccaagctgacacatccaagtgaatttcatatctgatttgcctgctttctagcttgatattatatttcgcttacaacatcttatcaaaattatcttttcaatcaatctagagagctttgttttctaaagatttactcagtattttcctcagagacacatttccagacgacctgtttctcattagctggaataaatgggagtgtgtttacagcacagcaccagacttaaaagagttctttcctggggaagctggtcagggatcagcagctctgtcacctaaaggaactaatttcagtgttccgctataacataaaacagagtattggttcattaacatagtcttcaaaaagcaaactgcaaaactcttcatgatatacagttttgctttgaacacaattttaagcagttctaacatacaaaaatctatttatgccaaacagacataatatgtagtgacgataaaatatttaacctgtgttcagcaaacagtgatggcccactgagggcaacatggagactatgaagataagttaagacattcttaaattgtttacactgtggtaactaatccaactttctgtataaataaaatcttcagaaatcaatctttgataccatgggcatgctgagaaaaaaatgtcagtttagtcaattacaaataatagggatttttcagtggaagtcaacaatattatcagaagatgtaattaagaatatttacaaatatattgatgtaagagaatatttgcacatatttttatcattgtaaactatttctcaaatgtcttagccagcaaaaccaataatcataagcaagacaaaacccacttacatgaagtcactctattatctgacatatcttcttctcatggagctaatttcactgccacggtggtccaggcttactaagaccattagtacagtgagaatgagaaactcagaccaaagataatgtagataatttacacataagtaattgcaagtgtggtatctgattaaagagccagtagaatactactcagaactgaatacatatattttgctctctttgggtttacacataactattaatataatattcctataatagcagtagtaagaataaaatgtta

SEQ ID NO: 32413 - DNA, 1441 bp, Bovine  19866880482231
taatcaaaagatggctacaatgaatcaggttgaacttattctagatcttgggaaatatgtaagatttagataaacagaaggtgaatgaaaatcacagtagaacaatatccagagccaagggtttaaggtatcaaagggcaagggtcttgggggatgccaaagcttctgcaggtagctgaagtcatcagatcacaatcaaaagcaactgcacaaaaattcagcaagaaataaccagaggcactgtggcagatattctgattgtttgcaaagtgaagaggagcagatcaaccagatgggactacaaaaacccagacatagggtagatcttttcaaaaataggcatcaagctactcagtaaattgaaaagcagatcctatggtggtgacaggttttgaaaagaatgggtggaaagaaacataagccacagttttgcttttcaaagccatacttgtacagatggaaaataccttcaaatatgaaagatgagagagcgggacacaaaaccgagaacttcatgttgcaatttgagttttctctgtgtttttacacgtcaagtcttaaatggaatagcttttattatttcaaatattatcctctgatatttgattgcatatttaacatctctaatgtgctaaaacttaaaaagttcactttgtataataaatcagtaataatattcatgagaaaacagtattgtttaaggtgactgacatttgaaaaatgtacatctactctgcttatttacaaaatgtttgtagttattgttactttatatcacttataacttttcttgtggcttagatatgacttttttctttgaagttcttcactaattttgttatccctttcatgtatggttgaattttaaaacaggttatggctgattttgttggcacggcaattagatatatggcaatggcactccacttcagtactttggcctggaaaatcccatggacggaggagcctggtgggcgccacagtccatgaggtcactagagtcggacatgactgagtgacttcactttcacttttcactttcatttcatggagaaggaaatggcaacccactccagtgttcttacctggagaatcccagggacaggggagtctggtgggctgccatctctggggtcacacagagtcggacacgactgaagtgacttagcagcagcagcagcatgcctactttatgttattgataagttaccatgaagtctattgagaatttcaaagattcaatagattctgtcacaagagataagaatgaatgattaagtatatagattgatgaagaaataaattattgtagtacataaatgtttttatgaattaataatctaatgctaatgaaatataagtaaatggtaattttttgccagtcattttcttctctccaaataggaaactataaaaatatatgaaactataagtttattat

SEQ ID NO: 32414 - DNA, 1307 bp, Bovine  19866880555607
tgcttattgcctttttttgtttgtctgacttccaagaaacatgtgctggatgataattatgctttggggcatatcttctaagaagcaaatttgacaatctatttcatgatgggttctgttaaagaaacaaaaacactgatggagacaaacctgcaaaatgagttcatctaatttcattggatagactgcatgttttcataagttcatgtaactaaagatatgtttttagtccaacacagatttcaaatcaatggtcagttttgtttttgttttctttttcctactatgtgttatgtgaaagttttagcataaaatttttatgtaaactgaaagcaggcaaacaatcctctctctcttctcaactagagaacagtcacatgatctatgcactgccaatcatttagagattatccatgacaacagtggtatttcgatggacaatgggaactcagaaacaactgaattcagcaacaagcaacaaatactaagtatctggtggggttattgtgatgcaagctgactaagaaacactcttctactagaatgtgtttgatttttgctctttggttccttctaaagtctgttatcacaaacgtattattccttctgacataaattaatttttagctcaataaagttaacttcagtaatttatttacagtttacagttgagatttctgaaaaattaagggccatataaaaatgctttcttttatattttgatatcattacctccctgtctaaagcacatgcaataggtgtgaggaatttgtttagatttattcttcaattgtaaaatatgttttcagtgtgtccttgtcaatgctgttttggttgaaaagaatagaaaacaatttgagttagctgtttgtaaacagatccgcaaaataaaggattatctttgagtggaaggaaacacatttattccactaaaatgagatagtaggaagtaacagtgattgtagatatggttatttttgaaaggaaaaggcagatagctaaggatgttgacgatgctctggccctttatttcatagggaattctcgattgataagagagagcattcatgctctagccctctgcgtctctgctttgaatgtcagagacatgaaatgtgaaacatgtcaagaatacctgcttttacagtaataatggaatgtgtgactttgctattgttggtggtaacatgacaaacttgattatctccctttttctcttgagtcatcaatttctctcctcctgaatcattctaatcaggaaataaacatgaaagactataacttttttatatatatatatatatata

SEQ ID NO: 32415 - DNA, 1076 bp, Bovine  19866880572286
taataaaagtaaccttttatgttgtactgttatctgcagtaagagaatcataaccacagatgcagaaggtggtcgtatgttgttcttttggaacttacactggactgacctttgatcttgctctactgtgtaactttgagcaagcaatgttacctctctgaggatgaggtatttcacctgaaaaatgagaatttgatagccatcttacaggtaattgtgagcgttatttaataaacagagtaaaatgcctgataatcatattcaggaaattatggcactcaatacattgtgagagaaatttttaaaaatcagaagtttgcattagatcctcagagttttgaatgtacattgctcaatgatatttcataaaatattttaaagagaatattaaagaaattaaaaataatcaaatgagaaacactgaagaatcctgaaaataatcacacaacattttaaaaggatataacagtatattctttaatttcatagtgtatagtagtttgggcaggagttctagagaagggaggaatatagaaagaagtataaagcagggtgtaatgtagaatattgctctttataaatctatatttaagtattgggagaaaagtggccataaaatgttttaacagcagttaaatgctttaagtaacttgcattttagatattccataactatcaaaacaacttgaagattgcttctgtatttgagtgtagacagcttctacttgcctatcttctttccctccttccctcccactcccccttcctactttccttcctttcttcctataaatctgaatgtattggggagagtccatttcttttttcaaagtattaaatgcattcctagaaagagtcatctcacttttgtatagatggatttcagaaactaaataaaaacaaatttcaacaacatagccaaaaactatacttacccaagtgggagctgttgccaaggtctattgggtgatcacattccttactcttctgatttcaagtaccattatatttcagcagagggcattattttaaaccacaaaagaaatcttgcttacatttctttgagcttctcttta

SEQ ID NO: 32416 - DNA, 1925 bp, Bovine  19866880646456
tgcttctctcgtcaaagttttcatgatctctcttaatatcacaaagcaatttgataaacaaaataaatcacaaatcctaggaaaaaataatagtcaatgttttaaattcatttatagaatttacattaaaaatgaagtctttagaaaatgctgcttagcatacagaaatggatcttttttaaaattattagtctctttgatttatggatcaagtcacatagctaggcttatgatttttgtacgtcaaatcatattataaaggcagctgctgatcaataagactaactctgctatcagagacccacgtttcccatacagtggacactaatattttaaaagtggcccaaaaaaaccaaaaccaacttgctttgttataataacagatgtggtaaatatgaaaatttgttcaagagatgtatgtagagagaagcagccttttcaggtagtgaatctcatgctacaacattaagattgattctcatgttcagattggatgttgaatgttgttgaccctggatgtatggtttagtaatctaagcaattctagtagtttcatctcttacaaaccagcttcagagacaaaatatgaaccagtttatcattagccgaggctggttcaatagtctactactatttctagctccagtaggaatgcagaggtggagaagagattcccaaaagaaagcaggggtagaaaggcaattgtttccaaaagagagatagggctgtgcctgagagagatagtccactgggcttcccccattgtgctagtgctaaagaatccacttgctaatgcaggagacataagagatgtaagtttgatccctgggttgggaagatcctctggaggagggcatggcaacccactccattattcttgcccagagaatctgtggacagaagagtctggcaggctacagttcatggggcaacaaacagttggacaagacaagcgacttagcatgcacacaccatagtccactacagtaatcttgagtatttctggtagtaactaatattttgccacttggtatgatcaggtaccaggagccaccttaatgtttaaagcattgctcctagatcatttggagtagtttctggacaaggaaaaaggaacactgggaggaaagagatagtactgattgtggggggaaaagtggtggtaataaaggtcaccttaccgcaagtcctagttgtgaccattactgagtcactttagagtgtagttttgaactattagtggtcagtggtgtgccatttaggggaaggagaacagaaagtcagaatggtggggggggttttccatggaaaacaccttgattccaacttcctgaagtgaacatatgaaagtgattagccaaagctcactggctgatgtaaactgtcgtttttttctttcagaaatgttcactgtcatttttttctttcagaaatgttctaaaaggaattagattgttttatttgctcattccatgcttggtagccttagggaccagaacaaagaatgaactatgacccttgtttcctgctattagctctaaatgcaccttaatatgacactatatattaatgttatattaagaattgtaacacaaaagtaagaaaattaggctaaagttcttttttttcttttaaaatcatatttcattagtgatacatccaccaaatggaacctattctttggaattgttatactccttcaaaagcttgcaaattagtgtaaactcgggacctgccgaacatcctttcagcattatgagattccagaaaatgtgaataggatgtttcagttgttaggtaattttccagattcccttttgtgtgtgtgtgcttagataattcaaatggcttcatttcaacacttcaggcttctcatgtacactgtattagagtgtgcaacatttctgaaggaattggcacagaca

SEQ ID NO: 32417 - DNA, 1703 bp, Bovine  19866880656566
attgttaaataccatgggatgctgcatatttaagggagaaaaatacagctttagaaaaattttgtgaaatagaattaaaatcctaagagggaagtaatttctttgttttattcacggctatattctagacatataaaagcatgcctaagaccatttagtatatatctgtttaatgactatatgtaaaatgtattttgttaatacatgtgccttaatagttatatcaaaaaactcaccaccaaagtatcattctgaatttttatctacatcaaaaactatacccctgccacacattccttttccaggtgaataatcaattataatatgtaattgttacaaaagcaaccatttaaacatgagattaaaataaatatagtcttgcaagcaacaaagtctagataacataaacattaagttataatcatggttattttgatattataatattttaaataagagctattaaaaatgctactccaactcttatttccaatatttgaataatgattataaattatttcatgtaattgttttaatatgtttcttggattttaatacatcaatataggtccttcctgtgtagtgtattctttccttgcattaacacaaatatttagtttgacgaaatacagtctacccatcatattcacagattattcccccatgaatatggagggttgacagcactaggccattttatgaaaggatattgagcaagcacctaaagtcctttatccctccagtctgatagcaatctgaaattcagaatagatattcttaccatggaattatattaaactttggctagcaaaagcaacaacattttaatgacttgcatttatgaaactggtaaaactaactccattcattctgtcaagtacctaattgtagagtctataaaatatgaagataaccttgtttgactatataagaaattattccatttggacttcttcaaaacaaaacagataagcaaaaacaaaaaaatatatatataaataaaacctatcacaatattgagatctctcagaattactacttggaattattgttattattactgttgcttggcattcatggttggatgctgccttagctttgtgggcttgatttccttattctaaaatccaggcatcttctgtcaaagaacatttcttcatctcatctggggaagggaaacttgcatcattctttgttttcctctctctttgtaggtatgtgtcttgtccctcttttcagtggtttgtgatcacttctattctctagaaggggccccattcattcagcatactgtgttccttttgcaggctcctaaaatacactactgtttcaaaaaattcctatttaatgtttatcaacacaatataccttctataaatttctgtgttcatatgtagacatatcccaatatataagtatggtttatttcaaatgcccattctaagttggttatttatttatttatttatttattttaatacctaaatgtattttcactggaaaacaatattgaaaattgcatttacagaatcaacagaataccaaaaatcctcttaaacaatgtttttgactatgtggtgtcacacagttaccacaccgtttatgaagagaaatacatttatgtttgcaaaatgactgaacccatatttcccagattatagagatttggatgtaagaaattgataggtataacaaaataaata

SEQ ID NO: 32418 - DNA, 2432 bp, Bovine  19866880680539
ttctttaagagttccttacaattctctgaagaaaacacttgcatgaggtttaaaaatataaactgctaaagatgtatgttcttttgaatgctacaaagatagtaggcccacttaagtctgcttgatgtattctaataaactagagtaagataataaatgtgtaattttgcataaagtttcaaaggagaaaatgaatattagattggagatctagtcagtgctacaggcacaaactagaacagggaagaaaaagcacacaaggaattaagaaaccatctctacaagttattaattaatagatattcaaacgtgtggggacagatgcaaattgaaatttttctttttcctcaatgagtcgcccattgattccctaatgaacacctttatctaatggtgaacgtttgccatgtgggtcagaatatcttagacaattttgcaggatggtctgtttcttctataaacattttttcctacctttctggctatagatttttacaactgctgttcttagtcaaacacttgacattttaccacagaacattacattaccacacctcccacccacacaaatgtactcctttcaaatgtcttttaagaacctctatttccacaaaactcattactttggggaagcctttccatattagcactgaccagaggcaagaattctgtacttttctaattattatctaaaagtagttaaattttatatggacatctaaatctgcttttttgactgcttgtctgtctggctgtgaaagaagtgtttctttacttatgtaaataaatatatggtaaaaaacctagatatcacttatgtagtaataataatttctatcatctatttaaaaatttctgtcaatcactccaagtaattatgtctgtggacctcctttatttctcacatcaatactctaaaataagtactgccatttccattattttacaataagaaaggagagattcacaaaggtcaagtaacttgctcaagggcatacaggtattaaatgacagagcagagatttgagctaatacaatctggtctagagtctatgtgcttcagcatttgctatatggtcttccatttgctatatatatatactttggtcaaacaaggtcttcttttggatcggtttatagtcttattttattatgagcacccataattatcttgggttattttctgattttagaaatttatttttttttttactttaaaatgtaggcttttgtaagataaaaaccatgtgtctttattttatttactacacaacatccattataatatgtataaaatacccatgaacataatacacagtcacatacatacacatatatgtcacagtttgcacatttggatactttactatttataacatttttgtttaactttttcttcctgtgtcataaaattaagtaagcattccatatcattaaatgttattaaaagcagaaacataatttaaaagacttctttgcaaccaccaattcacatttcttcatttcactacaactgaaaaacacttcagtgcttatattcagtcattgttcatattctacccatggatcccctcatatattatttatttttgtatgcctataatccccttccaaaacgttattttcttttgcttctaatgacttaataccataaaatgttgaaagattttccataagatttagaagataccatcagcaagcagaaaggagacttggtctagtagattatatcctcatatagtgtagggtgcttaagtataaaaacccagtttgatcagattgaaacaacctttattcatagtctagattctagtctagaacagcctttcaggattaatttaaagcttgtgtgctgcctgaaatattgtcttgctcaatttatttccccttccctgtcctatgaatttatttccttcctggcttctcctgggaccattttctcaattaagcatttacagataaattctcagatttagggttggctttgagaaaaccttatgtaagacagaatatctttatatgtatatttttgcacataacttttataatattcttaatatatcttcttagatttggattgactgtgtcaaaaagtgtaaatattttattgctttggcatttgtactaatatccattttttccagttataaaagtgccaatatagcagcactttctacagttatttactgcaatatgtactatataattttagctcatttctaacatcaatagagaatttcttctatttcctactggccattgtcatggggttatgagaaggagtagatagacatcagtgttcatgttactattttatctgtaatttcaaatgttcatgatcagcattaaatttaatttaggtgggttctacatgtgttttgatggaaaattaatgttttagtttaaatcttacacgtgtctttacctggggt

SEQ ID NO: 32419 - DNA, 2970 bp, Bovine  19866880877729
tcttttttttctgaaataaaaaaaaaaaatttatgctaatatcttttcccagcaacaaaatgcggatatatcaatgaggatatgaaatcactggcttatcaacaatattataaacctcactgggcttttaacatttttacttaaggttggattaaacagctctcatttccttcagtcgtttatcctgaaaacattctcagtatgatgccgtttctttctttattaatacaagttgaaagaagctgacaagtgaacaagaaatatgtaagcacactctattctaactgatttgttcaagaggatgattcatttaatttcataaaggatcagtgggccagaactgtagatgaccaggtcagtggagggaatgtaggggagaaagaggtctgtgagaaggatctatgtaacaagcaacaatatttagttttttagagctgaagttctgcttgagcaattctgatgttaccagcaacagtcatttaaagagctgctgatgcctcagagaaaacatttttaaagtgtcctatctagaaacaatgttccttgtactgtgtcatatatattaaaactccgtcccttgcttatattacagtacatcgtgcctgattaaaacctgtactactgtaatgtggcttcttgagagtgccgattaaatgtcgctcctgaaatatttcctcctgctgaatctctctgaatatgattgaaatattaatcacttggtaaacaaagctcatgaatggataggatacaattaaatgtttttaataaagtgaatttcatgcaattattttaagtgttatagagaaaatgcaaaatcatacaaacaggctacaaatattcttgatatctttatattgctttctttaatatttaactttgatgatggttcaatatgcaaattatgtcatatttctaagagattgtatggtatttttggatagtgtcactcactagccagtaggatccctggagtaggtgatatgtatcttgtaatagataagattaaaaaactgatatatactctggaaatcataatgatggtggtttagcctgtatagtgctgtatttagtgatttgtttttttggatttcactcaactatacatcgcatagacagaaaaacctcagcttaactattatctttaattttgctttctttatattttaaaggaaactttaaaattaaagcaattcaagtaaatgctttgttgcaggtaatgatttgcaagagtgtagttgtatagaaaatgatttattttgaaagtatattcaatttttcaaagtaaatcagagaggcatacatatttggaacttttctagagggaactaggtggtgctgttctgtcatctttgtgtcttagtgacttctttgattcttttctcagttcattaaacacttttgtacaataggtaaggtatagttttggtctatagtggccttatttttgttaaccaatgaagtttatattgatcttgaatcttttcttttcagcagtatttttgtacagcagataaaaactttcttcgtaagcagtaagctatagcacagtgtaaaatgtcttttttatttcttcatcatttaaattattatatataattctgagatcttcaaatatttatattattatgtgtttttaaattctttggctattttacttgtaaaaatacttatgattggtttaatcaaaatttaaagtggtggaatttttgtgcaaagttgatttaatataaaaatgtcacaaaatgcataagctcaaggcaaacttaattgtatttttgaaatactaaaaaaaaaaaaatcaactaaaactttaaacaaagaaaagtaaaactttcccttgaaaataaattggttgcttactttacttacatataagaaaagtaaccctcaattaggccatcagttaatcttttcttgtttctagatattaagttaattttgtcttatgatcttggtggtacttgatagtccaaataagtctcttatttcaggctaaataacaacaaataaagttactccactgttcatgtatttttggtatactggtattttgggggtatattttcttagtaagaattttgacttctggatacccttaggcttagagaatcagatatgagaaaactttaaaagggttgcagctttttccaacaaaaatcatcctgtaagttgtgtttcttaattttttaatacctttagataagagtgtatcgtgtaatttattttctaatataaatctggacataaaataaggatgaagtacttcaagagttctacccatatgttttcttgtagactcatagttctatcattttgaatggggacaaaaatgacttatgttctttttttcctgacataataaaccctccttactatttttatcataagatgttcaagatttatctttaatagaaaagtgaatgttatatagacaactcttcgtgttttctgttctctctgaaatcttttatctttagaagacagaactcaatgtggaatttcagaatgggtccatggcatgtcgtcttacagtgcagagagataatctctgagatgaacatctgctaggctaataaacctaagtgaaagtgctgctatacttctgtgctcatgtctggtctcctggaataaaatgaaagtcacaagtattaagatggataccagtggctaatcatttgtcaaataagagttcagattgggaaagctgcataaaggaattgagattattcattcacaagaataccttcattttatatcaaatgaaaaacttcctaagaaggattaggtaactcccattttatactgccataagcttaattgtgaagaaaacgaatagtaaataaacactttgggattagataaaaaatcagtatttttgtcttgggtgtcaattttttatattgcaaaaatactttctaacttttagatgatgtcattatgagagtaaatcttcggttagcataaagaaat

SEQ ID NO: 32420 - DNA, 1290 bp, Bovine  19866880994513
tgtacagtaaaacactgttaaagactagaatgtctcaaatttggtggacatataaatcaccctggaatcttgttataatgaagaatctgactctgtgggtagggtagaagttgggactctgtagttctaacaaattcccaagtgatggtggtgatgttgtctgacatcacatactgcatagcaaacctatagactatttcactacagaatcttaatttctcttgtagttaccaacaagaacaaaaacatgatttgcttctgagtattgatcacaagtgttgagctacttatgttcaactgggacactttcttgaatatagcaatcttagaataatgatttttttttttttaactcagtgagactttagaagtcatcaaatacagctctgtcatactatcattgaggaaattgagggtcagggaagttgagtacatgcccacaatcatatagctgacagcaggttgtgcaccagaacgaaggaaccctaactactgtgtcaataaagaaaccctaacttctttggcacttttgtttttatttatactccctggcacaaaacaaagcatgagtcaataatgattagaatttcaccttttggtgctcacaatagtttaaatgatagcagtatccttggacttgctgacttgcctaacagctaaaactcacagtaggcaactgtctcttacaataataagagtattcacatatcctctttcttctagagtccactttcagttttattatggacattttgctccttaattttgagaacctggggagaaaggtggacatagaaatgaatgggtcgttagttaaaaggcaagggtgaggtcgtaaaaggttgtggctaagtaagcaacaaatgagaaagagctaagggcctcaatattgatcctgcctctcatctttccctctgtctccttgcttgcaggtttctattgtgtagtctcttgaacaaagcagactatttatggtgtgactgatttaacactactgaactagtctatcatctgctaatttggtccgattaaaaactggtcatagggaaaagcctggaattaagctcatttggaaacacaacttctgattaatttatgtcctgttcatttatatctcctcctctaaatcaggcacatccaggtgctgatttatagagatggttctttccagattcctgaattttctttccatgaccacctttggttaggtccttgaaaaaagcacagttatgttttttgtcccttccttaaggctacaattaaggcacatacggaagatgcctaagattt

SEQ ID NO: 32421 - DNA, 2401 bp, Bovine  19866881029671
gatttttaatttcttaacttaaaatgggatgcaattgtaactttaccattaaattttttcttatggcattttaactaaataggagtctagtattaattctaattgctgcttattaataaataccaaagagaatgctctccttctagtatgaatagatgtatgatcagccaaagtaattgcaaacagtcacaggaaaaaaaaaatgcttttaagacttactaaacacagatgcaaacaatgtggcatagctggatagctgtgaaatcaaagctgccagcagataaccttgcatgcagctttaaggaattctcttagcttaaaacaaacttggacttgactctgagcccaaaagagttatgagcagaaacaggtcttaaagaaggaggctaaagattgtaatccaagaatatattttttgtgtgcccaatgaggaaagcagtttaggaactattgggttggcccaaaattttgtttgggtttttccataagatgtggcagaaaaacccaaatgaagtttttgaccagactaacacattgcctgttggagccacacaactttagaaaacatttgctgtcagagagattgtctgcacacctggagggaaacatcaaaaaagtcccttttttcctgtagtggtgtatgaaaaaaagaaacaaaagcaacgatatggttggaaatgttctttatttttaatcacaattaaatttatgaattattctagcttaaaaaaataaaattgttggaagtacaactttttgaaatgcaattcctatatttctgtatctgaatgtttcttcatgataaaggccaggaacgtagtgaaggacagaaaagcatgcctggtttggttatcctcactttgactaactttgtgtaagatactatatttcctgaatgaatgcaaagctaatatatatacattgagatatataatgtcatctttaaccactacatttcaagtcagtatttaaggattactaatacttctagagaacccattataataatgttttgaaaaatggaagataaaatataaaaaagaaatcacttatgccattatttttgtctgcttaatttgaatatgtatgtcctctagtgtttcttaaattgacaacgtgatctctcttacttcatcttaaccatcatatattcctgcattgaataccttcaggtacttttcatctgtcagttagtgtttaataatatattgcttagatttgaaaacttattcaaatttatttttctacatatttgttgtgtatataattaacaacgaatatgctagggttacaggaatcattcagcttcttcaatagaattacttcctctgtagatgagaggagcataaataaatactaagaaatatggaaaaattaagaaaaatccacacattcactcaacaactatttttatcccttattcagatatgatacaagcttgtgaatatacaaagataaatgtggcacagaatatcatatttaagaatttctagtcaatgtacaggtcaacaaactttttctgtacagggacagacagtgattattttaggattatattatatccctgtgataactacttaattttgcactcttacacaaaatagtttatagacaaaaaatggacatattagtatgactgtaataatataaagctttatttacaaactaagatcaaatatatatggggtccaatgtctaaagtttctcaatcaacccttggtctgctgctgctgctgctgctgctaagtcacttcagttgtgtccaactctatgcgaccccatagacgaaagcccacgaggctccactgtccctgggattctccaggcaagaacactggagtgggttgccatttccttctccaatgcatgaaagtgaaaagtgaaagtgaagtcgctcagtcttgtccgacttagcgttcccatggactgcagtctaccaggctcctctgtccatgggattttctaggcaagagtactggagtggggtgcattgccttctccgagcccttggtctagtgggtgataaaggacatataaagcaatcattaaacttagtgtgagagtactagaagggaggtgattaaaggatgcagagtttgaatttatctgagggaatgctgtacacagaatctggcatttcattttatctttgtttacttattttattgaagtatagttgatttactgtatattagttttgagtgtacaaagtagtgattcaatatttttatagattctactccatttaaagttattataaaataatgactgtatttctgtgctgtacaatgtgtccttgttatttatttgttttatacatagtaatttgtacctcttagtcccctacccctaatttgcccctcccctcttctctccctctactcttctctatatgtgtaag

SEQ ID NO: 32422 - DNA, 869 bp, Bovine  19866881690744
taggttctctatgtgtttattccagatactccaactcttaattaaaatgaacaatccccagcatcaattcagcatacagagctgccattattgccattctttgatatgtgagccaaaggtatcagtgattgtggatttgaacatgtggcctcctgaattatcatcaagtattcatcaagctctctcagagctcaatggcaccattttaggtcctactaaggaaagtgcatttttccctgctaggaagatttcataaaaattggtaaccatgaggtaacaattatttccagtgttcattaacattgtatctgtaatgggaataggagactgttgaggctaaaatctaaagcagataattaagaaaacagtatattacaaactatatttctcgtattagaaatcttattagacttttctttattataacatactatatgaagaattctaaccatttattttactttctctactctaacattgctttctaaaactagtctgtctgaagaaataaacataactttctaaataacgtctacaatttgtacatattttaaatgtgtgcatgtgtgctcagttgctcattcatgtctggctctttgtgaccctatggactgtagcctccaggctcctcttttcatggaagaaggcaagaatactggagtgggttaccatttcctactccagggatcttgccaacccagggactgaatctgtgtctcccgtgtctctgcatttcaggtatactcttcaccactgtgctaccagggagcactcaaattacttatagttatgtttttcatgtttaatattgtttgatgctagatgtgaagtattattttaacaattttatagatgaaaacagaggagtt

SEQ ID NO: 32423 - DNA, 914 bp, Bovine  19866881868035
atgaaatgataatgatttcattaacctatttttgcccttttccaaatatgatgagtataaatgtgataggaaattaaaattgtgcatttctggaggaaagcaatcaagctagaatgaccaaaaatgcttacatgcttatctggcaactttgctcccctagatagcaaagctgagagtaggggatcattataaatatctatttgtctatcaatgaagaaattaaatcatgaaaactcaggctcagaaattcaacaaatcaattttatagaaggaactctcagactttttatttatttgggatttccagtttaatagtaacaataaaacattctggcttattttattaaatgaaaggtaatggatataaactcagtgatttttggtggcaaatttaaaatgcattcccaagtaccaaatattttattatgaaatgattttaaaatctaggtaaagaagagactattaaacacgcatatgtgtgcaggttagttcaccgctggatgccttacaagccagctgctgtgcaggctatgagcacttgcagatttagttatagagtcatatttaaaaatgaagaggtgttaatagatatcctggcacatagaagccacagggagaaaagaaataagtaaggtgatactagaaagaaagaacacaaaatagcaatcaaataaaggtcaaccatgcaatgcactgtttacaggagtacaacaaaatattctcctctccctctgctctcccattctctctctctctctctcttacatacacaatcacacagacacatgcacacatacacgggatgatgacctggtgacctgtggctctggaaacaactctgacctagcttgaagctggcatacatatcccgtttatagacagactctataggaatgagaattatacctcataaa

SEQ ID NO: 32424 - DNA, 1673 bp, Bovine  19866880351996
ctgtaatgtgctctaaggaaacagcatccacacgccacatcacccaccaaagtcacctctgcggagtgacacacgggaagccggtggcccagacgcaggccatggagcttcttctggtctcaggcaaacccacacatttaatgctcagggagcacatacatcacacactattaaagctgccagtttccgtctctttcacaccattagctgaatatatatatcattaaaggaagtgagttacaatataaaaatatggtaattttgacagtcaggtcacaattgacagcacatttgggggcctgctttccttaactgtctccagagaccctatatttagtgaaaagacatttcccagaaaagttttcataaatattctccagggggaaaaaatgtatatttatcacttcacataaaaagaaatctgaagtaaatgttttagtagctgacttctcagaaagtgagtggctatttttaatccaggactggaagaatttttcttatcaactttatgaaagtcagggaatgctctcagctgggttaccagcaatgttattaacagcagcatccttatttttttttcttccttccttgtcctccctgccactgtaatacttcatattccatctgatcctggtgtggatatttttaattttttgcattttatgacactttgtcattttggagactcactggctgtggacagactgcccatcccagggtaagctggttcttggagatagcagatgagtcccctacaatttcacctgtcacatttctatcaccccatccagagccccgcctctgatcatctccttgtttagactctcagacttccaggtactcttgccttccctaagcactttaggctcagataccagacaatgaggaacagcccctgtgccctggagcccactgaaagtattcaggctagcccatccagccatactcagctagcttatcctgctgaacttattcctttcccctcaaacaataataaaggttcttccccccactccctcctcactcccactgcctcctgacccaccctggcccttccttgtggaggccctattggtacggtgttgcccttccttttggggagtgtgaggaacactcgatgtctttttgatggcattcacctccgaatttattatttacaccagaatttaataataataaaatctgcattgaaaaacagggagggatagttagggagtgttcgatggacatgtatacactaccatatttaaaatggataaccagcaaggaggttaaagaggagagtgaaaaagttggcttaaaactcaacattcagaaaactaagatcatagcatctggtcccatcacttcatgggaaatagatggggaaacagtggaaacagtggcagactttatttttgggggctccaaaatgactgcagatagtgacttcagccatgaaattaaaaaatgcttactcctcggaaggaaagctctgatcaacctagacaggcatattaaaaagcagatatattacttttccaacaaaggtccgtctagtccaagatttggtttttctagctgtcatgtatggatgtgagagttggactataaagaaagctgagagctgaagaactgatgctttttgtggtgttggagaagactcttgagagtcccttgttcagcaaggagat

SEQ ID NO: 32425 - DNA, 993 bp, Bovine  19866880505403
tccgtctagtcaaggctatggtttttccagtagtcatgtatggatgtgagagttggactgtgaagaaggctgagaaccaaagaattgatgcttttgaactgtgctgttggagaagactcttgagcgtctcttggactgcaaggagatccaaccagtccattctgaaggagatcagccctgggatttctttggaaggaatgatgctgaagctgaaactccagtactttggccacctcatgcgaagagttgactcattggaaaagaccctgatgctgggagggatgggggcaggaggaagagggaatgacagaggatgacatggtttgacggcatcacggactcgatggatgtgagtttgagcgaactcctggagatggtgatggacagggaggcttggcgtgctgtgattcatggggttacagagtcggacacaactgaatgactgaactgaactgaactgaactgagtccctatctttaaataatcacattagggattagggctttaacatatgaattttaggggccaaaattcagtctataacatccctgtaagatataatgacaaggaagttgtaatcttaaacagaaagtgtattttttattctaggttcaacaaaataccttttgtagtaatctctatcataagacatggtatcctgtatctaacaggtgttcaaggtctttagaaagatttgtgaagaaacaaaaagcaacgcaaatacacttctcattagtcctatttttggccaaattcgtcttgagaggtcacccagaatgataaatatcagtagttcagaggttaagttattttcttccacataaacattagtcagtgttatgatttttaattcttgttttaattagatatcagagaatattgaaaaattccctctaatgagcttttttttttttctccttcatgagaagatgaagtcatgagagatgattaagtaatagggcttgccaagtacgtatcagatctgatcaagga

SEQ ID NO: 32426 - DNA, 1636 bp, Bovine  19866880516354
gtttgccttggaaacaaacagagatcattctgtcatttttgagattgcatcccagtactgcatttcggactcttttgttgactacaatggctactccatttcttctaagggattcctacccacagtagtataattttttttaaaaaataaaatttttcttctttgtagtttgttgttcagtcactaagtcatgtccgactatttgtgactccatgagccttagcacaccaggcttcactgtccttcactatctccctgagtttgctcatattcttatccattgagtcagtgatactatccaaccatttaatactctgctactctcttctcctttttccttcaatctttcccagcatcaagatcttttccaatgatggtacttcatatcaggtgggcaaggcactgataacatagattatattaattgagtttcaaatgttgaactaggctttcacatctagaataaatctcacatgttcacactgtataattacttcttacaaacttttaacttcaacttctcaatattttggtacagattttaagtctaaaatcaatgaaggatactgatctttaactttcttttttgtactgtctttgcctgatttgagcatcaggcaatactggcctcataaagcaagttgagtagtattattatttttagttgtccaagtttagatgctatcaattgttcataaccgctagaaaggacttgtacattgtggtatttcataaaatgtaacagtataaagaaattggaaaaaacaagccacaactatatgcaaaaatatacattgacctcacaaatactatcttgagcaaaatatatattcaatatgactccatttaataaaagaatcagagaaaactaatgtatgttagaagtcaggataatgattatctgtatgagaagtagttcctaaaaaaaggacatatattgtggcttctgggttccagtcatgttctatttctagttatacagatgtggacattcctgaacagttcattgagctgtgtacttacctacccatttctatatgtttgctatatcttgatttgtggggggtaaaaaagcaatatccacgaccccaacccaagccatggaggagctcccctctcacacactctctgtctactttttgcttgaattcccaggaaccagagtcacatgactcaaagttcatgtaaacacaaagatgaaaacaactttttatagtgtgtttgactagaaagacacaaatttcattgttttcaaaacaaaaccactatctatttttgtttacttttaggcctatgttcaaacagcctcaacaaatggataatctatctgaaaagtttgagagccattcacacttttagcagagaagaaatgtattaaaaggtggttctgccaacaactttcatccactgtgcactctctcctgcctgcttgtgcttgaagagactgctatcatatcatattctttataacaatacccagttaattaaaagtaaattatcctaatagcttctgtgattgcagatatcctttctttagcattctgtacttaagactaataagtgaatagagatttattaaatacatattataaaatgaaatccttgattactaagtacatcaagaatctgagaatat

SEQ ID NO: 32427 - DNA, 1796 bp, Bovine  19866880545496
tctaaatttcttttttaacattaataagaaatatagacactcctaaaggaactgtgggttttccaggtggatcagtgttcaagaatcctcctgcaatgcaagagaggtgggttcaattcttggattgggaatatcccctggacaaggcaatggcaactctctccagtattcatgcctgagaaatcccatggacagaggaacctggtgggctatagtccatggggttgcaaagagtcagacataacttagcgaccaaacaacaacaaaggaaatgcaaacttggtagctactgctgttttataagtgatacatagcctatgaaattagaaagatatttgaaccactcaaatgaacaatggctttaaatctatcccttctaaaattattattaggagccatttttacaggcatcacaatatttttttaaactcaagagtgtggactatgaatatagcacagctatcatatttaagaaacacttatatcaaacttacactgagaactaaaaagataggaaaactggacttcatgtgttgtactataaaatatagtcaattctcattatgcatggtagttatattctataaagttgctgtgaacatgaaattaatgaataatgaaccactgatcctaggggaaatgcagggttaggttcatgttgacctctggtcacaatatttttgtcaactgaactcataatcttgcttcatgtgtgtttctgtttaaagacatattattcagtgtttaatgttgattaattaattgtcaattttatatattcaacctaatgttaacatacccattttaatgatggggaacctaaggctcacaaacactgactgtccagtggcacacacagcttgcaagagagactctgaatctgaacccagatctcttgtttccattgagtaccaggtatacatttcaggccataaaagttcttgtaaaacaaatgtttaactttctttacatatgtgtgtgttagttgctcagtcatgtccaactctttgtgacgccatggactgtagcctgccaggttcctctatccatggaattctccaggaaagaatcctggagtgggttgccatttccttctccagggtatctttccaaccctggaatcgaagccaggcctcccaccttgtaggcagattctttaccatctgagctaccggagaagcccttcttcaattatgtgtgacattaaatgcccaccaaatggtagagatttgactgtaaaaacaaaggcaaacatcaggacgatatttctgcccaccaaggaataccaaagactgtcagcaagtcaccagaagctaggatagaggcctggaatagagccttctcttacagtcctcagaaggaagcagccctgccaataccttaatctgattctttagttgccagaactgtgagacaacacatttctgttgtttgagccccctagtttgtgggtcctttgttacactggaatctaacatatagcccatcactggttgaagaataaaacttatccccttatagcttccattttgctacatttcaacaaaaccagaaaataatttacttaaaagataaacaatgaactgaatcctacccaaggttatgaaaccatagcatcaacttttcccagagtacaaaagtctgattttgaaacctacctcaaaggatggatcacttctaagccatctgggccactgacaattgttctggacttcctagccattagtgtggctgcttttgtgtcatgtaaaaattaatgcagaaagagagtttcttggggggagagcagaggtccc

SEQ ID NO: 32428 - DNA, 1610 bp, Bovine  19866880681429
aattttttttaaaaggagaaagagagcctaatagtacagaaggtaaatcaaaggaactattgttttaagagaaatatagatttaaaagttaattcaagatcagtatttccagaggaattaaagatacatgagattaaggggatggataacagcatgtgatccttaagaaagcaaaaagtcatgaaatcaggacagaaaataaggaaagaatggatgcagataaaagcaattttgtaaatgacaggccaaccatctgatggctccgttttctctgaggtagagagatggtgctccaaaaactagccttcttggcaaaaggaagctgacagcacttttcctctctactcgttcagctcaccaggttgaagcttcttgttgctacaaagccaagagcagcagctatgcagatgatgcccagcactgatgccagagtgtccaccaatgccaatgttatgggtatctttgcacagccaagaactcaggagctatctctcataggagtcaaagctgcagaagatggctgaactcaaagcccacacagattttagcttcccccagttaaaacgatcaagctcatcaaatccaacccatgagtttgggcaacagtctgtgcatacttcagttctttttttaggatgcatttgctttaggaaactctaagaacactgattgtcaaaatgtaatgtgtagtttctaatccagtagaatatgagggtggctcagtggtacagaacctgcctgccaatacaggagagcgggttcaatccctgggtcggcaagatcccctggagaaggaaatgacaaccaactccagtattcttgcctggaaaatcccatggccagcagagcctggtgggttacagtctatgcagtcacaaagagtcggacataacttgagcatgcacacacgcagaacatgtgattctacattgttaacacgctcccaggtgatctcgatgttgttggtcctcaaatcatactgtgagtagcaaggtcataggaatttcataataaaaggccacaaggctcaacgtatctatccacatgacatttcaaaatgagcctgaaatatatgcgacttagacataacgacttaggtaaatgcagcttggcttcaagctgggacattcttcaataatacctatccaagtgaatgattagcacatctgtcagtcaaaaccaattgagtatatggatgtatctcactacgtgggctgcagacaattagtgggtattatctctgcctttgttgaatttattttttactcaatgaaaggcagaaagatactccgaaagtaccaaaactctcagggacactcagactaaaagagttttcaactacgtacagtcctgttaaactgtacataaggtttttggttttttctttcttttccacttcctgacatattatccaattccttgggcatgctgtgaacacatttcatggactagaaaccacagtgattctgtatgtactggcttctcatatgggtagttaactaaaggaaaagctatcctgttgataagccacagtaatataacatagctatggggtttatatccttcactgacatgatgattctatacaaaccttagtagattgaaagcca

SEQ ID NO: 32429 - DNA, 1426 bp, Bovine  19866880708931
cagaaagagacattgggtgaatttataaaatagcttatctgtctgccttttcccttccaggtgagcagaaatcctattttctaagtttgaatctctcccctgcattcaaagtcatttctaacatgcagcttcttaaatttcttttatgaaaacagcttgaaattctgggtggaaaagagtctttttctatgaaagaaaagtaatttagtttagatgttattcagtttgatctgcaaaccaagaaaatacccagagtcaattagactggctcaggggccagtaggtggtcctttgtctcagaagctgtttctttctttctttttttggctttacagatgtgaccacggaagccagtatgataatacaaagtgaaattcatgtactgctagcagctttagctgttttcttgccaaatgttatgttcattaagacagctatcatcaaaacaaaacaaaggagtcattcagggagccagttagaaatgcaatctggtattacatttctgataacaaggataaatcagttctgatgagtcccagtaaacaggttttgacttcctttgtaatttttgaatgacgttcttaacttattacttatgtgtgatttatttgaagggattactacccatatattaaagactctgaggatctttaatcatcttccatatcatcaatcatcaaggcagaacgttgagggagagcatatactgcctctaataaaccttcccaaggtgtagagaagctgtggagacagcaggtttcagattttatagcatttgctcagtttgatgcgcattagctgggtatcatttagcagcaaacactatatcagccaagcttcccaggtggcgctagcggtaaagaacccgcttgccaatggaggagacgtgagacgtagattcaatccctgggttaggaagatcctctggaggagggcgtggcaacccactccagtattcttgcctggagaatcccatggatagaggatcctggtgggctacatacagtccatggggtcacaaagagtaggacatgactgaagtgacttggcaggcacacacacacatgtattacctaagccgaagagggaggtgagcaagaatggtagtcagaatgacttgaaatagcttcttctgaaggattatttcatggacctgggctgcacagtaacttttcactttagtctcaacatcctctcaccctgatgccacagtcagctcccagcactgatggcctaattcataaggaagcacccagcatagttcctggcacctggtgttaataacacttgattgtgactgttgagaactggaatttgatggcagcttcttataccggtttctccaagatttattttcagaaattttccacctaggaaatggtactcaagtccttttctcttataaatcaatttctctaaaaatgga

SEQ ID NO: 32430 - DNA, 1036 bp, Bovine  19866880725295
gagtttataatttaactgccttggttttttaagtttgcttaattttatacataactattactaaattatctccaaattcttgaacatagtccaaagccttcctgctgctgctgctgctaagtcgcttcagtcgtgtccgactctgtgcgaccccatagatggcagcctaccaggctcccccttccctgggattctccaggcaagaacactggagtgggttaccattaagtttaaatacatcaagtagtttagaagttaaaggttgtatgaatggaaaagatctaataccagttaattgaaaaaaagatttctatggtgtcttttaaaatctagaacatgattttatttgcagtgattttaagttttatctgtctttccttttgcaagttgtgctcattaaatttaaggactttttccttaaccccaggtcaaaaagataattctgtatttcttaaatttaaagttttgcatttcaagtttaagtatttgagataacaaaaagaattaaatagtcaaatcagattcatgagaataatatcttatgtggtttcaagcttggtgatataaaataatttaggtattcctgaggcaaaggtgaagcatgaagttcaggattttgggtgctgttccttaggtcctttcttacctcactgggatagtttctgacccagacttaccccataggtttctaagtggtgtggtgtatgcagtcacataacttaaactgaagagaactgtgtaaacatctccattttacactctaacagttatatgtatgtatagatctatttgaattctctacagtttttcgttagctttgtacttctgggtttaatgacttttatataaatatagtgtttgaaatacattatttctcacttacaaattatgtataaagttatcacagtaatctgatattgcctatttaaatgttattcaatttcatagactgaacctccactgaatactccagaaaacagggaatatactgctgaaataatgtttgagtctttcaatgttcctggcttgtacattg

SEQ ID NO: 32431 - DNA, 1119 bp, Bovine  19866880736484
actgaatggtctatgatctccaactcttgcttgatcttttcttttgtaatattttatgattcttcattctgccttcctcaggcttgaacaggtattgttcacttagactctttctgcttatagtcaaatgtaatccctctctgtgaatgtgtcctaatatttaagatctcccagtgagcttgtgtctgcagggagagagatttttctgccacatggtcagtttaacctcttatcagataatgttaattaaagccttgttatggaggtatggtttgtagatcagcagcagcagcacacctgggagctttgttaaatatgcagaaatccagaccctgctctgcctcctgttgaatcaaaatctgcagtttaaccagattctacataattcatctgcacattaagtttgagaagcaccgaactcaagaaactcttttttttttaatgtttttgcatgtgcttttacctctggcttttacctgtctttccaatgtaagcataataagaaagatttctgttaagaacttacatgtatatgtatgattcacactttctctttgattaaaatggattttcatatatgggaaaagaatctggaaaagaatagacatatgtaaatacataactgaatcactttactgtatgaaagtgaaagtgttagtcactcagttgtgtctgactctttgtgaccctgtggactgtagcctgccaggctcctctgtccataggatttcccaggcaagaatactggagtgggttgcagtttccttctccagaagatcttcccaacccagggattgaacttgggtcttcttcactgcaggcagattctttacattcagcccagaaactaatacaacattataaatcaattatacctcaatataaaatagaattaaaaaaattatatatctttcatcactctttttggctgtatttttaaaaatttagctttatgaataactgttcagttcagttcagttcagttgctcagtcgtgtccgactctttgtgaccccatgaatcgcagcacgccaggcctccctgtccatcaccaactcctggagttcactcagactcactcacgtccgcccttgtcttcccagcatcgggtacagttgcg

SEQ ID NO: 32432 - DNA, 2694 bp, Bovine  19866880756097
cctcttagactgctctggaggtgttggacagaaagtcagaaaatgtccctaagaactccttggcttcaatggaaagtgttatttcactaagtaaatttctgtcccacccagacagatggtcttgtgaaagtcattcgttgtgtctgactctttgcgaccccatggactgtagcccgccaggttcctctgtcaacgggattctccaggccagaatactggagtgggtagccattcccctctccagaggatcttcctaatccagggatcgaacccagttctccctcattgcaggcagattctttactgtctcagccaccagggaagcccaagaataccagagtcggtagcctataccttctccagtggaacttcctgacccaggaaccaaaccagggtctcgtgcattgcaggaggattatttaccagatgagttacaagcaaagccacagctgaccttggttttgattaaaccagggagaaggttgccttgtgattggtgtattcttgtcccccaactcaccgctagggaatgctactcactagtatggtccatttttgttctttctgaccctgcctatcccaaacacagctaatatgattataggctagcctctctttttcttcatatcttcatctccatccccaacctctacatatcttatttgtgactttttagggaaaacattttaaaccaagatagctaccaaaaaatttgattttcccaaagtaatggatctttatggtgtaatattaggcaccaagagcatttttgtgttgtgctgatattggacttttgtctttggtagccggtgagggtaaagcacaaagccatgtcttcggtcacactgtgtgcagtccacctttccaatcacaaatggttcttagtacgactctcatgcctgaagaaaactgccacacatccatcctatacttccatttatattctcaatgccatcagaggttgaccacagaaaaaaacaatcccatctgctgcaccattatttcccccaaaaaatcacatttccttttccatgcaattttttttaaaaagaagaattttgtttcattgtcatatcttttggggtggtactgatattgtttgagttggtttgttttcatagggcttgctgactccccaaaatgaacaggaacttatatattcagttatacatcagtttgagagactgtttggacaaagttcagtttacaaagctaaactcagaaatgattttccttttaattccgtggaagaacatataagaaaaaggtttgcaaagcccattagccggtgtacaccgtaacatcttcagaaaatctagagccatattttctacccacaggctctggtgacagataagagaagctgtaattatcaatgttttaagttccagccttgtgagaatttctgatcagtctcctcctttcaatctttgttcaaagaacatctgtcttcagttcaatagtttaaactctaaatgaccaaatcagtaaatgtttattttgtaaattggcaaagggaaaggcagaagcaggctcaacctttcactaatattttgtttactgtgatagaaaatgccaccagataaattagagtcaggaagctttttcctaacaggcacataacatttactaatgagaggctgaggactgttttgttcaaaaaaatgaaaaggggattgaagtagcattcttgaacgtgctgtgtcattgccctttccctcacgataaattaagatgaattctttgccacaaaagcagtatatctggtggtgtaggtattaaacatactgcaatattttcaagatacctcaggaataaataaatggagccaggctcttgcagagggtcagattcaagtaagaagtgcagagagtcaagggtaagacaatttaaattttcacaaaatttggaatgagaactccgaaaaaagaacttctttgacgcctagcaaggggtaggggtaagaggaatgttagatgaatgcctaattggaatataacagaggtttgtcaagagagcacactaatcatagaaaacattcttttccaacaacacaagagaaaactacatggacatcactaaatagtcaacaccgaaatcagattgattatattctttgcagtcaaacatggagaagctgtatacagtcagtaaaaataagacctggagctgactgtggctctgatcatcagctccttattgcaaaattcaggcttaaattgaagaaagaagggaaaaccactaggcgattcaagtatgacctaaatcaaatccctcatgattatacagtggaggtaacaaatagattcaagggattagatctggtagatagagtgcctgaagaactatagatagaggttcataacattgtacaggaggcagtgatcaaaaccatcccaaagaaaaagaattgcgagaaggtaaagtgattgtctgaggaggctttacaaatagctgagaaaagagaagtgaaaggctaaagggaaagatatccaactgaatgcagtgttccagagaatagcaaggagagataagaaggccttcttcaatgaccaatgcatatgcatcacacttctatttataatttcatccccaaagtgtatcatttacaatcttaagctttatgactttgaggaatcccaaaagcttgacttcctgtaaattgcaacaaccagaatattttcaaggagatta

SEQ ID NO: 32433 - DNA, 1262 bp, Bovine  19866880762182
tggacacgatatagtgactgacaacagcaacaacatgttaagcacctagaagtgcacacccatcatttccttaccaccgacaccatcatcatccccatcccgcaccattttcaccactgtcatcaccactgccatttccttctcttcctcttcctcctcattcccttcctccacttcttcaccagcccccgcttcttctctttctcttctcttttattattttcacatcataattttcattcccatttcaactttcactgtttggaaatttggaagttatatgactattgaaatacatgagcgcagaagagacaaccaacacagcattggaaagcaattatactctgattaaaaatacatatataaaatcatgaaaaaaattggtagaatatatttaggacttttccctaactatttaagttgctagggccaatttagttttctgatgtggaaacatgacctgtgagaaatcctgatgtcagagctttcttttcaatcacatcagttaaaaaaaatttttaaataacattaataaagacagactggagagagtatcttttgactcatctgcatttatatctatcagactcatgcacctgcttgatgtgtaaaggtcaggcttttagacagaaatctcatgtggatctccttgaattatgtagaagtttacctggccagataatttttttttttcatagaaactgtagagaatgcattccaagtcatagtctacaaattgatgtttatatgttcccctccggagagagctgtaaccctgagaaggatatcaaggctgataccatggagcagacctgagaaggagcacctggcgtctccagtgattgaaatgatatattaatgagttctcattctcagtgacattttaccaggagccaattaaccgtagtaattacatcttttccattgcatgctttgaaatacgaagtacatgagtgttgggttgctgtgtttgttgagcattgtttttccatttaaagcactaaaagtttgagtcatttattatgttccctttgccttctgggtgttgcagcatggcagttttttgcaaaggatgagttttacaaccacacagatactgctgcatataaattaatataatccaatacaaccacagctgtgctttaaaaggtggcagaaaatacggtgggggagactgcacacagctaagaaatggaaaagagttagagcttcatgctaaaaaacagaatgcttggtaatgagagactgagtaagagatcctg

SEQ ID NO: 32434 - DNA, 1034 bp, Bovine  19866880808102
ccttttgagatggcccacactctgtctatggaatgtgtttctctctaaataaatccacttctttcctatcactttctcgctgaattctttctgcaatgagacatcaagaacctgagcttcattaagtcctgagaccaggtgtgatatagaaggcttacacagtttcaaaaggaggaaacttataaagatagattcaaattttttttatgttctaaaactctaatactttggccacctgattcaaagagccaattcactggaaaacactctgatgcttggaaagatagagggtaggagggggaggtgacagaagatgagatggtaggatggcttcactgactcaatggacatgagtttgagcaaaatctgggagatagtgaaggacagggaaacttagcacgctgcagtccctggggtcgcaaagactcggacatgactaagagactgaacatctttggatggtgcttatatttagtaaaatagattctcaattacttgaaagcaatggcctataaaatctagacccagaagacagaaataatggagactgcccatgcaacccaggcaccaaacatcatcatacaaaatggctttctgtgtacatcaaccagataatcaatttctcttttcaactgtccgtttggcctagagagttagaaattcaaatcactgcaatgtccttgttgccacaataaaacttgctattgtattctaaatactgaatattcttgttatacataactggggcaggttttataggtacacgctcagatttctctgagagcacatgtaataaataacactgcagaaatatggaagctgccttaggaccctaactttaattctacaaggaaagtataaaatagaaatcaagttcttgctttcaaacaagaaatcttaatctttttccagttttctttctaaaatgacagtttataatttagattaaaaggttatctgagatggaataattttaatgattgactagaagagtgaggtttatgaaacaattaatatgggaaaatcaattttat

SEQ ID NO: 32435 - DNA, 1930 bp, Bovine  19866880817313
catttaataaatatttgcctttcccattgataagaatggaaaacataatttcttttaattcttcataccaatgctaggttactagtaaaatatcccaggagtccttgggagcagtaacttttcttttttgaaaatttctgagttgtaaaagcaaatgagctccttatctttaaggaacaaaggctagatagtaaatgcatgctcacagtagcccaagattgcactggtgtgtccccagctctaaacaatgacaaaaagtacattaaccacaagatcaagatgcctaatcaatttgcaagtacatggaagggcttagaatgatgggtaataagcagcatgactttgtgaccaacaaatcatgttagaccaattcaattgcctcctctgacagagtggcagaccttgtatgtagggaggaagggacagacataatatattttgacttcagggaggcttctgactttgttccacatgacatgctcatcaacaaggtaggaaaatatggcttgctgtcagagatggattaaattgattagagcagtggctaattggaacgagaaggaaaatcacagactgcatgaaaatataaatgcagagccaaatatgctggcgttttgggtttggataaattcaagggcaaatgagtatagcaggcaaagcagaacacagttagatggcagatccttgcccataaatacaatagctcatgtcttctaatggcatttcttctaactctttggacattaacaagtgtaggaataaatggacactctgttactgtacttgcaggaaaggtgttatgttagattaaagctttgtgtcttcaaaatatacttttaaaatgcaaagaaaaccccctagatataattatttttctattaaactactaatattaagagtaagtctccatcacgagtaagtctccattcatcttcaaatgaatgaattttgatagatcttccaaatatgacagattgaatgagaataagaaaataagatgattaaatttcaaagggaagaaacaggagagaaatcttgggggagcagtaaatggctaaaggcaaagcaataggggcttctaataattctgactgtagtctgatttgacctgaaattatttttttggttagcctattagttaagatctgaccctaaattcagcatttagatcagggcaatcaatatcagatcaactggaagaactaccactatcatagaaatttggtcaggaattggggaatcctttatgacaagtaaatctttaatagataccaagtaagtgtccatctctgatagacacagcctctgccctccaagatctggggcactaaaggcaaagataatacctatgaaagataaaccataagtatttggatctctcctctctccagcatctgtgatttctttttctcacttgaatatatactagtcccctttctctaaaaaatttcacctaattttggtacatttaatgattttaagagatgtctaaatattctttgagatccctcctttgaaaaggtgaagactaattcctctccccttaaccatgggttgtgcttagggactgcttctatcaacatgacaaaaatgttggtgtgtcactttagggaaaatttacagaaggacctcaaaggaaaaatactgatgtatttgacaataataaatgtaaaacatctattcattaaaacataaagtaaaaaatataagccacagaatgtgaaaaaaatacttttaactgcatcactattaaagaacttgtatccagattacacaaagaactacaaattgataaaaagttggacaagtcaataaaaacagtagtttggaagtcttaactgagcattttgtaaaagagaaaattcaaatggtcaatagataaataaaataagagccaccttttagtaagcaggggaaataccaatgaaaa

SEQ ID NO: 32436 - DNA, 1737 bp, Bovine  19866880824135
ataagctctggtgaatgtatgagttgttttatttttttacacccataatcagttcccagagcataataaaacaaaaagcttatttctcccactaacccccttcagtttgttcccagtagtgaagctataaattatcaaccttcaaaaataactgttgccatttaataagaaatataaaatatactctcatctaacaagggaacacacgacagataaaaacaaacacagtattctttaaatttggtgacaagacgaaagatgggtacaagcatgtgggtgcattaaagtcagcagtgggcatgacccagggacacagctaaaaaaaagacctcatttagatgtcataaagtggatattacacatcatttttctaaaatgcagttgcaggcatcttatcttacctcctcctgagctttgcaattccccaaattgtcaaagctaagaaaaggaacaccttatcactccaatatagaggcataaagtgaaaacaaaggcaacctgtgccatgttgagggtggagagctttggtgtaactgcagaggtagccaaacctccagctccctatagattggctgccttgctgcatcccctccggcccctccctcaacacccactccctgctcttctcccagaactttcatgcctgcaacactttgtacctgatgtgttccctacagcatgggtctccaacctctggatctaatgcctgatggtctgaagtggatctgatgtaataataagtgcataatagacataatgtgctttaatcatccccaaaccatccccctccatgtccatggaaaacatatcttccatgaaactggtccctggtgccaaaaaggttggggacctctgccctataaaacctctagtcatcacagactctgattttgtatattcaatattttgcattttaaatcattttaatacatcttatgtaatcaataccaatcacactgaagtctctgggttaaatatcctacgtcaaatattcctgcctaaatccttaaatcccttgctttggagaagtaaatgtggtctacgtaactgagatcttattaaaagtgaagaatctctaatgagcaagccaaagaagctagacatcaaagaatacatgctgtataattccatttatgtgaaagcctagaacaggcgagattaatctgttttgacagaaagcagattagtgagtgcctggggctaggagtcaggaccagggagtgagaggcttgggtaaacttgtgagagttatgaaaacatcctataccttcacggaagtagtgctggcacaggtgcacacatttgtcaaaactcacactgttcacttacaattagtgcattttcttgtatataaattatgtccaacctttgctccatctcagaactactgaatcggcatctgcattttaactaaacactaggatgatctggacatttatgaagcttgagaatcaaaggattagagaacttaactcaggagcacattgaaattgcctgggtagctttaaaccaattccagaaaaacatctacttctacttcattgactactctaaagcctttgactgtgtggatcacaacaaactgtggaaattcttaaagggatggaaatacaagaccaccttatctgcctcctgaaaaacctgtaggcatgtcaagaagcaacagttagaaccagacaaggaacaacagactggttcaaaattaggaaaggagtacatcaaggctgtatattgtca

SEQ ID NO: 32437 - DNA, 1205 bp, Bovine  19866880828843
aaatggaaatgttactttaatcattttagtcaaattgaatgtgtcaaggagaaatacaatgaatagaagcagcactaattcaaaaacacgtcctcagtcccaacaatcccaagtgaagcagagaaaagagattgcatgccttgagaagaagatgctagcaattaggaaagcttggttctaatgcagttcaaatgcaatccatttcaatgctctgagcttcactcttcctattaatatgataataacacatgatttatacagctattgggagattaaaattaaatcacatatatgaaagtgcctaacagaaggccgagcatacaacaggtgttaaatgaatagcttgagtttttttctccttattcctcctttatgtatcaatattatcatctctaaaacaaacacatacacacacacatatataaaccaaattcaaatgataactaacaatattcaagatataactgacgaacataaaatgccttgaaaatgaacatttttcagctcatgtaaaatataggtacaattgaaaattaacccaaattatcttaatatgtactaccttaataaaactccacagaggatatcttttgctcaccaaaaggaaaagaaatcctctacatctccttttcaaaaatattgccccatactgcaggaagggaggtctaagaaggaggggatatattatatgtattatgcatgtgcactcagtcattcagtcatttccaactctttgcaaccctatagtctgtagcccaccaggttcctctgtccacaggatttttccaggcaagaacagcggactggattgccatttccttccccaggatatcttcccaccccagagatgtacttgtgtctcttgtgtctcctacactggcaggcagattctttaccactgcacaacctggcaagccccagggtagtgataccagttctgaattccttcctgtgagcctagcactcagagccactatacatatagctgatttcctttgttgtgcagcagaaactaacataacattgtaaagcaaccatacgcccgtgaaaaataaaataatattaatatattgcctcagcttgatgctaaaaatccctcctctgaacaagcatgtttcatgtctatgggcacaggctcttccttgggtcattttagacaccatatgaggagaatattacacccaaagaccacttttctgtaggca

SEQ ID NO: 32438 - DNA, 1792 bp, Bovine  19866880842186
ctgagggtttgaatgctgaggttttaaaatatgctcaataccggaaaaatgtaagtctaaagatcagctgaacaccacctgtactgagaacacagatctgctctctgtctccatttgacttcatagcagtaggttacaagaacacgatttgaaagggtgttatattcttttattgaatattcaataaaagtataataacattgaaatgctggagtccataggaaacactgtacacttctgttttttcattccactgcgtagtaaaatcctatcttaaaagtgtgcctgcagttctaatctctccaatggtgctcagtgctaaatgatacagactccacggtcattctagaaaatttgcactttttctttgcaatatgagaagcttcagatatttcataaaaccaccatcctccagaaacagaggaaccagacaatatttgagctcttgagaagagccaaaggcactgatttggggatggaaagaatgaagaggacactcagaagtgggcaccagtagtgataaatctataaatgcatagaataaaataagatcaataagtaaattatctcagtgcttctaagagatctctctccctcatgtcccagtctagtagagggcagggtggggtggggacaagtggagagagtcttctgatctctcttgcttctctacaattctctaaaatcatttctccagtggaatattacccagccataaaaaggaacaaaattggatcccttgtagtgatgtggacagacctagagtctatcatacaaagtgaagtaagtcagaaagagaaaaacaaatgtatattattgcatatgtatggaatctagaaaaatggtacagatgaatctatctgcagggcaagaatagagatgcaggtgtacagaatggatatgtgcacacagaaagggaaagggagggtggaacaaactgggagagtaggattgacatatatccaccactatgtgtgaatatataattagtgggaagctgctgtatagcacagggagctcagctcagtactctgtgatgacctagaggggtgggggtggaggctcaagagggaggagatatatgtatacatatagctgattcactttgtcataaaacaaactaacacaacattgtaaagcaattatactccaataataaataaactaaattataataataaataaataaaaataaaatcacttctcctttccttccacctcctcagcaaactatatcagttctcctgagcaattcagcttttgagaaaccaaagatagaataaccaacaggccactaccttctaccccaccaggtagccctcctgaatcaatgatgaactgagcctgttacatgcagaaagaggacaaaaaggaagacacgcaccaattaacacatcagtcaatatcagaaagccacagacgtgagtacatgaaaatagatcatggcatatctcttgtcttcagagtcttgttatgacatctgtaggggcgggggcggggggtggggtggtcattagtagtaaagatgctctccatgtttctgaagatctgctcaattgagatggcactagactgccaggtgagcatatgggcttcttaccctgcccattctctcagggctcttgtctaagtgaatcagacagcctgggaggtcctgccagcatgattaggatcaaagcattcaccctgtctgcagatggtaatcaattcaatttgctcacctcatgaagttatctgccccctgccactcctcctcaggaagtggaaatgaagccctcttgtgagtctcggg

SEQ ID NO: 32439 - DNA, 1851 bp, Bovine  19866880955431
gttttgccatatatcaacatgaatccgccacaggtatatacatgttccccatcctgaacccttctccctcttccctccccgtaccatccctctgtgtcatccagtgcaccagccccaagcatccagtatcgtccatcaaacctggactggcaacttgtttcatatatgatattatacccactccactctcaagacgaccttacttaactggtcttcccccgagtatgcctctgagcacattgaaggcagaggctaaaccttttctttctattactcttcatggcccaagtcttgccacagagtgtgcgcttcataaatattcttagagtagattaatggctaagttcaaatttctttcccaacaggttccatccctgttcaaactccagatgctccactcagctaagaggatgtgcctcagtgttttcctagctctgcctctgagtgatctgaaaccaccactgtagactgtgccatttgccttcatcacctcctgttgacatctctccacgactgttgtcatctcactggacttaacctttataggaaaaacacaaggtgacctccatccatcttgaactcctttatttaatgtatccccactggtcacatttgcttattaaagtgtagaaagaatgatgaagttttcatggttctccaagtcatagaaatgctgagctgcacagaactttagaaattaaccagaatgagcatttcatccaggggaccaggagactctgtgtgacccaaaagaggggaagtgcttctcagggacacaccgtggggtcagtggtagaattaaaattagcacctagctttccagattcacagttcagtgagtgctttttctagtttgtgtaagtgcattctcatacagacatacatgcacatggataaactgtgttctggttaatgaaatagaaaattgaacaaaagtttaactacttaatgctaacatatttgattttgtttttttaggatacaaattttattcaagttcccatagacgataaactaggaggcactggagcatatccagggacataaaacaaggtggaaaaatttcatggtctaaaggtattgaaattacatagattactcttatcactgtggaatttaacatatttgaatttatgaagctttttgaagttttttgtcttgaggtgctccaacggggatttttagcagatgcaatatcagcagcacttatggggggacttttcattatgggatgtgtcctagcactgcagccattggtattcttggtcccctcctgctaaaatgtcagtggtggtggtgtagtccccaagtcacgtgtgactctgtgaccccatggattgtagcccgccaggctcctctgtccatgggattcttcaggcaagagtactggagtgggttgtcatttctttctccaaaacatcagtaatgctccctagagcaacagttgtgacaactccccagatttctgcctatgtttccaaatgctatggaggcagtcttgcccaggaatcactttttgatcctcagagaagaggatgtagagtagggctggttatgctgattttttgatgaggaaaaaaaaaagatattttctgatgagaaaacttcttctgggaggggtcagttaactggcagagaaagggctatgagtgatcatgagatgataccttcgttcttgtaagccctggctttctgctgttcctatcagatggttgatttattttcagtccagcccagactctgacctactcagaggtgtccctgcttgaccagcagttgttgatgtgatggggaggagacgggagataacaaagagctgaggcccaggagggaggagggagaggcaaagtg

SEQ ID NO: 32440 - DNA, 739 bp, Bovine  19866880964277
ttttcatctgtttttaaaagaatggttaggtgtgatagaattttctatttttcctgattcaactgttttatttttcaatcttgatgacctttcataatctggaaactttaaaatgctgattcttagctctggcctctagaaaatacaatttccttactctaaggatgggcttctgtaaattttaaagctccccaggtgattctaatgtgctgtccagattgaaaaccactgaatttaaccaaaactaaggaaatctgtgggtttctgagactataatcctgcgaacactatccacacaatggcagagtaacgccttctggagaccagccttgcacccccgaatttataaagttacagcaaatagcacaaaggattaaccaaatcctttgatctcaaaaacttctgaaaatctagtcacttcgcttccccttttccatttttccaaatcaaaggcttcagacagattatctttaagcaggtttccaaggactaccactgaaactgaaatgttggtagtttccagcagataatcagaatggaactgatatgaagaactgctcttgaagtattggaattacctattgatcctatgggtggtttaaaatatacagaaggaaggggaagggaggaagggatagaagaaagagaaaagggagagaaggagagaagaaacagctcctatgagataatattcatttttgttgttaagctgattttttcagtagaaatagtccaaagg

SEQ ID NO: 32441 - DNA, 1398 bp, Bovine  19866881021350
taaaatgacaaatttgatagttttcttactcactgaaatgtatatcattctttttataagaaaattaattttaagtgtttaattatttgctttctgtcaagaaactgaacatcacgttaagtaggagactggtgtattatgcaaactatcaacatataggctgtcctcaatttataaatggggtgagttctcatcgtttcttagtaattcagaggttggaaatttggagtgtacttttttccatgaagattcgttacacagaatggttagttttctaaaaccaataaaaaattcttttaccctgttaacactgatgaaactgttttcctagagaagttaatctcaaagtgtggtccacaaaccccacgaaaccactgagacactttcaaggagtacctgggtcaaaaatattttcacagtcacacagaaatgcaatttacctactgtgcccacatttacactgatggtcccaaagcaatggtgaataaaaccaccaatgccttagcccaaagctgagggcactgaactagtagctttcattcttcactagtattcatatatagtagaacaaaaatgccaatttcacttaagaatgactatgatgaagctgtaaacattgttcattatattaagtcacaactccaaaagacctccttttaatattctacatatcaaaatgggcagttcgcagaaagtacttcagctgcataccaaactacaatagttgtttccaggaagaaaaaaaatactgcatgattgttcaagatgcaaatgaactacccacttttgccatggaatagcactgttccttaaaaagccaactggcagacagtggttaggggcttcccaggtagcgctagtggtaaagaacactcctgccaatgcaggagatatgggtttgacccctgggttgggggaagatcccctggaggaggaaatggcaacccactccagtattcttgcctggagaatcccatggaaagaaaagcctggcaggctacagtccatagcactgcaaagagttggatacgactgaagtgacttagaatgtagcataaacaatggttattcagacttgggtatccagcagatattttagctccctattcataagtgaagtttcagcttccttcatccctattgagaatatctgaaaagtccataaaaagcctatcacaaataatcaagaatatctattcagtaaaataccatacaaaagtgatgagctctctctctctctccctcccttgtttgactaattttagcagctgctcaaagcttgacttgctcagagaccattgattctcaattcttctgtatggtattctactgaatagacatcttaaccatagcagagttaggcggaggtgttcttttccctgctttctggggtgggaa

SEQ ID NO: 32442 - DNA, 1187 bp, Bovine  19866881054146
tcagttgaggagcttaagagttcacccatgcttggggtctactcttggagattctaatttgattagcctgtgtcaaggctcaggcattgataatttttaaatgttccccagatgattctaaagcacagtcagggttgagaccactgccttagatcatgccaaggttcactctaataatgggtcagatgccatgattgtcagccgtggtgggcagataactgagagaaaagtgacacgatacacacctaattgctctcttaggatatagaaaaaagggttattcaaagagagatatagctaaaatccacaagtagtagtagcaaatagcattgttgactgattcctatggtaggtgcgagctgaggtgcaaaaacataatagtaagttcaccacatgtaaaaagaaaaatgaatagataaatagacagacaggtagatagatagatacatgaacatgtatggcaaacttgatgaagatatccaagaaagtagatggtagttactgctggaatgtagggctaaaggaagacttatttttattatgtaattgtatgctcatttatgtgaccatggcatgtgtcattgtcagaaagacttttaagatacttaagcaacaaccatttctgatcttgataaggactttttcccccctctgtgctccccaaatcaagccatctgtttcccttttctgataaacataatcggaattttttggataaccccctttgtttactgttcactctctacatacacctaacctgagctctactaattagcaataaaccttaatattttagctgactctgggattggtacttgttgaagatcagacaagcatttttctacagaaaattgcaacgtgggagtaactggggtatagctatagatacacttggggctttacagttatgttgtatataggtgggattagtggatgggctagaaaggagcctatgactgctatgaggaaagatgatagggataaaatagaatttgcattagcttgtagctcccttgggctgcctaagcgctaaagaacttttagctttccattctattgatcaggtctgcctttgatgttctctttaaacatcatccccagagcagaaatgtaggggataatagggacccccgaagaccacctagggtcttttctcccacccctgacacactactcctccactcaga

SEQ ID NO: 32443 - DNA, 1309 bp, Bovine  19866881110464
tgatggaaacgtgtgaagcaatttggtgtcagaggggaaggcagattcctgatttggagtcaatcagctgacactcagataaactgcagactcttattttgacaaccccttagggtcttggcaacccactccagtgttcttgcctggataaaaccagggacagaggagcctggtgggctgccgtctgtggggtcgcacagagtcggacacgactgaagtgacccagcagcagcagtagggtcattgtgacaaacagtgacagggtctggcacacagctcggggatcctctggtcttgagtgtgctgggaggctggatggcgagcaagaaggatcgtagaaggaagagaaccctttcctctcagacctgaaggaggaaaaactctactcatttaaaatgttcaaattttatgaatataaaaaagaatgtatgtatatgggtaactgaatcactttactatacagcagaaattaacacaatgctgtaagtcaactatatttcaataaaaaataaataaaggcaaaagttaaagtgctcaaaattcttatactaggtgtctcttaatatttcagaaatttaaacccaacaaccccccaggagcaaactgcaatctgttccttcttctaaggagtttaaacttgtagcagctgttggtggtggtccttgatgtcttggcaagcctacccagtgcaaaatgtatgaaaccctaggaactcagaggcagccacaaagagaaaaccctttagagagaaataaagttcttaacaatccctgctaactatgctgtgaaagggagaacactgtttcaattaccaaatgtcagctttaatccccacttacgagcactggaaataaaacgatgcaataattacacaatctgcagaaaaactgacaaatatattcccaatacaaatgatttattgagccagcccggccacagcctggcttcactccttaatggaagctgtaaaaatggtgccctgtccttcaataatcaccacgatttcttacaaaccactgattaagcaatagatgaggcaagcattttggaaatgctaaagtatctctgattgttggagctctctccaaaatgactgtgtctgcttaggtggcctattaaggaattgtatgatggtatatcagaaaggaccttttacaactgaggccattccagagatgataagaggttacgtgttaggcagagggcatcatgcatcatgcaggaaatccagaggctctgatttccagtcctttccacaatcccccacagcctcacctattaacaaggcataatcaaatggggccattaa

SEQ ID NO: 32444 - DNA, 1808 bp, Bovine  19866881191898
aactaaaagttgccatcataatttgctacagagctgagtttatatttatacaaatgtgcatggcaaactgcatataagtctctccccaaaatggtgacaaattagtcgcactctaccaattctgacttaaaagaacatttcttcatatttcatacatagagcacaccaacgtggaacactcctgtgctctctttaaagcatgaccacttatgcccctacaattctactttaaggaagttaaccaaaggaactaattacgaatgtgaattaatttggggctttaaggatagttattacaatatcacttatagtagcaatctaaatgttctattgcatgagattggttacaatcatctaaaaaattattctgtggagaaatatttgttggtatcaaatgagttcattatgttgaaaaaagcaggttacaaaataatataatcccattgtatttatacaatacatacatttatatatatatatacatacatatccatctatatgtgaatacgtatgccaaactgaaattttataagcaatttctctagatgataataatatggaagatttttaaaatgtgttttttctttaccctaatccaaattttctgtttttcctataatgaacagttgctacaattgcaatatggaaaaaaaaacgccataaaattttaatcaaaactttgttggtgatcataataggtacaatcaagtaggaaatacactttacacttttcttaatcagtttatcctacttgaaagagacacatgtcatgcacacgtggacagcacaaggctttaagcctaaaacagacagagcccagtcgacacctgtgatgtggatctctctgacatagttggagaaccatttcttcctaaatctgtctaatccttgacttctatgaagttaccttcaggaaggcttctccctttagccttttcatcatgcttttattctttttcttagcctccttgttttagcttgacccatcataacaaagggggcttcccgggtggggctagtggtaaagaacccacctgccaatgcaggaaacataagagatgtgggttcaatccctgggctgggaagaccccccggaggtggacacagcaatccaccccagtagttttgcctggagaatcccatggacagaagagactagtgggctacagctcatagggtcgcaaaaagtcggacatgactgaagtgactaagcacacattagcaagtcataacgaaataccccaggctgcttaaccagcagaagtttatttctcatggtttgagaggctgcatgtccaagcaagatgcgggctgactcaattcctggtgagagtgttcttcctggcttgagacggcatcttctctgtgtgccttcagtcttttcttggcgcatatacttggaggggagagagagctctctccctttttcttcttacaaggccatttaatgccatcatgacaaccccaccctcaagggcaccatctttaaataccagcacagtgggagttagactttcaacatatgaatttgagggcgagggtagggagcacaaacactcagtccataacactcctcttcttctgattaaatacaaatgttttccagggctctgtcctgatgctttgcacattctccaccattcacatatagcaatgctttccaccccatctttttctaaagtctcagtgatgactcaggctccaactccagacccaaatcttccgtgcgtcccacacacagctcaaactcaaatatcctaaaattgctacccatctccagactcactttagggtaaagaaaaacaaaa

SEQ ID NO: 32445 - DNA, 1067 bp, Bovine  19866881231692
cctgaattccccctgatatagacccagaggggaaaaatacaaatattgttctcccagggaaaaccagtgcccaatttagttactgctggatggatgacatgattcgtaggcataggagatctatcatcttcaacttttctatctagccaagatcagactgtggtaataagtctaaggagcagcatttcaactccagctgtggatccaatttccacttatatgatttaacctggaaattaccagtgacaatcgcagagggaaaatgaacagctgatttgggaggtacagtgggagaagctggctcagccttgtaagaagaaaagacaaatgatatacatggcaaactgggataaaggacatctttgcggaaatgaaatgtgattcacagtcattccaactgtgtagccaccaaacagcctattaaggaatgagtggtttgatgggattataggtaagataagtgaaattaaagaacatcacatgcatctgggagctttgattgagaggtagtgagaggtctaagcagcaggaggaaatgaagactggatcatgctttgaatgaaaaaataaaaggaaaagaaaggtagcacatggggggaaagtctatttaattggggtgcagatatagggggaaattagtttccaactctaaaatatgtaaaggctgagaattgtaaaaagtgtaatgaaaactcaaaaagtgtcagcatctttagttataggggtcccatgtgttcaatgaacattgttaaaaccctaagagccaggtattgtgcacatctgtagattaaagatatcatctcttccctgcatgagattaagattggggcacagaaaaggcagctgaaaaatacaggaacaaatgtataataggaatcagtatttccaggaaaactaccctcttttcattttaagaacacagatccctccattaattgaccttccatatactctgccgctcagtcttcacataccctgccccccattgcactggcaacaaaaccgaggacctgagatatttacacatatcacagagacaaaaatcaaagaagctggggttgaaccca

SEQ ID NO: 32446 - DNA, 1285 bp, Bovine  19866881246900
tcgtgttttagttgcaggcagtagaaatatttggggtgtgtgagtttcatctctgtttggccctggggttgatagcaatgtattcccaacataatgattcttttcatgtgacagggagctggagagagggatgctgagcgaaggagtccatatattccctataactcgaattactacaatgaattgctacattactcacccctgcactggacattaatcacaaaaacgaaagtgcagtgccagggagttggagaggctgtgctactccagcctgcaccctgtgccaggagcctatggctacagtgaaggtctgcaaagctctctgtcctttctgtttttaaacccttagtcacagtggtttgtgagggaaagtcacagcagagacttagacggaactgagctcttgctcctcagagagggccacctgccaaccaagagctcaccagagtctcctctggatcctgtgcttgacagtcgtgcgtgtatgtatgctaaattgcttcagtagtgtccgactctactgtgactccatgggctgtagcctgctaggctcttctgtccatgggattctgcagccaagaatactggagtgggttgtcatatcttcctcttatgtctcctgcactagtaggagggttcattaccattgagccaactgggaagctgattcttgccagtcagcttacctgtattggcctacgcttgatttggtcaaattcttaagaacctgagatagttaaaatatctgaatacttaagaaaattacatatctgggaaaaatatggacaaaattgtttatgtcacagaaagaagcaaattattaagaggaaaagcatgttgccaagagatatataaatataatctaattcgtttatatatatgttttaacaaatacataatattctgtttttcaccagcttatgggagacaggctcaaatttgaatctaatcactgcagatggtgactgcagtcatgaaattaaaagacacttactccttggaaggaaggttatgaccaacctagatagtgtattcaaaagcagagacattactttgccaacaaaggtccatctggtcaaggctatggtttttcctgtggtcatatatagatgtgagagttggactgggaagagggctgagcaccgaattgatgttttgaactgtggtgttggagaagactcctgagagtcccttggactgcaaggagatccaaccagtccattctgaaggagatcagccctgggatttctttggaaggaatgatgctaaggctgaaattccagta

SEQ ID NO: 32447 - DNA, 1349 bp, Bovine  19866881261131
tatcaactaattttcaagctctttatgagcttaggtcatttcttggtaccctgccccagcagtcagcttgggactagtcactcactcttcacagagtaagagatgccctgcatctttggactgactatggggtcaaatcacattttgagtacactgggtgatacctatggaagcacgcacaagcagaagaggtaataaatgttgaaatgataaactggggaaagcagtgtctataaaatgaaagaggctttatggatttacttatttacttaaagagtagaggaaagtttaagacgcacagggagagatgttcagcgtcattctgctgaaactttaaggatggttcaaatgccttttgaaaaccccttctgatcccagtggatttttgtcctatgcagtaggattagttgcttcaggaaaaacattagaattgtaaatacttaagttaatgacttactagtaggcaaaataaacactatgaggtaagattttggaaacagatctagatttgagccccatatctagcatttagaatctgtgtgaactcaggcaaattactacagaaggacctgtatggaaatatgagacttgactaagacggtgcaggtaaaagacttcttcccacatagttgagaaaacaataaagaacagcaaagataagatttactactatgttatttggaaatgtaaaaaacataaaggggagttaggtctgatttagagaagttaatgcctaattactaggcattgccttacctttgggaacactacatacaataaacatttgcctgatatccaactgggtgggtcctgtgctgattcttatttcattttaaatcatatttcctttggcttcattcttactggagaacaaatcagatgacagttgtgaccaggttcatctctcttttcttggaaccccacagggttttttctctgtttccacattttggcttgactttatgtgggaccttaataatgacttaaaattgaaaataaaattcagtcactgatactctcttggtagagatattatgttttcattttaccaattccaccaaatttggggaacatcatgtagttattgtcaagtccaaagcttctaaaatatacattgatatatagagacaggagaatgaagaggtcatgcagaagccaccaaggtaccaagtcattgtttagatgtgatgaagagtccattgtaagaatagatgcaagaggtttttgccgtagatgagaggggcagggacaaaatctaaaatttttcaggttgcttattaattagcctagtgctttcctttgaaacctcaattcgctcattaaaacacatagaactaaattgatactgt

SEQ ID NO: 32448 - DNA, 1235 bp, Bovine  19866881280513
tagtgaaagtgcaaagggtaaaatattggaagctgatccaaactttgaaaggtatatgacaatttaccaagacataaaaaagaagcttacagtatattataggttgcatctggagaagaatggaaacactgttcaaataacgcttgataagtttcttacaaagaaatacagtgctttgtgaactccactctcccaatttctccccctcccctttcccccttggtaactagtttgttttctatatctgtggctctgttcctgttttgtaaataggtttatttgtaccatttttaaagatttcgcatatcagcgatattgtatgatatttgtctatctctctgtgacttactatatataaaatagataactaataattacctactatatagtacaggaaactttactcagttccgtaattacctaaatggggacagaatctaaaaaagaggggatatatgtatatgtacaactgattacattgctgcataaaagaaaccaacacaacattgtaaatcaactgtaaataaaattaattaaaaaagaaatacaatgctttaattctcaatgtttctaagatttttaattcacattgtactaaatatatattagctttactacttttcatcacttgatacatttgtaattgatagtaacaggcttttaacattttggcaaaattttttaagacttgcagaacaattacagttttcactattaaagattactcctcagagtattggattcacaatcatttttatggtcctggagtaccatgcgaaatgaggactgcctgctttcttattaagaaaaagacactttgagtcagaccttttactgctcacaaatgacatggtcatattgatctaagacagtttgactgataatcttgagtaatgtgggaacccttgtgtagatttgtcctgtggacataaataatagctgggttggaaatgaagtctctcagtgaattcctctgtttttttaatgctttagctttgtttttttttttttttcctcactatcagcctgttagaataccttagaagagcatctaaagtaggactagatttcccttgatgttgttaaatcaagatctttttcaaggtaattttgtagaagctatttaagttgtcccactagataaatacctgctgatgactattctattcactccctaattcctgagcttttgtttccttgattgcctatttagtttgtgtaatttaacattttga

SEQ ID NO: 32449 - DNA, 1049 bp, Bovine  19866881300963
atgaaaaatttaatcatccttcaatctcatctgttaggtctccattgcttcatgtgcaactttctatacagttcctgtttataccacatatgaacacagacatacacagggctcatccttccttcctttctccctcccttaatcctcccttttccactcatagttttccaaatattggatccccactacaaatcaatggtcacaaactagcggctcacagtcagggaaaatattttgttggcaaaagattaaggaaatttaacatgaacaatctggacacccattcctctgtgctgatgatgttatcaacgctgcacaggctttctaatttaacatggtcctttccagttcctattattcacgcctctactaatccacctttttacattctggcctatcacctgtaagcatttgaatttatatcctcctggtattacttaccaacttgctttttgcatttaacattatgtcatgatattatcgattagaattacatgcagttgcctataactgaaaatgccaaatgatagtggcttaaatcctaccggtttctctttttcacatgtaaaataagtctggaagtgtgtgggccacagcctagatggcacttcagagtcgtaagtgacctgagctcctcctatttttcctttccaccttccttgggacctggcttctagtctcaaactcagtttatcatccctactggctaagaattctagtcactcaatgtcgatctgtgttacaggcagtagaaaactggagggcaaaacacagaatggtgcttctcctgaatcagccttctttaaaggcattttccggaagtcctgctcaaatactttcactcagatctcatgagccataactttgccacacagccacacctagctacacaggaggtggagaaatgtccttgactgggaacacaagcaccagaataagatccgggtactgctatcaaggagaaaacaaaaatatcaacctctgctccatatccctgcaggttagtacagacatatggccgagactggtcagggtcccctcaagttcca

SEQ ID NO: 32450 - DNA, 1087 bp, Bovine  19866881305274
aaatgtatctctaattcttatagttaaaacctgtatctttttttcttatcatttttgacattctattttttttcatttatatctatccatatcacattcattaactactaaatttaaaacaataatactgtttatcctcaagaaaatgtctcattttccttacttcttttggttcttgaaattgaactaacaaaaaggttgtagatgtgaagttaggtagaaatactgaggaggtggttggttcaattttgttcctagctctctgattatctatgttacagcacagcaatgttggaatttcctctgttctaattcttcaacaccttttagactgcctagaggaaacaaatggtctcttgactttgcaaggaaaatgatccaaatctctcaaatgtaaactacttcccattttgatttgatagcattttctcactaaccaggagggaagacgataaccatagaatagcttttattgccagtatcatattcttatttctattcatcaactaatagtactgtggaagcatatcaaatcttaagaacatgatatgtgctgcaaagaacatataattaggcttttaaataatggtatagatttcagaggctttaagttaatccagaagatattgttgtctttctccttctcttatccccctcccatatttgactaattgctaactattaaatatttattgagtaactactcagttcctacaaagtgctaaacagtgagaaaagactcaaactgtttaccattacagtaaagcaaaatcccaaccaactacgtgcttaaattatatggtgagataaaacttgaaagggtaaggcaattagcaagtagaacagtgtatataagtgaaaatggtatgaaacattttatactcctcttttttgtaagagatcccaacttctatcaatagagaagaaaagtgtgagaagtataacacgtttcccttatttaaagagctcgggaaaaaggataatacacatattaacatagctagcttttgctaaggttctagaacacatagaggtgatcgctcagtcatctccagctccttgcgaccccagggacttaacctaccag

SEQ ID NO: 32451 - DNA, 1551 bp, Bovine  19866881318300
ccttttggtaggacttcagaaattacattttggtaggacctcagaaattactctagtttccaggaagaaattcctgaagacctgaactaacagcttaccatgaaacacactccaaaactttaattctgatatataatgttatatactttaaaaaactctctctctgttgactagtacttgggcccctcctgaccaacaatgtggagaaataaaatacattaaaaaaaaatgcagatcatcttcttttcctcagtcttgtttttaagcaccacatcttcctctgatactttgtgctcattccaagacattttcaaagccttgtgatgtttcctggccctgaccctcttgtgtccttttgtgacccacaaaaaaaatctaattcacattaaaatatattgaagacaaataacatacccagatatcaggaagttattataaaattgaatcaaaacaaatattaatagataagcataaaataaactcagatcttatagccttaaagggattaatgtatgattttgattttaagtgccctgaaaagattattattagatgcattaatgacaattttcccaatattggacactagtgtgtttgcttgattttgttgcacatgtcctagacagaccttttaaaaagcaaaacaatgtattattgatgtaactggaaatataccaactgaagaacctatttctgagagataggtcagaattcttgagaacaagtttctttgaaaaacaaaattgtgctagggaggagagatgtcacatcctcttgaatttttgtactcagatataaattgactgatctaaatataggaaaagttagtctgtaaattgaaaatgcattagcaatttttactcccattcccatgggactgcattgtttgagagaaatgtgtctggggctgtgttttgtttgatctggaaggaacttgaagactgaagggcagagttggttctactttgattattgtaatgccaatatatttttattcagtgcaagcttggtgactcctagtcagaagggaggtgtacttgtttaacgaaagattttctggatgaaggatggaacatatggcagcctcaggttttctgtcctattctgaaataaatgtaaaaatacgtgtttgcctttctaggatgcaatattgattttatgtattcagatgcattttagagaagaccctccaaatgtcaatggacttgcagaatgcatcacatcttaatgtggggtaacactagcagttgggatgaaaactagatgggcttacaaaaaggccaaacaaggggactttgtgactctgaaggcttatttgttgttattgtagttgaaggagatgcaatttgatctgagctaatgacacattcatagtcctatgaatctgtacatatcatttggtttcctctgaaaatgaattaaagcttcccaacacaaaataaaaattaaaaagattctgaagtttctcagggaaaaagaattatataatttcaagacggaaggagaaagaggagaagaacattattagacagacacctagcatagatcggg

SEQ ID NO: 32452 - DNA, 1024 bp, Bovine  19866881336418
ttatgagcatcaactaaatttttttgctatataatagagtttcttctttcacaagtattgcttaaagcagctaaagaactaaatgaagtttcttaaattaagctgaaaaaaagtctggtaaagtaattcctaaccaacaagtcatggtcccacgggctggtgctgccctgcaggccagagttctaactgtgtatattggagaagctggttactgtgtttgtgagcacaggggaagcagacagacagaactgttgttgggtatctcagcctgattgctgggagatgcctccagaggccagacctaattccagaaagctgctcttcctcatatacccagagttgtgatggatgcctgttatttaaacccttgaaatgtgaggagaaagtatctaaaatgagcatgatgaaatgtagccttattcaattagaaagatgaagcatgattttgagaggcagaatataattacacagttggagcatttccaggaggttgtgcatggcaccccagctgactctggaagaaatgtactcagactgagcccgggcagatggtgtccatcatcctcctcctcacaagtgctgcaaaccttggtcttacgatgaccataatgtctcatagtctcaattcatacccaaatgccagtgatatcaactttgcacatttatgaagtcatatccacaaaacactgaagaaggctgatctcacattcttcagtgttttatgaataagactttataaataaggctgagcaccaaagaacttatgcattcaaattttggtgttttaggaagactcttaagagtcccttgggcagcaaaaagatcaaaccagtcaatcctaaatgaaatcaatcctgaatattcattggaaggaatgatgtggaagctgaagctccaacactttgacacctgatgcaaagattcactggaaaggaccctggatgctgggaaagtctcagggcaggaagagaagggattgatagaggatgagatggttgaatggcatgactcagtgggcatgagt

SEQ ID NO: 32453 - DNA, 1384 bp, Bovine  19866881350709
tttttttttttagtttggggttgcaaggctgaggtcttacaaattcttggtggttgagggtggtggtattgttcaggggattgcatatatgtattttaaccctttatgcacccatgcaagtgtgttctgggtctggatttgtcttggtctttgtgccttcttcccttgctagcattgttaactgatatgacaaggagactagcaaatcctgctttcagagctgaaagcaggagctccgctttgcatcctgatgatagactgttctaggagagaagcagggacatccccaggcttacagaaacagttagtaggatcgattttgtgtttacctactttatttgtatgagtagcagaattctacttgaatttttttttctatagcacagcaactgttggcaatatatctgtcgtggcaggcatattcctaattcctggaatttcctggtatttaaaagaaaatctacatatggatttaagtctgttcacaaccaatatggacaggaaaggaaactgggtttaatggggactgacattgtgcttggaccattggcatcttcctaataaccctatgagatgataattataacccaactttgtaggtgtgaaaattcagataaagaggttaagtcattttctcagggtcagtagcagagttagaatctgaaacaagctctgtttaactttctattattccaaaagcctaagcatttccaatagcaacatcttccttctcagtatatgaaagaagggatgttcgtggttccatcttatacagtaaaagtatactaaagagaaggcattttaatttagtgttcattcttacttttaaagtattttatcttacttatcttactttatcttacttttaaagtattttaaaatatttgttctccatctaaacgaaaaatacgctctgctcaatgctatgaaaaataaagttgaattaatttcaagtttgttagcctgttgaaatttccagatgtggttaaaaatcaaatgtgttattttgctatttagggtttgaaatgtaagctctttgggaagtctgcattgtttgggggtttccgaagctcttgattctttcttgctcatttacactgggtttgcaatagaaattatccagagcagcaatagccttgaagtattttctgtattccatcaagaaacccaacatgtcctttcaaaacttaattgagcagcacaaagctaattagctgtccgaagacacgccatttaattcacaatccagcattaatttgttcaacacaatgagcttatcttccatataaatgccttgccctatggcttctcaagcagctgcaatatacaagaatgactgataactctttcctttaaatgtgatggctgcttttattctctctct

SEQ ID NO: 32454 - DNA, 824 bp, Bovine  19866881357488
gttgtcacagagcactggctatgagctccctgtgtcatacagcaaatttccactggctaacaaagtctgttttcctctaagggatatccattttccttctcttgacttcatggcgatgaaagaggagatacagttgcaatctgaacccaaaaatctggggattattgaagtagtataaattttctttaagaaattatcaagatggtacctactttgttatccgcccccccatattcctaatgcaaaaccttgattaattaaacaacaacaacaacaaacccctgcaacattgatttagatgttgctcagcccaaccatcactaattagaaaactcaccttggacatggaggccacagaattcttagaggagggccaccttttgaatctcagccaaggaaaccagtagcgcctatctcttgtcccttagcctttccaaaaatgtttaaatagctcatggggtttaagattttttaaagtaccatttaaatggtattaaattggaatattttcacctagccccaaagacttaattttcaaaaattctgcttgatcattagcacaactggtgtcctcattaataagctgagctgccaccatccatgtcctgttacctttgtgctctgctatttacaagctggttgcaaagagctcttgcaagtcattgcattataatcaatttgcttggctttccttctagattcattaaattgtcttcaagggtgcccattaagtatgcatttctcatcaactaagtggttcaaaatgaaggcctttgaacacttctaattaactatgtaaagtttagaacaaagttaatagtgac

SEQ ID NO: 32455 - DNA, 955 bp, Bovine  19866881467947
gacatacatttttatacttcctctaaactcttttacacactttatagtcactttagtataactaccagttcaacgctcaaatgaaggatgcacttttctttggaaagaatgagaagttccaaatccatatgacaatgaaacactgtaagaaagtctgtattcaatttaatatcatatgtttccagcagtttgcaaatcctacaccagttccatcaagaaaaactgacatagatcagaaactcttctagaggctcactaaactttgtttctgaaatacaccgttgatagattctaagtcaaaaaaagccaaagtcatcaaggcaaaacagttatttagtgcaaactactctctctatcccacatacatatgcaaatgaaccaaaaactactcagatccaccttcaattcaactcaaaccaactaggtatcaccactgtcagtgccctgccataccaatgcacatgtttgaggtaaatgaataaatctacattcgcagaagcagagagaagaaagaaaaacctgggtcctaccttgattgttttcgagggctgacacttgatgtgatgggacacgctggcagtttggttcatgtttcaggaccctggacagtgcacgatcccaggtggagttccacgatgaactggagatcagttctcctttactggacttcagctggggctgctgctgttgctgttgctactgctgttgcttctgctgctgctgcttctgctgctttctcactccggaggctgaaacgctgtcagattggagggatctgtatctcacttagccctaaaaaaagcattcacttggttcatcagtctcaaagctcttggcgatatggaatagaaaactaaagactgtttcaattcacttgcactgtaccttttcagtactgagatgtgacagcttcacagtacagccaagatctggctctcactctcttttcaaaggg

SEQ ID NO: 32456 - DNA, 806 bp, Bovine  19866881525485
tcctgttgattgctctaggaaataatgccaagttaaccattctggaaatgagtacaataaggtctaggacttgagccttagttttcagggtgttcactgaagaaatgggactagacaattgataatcctttaattcatctcttctaagcttgtcaccactcaaaaaccaagtcaaccatttgctaaatttcccaggctgtccacagttggaaataaagccatcttcctaagcactgtagtgctatttatctctccttatcattacaacagaatccacagctctgtcacacagcatagattataacaggaacataaaacacagcaaattaattttctcacataataacagtgttagatgacaaagaaataaaaacaggctgtcctcttcccaaagcaattttaaaactctaacatcaagtcacactcactctactctaatctactagagacttcataaaatgcattcttttaaagtatttattttttgttaacgcacagatattccctattgttgcataattaagtcagtccacacaaagcctccatttattattgaggttgggggcagtgctaaatattgtaaaggaccttttaaaaatcaagaacataactagagcaataaacatctctgaactgggtattattgggtgaactattggaaagtaattgttgttttgttcctcatataaatttaggactccatctgatctccatgaaatagatgattagcaacattttaagggtagagcatcagaggaaaagatgttaccatacccataagcaaaaacaaatagaattgaaagcca

SEQ ID NO: 32457 - DNA, 1346 bp, Bovine  19866880681453
aaataattttttaaaaattcaaaaccaatacagtttttgaagaatcttgagagctggttttctcctaaacacctaaacattcggctcaacacacacacagacacacacacacacacacacaaattcctctttaaagtgactggccagataaagcttctttaaaaaacattttttactagaaatctgtttcaggcaaaatgattttactgacataaagttctgagagggcaccaactcatacacagacttacaatcctctcacagagtcattgtactctgcaaagagagatttctaatcccttaatctttccctctgtgttcttaaattgcaatttaaatctgtccttgcaaattctagaaaatttattttggctttgcataattcatcactgacaaaattaccatttagcatacttagtatgcctctgacaaggagaaaggcttgaagttctcaggacactcaacttgagtataacttaggtcaaaattattttcacttgactttggtagagtgagttaaaataactaaatggattatttaaagacaacactgaaaatgcaagtggataatagaaataaaaacatcaaaatttgtgggatgattagagggaattttttttactttgaatgtatacattaaaaatgaagaaaaggtgaaaataatttgtctaaccataaacgttaagaagctactctgacttccttaagaagtcttcttgtaatgcccaaagatactctttcattctatctcattaaatagaaaatgatgacatagccacatctatatacaaggaaggttaggaaaaataacatgtagcctgaaacaggtctgctttatatacaactgagatttcttgggaaacgagaagtagggaatgccgcatagcttaatacagagattacacctaagaatttcccttgtagtaaccccatgaagtaacactttccacataaatacatctattttcccctaggcagaaataatgttaaaatggaaattggcagcactccttgaaggatgatttagaccaaactacagtttgcataatccatgaaggaaagtataatagaatgatgatatctatgctgtcttgtttaacactaattcatttaatccataattatatggaatgtctaccttatgacaaatcctaatttacatattgacaatacaaagataaatcagacaagatccctatttataaggaatttatattctgctgaggaggcataaactattgataaaaataaagaaaaataatctactataagtaccagaaagaaaataaaacagggtgatatatggttgcaggtagggaaaacttttgatgaatgtcaaagagagt

SEQ ID NO: 32458 - DNA, 1342 bp, Bovine  19866880702188
catttaaattttttaaaatgccatgctaaattctctcactcagtaatacagatgaaattattgtatttcatcagtaatgaagctatgtaaatatttaaaaatatgtcaaaatatattctcatttaaaaaaagatttgtaatattctatttatcttatcttcagttgcttatactaaaagcaaaagtttcttatattagtgaagttatttttaaaaattattttactagtcatgtattctaccttaaatcagtgctcactgtcagtgaaagtgtttcttcatatggtccccaaacctagtttaattgctaaattgattaggaaaaatatagtcagctcatcacctgactgatagactttgtttttatcttggctgccaacatttgtcaagcatatagacatattctaacatgcagacaagtgttgaatacatattttacaatattctgtgtcatttccttaaaaaaaaaaagtgtttactttgcaagtaaacagacagtctatctggtaaaaacagactcaaataaaatccctggaaaggagtagaacagatgtatcttagtaacatgaaagtgaaagtgttctccaggccagaatactggagagggtatcttttcccttctccaggagatcttcccatccagggatcgaacccagctctcccaccctgcaggcagattctttaccagctgaaccaccagggaaacccaagaatactgtaatgggtagctaacccttttccagtggatcttcctgatccaggaatcaaaccagggtctcctgcattgcaggcagattctttaccaactgagctatcaggaaagccctcttagtaacataactaactacatatgcaattcatcttccccaccttatataaagggatgagatactgctcagtagcactagcatttccaattgaatattggctgctggattatggagcaattttatgaaaaagtcgaatggtttggatagattatataattaacaaaatttttgaatgcttgtcaccatgattatcatttcaatgtattgattttcagcctttagctagttttttccacatcaaatgtgggcactagtttaagtaactttttggtaccttattaaaatttttattaattataaaatttaagtaaccctttcagattaaatatatccaaaaatcatcataatttgcatcaaattgctctctattctgagcttctggtagagaaattttcatagaaaagatgccctctaaagactaaactccaaaaataagctacagtctgggccactgattactcaaaatttgcatccacaattcttttactaaatagtacatttaggaactaacat

SEQ ID NO: 32459 - DNA, 1673 bp, Bovine  19866880739210
atttaacttagatgcagagtacattatgcaaaattccaggctggatgaatcataagctggaatcaagattgacaggagaaatattaacaacctcagatatggagatgataccactctaatggcagaaagtaagaggaactaaagagtattttgataaagctgaaagaggagactgaaaagttagcttaaaactgagcattcaaaaaatgaagatcatggcatctgatccatcatttcatggcagatacatgaggagaaaaaaaaatggaaaccgtggcagattttattttcttgtgctcaaaaatcactgtagacagtgactgcaaccataaaattaaaagacctttgcaccctggaaaaaaagctctgacaaattctagatagcatgctgaaaagcacagacgttaagagattaagacattgcaaacaaaggttcatataatcaaacctgtggtttttccactagtcatgtacaaatgtgagagctggaccataaagaaggttgtgttgaagaagtgatgcttttgaactttggtgctggagaagactcttgagagttccttggacagcaagaagatcaaaccagtctatcctgaatgaaatcaacactgaatattcattggaagggctaatgctgaagctgaagctccaatactttggccacctgatgtgaagacccaacacattggaaaagaccctgatgctgggaaagactgagggcaagaggagaagggcacaaagaaaatgagatggttagacagcttcaatgactaaatggacacgagtttgagcaaactccgggagactgtgaagcacagggaatcctggtgtgcttagtccataggttcacaaagagtcagacatgacttagtgcctgaatgacaacaaccaacatattattttgagtaaatacaatcagaaccaagaagtatgtgacacaatataattggaaaaattaactcatgttacagtgctggaatcatgtatttatattctctgataaaattaagtctgatataccatagatattaattctactattgaagaataaggaaagcttttttcacaaataagaaaagaatttttaagaatatatatgaaagtatagtttttttcagtttttattgggttcctttgcataagtatttctagactataatcctctagtcactagtgaaaggactctagtttgtgctctggtgccatcagtctgcccataattctttactccaaacacacgagcagatttctcccttaattctacaaaactttgcttagcccaagttgtaattctaaaccaaactttagtgaaagcttggagatagcaagaagaaattatagctctgaaaagaaaatgttagcaacagacaggggccataaattctcctggacaccaaaaacgatgggtcttcacacagtgagtatttttggctctttcttgccttattgcccattctcctactgtcagatggcaagggccagtttatttccctcaatggtgatgtttgaacctgaattctaccttcatcttctcagattatggcggtgatggaggaaaatattattttccactcccaggctcttgcctacctccaatcaaaatctcaataaaattggaaatgcaaacaatctacgaattaagataaacttttaaattattgtgcagaggaatt

SEQ ID NO: 32460 - DNA, 1344 bp, Bovine  19866880800542
cgacttgatggacatgagtttgagtgaactccgagtatggtgatgggcagggaggcctggcatgctgcaattcatggggtcacaaagagtgggacatgactgagcaactgaatggaactgaatgttctaatatggttttatttctcattgtattcctgttctttgctcaatttccttatcgtttttcatgtctcagttgttttgcagaagttcctcctaaattcttgatgctaatcccttgtcagttgtagatgttgtaaatatcaaagtacagactgtcaccccatctgttaactttgtttatgtggttcattgactaaaaacatgaatcttaagatttatactttgtacacctttgatttaaaaaacttagaatactttctctactccaaattcccaaagaggaatttttaaaataacagtgaagagaaagaacaaatttcccttcatttcttcccttggtcagcattcatagtttataaaggcagcattttcacatctttgattattccaagtattcttttcacacaaactactacctaaatgtgataatcagttgtcaacccactttcaaaaggccttgccatatggtatgattttattggtcaattccagagtatatattaacttggaaaaaatgggctgctgctaatgggatatggaatggaaatgctgtcttttgtcactaaggggactttatgtgtgaagttaatgtacacataaatcaacgctgtaaacaaaaacaagagaatatcaaaaatttgttgctatcagttgtcacctatatacagatgacattgaagtttattatattttgagaatttgtttccatattcacctttatatcatcaacaaatatttccatttaggcttaaagaacaaactgtttaataaatcaaaatgaatttgatagatttgtacctgaatactgactctgaaattaaaggacgcttacttggaaggaaagttatgaccaacctagatagcatattcaaaagcagagacattactttgctaacaaaggtctgtctagtcaaggctatggtttttcctgtggtcatgtatggatgtgagagttggactgtgaagaaggctgagtgccaaagaattgatgcttttgaactgtggtgttggagaagactcttgagagtcccttagactgcaaggagatccaaccagtccattctgaaggagatcagccctgggatttctttggagggaatgatgctgaagctgaaactccagtactttggccacctcatgtgaagagttgactcattggaaaagactctgatgctgggagggattgggggcaggaagagaaggggacgacagaggatgaga

SEQ ID NO: 32461 - DNA, 1111 bp, Bovine  19866880902600
gaacagtctattcagcctcaatgatctgtgaaaaggacatgtaaagcacggggaaaggacttgaaccagatggcctggttaacaatagaacattttacaaattgtcaaaaaaataaaaacaagaggtaggaaaccacagccttcacaagaacatttcccctgacctgatggaagcagagataactactgtgctgcatttctaacaaacataataattgtgttcaccataagaaccaattgttactagccatgtggaaccaaaattaatttctaaattatgaaccgacagattgcaataagcttccctatcatttagcagtagaaagacctagttaattgagtttattgttataatgtttagggaaagtgtttaaggaatataattttttcattttataatggaatggcaggtttcagtgatcatggtttttcaggagtacaataaaaagttggatgataatgtcagcatcagggtggcaaaagacaattttcattttttttaatcctctcaacaacaaaagttcagtatccttcaatgaacaaaagtgcctgtgaggaaaccatatgatcagttccatatactgaggatctaggagtcttttcttcccacgatttaagtaataggtagacagatctgggtactggctgtagaaattgtagttgtctctgaaacagttatgggggcttttcgattataaaccaggagtcattggaaaacaccgtcttagataattacccatggctgagggagcctttgaggatgtccaagattctaaaaggcgtcagcagcttggccaaaataaaatctgagtttatatgtattggggtgggtaaaagaaaaaaagctgtattttacccatattatcccttgcagagggcagcattgcttagggccatgagagatccttctctgtaatttctctaaaagagaaaaggaagagcatgtgagtgaacacccagcttctctaattgtgtaagatactgccaaaggggctcatttctctcttgattcatcaagaatgttaaataatgagctttatgagtggagattaggaaaggaagaggctggaagagcagcagataatactcagagagggtattaaacatactg

SEQ ID NO: 32462 - DNA, 4354 bp, Bovine  19866880967960
gatgtcctttgcatataagttaaataaacagggtgacaatatacagccttgacgtactccttatataaatcaaaaataaaatgggtttgctatggccccatatgttatgaactatgtgaaaaatgaattgataaataacttttgttatttaacaatttattttatttatgtatttactagtcagattgtatcacatcatacctgcctttgggatgccaattcatcatttaactaagaaataaatattttaactgaagctaagcaaatgtgaaaataccaatatatgtatgtttaaaggacagtatgtatttggaaactgtgaacctctacggacataacatactcttttactcaaaatcattcagcaatcttaataggatgcccatatcatttagccaggtatggaagccacagaggtagaataacattacttgaactttaatttttttaaaaattattagtaaatgcagatgtacctacagttcttagattttgctattttacagattattttcttttgaatgaagcttccttcatggctcagatggtaaagaattagcctgcaatgcgggagacccaggttcaatccctgggttgggaagatcccctggagaagggaaggtctacccaccccagtagtctggcctggaaaattctatggacaaaggagcctggcgggctacagtttagggagtcacaaagagttggacacagctgagtgattgacactttcacttttcttttgaatagcaatagtcaggttattaaaaggaaagcaagttggactaagtcggactaagtaaacaagatttcaagatcaggttttgcaaggtcactgctattataaaaagtaaagtcatctttgattaacttatttttaactggctttgcagttgtagactgctttattgtaaccaaagataaatattgcagaaatgattctccctaaagctagtaagatattacatattctctaagctaggaattttaaatgaatttttgctagacacatgtgtggaatgcaaggcttaaagaaactatttggtatctcaaggaagtttttctggtctagtgagtcattcagagattgattgtttactgctgcctgctagtatatagagtttatggactgtttacttatttcaagatggtataaactttgccagcaagaaagtttcctgaagaatgtctcctcaaggaaagatgcatcagcatcttaactatgaagtctgaacaagattcagttgtttatataaactagattttgagactattgcagaagctatctaatttaatttttatttcaaaaaagtaaatagttggtacatattacatgcctactcagaaataaggggatagtagatttctctgatcgtatccatatatacacatgcactccagttttaatgttaatttttattacttaaaattaaaatattctacctatatcctaaaggcttccttggtggctcagactgtaaagaatctacctgcaaggcaggagatccaggttcccaactctgggttgggaaaatcttctggagaaggaaagggtaacccactccagtattcttgcctgaagaattccatggacagatgagcttagtaggccaccatccatggggttgcaaagagttggacaggactaagagattaacactttcactcatagttcctaaaggttgattggaataaatttttccaattatattttccacaattaaatataatttttcatgcaaatagttattgtgtgcttatcattgttatggatactggaaatatacacataggaagacacaggcataaatcttaaaccctagaggaatgtcttgttaagaggtaaaaaatgaatatgtaaagtttaaaaataaaatgaaatttaaaaaaaagcatgtaaaaattttacaagtttccaattattttatatttgccacaaatatccccaactagatttcaatttcctatgtgtctccccacccctaattctcaacttccaccattccctggctcatgtgtgtgtgtgtaaaagtcactcagtcgtgtctcttgtgatcccatggattatagcctgccaggctccactgtccattagattctccaggcaagaatactggtgtgggtagcagttctcttctccaggggatcttcccaaacccgggaatgaacccaggtctcccgctttgcaggcagattatttacagcagagccaccagggaagcccttcctgtctcatagggctcttaaaaacctgtttgcatattaaaaccttgtcctttagtaaacaaattgacaatctgtgtttaatccaaaatatctcaaactcacatggctagacattccctttttatcaaggaactaatgttatgagatataattgggaatgtattagtctcacttttgcatacaagaaaattgataaaatagtgagaagattcattaaccctcacaaggttttcttaattcattctctctttaatctaatcctaaatacatttagttactggagattgaaattttcaattactgtctatgggaaatttatgtgaatttcagtgcatctaaatataattgaagaatctttctctaaagtttaaaaatgaaaataatttatatattaattttacattttaatatacagcattaacactgacatgatacatactcaacatatttaattttccatgtccgtaagagtcatttctgtattcctacaagaaagatcagccatatatagttatcaaataagtgttggtatcataaaatgtaaagaaataaaataccaattaagttttcatcatattctaagtaacaagaaagaagagaagtcttccacatgaggtataccaagtagaaggatactcagatgtaaagctatgaaattcatttatttcaactcaatcaagtgtctttctaacataaaacattactgctagtcattttgtacattttcaactggtatgtaaagctttgaaatttcaagtattttagaaagttagagattttacatgcattttaaagtatctgctgtctttgatacctgaaaataaattgttacaaaagttgtcaagatctatgtttcttatcactaagcaaaatcataaatacctttcagtcagtcatcatgcagtcttattatcttggtactaatcaatatgcatgcattcacaggccatgaatttacatttttttttgtagaaacataactacagtgattgtcaggaggagctacattacttgactattagcaaagagttatattacttgactactctgttctagcaatcattgttcacatctaatgaatttacttatgtaagaccatattacattattgtcatttgaatgtatgtcaatattttctactctgattaaaaccagtaaagattaagaatcctttgtttgactcaaatgaacacatcatgcccagtggatcacttattgctactattttaaatagagaatttacttgaaaaatacctagaattctaaaaattgtttccactatggggtgtataggccacaaagttcttcagatattcattgagttatgagaaataatgtaggatgagctggtcatatcatgagaagtgcttttaaggtgtacttagaaactctttttcaaatataaaataatcttgtgataaaatgaacaagctaagaaatatttagtaaataatatgagataacatgaactccctgttaaagcttgggacagtagagtcagaatgcttctaaagagaagagaaaacactttccccctatacctgtattttaaatttaaattttttctatatgaaacacaataatacttctagccaaacttaggccctccactgttctggttttgagagaactaaagaggaagaaagtatagatgtacatttatatgcagttcagttcagtacagttgctcaggcgagtccaaagctttgcgaccccatggaatgcagcatgacaggcttccctgtccttcaacatctcctggggtttactcaaactcatgtccatcgaggcagtgatgacaccaaaccatctcatcctctgtcatccccttttcctcctgcctttaatttttcctagaatagggatcttttcctgtgagtcagtacttggcatcatgtggccaaagtattggagcttcagcttcagcatcagtccttccaatgaataatcagtactgacttcttttagaattgaatggttggatctccttgcagtccaaggggctctcaagggttttctccaaaaccacagctcaaaagaatgaattcttcagcactcagctttctttatagtccaaatgtcacatccgtacagactacaggaaaaatcatagcttgacaagatagac

SEQ ID NO: 32463 - DNA, 2683 bp, Bovine  19866881031622
tcattaaatattcaaagcaatgcttttaaagttatagactaaaataggcataaccacttaatgtcttttttgctcatttgtcaatatcatatggagagttttaaacaaggcaattaggctatcaaataattcagaaatataaaattggtaaagaccaggaagtactatttgactacataattaaaacaaaaactattaaaactaatgaaaaaaagttagtcagtatggatgtactataaataattgttactttacattaatatacaattattaaaataatgaaatagaaaaattcaatttatagtagccatgacaactataagcaactaaaattcatattaaataacaaaagaacaaaaatatgaaagcattttggaaaaagaattaaaattttattctacaaggagccataattaagtcactgatgaaaagatgtttgtgatgcaaaatctttaaaaaaatgcatatgttttaaaaaaaactaaaattttaaagaaaaaggcaatagaaaatgagtttaaaatatttacagaaaatagaacaaaaaagaaagctgattaataaagtaataaaaaatgctcacactcacatgtatataggaaaatacaaattaaaagcacaatggacaatagcatgccatgctcatcaattaaggaagaataaaacataaaggctgacattaccatgtatttcaaaagatagatatcaatgagttgtcatatactgccagtgggagatgggtacaaattgtcacaagcactttgaagaaaaatttgggaatatgtaatatagtaaaaaaaatccacttcttctgtgtatatgacctagaagtagaggtcgttccagagtgcctgataaaaagtggatttatttgacatttcagaaaaatttctcacaggcattcatagtctcagaatatcctctatttcaactgatacatagcaagtccagttgaaattttgaggtattttgcctgtgtgcctgcattctaagttgcttcagtcctgtctgactctttgagatcctgtggactgcagcctccaggctcctctgtccatgggattctccaggcaagaatactggagtaggttgccgtgccctcctccaggggatcttcctgacccaggaatcaaacctgtgtctcctgcggctcctgcactgcaggctgattttttaccactgagtgaccgatgaaaccaatgtatttcgagagaagcaaaattatgcatcatagtcacaagcacttgctttctgatagaggccattgagtggtacaggtattttggattatgtaccttgatcaaagaaaggaacagtatagtttttaagaaaacaaaacagtaaaatgcaaagagaactttttttatgaaaaagagattactgttagtggattgagtgcaaatgggatggcaccatgcagacagtataaattcaatgagcaccattttaaagatattaaatgcatactgtcttatatttatatagcacacattgcatactaaatcagttattaaataaatagtacctcatgccttgaaaaattcctaaaacatgaaatttataataagcatgtgtttggtcaccaaaatatctcaatgcctactctttaattccatgtcagtatctccatttgttatttttgctttgtgactcctctggtataaatctgctcatttttagttatataatatacacggttatcactatttagtcaaattatctgtgtactcttcagaaatatttcaggtagccttcctgaaacttttcatgttgctttttgtcaaccccccagggagagactgcataaacaaggcaacaaagcttatggcttacagaagttttccaattacagacaaacagttccatcaactcaatttccttgcagaaagagaagatgttgattcataaaagttttagtgcctcacattggtatgatttccagatgttttaattacatatcgctctgcatctcttgacaatgaatgcattgcactgaactgaaaagttacagccagctggttttctgtcagtttgaataagttatgatccttgtatttccagctattcacttttatagctgtcaggcctcaatacctccaagattaggaaggacagtcaaagcatagggctcagtaaaccccaggtattgatgcaaattacatcattctattcatttattttttgatggctaataaattaattttaaaagaaaaagcttcctaatatgctggttgtttggcaatatttggtataacataatggtaaaagacttgtttaacttcaaaaccacgtttgaatgcttttgtttttcttcgttatttttgctttccactttatattttacttcctttccattgtttttatttatcattgagacataaaaatttcctatttcacttaaatttttactgtttttgcattatctattaattaccttttccaatcattttccttttttatgtgattacaaactttgataaaatgcagtatttatgggggatgacagaggatgacatggctggatggcatcactgactcgatggatgtgagtctcagtgaactctgggatttggtgatggacagggaggcctggcgtgctgcaattcatggggtcgcaaagagtcagacacgactgagcgactgatctgatctgatatcacttcaagaatgataaatagtcctg

SEQ ID NO: 32464 - DNA, 1471 bp, Bovine  19866881210684
tcagagttgaaaggaagaaaaggggagtctaaagatcacaaatgcagacatgatctaaatccttgtccttctggacccatgcttccttcagggtcttcatcattataaatgttctctgccatttgccacacttgcatgatattgtcttctgatatagaacaaatcacccgaggttcattgggagtctagaagaaatcagacatcttggcagtgtgaccaccatgaataaacaacaactctggtggcccatcttctggggattgttcctctccaattttacttacatcccagacattcagtctttgatcaataccattggaagccaaaatagtctcattgtgaggcgaccactgaacctggactatttcatccttatgtgattcaaaggaatccaacttaagtttcagatttctcagatcccacagggcaacagttttgtcagctgatctgtggcaagaatgagctcactataaggactgaaagaaaggcagttcacttcagcaatgtgagcatcaactgagtggcttggtttggaagtactgtttgaaggagtatcccagatcatgagtttctgatcatcagcaactgacccaaagagggactcatggagcagatgccaggagataacctctactactgctgtgtgctctgtaaagatggtcttcacatccacactttcccttcctttggaacagcacttatgtcccacaggcagatggtgtggtcatctgaagcactcagtaagtgcccactgagatttgggttccaagaaagcccgtagccttccttctgatgtccacggaggcacaagtctgggttgcactctccagaagggtctggtttagcaggatattttgaatagtcaaaagcaagaacatcactggatggattctttgttgcaatgatgcaagggttctggggcatatagcatgcactgtttacctctccttcatggctgatccttgatttctatttcaattttttccactaactgagccaaaacctccaaattctcctttttcactgttgtagtgtgaagcatcaaactgagcatcatcattagggagctgcacgctgactgtcacaaggtgggttttgttcatctgacaagtgtgtccccaggacgagtcggtgaatactgaattctttcccttctggtctggttacatttggaagccactgtgcagttaggctaggccactccagagcatggatcatcaccaagttgtaaagaaaaggggtgttctttttccatattttatattcttcgttgatcacacattcttctactgcatcatcaaaggtgcttccttgttggccatgccgagtaggcaagccagcggggatcccagggttgagcactgcaggagcctgcgggcacttgctctgcacatgtagcctctctttgtccccagtgagctgattttttatgtcatataattacttgcagatggaatttaaaaacaccaag

SEQ ID NO: 32465 - DNA, 1013 bp, Bovine  19866881222591
gttatctttgtactaaaagttccaagatgtcaaattactcccccaaatttcagattaccaaagcaatagcatttattttaaaattcatactttcaaacataccctccaactctggggtctcaaaatactattccctagaaagaaattaccactcacaccttttacaaagggttgtatcaaagtttgctatattgcattttccttagacttcatgagaaatagttttaatcaaatagtaagcttaaaattatttcatagtttttcaaagaatcttgacatttcaagtttttgagactcctgctttttttcaaatctgaccttttctacctaaatatcatatttttgcattgcattttgataactcaatatgtttttaaatgaacgttgtgtgctttccacttgaaagtatacagaacaacatggcaagagcaagttccatttttaatttaaattattttcatggcattgagcagattttaacctttaaaacagcctggatgcaattctgattaatgcctcactctttagtctggtgattcagtggagatgaactccatcccctacagcagtggtgaacttcccttatctgatacagttgagaaaaatataataatagtatttccaggccatatttcctttcatttaacatgaaacattattactgatatccatggttcagggatacagtaactgtctaatggaattcatagaacatcaagaagaaaatcgatcttctattagacagtaagatattaatatataggaatatctgtgattttcagcatgaatccttaccccttacatttgtatagtattttagagttccccgagaacattcatataccttaaattacaaaaagaatcatgaattacatattatcatattgttttatacatatatatattatacatatacaagtatgtgtgtgatgagtcacttcagtcatgtccaactatttgtgaccccatggactgcagactgcaaggctcctttgcccatgggattctccagg

SEQ ID NO: 32466 - DNA, 1787 bp, Bovine  19866881256518
acatagtcacatgagctttttcaaccctcaacccttgtttcctatatattttcttaaaatttgtaataatatttaacagaaaacaactcagcacttattaattaccaggcacacatataaggagtttacatgtattcagttcagttcagttcagttgctcagtcgtgtccaactctttgcaatcccatgaactgcaacaacaccaggcctccctgtccatcaccaactcccagagtttacccaaactcatgtccattgagtcggggatgccatccaaccatctcatcctctgtcatccccttctcctgccctcaatctttcccagcatcagggtcttttcaaatgagtcagctagctgcatcaggtggccaaagtattggagtttcagcttcaacatcagtctttctgatgaacacgtcttacatcatttaaaccttcaataacttatgtaaaaacactctattctaggactttatttcaccaggctctgtttcttaaacttgtttatagatccaggttaatttatataagaagtgaagtgaagtcattcagtcgtgtaatttatgtatgtataaatataaatatatatatatatatgtgtgtgtgtgtgtgtatatgtgtgtatatatatatatgtatatgtatatgacaaaagccagtgtcaaatttcagatttttggtggggttagacaatgtcataataccataaaaaacttttcaatatatggcttgtagaagggtagaaagattacatttaccattgttaaagtgctcctgtttctgcctaatacattctgtggggctgccctcccttggaggatcccatggccaaagaagggatattcaggcacatcgcagctttattattaaacaagtgaggctcgtgttgttactgcagtaccttggatattctaaggcacatctatggatacatgctatcaatgaattgcccttcattataagatagttttatgtcctaaacagaaagtgaataaattcagtattgctgaggtgagtagagcacaggcaagtatgaagatatagagatttaagggcctgaaaaatgcccaagaatgcaactgcaagtaaattaatttatacatttgtcaagataagagtgaaaggtcagcatacaattccaatttttatgtaaaacaaaaagtaaggtgaatcctaacaaagcattctcacttaaggcaattttctctcagagttgtttttagtcctgccacctattaagcagagatttacaggtgatctgtgaaggggagtttgtactgccacacattaacagaaggtggagagtaaaacataatcgaagtcttaacttctcaactttatggtattgaaactcttttaatgccattttaaatttgcttaatttaaccccctgttaatttaaaagaacataaagcccaatagttttattgtcatactttattttgccctctgtgcacctctgatttaattcaggcaggttttaggcaggcaaaactaggctcatcataccacacctcgatgatcttaccgatcgctaaagtaaggatgctttatcttcctttattttacttgtgctctctcttctttaaatgcatgatgaatacaaaataaaggtcttttcaagttcattgatgctcttccactttcagtcatattgtgaatgatctgtgcctgcctggtggtaaggattggatctgtaaaggggcgagttgtctggtccttaattgcttctccctgttccaagtgataaggtagctctgtggatttacaattcatctctaaggaga

SEQ ID NO: 32467 - DNA, 855 bp, Bovine  19866881804551
taactataaatgttggttaaaaacacaatttaaatatcaaggtagagtttaacggtgatattaatgatttttttcacaactatcctattcttagtgaagatcagctgatacttttatgatttcatacacatacatggtaatttaatatttcttctggagaattccatggacattggagcctgacaggctgtagcctgtggagtcacagtccatggaatcacaaacagtaggacacggctgagtgactaacactttcactttcttacaatttaaattcaaatctatttgtctgcttctatatttgagttcatgtaatatagtcagtccaattacatagcttcataagtggatatttaaaaaatttaatattaacaccaaggctttatgtttaattttctgtttgatatgtactgataatatttactctgctgtttccattcatatcagagatgaagaaaattttctttagattatttctaaggttattagatagatacttctttgaataattttaagaactgagtattaaaatggctttattttttaaagatatcaaccatcctacaatattaaaatatcctataaaatgaatagttttgcctatgtacagaattacctagaagtagataacatgatgcacatttagtgttaaaaggaagttgttgacatttgtagcagaaaatatcaaattaagtaactctatcttgaattattctgaattaccaatcatctgtgccagttaggtaatgacttcctattacagttaatggaaattgaatgtaaatctccacgaacaaaattaaggttatcctgatatcgcaattacccagggtataagggtctgtgatagtctcc

SEQ ID NO: 32468 - DNA, 915 bp, Bovine  19866880361736
cacagaagctttagtcagatttaggtgaaaagctacagtggatcccatgcaactgcctgcatttccccgtaccagattattactatactgaaaactctgaaatacctaaaaaacatctagagcttagagatcttatttcctagagaaaagttttgtttgccatagactacgacacccttgtgagggaaacaaaaagaactagcattgaatgaatgaatacctggtctgggtccagcacttagccaggtgctgggactacaagagatgagggaaaacaaaacaaaacaaaaccttgttttcttagccagtccaggagctccatggactacagctcagagaaatgaagtaacttgttcaaggccatgaagctggttcaggttagagccagaatttgaacacacatcatctccatccaaagcacacatatccttttttaccactagtatgctctaaaaagatttcttaaaaagctggagtgtgctgtcatgcttctgtggtatggtgctagattaactagcacactttgcttgcgctttgtacacccatcccttttcacttctccatttcgagaatttgtcattgaaaaggcaagttggaatacagtgagggctgttcccccaccccacccgccatagtgcaaaagaggtctttctagggcacttgggagttcagggttagcccagtacagtaataaccatgaagtgcacaaggggaatgcagctgatttttccttgccaaaatgttcttctctttggttcatttcatggaggcctttgatacccttgtgagaaattctgttatttccataaaagtcctgaaggtagtaaactgggagttgttttaaagtatctaccccttttccaacttctgaaccaaattatttgcataaagtctggagaaaagcttttagttttg

SEQ ID NO: 32469 - DNA, 2021 bp, Bovine  19866880392459
agataagccctagcaattttatttttattttggagaaggaaatgacgacccaatccagtttcttgcctggaaaatcccatggacggaggagcctggcaggctacagtccatggggtcgcaaggagtcagacacgagtgaagtgacttcactttcacttcaattttatttttaggaaattattctacagataaactcacacctgtatgcataggaatacataggaagttttccactgccttattttctgtaagaggaaaggacaatgaacaacctaaatacctctccaaaggaaaataagttaataagttatgacacatccacaaaatggaataccatgcagctttaaaaataaataaaataggtctctttgggctaaaatgaaaaaaattgctgagatatattgttacatgtaaaaatcaaggagccatacaaaatacatgaaatgcaatcgtttgtttttatctaaaggacatgcccatatatagtggttcatgaattttaaacattctgaaatgacacccaagaaacaatatgtgcttcttaaggagggaaactagagcctggagtgggaggggggcttatatattacttcatatcacactattaacattttaattttacattcatgatttttaataagtgatcatgtaaagtgcttagaattctgtgccagtgagtattaaatattgtttgctgttgatgatgttattgtaatggatgcatacttatttcttttggctaacacagcatttgaggggctcctgcctctggctcccgggaaaggtctggctcctacctccttgccttcctcccttttctccaagaaggatgagaaacaggaaactatggagactaaatgcctattttcagtcttctctggaaggaacaattccacctggacatgtgtgcatgccaacacatcccagctgcctctcagctaagatatgaggttcagctagaggtgctgagaatgtggcaagattactccagcagatggaatcctgctgctgccccccaggagatggttcccgaagaaatgcttgtccttgaaccgtagccatgactccagagtttgcagtcgaaggtgattatcattgatgctgctctacgttctgccgcctgggactggcagaagtggggaaactggctgagaacatctcctccccagtgtggccaccctgccaacctggcaggacccagaggggaggctgtcagtatggtaggctgaataatgtttccccaaatatatccatatcctaatctctggaacctatgcatgtttacttatagggcaaatgggacttttcatgtttaactaaaggaagactcgagatggggagattatgctgggttatctgagtgggtatgatgtaatcacaagagtccttataagagggacataggaggctcagagtcagaggagaaagctacgtgagaatggaagcagagatttaaatgctatgccacctgctttaacaatgaaggagccctgagccaaggaatggaactctagaagctgaaaaaagtaaagaaatgcattctccccagagcctcctaataaaatataatcctggtagcaccttggtttcagcccagtgaaattccgttcagacttctgacctccacaactatcaggtaataaatacgtgtggtttcaagtcctgaaattttggaaattggttacagcagccataggaaaccagtacagtcattatcaactcttctcattatctctctgctcagctctcttcactgtcccctttcaactgccttcccaggcaaacctaccccacatcactccaagatggctactgcagctccagacctcacagcctctcagcttcaatcccacggaaaattgactaattgacaccacctaccactctctggctctactgagatgtgagaggaaggatttctctcaaactgtagggacccttgactttgtggtggggagaacagcacatgtctatgtaccgtggcagtaaagtaatggtaaggagcatggattcagaagtca

SEQ ID NO: 32470 - DNA, 1532 bp, Bovine  19866880404318
tgttcccactaacatgcacctttgcaatcaattttccttgtgctgacaggtgggacctgccttagatcctcagcagttgagaaagataaagattgggaagtgaagccagagctgaaacataccacatctacttcctggcttgctggaaaagccccagttacaaatatcaaaaagggcacaaataccctctttgccaaatgaaaatctgaaattctccaggccagaattctggagtgggtagcgattccattctccaggggatcttctcaacccagggattgaactcaggtttcccgcattgcaggaggattcttcaccagttgagccacaagggaagcccaacatctgtattactaggtcacaaaatatatgccccttgcttcatggaaaaggcaaaacttggagcctcgaattgtacatacccactctggttgccagccaagcagctttggtcagggtatgtaatgtctccagacctcagtgtcttcatcagtagaatgggcacagcaacctctaccacacagaaagatcatgaagattaatagagatcattgtaaattacaggcccagtgcaaacacacagtgatagctctaagaatgcttgtctccttcctggctgatggcaaagacacagatagaggtaaaaaaggaaaattcattctgatattttctggatgatacaagaaggaaggagctatgcgtctttcacgttctttaagttcatctaaggaaagaacagggccatgtgcaaactcactggctaaaattaagtcttctccatagctcttcataatttctttgtgagtcagtgtttgagacatgatgttgacaaggggagagggtgggagactgattccattatgctgtaaacctatctcctcaaataaggacaaaatgatagctttgtccacctatcctaacgacaatttacaattatgactcaatttgtcacagaagagaaacatgctatttatttgttatttttatttttttaagggaagcgtgggagacatttacatggctaatgagaaccaaaggtgaaatagcttttatgataacagagatagcaccagacttcatttttggtaatttccttccaattgagatgttgctgataatgctggacagtgtccagctttgaaatggccctaatcagagtccaaatgctatggcaacaatctcttgagaaatatcatacccactcaggtgatcttatgcctgagtgaagaatataattgttactgtaaaaaatatttggtgtgttacaattatatggtatgtcaaaatacagcattctctcaatgatagttaaattttcatggatttttttttaccctctttcacagtatttaaataatttgactgtgagactaaaccatttaaaaaggtaagtttacccacatcacttaatagcccttcatacaaaacccacatccaaaggtctgaattcttttttagaaactcatcatttatgttagaaaaaaagaagagagagaaacatgcatcaacaatgtagataattttaattcaaa

SEQ ID NO: 32471 - DNA, 1329 bp, Bovine  19866880444228
tgaaaagctgtttatagttcatgtaagagaaggactgagaattacccattggattcagtcatgtagagatcactggcgacttaacaggagcagtttctatagaagggagggtaatgaaaccttattgcaaagggtttttggctgaacaggagaggaatgggatgaaatgagtaaagagggggaccagagacttgagccagtagccagaggcaaccttcaaaaggggagagtcctgtatatttttaaaaacaagagcaatactagagctgatgaaaatgatccagtgaaaatggaaaagtcaatccttagagtgaacttgactgttgaaatatcttctggcaagtgagaggagtctcacgcacctgtggtgctggccttagataggggcgaggccattcttccaaatgggaggggaggcagagtatgggctggtaagttgacctatgccatggttagagcggtggcacttccattttctcagtgaagtagggagcaggattattagctaagagggaggagagagcagaggtgttggaggtttgatgagactctgtaaagcaaaaaatggtttgagaatctaggaaagtgactggaataggaaatatcaaaggatctccaggaaataccaagggatcacttgaagttagtggacaggggttataataagactagttagcacaattcagtgtttttctcatttctgttcagcagactcagagtagatgagtaaaatggaggaagaaaggacaagaacgtttttaacatttctgctgtcactatttatatcatcctatcatcctaactaatgattttagaggattttgtaaaatgaactcaacctaatttagccaatctctgcaacttgggacattggagtttctctgttgctcattaccacaagtaatgggttcagtgaattcccttttatatcaacttttgcttgtattttccattctttctctggaaaatggtgttgctaaacaaacaggataataagcaggatactgtcagtggcaagtaacagaaatggaaacagtttctgttaagtcacttaaacagtatgcaaatgtgtcacatcctatacaaggcatcctgtgataacttaagcttcggacttgccttattcatcattttaaagccatcaccacagactcagagttttctgctctgtcaactccagtgtgccagctttgtccccaaggtagaccatcctcacggtcagaaaatagccaccatgatctcacacatcacatgtggatatgacaatatctgtgagcaaatgttcccagaggctcacaggaaacctctcctcacatctcattggacaga

SEQ ID NO: 32472 - DNA, 1454 bp, Bovine  19866880454059
cgactttgactaagcatctactatatgccggacttggcatgttccacccccaccctaccctgagagctgttcacctgtgatcaccctgattttacaactgaagacactgaggcatcttcctcaggtttccaaaaggcagattatagtggtgagacttgtactgtcatcctttcatagccaagcaattattttatggagggaaaatgaggccagaaacttctgagcagcaaactccacaaacggcaatgtagtttttctgacgcccgtgtttctgggaagctcagcgtttcagatgtgttttagtaactcattcccggctccccaggagagctagtcccatctcataccttggccagtgaaaaccgctccctgggccctcagaccctgaggtctgcgagccagggacacagtctcgtctacctgggtctctagctggtgctctggtacagtacctggcagcccggggtggcctgggatccaggacgtgccatcctggaagctggtctggccctagacagggcgtgagcagcacaggtttccctcagagctcactgtatcctggggaaacagaacctcaatgcagcatcaagtgttattcgagcctcacggccaggctttctagaggaggtgacattccttccaccgggtagaacaacaaagagaaggaaattcaggccaagagaacacgtgcaaagacacagaggtgtgcagaatccttgggggtgggcgagagggcgggaggtgagcccagtcggagcagagcctggtggcgctggggccagggtggagggagcggcgagccccaccagcagggcggacttggcacctgtgggcagcacggggcccggggagctctgagtgatgcgctcagctcggtgttgaggaggccccctctggggccagtggggctgcctctcttcctttcatcagacactgtgaacacattcccttaagcgtatcctttttaatatcacatctatttgtctgtctgctcattgtttgttgctggaacaaaatacgcagtactttaagaggcccagcttctgtgaagaaatcaggatctctgctatgtcacagagcagggggaaccaagccagaccccagggcccctgaggatggaacacagcaggagctgctcctgtcggcacaggttccggggctgtctcgaagcccagggaccccagactcgatcaggaaagaagccccgccacaaagcctgctcttccctttcatggctcgtgccatggtcccaggcccccaccccactgggcctgccggcctccccggctccagcgtgctgctccagccagcactccccagccttccccagccttccagaagcctgtagcacaggaagtcagcctgctctatacttctccctcagatccggggctcatctgtgcaaaacaggagccagggagaggggtggtctccaatacaaataaaccccagga

SEQ ID NO: 32473 - DNA, 1009 bp, Bovine  19866880459667
ccccactgtctctattactaaattctaaacagaagcatttggaagaaaggacttatttagccaaggtttctcttgcattgtttcatttgcaggcagcaccctccctctatctcccctcctttcatcttctctgtcctcctggcctgggcctttgtcctccacaccagcctcccagagccctgggttccttgggatgctaatcacacccggtgctcttcttgcgccaagaatatttctatttatcaagccagggcagactttgccttcgggagggacacatacaagggcaggaacactttccaatccttcgggctgcttctctttttcctttctcatttcaattccaggacgcttttcttttttctttctttctcggtcctctttgtgccttgccctgcttttggatgcactggttacttggcactgtctcctctcaggactgagtgcagacccgtccagccacagttttgctgcagaattactgatacttactttacaaaggagattcaactctctttaaacccagcaaacccgtgttcaatccctgggttgggaagatcccctggagaagaaataccactccagtattcttggccgggaaatcccatagacagaggagactggtgagctatagtccatgaggccacagagagtcggacacaactgagcaactaacacacacacggacacacacacacaaatccagcaaagtggtatcactagctgtctaaatttcctctgtctctgtttgggcttcccctaaagtagatgtaagatgagaattccagtgcaagcagtttatgtaggaagagaaggggacaccagggggagtagggggttgggggggtgagacagccaaaagaaggagcccaggaagggtgagtttccaaatctactactactgtgggcagctgcagcccactccccatggaagctctggaaaaaggtgaagaccatacaccccagcagggttggaggtgaggagctgggctatttgtgtccagggaga

SEQ ID NO: 32474 - DNA, 2179 bp, Bovine  19866880560858
ttcaaagagactctctcaaactcacctctgtctttaaagcatctgagactctaagaatgcatcgaggatcttatacgtgcaacgtgctctctatctcccagagaaataaaaactcatgtttgacctcatccaatagcagctggcttgtcactgagacataacgcatagcctggcttcacagatgatgatgactctgggggctcctgacccccagcattagcatggaccttccttctcccttgcctctccaaccagaaaatcagtagttggatgagaatcttaattcttctgtcattctgctgggagcctaaggaaaggaatgatcctatagaacagacatgtcaagaaagaacagatcctgggacttccctgatggtccagtggctaagactctgtgctcccacacagagtcttgctgggggcccaggttcgattcctggtcaaggaacttgatcccacaatctgtactaaaatatccttctaagactggatagtagtcggagtgttagtcactcaatcatgtctgaactctgtgtgaccccattgactgtagcctgccaggctcctctgtccatgggattctccaggcaagaatattggagtggggtgccattcccttctccaggggatctttccaaccccagggattgaacccagtcttctgcattgctggcagattctttactctgagctacagggcagcgagctaaataaataaatattcagaagaaaagaaagaacaggtcctaccaataagatgtcctgatcaaaggatggaaccatgtgacatacagagatattttggggccagaatggctaaaagaaggctgattagtagcagagtggaaatcaatggctggaaataaggacacagtctttatttttttactttgtgcatttctgtttatggtactccttagagtagaagctggaatttgtctttggggcattctgtccctttgttctggggggaacaagtttcatgagctggttttgtcccagggatggcagcaagtccctagtcctcattactgggcttgtcttgaactctgagtaaccaaacccagagcttcaggctgaggagttaaatagtttgttgaagaatataaatataactctttaaactgggggcagggcaggttgcagcacatgtcattataatgtagataaagtgttttgtttgctttggcagattggggagtgggaagggtggagaccaagattggaatcctggcattgaaactgagatgggcagcaggcatggggacacagtggctaatgtgtgaaggtgggaggaccccctatttagaagaaccagccctgcaccccagggacagtgagagctgatactcacccaccttccctttcctctctgcaactccctggctggttctcaagccctgtgaatgcctgataaacccaagatgtcggcgtaatgaatttgggggatcaggaaggaacctggatcctggctttcatgagcaatgcgtgcaatacaagataactgtgccttgaccagaggcgccaggaggatatcctgctgagaggtgacaagcaccaacaatccagcagggaaggttttataggtcatggagtaggaaggagacttccctgagggctgtcacaccatcggaggctctaccctttgatgcagagggacactgttccttgaccaaagacaaaaagggaatggatgaacgtggaaggaatgaagcactgctttcctgcatctgtctttgtaggctcagctgtgtccttgcggctcccccgtaatcctgatgatgtgaccaatcacaacagagaagctatctctgaggagcatcatacaccaagggacagctgccccgcaagacactgaccatcctgcggctgctctccacgcaggcagcacacacccttcggacaccaacacgatgagccacaactggccccaaatttcaggacctcaacagttgtaccagaaggtccctgctcggaagtggtcagcagagaaaggacttggccatatggtggtgctggggccgcttggggttggcagaatctgcagggcagcaacccacactcacctcctcttgatggtgagcatcacgcccaggaggatgatggtgaacatgaggaggccagcgatcacgccagccatcttcacggtgttgtccacctgcttctccggctccacagt

SEQ ID NO: 32475 - DNA, 1310 bp, Bovine  19866880588274
gccccttctttggcagtgaccgtgtcccctctgtggctccagcctcccataggtccgctggagtccccacttctgttgggtggccctgacctctgggctctgaagagcctttgtctctctagtgtgggctaggtaatggcccctgaggttgctaccttctgggttgcctcaccatcctctctcgatctctgggtacccagttctctggtaaattcactctggtttgaatgtttgaaacagtttcctttttcctggttggatgctgactgatgtggagcccatgctcgtttctagtgattagtccctcctttagtaaacggtgaggggaaaaaataatctgatttaaccatccagtctatatttttttttcctgtatcaacatcacacttgtgtgaaatatctggaatctacatttttccatttaaaaaagtcaacaacagcatttgtttctccccaggcttctcgcacccctcctgtttgctataatttccatccttaaagactgccaaagtagttcatgatcacaattacaaatgttctcaatgccttgggatgcaatttgtaaagtctagaggcttgaagctaatgaagtatccagatgctttcctagcaacttctttcctatcgtggacttcaattccatcttaaaagtagtctaccattctgagaattcacttcccaggaaaagtcagaagggggatgatgcatacctcactctagaagagccagaaacctgcccagcttccccagctttcccctgctgcctcctcttggcaaaaacccccaaaatcagagatacctgccatgcttgaaaccttcgctggcatagaggtagcatctcagagtcagaatttcaaaggtttgctctactgggtgccagatgcatgtaacgccagagaaaagacagaaaaacaaaagaagtcattaaatagatgggcataagtaagatgccagctcagtaagatgtggggataaatgcccttggatagtgaagaggcgactgtgtgtttgaaagactggagcttttaggaattctgtctccgagagccagcttcctttctttgccttcagcaatgatcaccagcatgggttatgcatccactggggtgtgcttggttttatcagttgcaattatatgttctttatctgaaacttctattttttgctccatatctttacaggggaaattctttgaagtaaagctatagaattagggctatagcaagtgagagtacttggagagaaacttattaatcccttgttgccaaattacttattgctgccattaagtgatctggatggaaactggt

SEQ ID NO: 32476 - DNA, 1171 bp, Bovine  19866880609059
aaattttaaatttaattgaatatgtatacaatgttactcttttgttaaaagactatattagaaggagacaaccagaccctcaattttttccaataatgttagtgttgtatatcctggcttgaataaaacacatttcataaaacacctacacagttctgcagtacattatgaatggcctctctggagaaatcttatatgcctttcaactttgacatagtgagacagtaataatagaagtctttggcatatcattttgcagacattgtaagcatttttagctttactgatggaaagccagggctgaccttacctggtactgacctgcagtggtttgggagaggtgaacggggcaggaagggccctccctctttgttccccgcccaggtggggctatggacacaaaagccaaatgggaatgtattagaaattgtgtgagttgagatagaaggtagctgctcttggagaagctcaaaatgagtgtggcttaataaatgagaagctggcttctgtctcaggtaaaagtccaggatggtgcagccactctgcccttcactagtgctcaaggatcgagcgtgcttgatacttgatgctcttccattcctaggccatttcctttctctgtgttgtcagatgtgacccaccatgcccatcagcagtgtatctgctctggaaaggggttgggggtggggggtgtggaaagcagagaccgcctcttccttctacgggcaggaactgggggttgcatgcatccttcagctcacatcctattagccagaacttaaccatcctaaccataggaccacatctagctacaagggaggttaggaaatgtaatgtttattttgattagtaaaatgcccaactgagtccaggctttccattactacagaaaaaggagaaaaatggatattgggggcttaactaacagtttctgataaagggagaccaaagggcttgaaatcatggatattatgaaggaaaatgagttttctccttggagttgtctagttttacctctcaaccatgtaataaggaagcaggcccaactagctccttcctttcttcagaatcctgattgtctcagggtctgatggaaattcagattcagggagaacttaatgaggtgttgagtgcctaatgaagcttcagttattcatgacaatcacatgaa

SEQ ID NO: 32477 - DNA, 755 bp, Bovine  19866880614878
tcccaaggctgagctcccaggtcagaggcccagaccatgggctgggtcagctgagccagggtctgcctgggctttgctcccttccaggagctgccagcatgggcagtgatgtccacggtttgctgggcatgatagtcctgatgctgccacctgtggggagcttgttccagtcttatgtggactcccttggctgccagagatcaaagatgtttgcccaacatggcttctgctcagttccaatcaatatcctgttctctgatttcagctggtagcctggtggctctgggatcaaacacgaggagaaaccaagctcagaatccagctggtccagggtcattagtattcaccatccagcaaccaaaacagcaaggttggccaggaggtgataataacaagggtcaacatgcacggagtgctcactgtgtgtgtcccactctatttcctaaatcaccacctggcccgtcagctcccagacttcaggaagagtgtgttaatacacgatccccccactagtacctcagccccgccaaatctcaccactgggttacttctctgtctccccctctccttgtctctgtcccacaggggagggatagtctgacagtttcactttttcaaactgctctgaatttcaaagatgccgtcagattcccataacagggccatcatcaattctgacggctctaagctttttcttcctaaactgtcataatgcagcttaataatatgaagcttaaaccctttcagcttttaat

SEQ ID NO: 32478 - DNA, 1798 bp, Bovine  19866880638227
cattgccttctccaatgcatgaaagtaaaaagtgaaagtgaagtcgctcagtcgtgtccaactcttagcgaccccatggactgcagcctaccaggctcctctgtccatggattttctaggcaagagtactggagtggggtgccattgccttctcctatatatatatatatatacacttttcagattcttttccattataggttattacaatacactgactgtagttccctgtactgcacagcaggcccttgttgtctgctttgtatatagcagtgtgtctgttagttccatactgctaatgtatccctctccccctttcctctttggtttgttttctatgtctgtgagtctctttctgttttgtaaataagttctcttgtgatatgttttagattccacataagtgatattacatgatgtttgtctttctctgacttacttcatttagtataataatctctaggtccatccatgttgttacaaatgacaatattttgttattttttttttttacggctgagtaatattgccacatatatagtgtacatcttttttatccattcgtctgttgatggacatttaaggacctcgatttttaacttgacatatggccaagtgaattaaaaaaaaaaaaattccatatttcccagcctcttctgcagcttggtgtggccatgtgactgagttctggccaatgaaatgtaagcataagtgatgtgtagtgtttccaggaaggctgtttaagggccatgactcagctttaatttcttccaatgtgtctttcctttttccatccaaaaaaaaaaaaatacggactggtgttccagtagctatggaccgtgaagttacctgaggaatgaaagctaaagatggtggagcaaaaatactgaatcctggattgctgacgataccacagagctccaggcctctcttgaaatgggtgcttcctagattttttatgagaaagacaaaaataaacttcaatcttaaaaaaaaaatttatttatttgggtgccctgggtcttagttgcagcattcgaactcttggttgaggcatgtgggatctggttccctgatcagggatcaaacccatgccccctgcattgggagttggagtcttagcccctggactggcaggtaagtgcgctccactggatagttttgcatctggccagcagatgaggataggagaagagtttggaggatcacttaggaagttttagaggatgcttagaaatgagatatacttttattacttctgtcctgattccattagagctcagtcacaaggacctatctgattactaagaaatgtagttttgctttgagcctaggaggaaaatgaactgggctggggaaagcaaccatttcacaaatatataagcaagaacaatagagaagctcaccgtctagaggacttccctgatggtccagtggttaagaatctgcctgccaatgcagaggacatgggttcaatccctggtttgccaagatttcacatgctgcaggcaactaagcccacaggccccaactgctgaggcctaagagctgcaactactgaagctcttgcccctggagcctgtgccccgcaacaagagaagccaacacacctgagaaacccttgtgctgcaactagagagcagtctgcgtgcagcaacgaagacccagcgcagcctaaaataaataaacaaaattttttaaaaagaagctcacagtctaaaaacagacaagtgaacagaggcggaaagacaagagagaatgtggtcaggcaggatgcagctcatgttggtggagctgc

SEQ ID NO: 32479 - DNA, 1284 bp, Bovine  19866880650371
caggtccccagccctttttggcacccaggacaggttttatggaagacaatctttccatggatcagggaaggggtagggtttgggaatgattcaagcccatttgcatttattgttcacttttttcccattattattataccagctctacttcaggtcaccaggcgttagatcctagaggttggggacttctggcatagacaaccagctctctaccacattcattctccccttctaaatgatacagctatggctgggaagtagctattccactagagaatacattttctaccctcttttttagctatgagtggcctcaagaccttttttatttttttaatagactttattttttaaactggttttaggttcatagcaaaattgagcagcaggtacaaaacctccaggcaagttttcaccggtgaaaagtgagtgggagtgacaggcaggacctggctctgccctcaagccccgcacgtgcgcacctccaccctcttcccgccaggatgcttgttggctggagatgaccaggaagacctaagaagcctggtcagggactctgtccacctgggtccctgagcaactgagcagagaacagttcgtcctgtctacctgcctagagagcaaaaagtaaacttcactaactgtgaaatggtatcatggattggatcttggaacagaaaaagcattcatagaaaaacctggtgaaatccatataaaatctggtattttgttaatagtaacctactaatgttaatgtcttagttctgacaaatgtagcatgagaattcgagatgtaagcattaggggaacccgggtagagagacggtgagaactgtctataccatttttttgcaatttttctataaatctaaaatattccaaatttaaaattgtattaaaataattttaaaaccttcacatgtatggagccattctatgtttggatctttaagttagtgcagtctagcctaccctacccaaggcacacctcttcatctctactgttcctaatcacactgtaagactcggatttggcattttccccactacgaagatttctgcgatccccagggggtgaggtgcccctcctactgcacactttcttcttctgtcattctcaagagaagcaactaacagatctgcccagttctcaagcacgcaggaagccttctttgagttgggagtcctgtctccttcacagctataatattcctcatgctgctctgagatatttgtccaacgagttaatgtcaacctctcctatttgttggaacatttactacg

SEQ ID NO: 32480 - DNA, 3817 bp, Bovine  19866880659948
cccctttccccaaccccatgcctgttaacaattccagtctcatctccttctatgctccctcctatttcttcagctttgacttagacttcatgtcttccagaaagccactggccatccaacctctcaggctaggctcaatgcatgccacctccacgggttctgatagcacttcgttcagttcagtcgctcagtcatgtccgactctttgtgactctttgtgaggttgctcaaactcatgtccatcgagttggtgatgccatccaactatctcatcctctgccatccccttctcctcctgccttcaatctttccccacatcagggtcttttccagtgagtcagttcttcacatcaggtggccaaaggattgaagctgcagctttaccattagtcctttcagtgaatattcaggactgatttctttttggattgactggtttgatctccttgcagtccaagggactctcaagagtcttctccaacaccacagttcaaaagcatcaattctatggtgcttagctttctttatggtccaactctcacatccatacatgactactggaaaaaccatagctttgactagacagacctttgtcaattaataaatgtctctgctttttaatatgctgtctagggttgtcatagcttttcttccaaggagcaagcgtcttttaatttcatggctgcagtcaccatctgcagtgattttggagcccaagaaaataaagtctgtcactgtgttcattgtttccccatctattttccatgaagtgatgggactggatagtgctctgaggatgcttccattgtgccattttactaaatagtgaactggtcagtttatatgcccatctctaagaataagctctatgagctcagttggtaaagaatctgcctgcaatgcaggacaccccggtttgattcctgggtcaagatctgctggagaaggtataggctacccactccagtattcttgggcttcccttgtggctcagctggtaaagaatctgcctgcagtgtgggagacctgggttcgatccctgggttgggaagatcccctagcaaagggaaaggctacccactccagtattctggcctggggagttccatggcttgtatagtccatggggtcgcaaagagtcagacatgactgaacaactttcactttccccataaggcaaagactgtaccttgtctcctcagttcctggagaccagtacaatgcttggtccaggaaaagtgctttaacatcttacagttgaaattctgtgagactgagtcctcggtcctcatctctgtctatattcactgactttgaacagccacatatcatctctatgtcaatgattccccagattttctccaaagtccaggcttcttttccaaattccaatctcatacatccagctgcccactcttcatctccactaggatatctattggacagcttagttcaaaacggaactccccattccttccttatcctcactgttccacctgcagattcccatctccactggtggcaactccatccttccagtgtctcagataatagccctggagttaccctcgactcctctgtttctctcagttgccatgtataatgtgtctgttggctcttaaaatacatgcatagtgcaaccacttctcaccacccctgctgccacagtccaggtgagtcaccgagctcctgcagtggcctctcaactggtttccctacttttacacgttctttcctttgtttccattcttcaaatagtaactagaatcagtctttcaaaataatgtccggaaattatcacttgtcttctcaaagctctgcagtggctttctatcccattcagagtaaaagcctaaagtccttataatggcttataaggcactatttggtcaggctccttttatttttccaactacaccttctattactttttctccacacatactctgcttactccatgacctccatgtacatgccagatatattactcccttgatctggactcttactctggatatttttcacaaagtctctgcccacatctcataattaaagacggtcctttcagtctctttagggttggaacctctttcacttcatgttcctggaatataccctctcccttccttgtactctttcatttcccatggtacttacttgtggaagattgtataagccacagattatattttccaattgctcctgttctgtattaccttttagaatcttgcagctgcccctcccttcaacaagagatggagtctagggacttccctggtggctaagtgtccaagtggctaagattctgcactcccaatgcaggcagcctgggcttaatccctgatcagggaaccaagatcccacgtgctacaaactaagagctcatacgctgcaactaaaagaccccacatgccacaaagaaagcggaagaccccatgtgccgcaacaaagacctggtgcagccaaataaatagtaataacatacatttttaaaaaaagggatggagtctaattcgtcttccgtagaatgtaggcagttattgcttgcttataaccaatagaaggtggtaagaatgttctgtgtggtgtccaagtgtaggtcacaaggggtaacacatttgccagtttgttcgctagcaggctcaccaatggagccctgcaccaccacggaagaagttcaaggatcttgaggcaagcatgctgtgaagaagccaggctacctgaagaggctgagtgtaggtgttccagctggctatcccagctgagatcccggatgacagcctacatcagctggtagccatgtgagtgaagacacttccagaccacttcagccctaagccatagagccttccaagtcaaggcttcagacatcacggtgtagagacagactatccctgctgtatcctgtccaaattcctgattcactgaatcaacatgcatgataaattggttgttttacatcactaagatttggggtaatttgtaacacagtatgtttttactgtctaccataccatattatttactaacacattacaataagttattgtaaaataacaaccttattaagtctattgtttattttgaggttcctctgctagaacacaagtttcacaaggacaaggatcttcgtccgtttttgttctctggcatatcccagatatctagaacagtcctcgggaatagtaaatactcagtaaatatttaatgaacaaatttgtaagtgacagaaaaatttaactgaattttataagacacagcttgctacagctgagaggtctcttatatgtcaatttgtcaaatccactcatttgtatgaaaaaactgagcagagtaggggagtgacaggcaacaaagagagcacacggtgtgtggctccagagtaggcctggaggcccggggatcttctgtctgcaacaggaaatggtcttcaggtagatgtgtgatgctttgctcagtctgcagcttccagacatcacaggagccttgatgatcaaaacaacatccagctacagttagtggaaagacgctgtggaaagattcctattaagtaatgtcttccaattaacctccagttaatcaggaaatactgttaactagaagctaagcattcaagctaactaattaatataatttgaaatgattgagggcaagtctattctacttaatgctatttctggttgaagtccaaatgatggaacaacatgtattgttttctctttcactataaaagcagttaatttccatgctagaaagttggaaaatataaaaaagcacaaacacacacaccaagaaaaaaaaatcaacccaaatccca

SEQ ID NO: 32481 - DNA, 911 bp, Bovine  19866880681900
caggcattccctttgctccttagaatttaaaagggtttggggagaagtgatacgagggcctcattctttaaaaaggaagttgaatcaagatcttccccattgcagaacagtatttctggagcaggtggagtcagtaataacatcttgccccagaattgagttcagttgtttcaaaaccaggaactcgttcaaacaggcagtgcacacctggagcgcttaagggagaagtgtgaggcaggggaggtccctgcccactctcgcctgtgggattgtttcttagcctgcttattttgcaggagtacctttttattcatgtcttccctcaccaaggtaaccagcagtttgagctgtaggaaggcacaggggtgtcctcctgtccacagggaccttggcatcatccttggagggcagagacgccgaaacagaccccgaagtacaggtgctggccaatgaagggagggcgactgtctgcacttggaacatctggccgatgagtgtcctgtggatgaaacatctgggaggttgcctgagagacttagtttccatccagatgttctttagacacagaccattacatgaaatcattagttgctcttggcaacacgcccaggagttccaaaccttgcagattcctaaatagactttctgtaaagagctggaggggtgtgtccatgaagatgacttacagggcctcagagagaaggtgcgatggagggatgaccctgccaagagccctgtatctctatttatacatcccgagttacgcaagatgtcctgattgagaaaacaggagatgaggcctctctctcaggatccagcattctcacacccatcccagccccacccgaaacccagtcttggctgacccgaggctcacagagccgtgtctggtagcattgtccttagtggat

SEQ ID NO: 32482 - DNA, 916 bp, Bovine  19866880707388
ggcttaaatgtcctatgatagtgtatacagtcaaagcaagagaaataccccaggtggtgagactgtgacccactattacaaccagactggtgtggtctagagttttggcaaatattaagtgtttgtaaagacagctcactgagcatttgctatgaatgtagtgtgatcaggcaatgtgttaccacttggcactaagacatttaatcctcataacaaactacacaggagggctattcttaatctctttttatacaggtttagagagttaaagtaacttgtacaaggtcactgacccaggaagtgagaacatgtcacaataaacccaatgtctggcttgaaagtccttgtgcacaacggcttggccgccatctatccatccccaggaagactgacagctggaagcagtgtgtgcgtagactcatggtttgaatggtggtaatacacctactatgtgccagcattgtgcagttcacatagttcatttaatcactaacaaggctcgaggtagttagcaatagctgccttttgcagataaagaaactaacactcagaaagttcaggtcatttggtcatagcagcccactaatgtacagctggggttcatattcaggctgtttggcataaaacccctctctctttccagcctcgtgttagaggaaacagcagggaatctatgggagaggttttgttgtgagcctcaaatcacctgactgattgcatttggctttccagaagcacctggggggtgcaccaaggcagggtccaggcatcatccccatggcgtggatagaaggcttccctgagcaggaacaccctgcccacttgtgggagggctgagctggggttccgtttcctctttactgatgcggagtgaatttgaaggttattgcaatgaataataaatgagctatcatag

SEQ ID NO: 32483 - DNA, 1260 bp, Bovine  19866880734132
ctgtttgaaaagtcagcctctggaaccaaatatacctggaaaaagttgtttaacctctcagcacctgggttccttatctgtaaaaatggcgatagattgggaattctctggtgatccagtggttaggactctgtgcttccgctgctgggggcccagatttgatccctggtcagggaactaagaccccccagccatgtggttactttttaaaaaaggagataatcatagcacctaacttccaggttgtgctcatagaaaggatggcatgtatagaaactagaatcatgtccatccgactctaaagttttcattaaatgtagctactacagttgcactaaatccaaaaaaaaaaaatcttgacaaagaatcctttagcacaatcaacccaaaaaccacccacccatctctttagaactgtagatgtccactgtcatagctatagaaaacatgacatctatatccaaggagtggcaacatggcagaatttcacgttaacttaaaaataatcaaataagcaatccaccttcatatttccaataacattaaacctgattttatataataaggagatacagagttggggcaagtagggtggtttggtggcttacttgctaagttctgtctgactcttgtgactccatggactgtagcccaccgagctcctctgtgcatgagatttcccaggcaagaatactggagtgggtagccatttccttctccaagggatcttcccaacccagatatcaaacacgggtctccagcattgcagccggtctctttactgactgagccaccagggaaacccagggtggtttagtgacaagagttcatgggggaacctggttgttagacaagggggagccagtgttgggaaccagcatgaaaattcaggacgctgaagatgaacaggaaggtttagcccaggaagagctcagggcatttcttgccaagatgctctacctgctttgggccactttttgaggattacctacatgtgcgactgtacatcacaagtcccatatttaaggcatgccccaacctctccgtttcttcttctcatcaccaatggaaaacaaaacaacaacaaaaaaaacaatcacaaggtctttatcaaaacaaattgagaacagcaatgctttgaaattaaattttaatcaaacaccattaatgtttgagagagcagaggtgctccatctctgctctctcgagctgtgtgggcatcatcacagtaaaagcaccaacattcaggacaccaggcct

SEQ ID NO: 32484 - DNA, 4711 bp, Bovine  19866880758672
cttcatggaagacagtttttccatggaccagtaaggtgggatggtttggggatgatgtgaatgtcatgtgcattacacttactgtgcactttatttccgttactggtttatcaggtccacttcagatcatcagacattagatcctgggggttggggacccctgctccaagacctccagtcagtttttacagtagaaaaagaagaaagacacatagcttgacccaggaccatgggaaaaggaagatgatgatatcaacaaaagtgcttaaaaatggaccatatggtccaggcttgattaaaaatgcctatgcaggtagctgtgcacatgatgaaagtcctgaatgccagatgacctcagtactattgagaatctgtgccgagggtccaaagctgggagaggctgaaaagacaagaagtgatatttagatggacatatacacactactatatgtaaaataggtaactaataaggacctactgtgtagcatgggaaaactctactctataatggcctagatgggaaaagattctaaaaaagagtggatatatggatatatataacagattcatcactgactcaatggacatgagtttgcgcaagctccaggagatggtgaaggacagggaggcctggtgtgctgcagtccatggcgtctcaaagagtcgggtatgactgaacgacaacagtttcaccttgctgtacccctgaaactaacacaacatagtaaatcaactatactccaataaatttttttttttaaagaattgatatttagagaataagataatcgaagtttcaataatggaaccctgctgtgggatgaagtggctttgagtctgactgttggcagtcacattagatagatggtaatggattcaaggtgaagccgagtattttcaagaacaaagagatcaggctatggagggcacagctatctaagtagatacggttcttctgacgctaaacctcccacccaggggaactggtgaagacccttcctaagagcagaagtgactctgcatgctgccttctcctgggtctcacctgttctccagcctgttttctgctgaccttcacttctcactgtcctggtccctgtggcagctggcaccactgctttgtctcagatcttgcacagctgatgagtgatggctctcagtttctctacctgcagtcacccaaaggtcagactttcaagtcagcctccatcaggtgcatctctatagtcccatctcctgatgctcttctgagctagtgcatggacctgtgccatgttagaatccagggaggttttctctcatccacaaagctttctgctcagtactcgctcctgctgcctgcagctgctcagagttgcctcctattggcagcagtaagaggggtgatcctgaatgctctggctttttagtaggactggaactatttaaaggttagagtctccaccatgagatagaagaaatttgtacttacccctttcacagtgcagcccatcctttccttgcctggctgctggggttttctgtttagtgcatttccacttgggtgtagactcagtaagcaatttataaaggttataaatgtattaagtaaatattcttggccagagcaaggagtagcagtagcacaaggaggaatcaagggccagggttcaaacctacacagcccagcaccgtagccaaagctccatgaggctattgaaatttaaattagttcaaagtaaattaaaacttcagtttgttagttgcactatccacatttcaagtcctcagtagccagatgtggctagcagttatcatattgagcagcatttccactatcacagaaaattctctttgactgcattgctgtagactctgggagggctggtaaaaataggtcagggcccatatttggtttcagacaggctattatattaatgtaggcatttgagaccattggtaaaggccaggaatcctgtcataagaaatacaaaatataatgggggcttagaaggcagaaaatatgtctccccaaaagccggaggggacctttgactgggctaacttgctgctacgaccctgatctactaaactggacttcccaaattccactgcgtcactctggcctgggaataaagtctggggaatggtttaagcccagagttttcaaactttattgactagaagacttacctggagagctggtaaatatgaagatccttgcccatccctaatggtaatgaaattagacctgagaatcagtgttttgaacaagctcccctgtgatgatgattccgctggtcgtgaaccacaacttgagtaccatcggtttaacctctaccccactccagtactcttgcctggagaatcccatggacggaggagcctggaaggctgtagtccatggggtcgctaagagtcagacatgactgaacgacttcactttcacttttcacttacatgcattggagaagaaaatggcaacccactgcagtgtccttgcctggagaatcccagggacgggggagcctggtgggctgccgtctatggggtcacacggagtcggacacgactgaagcgacttagcagcagcagcagccctgggtgtggagaaaagagactgtacaggaaaccaaatactttcttcctgctaccagtatttgttcaatgtgacaatacagagaagcagttgttttgcattttactgtagagttgcccctgtgggttttaccgcttttggaactcttatgtcccttttggtgtatatttcagcatgaagataatcagttttcacttataagagctgaactaggatttctgccagcttacttctcaatccctgtccaccgggggctcaaaacacacccctgttttcttatgatgatgacaatgactggtgtctgaaatacatgttgtgttgttgcatgctgatagcatatctgaacgtatcacttctgtacagatattggggcttaggtagaaaatggttgttgggtaagactgagcatcagtatcagaacaaatctgtattctttctcagaaggctagagcagcctgggagaaacaaatccatttccaactttcactctataaaaagttccatattttctcagatcagacaaaatatattgagtgccaaaatgctgcagcaatacggacgcgtccctcagctgggttggaatctgtatgcattgtccccccgggccagttttgattatgttctttttccttttattgcagtcagcaaatctgaatttgctattgtggggagagcaagaagaagaggaaaaaaatgaaggtttttaaccttcagaaagttcagaggttcagtctgaataagcacaaaaacttttcagtgtgcttctgaattccttgaatttgcagaactgctcagaatcccaagagaactaccttgcacgtaggattcaggccccgctttgtagctaaaaggcagagctgcagttatgagaaaggagcagaattaaggaaagagggaagaggaatcagagaggggaaaaaaaaagagtttggtccccatccaggctaagtttcagcctattcagtttcttcaattcaaagccatctgcttcccacgactctcagataacgtctcccctgccaggacaccctgttcctgcttaattgaaattagtttccaagaatagttgtccaatgcagtttccagtggagggactgttttgaaagtcacaataggagtcgaagctttgggatgcagatgtccacacatgagccagatgtttgaaaggcatcacacggtctatagcagccttcacatttccaaagccaggagttctctcagtggcctctgccactcgcaaatggctcctttgaaactgccaccatctctccatcagggacctgtaatcccacaagtgtgaagggaaacaatcactttgattcaggtttagagctatgtgtttcccaggcttaattataccacaggtatataaattacagaaacatgttaatgctcccatgattaaaattatagagtgcctaattgaaaaagcataaactgaattgaagaattcctaattatagtttgctttgaggtgttaatttcctccataacgaatgtgtaatttcttggaacctaaacaggtagcctcttgcatcaacacgtaggctgcagacaggtgggataaggttgatttttcagttcagaaagttgacaaaggaggcttggttcaggcggagaggattgaaagggagcttgggaaggaggtaaaactagtgaaggccataaaccaaggtgcaccttgtggacattgggaccaaggactgatgaggagcccctacaaaaatttttccacctgcttttctctttccagagtctcaactttcatcccagttagttttagtaatttttgtgcctgtaagacagtgattcttaaaatttggtccagaccaatggtaatatctggaaatttattagaaatgaaaatcctaggccccgcccccaatctattgattcaggagctctgtggatggagcccagatggctgtgttttaacgagacctccagaagattctgattcatgctagagtctggggagcacaattcagaatgggtcccagatagccaaagtcacatccagctgagctttcttgggctccttctctggatcagaagctgtgattggtggcttcccaagcatcatttcattctataatcttaacatcacacggagtaggaaaaaaaaaaaatgct

SEQ ID NO: 32485 - DNA, 1106 bp, Bovine  19866880760017
taaaaaaaatgtttaagttatcctatgtctaatgactgcaagccaaccaaccaaccagtttggtgtggaagactgggaattgtgcaggtatgtcactttaagatccagccctcacttgccgctgatcctggaccactctcctttctgagttcagtttccttagatgtaacatgagaagaagaatccttatgtcacagggctttttagagggttgaatcccatatgaagcagctaagcacaccagaatcattcaataaatgttccttttcatccttcatccggaggcctcgtgagcctaatgagggtgcagaaaggatgcttacttaacaatctggagtgaagcagttctggggagcgaacgtgcatccttgatttcatcatgtgccagaggatggaaatgaacagcctggaggattgcgccccagccctcgcagctgcctctctactgaaggatttacgttctgcgtgattaggcctgaaatggacaggaagctttattgtgccaggctggcagggcgtggaggagcaaattgataaagacacctgggtcagtggcaagtggggtgtttcctaatttatagaaacacatcgagttctattactcagccccttcctttctgctctatctcaccacccctcctactagaccttctctgcccctccttgacaaatggtgacttatttacgggcagggagaggatttactgataaagatgaggcactggccaaacccacagcaagtaaattcccagagaagcaacatctggtcgtttgacttcatatagccaacctttgctggatgctttctgccaggtgctgggacatcagtcatgtgggaacacataggtcacatcttgtctcagcttcttgggcaggtaaactctgagtcttgttacctccttggaataaaatgaagataatgccggctcctgccccacagatagtaaacgctcagtggcaagtagcattaattatcaaaagttgtccatccacatttccagattccaaaccttggcatcttacattgctcagccatgaaaggaatgaaactgggtcatttgccagagatgtgaatggacccagagtctgtcatatagagtgaagta

SEQ ID NO: 32486 - DNA, 1592 bp, Bovine  19866880938430
cctactcatagtttctgttggtcagaaatctgagtgcagatttcatgggtacctctggctctaggtctttgatgaagctgtattccagctgcctggtgtgactatggttgcatctgaagactcatctgaggggaagaatctgatttcaagttcacccatgtggttgcaagcagattcactttctcatgggttactggagtaaggtcctcagttccatgcccagtggatctctctgtagggcagctcacaacctggcagctgatttcccacagagcaagtgagagagagaaagtgagcagactaggctagaaggaagccccagtctttttataacctaatcttgaaagtgacatgtccatactttgttacattctattcattagaagtcagtcagtaaaacagtctgtgttcaatggaagggataataccaggatatatgaaagcaggcaggaatcattgcagtcatttgagagactgccacatacaaaccccaacgtcactctacagtggttttgtgagagcccaaggaatcatgtcagtacaagagcatttacatgtgttacagcaaatatacacatgtaagtatacatattataacaatttatttcaaggggtccaatcaaaattctccagctacttttatttagctttcattaacagtcagttaatgaaagtcctttaattcataagtggttctaaactattctctctacacatttctccaacacctggatacttcaagggaaataaatgatttaatgttccttataacataaattgccactgacaacaatatttaatcattaaagagttaacagtgcactctgaattgcattacccagataaaacattcactccctaagtaaatgaattagccacataattgacagtcgattccagtaataaaacactaattaagtgattttgctaagtaaaaagttcaatgcaatgaatttgctaaacaatggtctaacaaattttcacgctaaataaatgacttgaaatggtgactaaatgctcaccatgtgtggggtcagttgaaaaagcaatggtgcttttagaaaacaatgacagaagtgactgtgaagctaacccccttaacgacattacactaggctccttgccaagcagggaccaagcgaatatgtctgactgaggtggaggtatgagactggggggtggggaggggaggaaaatcaccatggtcacagcatgagtgactaggttaaaagagaatttgcaaagtccagtatagtcagactggagtcatagcagaagtgagaatgggaaagtggaggaaggcttcaatgccagaccttatgggctaatgaaggtcagactcagcaccagagagacttggaaagcagtggcttcataggtacaaggatccttgtagtcctctggaagcaggttggattaactcatttaccatgatgtcttctgaaagatgtggattgaggtaagtctatggtttttgtgggccccattagcttggacttccaacttctctccaacaaagaacagtatagattgctcatcattaaaaccttgttctctggaccctttgttgacaaaggtccgtatagtcaaag

SEQ ID NO: 32487 - DNA, 1351 bp, Bovine  19866880957270
tgcacccatggagaaggaaatggcaacccactccaggattcttgcctgggaaatctcatggacagaggagtctggcaggctacagtccccaaggggtcgccaagagtcagacacaactgagcgactaagcacaaggatccttgaagtgcttactcctatcctgtttagactcctcttgggaatcaggagtgtctgagctcagagttaagagaacctcactctcctaggctccaccatccactgaccatgtggcccatcagcccttgggagcctcagtttcctcatttgtaacaaaggttaacagcatccatcctgcttctctcccaggtcgctgtgagagtccagagagataacccactcacctgctcaccaagtccttatcgagtacctgtgcagaggatagaacagggagcaaagcacgctgtgtccctgttcttgggggttccggtttgtagtagcagatatgcttataaattgcaaagttcgggaaaaggcccacaggataagctgacctgacttcatagaccctgtgggtgcccagagctccccagtccacctttggggaccccagccctgccagtaggtgcagcaacactcggtgatgtgaacccagtgatggggacagcaagctgagcctctcccccaccacccccgccagacccaaccggacattctgtttatgtgtcttttagcgtgtcggagctcacttgaattaactgtaaaggattagcctgattcttctgctgaagaacgtttttttttttttttttccttaattatttttatttggtgttatttgaagtaagcgtgccattgactaaagcctgcacatcttgtttatgcctagattgtgtttaaaatggtattctctgtaacacgatttttagttattgatgacctcttttataatgacttagtcagcttcacttgaatgatagtattgataacaatatgtggctgacaatctgtttgcagtaatactccaagaggcaaaaggaaagcatttgtacacacgtagaaaatagatacatttgctggttttaagaaagcatgaaaatggagcattttaatcctgatctcacttcccgagacacttgcagagtgtttttatgtggtctttcctgcattgtcctctacagaaggcatctctacctgcttttaatgacaaaatctctaagatttaaagaggcaggtgactttccctagtaagtaatgacaaaatcagaaccagaaggacaggtgggaaaaaagaggagcatatacaggccctttgtacggcagagtaatcttcctgagcctcaacttcctcatctgtaaatggggatgataactgagggtgatgccaggggtt

SEQ ID NO: 32488 - DNA, 839 bp, Bovine  19866880992634
ctgcctggactaggtgaacctgctgcctctgggaccatgtctgctgcaccagccttctgaggagtacagcttacctggcagatcccgtgatcatcatttaagtcacttagtctccaggttgctaccctgaagttcactgttagaggctggtgaccacaacactaaaaataacattgtcctagagaatatttatagttttttcattccctcaagtacagactgtgccttatctgggaaataccacttattttagggctcttgagttgggcatttaaatggtagggcttgttaggtggtagtcatatttcaaattagttctgcggacatttgcatgcttctgagttccctgtgacatacctggtgccagggtaacatgttaccacaggtctggtaggggaaatagacacaagcaatatttaaattgcagggaaacaaaataagtagaacaataaaaggaacattaaggcataggggaggttaggaaaaacttctcagaagagttaacatttgagttaggttttgatggatgagtagaagttagaagtgaagtgaagtcgctcagtcgtgaactgtagcccaccaggctcccccatccatgggattctccaggcaagaacactggagtaggttaccatttccttctcctggtaggtaaatagttgcagaataattaagtgaaaatggctagagagatggacagaggcctccttctgatgttattgccagtgtgtttatagattcttaatgatatagtagaaagagcttccagttgtaaaatctccccctttttccctagtgtcctaaatgccattcagatcctagcctcagcagtagggcaa

SEQ ID NO: 32489 - DNA, 1093 bp, Bovine  19866881004577
atccccaaagtatggttttgtgtttattccttctacatacctttctttccttttgtagctacaatacctgtctacatatttttaaattttaggtagcatcatcattaccgtgaaaacattgtgtcaaccattggctaaacactaagaatgtgaaaaaccttagttgtccaatttttaaatatatgctttggagaggctccatttaaaaaaatttttttactcggatgttcagagctacccaaacattactataaaatgccacttttcatagaggcagccaaggtctttttattatattatgcctttggaaaccaatgatttgtgcctaagacaattctctccatattattttaccctgaatagaatgaggttggttgggagttctgccctaaggaaatatcaaaacccccaatacatactcatttatagttcgaaagtgaactctcttatcagatttccttttatttcctgctggggcagtatgaacagaactcagatggaggcagagggtctgctgtatatcttttcaaatttatgattaagaaggtcacatatacatttttaaacacactcctttttgataataaatgaagaatgaaactgtgaaatgtcatcagaagccgaattactcgtttttcgttcattcgcatacccctgcctgctggctgattgcctgccaatggtgagaaaggcccaagtaaccgaatgctgcatttcttaaggttttgctgtctgtctggaatagcctcactggtggagcagcgtgcctgtggccagagcattttaaccgaaagatgcacttctattcctgagcccccttccttgccccaggccaattttaaaaaaatgaataattccattttagcctgcgtttgtcttcacattgtggccagaatgggagaagtgaaagctcttctcttcccaagtccagatcctctctagatgcttctcttttacgttctctgtctgtagagcaggctctaaatggatgccatgcctttggcatgagcccctctaacagatcatggtgggaggggaggatatagtcaggggatctgtgcctgtgggtcccttcctgcaaggtcatttagca

SEQ ID NO: 32490 - DNA, 674 bp, Bovine  19866881099043
gtaatttgaactctcttcctcttggggatgggtggaaaagctaaagtctcctcaaatcagtgtatggactcaacaaagaatcaaggtgccccctgcccccgccttgctctaaagcttgtatgagatcagcaggataatcaatttcacagttctgtaaggccgattggaacatgattatgaagttagccagagcattctacctgggccttaaaaggcctgttgcagagggacatctagtatatgaaacccaccagacacctgccaaagccaaggactcccttgcttcctaaggtttaatcgcttgctcacctgagttccactgtccaatcctgcccaaggcctggagggtcagtctgtgtggtcagcagtcctctaagaacttaagtccaacttcagcagaaaggtttggggtcgaattgcttactgcagtctgattaagggagagacttcaccttcaaggttgccctctgctgggttcctgcctcaggtacccctaccctttccaggcccctgctctaaatcactccagcctctcccccaggtgacagagctctgccctctaagatgactgactccctgcactgagaggcaacaaggcaccttctacaacaaggtaccgagcagcagactgtgatgatgtcgggggcagcctggtgatacctcggaacctgggc

SEQ ID NO: 32491 - DNA, 1346 bp, Bovine  19866881149063
ttaaatagtatgaagcaaagggaagctatgcctcaagtcattcttgtcagccagctgaagagattctgcagtatgtgctttataaagtttggggttttttcctaagcacagctgtcttcctgctcagaatctttggtctcaggcaatctgttacttgcaatatcactgtatccttgtaaatttagaccttcagtaaatcttcttcaagcctgagagaaaggacacatgtatactctgttttgatcacagagtaaagaagtataatccttgccctggaaggccctgcaattgaatttggaaaacaaattcaattaatagacgcttgccagcttctatcattctggggttgcctggaagcttggtcagggattgcagtggcttctggtgacatccaggataactcagccacttggaagaggtgaatcaaagggcgaggaagcatgttgtcatgaggaggtggccaggcagaggggaatcctgaaggttgagagcagaccgccagaggttgtgaatgttgagacccaagagtgcagcttggagctgctgatggtgaaaaaatcctggctcaggatggaggccttgcaactggtcccaaaatacacaaaatattagatctagtgaggggtaacctcatagcatgcaaataaacagagctgagatcagaactctggcctctccattctcagtcccatgttcttgacaatatagagaacagagatgtctgtgagtctttatcaaatgcagcctgaactctctgcccctgaggaatcatattcccaggctctggtccacagagcccccagtgaagaagaatgccaacctgtattatatgggcttcccaggtggcaccattggtaaagaagccgcctgccagttcaggagacacaagagacttgggttcaatccctaggttgggaagatcccctggaggaggaacccactagagcaacccactctagtattcttgcctagagaatcccacggacagaggatcctcgcaggctactgtccgtggggtcgcaaagaatcagaaacgacttaagtgccttagcacaacacatcacgtggttggtagaggcattggatggcttgcgtgggctgttctagatcccacccattgttggaagttcttcacccctttctcccatctggggccactgttcatttggccaaagatattcaacagttttatgagtgaccagatttgctggctgtggttgccccagttcagcctcccaaggaggcacagagctttccttctggacctatagaatttggctgtcctgataaatgagagaaagccttggggtgggcttaccttgggggctttggccagttcctactta

SEQ ID NO: 32492 - DNA, 2070 bp, Bovine  19866881278422
ccaaagatcccaagtgctaaagatcccgcataccccagtgaagacaaaagatcccaagtgctaaagatcctgcataccccagtgaagaccaaagatcccaagtgctaaagatcccgcataccccagtgaagaccaaagatcccaagtgctgtaactagtgcaaccaaatagatgaataaatattaaaaaataaaaagccaggacatcctgtccttctataagcctcctgttccactcagcccatgaccaaacaggagtctcccatccctcttcctacacgctctccttgtaaccctgagcccattcgtgtttgattttacttcctgaaatgttaagcctgccctctccttcccaggctgcttgtaacgtgactcagcttgatacagagtatgggttgtatcgtgcccctcacaaaggatgtgttgaagcaaggctcaccccagttcctgtgaaggtggtcttatttagaaagaaggtctctgcaggtataattagttaagatgaagtcgtgacggtggacccagatctataatatgacactgtaatatgactggtgtccttacaagaagaggaaaacatcaggtgaagacagagacacaagaagaacctctgtgatgacagaggcagatattgatacaatacatctccagcctaaggtgtgccagtggttgcccgcagatgccagcagccaaaagagatgaagaaggattctacccagggtctcagagggagcatggccctgttgacgtctggacttcagacttctagcctctaaatttctgttatttaagtcacccgggttgcagtactttattacagccctggaaatgaacaggcttggaagtgcagtgatcctgagcatggggcagcaggcaggggtccacctcgcagagctgtgcctttgcagcgaaagacctcaaggagactgaagctgagaactgccatcctggagaatccttttggcacaccctccccctgctgtggggtctccatgttggctggattctgcacttggctcacagcaggcctcttctctggggctctgaccctcccctctgtaatcggcctcctgcgtttgaacagtcttagcatctgctgccaggcacatcctggccttggcctgggacacaccaaccaggccgttcacgttgtcctgacctcatttgacccataggccatccctgataggtttttgtgctcgcctccggactgactgctcctgcgtaggcctcctgtgttccacagctgcccaggactgctctgaactctgcaagaagagttaaccatccgttcagtgcggccaattgttctcttgcactggctgtcggaggatgtctaaagggactatcactttgccgcagggcacccgaaagagtgtgtgttctcttttacatctgctcttcagactaaatccttaatccccagcgcaggccctgggtgctcctctctcccgcagctaagcagctttgagcccccagggctccaggctcagcacacaagttctgcaagcagggagccagcactgttagccctgagctggctcaatttcttcatcctcatcgatggagcaggcttcgtctggcacacagggagccagggtggggaggagaccactgggtggtcttagggacgtccacaatgtgtcccacacagcgatggcatagggaaatctgactcatagtctagcttggcctaagcagagtcatacatgctcttctctgtacagacttctgtgttagcatccatcacactgagctttgattttcagcttgcacgtgtgtctttgccattacgcggtgagttctcaaacagcagggtggtctcctaatcgcctcgcatgcccagcaccttgttttacccactattatcttgataatcccagcaaccactcacgccacaccagtcgacgtctaggactggccgcctagacagccaagggttgaatgggtgctaatgaggccaagggaaggggtctagtccatttggaagtcacttagctttttctagttccctgaccatgggcaaaattttcctcggccaaatccacacatagctcctaagcatacgttg

SEQ ID NO: 32493 - DNA, 1206 bp, Bovine  19866881325694
gttcgcaatgtgacatgaaacagcaggcgccgtgcttgccctgctgcggcttttggacccacaccaatatgtttgattgaaagactctttcagaagcttaatgtttttaacattaaagaattaaatcaataatgtccccatttcagcttctctgtgattatgtcctttgtgtcctgtttgctatttagtcacaagctttctaaaaatcacaatccatgtcatttgtcaaagaaaatcaagagaagagggaaagaggacaagaaaggaattaccctcggatgaatacctactatgcgccaggcactgttccagtggtattacatccattgacttaggtcagcctcctcgaaacccctaaagcaatatgtggctataatcctcatttgataaattagcaatcggaagctcagagaggaaaagagacttctccagtctctgcaaagagcagagcctggattggaactctctggtgtgttggattccaaacgcatcctcctccatggtgttctttgctaatttcctccactcggcgctcccatccagtaatagaaccacttgacgccaaggaagaccttcctctggcatgaggctcccctgtcttcaggcctagttcacagagctaatgtgaaagatcttcctgtctacctggctgggcccctcaggtgagtcgctgagtcactcggtcatgtccgactctatgcaaccccatggacagcagcccaccaggttcctctgtctacagggattctccaggcaagaatactggagtgggttgcagtgccctcccccagggcatcttcctgacccaggaaacaaactggggtctcctgcttgcaggcagattctttaccagctgatctaccagggaagcccccaggaggtgatgccagatctcctgaatagtccctgggatgggaaggggaagcccagattgcctgtctacagagggtcagggaattcacttgagaagcagaattttaaagttcagggtccttgatttgggatcaagagtgtggtgactacgacagggtttcaatcctagaaagaaacaagtgtgtcctaggactgagtggctagccaggcagttggaggcaacagtctaggcttctaggggaaactttgctcctctctagctgggagactttgaggaagctacttttctgagccagaatttcgtcagtgaaatgagaccagtgcttccttcca

SEQ ID NO: 32494 - DNA, 1586 bp, Bovine  19866881370967
taagtaaaggaaatattagggacaaaaatgaaaggagagccaagacttgagtagcaggcaaatgtcaacactggcattggggaatgacaatttactggggaattctctagtaaagaggacctagattctgagttttaatagccttggacagttagatgtagggtcccatgctcaataaagcttacatactagaaatgggttactcttgagtgaacaactgaatagagggggaaaagatatttgaagcatttaaaggagtaaaagatgggctaatggctcaagaaagcaccaagtgttgatgaggcatattataaaaagcatcaaataaaatttagatacgaaagtataaactcagcagacatgttatgaaggaaatgaaacatacatgaggagagaattaatgacatggaaaatagaaattaataaactccccaaaatgtactcaggaaaacaaaagggaaacatggaagaggagagataagacttgaaacacagctgagagagtctcacaaggtatcttctgtgagtggagtcttggggaggaggcattattcaaagagatttggcaaagggctttctagaactgacaaaagacagttctgcttcaagatgcccagttaatcctaaactggatggattaaacatttttcttttaagtgggtgggggagatttcttacataaaatttcagagcacccaaaaaaagtcttcaaagatgactggaaaaatacacagatcactttgtcatgccatgaccaatccaaaacagctttttaaccccagcaatggaaaacagttgaaaaatctgcaaagttcagaggggaggaggaaaaaaagtaaactgtaaattgaatacataattgaaaatgggatgagagaaaagtattctgataaataaaaaccaagaattggctgccagtgaaatctcactataggaaagtcgaaagattttggttcaagaaaaagaacattgatcttagaaaggcctaaatgcaagaaagaaaggtgagccaagacattggtaaacgatattgaagtcaatattgacaacataaaaaaacaataatgcttgaattgttatgtgcctgtgcaggaaacagagaactgaactgttggacaataataaaatataaaatgggagggaattgattgataaaaatcaccctgaccttttggatcatttggtaagtggagggcctgataatagttgacttaaataaaatatgtataataaactctagaagacacaggagacacaaaattaaattaaagagagtataaaagttgtttataaattgtaggacaaagtaaaaatgcaaaagaagatgaactatttccaggtttatcagtaaccataatatatgtctctgttatcattctaaattcaccaattaagagatacattgtcagattaagtaattaaaaaaaaaaggctacgtgtttgaaaatgacactgggtgatgcagtttttgaattttgcccaattcgttcatatgaatggacaaaaaaaaaactcaaatagcaaaacaaaacccatggataatatctacataatacctgggtgacaaactcccctcatgaattaca

SEQ ID NO: 32495 - DNA, 1062 bp, Bovine  19866881381758
gtttgactttttccccctgatcctcaccatcactggcctgcagggaggaaatgcagacctctgtctgccccaccttctgattcccagatggggctagcccaccttctccctacctgtttccccactcaggtgaccctaccttccctccgtgtgggtctctttggaaacttcagacatgatcagagagggcagccagctaggcaggatgatcacagagtaggcagcacgtgtgagaagatggataggcttccagtgtttgttgggtagaagaagaaggcatctgatgctcttgagacatcttgttgccacaccccaggcaccagttcacctggctacatgtaggcagggcaagcaaacacacagaatattcaccatgacccagagactggtcaggcaccttaggcacatatgtattaaggcatttaatcctcacaaaaacgccttgaggtagctgctgttatagtcacccccattttacaaatgaagaaactgaggcactaaaaggtagcttgcccaaggtgacataagagtaatggcagagccatggtatcaaccagagtcccttctcttaagcctcacgttcacctgtagatacaggcaagtgcacatccgaagccacgctcacagccttcatgtcccagcccccaacccctgagattccccagtagattgactgacgggcgtcacagtgtcatcacagctccctcttcagaaaggaaagtgagaccctcgagagggaccccccactgcaggccagggctgagaactgcactgtatcttttgattgctcagtcctgcaaaggaacactgagtgtgtggaacaagccagcccaaattcctccgcttgattttctggaatcaaattaggctggtgaataggccagtggcgttttcatcaatttctcagccttcctttggaactgagcctgatttccttggcctcctgcaacgctgcctgctgtttactgagcaaaccagctcccagaaccagcttcactttagcaatgcagcagggcaacgtggtagagggaagattacaggtattagaggccatttaggatc

SEQ ID NO: 32496 - DNA, 1237 bp, Bovine  19866881809042
atacaggttactggttgaagaacactcccaacagggcacgatgacgctgataatatgaatagctgcatcttccaagactaacccagttgctgtcttttaaaaaatatgtctagtcatcttcagcttggtagtgaatcttcagtggaaaaaacttgcctggcattcatgataaaagaagccttgtttctaaaagcagggttcagactgggagctgggggtgggggataccctccctgtctctttcccctcttcttgctttcccgcctacctctctcctttctctccctctctccatgcctctttccctctgtctctttctttctttgcctcttccatcttttcctcatcaatttcaagaccttgtagcagtggctttcacaaaacctgatggcttatgccttccaggaggggaagttcacaaattgcaacagagtggctttttttttttttttttttggtttttgttttgtttttcttttttttttaaagctgagcagcaggatcacagaacctgcaggtttgctgcctgctcagcaggataaagagagcagagcttaaaagatgaaagccaagccgaccagaagaaaggaaaacatgaagaatgctcttgaaagggggaggagactttgcttaagccactggggtaagaaggagacactgcccccaagcatatgctgtttcccttgtccagatggtgtcatttgccctgcgaaacaagtaccagacaatgagacttggatgctctctcagaaataaatgtgtgaggaagtcatttgggaaatgatgcccacggccattgtacttaaacagaagagatccaaccgtattggaaaacaactgccctgcaatgctagcctccagttcatttgaatactctgtttacattgttaccagtcaccagtcatatttgcacaaggagaacttccacctgcttgtagtttacctagggcacatactgtatttacatggtatagattagagtgggagaactagttacaccagtttggaactggaaaaagtgaaatgaaatgttcatcttggtttcctcagacccactgcctgtgccacaggggctgccatgtggtaatctgtatcgtcactgccaccatcctctgatcatctctgatagaatggctgactgtgtgctaggcactggtctaagagctcacaacattcaaaggaaggatgtactgttaccagccagggttcttagccttctccaatccatagaaattga

SEQ ID NO: 32497 - DNA, 1258 bp, Bovine  19866881817999
ctgcagataagtgttaacaggaaattattagcataacacctggtactgtgttgtggttgttcagtcactaagttgtgtccagctctttgagaccccatggactacagcatgctaagttcctctgtcctccagtgtctcccagagtttgttcaaattcatgtcctttgacccattgatgctatctaaccatctcatgctctgctggccccttctccttcttcttttgccctccatctttcccagcatcggggtcttttccagtgagtcagctcttcccatcaggtggccaagtgttggggcttcagcttcagcgtcagtccttccaatgaatattcagggttgagttcctttaggatggactggtttgatctctttgctattatggttgttgttttccaatccctgttcccctgggacatggtgaaagctcagttagatatagctaactgcaaccattctgtcaaagttcttctggtcttgttttataatcctagctcagtgtctagaacacagaaattgcttgataaataattgtgggaaattgaataaatgagtctttgaataaataaataaatatggaaaatcgaaaaagtgagtaaatggatagattagtgttcttcactggtctctttctgcagcacatgatggtctctatgataagctttgtttctgatatcagcatcttttgtccattggctgtttcaaagaattctcagtctctccatctgcaattgcttacagtattcatattcagtacagactttttcttgtttatttatttattttggactgttctgggtcttcattgctgtggcagcctttctctagtttcagcgagcaggggttatttattgtggagctcgggtgtcccagtgttgcaggcttctcttgcttgggcttcttctgttgcggagcatgggctctaggctcccaggcttcagtagttgcagcatatgggctcaatagctgcagttcccagactctagagcataggctcaatagttctgttgcacggctcagttgctctgtggcatgcgggatcctcctagacaaggggttgaacccgtgtctcctgtattggcaggcagattcttcaccactgagacaccagggaaaccccagagcttttgctgagtatgttttaaagtgatcttgtgttcctctgatagtctcagaaaatgacctatggacaatagcttacagcaatggcatacagttcacatggctttcttggctctgagtgtcctgtaatctgagg

SEQ ID NO: 32498 - DNA, 721 bp, Bovine  19866881857193
ttgctgcaaagaagccagtctagtctttgatgggccacattcagttgcgctaaatattaattaactcttttatctgctcagtaaagccagacccgttctaggcagccctgttaaatctattcctgctcctttatttgcttgcaagtagcattggcagtgtttccttctaaagagtttcctgtaattcagagctttacactaaatgatttacccatctcatctcctcattacatctcaggccctccttggtcttctcaacttcccctgtggtccctgggttggggtatccttctcttcaatcaatgaactcctctagctggtccctgcatcccacagattgaaggcgattaaatgagataatgcaaatggcatcactttaaaaccataaagggctgcacagatgtgaggggttattattatgagcctttcttattaatgagtattaatgagctaagcctgcagatccctaacgctacagagacctcatattaaccatatggaagcctgattttcaaagagaatgagaatgaactgggagaagaggcagaaaacaatttttttttttggatttccttccctagttctcagtatcttgaccacaatctgcatgaaactaagtggttgtgtgtttacataatggataattatgtctttgtctttgttcttagctaattgcttcaggacacctgcccccacgtgatttctgcatttttatggccct

SEQ ID NO: 32499 - DNA, 1530 bp, Bovine  19866880358285
tatatatggaatttagaaagatggtaacgataaccctgtatatgagacagcaaaagagaccctgatgtatagaacagtcttatggactctgtgggagagggagagggtgggaagatttgggagaatggcattgaaacatgtgaaatgtcatgtatgaaatgagatgccagtccaggttcagtgcacgatgctggatgcttggggctggtgcactgggacggcccagggggatggtatggggagcggggagggaggagggttcaggatggggagcacgtgtatacctgaaattaaaaaaaagaaaaaaaaaaaaaaaagaggagaaggggacgacagacgacgagatcgtcgttggatggcatcaccgactcaatggacatgggtttgagtggactctaggagttggtgatggacagggaggcctggagtactgcggttcatgggacacagttgcaacacaactgttggacacaattgagtgactgaactgaactgaacagccgaaaataaatccaaaaaaatatatatatatatacctatgtccagaggattgggaaagtgggtatatgttgggggtgggtaagagagtgttaaatcttcatctttgatagtatgcagttaaaagaaattcttgtaactagaagttcaagcaataggtttgttgtttagtaggtaagttgtatctgactcgcttatgaccccatgaactgtagcccgccagcctcctctgtccatggaattttctaggcaagaatactggaaggggttgccattttcttctccaggggatcttaccgacccagggatagaacccatgtctcctgcattgcaggcagattctttaccactgagctaaagcaacagaaataaagaccaaatgtcagaagaaacagccgaaaggaaaaagtggtcctctttagaggagaagactccaagatggggaccagtgaaatagagggcatggatttgcttagcactttttctaatagtaaaccttttcaacatgcatatgtgccacttcaataaaaattgaaggaagctgacagtttacattcctaactcaaatacatctcacctcatctctaaggagtccactcttcattcaaccatccctcaaccaatgggctcagttttgagtcatcgagcatttgtgtcacagcctgtaaaattcaggtaatgaaaatacactcttatgaaattgacagtaaagacctacagaagtgcaaaatgggtcttgactgatgattacaaataaagtgaagatggtttgcttgctttattcagcacacccttgtgaactaaaaacaccagtgtggaagcaaactcaatcaagctaattaaactgtgtttctccatttcaataatagaaaaaaaccattctatgcttccaagctaactaactaaattgtacatagaaggaaagccacaccaaacaacagaaaaggtcaatgcaatttaagaccaaagactgatgtgtgctttctggatccatcaataacttttctcagtactaaggatgctccattgtta

SEQ ID NO: 32500 - DNA, 3983 bp, Bovine  19866880682079
tcctttacatattcttgacaagtgtcacgaagtctcccgcagggtccccactggtgtaaaatgatcacagtgatgattgtgggtacctggtaggctagttgacggctctatcacatttaagagtttattgtatgataagtggttcagtgactgctggctactcagaaacctttggataagaaagtgtcacaaaggacagtgttttgaaaggtaaaaaccatgctcctttagattttccttcttcagaatgaatggcaaaggaactagatgaaattgagctctgtcccagtgaacataaattttactaagatgatagagatgaaaagtgttgctagaaagattaacattggtgtttttaagaatgatcagtatgatgtccatattttcagcctttaacctcttgggtcatttctataatggttacattcacatgaataggctaagatttgtgtgaatatgtatgagcctgtaaagtgtattttgatagtatctacgctgccaactgtgaaaaattcataatctgagttcatgcatgcttgttaagtcacttcagtcacttcagtcatgtctgactctttatgactctatggactgtagctcaccaggctcctctgtccatgggattctccaggcaagaatactagagtgggttaccatgccctcctccaggggatcttccccacccagggatcaaacccacatctcttatgtctcctgcattggtaggcagattctttaccactagcaccacctgggaagcccatcatttactgtttttccaaaactaataattaagcaattctaacaatccaatacatacattaaattgttaagatcctgatacaagaagctttctcacttcaggctttgacaaaaatttattatctgtttgacttacagaagtcaatatttaaaaccatctggttttataaaaatcctccttttctatttgattatcaagagagaaaactcaaagtctaatatagtcagaaaaggctttcacagttcttcaggagcaagcctgtttttctcacaaaggtctgatccaccaagctaagaagctgggcaggcacagcagtaccacgtcatcaaaaggaagtgggttacacaggacaagccgagcaggtaccgaagacacaagtaagttacatggagaagtggtccacgtgcccatggtgcccactcctgctcccccaccttctgccccactgccttcttctcacaggtgagaatccataaggaagtgagttttccaagggtcatgttgctgggtagggtcacccaattcccagtctgaaagttctccattctacctggactctaaagagcaaaacaatatttaataagctgaccttgaacccagataatatcagtgggcacattcacaagacgagcacaaggttttatccagctctgcaccggcagaattctgaattctctctgattttccattttaacactgggcagtactttgagtcgtgagtggctttaaattattcagttgcaaataatacatattaaaagtaagtttttatgcatcgctctttgtgttctgggcataaacacctgtcagtgacttggttgtatacaggctgttacgggatgagtgggtcatatgttaccgctccagtaccactgctgggcaccagacagtgatgggaggtggatgccattgagggaagctgagaagcaagtgtctgtggttaaatattgatatgttttgcatagtccttgtcaattaagtgctccttgatagccagctagagatctgtttacaacccagtctcctgagcactgattatattttagtcattccaatgttgaaatactcagtctcaagtgaagaaagaaagaagcatctggttatatttgctttctgtaacacatcagaataggtcccttagaaaaataaatagttgtaaacaaaagtagttgaaaagaagtagatacatatgaactctttaaacaaaaggatcaaaagtggtggtcatgatattaaggggttcagaactaaaatatgcaagcatacaactccacgttgacaaagcaaacaatccgattaaaaaatgagctgagaacctgaatcgatgtttttccaaagaagctttaaaaatggccaagaaacacatgaaaagacagtcagcatcgttagtcatcagggaaatataaataaaaaccatgagatatcacctcacacctgtcagaatgacaagtatcaaaaagataacaagtgttggtgagaatgtggagaaaagggaatcctagcacactgtacactgtgaactgattcagcaactgtggaaaacagtatggaggttcttttcttttttttttttaattttattttatttttaaactttacataattgtattagttttgccaaatatcaaaatgaatcggccacaggtatacatgtgtttcccatcatgaaccctccctccctcctccctccccatacatgtaaaatatcatgtaagaaacgagttgccagtccaggttcgatgcacgatactggatacttggggctagtgtactgggacgacgcagagggatggtatggggaggttatgtaaagtttaaaaataaaattaaattaaaaacaaaaaagatgtactaatagaaaatcaaaaaataaaaaaaataaaaattgaaaataaaactgtcatatgactccccttctgagtatttttccaaagaaaataaaaacaattagaaaagctacatgcacctgtatgttcgctgcagcattactcacgattgccaggttgtgggagcaacctcaatgcccactgatagatgaatggctagagaaatcatagtgcgtatctgtgtaaaatggaacgttattcagacacaaaaaggcatgaagtctcatcacttttgacagcatgaacggacatagagggtattatggtaagttaaataagtcaaattctgtgtaatcacttacatgtggctgctttcgttcagtagctcagtcgtattcaactctttctgacccacatggactgcggcatcccaggcctccctgtccatctccatcttccagagtttgttcagactcatgtccattgagttgatgatgccattcaaccatctcatcctccgccaccctctttccctcctgccctctatctttcccagcatcaaggtcttttccaatgagtcagctcttcacatcaggtgaccaaaggattgcagtgtcagcttcagcatcagtccttccagtgaatattcagtgttgatttcctttaggatggactgatttgatgtttttgctgtccaaaggattctcaagaatcttctccagcaccattgttcaaaagcatcaattctttggtgctcagccttctttatggtccaacttatatatgaaatctaaaccaaaacaaatgaaaaaataaacagaaacagactcaccgatattgagaacgaataggttgttgccagaggggaggggaatgggcagataagtgaaataactgtggctttcatttataaaataaatgagtcgtggggatgacgggtacaacatgggaaacacagtcactaatattgcaataattttgtatggtcacggatggtgtttagacatggtgctcactttgtaatgtatggacatatggactcactgtgctatacacctggagctagtataatgctgcaggtcaatgttacttcgctataagtagataagtaaataaataaataactgaatagtcgttcaggctactatgagaaatgtgccataaactgggtggcttatgaacagcagacacttttcagttctggcggctgggaagtccagggtcctggtagctttgatgtctggtgagacctttttcctcatttatagacagcactgtttagctatgtcctcacatgagaaggcaatggcaccccactccagtactcttgcctggaaaatcccatggatggaggagccggtaggctgcagtccaggggtcgctaagagtggaca

SEQ ID NO: 32501 - DNA, 3163 bp, Bovine  19866880821830
ccttcctgtctatggcccctctgtcttctcaggagcttgttccctcgcagcatgaaatacaagaaagtcgcttattgctcctgagcttgaatgtgaaaagtcagagtgttcaagtgtgcgtgtgtgtgtgaatgtataaatacacagattatacgtaaatgcgttatctctaagttgtaattaaaggcaccctgaggtgggagggaagagaagttagaatagcattttcgcctccagggcgacgcgctgcgttctgcatggatgctcttttgataaagctggtcctcccagagaccgcctgccagcatccaaggatgagcgccttccaaggacgccagcagcacgtgtgtctctccctcccccaaaagcttgcctgccgctggattactgcatccgtttgataccaaatccatgatgttccctatctctcctttcaccgcggacttcagaaatccccgcctctgtgagtgttctttacaaagagggcggtaatcgggatcactgctgggctctaacctgcttttcatattttccctctcacccaggggcggatctgtaggaaagctggcaagtcgaaaaagtccttcagtcgcaaggaagccgaggccacctttaagagtttggtgaagactcatgaaaagtacggctgggtcaccccgcccgtgtctgacggctgatgttcgcgccgtgcactagacgcttaagctgcctctccacacacacacacacctgacatctcctctccacgctgagcacccttcatcctttttataactccagccttcggaacggaatcctgaatgccaaggagacgcctaagttatttatgatcagatgtgtttacagagagaaggacggggagccaacgctgttcgggattaggtttcgatgataaatgaatgatcatctctaggtcactttagatcacacgtcgagatggtgacgttcccctgcccgcctgccctccccgcccccaccccatcattgggcctctagcttctcctcctgacagcagctccacagagcagccaggaagctcagctcccctcgctggacccattgacacgcccctaggaacgccgtgccccgtccagtccccgtacgctgtgcccctgtctccttctctccccagcaggtcaacatcgtaacttgaagacacatctttctgtggccccgtgtcatgacatgtagacctcgtttgtgctctatgaccgctggttcatgagaacaaaaaaaatttaatatggccaagttctcgggatggaaaacagcaaccgccctcttggctagaccgtgctcccaaggccgatgccgacgcatgtgcggtccgcagctcagcccacgcccgtgggtgaaggcggggtgctgtggccacaaccgggcagctgggtgcagacgccggggtggggggcgctcaggtcgggttgcggacggggtctcttccgacatcctcagacgctcctacgacgttcgtgttcctgtctcctctctgctggtcgacccaccgccgaaagcaaaagacagtgtgccatccgctgaagccacctgacccgtgtcctgtgtgcgcgtggcggggaatgccagaactgccttcggaggcctggtgacggtaggacaatttgcatggcccagtagtcactcgtgtgtccccgaggccgcgatgcgtgagcaccctcgctcggatataaactcctgttacttaatctccccacaatttcagttttctcttctgttaagttacttagacctttccaagaagttccatgaaatgaggaaaccactgtttcttataatatgcggaaaagaggtaaaatgttcattccaagtggaaaaatcttattggacacattttaaataaaatcacgcatacctgaatctggtcgttgtgggctcttcttccactgaaagtatttgttttcgggctttccaggtggcgctagtggtaaggaatccacctgccaatgcaggagacgccagaggcacaggttcgattcctgggttcatagttaagatactgcacgtgccaggaaggcattcctgccataagttgcaggaaaggagtctcaggaaccaatggtcttttcaaaaatccagtggattggaacggtccccagaagcagccagaaagacaataggacactggctggaaggactgatgggttatttggccgaacccggatgctgccagtcccagtttagcatcgtgaaggaagaggaagcgtctctgctcactatattagatccttcaggcagtttcgggtacttggcgtcccacacacctgtcccaggaggtcagagctctcagacaccaaaccttaacgccgagggccagctcccccagtagggtttggccttacccgaatccactctttattgctactttaattattttaaccatgttcttatggccccggatacacatgcagttctgtgcagctaagatgcttgacttcttgttcaagttccctctgagtaaatgtagtcatgaaattcgatgacaatgaacttaaggtatccgttcacctgatcctccacggcagaattctccgtcctggaaacgtgacatccagcctccggtccctgggcccctgggctccagtctataatggaatcacacgtgggagagtgagggcctaggacagaagcactggtcagggagagcacctcggtttctttctttccagaagtcctctcttccaattgtaaaataaaagtaactttctactaggaacgtaggtacatatttgacccaaacctgggtcacttgagtgctgctcattaactgatggaacagcttggccacgggttggttcaggggcggccaggtggtgggcaaggtgactgccaacggcaaaggggagggagaccattggcttggctccattccaacctgtacctcctaaacttcctgtgcgtggtgtttccattaggtttgttagaaacccggaagtgatagaagaaatacctctttgtttaaaaaaaaatgctagtcttcacttaaattgggaagacttttttattttaaaaagcagcagggaataatttaaaactcaactattgctttgactcttagaagcaagaattcccctttctgggggcttggagggaaacatgacagagttggccaaacagcagaggccgaggggggatggttccgtgatga

SEQ ID NO: 32502 - DNA, 831 bp, Bovine  19866881053208
ttctatggggctgagaaagtctagcttacatctggatttcatttgaaacatagagtaatttagcccaggagcccgtggactgcagggcccctgggagtggccctccacgtggcaatgaagggcagtccccaaaccctgacagccacctcatctcaggatggtactgagtggcttgggcctcattaactccctcctgaagtaggcatacgacaatgaaaatgctgcaatttagagcagcttcatacaaacatttatttagaacaaggagataatgagtgattattttcacttctagagcatcgcagatgttgttcatcaaagtgtgtcagtcagaaacaattctttcatatgtatgagctcatctttaagaattcccaggggattcatctgagcctaactgaaaaactgcttcaaaacccaattctaaaattgaaggaagccaccaagggggaaatgtacaggctgggatgagaacccctcactgagacacttcaattgaatcttgggttaataaacagggtctttctatttaagtaccttacaatcgatagaatgtttttctaattgattttttgccctgggtttgcttttttgtaaaatgtgaatcaagtaaaataacctccacatattaaaaactgaaaagcttggcataacttgcattgcaggtcagactcctagccagcatccggtcatcaatacacagagaagtagcagaaagactggtgttcaaatcctggctctaatatttggtaactgtgactgcgggtaaatcatctaagctgtcctgagggttggtttcctcctctgacacatgcggtattatgctgtaaa

SEQ ID NO: 32503 - DNA, 1051 bp, Bovine  19866881082677
ctggagtttggaatagggcatcgtcaactaaaaaatacagttgcaacctgaacgttaagagttattttatttggtgggaatatttaggactccaagcccaggagacagcatctcagcagctctgagaaaactgcttcaaggaggcaagaagagaagtcaggctatatccaagtttgcaagaaagggagcaagcagtctgaatatcaaagattagatatcgaattaaggaatttagcattctatgtatgggaagatgcaagcctctaggctcactgaattcattcctttcacattcacctcagctatctggggccaaacctgtttccttgttccacttcaggggtggcagataactgctcttgcattcccccaggccctcagcagtcacagtggggtggggtggcaccatcagctggatcacagtttggggagccctcgttcacatctggaggccagaaattgctgatggatgtgacatttcttgtttatggatgtggcaggggacattttattttcacagcatgaaactttttctcatcaggtctcaaacctggagctctctgtgatataactcaagagcccttcacgtcaaggctgaagggaagccgttcctttggcctgtacttcagaccttccaaaccttccagagaagctcttagaagctcagggagaatccattcagcctgagctcttctctaaggagactgtctgttttctcagtcgctggaaaatgaactagggaccaccagggagatggacccctgcaacttgcaaactcagagacaaaggcagctttgaaccctccctctttcactgttaggacttttttctgccctgaggcagctgggatttggctctgcacctggattagctagacgtggaacgttaccgtcagtgctcatgggagatttgttcttctctttaaaacctcattttcctctttggtttgaaaatagagtcgaacctcataaacctagcttcatttcaggattccatggagcctactcaattgtcagttgtcaagcctggtttgcatgctgcagagatggca

SEQ ID NO: 32504 - DNA, 1608 bp, Bovine  19866881211367
gaagggaccccagggagaagagggcagatgtgcagagcagtgtttacaatgtgtccgggacagtgtggtccacagctaggctgtctgtgttggggctcagctgaggactgcaaggtggcagcctgtcctcctccagcgagaactttgctatcttatcaggatcagtgaaccactcaggatgcagagctcggtgtcactaacaggtcactgcaacctaaatgtccatcgacagaagaatggacaagaagatgtggtacatgtgcacaatggaatactactcagtcgtgaacagtaatgaacgagtgccattcactgtgacgtggatggatctagagactcatcctgagtgaagtacgaaaaagacaaatgtcatataatatcacttatgtggggaatctagagagagcatacaaatacacttatttgcaaagcagaaatagggtcacagatgtagagaacagaagaatggataccaaggtgggggagtgggtagcaggatgaacttggatattgggactgacacatacacactgctgagtatgcaataggtgactaatgagaacctactcagtgctctctggtgacctaaatgggaagggaatctttgaaaaagaggggatatatgtgtatacataactgattcgctttgctgtactgcagaaactaactcaacattgtagatcagctatattcgaataaaaaatttttaaaaactcctaaaaatgtcactgcaaattgcttttccaggccgaatacaagcaacctttagcatctacaattttgaattatctgtgcctctcttcaccagcattagcagagataattgaaaattggcaacacttaaattcatgtaaaaaaaaaaacagctcagaaagcttgttaatgtcttaagaccacaagggtgccatttattccttcccagaggagtcctcaaggctcctgcaacccaaggaggatctctggtctcccagatgacccaagcgatgtcagtcatcttgtactggacgtctgctcatgacccaggccccttctgtggtaaggagatatcttccctgtataagggcctctgggactcattggcgtgaccagcagcatcaactcagtcctagaagctccagcggccaccagcgctggtggccaggggtgaaaggagccctcgccaaagtgtggcaaacctccctatgattccagtacagctcagcttggaagatggcggtagtggtaaagaacctgcctgccaacgcaggagacagaagagacgtcagttcaatccctgggtcaggaagatccccaggagtaggaaacggcactgtcctccagtattcttgcctggagaatcccacgaacagaggagcctggtgggctacagtccatggggctgcagagtttggcatgactgaagcaactttgcatgcatgcagcttggtagagagtcaggctggctcagcgtggattgaaagaaaagcgttttgactttcctgcctaataaagattcgtcatgtgttaagactcttaatcactgaagctaagaaccactattaattagagctgataaaagcataagaaatatttaatcctcttgttactgggagctggggattttcacag

SEQ ID NO: 32505 - DNA, 1237 bp, Bovine  19866881228368
attataatatgtaaatatatgtacactgtataattacatataatatttatcatgtactgtacattattggaaaaggaaatggcaacccactccagtgttcttgcctggagaatcccagggacgggggagcctggtgggctgccatctacgactgaagcgacttagcggtacattatatataatatatataaacataatttaaaagctttttaagtaggccccccaatacaacagactgttgagcaaaatgagaaaacttacaagagttaaaaaattaacactcccagaaatgaattgctgccttctgagaaaggtatgcgccattttagagaataatcaagcattctacttgcacgtcaaaaggagactaaatgagacattaaattaacagcaattaaaaaaaagatagttttctaacaaggttttgttcccctgagaaccataggagacgtcagcattccttaagatgacaaatcgtttttccgttaattagcatctctgcaaactgccccaaacagatggctataaagccagctgcatatagtattttttttgtaaaaacaaataaaggaaagaaaatcaacagcagcaagcctagagcttattaaattgtattgaattctatttccagttcaattgataatttattctctaaccccaacataaccacacaacacagcatcagaaaggaacatcatcagtaaatgggcttactggcatctaaggctcaatggtgaatcctcagttttgaaagcagtcatgtcaatgctcagtattttgcttcctgacttttttaccttgatcctccagaaataggcccaagacatatgcatgtggctggtggctcagagggtaaagaatctgcctgcagtgcaggcaacctcggtttgatccctggatcaggaagatcccctggagaagggaatggctacctactccagtattctcgcctggagaatccagcggacagaggagcctggtgggctagagtctgtggagtctcaaaagagtcagacataacttgatgactaaacaacaacaacaatgtattacacattatcaactgatattgatatttgttttattatattatatataaatatatttattttcagttgtatttcaatgcaaaactctcatgcacttactatttcaaaaatgcctgctgcgatatttgattattgctttgcttcagtcttaaatgatggattattcatctcatacctccttcaaagtg

SEQ ID NO: 32506 - DNA, 898 bp, Bovine  19866881270457
ctgcttgctaccagcagctaggagacactgagaaccttacttgctgtaaagttcaggtccaaaagttcagccaagggcacagcacagcccatgcaggaaacgcccgagacgcatctcccaggaaactcaccagcgctccaggtgcatggcctggagcttctcggggtccttcggggggaacatggtcggccggatctgggtgtgtctgttgtgggggacatcgtcccaggatgtgaaccactgcccatctttcgtcatcacctgcagggccagagggttgggactcaacgaccagcccatctgagagcagggaaagccagaagagggggtggggaagctctcaagagatggcacgtctcatttctccctaaagagaggaggacggtttgcaaggaaagaaatgacaccatcttttattccatgaaccaggacactcattctatgaggtggcattttcattttccaagcgggttattttttctctctttcttttataaaacaagactcagaccgttcctgggctaacactgagaagtgaattgcttcctactggaaacaaagcttggaatcccagccaattaaaagggaagaaagcaaagctatacttgtacataaacaaagctgactcgtgattacagaataaaggtaggagaacttccactgccagaaatacttgtataaacgtaccgtttgtcattaaacataattctgaaactgattctaagttgcataatcaaatgaaccatttattcaagttaccctagagtggatgctttaaaattctcacgactctaagacgcctagtaagttgacccgcccttttgagccagagtcctggcgggagactaccttccactgcgagagcccaggcacccactttcagtcctggcaactctga

SEQ ID NO: 32507 - DNA, 1113 bp, Bovine  19866881490253
taggctcacactgcctctctcttcaaaccagctgtgacagattcactacccacgtgcagcttcactttagactatgatttgctttctcgtggggacgctgggcttcccggcctcctgacggtacctgcaagggacatcacagaggatgcggtcgtagaagaggatctccttcctgccgttgacgtccacctgcaggcgcgggatgcaggacgcgtcgtggttgaccaccatgatgcaggggctgcccagccgcttggcctggtgcaccagcaggtagcaccgcctgttgtccacgtcgttggcgatgacaaagccctctgtgagcgcaaaggcggcgtcgggttaaaggcagcggacagggggccacgctcgcccccaggctggcaggtgggaccagcaacccagccttagacttgccggaactggggccgcgatccgggagaaggaagtgggcggcttggcaggggtttcaagtcccttaaaatgtcaaatcttcaaaattcatcttgccaacagttcctcactttggacggcttattctgcccaaactagcttttctaccattgactattaacaaaaaaagggagagtgaggagagaaagacgtggaaactaagagagtctcctgacaagtgtttaaaataggccacacgtgctggggctccactatagaccctgagagtcagctcccagagtgaggtggggactgaggctcctgagggtccacttgccgaggaggctcggacctttgccatcgacctaatgtcctccaagttcaagacggaagcctcgtttcctatgtggagcctggaaacgtcacataactcacctaccagacgctggtgggatttgaacctggggagtctgacagtggctctaaactacatcctcccgcctctcacacaggtactaaccatcagaagagaaccaaaaccccaatgtgagacggggactcccgaaaattcaaactgacatcaacctattggggccccccttgaggtctggtggttaagactctgcctcgccatgcagggaacgtgggtccaaaccctggtgggagacctgagatcccacacgctgggggtcaactcctgggccgagcaccaaggcgagg

SEQ ID NO: 32508 - DNA, 1048 bp, Bovine  19866881170492
atatatgttgatggagaggtgtcattcactggttttccagtgcttcagtatctccagggtgtttagtaaatatctttgtcacctacctagtgttaccttggcctgtgtatcattagccaaggagatgttcccatttctttaggcatctttctccagctcatttgtttggataaatgcctttcctgtatgctccctctgctacaacttccatagctttgtcacatgttgccatatttgcctatttattcacctgtcttccttggtaattactatgatttctttgttctttgtaccctattcaccattttatctctggcacatgagacaatatctggcctattgctgatatcaattatttgctggataaatgaaataagtctaattaagacaacaatatcccactggaaatattgtcaagtgaatgatagttgtctgtttcatgatttataaaattgtataaaagcttaatgtggaagataatttctagctaggaggaagtagaagacattaaagtcaactgtttgagagcaccatggtcaaactcagaaatattccagttttgtgtggtgtcagtcctgatctcagtagatatttcacattaaaactctctatttggcacacttatgcattaaaatgttgttttccactctggctttgtcattaaaatattgaatttcctttgtaacatttcaaaaaaaattaaaagattaaactcaagttgcatctagtgtaattatattacaaagactggtatgaagtaaatttcagagcactagcccaagagagtcatcagacaataaaatttgatggttatagttacaatcaatcaaaagtaataaaagtgatttcttactgaatagtaaaatttatgctttcatttatctttatggtgcacctaaaaatgaccatgaaataaactaatccattctactttatggaataaactaaatttatttcacacaccatcactagtgatcccactttaatagatttataaattgccaaataacattcttgactgtgtattcagaaataaatttaccaccta

SEQ ID NO: 32509 - DNA, 1806 bp, Bovine  19866881517064
aaaggaaaggaacacagttttctctacatgttttattaggaccccaaaaggaatattgaaagaaataacatcatttcttaaaaatgaaatgtgtgctcttgctacaaacagtcacttagataatgtgaatatttgcttatctttggctcaaaatgtttatttcacacatgtgtgtttacttctaaagtgaaaaaaaacaaaaaaaaacatatcgtagctattgttagcattgtaatattgaatgcaccagtgcctccctttgtagaatactgaattggctatcattagtgtcagatgttatatacattgcaataacactgtctatgtaattgtgataaattttccacttctgatttgtcagtttaacccataaaaataaatttatgacttcctgaaaatgactgatgcttttcatctattaagtaatgtctgctggtacagtgcaagttttttttgttgttttttgttgttgttgttttaatgagttcttgaattctgttgaagtctgcatgtcctaatcctttgtaaacagtaaacaggtgtgacaatttacagcaatccagtgagaagctctctaatcactccatcttaggattttaaaatgtgttttatggggaaaagctataaatctatttttatatacagtaacatttttgagcacattacttcggtttttagctagtgaaaaatcttgaaaatgaaaatctagaaagtgaaacttacccagattatttacctttaatctatagataattttgttatcatattttgtctttcatgctcaataatattacagtttcagatactgcctctaaatcccaatgtaagaatttgctaaagtattgttacaaacattgcttttaatagatacggtcatgcttgatcttttttagtatgctgattttatttcaattatcaaaaattccactttatgcacagtcttcattatgcccaggctaacagttctatgcacttcatgcttgccagattccagagcagttttagaaatgctctgtgattgattaaaaacaaatatttgcaaataataaattttgataccaaattatgcatccattcagtggaattcttcatcaagctaaagaggaactttaaaaagagtatgagacaataaattaaaatgcacattttaatgagctatcaactgggtaattttggaaagaaagtattttctatcacttctacatcaaatttgactccagcagtgtctgtctctgtccctgtttataaccaactctcatggctatagttgacatcctagatatactacagcttaggtcttttagggagcacttttcatagactttatcctgttttctaacagaatagaaatagcatgcattaaggcacatgagcccaccatttgttgctcagggactgaggtttcacttcaggtgcatgattgccaggaactgaagcttttttaaatctaccacatctacttggaaagcaacagctcctacatgagtgcaatcttaatattttcccccggaaaacaatgtctcttaattcattattttttaataggcgttatacttgtaaaatgaagaatttcttttgtgatggtgaggactacagaacaaacatcaccctttgccttctgaaatcatatgaccaggtcaataatgtgctataattatttattattttctgagctaaggacacaatacttgaataaattaaattattttaccaagagatgataatacagaggtgtgtgtgtgtgttttgggtgtgagcatgaactaaatgttataaatctaaattttaggtgagataaaacagtaa

SEQ ID NO: 32510 - DNA, 1699 bp, Bovine  19866880608107
gatctgtctctaagcctgcttaactacttctatttggatgtctaatatgcattttagacttaacatgtccaaaattgtattgcttggccctttttattatatcccacatctaatcttcaaatagatctagacattgacttatttattcctctgctgctctcacctttgttcaagccactacaatctctcatgtgcattattaaaataactagttttcctctgtcctcttttcaaaatctgttctcaatacaacagtcagaaagagctttatttttaaaacataagtcagatcatggtctttgctcagaaatgtcatatcatactcagagtaaaagccaaagttctttcaatagcctaaagcattatataatctgtccacccaaattctctatcctgttaaatacaggccttttctactttatacccttcttttgctcattgtcctctacccacactggcctccttgctgcttcccagatacactaagcacatttccacctctgggcctttatactttttgttctttttatcaagaatgttatcctcatgatagccacagtttcactattcatcagctcttcaaatgtcatttcagtatgggtcactctacataaaatttcaagtcttttcaacactctctaatactcttgttttatttcttcttagcaattatccttaactaatatactatgtgtttatatattttatttatattttccctgtaaaatgtaagctctggaagaagggaagtcttatttttgttatatccccagtatctagaactgtacttaagtcttagcgtggtacatatgtgctgagtcatgtctgattctttatgaccttcctcttcccaacccagggatcttcccaacccagggatcaaatccatgtctcctgcttctcctgcgttgcaggtggattctttaccactgaaccagatactcaataaatatttgccaaatgaatgctgaataaatgaagtattttaggaagtcgtatcaggagaatcttttttcttgcataaagccatctgtcaattttatcaacagataaatcaaagctgcttcagactgtgaaacaaataaaatgacctcaagatttgaaaaataaataatactaacaaagttatgattagctgctcaggcgacctcaaagaaacaatgagaagtatttatgtgaatccaaaatattttaatagtaaagaataaacagtatatctcagcaacgtgttcctagtgttcaatggacagttttataagtgcgaaaacttagccaaaatagttttcatcaattcaagaaaaggtaaaaccaaaacagtcatctaattatctgaacagaattacacatttttaagtaacaatgtggttatttcccatttaggctgatacattaaaatataaagaaacaaattattttacaaatcaaaagtcttaatttcagaatatgtttggctctttagaaaataagaattaaaaacttaactataaattttatgttataggctccttaatcacactgattttctgaaattaaacaaacagcttttctgcttcctttagtttttgtttcctattcatcttagcaattacagcccaacggtcctcctgcgttttcctcatagtttcagacttctgcatagatccaggagtcgttagagatgaaggagtctggatagaaaataaagtcataatatgtttaa

SEQ ID NO: 32511 - DNA, 1329 bp, Bovine  19866880709440
taatgaacgcatatcactcctacctaaaattgattgtccagaacttatcgtaaagccttaacaaagtgagagggaaagtataattttctcatgtgcctggcaagagataataactggatatacctgatcataaatctctatcatacttgagtaaacagctgaattatggttctaccatgaaatattactcagcaatttaaaagaatgaattggaactatatcatgttttggagatatttccatgagataatgaattgagtaaagcaaaactctgaaaagtacacattatctcatttttataaattagtggggaaccctgccatatacagaggaagaaagatggggggaaagaaagcagaaggataaaatgaggcactaagaatttgtatgattatgtttaggcactgagaaggccatggcaccccactctagtactcttgcctagaggatcccagggatgggggagcctggtgggctgccgtcacacagagtgtgacctggtgggtcacacagagtcggacatgactgaagtgacttagcagcagcagtaggttatacatatgaatatagaaactaagtcatttttatcttttccttataattttgactgtttttataggcctcaaaacactgatctgttgaaattaaatgaagttttcacttccccccagctctaaactctgatttcataacttaaataataaatcttatctatctctatttgtcatttcctatttctaacccacagttacctgctactgattaaagttcttgatgtactactacagcttgttgactattaattacactgaattcaggttgcctgaactatgaataatttatttttaacctttatatcaaccaaagcagcttcctcttttacatcattaatttacatttacttgaaatgagatattttattactgcttaagtaatcaagttaggatatttttcttaggaaaggtattagatctaatctaaaagtctataacttaaattttcagtctaagaaatattcctatctctcacctagactattttaatatcgtcaataacctcacttgtactgatttacattatctaatgatctttctaaaacaaaaatctttttcaagtaggagaataaatgatagacttggaaaccatatactttatattcattcgtaaaattttaaaatatattttaaggaataaagtcttaatttccttgcttaacctctattccatcttccataaaaaaaatgtccaagctttgcaacataatatacaacctcctatatgaagagaccatgggtctgggtatactaattactcttcatcattcatatt

SEQ ID NO: 32512 - DNA, 932 bp, Bovine  19866880806330
tgaaagcaatttgctgaagaaaggataagcatttggaaacagtgcttcccaagagatagaagaattaggagttgcaaaatcaggtagagatgtgacaggttaaacccaaaatcaagtatctgtaatcataaacaatattgtcttctgtaagcaaaggtggctaactacagcctccaagacaaagtcagcccacaatcttctttcgcaggcccttgaattaagaatctttcctcgaatcgccagtccggttcaatgcatgatacaggatgctcagggctggtgtactgggatgacccagagggatgatacggggagggaggtgggagggggcttcaggaaggggaacacgtgtacacccgtggcagattcatgtcaatgtatggcaaaatcaatacactattgtaaagtaattagcctccaattaaaataaattaattaaatttaaaaaattaaaaaaagaatgtttcctatgtttttataagattgttaaaaatgaagaaaaaaaggaggggaaggagaaaattaacattctctatacagccacaaagcctaaaatatttactgtctagtcctttacaaaaagtttaccaacccatgatctacacattataatcaattaaaccacaatgaagcccttatcctaagaaattcattaaataaatatgattctacctgaacactaaacataggtactgaatatatatcatatatatctttctcaaaattgcagctttgtgtctcaaaggtaacaaaggcataccaaatttacaatcagctacagaatatacacatttgatctcacttaaaggtactatcaacacactcttaaataatataaatactttcaccaagacagttatcaaaatgtactataaaaattgatagagatagaaatgtggttttgctaaaaccaaatatattttagaaaatat

SEQ ID NO: 32513 - DNA, 1162 bp, Bovine  19866881071914
cccctctcctcctgccctcaatcctttcccagcatcaaggtcttttcaaatgagtcagctctttgcatcaggtggcaaaagtactggagtttcagcttcaacatcagtccttccaatgaacacccaggactgatctcctttaggatggactggttggatctccttgcagtccaagggactctccagagtcttctccaacaccacagttcaaagccatcaattcttcagtgctcagctttctttatagtccaactctcacatccacacatgaccactgagtgactgaacaacaccaaatacaaatacaggcattatttttttctgaaacacgatcagtagctaaaaaacacatacaaatacataagcacttttaatgtatgaaatattattcaaatatttatatctaaaagcatgcatactcaaagcaatcctatatttatatgcttaatatttaaacaatagaatatgctaaatatttctgaaaaaagctaatggggaaaaattatatttttaatccatatgtaaacttatcctattattttctaatattatatctttataaaacttaggttacacctaaaatccaaaattactttatctatattgctacaaaacctactttttcttctcgttctgtttcaaggtgtttcttaacagaccaaagttcatttctgagattgcatagttcagtctcctaaagaaaaaggaacatgaaatttataagtgcatctatatagttcttaagataatgaaaatgcaaactaatattttaaaactttagttttacagaaaaatgaattcactcataaaagatatacgttttaaaagcttactgttatgaaggctgctagatgaacataaccaaagatttcatttagacaaattttaacactatatatatctctaaagaaatatttaacactatatgtatctcttcttctcatcctctcccaatctatcccactcctcctttccaaacctcaatcagagctcaaacttatttgtaattggaatttataacttttcacttgaaaaaaagagatcattctacaatttcaaaaaaaattagaaaaccatctccctataaaatctataatatctctttcagatctatgggtatttgattctatagatcaaaaattatgggttatatgaaaattgg

SEQ ID NO: 32514 - DNA, 1718 bp, Bovine  19866881600537
tgtggtaagatttcaggttttaagaactttaattttttctacgaaaggggttagcaaaaatgttaaaatattgtctaccagaatgagcattaaattgtgcttaacttcccaacatatgttaacatattttgtcattttaatttttcagtatctttccatgacaaaatttttaattggaacttttaaagatctgttttttaaagacattaagaaaaagtaagagttggacaaagctttgttcctctttaataatttgtaaaatgctataacagtaataggtttaagatgtttagccatcaacctagccttaagttcacaaactgctttattctgattacaactatttccactagataatcttttttatatctataagcaatatatatttttttttcattcgattttctgctaaatgaaaaaaagagtttcttcaggtaagaactgtatttagtactactcccttttgaagggaacatgcaggcacaataaccgttgcttccttgagcccgaatcttgaaaagaatcctagatgtccctctagtgggggtcttatgttccacaaaatttgatgagcccttgataatgtccattttatagcaatatattggtgacagcaattctgttcatgtttttcaaatcaatcatcctatgatgataaagtaaacaatctagatttaagaagtataagacaaaccacaacgttgtaaaatttcagcagcatgaatacaaattccatttctcagagagtagtcaatttggggtcctttgttttccaaatcctaagtatttttgagtggttgtggttcagtgttctcagtttagtaaacctccctatgagatgagcaaaatgctgtagatcttctggatgataaatttttgaatatttgtacaaaatttgtaaaactggttcctgtaaattttccacatgttgcttatttttaaggcatgggcaatctgaaaaacatcatcatatatatcgtaatgaatactggaaaatggtagaagataattaagacaatacagtttaaaataataaaaatagaaaatacacactgaacctttcatatatgccagattttatgctaggtaacctccttctatgcaatgtcttatttgagcttcataatactctatgaggggcttccctggtggctcagagggtaaagcatctgcctacaatgtgggagacccgggttggatccctgggtcaggaagatcccctagagaaggaaatggcagcccgctccagtactcttgtctggaaaatcccatggactgagaagcttggtaggctacagtccatggggttgcaaagagtcggacatgactgagcgtatttcttaatgattagacagcattcattcatctagtcattgtgctggagatacagcagtgaacatagaccaagtttcctgcccttattgagcttgtattttgggtctaggaggagtaggggagaatagagacatatacacattttaaaaataaaaatatatgacaaaaattaagagtaggggataagaatttagggtagaggcacaacagctatattttaaagggtaatcagatttaatatgacacttagcagagatccaggatggtgaaggagggagccatgaagccctttagaaaggagttttcaagcagaaaatttgtcaagtacagtagaacttgtggaaggagcctacttaaaattttcagggaacatatgcatcaaa

SEQ ID NO: 32515 - DNA, 2577 bp, Bovine  19866880389915
tgaaaagtgaaagtgaagtcgctcagtctgtccaactcttcgcgaccccatggactgcagcctaccaggctcctctgcccatcggattttccaggcaagagtactggagtggggtgccattgccttctcccattacatctcagctaggaagaaatgaaggggtgttgcaagagacacagaagtctgctttggcaaaatcacttttcctggaaatcaagagtagaaaagagcattttctccaatagataggacctgtcacatgtcagcacattcagccgcccagagagcagccctgtcagtcttcctaccactatcaccctgtggaaagggcatgtaaaacttggtcccatgacattataagtacttcctcccttcaaggccacataagccacactcacctgcccaagttgttttggggaagagtaaaatagacgagatgtgaaaatcagaaaaaataaggatctcaaagtctacttttatttaatggggctattaattattttttgattagactaaataaataaaaataaataaaattccctttattccacccaaaatgtgggcctcataaggtatcaattcagttcagtcgctcagtcgtgtctgactttttgtgaccccatgaatcacagcatgccaggcctccctgtccatcaccaactccaggagttcactcaaactcatgtccatttagtcggtgatgccatccagccatctcatcctctgtcatccccttgtcctcctgcccccaatccctcccagcatcagagtcttttccaatgagtcaacactttgcatgaggtggccaaagtactggagtttcagctttagcatcagtccttccaatgaacacacaggactgatctccatcagaatggattggttggatctccttgcagtccaagggactctcaagagtcttctccaacactacagttcaaaagcatcaattcttcagtgctcagctttcttcacagtccaactctcacatccatacatgactactggaaaaaccatagccttgactagatggacctttgggatattactcaataatcagaaaagaaatgcattttctgagcacataaatttctgtgctccctaaaagtgtgtggaggggaaactggcatctactagatcagatacagcttacaaaattgagcacattatgaaacagggcaattgaagtgaaagtagactgatgaaattaaaacaaacaaagagctatataactaaccttctgagatagttaataccaaaactggtcacaaaactttgcttcaagtttcaaagaattcttaatacctgggaaaatgtatgtaatttagacaattgattcatggttgactcctcctccatctattaatttgaagcttcattttgaaagctgtgatttcttaatctagatgtttaaaagaaatagaatatatagaccacgatttcatagtgtaaaatctactcctcaactttaaactagaaatctctggaagctgaattaacatttagaccactagggtacaatttaggaaattattgcttcaattgctcaaatgggaccccaatggaataaaaggttccactaagtctacgctttattaaattgcaccttggagttctgtactgttggatagtacacttcaggtaccacagtttggctctttgttgttgctctctgaagaactaaaggcaattacctattagcatgagcttagaagccaaacgttttttaaaccaaccttgagggagaaaaagaaggaggttaattctatttgaatgaacacaaacaccgctttccaaatgtggtccctattagataatatttaatgacactaagcataagagactaatttatacaagtttgttaacctttcatataagtaaaaatgactaaatggcagctttgggtggatgctgttttctgtttcaggtacctcaattggtgacatcaatatacttcctgaatctaagactcctcaacataacccttgaatctatacatggactctgagaacttctcactgagtattacatacttttactgtccaatatggcaggcattaaccacatacggttattcaaacttaaatttagttaaaattaagtaagatttaaaattccattcctcagtcactctagccacttcaagcattcaatagccacatgtggttaatggctaaattagtcggagagggctaaatggaaggtgacgagattagcattgtgattcagggccaaacagaaagcctgtcatgctatgacaacaggacttactttgcagaagctatggaattaataagggttttggcatatagtacatttatgccctgaaaaaaaaaaatgaaactaacttgttgtaagatggattagagaaaataaaaaggactaaatgcataggagatcatttaaggttgaaaatttataccacacaacaacttactgctgctgctgctgctgctaagtcacctcagccatgtctcactctgtgcgaccccatagacggcagtccaccaggctcccccgtccctgggattctccaggcaagaacactggagtgggttgccatttccttctccaatg

SEQ ID NO: 32516 - DNA, 949 bp, Bovine  19866880436738
ctttcagtatcctatcattttgccttttcatactgttcatggggttctcaaggcaagaatactgaagtggtttgccattcccttctccagtagaccacattctgtcaaatctctccaccatgacccacctgtcttgggttgccccacgagcatggcttagtttcattgagttagacaaggctgtggtcctagtgtgattagattaactagttttctgtgagtatggtttcagtgtgtctgccctctgatgccctatcacagcacctaccgtcttacttgggtttctcttaccttggacgtggggtattttttcacgtcttttaagttatctgcttagaaacaagaattctgtgtcttatcaaaataatttcctgtgggttatgttgtttttattatgttcgtttataagaacttaaggattgtttcatagtgatctatgattctatttattcaagtgttcaagccttttgacatttttgacaactttccaaagtcaaattctaaacgaaattgtgaactctaattgagattgatgtttcccacaggggccttgcaaaatctcagagggtttgttttttcacctagtaagaaagaaacattaaaaaataatttggtttatttgatgtcttaaattgtgacacattgtcaaataagaaatacttaactttctctagcttttatttgtgtgggtaaaaattattaatagatatttcagaagttgtgtgaagttcatagaaattttccagtacctttttatccatcatatgtcctgttataattttgtgagctataatttgagtttttttaattgaagtgtagttgatttaccaggctatgttaatttctgctgtacagcagagttattcagttagatatatatatatatatacacacacacacacacacatacacacatgtatatatatttcctgtttccccttcatgggat

SEQ ID NO: 32517 - DNA, 2405 bp, Bovine  19866880459004
tttgaacttcggccatgtgcccttccccgcccagaagaattctgttctcttcattagtagacttgcgctacagaaacattgctctcgattgttatgtcagtattttgaatcgcatcgctaaaagttgtgtacaaaactgttttttctcctcttctataagtactggtgtaatatctttaatttggccttctgtaccgcacagcctaaaatatttactgtctgacccaaaacactggcagatccctgtactgagttttgtcttcagtctgatttctggtttgcaaaatgggtgtggagcctatttcagaggactactgtgaagaccgaggaagagagcggatgttagacttctgccaggtgctaatgtcagtagatgttagattttccggagtgagaagtcaataatcaacttctcaagggcatgtgagggttggggaccaggatggagggtggagctcagaactcacctttgagaatcaaccccaccccaggaacagcataccccagtgttgctgtccagcccctgagtcatggaccttgggcctcacaaaggccgcatcctgccagctctgcaaatccccacaatgttaatgccgctgggatataattttcctcatgaaacgcaatgaagcataactaaaaaatgtaagtaacagcttcgggcccttaatgaggctataaatacagtatgaaaataatttatacagctatttcctggtgaagagctgtccttttcttagacctctttgcttttctctttgcttgcctcattaatactagccattggctttctttgctcactcattttaagaaggaaacaaggatttgtcactttgtagtggctgctgctctgcattgcacgagagaggcaaatgggaatgtagagtgaagcgcagatgctgggcagacagctcagcttgctcactgtccaggtgactcactccattccataaatcattcctgtgggaaacttacaccccaccttccttcagggtcagtgtaaatataatatggtgtatgtgtaaatatgaaagtgaaagtgttagttgctcagtcgtgtccgactctttgcgatccagtggactgtagcctcccaggctcctctgtccttgggattctccaggcaagactactggaatgggttgccattcccttcttcaggggatcttcccaacccaggggatcgaacccaggtgtcatgcaatgcaggcagattctttacagtctgagccacaagggaagcctcatgaaatctgtgtaaaaatgagatctatgaatgccaagggtgtcatccctgggccgaacccatgagtcattttatagcttctcccctatgtccctgggctgtatcttctttgaacaggtagatatgcagagattggggttcttagaatgagctctcagggcgggcaggttgctgtgcagagccttgacacagctggagacctggtccagcttctgcacgtggaggcagaggcccatcctcacaccaggcttggacgtccacgtgtgaatcctcccaccctgctgacagctaggatgctccccagacagctctagcgggaagcagttggtttgatgagaaccaaatggctctgggcagtgctcgaggcagatgtgtctggttccatccgacaccagtgccaccacgaggagtggtctggggtcgaaaggacctgcagggatttttcagggctgctgagaaactaatcatggtggacctgctcacttggtgctttacacgtgcccatgcatgagatgttcatgtgtatttgaaagagcaagtcaacgggaaagcagatggttgtcttcagtggccttgtaacatgatgtgtgttggcaccagggaatgggaagaggtgtgttcattctccagggaggttttaggggaaagccgagttgagatctgcaggtgggaacactaagtttgtgtgtgtctgtacatatacctgtatatgtcttgttttgttcttcacggagcctgcagacccgatggtcaggaagcaaaagctaaaaccgaaggtgattggacagatatctgaaagtagggcctgttgatagtttgcagatgccaagtctgtaagacatcacgataaggggtgaccttagagggggaagatcaacagagggagggaggagcatatggagggctccaaccggtgcaggcgaattctcgtttctcagctgaaaaagtcagcactgctcactgcctgttccagaaggcacagaatgcagcagctgtcttgagtttttgcagcaccccctcatcaaataaaaatttgtgggtgccagaaattttggaagaaacagcagcagcagcttcttcttttgcccagtgggggaggactttgggtgtgttttttttgttgttttcttggtgcagatggtgtagttattttaagtaa

SEQ ID NO: 32518 - DNA, 1212 bp, Bovine  19866880527051
cttataaatatgataggcagattaagtattattgttgtcgagattatcagacatcagattacttttttttttttgattgcttacttttaaatgtattacctttgacttgctggtcatcagttaaatataggaaggcagatggcagaaacagatactttataaacattgagcattcttattatgtagctgagaaagagattgaaatgctttcaaccaggcttgccatccaacatgaagattcctttttgagagttgccttaactcgacaaagcccatcagtcaagatggtggtatttatccatagttaagaaaaaactagttgttgtagaaacagtaagcctggattgagtaagctgtgggaaatagtaaaggacaaggaagcctggtgctgcagtccgtaggctgcaaagagtggacgtgagtcagtgactaaacagcagcagcaaaagtgtcttagagatcagatttcagtctaaaaagctttagagatctccagaaattccattcctcaccatcaatgaatacaatcctgttccctctcagagaatgaatatataaatgccccatcagtgactataaaatgggtaaaggacaaggtagctttctttataacttacttattatcagactgttcgtgtccataagggtttcaccattttataaatctgtcctatttagaggtaaagcagttcaggttttgtgttgactgttctgtgattttatgtgtaaaaatcatatccctgttaaaaaaacttagcttgcgaggataaggactttacatattttgtatcattccaatgttctatggataggtagacttacacgtgctgttcaatttaaaagttgagatacaggaaatccattccctttctgcaagtatgcgttgaatttactacacataaggtgctgtgttagactccaacaactatgcaagtttgtgcgtttttcttttaccctggagaaacaaatgacaggaatgtggaatgtggtggatactgagtctgaaagaactgttcccatggcagtgggctttttaggaaggaaaccattattgctgaaaatccaaccttctttgcaaatatatgagggatgtgaagaatttcagcaaaggaatggcagagttatcctccttggtgcacaatattgtcagtcggatcttaaatagctcagaaagcagaattgattttgatttcacatttgaagtgatgtttg

SEQ ID NO: 32519 - DNA, 1371 bp, Bovine  19866880536209
tcaacaagcacagcagggttctctctgtgcacggaactgtgaggtgctcaggactagcagtgacacatggacgtgagagcaaggccacagccacgtggcgaaacacaggcagggaggacagccatgatcgcctggaaccctaactaaaatccggcagtctcgaagtcctcaacaatttccccatcacaacatgctcctgtgactttgcgacctttgccaaattacttaaccactccattctgtgcctcactttgctcatctataaaatggggagagataatcactcttcctccttttgggttgtcatgaggattaaataatttaaaatataaagtggttagaatagcactgggtacctacctagtcggcgttacataagtccggctacatcacattacttctgttattactatgattaagaataagcacatatcatcaaagcacaggttcccccatgcatgcacacacacacagacacacacacacacatttttcccttcttttgcacaaaaactagtgactgagtcacattttccaaagagagaaactggatttggcaacagagcccttaatgcagccttctttattttctgtcttcagcactcctttataaataggtttgccaaattgaagcttaatagcttaatattgggttcatattaatctcaccctgtctgaacttcaaagggacaaattgttctgactgctaatgaaacggatttcagttgcaagtttctaagagaccagaggcagaaaaagtaccagctgatctaaaaagacagacatctctttggtgctcttttaaagccatatgggcttacagagttgccaccggaagccgggaagaaacccaacagccttagccagggcggggcgggggggggggtgggtacacaaggcccctcagacactagatggcactagaacatactcgaagcctggccgccttcagctgtccacacaccccaccctgctctgcagctaggttcactgaggcaagatgtgggacagacacttcaaattggcatcaactatctgaatgttagcagcagtcaaagaagtaatattgtgtttgcttttagctccctggacaaactatatccaggcactgttttctgggatttcaaaaggcaaatcatcacaaccgtgtgagtatacttcccactggactctatatttaaaaatggttaaggtggtaaattttatgttaggtacgcgtggcatggcgtgcatgactctttgcgaccccatggactgtagccgaccaggctcttctgtccatgggatgttaaggtatgttttaccaaaatttaaaaaaaaagaactagaaaaaaaaaaaagcaaatcatccccaataacaggaagagcatg

SEQ ID NO: 32520 - DNA, 1375 bp, Bovine  19866880575323
cagacgtttcccctgtaaatttaggatactatcatatattcgtcatccaagaaattaaaaagctgaaagcagagtctgccaggaagcctctactactacctccctgtgatcttatttagtcctgggctgtcttcaaagcaaaatttgactgacatgcaattcttcagtctaggacagcattgtaccaattgtgctctatggaaaattatatccttaagctgttaatagtattccatgaaaagaaatgaaattattgaatgtttctttcctgcagtccacccccaagttcttaacatacagatgcatgttgcaatattgtatgctatatttccaaagattgtttgagtgaggaacctttctccagcaacactagcaacatcttgtggcttactcttcctcagagaagagtttgagaaatgtcctaagttagacttcactgatgaaagtcatgcagaaacacccaaactctggtaatatgagtaccatacttagaagaggtggaacagacattgagtgatgtcaaatcagaactgccccagttaacgccagagagtgaacagagaattctctgtgcaccgtggccatccacactctggcttggcttaccatgaccgagttgctagggatagctgtccaagtggacagggtatccggctcctgtttactttctcctactgcagaattctccttatttcccacgtccagcagaaaacctccctacagttggtggtttggatgagaatatttatcttccccaaacagctctgcaacttcccctccctaaattgggaggtcgagatgactcagggtagggaagaacttacagtgagaaagaaaacactgttatttgtggttatttctacttctgacaagttgcgtgaccttgggaaaggaatcaaccattcatttaagcctgaatttcttcatctgtacaatggggataataatagcacccatgtcacagagtttgttgtctgaggagtgaggtactgcttgcaaagcacctaacacagtgacagcacatcgtgtgtctgcaattaatattcatgtcacttgtaactgttgctagtgcagattccacgtgtgtgtaagagacagagagagagagagagagaaagcaaaagaatgaagagagggaagtgggaggcatatgatgcaatgtttaaggtataatgggaattccatcttgcagaggaagatttagattaaaatggcaaatgaataaatttcctactaattatctctttcacttaaagagacaatttatcaatgtgatactaggcagagtcctggaaaccaaaattactggttgaagtgaagtgaagtgagagttgttcagtcaagtctaactctttgtgaccccatggattgtagt

SEQ ID NO: 32521 - DNA, 4361 bp, Bovine  19866880579986
gaccctggaggccactgtcagggagccgatctgatcatcggacccatctgagccctgtgatcaaagtctgggagatcatgagccattggaaacaaaacagtcttaggggaaaaggagttgtttaaaaaaaaaaaagaccaggactccctcctgaatctacaataggcatttattgaaacttcatgaccatattcatccactaggtaggttctaaagatgcagagatgaaagccaggctccatcctccaggctggaaaggcacaagggtatactaacaattttaatgccccacattaagaggaagtccagactcctgtggagtagtgggaggagaagagggcccatgaggctcttccacagctctcatgccggccccctgacagcacaccgtctttcatacctgatttctacctggaatgcccttcgacccatggggtctcccgggaaatcccaacacacctgttagcatacaacttctttgttactctacctcagaagtgttccctgacttcctcaaggagaaatgggcagtcaccctgttgtgtggctatggtactactggggtgatactaaaaacactttacaactggaacaagcgggcagcaaattggaaaagacacagccataggcaaggggtaccacatccacccaggtgccacggatagtcctcagagaccacctgctccgctgcactgacttaacaatgtacaggaacaccctaccgaaaacgagctttcgtaattcaccgaagaattctagaagagcagctatagggaggggcctcatcctgccttaagagcctgcactgggctcctaaaaaccttcctgtcccctcctcactcagccacccactacgagggccaggcaccaagtcgtgcacgccggcctccactgctacagccatgacgccagcccaaccaccacaccctctcaccaggacccctgtcacaagtgacccctgcctcccctccagcccatctctgtggccagagggacctttccaaagagcaaatcgatcgtgacacttcttgactttaaaaagccgttgaagggtttcctcaatgttcttaagataaagtcaaaattcaaggcattagagagaggtcacaggacagaggtggcatttgcagggtctgctggcagatgcagaaatggagcacaagggcccctcgcgcccacaggaagatggcagagaccagagcacacaggctcagtccagggcacagacggtacggaatgaaaaaccacacggctctgatggtctggaagtgagaatgtactgtgccccctctttcccccgttctacacccaaaccaggtatcacgaatcatggggttctgtccattgagcccaccttccatgtcagaacccttctcaagactgggcttgcgaaagccaccaccagccctgagatggtcgtgaaaccagctgcccgtctccggacagaggcacgagatgtcggagtggggctcctaggagacaagcctagaaggacagccaggtgctggatcccctccagagacttgatgcgcaaccctgaagacctacacatccagctgtttcctaataactgctctgggctcccccctccacacacaccccacaaacagggaactcttcagggcttagaacgtagctgccattctgttttgtttggaaatcacttacacttcctagtgcagagctagcttcttgaaggcaagccccttggaagagtcactgggactgtgaaatcttgttctgataaacagatttccagggccagaaaaattggccagattatatttcaaagtgctttccctgagaatccagagcctggaggcacggggacttgataaacgagacggtggaatacagactaaataccacgtaaggttagacacagggtggtcttgcagccatagggctcccagagctttactggcaggacgtcggaattcctgccccggtgtatgagaacgccaaggaaccattcttgggcacatttcagcaactccatcacgcgtgcaagggctgcagagccttgtgttttagaagtgacaatatcaacaaacacaaaaggaaaaggaaaagccgaggccgagagaggttgaatcatgctgactctgtcgtcaaaaatcttccgcaaaccacttatggttgccagaggggaggatgcgggaaagggatagttagggagtttgggatagataggtccacactgctgtatttaaaatgaaaaaccaacaaggaccttactgtatagcaaagggaactctggtcattgttgtgtggcagcctggatgggaggggagtttgggagagaatggacacatgtgtatgtatggctgagtccgtttgctgtccacctgaagctatcacaacattgttaagcagttatgttgttgtttagttgcaaagttgtgtccgactcttttgcggccccagggactgtacagcttgccaggctcctctgtctatgggatttcccatgcaagaaaactggaatgggttgccatttctttctccaggctaatcggctataccccattataaaataaaaagtttaccaaaaaaaatcttcctcaaacccatccagtgtgcctcactagactggcaccatccaatccaagccaccgagacccggggtctgctttacaccagtggctctcaacagggggcacttttgccccctggggacagatggcagtgtctggagacattgttggttgtggcttctattgaatagaggccaggagtgcacccccgtaatacacagggcagcccctcacaacagagaaccacatggcctgaaatggcagaagagagccgatgtgagaaatgctggcttaaaccaacctttcacttctcactccccccaccccaggtctttctcctcacagcagatgaagatgttaaacactgctgatggctcttctgtacccttgtaataaatctaaaactcttgccaggatttataaaacctggtgcccgccccacctccccaccccaacctctacaacctcattccatctcctccatcacaaatgtcctccctgcagtggtcctctgctcacgctgtccactgaccccgattcttccacacaccttgcatctggtattacgggttgaatctgtccccccagaattcacacgctgaggtcttaacccctgtatctcagtatgtgactgtgttgggaggcagggactttaaaagcgtgattaagttaaaatgctgcgaaagacgaaaggcaaaaggagaagggggcggcagaggatgaggtggttagataacaccactgactcagtggacatgcatttgagtaaactgtgggagacagtggatgaagggagcttggggcgctgcagtccatgcggtcacagagtcagacatgacttagcgagaacaacaacaacaaagttaaaatgaggccgtttgcgtgggccctaatcccatcggtctgctgtccttacaaaaagggatgaggacacagacgcacagggagggtcatgtgaaaactctggaagaagacagctgtctacaagccaaggagataggcctcaaaagaaaccaactctgcacactttgatctcagacttctggactccagagtcatgagtaaagaaatgcctggtgttgaagccgctcaccatgtttccttgtcacggcagccctggcaaacggctacatctggctaatctcatttgtcctccactttacatcactgactctgagactccttcaccgacaccccgtctaaagccggccccgccgtttccagctctgagagtgtcccgtgttctccttcatcccgatgtgtgctcaccaacgcatctgtactatcttcccaccagattgcacaaccccaaagggcactgctttgttttgctctgagtcctgggcatctgacatttagtaggttctcaacaaatatctgtggttattctcagaagaaaaccaaatgtctagttactgatttaaccccatccctcacactgtaccttggaaagttccatctaccccctgcctcgtccccctagaaggtgagcagaatctgtacatacataaaaataagggacatgggggtgtctggatgagtataagtaaattactactctgccagctttaaaagaggttagaaatcttttgagcccgacagtaggactttctagtggctgaaatatttatcccatctcagtgtcttgggacacatttagaatccaaaaaagacaagcattagcacgaagttggctagctgggggtttttccttctcctttttcttttttcattaagctgaaaaatgaaaaagagttgcccattttcactgcagcagcacatcacttacttaaaataactacaccatctgcaccaagaaaacaa

SEQ ID NO: 32522 - DNA, 2025 bp, Bovine  19866880580066
cttgtgtctcttacgtctcctaaattggcagccaggttttttaccactaacaacacctggaaagccctagaattggtcggtcatgagcaattaagactgctgctccaaagaagccacatcctggaaggtcctgtaatcctggtaaggattttgatgttcgctctaaaaacaataggtagctagagaaatgtttgggttagaagctttgggggagagtaatatactaaaatccacccaagggcattcaagtttcgaaaacaaacctttgaaaaacagatcatcctgatatatcctagactgataaaataaaggtgtggtgatgcaaacagcagcctaccttttctgtattattggtaagttgtggttgatggggtatttgttctgatagaaaagaaacataggtgttgtttcagaattagatgggggtcatgagtggattcctggaggaggaaatggcaatgcgttccagtagtcttgcctgtaaaatcccatggatagagtagcctggtgggctacagtacctggggtcacatagagtcaaatgtgactgagggactgagcacacacacaaatatgaatggatttatatcagtgctttccaacgtgttaaataccgcgccaaccttctttaaacacagcacgggtaaggatgcttatatttctacagcctactggggacatgaggaaggctgctcacagttggagacagctgagtggtgtctccaggtcccccaagcctcaagcagtgcagaggggctcaacatctggaaatgttgtagccatgcgttccgggaaacaaactcactcagaaggataatgcagatagtggagtacagtttattataccggcgagcccaaggcagagtttcctcttagcccaggaccccgaccagtttttgtgaaaaccttatagaccctaagtgtatgtgcaaaaatctacctccccaaattccctgaaaccagtctgaacaaaggaaaaagaaagatacaatcaaagttaacccatgattcatatgccttaagcctaggtagttaacagtggacaattttcaatagacttgtgatcatacctcaataagcataatagaatgtatgattctactcggttacacagataattagggtattgttttaggctatggagagccctggggctcttccttccgggggtctggttttccagtccgtatgtcgtttccatagatactgggcatattgttcaaagtccacagtctggcccaagatgaaggtaatagtcctgctttcaagatagagcctgttctgtttcctccttcagaaacacctgtgagtcacttgtcacacacagtgtgccctggcatgtgagtgggaagctctgggcttgaggacagaggctggatcttaaccctttgactgctgcttccttgtctgtttcactcctgtctcacgtcccttcatgctctcagcgcatctctccagggtctcatggatgccacgctgggtgcagctgttctaaacacaacaggctgctttcaattttttaatgtgtgaggtctgatgggttagctttgaagtggtccaggctggacccagcctctcatcagtatacagactgtagaagttatgtctctgctgcctccctgccacccctctggtctgagttctgttggtgggcatttccctgtttatgaaagaccgtggctcagtcatctttcaattaaacttaataatgaaaacaaaccctcagactcttcttagagggaaagggcggatgaatctggagaggcattagaggctgagggagacagttggtttgaataaggtcacagattaattagatttgggcttaattaacactgcatgagcatctggacagctttgccaacaaaggggatcatcgggatacgtttgactggtccctttctcctttgggcgctccttctctggttcaggctttggtccccactgttgtgagagactctggtgcctgaaagcttttccaagtcaattatacaggcttcactctggctgggtgaaggtctggtt

SEQ ID NO: 32523 - DNA, 850 bp, Bovine  19866880581359
cctgggaaatggaaggatggagaccccccaagaacagaaatgagggggtgcattgcaggaggagccgatgaggaactcagcaggagacatgccacctcctgaggttcagcctggcctttggtgacctctgatctctggggacaactggaagctcaacatcacctgtgacccaacatgaacttgtcaagaatacaggactcaagtggaaaaataagtcttcctcaatgcctctgctgccctgaggtcattattcttcaatttttaccgtggtggttttgcagataacatttttctacatgttctgcataaccggtcctaggcaaattaagtgcttgataagcatcatctcacaataacctccttagggtatttattgcccagattttacagttgagtaaaatgaaatcaagcagagaaatcttcctaagaccaggaggctggtgagtgcaggagttcacgggaggtcctgaggtcttcagcattgtcctgggagcaagtggtccaggcttctgtgaaggatgcttctgaaacttctctagctttacctgctgcgggggttgggtgtgagctgttttgtgtagaccctacctaaatcgaattaaaattgactaattaaatgtggcctctttcagtagactgccatatctccacttacagctctccttctctcctgagaaggcagccccaacattgttttgaaaagttgctcaattattaatggttgaataacactttgaagtgttattattattaaagtgtcatttaattgttaataagaaggccctgaggggggatgggagttggttttgcctgcctgcctccttctcctcctccttccctccctccctcc

SEQ ID NO: 32524 - DNA, 1189 bp, Bovine  19866880590251
tcagcataaactttttgagtaattcataaattatataaagtcagcataaacttatttttattatttttttctaattgaagaataattgcatacagctaatttatttattaaagttttttgtctatgtcccaagaactctaactgtgtcacatttgagaataaatggaaaaaacaaatttttttcataattaaaaaaagagtgtgtctgccactctaccttctcataatttaattatctatgtatacgtgaactcatttctgtagtactgccagctcctaaggagtaagagacacctgctcccagatggggaggaggtgccttggagctgcactcatctttcccgtctgcctgcactcatctttcccgtctgcctggccttggatcctgaccctagccagctgtggactctgtttcactgattcacttcggcatctggctgtattccttggctgacctcaatgtgaggggcttcctgctgccttcatgtccacgttgcatgtctccagtctgatagcctagcatctgcttgggtgtcatggaggtttgcagcttctcttccattcatttgaccctggaatttgacccattctgcgctttattacagatgctgcttatattgatgaatgttactttctggccacaccactgcctctagatgccatcgtatgtgtgggtgcgacttgaaagtgttatcctggtagaagaaggcagtgagaggataagctgtggggtgtttcagatgctgagggattagtacccagcccttctctctgggggacaccagtgtgcacagcaggcctctggaagaaggatggaaattctagcagctgtgttctctccacttttgttttcccacgtttcctgaagtcaatgttacctatagtttgtgaccgagagaaaaaaaaaaaaaaggccctaattcctttcaccaaagtcattatggattgattggcctgctgggaggagaggatttaaaaagtaattaagagatggtgggttaaagaaagttagcaaaaaccccaacaataatgaacaatggatgaactagtgtgctaacagtgtaatctctcggctttgtaggatagagaggtttaaagtcatgcactgattcctggtgggggtgggggaaatggatcctccagctgggctgggccagacagctggcaggaagaggaggacagtaggggg

SEQ ID NO: 32525 - DNA, 1215 bp, Bovine  19866880639015
ttcaggtgagagtgagtgagtgagaagggagatcattaggtagaaaggttctgggatgcctgtacttctggttgaacctttgggggatgaactgatcacatttgaatgctgtcttttaaaatttattaaaaaatttttcttttggctgtgctgtgtggcatgtgggatcttagttccccggccagcaatcaggacccatgtaccctggagtggaagcctggagtcttaaccactagacagccatgggagtccctaggaaatgctgtcttatcagagctacaggtgatattattgaacctgtgtctttcctcatcaacccgctcctggaaatggtgggtagctgaaacaaagatacaaagaagattagaggcaactgagacctagccaagccttggacctggaagatgaaaggttgagcctgtttgaaattgcatctcctggacctacttcagtgcctgggctttcagagagaattgtggcacacacactttacttttaaaaggtaaaacattgactcttctggagacaagaaaactctctttagctgtggactaatgctcgagttgaacgtagggaatcactgtctccatggctttttaacccccgggtagtgttttagagcaattacctgtacagctagttgctatagttacctattgtctatgcttccagaggagaaatctctagctcagatggttagcaggagagaaacaggtgctcagatctaacaaaaaagtgggacatgcagaaaaaacatctttatccatccagtggcaagttctggaacatctagcctgttcaccggccagtgatcatgtatctctacctcttttcccatgggaatcaccccagttcacaggggcaagcccccaagagtcatatgtgaaataggtgatgtgatcaccgtggttataactaattggaccgtcgcgaacacctgacctcaaatgggaccatcaggattctctcccctggaaactgggactgaagcttttctagctactctgtgtggataaatggcaggacctgtccaagggaggttttcagcctggagactattctctatcttgtggaaagaggggaaagagagaagatgcctgtttgcagaggaagcagagaggggagggagagtgtcttgagggtttttctgtttcaggttctttccttcttaaggcatgattgttttcctgccttggatgttttctgtggtttttt

SEQ ID NO: 32526 - DNA, 1014 bp, Bovine  19866880639029
gactgcagcccaccaggctcctctgtcctgggactctccaggcaagagtactggagtggggtgccattgccttctccattatttccatttcatagatgagaaaaccaaggcacagagagcttagttgctcaaagtcacacagcaaatggcagagctggaactcaaacccaggcagtctgctccctagtccttaggcttaacccctacaggatgaagcccaatgggaacaggcaggcacctcatttaaaggtgaaataccctcccaagaccagtggctaaaatgatctccaagttcctactcagagccatctgcagtcctggaaattaaacaggggtcagggagcttgaatgacttaactgctgttcaatttagatttcctggctgaaagggtttctgctcatcctactggaaattaatagccaattgtttctttgcattcttgtgggagggtgagccattctgcctgggccctggctgtttctggaacagtaagcactcagccagcatcagccaggtaaaggctgggaagtgaagaaaccaaatctcttgtcgaacctggtagcttactccactggtctaggagctggggcccctcctcctgactttgcaggaaacctgcccctgtcgtgggtcagttcagcgcccttctgtgcctctaacagagggagtcagaggaaggaaaggcagttatttgttaggagaaggggcaaaaggtcttcaaaggaagcatgagaagcagcaaccatagcatctataggagtgaccctgcactattaacaggggatcccgcttagcacagtaagtctacccccagccttgctggatggaagtgagcttggagacacggtgggagcgccctctgcctgggcacagggcagggactccgtgaatacacactgaatatcttgtaacatgagtataactgaacatccttgaaatactgggttttactttttcctggtccctggtcacctccttattctgtctgccagtggactagaggaatactataa

SEQ ID NO: 32527 - DNA, 965 bp, Bovine  19866880644628
tcaccgccaccagcagccattgagctagaatgagaaggaagtggggacttgagagtaatgggaagtgaatgtttatgtgggactcaacccaaaagggaaacagggcatgaagttcagtcagaagccaaaagggccataataaggagaatggggaaccactcactccctaatctgcgttatctcaccccccaccctccaggctgaccgggtgagacaccaccccagatgacaggatttcctgttattacacaggcctgccatctcaccccacaccatcttgtcaactcaacttcccacttctgtgggctcgatggtaaatgaggcacagaagctggattctagccagtggagaggcagagggatgaccgaatggcaggcagggcaggaagtggcagaaatgacgcagagaaaccacctttgatgtgagccacaatctcccctgagcacaagccccaaagtagcaaaattccaaaggatgatgaaacatcttagagagaggtgcctcggggctaaagtctagccagcgtgattggggaaaccatatcagttgggtagtacttctgtgtcacatgaccatcggcggctgccccaggccccttggcaggatctggccagacaccctcagggtccaggaacagagggaaccttacaggatcctgatcttaagctagtcagtgcctctcagatttgatcattaaattctcccaagatcacccacctcgcatctacaacagggtgtgtttcaaggcagcggcatcctttaagcaggaaaacatggaaacgacctttcctcacaggcccccattctataggggcccatcagagatcgtgtgcatgactcagataaaacgctaggactctcacagctttctatattctgaaccacatgggtggcaatggggacagtgaaaaagatggagaaagccaacagcgagcatttccagagctatacattatgtcattcg

SEQ ID NO: 32528 - DNA, 3840 bp, Bovine  19866880689298
cggaacagtcagaaaagattcagcaaagccaacaggagcagcaataagaaccaagcagaaaacagaacttaaggtgaggctcccggagtgacggtgaggggtagcccctctgccccagttcaggcccatggaggagagggtccccaactggccagccacgtacctgatgttttcattcagcgcataaagctcattgctctgcaagccgccccccttaaagacgttgatcacggcagtctggacgctgcggggaaatagaaagacccccggtgagtggacctgcctccccggtgccacctccacaagcagctcagagccgaaggtggggagaagggccaggaagcccggggcacagacaggcccactttttctctccctggaatccatcactggcacacgaaggtccttggagaggaggaagaccgaggccaagaggacaaaaagaggccatctccctgcgctttctcgcaggctggcagccctgctggggagcagcctcactgaagggcgggcggtgggatctgctctcgggaaactgtgtggccggcacctgcgggtctggaagagtcccgcgtggcattggctacaagcaggagttcaccccagcctgaggtcctctcccttaggaggcctctgtcttcacagcctggaaaggatcacgccttgccttatcttaatttttttttaattttgcaattatggattttaattgtcctcgccttttattttacttaaaaaaaattggagtataattgctttacaatggtatattagtttctgtgatacaacgaagtgaatcagctatatgtatacataatgtcctttccttcttggacctccctgccagctcccccctcaatcctacccatctaggtcatcaaagagcactgaagtgacctccccgtgctatacaccagcttcccaccagcgatctatttcacagctgctggtctgtgtatgtcactctctcccgattcatcccaccctccccttccccctctgtgtccacacaccccttctctatgtctgcatctctgttcctgccctgcaaatatgttcatctggaccattttttctagatttcatattcatgccacaatatacgatatttgtttttctccttctgacttacttcacagtgtatgacagactctaggtccatccttttaatagtactttctgggaagaactccagaagggctggcctcacttccccttcccctcccatgagtgtccaggcaggagagttgatcccttgaaggacacaggtaagtctctggacccagcccagcatttcagcaaggagctgatcacaggcttgttttcaccccaggtttcaggctttttaaaaatgaaccaggttctacttaacatcaaaacattttcagttctctcctccctcacaatcatgagttgtgcattcatttaaaaaaattgataatgatccaaatgacacacacacacaaaccctcagtaatgctttaaaataacaatgcatttgatttatccaaagaggaaccacacagatttgaaaaacagctccaggaaggtgagacatagtatggattcagtctctactcagtacctggtacacagattggctgggcaccttactaaggctcagaggctcctctcccagccaccaatagcttccaggtggggatcaaccctggtctacgctgcattgctagcttttcacagatacatgtctcatcttcccaaataggtagcaggtgacttggaggttacttagatgttcccaccctcgggtcctctgacaactggcatgggactaatgttaagttctgatccaactgtcccgggctggttaactgactttgagagcctagaagcccccagtggtccgctttccctctattcaaacaaggaaggacagggagagagaaaaagggacaaactaggagtatgggattaacaaactgggatatagcaaacagatacgcaaccaggatttactgcatagtacagggagctatgttcaatatcttataataacctattgcgaaatataatcagaaaaaataactgaatctaacacaatattgcaaataactgtatattaatacaaaaagaaaaaatacattaaaaaaaaaaaaaaacaagaaacgctgatgcatacagttgccatagggaaacgggcacactggtgccagtcacccctacccatgaccttctggagctgtgatctcgggagatgctgaagctcagccagcccctggccctggcaccccaacccctaccccaccaccaccttcccgcccacccagtgcctcccatacctgttccaagcggagttggaactcagctgcagagcctggcgggctgcctggaagcggggcaggtcgctgagcgccggggagctcatgaagcgtggtctgggcctgcggaaggagcccatcttggggaactcgacgggcaggctgggggcgaagccacgggtcataagtccaggtgagggggcggcttctcctctgaccagaaggttccgactgcccacccaaagggcttctcccagggctgtctttcggccctcaggcgttctcaaaaccacgatgttgaccaatacctgaaaagagaggccagcttttcttgaaaacacctgggctgagcagaccccatcatgggggaagctggttgggacttcctggccaaactaccctaaaaaaaaaaattccaggaccccagagtactatctataacttgcagggtcccattcacaagtgttcacaagcctccttttggttataaccttgtggtcatccccaggtggagaggcactcacagtgagttgaggccagtcctacagagaagtgattgctaagctatgtttgactgtggttcccatgcacacccatcaaagtttgggcccccactgagtctctgtagcttccaccaagttttccattgagatgacttaaaaaaaaaaaaaaaatagagcacacaagagctccttgtctaggcactgaagatggtccatgacacgcctgaccacagcagcccacatgcatcgctcagtatttcccaaagcatcagtgcctcttccctcaggctcatctcctcaccctcccttgcctgccattcattcatttattctatcagaacatatttattagctactatttactaaccaggcttccctggtggctcagtggtaaagaatccacctgctaatgcaggagacgtgggttggaactctgggtcaggaatatcccctggaggaggaaatggcaacccattccagtattcttgcctggagaatcccatggacagaggagtctggtgggctacagtccatggggtcgcaaaagggctggacacaactttgtaataaacaacatcgatttattaaccacgtgagctgtgtagcatccgaagatttctaagaccgagtccctgccctcaggaggctcacggtctatgggaagagaagtttcctgtatttgctcatgcaacaaacatttactaagcccctacagcactttgagcactcgggtattggggatgcatggtggccatggagaatgtggtccctgctccatggagctgttccatgtgaggctgcaggcttttgattgtatctactatttcccttagggcttccctggtagctcagctagtaaagaatccacctgcagtgcaggagaccccggtttgattcttgcgttgggaagatccactggagaagagataggctacccattccagtattcttgggcttcccttgtggttcagacggtaaagaatccacctgcaatgtgggagacctgggtctgatccctgggtgggaagatccccggaggagggcaggcaacccactcc

SEQ ID NO: 32529 - DNA, 965 bp, Bovine  19866880699295
tttgtagatgtccttgaaaggttttctgttgctgtttggaagaaaaattctcaataaacacaaaataaactagactggatgtggtgggtgttttctaatattacgtaatttatcatttcagataatgtgaccaaaagagaagcctttggaactaattcttcagaaaacaattttacttcaataaaatttactcagagaaatgaaccaaatgattgccgtcttagcaataaagccatctttcttcatacttcatcacaatgttcggaagaggagcaggtaataccatagcacctttatggaagcagagaaaaacattcatcatgaatttaaaacaagaaactgtaagaacataaaaaacactggacagttgctggatcagtaactcacactcctgattttagaaggagagcccctggattactttactgaaaatcgtcattacatttcatgatttcaacagccaacttttatgataatatcaggatctgccatctacagatttttcttgtaattatttctatattttagcttatcttctgttcgggataaaagagtttcctttttataattctatgtgtaaatggagtttcttttactgtcctggattcagtccttcagacttaaagcagaatgtgttatcttggtttttccacgagttggtcaataaataaatgttagatgctctctttctaatcttcaagatttcatagactatattcacattctttctagctatgtttttttaacaatcaaggaatcctagtggaaactgttctattttttttaagccatttgagtttctactttatatctcacacgtcttccctgtgatatggtggatagaatgtatatgagattgtggttttatgcaaaggaaaaacatctccacgttagaagtgtgtttatatacagtgaaggcctataattctttacttctataacttattccagagagacaattaagg

SEQ ID NO: 32530 - DNA, 4597 bp, Bovine  19866880725528
tgtcttctatggtttttgtcttgtttttcgataatgataggtgatggccaaaaagctggcagttcctttcaaggtgatctgaatcgagcagggaaggtgaaggtgaggcataattcaattttgttccatggccaaaaccccaaaaaagcacaagaacctcacaggactcatttgctttctcccatacaaatttggaaaattcagcagaatttgtccatatgattttttttttaaatggtgtttgattaaaaaaaaatgatgtttgattatcttcaactgtcttggttggctgggttctggatcttttttcctcaaagctttagaaatggaagtggtgcttcaatagagaaacatgactctcactcccctgaacttataccattaagagaaatgacaatataacagattctcaagttttagcactaaaccatcatttggaagataagtttttgctgtcacttggatgtcaaaaaatagctgcagttatgtacttacaagccatggaagctaccatttttaattcctgtgtaaaagccatggtctgataagtagagtggggaagaaagacctaggctgtgttttgaattccaatgatgaaatctaaatttataattttatggtattttgctatgcacatgttttagatcataagcataaaaggcatttcgacatcctgcctttgctaggtctgccagtggtgaaatcattgttttaatttacactctttgatattcacctgagatgaatcagttcatgtatgaagtgttaacattttgttaatctaaaatgtctcattgtcagcttgctgtggaaagcagtattccacgtggaatagtttttcattaaaatgctgctattgtgtctgtaaaggtcatttgctctgctttttacctttaaagtaatcttcagttttatttggtcgaaagagaacacttgattttttgccctgctcacctttcttgtggttacctggggcaggatgattctatctcgaatgaaccttctctcctgctttctttagtttcttctgtctctttggagtttaaagcacaccgttatgagaacagacagacccaccaccatcgctggccagagaaacacaagcaataaaacaaaaacaaaagacggagacactgctttggactgtcttgatggtggtatatattctgggatagaatcaggaacaaaacttttcaaaaactccgcagactgtattttttctttcagtctagagatcttattatggtgcctacaaaatccaggccaacttctaaatttactgctgctttcagatgtctctgggaaagcacagaactctagctgggactcaaaagttaatgagaaaattggattcagttgctcacttgagtgttgtagaaatggattcattgattcttaactctaggtcagatttgcataaaatgatattaatccttttctaggtagacaatttccttgatatagaagatttagacctggatgaagagattaatccccaactgagcaagggtatgttttctgtttccttcctacactgcttgacctctttctagaaactacacgtaagactttagacagcttttctctttttttttttctgggtgggtgggcgcagggtgcaattcttacctctcctttccccaagatacagaaaactggagtcctgcagtcttttttttgttaataaagatttcagctgaaaggtcaaacaaagcttgttgaaggttgtaaagtctttgatcttaaaagaaataaagattttcttcctcccatctcccatttaccatatgattgatttttggataattgtctcaagtagaaccatttaagtcaaactcttatttcttagaatttctgcatcatgctgtaaattgagattagttttgaatgctccataaaataccagttgatcgtaaacattatgagagttggtcataaaataaacacaaaagaaaataaaatccagatctttgcttttatgaatatttattaatatgtaagccaaacacttgaaactaaagctgtgttgtgaatgtttttttctgggctgttctacataggctgggctgagagagcctgctgtccgctgacatgtatgtagtccatgacttttatgaggcctttttcctctcctggttaacatttctgtgtaagcataggtaccctttgttgttccaaggagctttgaaatatgttcaaaatttgagttgttttgaaaactctcattcctaatttaatatgcaagaatatctcaacgttaatgttgaatgtttccatggggcagtttccacaggggagttggttgttggcgtttgttgtttacagtcattaggtggtcataaacagccattgtggtcattattgttggggaggagggcttccttgtaatcacacaggagttaaagtgcaggctctagctggtttgtggactgctgtctgtaaattgtctctataagcctctgctttggcttctctggttccccctgaatttgagaggctttggtaattggaagcaattaacatttttattctgcttccaaacataacactactccactgaagggattatttctcaagcagtctattaaccagtaaactgcagattttttcccccttgcttgcttggtttaagggagatgagggatctaagggaatcacagactcctgggagaggttctcttaacttctgtgctttaggcggctctgaatttctttataagagcaatttaggggttctgattggattagaaggtgttgctaagggtttatgagggagccaaatttgtagagcaagcacactgtttctgggttttgggtagtttgggggaaaggagcagattcctgggtcttgttcccaaaaaagagtttaattcagaaggtcttttgtgacacctagtgatctgtgttattaaccactcccccaggggattctgatacagttcttctgtgggtagcacttggagtaggtacttggagttggcgcttggaattggcatgtatatatttgcaacataaagttactttcacaggagggcacagcagtgcacaggtggagcgtttctgtgatggttccttttcttgccagtaattagaaagtctttataccgacataatcctgcatagccagtgaatttgattttggttgtatcagtattttaaattagtctttacttttcccactacttttatattgtttcctttaaacattttttaaattattttttattgctattaggtctgtttcttttgtttaaaggattgcgtaaaaacgtcttactagtatgatttttccagaaatttgagaacaagtagtttttcatttgtgtataaaagcttcctgaggctgaaccaagtctcagtggacttgaattagctagtcaagaccttctgaggtgtaaaataatgtgaaaagtcaaggctaaaaagcaaccaaggcttcagtgatctatcccaattactgaaaagaccaccaagcttcactgtttttataatgtacagtctgggtcatctgaaagaaaacacacacacacacacacacacacacacacacaagaaatttgccaaatgggttttatctttgggtctaatttgtattacacttcaggaatgtgagcagaaggtaaatatatcagatgggaaatgtgacattttaaataagcaagttgcttgtataattttggcagctgagaggcttactgattagattctgtcattattgtttaaacaacagatttgcctggggcaacaaggaagtgagttgcctattgtttttctaccatggactttatttgttcaccttcttcattttcataaatattctccaagattcaggcctttgatgccgccctgggatttagcttgttgtttcagcagcccaggtggacacactttttccaagaagccaacccagtgatgtgctattgaccagttgtcccaggaaaccttggtcacaaagtgtggtgccctgtgtttatttgacattaaattaacttttttttttcctcttttgagacaagataattaccctgattacttactgtcatgcatatccagaaagattattatttggaatcggtattaattattataggggcctccctggtggctgagtggtaaagaatccgcctgccaatgcaggaaactccggtttggtttgagttgagaagattccctggagaaggaaatggcaacccactccagtattcttgcctgggaaatcccatggacagaggagcctggcaggctaaatagtccatgggatcacagaagactcaacaattggtttgccctttagagtagaaagaatcttctgattgtctttatttccgcccctcagttggcccagcctgttctgtggatgagtgcagaaggtcaaagagaccgttttgaggtctggtattcagaattatactgtattatacacgtttcttgaccagtatatgtacttatgttgtgattgatttcactgaattaaaatgggcaactgatcctgcttgaagattggcagccttatttgattttcattttcaagctttccagtacttccagttttaatgaaggtatcagtttctctccctctccctcttttttttttttt

SEQ ID NO: 32531 - DNA, 1341 bp, Bovine  19866880728308
tcgtctaacacaaatcacttatttctacttgtttttcttcctttggataggcttcagagtggcagatctggtttcatctagccatgggagcttcccagaatggaacggctgccctgagaggcagtgagcatcttgtccctgaaagggtccaagcagaagccacttctggagtgggtgctggaaaggattcgggcatgaggcagagttgggtgagtgacttctgaggtcccttgacattctggagcattagttgatgagagggtcttcccttacctagtccagactcacagggctaaagtcatagcgaatggtacacatatcttacaaggaaaaaagaaaggagagagagaagatagaagaagaaaacggaagcagaggaggagaagaggaagaagaagagaagaggaagaggaaaaggaaggaggaggagaagaaagaaaaacaagaaaggaggagaaaaaggatattccatcagatcaaagcagtgcagcaatcactagagtttctggtcttgcatgcaaggatccaggcaccagcctggagttgagaagagggctttggagtgactgacgcaaaggagaaccgggtaagcagggtagggtggggaatgagaattgcatgttctcattcttatgactctgactcactgagatggacttttttttaggtcactgatccctcccttccctttataaaggcccctttcctccacctttagcaccaaagcactgacgtgctttccccacttgtcttttggaagtccatcttgtgatggaacgctaaggtgcttggctgataatagttgaacacattacccttggaaaaaaaacaaggggagacagaatcttcaaccccaggaacaagtctcccaagcaggaaatcttagactctgggcaagcaaaagagatattttcaggataaggacatttttttctagaacttctcaaaccatacctgctgtttttaaggggtcatcagagatgggtccctttctctctccatctgtgtttctttcttcatttatattcttcctctattcttccttaacagcttttcctaagcctgtattatatcccaggggacttcccagatggctcagtggtaaagaatccatctgtcaatgcaggagacgcaagttcaatccctgggtcgggaagattcccctggaggaggaaatggcaacccactccagtattcttgcctggagaatcccatggacagaggagcctggtgaattacatggggtcgcaaagactcagaagaggactgagcgactgagcatgcacgattgtatcccaggcattgcctaggtttggtattcgaagataaatcacacggcat

SEQ ID NO: 32532 - DNA, 1645 bp, Bovine  19866880731183
catgagattctctaggcaagagtactggaatgggttgcccatgtccttctcccagaggatcttcctgactcagggactgaactcaagtctcctgtagttcctgcatggaaggcagattctttgtcactgagccaccagggaagccctttttgcatttggttaacttctctgacactagctgtcaatcactgcatgcaaatattgtttgcaaatctcagagaattacatggcagcttttcagagataagtgaactctgttaatgaagaaaataaaatgaagcccttcctatgttggtatcaatctcagcttcacttgtgaagaaaacttgaaaaattaatacagatccaaagcccaacaaaagaaaaagatctttaaagaaagcttgcgtatgacctccttacacctgggaattagactggtgttgaaatagcaggcaggcttaggaaagccaaaatttatgaatgccacagaaataaatactttgcatgctgttctcacctgttaaggggggaatgttgtaatatctacttgacaacattgtttctgacattgagtgaaatcacattgtatgtaaaaatcacctcagcgtacatgactcaaacttgtacctctataacacaatagattatgcatattatttgtttgattgtgagcagagtgattgaaacaatgattgttaatttcataaatgccaggaatttgatatatgtattgtacattgcatcatgatcttttgtgaagcaagtgattcttctgtaattttaataggccattcctgactttaaaattttttttatggcttagataggttactgcatttcacttttcttaaaaaaaaaatgacccctgacttcattttgcctttgctgagtgcagtgagtatggatatgctatactctgtagagttggaagagccatacatgtttctagagacactctgctattaccaggcttatttcactgagagagaaaactcagtttagcaaatcattgtttgttttgcaatagatgcagaaaatggtagtgaataatgaactgtcagattggtgctggtctcatatgtcttaccagttagctcttaagcattaataagcagagtgcaaaaataattattttgaggtacagcatatggttgctttagaataatatggtcatttccattccatttcaggcaaatcaaacctttgagctaaaactgcattcttattttctgaatagccatatgtaatgacaagagttacttaattaaaattctgcaacatgacaatgggagaaatgatgaattatccatttctaatctgttcccctgccaccgtttcatcaaatatctagatgggtaattagtaatcacaaattcccctgggggtgtatttgttgagcacctatcggtgcttgggactgtgaaggatacagaagctttcaacaaagtctttacctcatggaatgtaattgataggaaatgacattctcacaagagcagttaaggaatgatagaagagtttaaaattaagtgtcaaaaaattagtagaaacatttttaagtgttcgaaggaagtggaaatttctgtgggtttaggaaatcgaagaaaactggactgtgaagagaggttaagagtgtcaaggataggacacaggataaattcag

SEQ ID NO: 32533 - DNA, 1432 bp, Bovine  19866880797026
catcagatccacgcccccccatgtcatgtccacctcccctgccttggttccagctctcatctcccacatcaacccactttaacagcctcaaatcaaaagatcctactgattctttccaaccaacctcaaacctctcctcctctgtgaatattccccacctctccagggtggggagactcagtaactctgatttgcttcacccagtagctcttagtacacaccactcttacaatactgattatactctactgcaatgccatcaaataaaaatacacatgccacaagcataattttaaatgccccaatagcctcattaaaaaggcaaaaagaaattggtaatttttaacaatatattttacttaaccagatacatgcaaaatattatcatgtaacatgtaatcaatacaaaaaacaagatattctataatttttcatattagttctttgaaatccaatgtatgttttccctttacagcatgttttagacactgaggtgttatcaaaaatagttgatctgtatttagttgtcataaaagttacaactgaaaaaagtagattcacacacccaagttgttccaaatgaacttgagagttttataataactgcatcaaatatcaactttatattttaagttaaaattaacatccaaaatcagttcctcagtcacactagtggctaatggctatgaggttggatcatgtagctctatggtaattatttgcatatacatttgtccttcccactaaatcagactatatctaatttacctatatcctcctcaagcataggcttgccacatatatggtgtttcgtgaaagtctgttgactagacaaagaaaaacggacacggaaatcacctgactatagcaacaataaatcaaggaaattcttttgtaaggaatatgaatggcagttttatgaatatacacacacatacaagcacaggcttgtattaaaaataattatgactaagtacatttgaaattggtgcagccactatggagaacagtatgaaggttcctcaaaaaactaaaaataaagttgccatatgatccagaaattcaatccctgggcatatatccaaacagattatacttcaaaaagatacatgcaccccaatgttcattgcagcactatttacaacagccaagatatgggaaaagtgtaaatgtctatccaaagatgaatggataaagaagctgtggtacatatatacaatgggatgctactcggtcaaacagagaatgaaatcatgccatgtgtagcaacatggacagacctagagattatttgtaccaactgaagcaagtcagaaaaagaaaggtaaatatcatatgacagcacttacatgtggaatctaaaatacgacacaaatgaacttatctgtgaaacagaaagactgacagcacttatccatgaaacagaaagact

SEQ ID NO: 32534 - DNA, 1955 bp, Bovine  19866880820777
cactatcattggtccccgtcatccatgcaaccacagggctttagtgggctccctgcatcccagcactggccaacatgagtgtgccgatctcatgaagctgattagtgggtcaaatgggctactgcttgagagcatgtggcctaagtgaaagcacatagcatgtggtcaatagtggcttgcttccttccacccagggatggtggaggaggtgggattctgagatgcaagaaggcgctaaatcatctgtcccacagagcattagcagggattgtagtgggccatgagccacggatgcaaaccaagaaagtcctcctccaaacccttcctccaccctgcccctggagctgaggttaccgtagacagccctcctcccctcaggccctttctgcccagggaaggtgcagagaacatgcccagcaagagtctacaagccacctgccaagtgcctgtcccctttctccttgttcagacagattactctttcgaggagcggcagcagcctgcttcatcaccctaattgcaggaggtcacaggtccaggatcagaagtcaatgatcagagggcagtcaaagggtctggagtgagaagtcagaggtcaaagattgatgatcatggagtcaaaagaccaaggtcaaaggtctgttgtcagaagtcaagaggtaatggggtctgtgttgaggtcaaaggtgaaggaaacaacagggatttgaaattaaatccagcatgcaatttatccaagagatgaggactattgagagattatgcagaaacctctgccttctctctggaggcagaacattcctgctgccagtgctgccagaccccaagcttgtctcctggggccaaggctctctggaatgaggattctccttgggctgctgtcccactgctttcccattttacagatggatttactgcggtaaagaaaagggtctaacacatggaaatagtcctgggaaaaccgagaccaggactggtgtggcctagtctgtctttgggaactggacgtgacaaagcatctctctggcacatcctgaaatgacaaatgaaaccattctgggtggtagtaagggctgcaggcatctcattttgcaaatcagaatccttctatcagcattcattcgcctgaacgaggcttctaagcagagcccaggcacaaactcactctctcaggcttcatatcaatgtgccagctccttcctggcagattcatctgccaggggcttgcagactggctcctgccacctgttttccccagtcctgaaacgttttccgaatcatagacaacagcattaagatggcaaagttgattgaaaaccacagaggtgagaaagctatgcaaccaggaaggcgacacggctggagctgcatgtcctctcaagcggctgccctctggctccctcctatctcggttcaccatgcggcaggtagtatgtgggtgcccggccccgggagcccctctccatggtctgtggctgtttactgtcagagactaatctgtctcaagtaagccttaggctcagatgagaagcagagcaaaatgccaacacttcctctgggactcagggtaccataatgtgggggatggggcgcagggacactgaagtgacaagagctggagccctggacacgtgtgctcccaggggaaatgtctccaaagccagccctgcctggcaaagccttagttctcccgggtccctggattcagctcccaaactggcacagatttccagcatttaccagacagacagcaccgtggcttcgggggtcaattttgagagcgtcaggttaacaaataacccctcaggaagcaatgtctagttctgatggagaccctggaggcaggaagtggacatttcagtccagggctgatgccatcatttgaagttgcagtgcggtaaccgtgggttgtatgccaattccccataaggccaaagggaatgaaaaggatggga

SEQ ID NO: 32535 - DNA, 1133 bp, Bovine  19866880926525
tggtcgccggcccgccgggctctcttggcttgcagccgtatcactcccatctccgcctccatctttatatggccttcttccctgtgtctttgtccagattgcccctttataaggatcccaatcattggcatagggtgcactctgacccagtaccagcccccggtgctacagtagtaaagaatctgcctgcagtgcaggagaggcaagagacgcgggttccatcccggggtcaggaagatcccctggagaagagcatggcaacccactgcagtattcttgcctagagaatcccatggtcagaggagtctggtgggctacagtccatgggattgcaaagagttggacacgactaagtgagcatgggcattgagctgacccaccatgacctcttcttaacttgattccacctgcaaaaaacatctttccaaataaggtcacattcacaggtcctcgaggttagaacttgacctcatctttggggcggggggccacgattctactcacttcagtagcctcggcaaaatactaacacaatatgcacacacagtgggtcttcaacaaataatagtttccgttactcttctgaacagttttggaaaacctttgtgcacctttctgactgaattttgctgtattttcaggcctttgaggtttagagtatcaataaaaccagagcatttctgttgttttttggtaacgcacagcttttctttgcaatatgatgctcttctgggctctgtataagagctgccatgcatctcaattacggaatacgtttagcatttggattttgagtgactttggcccagtgctgtcaaggtttgcttcgggcacttttgtcttgcttaacgatgcaaaacagaaaatgctcacaaatggttaccccaaaatgagacctgtcgttattgcttcttttacctccggggccccaaactgcagaagcttattcactgcgagacaacgaggactctaaatctcccacctccatatattacatttcatattgcacttgaacatggcaaaattaattgtggccaaggcagggaagacaggaaaaacctataatggtttatcatattttgcaggcttcgtgaggaccataaatttaaagcatataggaattgtatttattc

SEQ ID NO: 32536 - DNA, 704 bp, Bovine  19866880941957
cttgccttggaaatcccatggacagagaagcctggtgggttacaagttcatggggtcacaaaagagttggacacaactgagcaacaaaacagcagcaaataatagtactataaccctattgaaagactttatctttggatacattccccaactttggaatgtgctatataggtttatctatgtattctcatccttgttactctggaactaacgactccattatggctgagtgagaggtttcagcagtctctgactagggacaaaaccagctggccccactctggaaggaaattctattcttggcccccttatcagcatcactcactccccagctgagcccagagcctgaaggaggtcagcttgcagcccagcccagcagtgggactgagaaacggaagaacaggtcttctccaccccaccatgaaactgaaaaagcatatgtgctacatgtatgtggatggagatcttccttcctgcatccttcccttcccttcttctttcctcccttccttctcccagcacattcacaaatgaggtgccagtgtaaacttgagcctaacaacgttggtggttgattaaactcttgtttcattcctctgctaatcaactacaaaagccttcaatacacacaccaacctcagagaggttatatcacttaattactataaaacaaccccacaggttaatgcatgctttgatctcaa

SEQ ID NO: 32537 - DNA, 1233 bp, Bovine  19866880970885
taatggagcctgagaggaactagctgtccatcaagaccaataaaggggatgtttagagaactggaaaaatgcacatcaacaggtcccaagaccctcacttatgggcagtttattgaattagcactgagaacttctcttctaaaaagaaatataaacaccttcagaaagatcaggggagtagcaaagcgaagggcacaacctaaattagaaacaccttgaaactgcagacttctaaagtatgaaggctctgataatagagacaatagatacacatatcaaagcccctattaaaataagtactgccaggagctgcagagatttttttttttaatcaaattgatcaaataagaatgttcattgttgaaactcttataaatcttctcttatatattttatatagtaactgaacaatgggggcaagtcactttcgagtttaatttttgagttcaattcacttctcttcatgttttaaagagtttttggaagaattgaacacacataaaattagaaaagtactgagcaaagtatctggtgtgccagaaacagcaatcactattgatcatcattattattattctgtttagaattgatcaattactccatccctttcttttttttaattaatttattttttattgaaagataattacagaattttgctgttttctgtcaaacctcaacatgacatttctccagagaagacctacagatggctaacaaacacatgaaaagatgctcaacatcactcattattagagaaatgcaaatcaaactacaaggagatatcacctcacacaggtcagaatggcccccatctctttcttaagtcttcatttcctgttgacacttttgctctttgaacctccttccctaaagtgtcattgtgctcatctgatagagtggctgagtgggcttaggtttcatcaggttcaaatcccaccttatgcacttactaattatatggtctggggtaagtcatttgacttttctgcatctctgcttcctcaactacaaaatggggaaaatgagacctaactttcaaggttaactatgaggactaagtgagactatctatataaaggactttgcatagcagagtcatacaagcactcatgaaagggtagttattattgctgttataacaatattatttcttgattttataaaagtgaagctcttctttcgtgaaacgaggctggtctatgtgtcctcaaggtaaaggtgtaagttgaa

SEQ ID NO: 32538 - DNA, 827 bp, Bovine  19866881011694
agactaacaaaggtgttttcttaaccagaccctcagtctgctgatttctgatgaccatcaggagaatgttcatccctaacatgttagatggctcactttctgtgctcccagtttaataaatcactcactctggacatcctgacagatgtccaagtgatatttcctttggctacaactcatcccatcctttctagttattgactcagtccttctgtcatctaaacaaggcccagccaacatctttgagttatgacacttcctttccctctcttcccacattctttttcacttggcttctctcgattactcttctttgtgcttgcctggagatccttaatgatcttgcctctagtgaattcaaacctttggactaacaagtgttctgagctgttttcttccttctgggaagccaactggaaagtcacccagacatactgccccaactgtatttcaagtaagcaaccagaggagctgagagcctccaacccctaaggatatatggagtgccaactgcatatctttgagtttgaataataatacacatgcacacacacatatacatatatacttccacagctggtgagtttaagtgacactacattaatagcaataataaaaatttccatccttgtccttgatgatggccaatcatgcaagaacctcagcctctgacaaagacctccaaaccccatgagcatttccgtgggttcattttataggtagacctgcaaacccagtcaggaccacatggctttttccaggcacactgtcaacccacctctgtttctgtctcccctaaggtaccgagtcactcagcgacagcatca

SEQ ID NO: 32539 - DNA, 967 bp, Bovine  19866881029924
aaatatttttaatagtactactgacccttttaacactctcagaaagaaaatgaatctcatacgcattcaggcaggtaactattacaaaaataaatagaagagtcaatcagtgaaagcatacttgagaaactaaagaaacgtacgtaactatacacggtgagaactactttaacacagacaagattccacttgatattagcaagacaaccaaataccaagacaaatgaagggctggaaagcaggagacaactgaagaaaaagctttcagatgttccttcaaacagagctaactgcattgactgtggtcaactctgttggctatcattcaactcttaggcccgaccctaagtcctatgtggtttttcagaggtatttaaaagtttcagggtaagaaaggacacttagtgatttatgacatatttttgcactcacagctcttgtgctctaggaggaattttttcaggtcattagtttataatgtgaactggcgcctaaggatattttgaaagggaaaaaactagtgtgcttggagatgcagtttatgtaacttgcatcatcatttatttcagctcaatttggggcctaaactgaactcaaaatgaagtcaccacatctgcaacagattctctgggcatggaacgagcacacagaaatctgcaaacagaacagactccttacccggaaaaacaaaaacagtgtaacctccttaaaatatccaagtccttgcaagaagttcttacactttcagagtacaaaaataaagtcagccttacaagtaagttccaaaataatctgggttatcaaaatgccactggcataccaaaatgcatgaattctgccagttttatccttgtttccacagcctgccccagctattcacacaaccatgcatgtgtgggtctagaaaacatgaaactaaatcattagactctgagaaggcaagcatcttcctaaatccatgtgcata

SEQ ID NO: 32540 - DNA, 982 bp, Bovine  19866881062187
aaaagtcatattttctgcattgtatcagcctctttgcagtagctggacaatatatttccagctttttaaagctgtctcccaggaggttgattgtttatttcttccaaacgggacataaaaggatgataaagctacaaatccaaagaaactaattactcagtacttgaaaggatgaagtgaattttgagctttatgaatgcatgctaataataagtatcatggatagtaattatgcttacaattttaattagtgaatgctgctgtaaattaaaaggctacgtctccattagaaacaaaccccacagaactctctaaacctgaaacaaaccacagtgtgcatatacaaagattctgaagaacttttaagatgaaaaattcgagtattttcagataaaattccacaggccatcctgaaagtcattaccaggcactgatcattaattagctctatagtttgtaatgagaagaggtgggagtaatatttttcttctttgaaaaacattagcaattatacatttcaggaaaccctagaaatctgggttgtggtgtagccatcatggtgctgtagagaaaaagtcttaaaatgccatttgagtatctctagacccaattagcccaatattctcaaaattctttagtacacataactggaaaaaacagcaactgtatattcaaactgtcatctatatatcccatatttggctggattaatgctcttttttcttaaagtcttggtttcatttgctacaatattgcttctgttttatgtttggggcttttttttttttttttttttggtgggggcaggtgcagtgctgtgaggcatgcaggaacctagctccctgatcagggatccagcccacaccctctgcaatgggaggcaaagtcttaattacttggactgccagggaagtctctggtttaatgctcttgacttggcgattatattaaataacattttcaactcaattaactaaccaaa

SEQ ID NO: 32541 - DNA, 1142 bp, Bovine  19866881150382
atgctgtgtgtctaccatgcaggtctctcccccagacctcatcccacgtcctgagcctgggcttttttccagatttctcctctttcttgatctgcaggtagtaagcactcactgtccagtccagtttcctcctaggctggttgtagggccgccaccacctgggttttccaactgccaacctcgagtgtttgcttttaacagcagcaggagagaagatgaattgttttcaagggcactttttttaaaggatggttctttaatggggtccctgcttctttgaactcttccggtgcttctgttttatagttatcgatttttgcgatcataaaagtaatacatggttattgtaaaaatgtgggaacattttagaaatgtgagacttggcgcgtgcaagcacccacgcttcagagaggacctctgccgacgtctggcatagattcttctgtcctgttggctccttggcgttttgtcccctatatcatttctcccccaaagaagggcgtgaggacccagcctcttgtctggcattgctgcaggcagtgtttgctgctgcctgagttcagagaatgggctggctcaagagcagtgacggaggctggagatgcagcagcgtgtattagggatgtctgggcaccgccatttagggcttcagaggattgggctgagcctcagtgttcctcatctgaacaatggggatgatgagagatgtcctagtgttttagagggagattgggattcaacagtaagatgatggatgggaagacactcagtaagttctaaattctatgtattattacctgattctgagaaataattgctgttgccatcaaatagctcctgggggctccaagtgaatagtcatggtgacttagtcctaagggttaggattttattctcttgtcattgtgtatacatatttgtgtatgtgcatatagtcacacacgtgtgtgtgtacacatatatgcatatgaaaagtgaaagtcgctcagttgtgtccgactctttgcgaccccatggactatacagtccatggaattctccaggccagaatgctggagtgggtagcctttcccttctccaggggtcttctcaacccaggaatcaaacccaggtctcccacactgcaggcggattcttaccag

SEQ ID NO: 32542 - DNA, 1505 bp, Bovine  19866881151354
ttcaatctgcttaaaatttccatggctccctattccccacaggacaagctcagacttctcagctgaatatatctttcatgagctgctactggggctgtcatgggggttgagggcagagaggggtgtaagggcgagaccagaggagtgggcaagagatctggggcatgttaagaagtgtagtctttatcctgtgcacaataggaagtcacaaatggtcagtttcaagctgggtcatgcacgaacagaggtgctctggttaaaagcaaggcttctaggatcaaacttagcttcaaagcctgaacatgccactttagctgtgtgtccttgggcaagttacttaacctttctgagctggtttcttcaactggagaagggagattaagaccccatgagatggatacaattatgacacttaaatgaggttgtgctcagcttactacctagcacatagtaagcacttgactaatcataactaacattaccactaataactctaaatcttcctacacttcctccaagaagcactccatgagccctcaaaactgagttaagcctcatccccatgtattcttttaacactttgtattttccttgttggtaagacttatgagcctgtatcttagttgaccattaatatgtcatttcccccatcagaccatgctctccctaaggctgggaactctggcaagaagttactttgacatttactaattcaacaaataccttagatcacctcctactttgattcacatgatctcttttgtcttatctttatttccaccttacaggtgaggaaatagaggctcagagaatcaagccataagtccgcagtgctacaatcagtgactgtcagagctgtgatccacctctggcctcatatctcacaatggccatctgggcaagaggaaaagctgagagcagtaacaccctctaaaatgaccttcccagagcaggacgagtgtcctcactcagcctcacgaaatggcaaagtgaaggaataaaacatttcagctggaaaaacaatagatagccagaaatcaaccccaattctaccagaagtcataattccagaaaacagaactacatacacaaacggcaatatattccaagatacacataataaaatcaccttggcaatgcctatgcccttgtggccaaaccaggaagggattgaatttaaaagagaaccagtgaaggcaaaaggagaagtgggaggcagaggatgggatggttagatagtatcaccgacttaatggacatgaatttgagcaaactccaggagacagtgaaggacaagaaagcctactgcagtccatggggtgccaaagagtcaaacactcctgagtgacggagcacacagctggaggacttttacccacatgagcccatccaaagaggtgtgcctacccacctacaaggttcagctccctgccacatagccaagagcctgatagtggtgaaacgccagagtaattacaatgaaaatttccaagggggaaagatca

SEQ ID NO: 32543 - DNA, 1102 bp, Bovine  19866881183248
tgggctgccgtctatggggtcgcacagagtcggacacgactgaagcgacttagcagcagcagaagtttctctctctggagccgagttaaaatggaatacagtcattaaaaggtgatctagtgtaacaagctccccaccaaaggcagagcagaaggttctattcctctgtgagttgttatatgaagtagctcatgcctgacaatcagtgaactaaatccttcgacaacgagagatttataaggacttgtctacagagacgaagtgtttctatagatttgagcagagctgggaccagggaataggaaccttgcacataaatacagtttgtggctttgggattccacagctgggagctctcaacagccactgtgtataaatatgcctatggagttgagttctaaataatgacagtcctacattcaggattcacatggcttccaggacctcagtcagttcagtctgactctttgggacccgatggactgcagcacaccaggctttcctgtccatcaccaactcctggagcttgctcaaactcatgtccatcgtgttggtgatgccatccacccatctcatcctctgtcgttcccttctactccccgcttcaatctttcccagcattagggtcttttccaatgaattggtttttcacatcaagtggccaatgtattggagtttcagcttcagcatcagtccttccaatgtatattcaggactgatttcctttaggatggactgactggatctccttgcagtcaaagggactctcaagagtcttctccaacaccacagttcaaaagcatcaattcttcagtgctcagctttctttatagtccaactctcaacattcatacatgactactggaaaaaccatagctttgactaaatggaatttattggtaaaataatgtttttgctttttaatatgctgtctaggttggtcatagcttttcttccaaggagcaagcgtcttttaatttcatggctgcagtcaccatctgcagtgattttggagcccaaaaatataaagcctgtcactgtttccattgtttccccatctattttccatgaagtgatgggactggatgagttaaaaaggtgt

SEQ ID NO: 32544 - DNA, 1049 bp, Bovine  19866881183579
cgacttgaaagtaacgaaggctaggcatttgtggagaagagaaacccagacacacttcaaacatgatgtgggcctcaggtggctggaagcctgaacagcgcatcttctctaggcctgtccttgctctgggcctcatcctcccaccgcacacccgagtaagaaaacaaacagcagcgatcaaagcagagccagtggtagaagaaaggacaagcttgacttttttccatgtatttgaaggatgaaccctcagaatctgttgcctttttttctgctctgggttgcagcaggactggagggaatggaaatatgcttgaattttatttctttcaaacagagtcctacaaaggatatctcctagccttagcccatggtctcaaatacaaataacaatatcttggcaggaaatcacagagtggaaaaaggctacagaggacagatgttatcaaacaaaacaaaaatttaaagacttttaaataacagtttcccattcccaagtcgcactctgtggcttttgcttagtacaaacagcacctggaagtcttatttcttgcacaacaatggctctatgagatctttctctttgaaagtgttgttgttgtttttgttgttggctttggacttcagatgcatggattaatcacaagaaatactgccattgggcaatacatgttctatttatccatttacttattacttggaaatggtatataaatatacgtatttgcatagggatagagtttatcacaggcttccctggtggctcagacagtaaagaatctgcctgcaatacaggagacccaggttcaatccctgggtcgggaagattccctgcaggaaggcatgacaatccactccagtacttttgcctagagaatcccatgggcagaggagcctggcaggctgcagtccatagggtcacacagagtcgaacacgactgagcgactaagcatcagcagagttcatcacatgtatattcttaagtaatatattggttagttttgtttttaaacattataaggatgccattctatccattatcttctggaat

SEQ ID NO: 32545 - DNA, 1243 bp, Bovine  19866881189737
ttgacagtaggaaatactgatatatttagtctcagtaaatgtgtgatatgcacgtttcccccaaatgggtgcactctgatattttctaatctgtatcatgaaagattttgggtcaagtccccctgaattcatttcagaggcgccaagataatgcgtgtccagtgcctgtcctttccttgccctcagtgaatatgccatcattctctgtggtcatcatgatcaagattgctctggccatagttaagagaacggatgggtggagttgaatgacggtatctaaatcctgagggtgtggaaggtcattggctcttcatctctgtgtttgtgtcccaggggaggagctccttgctgggcttcctgccttcaggggcacctgggtggggggtgaggggatctatcagatgagctgtctatctggtttccctgggaacgggtttcttctgttttctgttttctgggcggccacatcagactgagtacccatttaccctcagaatggctttttcctggaagcctcagagtcattataagccatccacttctttaaatttttgccatgatcctacttcccttttcagagggttgcagtcttagtacaatagaattcatttgcattttccactaggtataccccctacttctgcccactggcccagcccgtaggctgcgccccctccccatgccctggccctagaagccgggaggagaatgcaagacaccacattcttctccaagatacacattgtggatcccgagtttccaaagtaaccccgtgcaatgagcccggcgggggagcaaggccagtgacagcacccaggaaccctttaactgcctcatgcttcgtgaacgcaggactctggctttccagataactgaaaagcacccaaaacttagctactttaatcattctagaagcgtattttcctaagtgttagcctcattggtccttcatgagtgaacatctactaaaaccccatggtttctgtaactcagagacttaggcaaggaaggttttgtgatggtgacagtgatgatggtggtggtggcagtggtggttgtagctgaattgtgtcccctagaatttgtatcggagaaggcgatggcacccactccagtgctctcgcctggaaaatcccatgggcagaggagcctggtaggcttcagtccatggggtcgctaagagtcggacacgactgagtgacttcactttcacttttcactttcatgcattggagaaggaaat

SEQ ID NO: 32546 - DNA, 1127 bp, Bovine  19866881220598
aatgagtagaggtgggaggaaagtgggtgcccctcctacatgcgcatgctcagttgcgtctgtctctttgggaccctttggactgtggcccccatgctcctctgtccattggatttcccaggcaagaatactggagtaggttgccacttcctcctccaggggatcttcctgacccaatattgaatctgagtctcctgaatctcctgcaccgaaggcagattctttacccaatgagccatcaggtaagtatgcctctcctacaaaggcattgaattcagctttttccaaacatcatttttatcaaaactaacttggttgtgcctgctcactgaatttcacttttgggtctccctgtgtgtgacttttgacactcacatttaatggagttatttgagaattttttccctgagtttttataattccttgtctatgtttgaagtttgcattttccaccttcatattttgccctcttagcagcatgacctgtgactgtggatgctcttgagtttctgcaaggtcaaattgttctgattttctttgtggtgaggacagtcctaatcccaagtgagaaggaaaaaatcatctctgacattgtcagccaatcgcagcaacatttttctctggcaaatccttgtccccatgtctcagataatgggatcccactgaattctaagtggaattcagtgtccccacttgttcctgacttgcaacttcttttaaaacagccacaaaactggaaacctagcggacatttccagccttgagatacagcagaaatgggaagttctgttgcaaatgatatgcctgacagttacatgtaagtgattttatcagggggtctggtggccagttttcagagtggcaggcgactggggtggcgcttgggggaacctgtcctctgtttcatccttggtctcaactgtggtttgaaaactgtatttggattgcattctgtgttgtgattcattccttcttgttggaacggcacagcgaccagcctcgttagctctaatagaccttttagcactctcaaggttatgtggtttccaagtattacaaactcattcgtgtcattctaatttaaacatgatgctgttcttattactgcatctcttttataaactacc

SEQ ID NO: 32547 - DNA, 1238 bp, Bovine  19866881332662
tattcttgcctgggaaatcccatgggacagagaagcctggcaggctatggtccatagggttgcaaagagtcggacacgctgaagtgacttagcacacatgcacgcatttctcaaaaatcattgttgtcaatgtattgttatacttgatggaaaaaactaaattactggacttgaaactgaggtggtcgagagactgtgtcctttcactccgtgagtgggtacatgttcacatctggatggttttagcaatgttctttcacgcatggaacaataatattttctttgaaatggtccactaaacccaaagggatacaaacaggaaaccgtgttttaaccaaactcttatctttcttatgtgaaaatcaaaccgcatctgtctatatgccactttttgtcttttttcccttcctattcggatgtgtcccagatggggtaggctgaagtgacgctagttagctcactctttttgcagccattgctcccttagcacgttgaggaaccgctggaccatttttacatgctttgcggacttagcttcttttattctagtttctgtggtgtgccaatcaatgattagaaaagaagggttgtgagccaagtaccattttttcccccaccttctccaaatcatgctttgtgtgacttgtagccactcatctaatttctgagtactgattctagttcctaattgtggtgtcaatccagtttttcttgctaatgttgaggccatttctgtattgagtgtgttcctgctgtaattcaggcattgagttggaatctgggaatacagatgaatgagacagaaatatgtcattcttactaatttctgtgtactgggtgttccaaatgctctagatgtatgaaaaagcaatagcaatctgtatatttgtagacattacagttatagattgattgaggagccagtgctcactactctttacatagtgctgattaaacagtatccaggatattgcctttggttttggagtctcaattttaggttgaataaacacttaatatgagttaagaaaagagcaataagaatgtttagaaacagtggattttcagactttggttttttgcttcaaggtttttttgttttttttttttttttacattcaaggatgtcttgtagtactctgaaaaaaaaacgagagtgtgaaagacatgtataatttatactactgtgtttgcattgctctcacacatcaatgtatgagtcctgtgttattacagat

SEQ ID NO: 32548 - DNA, 890 bp, Bovine  19866881423819
aaaaaaaaaaaaatgctccgttcagtgtggtgaatttccctagagaatgtgactgcatttacaatggacactgtcaaaaataagacttgaatataaaaccagggtctaggatattacaatctcaacagtgaggaggacagaaacaaccataggccgcatttctacatattgaaattcctgcagccagatgttcctgaggtttattaaaatgtgatctgattaagggattactgggagggttgtgctataaatcatgctgttagtcacatgcattcaaaggaattcctacaatgctagaaaagttgaatttaacattggagagtgtttacattgccaccaatcgagtaacagagaggaagtgggaaaaaaaaatccacaaaccagagcaagcatgcctcagggagtaagaagattacaggaatttagctgtttattagggcagagacatgctgtaaggattaaaggggatgaaggaaaggggtgcttcaaagtccattagtttacctaatgcaaaacgtaaacgttttctagagaaaataaaattaaaatatgatatgtttttgacaactaaattacaagtatctttgtaatttatatattctatacaaaaaaagcaagaaaaaactgctgtattgtttaaatggaaaataccaggttcaatccctataaaagcatcaaacgcataccatttaggataatatcactgatgcacatttgacaacaaaattacaaagctctttgatatactgtgtgtgaagagtggcaattaaggccaataaaatcaaatgaagaaaaaaaactaattaacactaacatatcattatgacttactagcatataaactcccatgcctgctctaaattgccagcaatggcaattcccaaattcct

SEQ ID NO: 32549 - DNA, 1293 bp, Bovine  19866881528065
tgccccccagcaagtgggccctgtagctgtggcacacgggcttagttgccccccagcaagtgggccctgtagctgtggcacacggacttagttgccccccagcaagtgggccctgtagctgtggcacacgggcttagttgccccccagcaagtgggccctgtagctgtggcacacgggcttagttgccccccagcaagtgggccctgtagctgtggcacacgggcttagttgccccccagcaagtgggccctgtagctgtggcacacgggcttagttgccccccagcaagtgggccctgtagctgtggcacacgggcttagttgccccccagcaagtgggccctgtagctgtggcacacgggcttagttgccccccagcaagtgggccctgtagctgtggcacacgggcttagttgccccccagcaagtgggccctgtagctgtggcacacgggcttagttgccccccagcaagtgggatcttcctggaccagggaccgaacccatgtcctctgcattggcaggtggattctttaccactggaccttcagggaagtccagttgctatttttattgttgtttgttgttgaaaatacaatcagaaagaagaaaataaaaatcaccaataatccgaccattcagaaaaaaatgatttattatcctttccgacatgttgtatatgtgtttgtatgtatatatagttttaaaacttcatcttatacatggtgaacatttttctgtttcttaaaacattcctattttagtttatcctcagttgttttcaccctaactctttggtcatcatttttattagctttattttctgtagtctgtatatgaagacaagaggcttttccattgtctcctaactttgaatgtctgttctaatactaattgattttttttgaaaccacacaagacccctcttaactgagcggctctccatctagggaggatgcatctacgaccagctaccagttctgcacgagttttaatggctatatggaattctgtatttatttagacacatccaaattcggggcagttatcttttttccgagtttttgtttggtcactagcatcacggtggatggcctgtttgcaacatggtatttgtgcacattcatagtcatttctgtgtattagaaaaattcccagaaatttaaaacccattcgtgtccccagtatcaaatgtccaggagcagaaactgttatctggccctggttcctgcagaatatacaggagctctatagtccagtgcttcatgtgtcatccttatcattttgttaacaa

SEQ ID NO: 32550 - DNA, 734 bp, Bovine  19866881664474
tttgtgaaatgaattcctaaaaacagagttgatttagtctggtgggtctacacctgctcctaactagctgtgcaggtgttgctttaaagcaggctttctggttttgtggaagtgctgtgtgctgtgcacgtggcccacaggctgggaagccagacagagatgactttaattgagagtggatgcttttgtgccacagttgtcatgcaatacagataaaatgagcaaaaatgggacatcgtgtcccatgggaaggcagcattacagttgagctaataactcttttatgattgaaaccttattgcatgattatagagctctaaagttgacttagaaactctactgcctgtttggatccacaggtttatcaggggccttgaaaaaatgttcactgaaatactcactattattgtctgtaactcattgaggtagatgatcacgtttctgaggctaggagatcagttttgagtaagattgaaatatgcgtattgtacatttgtcttgataaatgtactagtctagaggtcatgcactggagaaggaaatggcaccccactccagtgttcttgcctggagaatcccagggatggcggagcctggtgggctgccgtctatggggtcgcacagagtcagacacgactgaagcgacttagcagcagcagcagaggtcagttaatatgtttgtagtttttgttaggaggtgaaggtaggtattactcaaatttttcataaagcaa

SEQ ID NO: 32551 - DNA, 1536 bp, Bovine  19866881739529
gaaaatactgtttctactgcacaatttatcttgcttcgccactccctgaagcacaattcaagcaaggctctttccagggctctattttcgataaatgaagcagcaaaaggagaaattactccagccccaactctgccatttattagctgtgtgatctaaggtaacttatttcacttctctgagcctcagctcctttttccgtgcacagtacaggctccataatttgagggcccactgcgaactgacaatgtgaggtcatttttcaaaaattatttaaaaattcaaaaagataagtgctgggcataaaagcaagtctggcacgcttcggagctaagcacgaatcctgtgctggtcacaggtccatgaatctggccctgctacttacagctcaaaggagatgacacgtgagaaaatgtgcagtgcagagtctgacacacaggggcgcaggaaatgttggacgtgctccccaagttatgtctgccctcggtcctccagaccgtggcccttcccgaagcagcgacactggtgatgatgcagacgggccctcctgggaccttgggttatgaattgagccagcacctgcattacacacggtaccacggcaggatgacagacccagcactgaagacggttaggggcttaggaacaagtcagcgccagcatctctgggtggtcctcaccggcaagatggcagttgtcatttatctttcccatctgcttcacagagcgattgtcaagaggcactgcaatcacagctgcagactgcaaacttcacagggccctgcagacccaaagggctgtggagttttttattttttaacttgtcaactcagaaagtttcatctgaaaggtcagaggaagcagagggatggggaagccagcactcttagttttgaagatgagggaccagtgtgaaggcaagcaataggagtctggcctggaaatggaagttttaattacttaaatcgctgtgggtcagagaatggttccacttgatcatgctgaaaccaaagtctgacttcagccaaaaccagaaaggggaaacccaaaaccacaagtcacatttggtttctgtccaaggcagccctccaaacccttcagcatcccaccatggtggcctctggcttccctgggaccctgtgggtcacgtccatgcagccaaagcatcgacaacaatcagctcactctaatgggcagccttggaaaagtggaaaaccccacctcgaatgggaagacttgcaagaaggggctgctgcaaacttacctgaatcccctacccccagtaggagggctgtgctgaaccaatattgaagacattgctggtgtactgacctttcttcagccttagacccttccaacctcataaacttttccaaggaaaagaagtcatatgcgagcatgtgcatacacacgtaccacatatatgcgtgcatatgtgtaagtatgagtatatccagatcatgtgcatgtgtgctaagttgcttcagtcgtgtctgactgtgtccgaccctatggactgtagcctgccaggctcct

SEQ ID NO: 32552 - DNA, 963 bp, Bovine  19866881852016
tgtgtagcccttaggttagaatgagagcgtcagtatagacccagtgtacttaactgctaatgaatgttagctagttcacaactgtaactttgatgtacacacctgatatttgtacagtaaatacttcacactgtacatagaaaaactgttgatgtttatgagcattcaggctatcagagctactgcaagagcaacagctgtagtgcttttaaccactttttctccccttcatgagatgaagattcgttttcattatttaagctaggatctttccgtgcctgaggtttaatgacaggaaacgatcacgactcttaaactccgagtgagctcataaaccaaaagcctttcatgctgtctgtttccaaaacagattcaataaacatcattttgtacattactctgttcccgggctgtgtgtcttgattgaatttgcaagcgtgtccatttgcaaattctgagtctgagagcgtccgttagacctctgcatcctgtctgcacactcccggtgtgaggaacccgccttcccggcttctaggtcccttttcctgttgcctccacccctgggttaggcagcagcctgacctcagccagtctcccctgggctttgcttgccatcctcatctggattggcaagtcatttcctggaggaacagcctgtctgcggaggagcttggaaaacaccgaacagagtctgcaaaggcaaggtctcttctgaagccagcctggtctctttcctgagtgtttgacccagagggagcctttgtaagagccttcagagaggtgtatcatgaacggattgaaaaccctggaggaggtcaaggagaacagtcacacttttcactgagccttcagaaactggcacagtgaactaggaatgccgagaggtctgccttggtagatttcacgtcactggcgcactacctgtattcactcatccagccactcatcttcctaccaaatatt

SEQ ID NO: 32553 - DNA, 1411 bp, Bovine  19866880143189
aaaaggcagaggaatcagagattaaattgccaacatccactggatcatggaaaaagcaagagagttccagaaaaacatctatttctgctttattgactatgccaaagcctttgactgtgtggatcacaataaactgtggaaaattctgaaagagatgggaataccagactacctgacctgcctcttgagaaacctgtatgcaggtcaggaagcaacagttagaactggacatggaacaacagactggttccaaataggaataggagtacgtcaaggctgtatattgccaccctgcttattcaacttatatgcagagtacatcatgagaaatgctgggctggatgaagcacaaactggaatcaagattgcagggagaaatatcaataacctcagatatgcagatgacaccacccttatggcagaaagtgaagaggaactcaagagcctcttgatgaaagtgaaagaggagagtgaaaaagttggcttaaagctcaacattcagaaaactgagatcatggcatctggtcccatcacttcatggaaaatagatggagaaacagtggtagactttattttggggggctccaaaatcactgcagatggtgactgtagccatgaaattaaaagacgcttactccttggaaggaaagttataaccaacctagatagcatattcaaaagcagagatattactttgccaacaaaggtccatctagccaaggctagatgtttttccagtagtcatggtttttccagtagtcatgtatggatgcgagagttagactgtaaagaaagcagagtgccgaagaattgatgcttttgaacggtggttttgaagaagactcttaagagtcccttggactgcaaggagatccaaccagtccatcctaaaggacatcagtcctgcgtgttcattggaaggactgatactgaagctgaaactccattactttggccacctgatgcaaagagctgactcatttgaaaagaccctgatgctgggaaagattgaaggtgggaggagaaggggatgacagaggatgagatggttgggtggcatcactgactcaatggacatgagtttgagtaaactctgggatttggtgatagacagggagacctggcacgctgctgtccgtggggttgcaaagagtcggacacgactgagtgactgaactgaactgaagcaacttagcacgtgtgcgtgcacacacacacacacagagcactgtatgttctgattggatatctgtctcaacctaataaaaacaactctgtgtcacccttatcaaaaatcattccacttagataataaatgcttgtaattatattctcttcaaaattacaaaataccactttgattagataaaataggcttaccagggaaacctctacagccacccaaacccta

SEQ ID NO: 32554 - DNA, 1128 bp, Bovine  19866880355825
tctgtcttaatcctctttgctgggacctaagaagctttgtaacgtacaaaataattacaatctttgaaattacaaatctcattttaaacttatattttaactttttctaaaaatcctatcatagattttcttccaaaagaatgcatggtatcgattaatgagtacttaaagtcctgagttgctaaattaaaatgtttaaattgctaatgataacatgaacttcttttaaagaacagtgtccatttatcaaaatgacttcagatatagtttttattttctctcatttgaaaaatccttcttataagtactgctgctgctgctgctgctgctgctgctaagtcgcttcagtcgtgtccgactctgtgcgaccccatagatggcagcccagtaggctcctccgtccctgggattctccaggcaagaacactggagtgggttgccatttccttctccaatgcatgaaagtgaaaagtgaaagtgaagtcactcagtccgactctgtgcgaccccaaggactgaagcctaccaggctcctccatccatgggattttccaggcaagagtactggagtggggtgccattgccttctccttataagtactaatgaatgacatttaagttacattctaacaatctctttaagatttatttccccccaagtataaccatatcttaagaaatgaccgctgtcctatcccatcatctcaaaaaagttatgctaggatttttgcagatttatatttaaccactgtacttctagtactctatcaatttcaaagccaacttaatacaagcattcaggcacatacgtatatacttgcccacacaccaacactggactttttcttaacatctgccaactgttaatagtttttaccagcgtctagccgtgtttatttgtacctggtttctaataatttttcttcttctaagacatgccatagaactgaggtaacaaatactatattgaattttaagaattattctcacagggataaaaagcaaacaaacaaactgcaaggcaagtaaaattctattacctctaatgcaaatcagcctaatgtcattcaggtagctctatttttgctctgctacttctcctattccaacatcgccacctctaaacta

SEQ ID NO: 32555 - DNA, 1630 bp, Bovine  19866880379882
gctgcaagaactcaagtcctgagatttgaaaccacctcatctgtgctatagagaattttttcaaagtatctctactttaaatcaggcgtgtatctttcatgaaattggcaggtggcccaactcccccagattttttatccctttccctgacaactttgctggataagactttggccaatttgattgctccttcaactttttttcttgctctttttcctgaccagcctccttggtagttaacacattccttctctggatatttatgcctttgattggataataaagtgaagtcgctccatcatgtctgactctttgtgaccccatggactgtagctcaccaggctcttttgtctgtggaactttccaggcatgagtactgtagtgggttgccatttccttctccaggggatcttcccaacccaagcattgaacccgggtctcctgcattgcaggcagatgcctttaccatctgagccaccagggaatctccttgattggataatagtaagctttaatcctccctctttgggcctgcaaagaattctgtcactttagagtaacttttacctatgttagttcttatctatgctcattttagaaagattattttccaaattctgcttgtgcttcacagggtctcttcattcatcttcatacttctctgcttaggcttcactctcataggattaggaagttcacttaatgttgtatgtaccatgggcactgcagttctattttagtttgctctgtaccattgtaattccttacattgtattggcacgttggaggaatcagggtatggtcaactttgtagccctgggctgtagtaaattttttacctctaattgcttgcttctttctcattaacatcaaagtggattatatgtctgttttcttgattattgattttgggagtggtgttagatggaaatctcttggtaaagaaagagtgtaatctgcttataaattgagtattatagtttgactttagtttacccctaaatgttcatatttatacttggccttacgttccaatgtaattttcattatgttttagcaatgaaggattttgccagaatatcaattgagaaattctcctaaatgtttctttaattgagccatgtgaggtataattaactatctaccaaatttcataatagttttaattcaaatagttatgatgaaacaagatctcctttttggcataaaaacaactgattttaacctgttctctcaagttttctttaatatctttgaaactaaactgcaaaagcttttaagaaggacactatatttaatagttatatttaatagttttatatttttatcatggtttcatacttgattgaatgcaatcatataaggtatgaaaattatgtaagttgaagttatgcttcaatggattttaattacatcggggaccctcatagaagagcggcttaaaaggatgtttgaaataattaaacattacattattttattttataggagcaaagtaatcctttgtacagtagcaactgacagcgtgttttggcacctgtgttagggatgaaaaaattatgtctttgcatatcctttgtgacactggaatccttatgctataatggacatgcagaagtttacttgtgtc

SEQ ID NO: 32556 - DNA, 847 bp, Bovine  19866880389694
ccaggtatacatgtgttccccatgcctgaaccctcctccctcctccctccccataccatccctctgggtcgtcccagtgcactagccccaagcatccagtatcgtgcatcgaacctggactggcaactcgtttcttacatgatattttacatgttacaatgtcattctcccaaatcttcccaccctctccctctcccacagagtccaccatccatcagtacatgatattattaaaaaattgaaactgtaataatatcatgtactgatggatggctgtggctaaatcttacaaggtgagaaatctgtcatgtctctgtttaattctctaggggagttttattttcctaaatcaagacataaattttctcccaactgtcatatgatttgaatttaggcacaagctgagaatttaggataccttgacgataatatttgtttgtaggaggaataaaaatccttccacatcgtctttgatcagagagaacattaaagctcaacttctgtgttttatttgtttctaaagcaggtttgatacctgctgtttcaagctttagcataatttactaacatctgttgaaatctgctgacttatatgatttttcttagagtgaatgatatagtacttaggtcagagcaaaacatgtaacctttttttcatgtaacttaaaatttttccaaaagaaaaaagaaaggaaaagaaaattatatttcatcaaccagagctaagaacttagattttttaatgtgtacctttatttatatatgtatgtatgttttaaaaatgaaacttgaaaacataatgagcataatgtgtcgaagaagatattcttcagtagttatgcacatt

SEQ ID NO: 32557 - DNA, 3853 bp, Bovine  19866880400955
tgctgctgctgctgctaagtcgcttcagtcatgtccaactctatgcgaccccatagacggcagcccactaggctcccccatccctgggattctccaggcaagaacactggagtgggttgccatttccttctccaatgcatgaaagtgaaaagtgaaagtgaagtcgctcagtagcgtccagccctcagggaccctatggactgcagcccaccatgctgaacagcaaataaagtgcagtcactttcttgaataatggtgatactaatgaatatatatcgcaacacttttcagcttcaagaacagaaaactccagacacatcaaaatggcacatatcaaactctaaataacaaaattatttaacaggtaattgcaaactctctgctcatcaaataaacaggaactcattttaagattaagacaagtaataagtcagttcaggttgaatttttagatgaaagagcaatcatgagcaactttctaagccaggatcttgattagattttttcctaacattaacaacaagattcataaatacacagtaagtttaagcaaaaaataaaattcacatatatttcaaggagcaactgttttatataaataatttatcattacaaactacctgaataaaaatcaaaagtgaattaccagcagtcagtaaaagtaactccccagcaaaaacttctgcgtatatttctcaacatgaagtaacatgaaagaattcactcatggctaatatatttgtcaagaaaaaaatggttttttattactgcacctaaataatttgaaggcacatcaactgtaattcatgtggtttttttttgttatcatttatccagtggtatatttatcagttgtcatatcaaggctctgccaggagagtttttaaacatttattaagaaacacagtctatagtcaaaatgagattatgcttattatcttcaaagaatctgaaatagcctattatatatttattggctcctaggacatgttccagccagataatgatcttttgtcaaaataagagtgatccagtaatatggtcctcttcacccaggctgacagcaactctcagaaagtaatcaaagcaaaactattcacctaagtgcaagtgacagaactagctcaaactgcttagatttttacttttgtttaaaattttagccccttgaaatgtaagtggagctaatgcacaggtattaaaaagcagcagacttataatcaataccttcactaacagctattccccaggctatcttaaataggagcactagagttatgcaagatggaaaatacccaattaggttttcctggaccaatttaacttgtctagctattgaatatgttgacaataaatacgtccacgctcttgagtatgtgagagaaaaatcagctctttaatcaccagtaacactagtctagaaacaagccatctggcttatctctgatatactctggggattgtatcattctatcttttaaaataccatgcgtaaattgctaacctcagaacaaacttaagtttcagatctctttacaaaaaagtacaagaaactgtttctttcaagtatctgagagtgattctaagagaaagtcatcaactgctctccctgctaaccactttcaatagtgccagaaacagagaacaaatctgagctccttgttcagatacaagccaataagagaagcatattttcacccagatgcttgtgtcacagtcagccagtactgaaacactgtacaagctgttgtagctagttgatttgggtggttaaatattgtctttgaacacatgtgaacaactcttttgaacctgagtcattctctttctcttgctctcgctctctctctctcttgcctgcagtgcaggagacctggtttcaatccctgggttgggaatatcgcctggagaagggaacagctacccactcctgcattcttgcctggagaattctacggacagaggatcctggcaggtgatgttccatggggttccaaagagtcaaatgtgactgagcgactttcactttcactttctttcatgttataaaggactcactgggctcctctggtcaatgttaactacaaatgtagctccacaggcccgagtaactgagcatacttctgtaaagaatatgttctaaagtcaagggcacagagttatcacaagccaactcaacttcagtctactccacagccattaacttaataggttctaggacaagaaacctctgggaaatgattgttgttaagctccatgaggattggagggacagggaacccttctgtccctctagggttccccgctatgtacatgtggagtagagagttaagaacaagttccatcctctctgcctaacacttcagcagctccttcctggggaaaaatcacagctgccacactaagtcacactttaagccttctgggtggagttactgttccttcaagacaggaactcaggttccctcttcctctactcttcccatttctggtgttgaagaggtgcacatgcatgcctgggctgaatctggacctctatgactactctgcctgatcactttgtgtaattttttaaaaaatctgatctggccttcgtctcctactctgctccaattctccacctacaactggggaggtaagtgtgactgaggctccctggaacagaaaaacacagtttagccttcaaatccctcactggaaaagccagacatggaaggttaccaagcattcatccagctaggaagcagcacttcatttccctgctggtggggaaacaagtcattgttcagtccagaaccccacagaagggctaaaagtgaaagacaaaaacatcaaaaatctcaccttgaaatccctttatccaaaagccctcagcaacaggcaaaggaaaatttgcaccaagttttttttctcttttttcatgtgtcttgacctcagtctgaccctcctgaagtcctccccgcttctactaccacatgttcaaattcatgaattttcaatgtgtcatcttctcaaggaaatcctcccagcctgcccagttagatttaagcatcaccgcctcatctatcctctcatgtaccttatttatatctccattaagcactttattttaattagttatttaaatatagctcccctactaaatcagctgtgcatctctggccttgagcacattgtcaaggttggtccctgctataaggcacactcatcgcctgtgaactcccacagcactttgaggggctcctactcagcccagtagcactcgatcagcactatcccctcaactccttttcttttttttttttggaagaaatggagagattggaaggattttgtatcatagataagcaatctgaactaatatgactgcccaaccaggaagagctaaaggagcaatgttttgtctcagcggatcatagctccatttggcccagagctatggaaattcttaaatcatcaggctcaaaggaagatccacagagagcagaaatcagtcatgactcaatgtgaatgaagcactaatggaaaaatcaggcaggataggcggaaggttgggtttctggtggcggaggaagtcctcagtgacaaaatgaccttcagcagagacctgaaaggggaggaagagaactgagtgggtggtgtcccagtgtaaactgtaaccaaatcttggatttctactgcttatactcttcaaactaaatcaattgcctctaggagaggaagatgctgatgaggaaaatagcaggagaaagagccctgttcttgacattcagggcacattaggaaagcagttcccaaacccccaacaagacacagagcactatcccccgcccaccagggtcctcaaccacag

SEQ ID NO: 32558 - DNA, 694 bp, Bovine  19866880571070
tttttttttttgttttttcccttaagggcaacattgctgaacttcgtttgtctccatttcttccatactctcatatgcctccattgttttgccattgctatcagctggaatatcttcccccataggaagcagttcaatgtttatcacttttgtatcctttccccttgtttccctgaacattttatacatgcctctaaatatacatttacctctaataaaccatatttatttactaatttgttatatttctggaaagcaaaatccaagccttattgatcttcacatttcctatctcttcaggggaactggcaaacaacagatgctgaaaaatgtttctcaaaagaatattaaatgaatgcactaaccggtgtgctctgaggatccagagacctctctgtaggcagtgtaggcagtgacagcaatctttttaaaatgcaaatctaatcatgtcacttttctgcttaaatccatccaaaggcttcatgcttcacttagatcccaagccttggtgtgaaatccacagtcttttctggcctgctgcctcttcctcctcctccagtctgtcgctcctcccctccccccacttccctggaaactgtcctcagctgccccagacccctctgcaggggatagtcttccctgggcaccaattagctgttagctgttcctccctccaactccaggtctaggtgtg

SEQ ID NO: 32559 - DNA, 1086 bp, Bovine  19866880612376
catcacacactaccagttttgccatctcaccttcccaggaggccccaagcagatattcttaaagctattctcttttttaagaacattgttttaaaatgcctatcaagacggaaaaccaggaaaacatgtgaaggactaccctgtagctgtattttctttcttctgtaagaaaaaaaggaatgcttcaaagtgcatcccatattttacatttgcattgaaatttaattttaaggatatgatttctaataaactgaaatttgcaaataaatggtttctcaggtttaaacatattttgggcaaaagatgagaagtccaattctaccatttgaggcaccaaaatatgcaaatattagaaaactaactgtatcatcaaaagaacatcattttaggcaataaacctttccacttcagaaggcttggctttatgactttatatccagtcatccacatgagcgttctgaagtttttcagtgaataaaaataagcatctttgagggggaggggaacagaaaaaaggacattttatcaaaggcatgcagatgatgtggtttatacaggactttaaagtagaaccacaaatggcacattttaattttccctgtaaatttctgggggaaaaatgcagttgtacattcttatccaggatgttcctcatctattgatacctgtctctctcattctttctctccttctctctctctctctctctctctcacacacacacacacacacacacacacacaaatgtgcatgtgcactcacaggggagttacaaggttcctaattgggaatgtttttctctgctctttaatccactatgaatgtttatcactaagctagttctcctttggcttcaggaagcagccagtatcccagcaggggagaaagagaatcagaaaatcagttctggaaggtctccaggtgaggattaaaaagatttttcccaaaaggcatcagcagcactgcatttagcatcagtgagtttaggaattcacctgaccctcttcatatgactctgctacaggtatgaaagagggcattcacttgagacaaagcaatcccactacggagcggcataaggctcag

SEQ ID NO: 32560 - DNA, 1074 bp, Bovine  19866880639386
ctatattagaaatgttttattgcactgcactacagctatgaagtgcaaggaaccatgaagattgaaaattacaaatgacagatgtgtctctttcttcttattttttagccttctttgaatcctggggggagccaggtgcttttgaaccattggaaagtgaggaattttgaagtacaacgtggtgacattgtgtcattagtgtaagtaaatcagaaacatactatattcctatataagacaatttagaattatctgatttagctagtaattccctgtttataccatattgtcaattactaaattaataggttcatgtaaaatgtaatacatttttcaaaatctattttgaaatgtaacaatactatgaaagaagatttttttctatgatacttaaaatttatcacttgattgacatacttggttttggcaaaatgtttttgatgaaatattgattagaaattattatattgatgatctagagtacatgtatctggtattttgagttattttgaaatattgcattttggaagcaacttgtatgttactctcatgctttattagctgtgtagctacaaaatatttctagaccattgtaagtgtgacatgaaattcagtggcatttatatatacgtatcagtgatttaactgaaaaaaggaagtttggaagatggtagactggaggcttttgtttgggaccaaaaggtggcactgtttctctgttaaagtattacgactggtcaggaacaagaatttcattctaatcttagtgtagagaaggaatgtcaaaatgtacatgactgcacaatgatattcctatgtttgaatgatttagatttgagatttgtttgtttattttaaaagtaaatttacactgagaagactgcaaccagaacttgcctaatttctactcttttcagctacttatacaaatgttttaacatgattccctgttaagccagttagtgcattagggaagcaattaatgtagtagttactgttatttgttttaatgatagtaaaatcctactgtttggtgaagacttggaacttataagtagattctgaattagaata

SEQ ID NO: 32561 - DNA, 1843 bp, Bovine  19866880689425
atagtaaaaattgacatattaaaaatacttagcatataatgctcagtaaaaaaagaatataaaatttaatttttgttataccatatatgtataattataatattttaagatatatgatagggtactttaaatatcaatttattatgaatgtaattttgtgtatgccttttattgtttacatgcaataaacatttaaacatatgtcatattttaatatattttcaaagctcctaactgataatttctattctttgaattaaatcatagagaagtcttgtaggtcaaatccctcccaaatacaaattcttgcttctttacaatccaatatcaagtttctcttttaacactgccttttaaaatattttggttgtttaaagttccttcttaattattgacctaatctctttctttgaaaaatctgcctctttggtttcagttcttttctctgtgattttaaggaaatgcttaaacatttcatgtgttatcaagacttactcatgaggatttatgctggagtgttaaccctgggagaagattacctcacagcatagtgaaatagttattgaaagcgaggttcccttctgtgtttgcgtgttcagatttgtttatactggattaaaaatttcatttggtgtgtgtatatctatacttttccaattcaggagagcctgatggactacagtccatgggttcacaaagagtaggacatgaaggaggactaagaactcatactttccaattactaattgcagtttatgtcttccttctgcccttctcatgtttgctgcatattttctaatttctttccactagagtaaaagcgacaagtttctacaacagtgtcttatatatattgggtgagccaaaaagttcatttgggttttcccatacatctctataaaaacctgaacaaccgttttggtcaacccaacagtaagctcacataaatatttgttaaataaataaaaatgatttaacatttttcaaaaaaaaatctccagaagttctgagatgtgtttgactattagaataatcactgaggggttaaattatattaaaaatcacatgattaattagtagaaagtcatgactagaagctgatgactctgataactattgctagaatgaattcattattccaggatgcagtcttaggaaaattctaaagtatgattaatgtttgaagtgatgatcttaagtagaagtattaatataacaggtaaggagaaatgagtatgcattgtaagagtactgcctggtgaacttttgccaggtggttgccaggtaaccaccacacagatgaatgcagagaacatcatcttcctcaggctccctctggtcactgtctcacccaaatgattattagctccatagattagttttgcctgttttaaaaggtatatgtaaattgaattatgtaatacatacttttttgtatctgacttctttcactcaacaatatgtctatgacttcatccccactatgtgtagagaaagttcatttttagtgctatgaagtgtttctctgtaagattactggacaatttatatttcagctctactgttaatagacatttgggttgttactgattttttggaaactgtagatacagcttaaattttctcatatatatatatatatatatatatatatatatatatatgaatgtctcttggcttttgatttaagaatagaattgcttgggacatagggtatatggtatgtctagctgtcaaagatgtagctaaagattattctaaagtgttgtattatattttatgtattagaatatggtgaacattaggggatggggttttgataaaataagaatcatagtggcag

SEQ ID NO: 32562 - DNA, 771 bp, Bovine  19866880729130
gaaaaaagagcatttgattcttatacccttttattacaaatacttttgaagttttctgtcttcttaacaaattctttggtgtttaagcatcccctttatttagatcactgtaactagactgcaagggtacattctgcaaactttccagttcaatgcaataattcagttactacaaaacactactattaaatatgtgtgtggtgttccctgctaataaaaacagatattgagatagctattcaaatgaatagttttaattatgaaatagatgatatataattaatgaaatattaaattgagataataaacatgtctacatattaacaagaagacagattactatatgtaatccaagtcagctacatagatatgtctatgtactgacaccaagatacatctatacaccaatgaatcttcaacatcctcatgaaactgaataaggctttcttattcactgctatgtccttccccattgcccagaagaaatcacgtttccctctgatgcatcctcctgacctaaaaagaaattcatggtaaggtatgtagcaacatcaagaagttggctcaacagataaaaaagattttagaagggtgctggaattatttccccaggcatacgtaactgaaaagtccaacctcccaaacaggtacagtgcaaagcaatctagtcacttcactttacaatatcagtgaacaaatctgtgaagataagaccatggattttagatcctttagctcttcattgctgaacctgatattgaaccatatggt

SEQ ID NO: 32563 - DNA, 1244 bp, Bovine  19866880749536
tatatatatatatatatatatataaaagactcttcttttactatctaatatacttctattgaaaaactcttcaatcttttcagtctccaatagaatctaggcatctcttgttaccattcaacccaaagctgcaaataatgaattttaaataattgaaagtatgttgctgtttagttgctaagtcaggtctcactcttttttatgacctcatggactgtagcccgccaggctcctgtgtccacgggatttctcagacaagaatactggagtgggtagccatctccttttccaggggattttcctgacccagggatcaaatttcctgcttggcaggcagattctttcactgagccacttgggaaacctaactgaaagtatatcacatctgattttattacttcatagggatttttttttccattacaaattttacctggaactcactacatgaaacacttgctctaaagtcttaaaattccaagagtatatattctgaaatcagaaaggtttcctagaccaggcagcaaatgaaaatgtaactatctcacacagcaacttggcccactataaaatgcacaaaggacaaacatcaaagtactgtctagattgtatataatctacttaggcattttaaatattttaaaccttttttaaggcaaatggatagtcacattacctttaaagagcactctgcctctctaaccaactctaacaaaattctagcatatgtgggtttacttcaatgtatcatatctacaaaatgtaggtatcactaaaatactcacatgtttaaggagaattaaatgatattttgtttagaaataaatgcagttagtgcttactgctcagtaaatagcaattaataataaaaaaatgtttatccatacatactcatgcaattccacaggcactttttaatctgggtcatgaactagagtaaatgtaaaccagaattcattatatcttttaggtttagctacaaagtcccaattctcagttttactgcattactgaccacttcagagtcataatagtttttcatttgctccctttcagatccaaactccttacttcactgctcacccaagactggcactctttacagagttcactagcaaagaccttaaaattcttttatcatttatccgttagtggccgagaatagaaatatcactggaccttcacctcaaataatcctctaaaaaaatactgagtgacgagttgggccagaagttcagactcaa

SEQ ID NO: 32564 - DNA, 858 bp, Bovine  19866880756434
tgtggtatggtgcaagggcacaaatcttgaaaggattaggctagagtgtgatttcagaaaaaagagaatggacatttactgatcagctcacaaagagccaggtactgtgattggtgctgtgccatctttggagtcaggatacccacaccctccatgtgttagttcccttactgtgtgaggtctttaacctcacagagcttcattcttcagtcctacaagaaaaatgatcatcatcattactcccccagcaggttgttgggaggaagaaacgtcatttactctgtatacaggatagttctagaggagtcacgattactgtttttttttttttttttaaatttattctcctttatttccccaaagttttaaagtcagttcattactattatcttagcaaaatttggagagcacaccgagaaagaaatttgctaagaagaaaaaaaatagggctgtgaaattaaggcattagcttattgtctacagtgcttctcaccctaacgatggaaatggaaaagtaacgcagaatgggggagatggcgagatgaaggtaggtataactattctgagcatctcctctgtgaggtgcagaagcaaaacatgagaatggacactgcatataaagaggacacctgtaagtgccttaaaatattacagttaacccagtaaaagaggattggagagtctcttcagaattcctgggaactctgaattatagtagaagaccaatagctgaataggtgaaggatagcagcattattattaagatgttttaaaaccagggcaagggtctaatttttatgactcattacagaatacagtagactatatcccaaaggcagattatgaatttgaaatatt

SEQ ID NO: 32565 - DNA, 1069 bp, Bovine  19866880765900
aatattgtattcgttttgccatacatccaacatgaatctgccacgtgtgtacatgtgttccccatcctgaaccctcccacctgcctcactccccataccatccctctgggtttttcttgcactgttttttatgttttctttttttacctttcttggggctaatctcatatttgtttttattgtgcttttaggcatggcgcagtcccaaggctgggtgagaaggtacttcaaggccttttgtaaaggcttctttgtggcggtacctgtggcagtgactttcttggatcgagttgcctgtgtggcaagagtggaaggagcatctatgcaggtaaaactgatatgactcctttctttgaaatacacgtttggttgtttctcaagcactagaaatgagatttctgtatattgtctccatgctagaaactgaaaggtttttgaaaggccttgaatgaaattttaatgttactaaatatctttataaggtcttctaatgcagtcatattataagcaatggtgaataaaaataattctctgatagttctctatatctatagtttatcaccccccgcccccttaggaatgataaattgagattctaaagaaattttacaaaataatatcactttctgtggctgtggcctgagattttaagtttttttttttttttcaattatccatatatgactgagatcacatttatgagttcagttgcaggatgaatttgtctccaattcagttacctgattgttttacactctcacacatgcactcacacatttatgcgcacacagaattctgataggtggaaaagtctacagcactgatttcagatattctagtatgttctttaagcatgttgctgattaagaagattaaatgccatttacattggaagaattttggagtggagatttccaaaagttatacgcaagtagtctccagtaactcagagaaaacttgattattctaatgctgatgtctgaaaccctagctgtttcagtaagtttatcaactaaaaagaatttgcattttgtaatataatttgttttcttccattattttgggtatt

SEQ ID NO: 32566 - DNA, 992 bp, Bovine  19866880768933
aatttttgtaacaaaatatggaaaaaataaacagtaagtagcagttaagctacagtgctctttataaatacaaatgctagactggcaatataaaatgtaagtaagaaagaagaaatattagctcaaaaaatctctagtcaatgaactttacattttaaatcctagattaggttaaaacatatgaaatggttagtatgttgcaatttttaacccacaaaaatgccagttttacatagttctacctaatatattaaacaaaaggcaccaagtcctcaaaagtagatacaccagaggaatgtgtattatggaaattttggcaacacacacttcttcaaattttaccaaaagcagaaaatttgaaaggctaatcaggaggtctttcagagtcccccacgctggtgacctgctctccaggagcagaggaaacaaactgaaagtcgtgacaaggggagattaaaccagtcaggtggttcaggaaaatgcactcgggtacagtttctgcaacatgtcagtgctgtgtggatggggtatcctggaacttttgggaagatcacacaatcagcagagagaaaccaatccagacaaatccccctcattctcatccattgtcagatgcaactgcagccttctgccaggatggtgtggaaaaacagaaaatgagctggaggataaataacgattattctctgctcctgagttatccacaaataatcgataaaatgcagggctccgtaggaatctttacctttgaaaccccgcctcaaagtgcttaaagggccgagagggtcaaaacgttggccctgtagtcactgaggctgagagagatcactgcagagcaggtctgagtggggtggagagggctgcggggaggccccagggtttagccactccctcctcagtgcatttaagaatagcagaggcaaaaagacaccgtcttcactcttggatacctcggtaagcaatccgggcagccatgcttctcctcaaggatc

SEQ ID NO: 32567 - DNA, 1329 bp, Bovine  19866880779524
tcctgactcctcccgtgtcctctctctgtccatcctgggactgtgtcagctcagcacccgtaattgaccaagcattttctcctggtttgacacctacctcactccttaatccctcgctctctcactgttggtatggttccttctaaagtgcaaacctggtcactctttcatttaaaacatttaaatggcttgtaacaatagcaaattaatacagaaatttttattacatgccaggtcatattcaaagtactttacatatattcagtcatgattatgccctggaacagcatatctagaaacttaccagtcatcactttggtatgtaataataaaactgatgttaattgagcccctatattttaaacacataattacaatattaactcatgtaatcctaacaacatcccaagaataaggactctgaaaattgtgggaccttaatgattatataagggtagtatattacaaggagcttgtccaaagatacatggctaatgaatagagagcattcacactgtaatccatgttctgaagcactgcaccacgatggttcctaataagctccctaggtctagagcctagctcacagcgctcacctggctcttttttccaacctccattttctttgacgttgcattctcctgtctggctgatctgccacactgaactaagcaggtgctctcttaaatgaagtatcacctgaacaagcttgattcactcaatctctctattccttctgtaaaagttgtctgagccctgtgacccaggatactcaccactaaaaggttatactctacaatcctatgtactttgttcccatcagctaaactgtatgcctaaaaaataaccatcagttgtggttattaacatgcatgtttatgctagctatacctattatcataagcatctaatttaattaaatgttacacaaattgatgaaatgtgaacaagaaaggaaaaaaaaaacagtcaaatgttttgaaagactaacttataatgagttttcttttttaaatggttgtcaaacgtggtgagacaactgtgaaagcctggggaaaatttgtaaatgtctagaaagattctgtattcagattttgtcacaaataatctttacgttttcactccaacataaagaagctaaaactgggaatttaaacagtgtagcatgagtgtggtttgtaaaacacttctgagaatttcaatttgtggacttatacccaaagagaatgacatctcaaatgacggtgaattaattgggcattatattttgtatagtacaatgatatgactaataaaatgaatatatgatatattgggtattatctgtgc

SEQ ID NO: 32568 - DNA, 2011 bp, Bovine  19866880806328
cttttaaagatattagattcattttttctcgggagagctttaaatagggatgaaagaataggacagagctcaggggcaggccaagggagagaaaaatgaaagtgaaaagaggctgagaaaaaaatgactggttatacagtttcaaggaagctaagagaaaaaaattctcaatatgttttaaagaggaagtggtcaactatatagaatactgttgaaaggctaaataagaggaatacatgggaaagatcactggttttggcaacatgaaagtaaccctgacaaaccctaagccaaacgaatgaatcatctcttcaaagcctaggcatctagctgggctgacaaagaaaatgatcgaagaaaggtacaatggtgaaaaggaagaggatgcaaagaaaatcttagcacagattcagactcttagcagcttttaatcttaaactgtcatacaagaacaactaacaataagattaaaaacaaaataaatatcacatactaactggaacacatattaaatcaatctaaatatgaatcttagaatttatcagcacaggataaaaattttattgctccaagttcaggagacataaggagacttttgaaaagacttctaattaattattgaacaaagaatagccaagcaaaggtctactaatacagtgcatctggtgggaagtactcctggggaggacttatcactccccactctgttcagggtgaagctccaaaaacctgatgattaatatcaatctcccatttgttaaacagcccaagtcaccctttgtcatttaaattgtactgaatttgaatctgcatagactgcaagaagagaaggaatcctgaagctacataaaataacctcacttcagtcttaaaacagaatacattaatcttttctggcactgcttccccaccaaaaccacagaactcagtgctattccttggtgagtcatgctgtaaaatttccagttgacttatccacagagagatggcaccacatgaaatagagcccatagaaacttgggagagaagtaaggcttcatgtcttcaaccttctgctttggctctgacttcagatatattacaccaaaaccaaggctgaaatccagggctctgagctgagcaagttgcaaggatgaaccaggactctttcatactcagatcctaaaccgattctccagattgcatgccaagatctgcatttctcaaagcagtgttctctggccacattcacctggtgctttaaaaaaaaaaaagcaaatctcaaagccccacttcacacttacacaccaaaatctgtaaggggcaggtaaagacatctgcatttctaataagctccctttagtgttttttaggtatgaactcttggcctaatttgtgtactatggatgattatacaacatttttgcagggtaaggtatttcaccttttggttcattctccaactcattttacagcatactgtcagattagtgttcctaaattgctgttattatcatttctctaccctgcccaaaagccttctgagtgcttcacagcccaaaggataatgttgagacttctttgtgtgatactcaaggttcttagtcatggcttcagaatttgcccttcccacaactgagtttccatcaaaatataaaattgctcaaatacccagtatatgttgtatagacttccacctccctgcttctaacttgctctctacttctagaaagttactttctcatttgctcagaagcccaaattctgtcctttctttgaactcatggaagcctatccatttttttccagccagaagttctgtgaacatcatagtgctttatctctgtctcttgctacagggtgtatgcgttctaccttttattctatgacagcgtggcctattcgcaccctgcagaaactgggaacaacaactcctttctctacactggtatcagcaaaataagatttccatgggactgttaggggaagcacactgacaaactgcccacccggccaggcaccatagtaatca

SEQ ID NO: 32569 - DNA, 1368 bp, Bovine  19866880811639
tcagaaaaagacaaatttgcaggtttcagttcatttgacgtccaataaatttttctttctgtttctttccctttactagagtttcttggttatgtttaacatgagctgtatacagtattctgtatacagagtggtaggatcagtgatcaatgtatgctctttggcaattataattgctttttaatcccaaattagtactctggagtgtatacgcaggtcttaccaaacattttaaaacataggcatccttatcttaatatgattattgaatactatttcaggttcacttacattaagtgtagagttaggaaagtattttaatgtattgcaaacgctaatgactcagttttcaccaaattcctttactatgcaagtgtaggctccagaagaaaaaactgaagtttttaaatgacatagaaggatgaaaatatcactaagtttagtatctttggttcattttttgttatactgaatggcttttatctagctgagagcagtggtgtaatattgttacccctctttacttgtggttctttcaatcatcatttgattggattaaaccctttactgagtcttagtttcattattaagtcagagtttgggacttagctggctcctccttaagctgatttctgggtacaggctctatatatttatatagggtattagatatatatttaataaagtgttgcttagagaggcctctctggttttctctcttctttataagtgaaaggaaatatttcagggagagaataactgtcttctcccttccagatcttcataactggtgctaaataagctagggaagagagagatctgctgaatcatggcattgaacttggtgtttcaagcactgtaatttctgatgaatggtgtctccggaggcttctgtaaaatgatgcatcctgacatccagtgaccttttaaactaatatttctattatgtaattcagttgcttctgtttcctggaggtaatagcattagtttgtactgaggtagataatgattttgttagcaatttcctttgtggtaagtgtttttgctgtaatttagtttgaaggaagaattgtttgtacaaataaaatctagaggaactcacctactagtagtacactgtgatcaagaaaaaggtggtccatcacttctgggacaatattcttgacactctgggtaaatacagtcacattggctcaatttcaggggaagattgttgccaactactaatttttaaaaattgtataacacgcacaatgctaatgacaaagtattggggctgtggaatcagacctattgctaactctctcattgatgggtaagcagtgttacaaacttgaatttctttatttataaaacaagagtaataa

SEQ ID NO: 32570 - DNA, 939 bp, Bovine  19866880857593
tttattaaacaattgtgatatcttcactacttttattcaagacaacacacacacacacacttttaacctcaaaatatcacattctgggaaacacagtcagtgtgcatccccatttgctctattaagcaaagaaatctggttgtattgattgtagccctatgtcagcaggctgatgtatgtgcatatcttgataaaagacttccgaaaacttaagaaatcacaaatgtaaactttcacacaacaataccaaattcttacctcttgatacctggaaactccaccattaaccgcagcatctataactccattcaggcacatggttaggggattaatattctgcatctgtcttgtctgacactgactaatcagagtcttcagctgctgattcttattctccagcacttcaatggcattttccagaggactcatttctacctgagaacaaatgagcataaatatatattggcttttgtgacactgaagaagaaagacaaagtagattatccacattctgaattatctgtgctcccctcaacatctctaccaggggccatcagtatagaacagacaaggatatagaagacaaattagctgtttgtaagccctgggaagagaaggtgattatattcactgtctgaaatgtggttcaaataatcagcaatcaccgattatacattagcactaaaacagttaatttaatccttgaaacaaaattcaagcctatgtattttacaatttattttttcttttcttttgaagggtaaatattcaaggacccttcatattcttagcatctttctagatacttaatgcaaagtaccacaggagataacaaatgcatttacagatcctctgatgtcaaggagatttcagcccagttgggaagatgggacatatgcccatatggaccccacatgcatacataacagcaccataagg

SEQ ID NO: 32571 - DNA, 890 bp, Bovine  19866880861707
atgctcttattatgtaaagaaagggagccagttgttgattcatctaattatactgcagtcccacacttctccatgttagaagccaaagcagattttttcataaataaaatacagaatatttataaaatctttttctaataatagcaaatagttcacgtgaatctgcctacaaataaggccattatgtccatacattttttttttccatatgcccgaataacatcattagtatcattaacagaactagaattctgggatagtctttagaaactatgaaattagcattaaactatgcatcattggccataggtgtcctccttgtagaaactgagctgctgctatctacttaccggctgacttgccttctatgggttgtgatatgtgaaagaaaggaatatttatttttctgtcctttttatgtatacatagcataaattcctaaggacctgcctagaatgaatttaaactagcaaagaaatcttttcttcatcaaaaatcctttcaactattttcttccaaagtagactgatttgggtgtgtactagttaatagtttataagcttggtcttccatgctgaacacatcagaggctttcccccctcatgcccagattcagtttcatgcaattttagtagtgcaccataaggaaaagagtgatttttgagctacaaccacattatcaaaacagaggagcctcctagagccctaattaccagaatcagaacagagaatgactatctccattctagttttctctaatatttaaggggaaaaaaaagattaactgctaatattgagaacaatgttaggttaaaaatatgaatgagcacctatattgggcagaagctatgtgaggtactgggatggtaaccaagccgcaggaaatgtta

SEQ ID NO: 32572 - DNA, 1187 bp, Bovine  19866880865686
tgcggtagtttgagcattctttggcattgcctttcttagggattggaatgaaaactgatcttttccagtcctgtggccactgctgagttttccaaatttgctggaatattgagaggctttctaacccttttgattttaactcgagggaaagagttcagtcagactgaatacagcaggtaagaatcctggggtgagacaaaccactcacaagagaattaaaaatcaacaaaggctaaaggcattccataatcctaagtacttgatgacctaagatgctcacttcatttcaagcatctacatcaaccctagggccacagtgagaatttaacttttcctctatttccttgcaggtcagcttcaagtaatccctcttttccagaagctgtccaactgactcttccacccacggtcctggtccacggccacttctctccctttagtatcaattttgtggactaagcctacagagcataaaatatggactaaaaccagatacagcctcatcatttcctagtccatgctttgtttcctagaacatgctttattaatttggcattatcaaatggaaagagatgcttctgtcacattttatcatatgtattccatttttcatagatataaaatgtttcctattcatttcctattgaatccagcctctccaccataatatctcccataatgtatctcatatttgaaaatggtttttaaaccattttcaggccaggagctatcaacaggggaagagaaagcaacagattattcaccctagttcttcgtatttgatggaaccaaagaaataaaagccaactgtgcttctgtagaattgaagatgatgagattgtatctagttctgtctacgtcatatgatctacaggctttgtccacacagcgtgatactgttttaaagcaaagggtattattgattgcccacttccttagtctaacatttaagtacgaatctcattcattcatttactgaatcattcatgttaagttggcctgaacttatatgatcccaaaatcttgagtgaaaagttggcatcaagtctttggggacagagcattcaaagaatgttccaaggggtgacatgtttgctataaggggctgccatagtctactaatttttttgtccctccccaccccaaccccgtatctaggtgggaataaaaagtagaaattagcaagt

SEQ ID NO: 32573 - DNA, 1000 bp, Bovine  19866880875611
ttttaaaattcattttactgtcttgtttctcatgatcaagtatgtatctctaatgtaaatgaaagccttgctaaaatatcttaaaagagaaaaagtttggtttggccttttcaaaatgagtgagactgatgaaaaaggcacttgagaatatttaatagatcttgattattttacaacttaagtgtttatttttgatgtgccttaaactaaaagataaggctgaaaatgtcctagaagatacctagggaccatttctttctcattcagtgtatattctcactctagtttgtacattctcattgccaccatttggagaaaaaggctgctaatctgaaatgaaacggcagactccccaaagggaaagtctaatgttgttttcttgcccatcttcctctcccccttctatgttctctgcctggtctttgtagatgaaagcacctcattgatgtaacgggaaaaagtagcaaggagccaatttctagctcccatctaaacaagagcctgtaccttcagtggagatcgcccagcaggcgagggggatactgacgccgtgtgtcttgctggtgaagctgtgaagagagagagagagcatttcagttcagaaaaccagataactgactacctgaaaaagccctctgtgtgtacaaacccgtacagatgatccagtgcacaaggatcgaggcaagggggaggggcgtgggtggagagtctaaatggtgcccacccaaaatggattccccacaaaggatggcagctccaagacatgggtaatcagggaaaagtcaccagagcacacatgatggtttaaccaggtgactggtccagcgtcctttccacttcctcaaagcccagatgcttctctgcccttggtctatttcaaaaggtgcttttacacatgaggtgccaggggagcaggctttgggctgagcaagaatggaaagacccaggtcacccaggcagctcagaataggtccctggggaatgtactgacatcagtctc

SEQ ID NO: 32574 - DNA, 1332 bp, Bovine  19866880885737
aaaactgaagcagactgatattgtttacctcctgctatgatgtgctaaggttgtattactttcaaatgcaaaacctcaatccaatcatgaagaaaattagaaaaaccaaaattaagggacatcatacaaaattcaaaaaatgtcagtgtcatgaaaaccagttcaatgcaacataacaactaaaggcaacatgtgatgctcaactggattcttaattaagacaagcaaatggctatcaagaacactattagaacaactgatgaaaattgaatacaaactatacatttgataacagtattgttctgttaccaaaaatcctgaattggacagctgttgtaggattatataagataaaatttcttagaatttaacactaaagggtcatcatatctacaattaatttttatgtaggtcagcaataatgatagcaataaaaatgacaatatggtgtgttgtctatatacatatatatgtatatatagagagaaagatcaagcaaacacacaaagatgctattaattgttgtgagtgggaattcactgtaatattcttataatttctaagtttgaattttttttaatttttttaaattgtgtttttgaagtaagtttgttttcattcaagcctatatatttgttctgatcaaagactatgttctcagccatactatcacttcattgccattttcgtcttagaagcatggcaaacagaaatgagaaaccctatttatcaagtctatccacttgccactgcaagattattcctcatggcatcatttccactactatttgaggttcacttttaggaggctcaaattctggggttccaccatccccttgagaggtattaatatcttctgttaagtgttgtttgctgaaatataggtcgtcctgaaatgcttattaataatcgtgttaccaactatgttgcaaaatttgccactaaggaagataatacttatttccaatggtctgtgcatcaaccttctttaattattaacctttggcttctgcacagggaaaatagaaaaatgctgttatttggcatacattattatgtgtaaggacataattatttcctagcctggctttggcctgtccttaggaccctggacaatatccaatctctgataaccaaccactcaaatagcaaaaacttttgtgcagaaaacacctcctagtttctacctaatgactttgactgttgaactattgtctcaataaacaacagagctgaaagggacctcagagaaaaccaggtttaattctctcatttttggagataaagcacaggggtccaaaaaggttgaatgtcctatccaaactaatacag

SEQ ID NO: 32575 - DNA, 879 bp, Bovine  19866880903607
attctgtgcattttgttgcttttgtcagatctcacctgctttctgttgaggtccagccattctttactctcaacccaagcatttctttaaataaagccttctttgtcccctatcttcagttaccccaagcccaggttcgtgtaatttgttacagatattgctagctctgcatttcttttctttggatcataccttatttcgtaattgcatacttagtaacttgttttattactatttgtctgtctttctcttaaccattaactaaactgagaaagagatatgatatagcattatagtatcttcaggtctcaacccagagcttggcatctgagtatttggtgaaaaaaatgtgtggaaatcaatggatatatgtaacactacttcagcctgaagttttctatgaaacagagctagcattgtcccatatccattttctttgaagataaactatgaagtttaaggtttcttgaaattatacaacacttttatgaatatattaacagtattatcaaaactgcttttaaaataagtacttcatcttattgaccttccttctgaattttttttttttttcattattcctcaaatccctgtgtggtttagagtatagaggaacttgctaatgtttaagttcatatcagacctcagtagatgcttgtaaagtgaagaagtgaattatttacaaacaggaaagtatccttcatgtgtattaaattggttgtagaatgattcattgatgaggattactgagcaccaggtactactccattttcatcatcaaaacagatgccttcagcactcctttctcttttctttgccattgtaaataaaggtcttggtgccccatttagctttttttttttttttgctttctatttg

SEQ ID NO: 32576 - DNA, 1526 bp, Bovine  19866880911810
caaatgtttgcagctaacacactttattgttttagaatttatcacatgatcccacagggacaatttgttacaaaagtgttattattgtagtatcactaaaatagtttgcttttcccttcaaattgccttgacttctattcaatattagatttttaaaaatcagtttgggaagaaattaaaatagaaacataatggaatgagaattgctaaaaatacaaggctgaaatattgaaaatgcagctaaaacagaaatagctaagtgtaaagtcagtaggtaaccaaaaggggtaatttgggaccagggagaatattattagataactttgaaaataaatgagaataaaaactctgtcctggcctttaaaaaaatgaagttatagaatatgtgaaaacatatgtccaaaatacccgtaagccttggatagacagttaaccaacatgcaacaaagcatacatgttagttaaatggtaacattcccttttttacttgtcaaagctacatcaatatttccatctagaacactgtaactttcaggatctatttctagatgctgatatgtcctgggggcatcaactccagaagctgctatggtaatcacttttgtatgatatcaacagccaatgttttttgagttcttgatttatagcaggcatttgtggttttttatctttttttaaaaaaattataaaacattttatttgaccaaatatattcaaaatatcattggtttaacttatgctaatataaaattattaataaggtattttacattttttccaactacactcatattgttaactggcctcatttcaagtggacagcagcacagtattaaagagtgtcttagtggctcccagcaggagatggtcccctgcccagctacctaaaacaagccggctgctctcctaccacattacttattaatattttgttctctttacagccctcactaatacctcaaattatcttatttccttgtgtattctttgtcccttaagacaaggactcacgttgaatggtgccctgaacagcataggctttcataagtgctcaatgtacactgtcccatctcctccagaaggggacaacagaggatgagatggttggatggcatcacagactcagtggacatgagtttgaacaagctctgggagttggtgatggacagggaagcctggagtgctgcagtccatggggttgcaaggacttggacacaactgagggactgaactgaacggaactgtacaccgtccctgactgaatccatgttcggtcaggcccctggatccccttagccccctggagctgctccttggcacacgtggcccacccccctcccttttttctccaggtccattgccagagtatggatcatggagctctgtgtagtggagctctgccagaagacctaccatgacttcctgtaggctctgcattaagttctttatggtattaattcattgaatctccccagtgaccccaagtaccttaggatgcttattttatagatgcaggaactagggca

SEQ ID NO: 32577 - DNA, 967 bp, Bovine  19866880967751
gaggcagggtgagaatagtaattttattaggggttaaaagaattgtgagagaccgtaagggaatctggggtaccatagaaggaaaagaggggaggatatttctaagaactaaaagaaactaccttcttagggtaaaccaagccaaagaggtacagagcagtggctagagaaacatagccaggtaaggaggaagagcgtgcagggccagtagatccaccaaagagaccatttaagacaaaagacccttagagttgctcagtttggtttccaaaaatttatcagagtctcagaataagacagttatgctgttattacaatgtcatgattgtcctttcccctattaggttatcctgggaaagttttattctttgtaagaaaattcagaggtcaaaatttacctacttgcaagtgttttagatatagaacaccaaaggaattccttttcaaaaattacaactatatctcaacctgtgatgcattgtcttgctatttttagttggccgtatatagtcagcaataactataaaatgtgttcaggtatgtctttttaaataaaaactgagtatgttgaggctacaatttgccagatgatttacccttttctatcattctttagtataaatatatagcagacatttttttctagtccataaagttttattgcaaatactgggaacccacttaaaatggaataaacagtgtctacccacatgtgtttttccttacaggaagccactttgattctgggttaaaagacattgattaatgtgagaaggctcgcctgcttctgtgagcactggtcctctaattctgtacacacacagaatggactctaatctctccagctgtcatgttgatgctctgggtgagctgtacatttcacaagctctggaaccactctgcaactcaaacacgatcaacagctttcctcaaaaccagaacagcagtgagagattattaaatcaaa

SEQ ID NO: 32578 - DNA, 4865 bp, Bovine  19866880990466
tcttatttatttctggcctggttccgaaaggatttgaggtagtatataaaatataagcacagtgccagagagaaaatagagcagaagaaagggaaaattagagtggagatatgagatcctgcagagttgtccaagatggctcattgattgggttgagtttcctataggtcaaaactaagaattaagcaagatctctgttccaattacaaaattaatagataaaaaagccccccacccccaaacttagaggcttgagtatatagttttctattgctgccatggatagaggagcctggtgggctacagtccatggggtcacaaagagtcagacacgactgaatgactttcactccacttcatttcattgctaaagttataaattataacaaacaatgacttaacacaaatttattgttttaaagttctgtatataagaagtctcacatagatcttaccaagttaaaatcaagtcagatcctgtttctttatgcagagttctgggagagagtctgtttctttgccttttccagtttctataggttaccctgttccttggcttatagtttcttatcttcatcttcaaaggagtgatgttgcatttcactgatcatacttctgtactctccctctgactctcttctgcctctcccctcctcttttaaagaccttgtaattacactgaccattggataatccagaatattctccctatcttgagggcagctaattccaagcaaacttaaaaccatctgcaaccttaattcctgctttctatataacctaccatacctgtagactcaagggggcaggatatggcaatctttgggcaatggagggcacatttccatgcctatcactcaagaataacaatatttattttgttcatgcatctgcagtgtggacagtttaatggaggcggggtcacttcatttttgtactacctggcattagccagtttatgtggaaagttggggctggaatcgtctctgtgttttctcactcaaatgcttggcacttgatgctggaaagactcaaagagcagagggtgggatagttgccatgccttgagcatctctatctgtccatatgatccttccatgtggcttctgcagcacagaggcccaggtagctgaacttctgtatgatgactaaggtctccaaggcctgggggtgggagaggaggagacaagaagggaaggaggtgaggaaggaaggagcaaggaagagagagaaggagaaagaaaatggtagaagctgtgttgcctttcctatcctagcctcctaaatcatgcagcatcacttgaatcactttctgttgactaaaactgagacaccgaagcaaagccaaattcaagagatgggagttagattgaaggaatgtcaaagaattttcacacatgttttaaaactaccacagccccttaaaatatttacagtgtcccctgaacagcttttctgggggataacaagtaaatattttttttcatgggtctcataaaaggacactatgtgtgatgtaaaaattgatggcctcacaaatgtctgcacgcacaaaaaaatgatgataaaattcatagagaaatttattatagcatttctgggtgctagtaccaaagtacatttttggggaaaaaaattctacaagtttctaaagcctttattccaaagtctctaatggactaaaaagaatccaatcaaaaacttaaagactatagaaaaattaatggactatccttcagctgatcttctatgaatattatattttatgataaaacatttaaacgacttaggcagaaaagagatcatgaatatatttcttggcaagaaccagaagtaaaaataatctttgtggccagttcacggcaggtttttaggtttttaagttagtttggtgttgagttcttagatgaaatcaataaattgtgctcctcctcatgtaatcactaatttcagacagaaatcaacacagaccatttttaatgtctgtaagataaatacatatcaacttgaagatggttattttcaaatttcagtggaacagccttttagcagatgtccatttgctactcttgagctcccatccttgcacataaaatggttatagtaattggcttttgatcattaatatttctttgcagatgtttgaatctgatgtgaaatatatttttttaatttagagtaagatttatgaataaaatgagtaagataaagtgtggaagttaatcaacttagttcttagatgatctgttcttaattcacatttttctaagaaggcagtaaaaatttttgtggatgatttttgtctcctttatattgtcttcattaatatatatattttttctctcaagaattgagaacagggtcactcactcaccttatacatttagcagttagtatacacagggagcggtctactcttttctctgcaattaagtaatataggacacagactgtgaaatgaatgagtgaataaaaggtaattacatggcatacttaatagaaagccaagttcaccagctttttaatgttctttcatttaagtatccatactcaattattgtgtttttttccccctaactgctacctagtaaaacaggaaattacaaagaacttctgaatgctgtcaaataacctaacctatttctatctcagacataatgtcactagatctacatggaaattgaatatagccatctatgctaaaaatctatagcaaactggagctatgggagtatttgaaggctggaccctttggggtttttcatttttaaagataccttctcatatactctttatgcctagaaagactgttgtccttgtgtgaagctatgccctgaagtgagagttgctgatcaaggccaaatataaaaaattatgtataactccttattttctgttcattcaacctactaaaaacagcatggtttacatgcttgaatagctctgtacagaaaagaaaacctgatctttttttactcttgattgtttaccccaggaatacaatttttaacaagaacttttccctgccaagtcctattctttgccttcattatgatgtatagccataaatgggcagataagagttaaattttttcaactgttccttttgctttctttctcttaagaagacaatcttttgtcgaatgatatatgaaagactctggggcagtgtaggggcagaagaacagaaaaagagcatttctccaaattggttaattgactgtatagcagttctactatgaagtaataattatagcatagagatgggatcaaaagtgaaacatccgacaaccatcttcatatttttctcaaacttgagaatcctgttctccaggtgaggatcttatgatctcctgtttatttacattgttaaagtatttgatatttagaataaaatcaatctgtttggtttcccacagtgacagaaacataaatgtgatacctacagccagagggccctgtgacacaaggcggatggtgcccttaaacatcttctgcaggcctcctttggcaaagattctgccaaattgtaacctccagaggccttctaacatcccagagatctttttccctgagattggatattgattctaaattatttggggaaaaataaaaatacataaatcctgatccctacctacgcgattttatctgcctgaggaactacagatgttgtcaccagaagcctcttctcaattttgcttaaagtggattgtagaagcactggggagaaagagaaacagttctgttcctgtcttcatcagcctaaacctggcttcgggctgataaaggctgactgttcaaataaagcattgttccatgtgagatcacaaagtgagggaagaaaagttttagatagaaggcagaatttaaaataatcctgtgaactgttactttgtcacacacaagactcacttaggtaaacttgccaccaagtgacaaggtgagctgggtgctcccttaaagccacagagaagggtaggttttacctcctttgtacatgcatacataggggactattcctgggcaagcgtcgacctgaatttctattgtccatcagcaggaataaggctacagtgtgaaatactccccagtactttgggatattgcactcgcattaaccttagttctgggaaatcagtttcagtctacctcaaaggatagcttaaataaagactgtaacactacaagtgataagaaatagtgttctaacttaaaagtgagatcttttgagtcataatttagatcaaattaacaatgtattagcagtatatttcagttatgagtcccaaattgactgtggccaaaatatttgcatgaagttgacttgatagacttaatgaaaaagtaatgcttaaatatatagtgggcttggtgaattattattaaatgtcccagtgttacagaactaaatttgggtttactcacccatgcgcagtaaagccaatctactgacctgggttgtggtgaaggaaagtgcagcatttatgataaggtcctatacaagaagtctggaggaaggtacagcaacccactccagtattcttgcctggagaatcccatggacagaggagcctggcaggcttcagtccatagggtcacacagagtcagacacaactgaagtgacttagcacatacacacacatacaagaaatcctgagcagctagtatgcaaatgacctgaactccctgtgggtttcagcggagcatttttaaaggtcaagtaagggagggaagacccaggctgtgtgaccagcttgtgcacacttccctgctttgttgatgggtgaggtaacaggggcagtgtcatagtgggtaacattatcagtccttaagctgcaataggcctgggggactatgtgct

SEQ ID NO: 32579 - DNA, 1944 bp, Bovine  19866881017648
gtaaagtttaaaaaagacttttgatgtctagtgattgacatatgtgtcttcttcttatacagcctctttttcctgccaaaaatagactattcagtaattccaaaccattctgtacccccttcaaacgataagagatataaagtagtttttcaaataccttattaattattttctctaagtcactgcattcaactccctaggaatcctaagacaacaaactagaatgtagcattaataatgctgtgttgaaaacaaagccataatgccagagaatttcaaggataaaaatatgaaatcctcttgcctgagattgtgcattgcaaaaacaactgtatggatcagtcagcttgactaagacattttgacatcttatttcaacatctaaaattaaaactacatcttcaatttgcactaaaagccttgtgtttcatctaggttaaactcagataaagatttactatgaagaagattagttataagaatattatttgtattcccctctcaaatttgaaaaaagttcaataatttgtaaatctcccagagtaatacgataactgttttgaggatgtattatgtttacaatttaataacattttgagcagaaaaaaataaagtagaaatttcactaaaatgacagcaatcacttcatctcaatagacatttcataatgatgataattaacagaacttcaacttctattttctaaatatatttgcttattataactctattgctgttacttattttccagtaatctcaaaagaccagattaatgtaatatctcttgcttttaacagaaataattatatgggtcagctggaaggaggttaaggtgtttctcagtcttgtgcctgtaattgcaaataccacagatcagtgagcaaaaaagaaaaaaaaaggaggcttaaacaccccatcctggttacagaaattgtcgtaggtcctcttcattttacactgtcctttctttttactctgcatcagtttactttcaaatgggcttttatgtttgatacaatgccttccttatcattcctaccacaggtgaaggtctctttggttctgacctttgatgctgtgctcatattctctacaccaagagctccaactcagaccccggcgtagtcctctacgcagggctcaggcagctttagacagccccctaaaaggtagagagacattgcaggaaccaccaggagaacagacccaacagaaactgtgtcaaagaaaacaaccacagaacagaaagaaaggttcctgacttcagaaaaaaattctcaattaaacaaaggcttattttcccaaagcaagaaacccacttaaccatatctttgggacaaactgttattttgtgaaatgaaagagacaagaatctttaacgcctttagactcatacggaatattgatcacatgcaagttacagctattcttaaactgtttgcttttctattttttcaaatctgaggcagcatcgttattctactattatttgagctcaaggtctttctcagaagtaggaaaaatctaataattgtctacaagcacattatgctgagaggtagcaagacaattttcattgctacagagccagcttggatgttcattaaaagtaccaggcagagcgtgggacccagtattaatgggacacagtgttgttagcaggtctcagaaacaagcactgatactgaatgcaaattgtgcatgataacataaactggactctctagactgttcactgacaaagggtgaaattgggtgtaaaagatgggcaccgaaacacagggaagtttctaaagaaaagaagtatttaacctcaggctgttccattgttaagaccttaaaaagcagacacactttcaataatgactaacatatagcacttggtatgcaccagccacaattctaagtactgtgtgtgtgtgtgtgtgcgtgtaagtctctcaa

SEQ ID NO: 32580 - DNA, 1165 bp, Bovine  19866881049251
ccgcatccatagagatttggaatcacagtgcagaggagctaattttgttcagtccatgtttcgtgttttgctattccagccaaataaacaaaaataaattatttaaatatttcctttttgttcttcctgttcattagattcaaaagtatagggggaacaaaactcaaaataatgagaaaatgattggagaagctattgaatccattttgtgttactgatcccacatatgttctaaattctaatccttttggacttgagatgcataagaatatttaatgtgtttctgccccattttacagtggacagttttcatgctaagtgctttaatgtatgtctgcactgttaatatatcacttgggactctagagttcaaaatgttgaatatactttatgaatttgaaatttactgacctagtgtttattttaatgaagatatatttatgtttataccattttgaaaaccaggccactgggacaaaggcaaatttcaaaatcttaattcttttcttagatataatttgataatggactcgttcactctagttacttctgcaaatgcttaagcaccttctctttgccaatccagatataatccaacttgcattcagtaactcttacctaaaaattaatttccccctaaaccccatttcttaaaagaagacttcaagcaacagtattctcgtatttgttaattctataatatgtctagtgaagtcatgtaaaatctgatttgaaatgcactgtgaatgacaaatttattatgatgaaagaaatccaggaagctataaagtagcatgaacatattcatgtgggaatatatgtcaaaagtctaattaaactaaattattctagattagccttactagttatctaaaaataaatacctatagagaactgatcctgctttgtaatctatcattaattttcatgcagatttccgatgaaaggattttaaggagaggagctatctctttttatttttagtcatttcatctgttgcttatacattgagaacatataactgtcaattgaaatttttgaagtacctattctgttgagaagcatgtattatactctttttaatccttctgacacggatattcaaatccaaggctttaaagtctaaagttaactatacgtgtaaaggtgctacttttttctgttt

SEQ ID NO: 32581 - DNA, 2660 bp, Bovine  19866881177811
tgttctggaatttaagcttttaacacttgtacaagaagtaagggagacaagaatggccttcttacagaaaaagtagaaaactggagcagcattttagcttcccttaccttctctttttaatggatatcttaaatatttaaaacatttgataaaatgatacatattcttatataagaacaattttaaggataaataagtatctaaattgtgatataaccctggggagttctaaaaacccaatgacagcaagaaaaggcaaaatgtctatagagtagaaaacaccaaactaaatggcaaatggacaggaagaaaacatttagagcagatgtaacagataaagatgaatatttactatatagaacaactcaaataaaaacaggcagagatatcaatatcaactaaaacaaaaacaaattttaaaaatgtccaacatcacaaataatttaagaaatataaataaaatcaagatactcttgccatgaaattacaaattgaagatttttgtaatatctgttattagtgagaatatggaaaaagaatcattctcttaaaatgttggtgagaatgtaaaattaaacaactttactagagggcaacacagccaatgcccaccaaaattaaagatctacataccatttaatttccatatctaactttctcttattctaaacaatcacacttgtaaattttcatataaataaaggaataaaggtctggaataatacgcagcaaatggataatggtttcctatgggaaaggaattggtatggtgagtaaaaagaggaaagagctacttgtactttttaattcaatatattcttacctgatgtttgaatttttatgtcaagaaatggttgcatgcatacttgcataatttccctaagttatttttttaaaagaccacagtaaattaaagatatcatgtgtgattagaatatttcagatacttttagttataatggcacttttcaacatattctctagtctcagtgtttttatactttcctttgtgctttcctatctttgtaatctatctttgattttggtatggattccacaataatatcttccagttcaaaaattctaacagtaaattgtctaaaaagtttatcctatctataatggtattttacttttagtgacatttttcatatctacaatttctaattagttttttttttttttttaatatccacacattcttatttggttccacctgtctgactacataatttctcactccagtccagtgaaagttattttatcacttaccctatggggaaaaaaaggatatttattttaaaaattttaacagatccacacattaacctaattttattaacgtataaagcaaattcatgtttgtgcaactgatatagctgtctttctcaaaagtagatttcttcatgtttttatgtcatttacagtgaatacggtaaagtggccctgcagatattagatctgatgagttagaccaaataactgagaatggtgccaaaaacagatcagcaagtatcataaatgtttaattttcattgttccaatcttgcttcaactccatttttaaattttcgtgaagttatttaaaagcaagactacatgcttattgcttcctttgtggctcagctggtaaagaatccacctgcaatgctggagacctgggctcgatccctgggttgggaagatcccctggagaagagaaaggttacccacaccagtattatttaagtttggatattcaggcttcagaaattttgcagtactttctttattaagatttatatattaggattaaagtgctaaataatgcaacaaggatcagcaattgtcagtcaagtgaaacaggttctttctaagcaagggatcatgaagagaaatataagatattaaatagttcattttaacttagaaatataaataaacattgatttgtcaatcttttgatgttatttaaagatacaaaacaactatttaggaatagctaatacctactccagtattcttgcctggaaaatcccatagccagaggagcctggcaggctaaggggtcacaaagagttggaaaggacttagccactgagcatgaatgcatgaacaatagaagtaattagtctaatcatcctctattattaatttattcctgttttccatatgtcctagcacatactctgcactatttaaatgaaggtcttaaataaactattcacagagatgggtagatagatggacagataaacagatgaatggaaatgaatcaactattcaacagaaagcaccaatctcatcttaaattagtcatacctagtatgacctagttacgcatcagagaaatggcaaatctgatttcaaattagtcaaacctagtgtgacctagttgtgatcagagaaatggcaaaaccaagtagcaagtaggtgagatagagcaaggtgagaaaatggaagaagtcaagagcagaagcacagtaaaagcccctcatggaggaggcaagccctcaactaaggtagaggagaaggctttacaatcaaatgcacagcggcagaaatgatgacctgtgggccacagtgacatcttagagtaggagagatgcgtggaagttatgcatgactaagaacagaagcaaactgtgcaagaaaacacatgctcttccttttaaccacat

SEQ ID NO: 32582 - DNA, 985 bp, Bovine  19866881197897
gcatggtttcgtacctcctcaacccagtattgaacccagccccggcaacgaaagcactgagtcatacttaccagatcaatgccagggaattcccaactttttgtattgattaaacaataattgcaagatcatattagataggaagtatcaaattaggatgaaatgtgtaaatatacatgtatctatgtatatatttagataaactttaaaaaatgtatatatttatataaactataaatattgtatacatagcatttatttctattaaaagtcatatccaatatatcaaatcctactcgttacaatgctaaaacaacaagaaattgctcaagaaacagataaactttaaatgagaaggtcctaacctttgtactgctgaactttaaatatgtaatttagtataatattaatatcctggagtgacatttacacaattctttatttctttagttccctgtacttcaagatggatgtagagaattaagtgattatgtgaaactattaagcttctaaaacacaatctgctataatgagtatttcatttgttgaaaacacctcacgttcatccttttcaatacctgcctgagacaggtatcaatactgatccagttcatttcatcacactagcagctattggatgtcctacaacatggcggccaatcctgacactcatgaagaaaagtgtctcaaatacatgaaggactataaaaaacacaaagagaatgaaaatgtcatagattttgaaggatgtatcttaagtcagagaaactcaataaataaccacttggcttaaagacaaaagaagaatctccaactgatttaaaaaccacaattaatcaacttagaaagacaataaacctagcacccagattccacattccgtttctcactcaagaaccatagctccttggagaaagagctgattccagggatgcgcagcaaaggtacacaaggaggagcctggagcatcttgttacaccagaaa

SEQ ID NO: 32583 - DNA, 1621 bp, Bovine  19866881313822
acacacagtaaatgctcactttcagttctaaaacttcccaattgtatataatcagtccagaactacatacagttccataaaagatcatttttataacattctgaaaaactctcttaattattacctgggaatgtgggccagttctttgacttcccttagccttggcatcttcacgagtaaaacaagcatagtatagtttcaagggctccttgtgatgttcaaatgaaacagtgaatatataaagcccaaaatgagtacaaggggccattcttgttgttataccccagactctggactaggaataacatgtgatggtggtaagaaaataatgtagggtctaaatttccacaatagtaggagacaagggttcaatccctgggtcaggaaaatccactggagaagagaatggctaccaactccattattcttgcctggagaatcccatggacagatgagccaggggggtcgctggagagttgaacacaactcagcgactaaagaacaaaaacatgcttagtaatccttcacagggaacctggaacacagtctgggatgtggggaagcatttctttctccttaaaaattaacagaaaaaatggcatgaagagcttaaactttggagttaaataaatttgagtcaaatctggttctgtcacatactaggtaaatggatggaatcaagcaaattatttctctaagcctcaacttaattatctgtaaacagaaaaataacaatatctgcttcatgatactgtttaagaaaaaagagggataatgtttaaaaggtatttagcagagtatctagaagattgtatgtgccaaataaatggtagtaactgttgttttaaaaaaaaaaaaaaagattaattttactttaaaggaagtattctgtggcagttacagtttgggacttttttctcctcctacttacaactctcactgctcgtattcactttaccattatactggtgattttagaaaataagttttcaccgatgacccatgtttacattaaaacaatatatgctgaatcttgagttcatgcctgaacttgtttggaattatagagatgagaaggtatcactaccattttaaatatgattattggctattatcttgctttccttttaagacaagggcaaaacatttttactatatgcagaaacattcctgttgacaatttattcatcactgtttatgacctgcagttttctttcaaatcaagcaattagattttacacaaacttccataaaatagcagcaaaaatgacttcctcagcatatttagtatttttttaaggtttcccagatctaacaccctccaattaatatttatcttcttcctcccaacatcaatgactatgctgcctaagggaagccccatgccacctaaggcacttgaggttagtaataagattgggctggatgaaataatacattgcattataaagaatgaacatctcatccaaatgaaatatgctaggagactaaagaggctaggagacaactaattgtaataatattaagaaacaggtaacaagtcattctttctcaatgcaactagatctactaactgccatagctactttctacttacattagtattacctcaagggatcta

SEQ ID NO: 32584 - DNA, 1937 bp, Bovine  19866881409682
cctaagaagatcccctgcagaaggaaatgacagcccactctagtattcttgcctagagaattccatggacagagaagcttggcaggctacagtccaaggggttgcaaagagtcggccttaacttagtgactgaacaacaacctgaagaagctaaggtggcaatcaatattgcattattaggatttaattttgctcttatgaaagaaaatatatagaaagaattgttttttcccctccctctataatactatattttttgagattagttgttgactaaagtaaatataaattaaagtattaattggtgcaagggtattaacattgaatagcaatcatgcaacatagggttcttcctgttgattgcaatgactttgtgtcttttatctatttagtgaactcctagtgatctttcaagttccaggtggcacatcacctccatgaggtctttttctctctgttaagcatagttggtagctctttctcagtggtccttttactgcgctgaattatctattatgaatatgtgatgtcagttgctcagttgtgtccgactgaaatgcttcactggctgagtcaccagggaagcccccgttataaatatagatatctgttatatctactatagccatatcacaatgtattataattacttatgtctttttttcccagaagatagttttcctggacagagatgatgccttagtcactatcttaatgtcagttccttaattaagaccccatatatagtaggttcttttgctgggaaagtaacaaacaaaatttcttgcctctacctagagtttatttgtaacaatccctgctttggggcctgaattagaattcggtggtgtaaataaagccactatgtctgaaaatcttacatggattttctagataccataaagagactgattaaagatcctccaagttaaattaaacagagttacactctccactgcatcgtaagtcaatttaaaaggattttatactttattcagaaaaggcaatatcatgagtcctgttttattaatacctaaatatgttatatactttgaagtattcattggttggttttgaaaggttctgtatgatggaaaggatattgaaggaatcagactagaaaggtattttatttatttatttatttttttttagaaaggtattttaatcttctgtacttttccctgtaattttgtaaggttgcatcccatacatgtcagtaaaaataactctatccctttattaaaacttcagtgtcttcatttatatttagagtggtagcaacataaaattgaaaacctgagagttgtgaaggatataaagtcatgttttaatagggaaactaaattgctccttcaaagagcctataaaactgaaaagcattcattataaatgtaataaagacttacgagtcccattttattaaaactacacccagtttcctgtaggggctggatcatttagaggtaaaccagtgacactttatgtctagcaacaaactttccgtgagataagatatctactgaaatgaggttggtggttttaacatgatccctaatggatatccattcatgttaaaagattagaacttttgctgtagctgagtttgtagcttctgataataatgcacccagaccagattaatgaccagtaaatttcttactactctaagtttcttgaagaaacagaacaattgtgaaagataaagcttatgcctctactaattgctgtgttatatcatcctatcatactgtaaaattcttactcaagtcaaattatgtagattaacactgtcacaggataatgactttccactggttacctttggcctctctttttcctttcaggtacaataatgtttttaatgtggtacaggagaatcattctcttttagactttagctgcttttcaaagattttcggttacattttccacag

SEQ ID NO: 32585 - DNA, 1913 bp, Bovine  19866881434085
tttttttttttgagtgcctattatgtttcaggcactgctctaggtacttgggataggtcagtgaacaaaaggattagagatcctcccctgtgaataacatgaatggtctagtatctcctagaagtatctctctaactcagttccactgccaattattctattagtgatttaagttgttttaagtctgtgtggaaagacactattagttttatatttccaatgacctatacattttatcttatgttctgcttaagccttccttttaataaagtatttattgatttcttatgctatgtgtgctatgtccagaagaaatgaaggatttatttcttgactaagtagcatttgggcattttgtcttgctaataaggtgtttcagtcactgattaagctctattaatttgtggcctttgtgcagttggtctgtttgataagatttcatcctttaatactatatcctcctttttttcctactttgtttttttgtccctcccttttcttcagttaatcctgttttccaaccttaaccctttcagcattccacaaaaaggatcttctaatttgagctttaaaaagtatttgaaaatgctcatatcttgagtgcacttgaattcctattctctatttgtactttaaattgttctcagtcttcaaattgtgcttctttttattcaccataaccttgtatggtgttgttcctctgaagcctacaacagtttaagtgtgtgtgtgtgtgtgtgtgtgtgtgtatgtttgtgcttacacacgtttgccagtggattagctgagctgcaatagaaatgtgtatgtgtgtttattaatagatatataaacatgcagattgtgttaaaacgtaagagaaagagatagcttacagtgaaccatgtcagattcgtgatctccaaagacttagcttcgggaccagagaccaggcttgatcacttaaaggtttctgtgtagcagcattttattaaagtataaaaagggacaagagggctggagggctgcagtctgtggggtcccaaacagtgggacatgaccgcgactaagcacaaaaagggacagagaaagcttctgacagagacatcagaaggggtgtcctactctctggtcttatcaaggccttatatactttaatggagaaggaaatagtaacccactccagcactcttgcctggaaaatcccatggacagaggagcctggtaggctacagtccatggggttgcaaagagttgcagattcactcccactatatacatcttaagttaataagattagaactaacaatagaaaggtctcacccagacccactcccatataagataatcagattagtcagaagtttcctgttaagatggagaaacttttctttgagcaagatacttgttatataattgttagtatagagcttaaggaagaatatacccttgagcaagatgagttgttttgttgtgtaatcattagctctgggcttaaagaaagttagtcttaacaactcagagtttaagaaaaaatgtcttatgtgactaagacaaagcaatgtagaaaaacaaattcatgagtctgataatagggaaacagagaagtaaataacaagcttatttcttccaaaggataagggaactgtttttttttttttttaaataaaactactgcatttaaaaattactttcatgttaactaaggctatacatttaatgttgtatgatttatagagaagtaatttgaaattctgtttaaacatttttgtttttcaaaattggatactgtcaagatatatatacagtattctttacagttaaattttcacacatataatgcatttaaattatatgtgtgatataatggatagaaaatcaaattactcctcttctaccacatccccatttctttccactgtacctctgtagaa

SEQ ID NO: 32586 - DNA, 1495 bp, Bovine  19866881481865
cttaagtctcagttttacaaatgactcaatgttgagcataattactgcctaactactgatgcaagcctagaaaatatccccttttaggttcagccacatttctgtctactatgtaccatattctttcaaaagtttttttttttttttccctctcataaagacatgcatctgtgtatccatgggttatgtctaacagatctaagaagtaggttaggttagtttgaaaagcacaggatatactcaatctgtgttagtcatcaagcctcttgtctgaaaaaccttggtgaaagcggaagtgagctgatgacaggaaaggaaattaacaaatgagaaagctgacttaagagttgtggggaaaggatgcattaaagaaaaattttcagcattctacaaaggtagaggatggggtagtgttttttgtttgttttttcatggtctcagtgtttttacgcatccctcgactctcaaaacaaaggcaaagaacgtctagtatgtcactgcttatttctattttgtcagcacttttactaaaatgatgttttgtttttctcctatgtcagtacgttattttgtttctgagaccactgaatatatcccctggggagcctgagaaagccttcaggaacttttctgagtaaatgcatccagtgaatggaacacaagacaaagaaacctgagatcagccttggatctgtgccttctgaagaggcacatctattcttatgatcatcaggaaacatttctaaaatgtttaggatgttcttaaataaattttttgctacaaatataaggctgctgatgtcaatataaaaactctcagtcacaagaactcaagctttcacactttaaaatctccttttgagataaagtcagcagcaaaacttagaaacagtgaactatatcatactacagaatattaaaacctgtaattgctaaacaaattaatcattttgcattgagtattttaattcaaattaatcaaggtctttatagtggtgaggtaagggaattcaggaaagcaaatcattttcaaagggaagttagatttatgtgaagcattacaaagggaagaatcagtgaagtggcaatctgtaataaaaagaaaagaaaaaagtgggtcactagggaaagaagcaaatcagtgctaaaatcttcaaaacctccatcttcttagtggacccatttttttaagactgcagtaaaaagaattctatttgaagtattttaatacataggcatttagaaattcaactatacatagataattcagtaaaaaaaaaaaaaaaaatttatgccctagagataagattttctaatcactctgttgttttgacttttaaagtgtccttttctctctttcagctactcgttaaccatgataagagcttccctatcttaaagacatttaaaaatacttcattttgaagaaaccatcaaagggacttcagctggcatatatgctggcatcagggcacaccaaaggcccaagtaacca

SEQ ID NO: 32587 - DNA, 1049 bp, Bovine  19866881493733
ctagaaaagagatggtattcagtgctatctctggggatgcaattaattctgtgtgggggcacagaaagagctacagagaagaggtgacagattaaccccttataaaaacctcaaaaacatgaaaatgacctcaaaatatgaataataaactcctattgtagataatggactttgcagcctttcatatctgagtttcaaccccagttctaccctcctgttggccatgtaaaatggatcaagttgtttagaaatgtagaaaggaggtctcattctgccaggaactgtgatcttaggcaattcccttcgcctctctaggcatcaatttcctagtctatgaaagaagtcatgaagtcatgctttaagatctttaacttgccctctgattctaacatgagtctatattatatattatagaaattcctatcctctgttggatgtgttcatttagcaactatttacccacaatacgtgagtacaactaagtacccacaatatgtcagtgttctagcacatggaagatgccagtgaatgtaatagtccaaaatcacatgacaatcacagaaaatatctattgaataacttataattcaatagatattgagttatctctatataatttatttgctttgttgtctccttgctcacaatcatttccctgcaagtatgacatgtgtatttaaaacagttaacactggtaaacaaaagaaaaaacacaaacattaacacaaaaagagaaattgaaatgaagatgaagtatagttagtaacactgccatcaagatgatagtttctctaaattcacattcaatcagtgagccttagcaacctgacaaaaaaagacagtatgttaatgagctctctaaccaatttagtatacagccatcttttcttcctcatttaaactattacatagtttcttaagagctatgatataaccaggtaagttttatttaaagataaataaaatctgtatatggcaagcaaacataaaaatctacaatatcactttttcagatatttcacttctctatctgggtatttctggctttt

SEQ ID NO: 32588 - DNA, 1062 bp, Bovine  19866881496594
gaatagaggaactgcagcatttctgagcatcacaaatacagtagcagatctcttgccgactctcagttagccagcctctccatttatccctttgaaacatgcaggctggagcccttgggcagccaatctttaccacataccacttttctccctcccaaccctctgagttgtacactcaaagggtacaactttgattgttttgttcccatacttattatcagttgttcttgttgctatgcaaattgctcataagctgatgaaatcaaagtgcaaaaaggcaagaattattgtaactaagaaaaacaagtactttgcgtcactaaaatgtaataaagatgaatcactaaaaatattggggcttcccaggtggtgctagtggtaaagaatttgccttccaatgcaggagacataagagacatgggttcgatccccaggtcaagaaaatctcctggagacaggcatggcaacctaatccagtattcttgcctagagaattccatggacagaggaaccttgtgggctagtccataggttagcaaaaggttggacatgactgaagtgacttagtgcacgtgtgcacacacacacacacacacacaaattaatataaacataatgggtatgaagaagcctagactaggtaattagaaaaaagttattcaaatctaaaaggattccacgctcagaatgctttgtgtcttaaattttcttttttaataaaccaaactaatttattgcagataacacattggtgtctgtgccttacacaagaatgattatgcaaaattccacagtttttaaaggaaagagtttcagccttacaacagaaactggcaaatagagataagagtataagttcaaggaagcctggagaagattctttaatatttatcaatactaccacacctctctttcatttgactccactcattagatgggattactgccatctgttcttaaggatgacattgagcatcatctcctcatccctgatctgccataagcattgcctgcatactcaggctaatgtactccggtttccagcgaaggactcagcaaggt

SEQ ID NO: 32589 - DNA, 698 bp, Bovine  19866881563319
gcctagctgggcatgatttactatttactaaagaatgaatgaatggatagatacctgaatggatggctagatggcagcatgaataataaaccttattttaactaatttagtatgaaaccttttaaaaaaaatattgcttgctccagaatgcagctgggattcagactccccccaccctaggctcctttaattttaaacatctcatggttgataataggcatataacaagttcctacagtatctgtgtatgcgtggtagtctcagttgtgcccgactctttgtgaccccgtggactgtaggccaccaggctcctctgtccatggaattctccaagcaagaatactgcagtgggttgccattcccttctccagggcatcttcctgactcagaggtcgaacctgggtctcctgcattgcaggcagattctttaccttctgagccaccagggaagcctacctgataggacttctggctaaggttttccccaataaacacaaataaggaaaaatgcataaacagaacaactgcttcagtatcagttaccaaagtctcaagcagaacgcattctttaaaataaaattcaatataacaaagtctattacagccagaaaaattgtgcaattttacttttttttcatcctactacctgaagcaaatcatttgaattcctattccaagtagttagaagttaatgatat

SEQ ID NO: 32590 - DNA, 803 bp, Bovine  19866881801793
ctatgaatatgataattgtaatatggctctctgtgcttttagaggtcataagttacattgcaaagacttgtgtatttggattgctgcaaagttactgtagagtgttaacaaccccaataggaaacatttaagtgttagttgtatgtctcgtgtaaattgtactatacaattaagtatgaatcatcaaaatgttccaggttattaagaattcattacttctactagaggatctttaaagagcagtaagaacttgaagaaataataggaaagctttggtaacaatgacagtgtgttaatcgagttgaaagaaggtaaagaatgtattaacagaatggacacaaatttggcaaaaaaaagaaaaagatatgtaataaatcaacaggagaaatcagttaataaagaggccaattatcagtgaaggaggggggtgtatttaatgattctaaatgaaaggttaaactgcttctgtgaatttctgtttaacaaaaaggaagaaaagcaatatggataattagacagtaataagatcataccaaaaaaatcagaaaactgccttaggtgttaggggaacattggctaatgaacttcatctgctgcagttatcttcaaatattcacttttggtctaggaatggagagggtggggattttggttattttcagggaggaaatagcacatttagcactttaattttattgtggatttttaaaatggtagcaaataatgaaatggataaaggatttctcatgagaagcatatgtaacatctgtcacttgttaaaatactgtattttcactatatat

SEQ ID NO: 32591 - DNA, 991 bp, Bovine  19866881514546
aaaaaaagaaaaaaaaatggacattctaaggaatatagaatataagctttgatgtcatagtcacttggatatataatcttatccatctatttatcctctgacaaaagtgaaaagaatctagtcagacttgaaatcaggataacttgaaaattagaacaacaaaaaaaccagtgactatacaggccaatcagtaatttgagattcatgactaagtttcaaccaagctcaccctaggaaggtatggtttactcagtatgatggaaaaatatcagaatgagaggcaggagacctggattctagctcttttctgctcctcgttagctaactagatttgtaagaatggtcacttcatctttcttgcccaaggtgatcacatcaataaaataatgggagtggactagattattgcaaaaatctttccagcactgaaatgttaagcaatacattttagtagactgctgtaagatctctaaatgtgagttgatgtctcttagttgagtgcctcagtgggagagcaacaattattcagaattaatatggatgagaataatcccctcaaagctttttagaaaccccaatagattcttcacttagtttaagtaattatccttattgttaggactgataataagaacatgcaacaaattcactctcaatcacctataatatctatttgttttcttttacactcagggtaaacacacttttagataattacaaatcttccctttttgttcttcaaatgctcacaattacaataattcttttcgatcttcttattcagagttctttttaaattctaacaaacaaatcaactgtttcatctggaagtatttctaatcaatcttttaactgctcaaaggaatctgtatttagacagtttagaacatctcatgcctctcacagttgggaggctctgagcaatcacatgtggccggaaaaacctattcaggcaggctagaggacttccaagcgagtttgtaggttgaaa

SEQ ID NO: 32592 - DNA, 1000 bp, Bovine  19866880542114
cccagtccagctacactcatctcacaggtccctggcccacacttgagctgacttaccaacacttgaggctccagccacaaatgttcacaaacatatttcctactttgtcccctcctggcttttgtgctcatccctgacccttcactttcatttttcacttttcactttcatgcattggagaaggaaatggcaacccactccagtgttcttgtctggagaatcccagggatgggggagcctggtgggctgccgtctatggggtcacacagagtcggacatgactgaagcgacttagcagctgacctattgtgctcatccttctggcccctccctgccaggttcacagagttgtcctgcgtttcctggtgtctgcagctgtaagcagctgcaaggggccaggctgagaccagagcctgaggcatcccaccctaccccgaagggacacaggcggcccagtgcctcccacctcagtgatgttcttagtgactttcgcctccacgtcgtatctctcctcatccaccttgtccacacgagcgtggagctgtcggcacaagtcctggtggaggaatgcggtgtgtgtagtgaggagaaaacccaggggtttggactcctgggtctgagggaggaggggttggggacctggaggagtagattgaagccagaccctggggaactttagagtcagaggttctgagaatctggactggagttgggctggaggaaccagtctctgggttttgaggttgtaggcagctgcaggccacatttctgaactcctaagggtgaggattggcaaattggacacgaacgtcctgggaagagtgggggcatcggtaagtatacccctgagtcccaagggacgcaagatcggacactaggaacctgggagcccaggctgggacggagtccctggttagaaccagtacctggagctccgcgaagcccagcccggccaactccagaggctggcaccgtgtgctcagagcgcgccccttctctc

SEQ ID NO: 32593 - DNA, 1019 bp, Bovine  19866880639011
atggctgattcaggttgatgtatggcagagaccaaccccagcattgtaaagcaattatcctccaattaaaaataaatagaatgaaaaaaattagtccatctggagggacttccttggtggtctcgtggttaagactcttccttccaatgcagggggcatgggttcgatacctggttacaaaactaaaatccccgcatgcctcacagtccagctccccgccctcctccaaaaaaaggcaacgagcaagacaacagtgagtagactgtggctctcatagtccactcacgctagatcccctcccaactcgcataaccaatctcttagacgcagccaagcctgagattctagtgacggaagccttggttgtgaccatctggtcgacccctatgctgatgaccctgtggtttctgggtctgcgggaggggtgggagtggcctgtgtgcagctctgatccggtgcatcattggaggtttccttcggctgtgccagtcttctgccagaagccccaccaggagaattagaatcacagccccaaggcatatccgggccagattgcccttagtgtagtgctggagggcaagacctggaggaacaagaagagacaggagcagatgataaaagcccagctccaaggggacttcccttgtggtccagggattaagacttgaccttccaatgccagggatgcaggttcaatccctggttggggagctaagatccctcaaagccgaaaaaccaaaacataaaacagaagcaatacaatgaagactttaaaagtggtccatatccaaaaaaaatagtggtaataatcttgggacttccctggtggtccagtggtttaaaatctgccttccaatgcagggggacacaggctggatccctggtcaggggactaaggtcccacatgccacaagcctgtgagcttgactactgagcccaagaaccacaactagagagaaaaccacatgccacatcaaagacgcctcaagctgcaactaagacccagcccagtcaaaaat

SEQ ID NO: 32594 - DNA, 936 bp, Bovine  19866880689726
tagctgtacttggctatatagtacttggctcccaaggggaatggatcttcaaaggtgatgatacatggttgacatggatcctgaataaatgacataattgggtgtctgggatcctgggagatgatgatgtcacagttttggtgtatcccagttgatgatggtaccaaggttgaagtggatcccggaagatgatgatgttggatgtcatgggtcccgggacaccatcgactctcagggatgctggggcctggtggcatcatggctgaattggctcctgggaggtgatgacagcatggttaaggtggatcctggggcatgaagacattgcggttggagtggatcctgggagatgatgacagcacaattgtgggggtctgtgggaaactggggcatcatcagtcctagtggatcctggtagaagatgtcaccatcggccatactggattctggaaggtgatgacatcactggtcatggtgggttctgggggatgatgacatcatcagctgtggtgaatcctgggagatgatgacaccatgttggtggagaatcatggatgatggtgacaccattggctctagactaccttagaaggtgacactatagttatgatgaatcttggatgagaacgagaccctagctgtggtggatcctgggagatgaacacgccgtagatcatagggaaccctgggaaatgatgtcatcaccagccatggttaccacgggaccccaggtgcaatgcggccatgagtggtggaagtcttgtggtgccgatgatgtcagtagcaggcacaccccaccccccaccccaacaggaggccaggactctgcagagttgatgatgtctgtagttgtggcagagagatgtggggccgcctaagagtccccaggactctaggagcaatggagcggcctccttgggagcagaagccagtctg

SEQ ID NO: 32595 - DNA, 2078 bp, Bovine  19866880696449
tatttattgagtgcctatgaagtgctggccccaggtaaggctcagaagcagcaccaagaactcatggtctctgggggtgacccagagagtagatggtcccccccccccaggtatcccagcatcgagcccccagcccccagagaaatcatctctaagtggatgtgtatgacgaatttaattcccccttctccatctcacaaaggtttctcacatttttgtacaaaaacccagacctcctttccccctccctgcccaccccaacacaaaaagttaatagtttaataaataataatatgctcctgcccaggcccagaggggtgggggtcagggagaccctgtggccagacttattagagacccatgaatctgggggccaagttccctcctcctcatggaccctggagtccacttgcctcccaccaccccctgttaaataaataagtataaataaggcacagatgcccctctgcccaggtctccgggacggatcctggagggatcgtctctaactaggagagaatggagtggggggatggaaatcctctgaccgccgcaactccatcccaaaataaataaataaataagatctggctttgaatggcgctggtggctctgggcggagggtcacagccgagtcttcagcagcagcaggccccgcacggcccagtcgagcgtcagctgcagcccccccaggatggcatgggccgcccggatgcccccccaggctgaggctgggggtgccagggggggtgccggagggtctgggggtacctggggcagggccaggcgggacatctgccaggagagaacagagggctagcgtcaggccaggggtgcagcagggtgtccaagtagggggaggcgtttgaggcctgtgctgaaccagggttggagaagggccagggggcctctttctacagcgtctcggggctggaagctggggtgtcaagggagagagtcctgcaggatgctgagttcagaagtgtgaggatggggttccagagtcaagttcagggggctggggtgggtctgtaaggtcagggctgggatcctggggctgaggtcttagatgtgaggtctctgggatcaagctcagacactcatggatgagggctggggcctccagtctggggtctcagagctgagaatcggagtctgagttccagggcctttgggctcatgtccaggaactgaggactgaagtcttaccacctcagggtcttgggtctggggtttagaaaggcagggtcttggggtcttaaggggtcacaacctaggtctgagctcttggggactcagggctcaaggtctgcggtcttcttgttggagacctcaggatctaggtccttggggtctggggcttgcagaggagggtctccaggctggttttgagtcagagatcatccttataggatctagggtcttaaggtgtcaggatctcaggggcagggtgtgtgtgtgtgtgggtgggggggcgggtctcagggtctggaggttcagaattccctgggcttggggtctggaatcttcctgtcttggggccaaggtctccaggtcttgggatgagggtttggactctcaaatcttacgacttcagagtgggagactcggagtcacaagatcatggggtctgagtctccaggtgagagtttagagtttccaggcaggacttcggagtccaggggctcagggacacagagggagggtctcagagtgggcctggagtctggggcctcagggacagggggagggtctcagagtgggcctggagtctggggcctcggggacagagagagggtctcagagtgccctggagtccagggcctcagggacacagagagagggtctcagagtgggcctagagtccgggggctcagggccaggtcatcgtaccaggagctgcagccggcgcagcagccggtccagccgggcctgcagggtgcccagctcgggctccagggtccgcagggaagggcctcctgaacgtcgcagccactgcacatgcctcaggtaggagaacaggtctgcccgcagccgtgtcaacactcccgggagctgggggcccggcggggggcggg

SEQ ID NO: 32596 - DNA, 3480 bp, Bovine  19866880834127
cccctccctgctcctctcctccgtctccccctgcatccggccgggcctccgcgcgggtcccacaggaatttctctaaaacactaatcggatcatgtgactctccagtttaaaaccttttcaatagctcctcagtacactcgtaatgcgtccggccttcagcctggactgggaggccggacgtccttgctcgtgcggctctcgccatgcccccatccaaggccccacgtgtcccctcaaggcacggattcccacggccgccgcctgcacatatggacagcacgctgatccctctgaaactgctttccctcaccttcattcctgaattcgtttctttcttttatttaggaaaaaatactttaaggccttaaaatatatataataaaataatagcacacacacctaggtatgtacccaaaagaattgaaaacagccattaaaacaaaaactttacacgtaacgaatgctcctaacagtactgttcacaagagtccaaaggtagaaactacctaaggttcatgaacaaatgaatgggtaaacaaaatacagtaacccatacatggaatattcagttcagttcagttcagtcgctcagtcgtgtccaactctctgcgaccccatgaatcgcagcatgccaggcctccctgtccatcaccaactcccggagttcactcagactcacatccattgagtcagtgatgccatccagccatctcattctctgtcgtccccttttcctcctgcccccaatccctcccagcatcaagtcttttccaatgagtcaactcttcgcatggaatattactcagccataaaaagaatgaagcattggacacacagcacacatacgtggtgacacatggatactaattggcctgccaatgcaagggacacgtgttcaatccctggtctgagaagattccacataccatggagcaactaagcccttgaaccacaactattgagcctgtgctctagagcccatgaactgcaactactgaagcctgcatgcccagagcctgtgctccgcaacaagagaagccactgcaatgggaagccagtgcaccacagcaaagacccagtgctgccaaaaataattaaatcaaaaagaatgaggtgttgacacaggctacacatggatgaacctggaaaacactgtaagtgaaagaagccagtcataaaggactgcacactggatgactcaactgatatgaaacagccacagtagacaagcccatagagacagaaagacgattattggttgccaggagctgaggggagaagggaatggggagtaacagattaatagatctgggtttctgtccagggtgataaaaaagtcctggaactagacactggagttgattgtacaactttgtgaatgttcttaatttcactgaattgtacacagttccaattggctaaaatagtaaatttttattttttattttttggctgtaccgcaaagtatgtgggatcttagttcaccaaccaggtgtcgaacccacaccccctgcagtggaagcccagagtcctaaccactggaccaccagggaagtctctaaagtggtaaattttatgttatgtgtattttaacaaataaaaatatacacacacacacattcatatattgactactagttttaaaacataaggtactcctgactgcatagatctttcccctcccctgactgcctctcccttctcagaggtcaccctaccccaaatttggtgcttattgtttccatggatgtgtttagacttttgatccttaaaatacagcattatcgacccactatcatctctctcatctctttgtgagatagagacttagacccaccactttgaaactctcaggacctcactttactgctctgtgaaatgggagagtaatgttacccacttcctaacaggctggaagggattgggggcaggaggagaaggggacgacagaggatgagatggctggatggcatcaccgactccatggacatgagtttgggtgaactctgggagttggtgatggacagggaggcctggcgtgctgcaattcatggggttgcaaagagtctaacatgattgagtgactgaagtgaactgaactgaacacgaagaggaacaaatgggtttgtgtttgtaaagcacttacattgtaagtcatcgtttattttcatttcatcccatactttgtgaagtgtggaacacattcactatggtttcaagttccaaaagtgcaaaaggagagagtgtaggcactttcagtcctgggagttagacaatgttgcgagctctttgctctcctcccggttctcccagttcacccagacacagcctgctgataagtgcaaacggggcaagctgtgctccgtcttccaaatttttctctgttatcacttggaacctttccatatttttacacagcaaacttctttgttctttcttttatgaacacacagcattcttctgggtagatttatcactcaaatccctgaccaatgggcatttagttcacttcccctgttttgaagcaaggcacaatactgcaacgattaacctgatacagacacctctcctggcatgtttctgagtagcgctggtatatttctttcctatttccatttgctcctcttcccatttctaactcttggttttcatcctgcgggtttcagcagaaacactgttgcctccaggaagccctcaggggtcactctcactcagaggcgagtctgctccggtaatcccacggcatcctgtttcctgccttggagcacactctccaggagggcaggagggcctgtgactgtctcctgctccgtcagaccgggagctccctgtgcactgggtccggtggcctctgtcttagctacttcagctccagcaccaaggacagagctagctcatagtaggtgctcagtaaacaccggtggcttcggatggagtgaaagtacgtagcacaatgagtaactggtttcttagcgtcaagtggatagccacgggggggttaatcacggagggcgagactgaggctcacagagggaacgtcgccttctcaggcagccgcgtgacggctgcagccaggttcccgtcccgattgcggagacttttccgtcgcctgtcactcagggccgcattcaccatctttcccggccacccgcctcgccccgcacagtgcctggcgcagacaggacctgatgaatgtgcatgtgttgaaggaatgaatgggtgtgtgtgtgtgtgtgtgtgtgggtgtgggtgtgtgtgtgtgttgtgagaggtgggggctgacctcctggaggcagaggacgggccctcagccccctccccttagaggacccaggcgtccgagccgccctgcgtccccgcctcctgggtccccccgtccacccgcttccggcctccccgccagccttttccccttccaggcgcggacgaggagccgggtttccggggggaaggcttaggcggcgacaccgaggcggcct

SEQ ID NO: 32597 - DNA, 1249 bp, Bovine  19866880838614
gccccggcccctccgcccccaccccttctgccgcagcaccagccctggctccaggactagcgcagacccagggtccggctccggcttcagctcggtctcctagggacagctgcgagaacctcaacaacttggactcaggcaagaagggtgagtggtggggacaccccttcgagggaacggtccttgtcctcgctttccaggcagagaaaaggagactctgaaaaggaggttcccgaccacccatcacgtgaacgctggaggtccctgaccctctgggcccttcgccctgagtcgtccctttctcctggtttcccgcctgtagagaaattctccccgatgctcatgctcagtatcaacaaggagctgcaggcacgcctggcccagggcctcacgggccccagccgcgcagccccggggcctcgcgccccggagtcgcagctcagcccgcactccagcgcctctgaggtctgcgcctggctacaggccaagggcttcagttcagggtgagtgtggcgtttgccggctaggaggctagggttatacgcgcgttagaggcgaagcgctcccaatggcccagtgggagtggcagacccgggggcctgggattggttcaggacgggggccttgtctgagtgcaactatgaatgtcaggctgtgattggcctgttttcctaggctccgattggagtcaccacggaaacctcgcgctatggttgatagagcaggattcaggaactttcagcagctgattggacaaaggcctaggggcgggcgtgacgtggttggcggggctgacattcgagctgcgattggccggcaggcctgaccatgccctcaatgcccctgctcaggaccatcgcggcgctgggagaactgagtggcgctcagctattctcactgccgaaggagaagtttcgggcgcttatccccgaggagggggcgcgcgtgtatagccagatcacggtgcagcgctcgctgctggaggtgagccgaaaccctcgtccccaggtccgggccggggagggcgctgaggatgctacggtcctgatttccaccccttcctccaggacaaagagaatgtgtcagaacttgaggcagtgatgaagaagcaaaagaaaagaatggaaaacgaggtagaaacggaagtcttttgatcctttccctcccctccgctcaaagtttcgaggcagcctctcgggagatcggactctgcagactgccctcgccagtggaattagatccctccagg

SEQ ID NO: 32598 - DNA, 1053 bp, Bovine  19866881089863
acgcccctccgcccccgcccccacccccgcgtcggcccctagtcccgcccctaccgtggttgatgaaggcggcagggccgagccacagctgagcgctgcgcttgcgggttgagtacatgatgctgaagtcgttctccccggctctcagcagctcctcgtcggcctcccgcagctccgcgatgcagcccaccagcagctccagcttctcgttctttttcctgccaagaagccggctcgctgtgggtcagtgagtacctccccaaccaccagcgctggggacaggagcctctcatcccaggcctcctgtgggaagaactgatgccggccagcgcgctccactgcccaaacgtctctgaaagtcccactgttgccctacacccacatatgcctggcgtgcatcctgtcctactctcggctcctctggcgcccactgcctcagcttcccgcggtccagtcctgcctggaagccccccgccacccaggctcttcactagacccatcagtcattttgtgggtctcagcctcttctcaaaatccccaggcaggctcaggatgcactgcgcaaccgtggtcagccctgtgagcgcgcaccactaccaccccccttctcactagactgcaagcagagggcagtgttcttcttgctcactgtcctgccctcgtacccagcagtgactgctacttgaggaggggggggtctggtggagatgagataaaggacagcagtgcactcttgggcacaaggtcagtcctttcccagcagcccagggaagcctgggtcgctggagggggggtctcatctcccagagggctgtggtaggccaggggggtcctgggggccaagccccgcgtcctttctctcaacatcgacatcttcgtggctctgtcgccacagtgctgggtctcctccacaagagagggagtgtcttctcccagcagtccccggggaaagatgcctcctgtaaggcctgggctgcgagtcctgccctcttaccatgcgcgagttacacaatctggctccattgtctccaggaataacgggtacagggcaag

SEQ ID NO: 32599 - DNA, 696 bp, Bovine  19866881159580
gaccgcaagagtttgtgggattgaccgtccgctgggacagacagctgccctgctctcgatgtccagcagatggcagcgaacaccctgctctgaccctagggggccgcgaggacgcaattccaggagtgtgtcggaaagcaagcatgccaaaaaagaagaagaagaaggagaaaaaatagggaggggcgccgcttcctaattcgcgccctagaggctagcagccccgcccgggatggggcgtctgttacttacatcgaagtccacacgctccccctctgggatctttggcgggatcagaggaggtaccacaggccggctgcgtggacagaagggaaacgctgagtgccctgaccttccggcggggcagcatcagcctcacgtgggtcctgagcgcctgccgtgcggccggtccgcatcggacaggctgccgtgagatgcacgccctggttccacagactcggtggaacccacgaatgtaaaatgtttcactaaggacgtttatatggcttagtgtcccaacgatgcgatttccagtacaacgcgttgagtaaaatatgctattgggattcgttttacccattttactttttcaaatgcagctagcaaaaaaataataataataattcagttacatatgggcttgcgttgtattcgtattgggtggtgctgctatgaggggctgccctaatttccagc

SEQ ID NO: 32600 - DNA, 1360 bp, Bovine  19866881246611
ccccctcggctttcgggacggctcttggctgctctgccgtctgtccgcctctgtctgggatcgtccgcttcccacctatctgccgcctcggtccgggggtctctgagcgagcaccgtggccgtccgcacctgtccaccttcccgggccgcggcacccacggctccctttgcctagctgctcttggttcacgctcccctgccacaaatcagccaggccgcccctgctcccccttctcgcaggcctcccctccggtggagcccaagcagcaggggccatcgtgggcgtgcaggcggcccatcccttcggttttgcagggctctcctgagcacacctgtcgtcctgcccgagtctctcctctcctgagcgccctccactccccacctcaccccctctgccccttctcccaccagctgggtctgcgccctcttggtaatgcgttttgtctttctcacctcagctactctctgcaaataaagtccttctggtacttaggtatctgtgatgctgttggtctgtcagcctgggacagagaaggccagcgtgtgtgtgtgtgtgtgtgtgtgtgtgtgtgtgcgcgcacgtgcgtgcaagtgtcccctgaagggcatgttgtggaggagagagactgtggaggagagacagagacagaggagggagggaagcgaggcagagacaaggagaaagggagagacagagagaggaagacagacacagagaggcaggaagaatggcagacagtggtccctcctgtcgtcgaaggagatgctggctctgtgtgtgcgtttgtgagtgtgcctgggggtgagtgtgtttgcacttgttctgcacagaagtgtctgagaaggagagggattaaacagcggagctggaaaatgtctggctattttcgggcaggaactggagcgtgcatttctcaagttcctacctgaaacttgtgtgtatttgtgtgtccatgagcacccatctgagcccgtgtgtgtgtgcaaataatggtgtgtttgtgagagacagagagacgtgagggttgagtgtgtctcactccgcgtggacaacatgagttgcgtgttttgtgcgtctgcgagccccccatgtgctcagggaactgtgtgaccacgtgtgagggtagagagtggagtgcaccttgctgtgtgcagacactggacccgtgtgtgtgcttcaggccttgagcctgcgcgtgtgtgtgcgtgtgcacgcgtgtgtgtagtcggggaagcagagtcccaggtgcggctgccagtcagcgctgggccccccctctccttcacacctcaccctggccccttcttggcagctaccctgtttgcaaacactctctcttcctctccgtggcctccttgg

SEQ ID NO: 32601 - DNA, 1377 bp, Bovine  19866881406822
tctgctcacctccccgccagctgcctggtccagcggatccccttctccctacgcttctgaatcttgacacccccagcttttaactcaccttttttttttttttttttttgcactttaagttctttgtgggggtagctggaaataactataatccctccctgaaagagtgggaagtctgtgatgttgtataggctagcagttaaagagcttagggtcatgggagcattcaggttcacgcccaggtgagtgcaagtactgcattggccccaaagtatggagaaacctggaggaagtgtttggtccaccgaatagaatggaattcctcaggacatgagctcaggccagcctgaccgagtccccagtgtaattatacttctttcttgctctatgacctttacatcacggtttctctcctgtaaaatggagataataattgggtctctgggaggagtaaggaactaagaggttcaaactcatggttctaccaagggctgtcccagtatcaagtcagctagtgtatataacagactttgagtagtttctggcatacagtaagtgctatgtacatgttgactcttgttattattatgcttatcatttatgcatgagcccagtacatagcagatgctcaataaatagcagctgtctctagctgtatgatctgggaaaagtgattttatttctctgagcccgaatgttctcatctagaaaacggagctgatgctagtactcatatcatgtgcttactgcatggtgcccagcatgaaaggagcacagtatattcaaactggcattgcagtgtcaaacctctgttaacagtattaacctgccccctcccctcggccttgaccccctgcttggctttaactccagctcacaccaagccctaaggcgcagcacagtgatgctggctgcctccttacgccccaactcttccccttctcctcagtcacccagacgaggaaccagaagctgagccccaggggccggagccggcgggaaagtgggtcctatgtaattatgacttccaggcgcgcaacagcagcgagctgtccgtcaaggagtgggacatactggaggttagaggagtaggggtgggggcgagggggtggagtccacccaaccctcgctacagacacagtctctgaaccctacgctgtacctcttccaggtcctagatgaccagcgcaagtggtggaaggttcaggaccagagggggcaggagggatacgtaccctataatatcctgacaccgcacccggggccgcgggggggccgcagtctggtgagccggggcagactcctgggtcctgagggaagaggaattagggggtcagatcctgagaacaaggggcgtgggggttaaggggtcaaaat

SEQ ID NO: 32602 - DNA, 506 bp, Bovine  19866882143417
ctgaccctacaggcggcactggggcctcacatgggcccagagggcctgagctcggactgggaactggcccaagggagaggtggtcagggggtggttgatccaaggggtgggccataggagccagatggtccccagatgaccccacaggggtcacagtggggtcaggggctgagtgtggagtctgggtaggtggagaggttacttcggggctctggcttgtggctgctttgaagttctcagtggacggtatgtccatgcttggggcaggagacaggctggactctgaggctggagatgtggaggggcgaggggcccctgtgaaggtcaactgggggtgcaggctgggcttcactggagagggaggttctgttcccaagggagttagaacggacttggcagtgaccgtagaggctgaggtgaggtcaggagtcatggtgtggtaaatagtggtggtgaggtgaggagtcgtggtggggtgaggagctgtagtggggtaaggggcggtg

SEQ ID NO: 32603 - DNA, 1492 bp, Bovine  19866880357204
tgaccaggaatcatatactagtttggctgcaaccatgtcttccaccgccattcctggaatggacagaaatttggtttaacttttgtcagaacaacttttccccaaacagcccaggtcccagaaccagcagttccctaatacagtgcccatcagggtaacaaggactaagcacccagaggtgagttcaggcttgaagagtctgtgaagggtaaaacaaggcaagcaatgctcaccaaagttcagggggtcagaaaactttctgtaaacagccagataataaatacgtaaggctttgcatgccagttacttgcagttactcacctcggctgtagtacacatgtgactttagacatcaggtaaacagatgagcctgactgtgctccaagaaaactttctttatggacactttagtttgaatttcttataatttttatgtgtcatgaaatattcctttcccccccagtcatttgaaaatgtagacaccatttcattgtgggctgtaggaaaacagatggtaggttgggtttggcgcatgctctgtcgtttgttggacctttggtccagtccaaaccctaagtccttcagcaattccccctttatcttagagttttgggcaaatatccttaaccttgaatgggaatatgttcttaaaggcaggggctggcttttatttttgtaactaccactgtacacagtatggagcttgatacatagtaggtatttaatacgcatctgctagatgaagggatgtgccagtaaaccaacccccaaaagtgagaaagtaaaaattgctcaggactgtagatcaggtttccagtgctgtgtctcctgaagggggccagctgacctctgatctgctaaggaacaatgaaactctttcatactcaactagatcagtgtgatgtctctgaaccaggctctagataaagcttatactgtgtttgcctgtctttctatgcatgaaaaattaaaaatatatttaacagatggtaaggcatagatatattttgactggcatgggtgctgggtgggcagagtactcttaatacactgtcaagcgttaacactttgggtgcttgatcattaaaatatatgtaacgtctggcttggaaggaaagttatgaccaacctagatagcatattcaaaagcagagacattactttgccaacaaaggtccatctagtcaaggctgtggtttttcctgtggtcatgtatggatgtgagagttggactgtgaagaaggctgagcaccgaagaattgatgcttttgaactgtggtgttagagaagactcttgagagtctcttggactgcaaggagatacaaccagtccattctgaaggagatcagccctgggatttctttggaaggaatgacgctaaagctgaaactccagtactttggctacttcatgcaaagagttgactcattggaaaagactctgatgctgggagggattgggggcaggaggagaagggaacgacagaggatg

SEQ ID NO: 32604 - DNA, 1671 bp, Bovine  19866880410129
tttgactgcttctggctgttgctcgcaggctgtgtcagatggggctgccaggcagggctgccgtgtcaggagaccttgggggaaggagcagatcccaagctgtagcagatggtgaatgctgtctttagtctttaacatttaagggaaaaactgggaatagacactcggctcagtggcagttatgatgcatttaaataagtcttgcaaatcatttacagaaatgcagatgcctccaaagttcttaattgcttgtggattttgtaggaacttcctctagttcatctttctatcctcagtgtctagtagagagtgtgggtgtggagtgagccccctgcatgctggagtggagaggggggctgcccactgaaggaatgcatatcctgagatgtaatggcattaagtgacagtgaattattgatcatcttcccagggcagtctgaccccttaagagcaaaaactgcattttatgcttttttatatcctccttatatccacccccaatttattcagtttcttgttctatccaaactaatgttgggcaggtacatagatgtcaactaccctatcatattttcctgaaaaacaagaatttctgaataagggaagtaggacttgggaaggtatctcagtttgcttccattcccaatgggaagatgaataccaacttcataaggttgttgtcaacattaagtaaaatcacacatgtaaatggccccagtccatgcctgatacctgggtggtagttataaaattataggtctgaagaagcagtacgtcatggtggttttgatcatgaatcttgtgttcatagagccctgggcttatattgtccctctgtcacttactagctttgctaacttgacaacatatttaacttttctgaacctcagtgtcctcagagaaaatggcactactaacagtgtctaactcacagagttggtgtaggattaaatgcaataattaaattaaatgcaataattgaattaaatgcatatagtcagtgctcgaaaaaagacagtactcattaatgtcatcgttggttgtttgaaattatatgggaaaatttgggttgggtgagtatatatagagaattctcaccctcccagttgttcaagctaaaaaacttggaattattcttaaatcttctgtttttctcactccccacaaccagtcgattagacattcctgttggatctatctttaaaatagaggtagaatctagcatcttctcaccacctccatttctaccactcctgtctgagccaccatcacctcactcctgggcactacccagtagctggtctccctgcttctatccttacccccaacagtctttcatcaacacagtagccagagggatcatgcttaaaaacacaagtcagttccatttcgtctctactcaaaaccctccactagttccccaactcccccagaacaagaaccaaacaaggccctgtaggtctctccctatgtgatctgctccctcctttgctcctctctgtcctcacctcccaccactccctttctcactccgttcattccagccacactagtttatctgctgtttcttgaacacaccaggcatactcctattttgagcactttgcatgggttgttcctctgttcctggaatgctcttctcttagacatttccatggttcatctctccca

SEQ ID NO: 32605 - DNA, 1899 bp, Bovine  19866880429950
agatgatgctaggctgttagctttgcctccctgggattgtgacattagagccgaaatagaacatggcacacaggggtctgcaggcagaaaatagagggagagcttctaacagggggttttatgtgcaccattaggctggaggaattttctcaaatgctgaactgtgatttctccaaaagcttctccgtgagagggaaactcctgccacttgcctgaacaaaattgttctaaaaacagatcactgcatggtttctgttttctttccattccttctttgcctctctttctttgtcttccctctccctttttttctgcctcccattctccctccctcccctccactctgcttccctccctccctcctcctttccttctttccttcctttcatttaatgtagaagataaggcctcagacttttgactcagacacagaccttgggcaagttactaaatctatctttgcctctgttttcccagaggcatcattgtgataatgggatcattgtgataattaaattagtttatacaggtaaataacttagcacagtgtctactcaataaacaaaagctatgtcttttgccagagaaacagttttgggggttttccttttataaaaacacaaagctgtggttttgaaaagcagtgcctcgctctgcctgtgtttacacaatcccttccagtgtgctttgttttaatattttttgtaataacgagttactgttggatttttgagatttttgttttcagcactgacttgacattaaaaactaatttgggcatttccaacttaaatagtaatttaggtattgaatatagttaaggaaactaaatgaagagaaaggaggctaccccgttgtctttgcctcaggattctgcaggaacaattctttacttagttcatggttcatgcactccagtttttccttattttaaggatcatgtaaaagtgtggttactttctgttattacatatgatgtaccatccattagcctgtgtattccagttcggtcctggtgctctattctcagggaacatttattgagcaatgaaataagaggttccagggcttagctagcccttcagatagaggaaaaggaaagtaaccatcttttacccatcagttgtttcctcatctcaagtcaaagccaaggttctagggtagccatgaaagtcagatacataaagagacctgattatatggcatctctctcctttactgcctgagttattttaggcccagacagactttatttagatctgaatggctcatttgacttgtttgaaatgagcatcagaagacaatatggtgagaaactaatagctgtaataacctaacaatttaaggcattgcctatccagttattccaatgtttacacagactgagtataaattttataaggactgtccttggaaggcatgctgataaatttgaccttttagatagcattgactcttatctaaagtttcaccagaaactttgtaacttgtgttgcaccttcttgtccagccaaacagatggaagagttcgctgtggagtataagatcattaatcccaaggctatcaccatggggcagctgtatgggtgctttgatcaagtgagccacgaatggacagatggtgtccttgccaatgctttccgagagcaagcatcttctttgtctgatgaccgcaagtggattatatttgatgggccagtggatgctgtttggattgaaaatatgaacactgttctggatgacaataaaaaggtacctttctgataccacttttacatggatggggaataaactcttttactgaagtgagtgattgatcacgatatataatgtatacacttatttacactgagaataaatgccacataagaaagtaacagttatcaattcataattata

SEQ ID NO: 32606 - DNA, 1911 bp, Bovine  19866880521834
tttgggttttcctgtaagatggtatggaaaaacctgaatgaacatttttgccaattcaatatataaggatgtgtgttagtcgctcagtcatgtttgactctttgtgaccccatggatagtagcccaccaggcttctttgtccatggaattctacagacaagaacactggagtgggtagccatttccttttccataggatcttccctaacccagggattgaacctggatctcccacattgcaggcagattctttaccatctgagccaccagggaagcccatagaagatatatataatgtatataatagttttcatctgtgggatagttggcttaatagaagttactggctactactggaagtgaaattctattcattattttaatagctttaataaaatggctctttcctagtgatatctgaatatgcaatttcatctaaccaagagttatcttgggtgcactgcagtgcacaatagatatgtattgaaaattccagtgagggatattagtattccattttactacagtgggttccaggtgtaaagtttctttagactgaaaaagaaataattcttattcagagctctatgggtatcacatcttcttgctagcatgggctagaaacttcaggtttcctctctcatccgtgttactgtatgttcaatggaatagtcgacttaggtttattgcttatgaattaccctcttgattcagattaggtcaagaattggctattgtcctcaatctgaccccatgctgggccacatgacaggtcgggaagtgctgatcatgtacgccaggctgcggggtgttcctgagccagacattggcatgtatgtggaaacctttttgtattcaatgcacatggaaacccatgctgacaagctggtctgcacatacaggtgagacattatgttgcttatttattaagctgcctactgcccatctgtatttctgctgtttagaatgaatgcctgtaaactcaacctgacaactctgtcacacggaaacaaatagccgtcagggttcagatatcagaaataaggcagatcacatttgtatgaagttaaccttttgcagacatgatctgtagcctttgcatttcaaaaagaacacattcattcctgtatccctatggttatttatctccttaaaacaaaaatattttaccaataatgatgctaaaaagcatactccccccaaaagtcatttcaatgaaaatgagttggtgtatacacagcattgtggatatatgagctaattctgttgaattaatgataatcttattttttctttctcctccactttctctctccttctttgacaataaagtggaggaaacaaaggtaaattgaataccgctattgccctaatgggaaagtcctcagttgttttcctggatgaaccatctactggcatggacccagtagccaggcgccatatgtgggacacagttacagggatatgtaatagtggcaaagctatcgtcatatcttcccacaggtatgacccattaggagacatgggtgagagtcagaagtgtataagagagacttagtttgagtcagggatatgtcagtgaacttgtctaagtacgtgaagtacataagagggaccgtgagcaaatgctgattcctaggcaaaatctagaatactcagttaagttctgaaatgtagttccttatataataattacacaaaacatacacatttattaatgcattaaaagcaataactgcctaccaaaaattttaggttatgactggaattcaactggtaaaatattatttaactaataaaatatttaactgatagcaaattttatctgcaatagtatttaattttatttaactgataagacttggtaaaaggtaggaagtcagggaagtgtttctcttggaatttagaaat

SEQ ID NO: 32607 - DNA, 1873 bp, Bovine  19866880532608
gctgagcgccgaagaattgatgcttttaaactgtggtgttggagaagactcttgagagtcccttggactgcaaggagatccaaccagtccattctgaaggagatcagccccctggggattctttagaaggaatgatgctaaagctgaagctccaatactttgaccacctcatgcgaagagttgactcattggaaaagactctgatgctgggagggattgggggcaagaggagaaggggacgacagaggatgagatggctggatggcatcactgactcgatggacgtgagtctgggtgaactccgggagttggtgatggacagggaggcctggcgtgctgtgattcatggggttgcaaagagtcggacatgactgagtcactgaactgaactgaatattacttttcaattcaaaaccctcttcaagttaaatgttatgaatggtctccagatagaaaataattaattatccaggatttaacatcctttcatgttagatcaaaagggtcctagactttgagattcctttaaaggcaaaagtatagcaatgaaaggaagacaaatagatatcctgcctggaaaattgactaactcaccctgagaaggaaatggcaacccactccagtggtcttgcctgaagaatcccagggacgggggagcctggtgggctgccgtctatgggttcgcacagagtcggacacgactgaagcgacttagcagcagtagcagcagcaccctgagaaacactgaatatacatgggttatctatactaccttaattaacatgataaaggaaatcctttctaaatactttattttcttctcttttagggacagttctaattccaggaaccactcagatgacccaaaaagatatcctctaccgactacaatcttcaaaagcaaagtgcattattaccaatgaagttttagctccagcagttgatgctgttgcatctaaatgtgaaaatctgcactccaaactaattgtgtctcagagccccagagagggttgggagaacctaaaggagatgatgaagtgagtaaccataattgttgtagaacagttttccaaaaagaaacacaacattgataagatagtcaaccctggattaaccagaaaaatgaaaattaaaataatagacaaagggaacaactggtgattatagtgcaaagctctgaggcaaggaactggtggtgtttttcacaggttgggatctcaaggaagcacaccataagacagacattagttgtgtaagttaattaagaagttatcttaggaccaatacctgtgaagaaaagggaacaatgtgggattgggcagctgttgaaatttatcatccacatacttcaaaaaagccatcagtcaacctacggggatcactggagtttagataacccttcaaagctatgtccagctaaagcaagaggtccaatcagatcagatcagatcagatcagtcgctcagtcatgtctgactctttgcaaccccatgaatcacaatacgccaggcctccctgtccatcaccaactcccggagttcactcagactcacatccatcgagtcagtgatgccatccagccatttcatcctctgttgtccccttctcctcttgcccccaatccctcccagcatcaaagtcttttccaatgagtcaactcttcgcatgaggtggccaaagtactggaatttcagcttgaacatcattccttccaaagagatcccagggctgatttccttcagagtggattggttggatctccttgcagtccaaaggactctcaagagtcttctccaacaccacagttcaaaagcatcagttcttcggcactcagttttcttcacagtccaactctcacattcatacatgacca

SEQ ID NO: 32608 - DNA, 1537 bp, Bovine  19866880615942
actgtttatatcatggtctggataatcctttgttgtgggggctgccctgggcatcataggctgtttagcagcatcctttacttctacctactagatgccagtagtaccccctatttgtgagaacaaaaatgttctcccacttcgccaaatgtctgttgaggtaacaaaatggtcctaatggagccataatcctatgctttttgcattttttttttttttttactacatgaggcatcaattactcaaaaaatttaaagattcaaagaagagaaaaagcctagctgagaggaacaatggtctgagaaaatggtctaagacaaaggtgataaactagcagtcaccaggctatatctagccctggctaagatgcttttgaactgtggtgttggagaagactcttgagggtcccttggactgcaaggagatccaaccagtccattctgaaggagatcagccctgggatttctttggagggaatgatgctgaagctgaagctccagtactttggccacctcatgcaaagagttgactcattggaaaagactctgatgctgggagggattgggggcaggaggagaaggggacaacagaggatgagatggctggatggcatcactgactcgatggacgtgagtctgagtgaactccgggagttggtgatggacagggaggcctggcgtgctgcgattcatggggtcgcgaagagtcggacatgactgagtgacagaactgaactgaaccctcttaaagttttttttaaaaaattgaatgagttatcaaaatttaaaaatgggtgatttctgggacttccctggtggtctagtggttaagagtctgccttgcagtgcaggggacacaagttcaatgcctgatcagggaacagagatcccacatgcctcagagtaactaagccagtagaccataatgaaagatcccacatgatgcaaagaagatgccatatgctgcaactaagacgtgatgaagccaaataaatatttttttaaatggatgatttctacctttctggtttctcttgaagaagcagataatctggtcatcctaagatcacattatcaaatggcacaatacaaaagagctgccctctttaggccagaaaagaagtcttatgttgtcccagccctgccttagtctgttaattggaatgcccttcaaagccatttgagtttgagattcctgctcaatagagacaagctattgttatccattaatattcctcacacaacattctacccttacctgccattgggtctgcacctggagataacacgaatatcaacggtgcacagcagttggaatcactgtaggacccctggagatcaaacgtaggggcttcaatgtacacacttcccatgtgttcagcaatgaacccccgaatggctggaatcattttgtcaggccgcaaacatcggaggatcaccatcctctccaaaccatgaagaaacttccaagatccaggggaatgtttcctcatggggccaggctgagtcatagatgaacttccattcattaccatttt

SEQ ID NO: 32609 - DNA, 1056 bp, Bovine  19866880690610
aactcgatgcacatgggtttgggtgaactctgggagttggtgatggacagggtggcctggcgtgctgcgattcatggggtcgcaaagagttggaccaactgagctactgaactgaactgagtgtatatctgttaatcccaaatttcaaatttatccctccctctcctttcccctttggtaaccataaatttattttctatgtcagtcagtctgttttgtaaataagttcatttatgtcatattttagactctacacataagtgatattatatggcatttgtctttctctttctgacttattaatacttagtatgataatgtctagatccattcatgttgctgcaaatggcattatttccttctttattgtgactgagtgtgtatatatatgtatgtgtgccatatctgtcagtggacatttatgttgctcccatatcttggctattataagtagtgttgctgtggtcatcacggtgcatggatccttttgaattagacttttccctggatatatctcttatgagtaagatttctagatcataaggcaactcaatttttagtgtttaaggaacctccatattgttctccctagtgaaaatcagccacatttaaagtcatttttcaattgaagacttcccccaagaggcagtctttttatcctgctcacctctgatctatttattgcgttgcctgaatactccagtcatgctgccctaaaccatttcattcatatctttgctttcaaacactgtctatagtatggctacagcagagaagttgctccttcactggttttaaaacctttgggttgtccaaagagggaagagaaagttcagttgcacttgcttttgccactttctaaattgatgcattctcatcaactgcatataccccatgtaactcagtaaagcattcagaagaatcttttctgagacagatcactaaaatccttcttagcagagagggcagtggaaagcagtggacccccaacaaggacttgtagcctacatgagccatgcaactgagaacattctttagaagtacacatgtgccatt

SEQ ID NO: 32610 - DNA, 2032 bp, Bovine  19866880715472
caaaagtttgaggacccctggaataatgcaagaattaaaactgttcaattagaaatggacagtttattttatgaacttgtagactaaaaaaatgtaccaccctaaaagttgagttctgttttattcagcatacattcttaggatgtcaagttagggaggcagcatctcaagtaagcctgagaaaactgttggaggttggaggggagccaggatatttaggagttttgtgacttctgaatgtcaaaagattactgttaatgaaagaaaaccagatagcacaggttaaggaatttattgtttttctatgtatgagaagatgcaagagtctgggctcactgaaaatcagtcctttgatatccacctcagctatctggggccagtatcctgtgttttcacatcctgagtttcctcaagctgcacctttgggggtgactgcagcttgtaggcaggtattctttgtctccttcctgagttccttcagggttcaccttcaggggatacagggtggctgcaattgctggtggctgcaacttctttaattaatgacatgacaggcaatatcttatttctcaatctaaagtataaatgtgtcagttgtctcctgtgaagttgtctttcagaaaatgtgaaagaaatgtatgttaaaaagtctctattgtcccttttttgaaacatacacttctgagaatacagtaaataagtttaaccaatagttaaagaatattggcttgaaggtgtgcaaacctttggcctccctccagccctttgctgagagaaagctggcctctgcccatggtccctccctccaggcttggttaactgtcctctctgtctgtctcaacctgcagggcatggtggaaaaatggctcctgcaggtggaacagatgatgcttgccagtatgcaggaagttattaaacttgggattgaagcatatgtccaggtaaatgaaaactggggcacacatgccagggtgttggcacaccaagaaaaatgtgggtgccaaggttaaatggaagcccatcttccactaaaacccatccctctcctgataaataacacctgacccctctgtgcctctcttctttttccatttaaatcctggggcagtatatatagttctgaatatgaaaggtttacaattacaagcagcccataccagtatatcctatgagccagaaccctttgattgctgtgggccagtcctttctgtgaaaataattgatggcaagaggtttatttagagcctcttcctgattaagcatcccctcccctaggtttttcatttagcattgcacatgccctgtttactttaaaaaattgcacaatgtgaaaattgcaaggtaagttttatttggggcaacaagaagactgtagtctgggaaatggcacttcagacacctctgagaaattgctccatagaggtagggggcaggtcagtatacatgtaattttggtgaaaggggaatacatgcaatcaagcacatattttttcaggtttctgctagtcacaaggagcactcatcaccatgaagggtattggtgcttttctagatggaaggatatataagaattgagctgataaaaatggctcctgaaaaatgtctatctgaagacccgtgctgcaagtttttctcagagcacagagtgcctcatttctgctctccaccctgaattccttttaggggatgctgaaaatcagcagctgcagcagcacatgatttaatccgtatagaggtagatggcaagtggcaatttgtagatgacactccaaagggcacaactcatttagctcccaaagctttaggtgacttgtataacagaaggcgtaagggaaaagaacctgtcacaattactcttaagtttactgttggcagactagatcttttcagttcagttcagttgctcagtcgtgtccaactctttacgatcccatggactggcagcatgccagtcatcaccaacttcctggagcttgctcaaactcatgtcctattgagtcagtgatgccatccaaccatctcaccctctgtt

SEQ ID NO: 32611 - DNA, 1138 bp, Bovine  19866880783034
tgaataccagcaccaccaaagagatcatgatggccagtaaactcaaggggttgtgaggctcaaaagaaataaatgaggaagtgctttctaaacagataaaattctggaaaaattcaatgtgcttatttggcaactattagatttcttcatatactgataacatatttatcttgcacttaatggaatagaagcttatcacagtgtgtgagttgcttctggagacacaagagagtaaatactacaatccccttctgaacctaactactgttactacaaagtaacttggcctgatccatgggctcaacttcatcccaggagaaactgggatcctccctcaggcaaaaaggtgtggaccatgtctcaacatggaaaatttggcatatagtacatagttaaaaatacttggaaatgaatgaaggaaaggacaaggaacaaaaaattaaagaagcaagaaagggagggaaggagagaagaaaggatggaaagatggaagaaaagaaggaaggaaaataggaggggagggaaggaatgtggaattacattaaccagaaatattttatcttccatagacagtaaaatgaatatacagcagtcctacaaagggaaattcggttttgctgcaacttaaaatagaagaatttggtgtgtccagatccaggccagtgccttacccacaaataccactgctttcttccctatgggaggcccaaaaaggcctttccgccggcgatccagcttggacatgatgatatcctgcgtctgattggctgaagttctggcagagaaattgatgcagttgggcagataagtatttttgggaaggcgaagtaggaagttgttggtgatgaccgatttgcctgtgcccgtgggtcctacgaacagcattggaatctcatggtccaggtaggttttcaagaagaaggactgtcgggctgtctccatggtggggatgatgagttctgagacctgtgccacaaagacatggtaagtcttgatactgggaccaggagattgtgtcttggtattcaagagacttgagttttatccttactatccattcagctctgtctcttatttatctttataattttgagtattttacctctctagcagcctagtttcttcatctatgaaaggg

SEQ ID NO: 32612 - DNA, 1831 bp, Bovine  19866880817530
gtttatcagtcaagtttatttttgcaaacaacaaaactcaactccaattaaattaagcagaaaagcaattttgtgtgtgtgtgtttaaggaaaaagaaaagtatattccctgcttatcactgacagtagattcttatcaattactgtgaatcatttttaaactcactgggtctttgtacacacaagtgtacaaatgggaaggaagatcttacctcttactaatgaggggatgctcactaatattactcacagtggggaataggcaagtttagatgctggccagctaaagtataaacatcccacaatagcagtgttttttagactgggttgtgtcccattagcaagttatagctgaccttgtctttggaggggcaaggaggtgagtgatggaatagaccttaacagttcattgcagatagtaaggtaagtattgttcaaaatgcattttgtatgtgtattcagaaataatttaaattattgaatagttgcactgagggaacatgaaaaagtggtgaggaaaaaccaatgattcctttccatattctccatgactgtgtttcctattatcttctatctcaatagcatctaacttcttatttttgcattgttcccctttccttctttctaatagatgtccatatcagacctgcaacttcgtttaacttgacatctactgtgttttgacatatttgagtgaatcacagagtagtcattatgagattcaaaactcatgtaaaagcattgagctgtaaaagaaaggatgtaatctgaaaaaagaaattgatatgattgaagaatatggattgttgagggtgactaggggtggagatggaataagaggagatgtagtagtgagagatgaggcttgctgctactgctaagtcacttcagtcgtgtccgactctgtgtgaccccagagacggcagcccaccaggctcccctgtccctgggactctccaggcaagaacactggagtgggttgcctagaggtaggtttaaactttgttttgcaggctgtaaatgccatgctaataattttgggtttattctgtaagcattgaggaactagagggttatagctaattctctgtcctaaggattttgcttcagtttcccaaccaaaatatcaaagtccttaagttatagtccattagatcatagcactttgatctttcttcactttagtctttctttgaaatattcatctattcttctccagtttacccacctcttctgtggataactcctgcatctttagctttgatgtcccaaattccaggcctacattttctcagctgcctgatggatgttgctacctggatactccattgtaccttcagtcatagcataattaaaagcattttttttctccttaaataatagacttccaccttcaaatcctcttttctgttagtgttgtttttctctaagacaccagtcttgaattttagaatttcttttcttttggctccccatacccaatctgcatgattcattccctttgctattaagaatctctattcaaatgttactttataagagatacgttccctgattgtaaaatatatgacattaaccctttttctgccctagcgctgcctttcctcctttaccttatcctcacctgatatattatgtatttgtttattgtgcatcttctcaactagaatttaggagaatttgttgattttgttcattggggaatctactgagtagagcaatgccaggcatataataagtactcagtaaatattttgtcgactgaactgaattattctgtcactatgctttatcagtttttcttctgtaatgtttcttttatcctttttct

SEQ ID NO: 32613 - DNA, 1954 bp, Bovine  19866880832077
cgtcttttctttcttgctgttggaaaaccgttttgttgttatttatttccttacctgtgactcagaggaggtaacagttatgtgctggaactgtaactgagcaagtgggtttgctgcccactgtgcaatggaaagaccaaggcaatggtctttgcagagagaaaatgttttattgaagggtggaaaacaaggagacaagaggcactgctttagattcatctccttgattggcttttgaatgggaaataaggaaaaagagggggaggctgcttagaaacaaatgatggaaagtaagtgtaagtttcaatgtaagtttcaggagtgaaggctggacagtccttcatgcctctcatgggttacatgtgcagttttagaggtgaaagggcccagtccgtaatatgtaatgagttttaagcctgtgatatccagagtgcacaatcagtcattcgagtccctcagggcatctgtgtgatgctcatgctcagttggagggactttctgcaagttgtttccacatctgtgatttccctggtactctgtgaaagaggtttggtgttccttgatgtttctaccttatcaaccttgatcctttaaggtacaggatgtggtttcagagccagctctatgtaacaagctcaggagagatgattgctaaggttttaggaagtctgaatcagataaacaattcattattaaaaataaaattatataaacttaaatttaataaattatattaaaaaggtaatactcaaaacttattgctttctaattattttaccacattttactattatctttgctcttaagattgtgcacatctattgaatatctatgtggtgagaataatttctaatcaattgctactatgtctctcttccaaattctgtgtccagtaatgtcatattagtgcttaaaatatgttgtggtggtgcatttacaccacagaaattggcacgtgctatataaatcagtgtttgattctttcccttaatgagatggttgttaacatttaccagcatagcatggggtaatcctatctaggggaaacatctaattgatcttagataaagaaggtagctctgtttcctttctcctaggtatgtgatctgattctggccaaagagacatgaaagttactcatttggggaatttcttagaaagcttttttgcttctaaaaatgagatataaggtagatatggattgtttctggccatgtgatgcctaaatgtgacatatctgggcttttgaagttatcttataacaatgtcaaggcaagattaacttgcattttgttctttaatttttttatttcttagacctcatcttcagagaaaaaattagtatgtgttgtttatattttctcttctagaggggatcctaatagatgtgacatctggggaaatactcctttacattatgcagcctccaatggtcatgcccactgcgtctcattcctgatcaactttggtgccaacatctttgctctggacaatgacttacagtctccactggatgctgctgccagcagagagcagaatgaatgtgtcgctcttctggataaggctgccactgcccagaacatcatgaaccccaagaaagtcaccaggcagaaggagcaggctcagaagaatgtcaagaagcagatcaaagagtgtgagaggctccaggagaagcaccaaaataagatggcccgcacatacagcaaggaggaatctgggactctttcttcttccaagggaactttctctaggtcagtcctttcaaatgcttctgcttctaacacatttgggtcactgtctaagggtattaatgataccctcaagcttaagttcaagaagaacaaagatacagcagagcagttagggaatgagagcagaagtggacagaagaatgtgatggaagtgttcagagaggatgacggaagatgaactctcaggggacttcatagagaag

SEQ ID NO: 32614 - DNA, 1307 bp, Bovine  19866880865417
ctcggagatctgaaattcttggaaagtctcaagacatatgacaaagacaacattcccccagtcatcatgaagcggatccgggaaaggtttatcgatcacccagatttccagcctgctgtaattaaaaatgtatcatctgcatgtgagggtctgtgcaagtgggtgagggccatggaggtgtatgatcgtgtggccaaagtggtggctcccaaacgggagcggctgaaggaggctgaggggaagctggacacacagatgcagaaactgaaccagaagcgagcagagctgaagctagtggaagaccgcctccaggccctgaacgatgactttgaagagatgaataccaagaaaaagacactggagggaaacattgaaatctgttcccaaaagctgatcagagcagaaaaactgattagtggtcttggaggagagaaagacagatggacagaagccgctcggcagctgggtatccgttatactaatctgacgggggatgtgtttggttgtcctctgggactgtggcttacctgggggcctttactgtggattatcgggctgagtgccagaagcagtggttggcgcaatgtaaggacaaggtcatccctggctccagtgacttcagtcttagcaacacattaggagatcctgtaaaaattcgtgcctggcagattgctgggcttcccattgactccttctccattgacaatggcatcattgtatccaattccagacgctgggccttaatgattgaccctcaggggcaggccaataagtggatcaagaatatggagaaagcaaataagctgtcagtcatcaagttctcggataccaactatgtgaggacgctagaacacgccctgcagtttggtaccccagtcttactagaaaatgttggggaagagttggatgcctttattgaacccatcttgctcaagtccacattcaaacagcaaggggttgagtacatgaggcttggtgaaaacatcatcgaatactccagagattttaagttatatatcacaacccgtttgaggaacccacattacctccctgaggtggccgtgaaagtctgtctcctcaactttatgatcactcccttgggcctccaagatcaactccttggcattgtggctgccaaggagaagccagaacttgaagagaaaaagaacaagttgattgtggaaagtgccaagaacaagaaacaactaaaggaaattgaagataagatattggaggtcctttccctttctgagggcaacatacttgaggatgagactgccatcaaaattttgtcttcttccaaagtg

SEQ ID NO: 32615 - DNA, 1192 bp, Bovine  19866880888257
ctctgtattatgtatatgtagcactgtttcctaggtcagagtgtctgtattttgtatttttatctttgatttctagtatagaaataggtttccctagcatttcctggcaggttctgtcctgtaatttttcttcctaatgagagaaattaaatcaatcattttttgatatgccaaagtatcagtctgtcaaaattaaccatttacactattttgagtagtgtaagtccatccttaagccattttattttatatgtccaacatcacacacagatgcatggactattgtgatttctgtttgatttcttgtattttgtggtttccctaagtccctagcctcatacatttcctttatattatagcatatgaattgttttccaactgaagaaaatagtattccttagctattttcatgattttgccgtgcctaatatgtctaaaatttatataactacctattataatcagaacattaacaaaaacgtccttgaattgtttttactaattacttcatacaacagccaaaaaaaaaatctctcagaatttcttgtggtttgatttatgccttgcttgttaccgcttgttagttctgtcttgctccagtcatcctttttgacccaatggcaattaaaatctattctctgctttttctgctggttttacattttaaagcagggtcagaaacctttttttataaagggtcatataataaatatttcagactttgtggacaatgtgatctctgtcacagttactcagctctgcttctgtagcatgcatgctgctatagacatgatgaaataaatgagtgtggctatgattcaagcaaacaaaacaacacaaaagacagagaatctcaaaagatcttgataggctaaagtaaaaggacaaatgacaggaagtggaatgagtaggcacaagggtaaacagatcttttgagattttgattctatcatccagtatggttgccatctcttgtaagctttcaagattttcatatgtgtattgagaaggctatttctttaagacaaaaataaaacaataccaaaaaaaaaaaaaaaaaagacagagagcctgattttggagtacggtctatagtatactgttttaaagtgttgaaatggaaagcaacaaaattctgtaaagcaattatccttcaattaaaaaataaataaatttttaaaaaaagatctta

SEQ ID NO: 32616 - DNA, 1265 bp, Bovine  19866880899335
tggggtaggtactatatattcatttatctctatttaaaatgggagaactaagtcttggagaagctaagtaacttgccctgaagttgtctacagtagtaagttctttaatcattaaagttcttacctctgaggcagttcagcacaagaaggtaacattgtgttaacagttaaagtacatataaaaattcgtgaaaatgggaatatgtatgtgttacggtggaagcaaagatgatggagcaagtggccaattattataaagtttcactcactgatctcaagtgccatgactctcagaggtaacagagagaccttcttgcttaagttcataccttattttccggtcttactctccagacaaacatgcatcttcctcaacttggttttcaaagcactgaggaatttgccatggtggcttctagggttcagaagaaccgcccacccaataaacagcatccccttttgccctgcagttgatcaataaggaagaggagctgttggaaaaggagaagagtaccttccctcttctgcaaattgtgatgaccaacaaagtgccttatgagcagctgtgggtgacagcctacgaatttagcaccaagtcagaggaatggatgaatggtatgccacggtttcactctactcggacaggatgggaatagggtagcagaatcaacccagccagttctgaaataagactgggacttcagattctggctggactctttatcatattctcacactctggattaaggctatgctatgctatgctatgctaagtcgcttcagtagtgtccgactctgtgcaaccccatagatggcagcccaccaggctctgccatccctgggattctccaggcaagaatactggagtgggttgcctttctggattaaggcaaccatagttaaatttttctgatgtgataacgatggaaggtagggatcaaaaagccagacctgtagctaggataaaatagaatgggcaaccactcaaagccatggattgggtagtaactgggaggataagatcacagttcccctattatgctaatgctttatgccagtacttcaatataataaacacaactatgaagaacaactttgttgccaattttctggatacagtaatgataattttcttaggataaattactggaagtgaaatggctagatcaaagaaagggttgtaataaaaatataaggattttagaatttacttttattattggtattgctttccagaaaagttatgttttaatttaatattcttc

SEQ ID NO: 32617 - DNA, 1439 bp, Bovine  19866880912370
cccccatgaagatgatctgccttgggatgaggatgaagtggaatgggaggaagatgtggttgatgctactcccttggaagtgttcttgcagtcccactacttggaagaattccttcctattttcatgagagagcagattgatctggaagctctgctgctttgctctgatgaggaccttcagagcatacaaatgcagctgggtcccaggaagaaagttcttaatgccataaatagaaggaagcaggtgctacaacagcctgggcagttggttgacactaacctctgatggagtgttgggtcaatggggtgagtctatagaggtgggggtgatgctgtagcttactggagatattccaggcaatacctactctgtacccaataccagactactggatttctagggttttggaggtgtccacctaagagagaagcccaaaatctactttgagaaatgctctgtacctaaattcacataaaccactcaaggaggtaagaaatgggaataaggaaatgacatttctcttcaattatctttttgatatttttgaatatagaaaggattaaatggatgacagagaatagaaaagactttatttcctaactttgaacttaaaactatagtctcctatcacactagcctaatttctgatccttagctccatgactttacctgttgatggaaactaagattcctccattggcctgtggcttgagcccaacttgaatgtgtctaaccctaatcagtagatgtttacatgtttacaagtaatagaaatgggtctgtaacattcctacttgggaacacagagaatgtcaggtagagagagagatgaaatagaatgtacggtacctgtatggactaaattttgtccttccaaaatttctatgcttaatttctgatcttgagtctagggattctaacgccagtcatgctgtgaagaggtagacacactggtgatgtgcttgcatcgccatgtgaagatagagcaagaagacagctatctgaaagccacaaaaggaagcctcgggagaaaccaaactttttattgcttttatcttggacttccagcctccagagctataagaaaataaagttctgttgtttaagccaccagtctgtggtattttgttacagcagtcctagcagaataagattgtccttaagacaagagagacagggaggagaaaataaaaatacagaaaagaagattagatgatttttagatggttagatgatttttttcctaagtgtaagtgcctcctgaaacctaaaaaaggaaaaagaaatctaggttttttgttgagaaaattcaattgtaaaagttgaatttttgtatggttattatatacatatcttatttactgttgtctatcaccatttctgcacatctgaatacatgcaggttctacaatataaactgtcaacactaacactgctg

SEQ ID NO: 32618 - DNA, 1527 bp, Bovine  19866880928125
ttcagtttcctcaagtaaaatgagcataatcaagggaattcccctggtggttcagtggttaggactctgtgcttccactgccaagggcacaggttcaattcccactccagggaaataagatccctcatgctgcacagtgtgggcctcctcccctaaaattaaaaaaaaaaaaaaaaatagaatgggcatagtcacagctgccttctagcattgagaagtggattgtataagacactgcacagagcgctgtcacataatacatattccataaaaggtgaattttattattgttgttgttatgtttttttgtggtgtgtgcttcatcagaggagcacacagaataagctccctcagcaaagagggaccaaagtaaagttttccttcccagtccctttaaattgcatgatgacttaccatggttcagaactaggctgagagtccaccaccagtgcacgaaggatctgggcaagctagatcccacgaggcatatgagagtgataccttctggctcagggtcagctacacctacccggatgcattgatgacatcgtcactcctcccaaggaaccagaagtagccctcttcgtcaatagttgctctgtccccagtgttataaaagtccccacattccacttcagctgttttctctgggttattctgcaaagagaacagcactcctttgttgaaagcaatgagtttagagatgatgagcctcaacacagggttcagatactggcttcaaatcctgctctacctgacttgggcagtttttatatctctctattttcattgcatgcaagcactcaatgcatgctactggtaaaatagtgaacaatactaagcaaattttaagagcattaaaaaaaataacaactcagttttgtgtggtactccagtagaataaaatttctaccagagtataattccatttattttattcactcttataagctcagcattcacacagtgcctggacagatgggagatgtcaataaatgtttgctgaatgaattttcttctcaaaagattacctatttgagcctcacacaaagactgtgaaaatggtgttttaattaaacttttaagataattgtatatttgcatgcagttatgagaaataattggacttctccggtggtccagatggtaaagaatccacctgtgaagtgagaaaggtgggttcgatccctgggttgggaatatcccctggaggaggaaatggcaaccaactccagtattcttgcctggagaatccccacgggcagaggagcctggcagcctacagtccatgaggtcacaaagagtgggacacaactaaatgactaagcacagaataagaaataatatgggcttccctagtggctcatatggtaaagaatctgcctgcaatgtaggagacccaggttcaatccctgggttgggaagattctctggagaaggaaatggcaaccagctccagtattcctgcctgaagaattccatggacagaggagcctggcgggctacagtccatggggtcccaaagag

SEQ ID NO: 32619 - DNA, 988 bp, Bovine  19866880951857
ggtgaataatcctatttcacaaatcccaggatggtaacatcttcccttaacaaatggggagatccataaagtaattgactttagaatggatttttttttcagcagaatgtctcccacgctgacagtaaataccaaagctaatagttggcaaggtgcttaatattcatgggactgaaaagaggctcttgatccatgatgatgtttaacttcaccagcccaatctctgagtgggaattaagaactctcatcctgaagcatctaattcatctttgcctcatgcaggttggaatattccttatgaattcaatgaatctgacctgaggattagtatgcgacagatccagatgtttctgaatgattacaaggaggtgccatttgatgctctgacctacctgacaggtatttatgggaggaggttttgaggtgccatttgatgctctgacctacctgacaggtatttatgggaggaggttttgacaaccacaaacctccacaattatgctccaccttcctgctcctctgctcccagctccattcgtttactcacttatgccttcaacaaacattgagctcttactgatgctggtcaccatgctggatattataaaacaaaaaaacaacataccaaaaaatcaagattaattcctcctcttaagtggtgcacagtccacaaagggagagaaatataacaaaataaatgacaatacagtggtaagttcaataagaggaacatttataatgtagaaaggcagcacaatgattaaatttcagatatggggtgggatgattagggataacttccttaaggcattaaagatggttttgagggataagtaggagttttactactggaagaagaaagtgggagtgggtggtgaaaaaagaaggcgagtgctcccagcagagataccctgaggtgaaaatgacccttgctggtttgtattaaagcaattcatcagctgtatcatcaatatataccagtacataa

SEQ ID NO: 32620 - DNA, 3379 bp, Bovine  19866881047788
ctgggctgtcttgcagcagcagccacataagccctgggctctcccaacacagctgcttgtaaacattgctcatcaacagcagtgaaggggaacttgagtggtgtgtactttatctgtctccaagccccacacttatccttccaaattacaggatcttctctttcatttccttcctagggatattgattgtaggagagctgcccacgcttcttccctctctgcacatccagttttcctgttagtctgactcggctgggttaaaagcctcaatttagagttctctggtgaaaccaactggaacatgcagcttcacatgctttcctaaaaactccaactctaatcatgagatcttagaaccctctaagtacagggctgcaaagagaagcgtgcttaagggtacctgagcatcatacatggggagggagggggagtgggaggcggaggtgaggtgggtagaaacatctcacaagccccttccctacgtggggctggacactggcctctcgctacatcaaccacctagaaggagacataagatggaatgcaaaagagtcacactcatgtgggtgatcctgcccagttctaaaagtctgataataactgagatctgattaataaagtcaccctggaaaggaaacttggaaaaaggtttccttttctaagttccctaggccaggaagggaaggtttaatctctcccctagaagttaaacaaactaataaacaaataaacatatggagctttaagaactaaatgagatacatagtcttatgaaaattcttggcaaagtgcagagcaactgatccatcatgaattattaatccaagatggatatggcttgggacacatctgctcttttgaggttggcatcatgcacgtaactctgcttgctcacaaagtagatctcagtgtatttgttaatgggatgcatggaaatttttttaaggccccaattctctttcagggattcaagagggtgtactcaggctatatctcccatagtaaagccctactttgcacaagcagccatttaaacataacttttattcaatatgtgaatacaaataaaaacaaataattcagtactataccttggggatccctttagagttcttaataatttccaagaaagagttacgtattaattcccagcagtcatcaaaagatggattaaagacaataattggctcattgacttcaagcttaatcataatcagctgaggtataaagaactccatttcttggtagggctcctcaaaatcatttccatccttcaggatacataagatatggtgattattacaaaatggaaccttttagaatcaaaggagtgacttgtacctgttcatagtgctacatggggtaccagaaaaggaaatgtaaggtaccatgcactgtttctatttaaaataagggttaagtctggcttagcccacctgagttcaccctctcccccttcttcaaagtatgtttacattgcttggaaattattttatcaatatttccaaatcctccccatctgttaaaattctgaccaaaatctcctcctttgggaagcctccctgttccccatgaagaaataatcttctacctctgaacttccttatttccacttgcgtgtggtattttatctttctctcatgagatttacatgcacaggatctgtgtctgaaccatctatgtcctccaaaatatacaaggtagcatttagtacatcataaaagcaggcggcacaaggggtaaagaacccgcctatcaatgcaggagacataacagacacaggtttgacccctgggtcgggaagatcccctggaggaggaaatggcaacccattccagtattcttgcctggagaatcccatggacaggggagcctggcaggctacagtccacagggtcacaaagagttgaacacaactgaagtgacttagcacacatgtacaagggctcaataaaaatttgttgaccgaatccaaaagtgtaagagtttatctgtacatcccacatggagttgctaattagcatataatatattttagacattcaaaatgtcaacctttttgcagtagaaatactgatatggaactttagtgaagtgaaagtcactcagtagtgtccaactctttgtgattccatggacgatacagttcatggaattctccaggtcagaatactggagtgggtagtctatcctttcttcaggggatcttcctgacctaggaatcgaaccggggtctcctgcattgtaggcagattctttaccagctgagctaccagggaagctgtagcttagttggtaaagaactgatgtggagacatttctaattcctaacactggctagtaacacaagatatctttcataaaaggcatgaaagtgaaagtgaagttgctgtcgtgtccgactctttgtgactccataatttgtagcccaccaggctcctccatccatgggattttccaggcaagagtactggagtgggttgccatttccgtctccaggggatcttcccaacccagggatcaaacctgggtctcctgcattgcaggcagatgctttactgtctgagctaccagggaagcaagtgcctaataaaattggcatgaggcatttgtaaagtatttgctcaaataattgattctaaagattcaatttagaatctagaaattctagatttgtctaaggattattgataagcattaggtgaatgtctactatgtatcaaatacccacacatttttttctttaagatatattcaatttttaattttccctttgtttgaaattttagaatgaaacttggttgagtttgagtctcttctgcttagccaaatagatgatcacaatgatatgtatagattagtccactgtagaatgctaatggtgcagtctaaatttgacagcactggttctgtattttttgaataacaggtcaactgttcatttttactttatttggcaaaatccttagaacttaaccttttctaaccagacaatttaaaattttatcactctttttaaattaaaatggcacacagtataaaatacaaaaaaaatcttccttgatttcccacgttatctaaatttaagggagtctatgatgctttgaaaaccatcacagtgttttagtttttatcttagtgctttagtttttatctagacttcacttaagtagtgtcatgaaagtagttattaattaggtcaatgaagtctcttgtttttagaggcacccattccaaaaccaaagaataaaagcccatatctgcaatgaacatgcacaacacttcctaaatagcaagccaaaagactgataacaaaccctttttaatccccttttttttttaaacagagaggatgaaaaagtgaccactcctctacagt

SEQ ID NO: 32621 - DNA, 1303 bp, Bovine  19866881073352
taaaaggtaaacctacatgtatcagtacacatgggtgattaaaaaaaaaaaaacataaaaaaatgcaagatagtaattactttaaaatcaggatagtggtaagctttggagggagacagggagagggctgtgattgggatgggatatatggaggggcttctatgaagggctggcaaagttgtatttcttgacatggatggtagatgtatagatgttaactttataatgattcactttataattttggtgattttctgtatctgtgctttactttatacagtaaaatattttttaaaaatacatgcaggcaaattatagaaacagaaaatcgattattagttgccaagggctgcaaggaaatagaaagtggtaaatgtaaaggatttctttttggagtgattattctgctattgattgtgataatgattgcacaactaaaatacgaaatatttatttaactgtttactttaaatggatgaattttagagatataaatatatggatatctaatattagatacatagatacagttgtagagctgtaagaacaccaaactaacagtgattaatttgggaggggagacagaatggatttagtgtgtaggaggcaagggttactttctgtaaaagtatttctgaattatttgattattttataaaaataacatattgccattatctagtaacagtcttgagcactgggctagtactattaccagaacttctgcagtcatggagatgttctgtatctatactgtgcagtacaacatccactagtcacacgtttatccttgagaagttgatatgtggttgatgagactgaggaaatacatttaatattacttaattttaatccatataaatttaaatagccacatatggctagaggctgccatgttgaatagcacagctctagaacttaaaggcggagaaaaaaccgttctatatctaagggttgctacgcccaggaggtaagtgtgagtgtgtgtgcatgttttccaggacggttcactcgccatctgaatatcatttccatcaatgccttcgaggatgacatattaaccaagattttcagttcaatcgctgactggcacttcgggaaagggtttgatgtggtgtttttaaggtaaggaggttcctctattattggcctggggtcctcatttctggcccttccttaactggtctgtcttctccttcctcccaaggtatggaaagatgatggtacaagcaacgatgacaatttacaaagctgcagtggagaatttcctgccaactccctccaagtcacactatgtctttaa

SEQ ID NO: 32622 - DNA, 1232 bp, Bovine  19866881085616
ctggaaggagatgatcgacctaaagagtaacattcattacacttggcaagaagtgtttcttaaatcctggaattattttcttttggagtttaatattttaaatcaccacataaagcctctggtgctagagatatagtgaagtgtgctatttaaagaccacaaggcagaataaaggaacacaagcagaacccaagtcacttcacttcacttactctagcttaagagaggatttccttttaacttccaaaattaaagtgtttgaaaatacttccacagagtgttttctttccaaagtacattttccagccacaaaacagatgtaaacaacctcaatcaataaatcaataaaacagaatcaaataacctcaacagatcaaatatatatatgatggcattagaaatcaatggaaataatggattaagaattagaaaagaactttttagaaagttaaaaaaataaatttctaattagaaaagaattaagatagattcctattaataccctgtatcaaaataagatagcagaaatataaaaactaaaatcataaaataaaaagaaaaaagaaaatggggcttccctggtggctcagtggtgaagaatccacctgccaatgtaagagacatgattcaatccctggttcgggaagatcccatgtgtcccggagaaactaagcctgtgtgccacaactattgagcctgtactctggagcccaggagccccaactcctgagcccacatgctacaactactgaagcccacgtatcctagaatctgcattcaacaagaagaaaagccacagcaatgagaaggaaccacaacgaaccatagtccttgctcatcacaactagagaaatgcccacgcagcagcaaagacccagcacaaccaaaaataaacaaataaatacaattattttttaaaaaaggaaaatattcaagttgactgtgtggtcttaggaatggggaagacccttcaactatatatgcaaagtcagattctataaagaaaaagatcatgattgtaatttaaaagtaaataataaccacgtgcaatacatatgaaggggtaatattctttatatatagcgagtcctttcaaatcaatgtgaaattgaacatcaaaattgaaaaatggacaaaggatatgaataacgcaattcatataagatggcatacaggatatctaaagtacatatactttaaagttcatgctttccagtaatcaaagaaatgca

SEQ ID NO: 32623 - DNA, 1060 bp, Bovine  19866881094013
attctaatatttatcttatgcctcccatatggaactgaacaatgggttctgaactcaagagttcataatctagtgggagaaatatatttatttttcatcattccattagcattggtgatctttggaatgcagagggtttttcactttcatttgattcatttagtatcagttcagttcagtcactcagtcatgtccaactctctgcgaccccatggactgcagcactccaggcttccctgtccatcaccaactcctggagcttactcaaactcgtgtccatcgagttggtgatgccatccaaccatgtcatcctttgtcgttcccttctccttctgccttccatctttcccagcatcagggtcttttctagtgagtcagttcttcgcatcaggtggccaaaatattgtagtttcagcttcagcatcagtccttccaatgaatattcagaactgatttcctttaggatggtgtggttggatctccttgctgttcaagggactctcaagagtcttctccagaaccacagttcaaaatgatcaattcttctgcgctcagctttctttatagtccaactcttatatccatacatgactactggaaaaaccatagctttgactagatggacctttgttgacaaagtaatgtctctactttttaatatgctgtctaggttgtcatttaatatgtatatattcatttatccattcaatcattcattcaaacaaatgcttttaggtgccacccatacatactcagttgtaacactgagtaaaatagaattttttgtgatgatgatgatgtattgcccatataatcagggaaaatcatgtttaattatttgagtcaaaacaaaataaaccaaaagccagtttgtttcttgtgtcttaggacatggcattgagttcttattttcttccccttaggacactgatgggggctttgaagctgaaccttggaggagccccagagggtccagctgggacaggcaagacagaaaccaccaaagatctggccaaagctttggccaagcaggtagggaaacgctgtccatcctcacact

SEQ ID NO: 32624 - DNA, 2033 bp, Bovine  19866881097952
cttcctggcaaatagatggggaaacagtggaaacagtgagagactttatattttggggctccaaaatcactgcagatggtgattgcagccatgaaattaaactacgcttactccttggaaggaaagttatgaccaacctacacagcatattaaaaagcggagacattagtttgccaacaaagttctgtctagtcaaagctatggtttttccagtagtcatgtatggatgtgagagttggactataaagaaagctgagtaccgaaaaatttatacatttgaactgtggttgttgaagaaggctcttgagagtcccttggacttcaaggagatccaaccagtccatcctagaggaaatcagtcctgaatattcattggaaggactgatactgaagctgaaactctaatactttggccacctgctgcgaagaactgactcattagaaaagaccctgatgctgggaaagattgaaggcaggaggaaaaggggacagcaaggatgagatggttgtatggcatcactgactcaatggacatgaatttgagtaaactctgggagttggtgatggacagggaggcttcgcatgctatagtccatggggtcgcaaagagttggacacgactgagcgactgaactgaactgaactaaactgagtcaccatataccctctgagccaccagggaagtctcatattttatatatactattgtatttttatatatactattggatttcattgtaatggattaggtcaagcaagtgaggtgagcgcagggtcagacgctgtctttatttttgtgctctcttgacttctgcatctgagcaagtgcttcaccgcatccagttagctctggacctctttgtcccagtactatttggtctgtgcttacctgtgaagctgcaaattcaagtttttgcaggcctgtcagatatcggttcctcatcatatcaacctcttgcctcttcttattcaggagtgtcttgaatgttaggatcaattcgaggtaggaggtgggggtaacatagttgtgccttcgaagggtgttgtaataatcaagtgacagctttttcacactctcctggaaatatttgcacatggagatgaccctgttgaggacacaaaggtggtcagacaggcccaacttgctccagagagatctagcacagctttggttcacagaagtaaggatgtgagaaagccactcacactggccagctagaacccccagttctttgaagcatgtccacagagcctcaagaaggattggggaggtatatagtcttactagaatgaactttgatcaggcaatttccagctttaatcacttttgtgaatcaccagggcttaagcaggaatttttaatctttggcagtctgatgaagcctctggacttttcagaataatattttaatgcataaaataatatattatagaattacaaaagaaaccaattatgttaaagatttttctaaatattttaaacaccaaatttatgatatagtaatgtgtatgtgtgtgtgcatgtgtttggctgcgccttgtggcatgtaggattttagtttcctgacctggatcgaacccacacagcctgcagtggttaagaatccactggaagcatggattcttaactactgcaggtaagcctcaatatgtgtgatttcatttacatgttaaatcaggggtcaacagactttttctggttaggatcagatagtaactattttaggctttgtgagccacatggtctcaagtagcaactattcaactctgcctctgtagtgtgcatggctgttttccaataaagcatatttgcaaaaataaggctgtgaactggattcagccgtggatcatagtttgccaactacagcattaaatagtaagactggacaacaggtctgaaaactaccatcattttgaaggggatgataaattggtgcatctgtaatgactgaacgagttatgaaaataattgcagtgcctactggtaacaaagtcacaggtcctacacaatcctatggggtttattgcctatg

SEQ ID NO: 32625 - DNA, 1023 bp, Bovine  19866881125308
ttttcatgagagccacatatttgggctcagtaggaagagatgtttccagagcaaggatagcatgacatacaggactttgaaaatactgtttctaccaaaaaaaccgtggccacatggctggcttccatccctggagtttaaaaaagaaggagaagaccctcaggaatatgtgcctacctcatctagtagctatagcccctcctcataatttttgccttgtgattcttcatttggaaagagaaattcccagctaagtcagtttagctatgccttcaaatttcagtgagctattagttgtgccctccaaattccagtgaactgaaacaaagctattactctagtaattagccagcaatgtgcctttatttagtggaatgaatttctgctccaatgaccaacatattagccatctattctcaagacaggtagtgacctgagaattctgtgtctgtttcctgaggactgctccactatgcaaaggctgatgaagtttcgggtcctctggggcatccacatgtcctgccctggcttccaccatgcccctcagcacctgcgctgccgatctttatcaggagctggaaccctaagatggaatgactatgacagacctgaggaatttaactttgcaagtgatgtactggaccactggactcaaatggagaaggtaaggaggcctctgtgttgtgtgtgagaacaggattcacctccttctcctaataggaagaggggcacagaactaaaagggcttctgactaagtctacaattttcatgggaaaagcttatgtttgggggttcagttctcagcctggacacttcctctattctctaagccccagtggctttatctgtgaaagggggataatctcacttaagaaacaagatagcaggtgaaagtatctggtactcagtcaggtaatcatgaccaagtgtcaagttctaatcacaggtcagcaagttgatgttggtctgaattctcatcttcaactaatgagactgtgagtctaactagaattcatctcata

SEQ ID NO: 32626 - DNA, 2429 bp, Bovine  19866881128778
aatataagcacatagtaaaaataattcaaataatataaaagggatataatataaaccaaaattttcttcttcttcctgtctctcaattccccttctcagagacaattatcagaagtttgtttgtttttccagggatagtctatgcatatataagtatacttctataagacctagtagtttttcttacaaaaatgaaacctctaaaccctgctttttcacaaacaacttgaagttccttctatatttacacgtaacctgctccagtgttcttgcctggagaataccagggatggtggagcctgatgggctgccgtgtatggggttgcacagagttggacacgactgacgcgacttagcagcagcagcagcagagctgcttcattctttttaacagctgcacaaaataccaacatatgactgcattataatttaaccaatcttccaccagtggacatttaggttatttccaatcttttgccattttaaacaatggatctcgtatttttaactcttacatatagtccctgcagattcaaattaccctctaagaggttgtaccaatttatattcctatgaacaatccataaattatattcctaccaacaaagaatgagagtgcttcttcataccctccccacgtagatgaagtgtttcagcaattgctgtctagaaaccccctgagtaagatattggagaatgatccacctattttgaactgtaaactgtttgcttattactgaggagaagaaatgatgttagaaatttccaaacagttaaactgtggtagtccaatttcaagtaaaggaataaaaagttcattctgaaaacagaaagccaggaagtagatgaggagacaatgtttcgaggatggaaaatgagtcaacatatgactctactaagagtctgaaagtgggcttcaaagaagagctgggttgcatcagccccagatgacacccacagtgaagcccaggctaccatggcttgcaaattccaagggtgttcctgtcctgtggtcctcttggagcacagaaaagttctaggacctgcaatgaataaaaagaaccacagctgagtccctttggacagaggcttagctttctgacctctgtatttctcagaagctattctgattgtctaccttgggggtagatttccatgttctcatttgcctatttggagtcagagcaattaatgaaatatattttggggttattattaagctcttatagcaagtgaggttacaggagactacttaggtctacatgagggattagggagaaagaagcccctaataaagatatggggactgagggcttctagggctccagctgtccatctaaacaagctgggttagagttctccaaattcagtcattcagaggctgcctgcgtgattttgtcatctccacaactacctatactaatattaaactttctctttaaatggactctgttaagtacagtacttacaaaattatctgatattatgtttcctttctaaaacatggtaaaacagtacatattttaaaataaaaaacccatgtacctcccccaacacaacaacattatctcattcatggactggcacatacacctctctggctcgtaccacactgggccaattcaagcagaggcaaatgaaggattattattgccttaactgtaagctcaaagggtattgagtagtccttaggtgattgaacctgcaaagctttactggtcatgtactactatgatatccccatccccaggttagacaccgtgaggccatggtacctgcctttaactatcaaggatgttacctgtgcagaacaaatccgacaaatgaagctacagacaaggcacaactgtacataatcaacagggcaatgactgcagactgctatataggaattcagagtagatggtcatcatggggttggttgagggcaaaggacttgaggaagacttcctggagaagatcaattgaatcaaagtatttgtaagtgctcattaatttagtgacaaccacagacagggccatgagatatactataaaggtataggaaactgtttatgtgctcaaggaactgacaatctggttaaggagaccataccaacataaatgaaacaaataaggaaaaaaaattatgactgtctaactagggaaaggtatataggtcagtggtctacaaagttttgatcatctacttctttcaataaaaaaacttctgagccctgagaattccacggggggttcagtggttaggactttgactgccgtgtcccagggaacctaaggtcctacaagccacacagtgtggcaaaaaaaaaattctgagcccatagcttccatggtggtgtatttataaatttattaaattaataatcaataatatatatatatatatatataatagacatttttaaagggagcattaaaaataaata

SEQ ID NO: 32627 - DNA, 1098 bp, Bovine  19866881134133
cttgtgtcttgtggatgtcttatgacatttaaaagtggtttctactctttaggtggaatctatcctgttcccagagttgaaaggatataatctgatacttggaactgttaatgctgatgaaaaactggtttctgactttgtggatcaaactttcgaggtatttcagaaaaatcaagttggtccctgcaagtaagttggtttagttgtaacttagccattttggcattggtttagagttcctacctatcatcaaataaataatccctattcccacagacctgaaacaatacataataagtagccaatacttacttacatagggattactatttatccccatttgcagatgaagaaaccataactttcccaatgttatacagcaaatagataggagagccagaattcaaattagaggtttacccctattatctgaaagccttggcaccagatagattctggaatttagaaattcctgaattttaaccagtggtcaggcaccagtcctaccaggaagccttgaaaaacccctggaccaacctcattcaccaggtgacagacaccagaagcaagaagaactatagtcctgcagcctccagaacagagaccacaaacacagaaagtctgacaaaatgagatggcatatgttctatatggcgtatgttctagataaagaaagaaggtaaaccccagaagaacaactcagtgaagtagagataggcaatcttccagaaaaagaattcagaataatgatagtgaagatgattcaggatctcaggaaaagaatgaaggcaaagactgagaagatttaagaaatgtttaccaaggacctagaaaaagaacaaagaacaaacaaacagagatgagcaatacactagaaggaatcaatagcaggataactaaggcagaagaatggataagtgacctgggagaatagtggaaatcaatgctgcaaagcagaatacagaaaaaataatgaaaagaaatgaagactgcctaacagacctttaacatcaccttaacatcacttaggagttggtgaggacagagaagcctggcatgctgtagtccatggggtcacaaagaatagacccaactagc

SEQ ID NO: 32628 - DNA, 1171 bp, Bovine  19866881152413
cagtcactttgcactttgggtttttttcatctatgagagcagcatgctaaggtcatttagtgcctgtccccttgaagatggcctggctggcattctctcgcccctacttcagaggcactttccttttcccgtggcagcaggaccaatgcttattgccatggttgtagctcgggccagttgaacagtaggtctcgaggatatattagctctcttgttatctgtctagctagttagaacattctgctttggtgtggacaccacttgggcctaactagcttagctccgtgtgctccagtcttggtttaccagcgttctctgtgttgaactttgatgctctcttatatgccaatctgttttatttggtctacaatgattttattttgcctacaatgattttagtttttgcattaagccaggacctaaaaataagattttatgtaacaatcaaaatcgctggtttttcctaaaaaatgagaaggtcccacaattcctgcttggccagagtaggctggggataagtaggggctgctgcatctaggtgggatatctgtcagagtccctatcaggcctatgtggcttttttcatttatatgaactgtccgacccttgtagacatcagaaatagtgacacttattccagtgttcattgtttcctctttgccattggttattatggtatatatttcctcccacctcatgaaggctagagttggggagatgattgagttctgaagccaaataacatcttcactcatagttgaaaaatgtcacatggtctattatttggcttctctgtgagatgcctggatacttccaaaggtttctataccataaagtacacccagtatttcccactctgatgtttaccttgagattatctggcagctcagccctgccagcatacccagggttcatggtgatgaagactgcacaggttgggtttagagagagctcggtgccttcaaagatgaatgtctttagcttccggataatggcttgttgaatgctgagaatctgttgagctaccacagacagtacttctacctggagtgagaatggctggttgatttgagctcctgcttctgacagccacccaccccactctgccatagtatccttcacctagcgaagaaagaaccccatcacctgagaataagaccttcacattcaa

SEQ ID NO: 32629 - DNA, 2142 bp, Bovine  19866881188319
tattgagtattttctatgtgctactttcagggctaagcacacataatctcattaatattcccaacaattttggaggtagcaaccactaaaactcccactttacagataaggaaactgaagctcagagtgccactaataaatgtcaaacatgggataagtaactagatctgccacattccaaggcctctgtttctaaacacatcattaaactgagtatacacacacacacacacacccacacccacccacacgcacgcacacacatttacactccagctacctggccctggtagagcgagggtccatgagacctgagcttgctttcatttctcagaaattatattctggttcccaagtccacaaagtctgatccataggtctagggaaaggtttggaatgtgtgttttcttcaaagttacatcttgatgtaattctgatacaatgattgatttagtgcttcacactttaggaaacccagagccagggttgtgttaagagacttctttgctaaataaaatatttctcagttgggtcaaacttttgagcttgaaatgactttcttttgggagtttgttgatgttgaaaggttaatcttcttacctctataatgaccttagggtcaaactgaggcagatgatgagcaaagactgtagaccccgctgtccatggttcaagcagggaccccaaggcagccagaatccagcctgtgtctgacaggcaccagaagacatcagacatcttcagctgcaacaatttcctgctgtctccaaaatacagttggcctcagatactattgtgactactatcctccccttctttacaccctcattcctcagggttttgctactcagtgtttatcattagtccagatatcagctgtctccaaaaagccttctcctcccctggtttggttaaaaagttagaaaatatatataacattgtttggtttgaatattattagttggaagaagggaagaagagggagaagagtttggtttaacattgactaaatagttatcccagcttcagctctgtgtttgttccctgatagggaagtggcttagtgtggcttagtttcagatattattttccctaagagctcatgattgggcttcatgcccagtttgtccacagttgaggagggagaggatctgccacttaaggtcacactgctggagcattttatctttcccaccaaaccctggagccactgacagggacacagaggcttgtcatttgtgtggttttcagaatgccttctgtttccactcactcctttacatctcctctgaaggtgcttaggtaggacccaaaggttcctcttttgatattcagaggtgtctgtcagcaaacactcatacctagcctatactcacaccttcaggggtgtgaaccaaagacagcaaaaagaataaacaggacggggtcaattccacctagagttcctttcccagcacatacagatgcacactccaccccgtatctgtggcccagcttctaagttggtgccctctttcctaccatgctgggaaataggatcgtaaagcgaatccgtggctgtgctttgccatcttggggaagcccgtggtcccactggtgaagaagatggccattgggtccagggtctttgacttaatacagatgtgatctggggaggctgatctgcaaaggaattcagtacaaaggacagaagtcatgtttcttactatttcattctctggggaagcaaaagaaacaatatgaggctttgagttagaaaaatggggtttgtaactcccagtattaggcatcaaagaaagtttatgggaggctcagataggtgacctgacatttctgcattttaaaaaatggggaaaatatgatggattatttcttaatttaacaaacaccgaaatagtatttcctatgattctggacaaggctctatatgatttacaagtaagaattcattcactattcagagcaaccctaagaggtaagtaatgcttttatgcaccttttgcagatgaggaaatggaggctcagaatgattaggtaacttacctaaagacgtatagccagcaagttgcagagccagggttcaaactcagtctgatgcatacactgtgcttttagtcacattgctaacctgtttttacacag

SEQ ID NO: 32630 - DNA, 1105 bp, Bovine  19866881370558
tttattcattgggagccttttcacttctaaaataaagccttttaggatgctgaaacttgaactttaatggtaagttaaagtgaaaaaaaaaaaaggtgtactcagagactttctaactcttgactttaaaccttccttttagagaaccagacttgcttaatttattagagcatttgcttttctaagtttccagctcacaaccattccgtggcccagcagaaagagataataaaaagttaagtaacaggtaaaaatcttttacagttgccttttccccagttggaagcagaatttttctttccctctgggcagtttggcctctaagctcctcctttttctgatttgaaactctactatttgcgtacagtgtttaaattgattcactcacaaccaagttctgaatgtctccagcattagtacctttgactcaggaagcttaagcaaaagattataatagtggtttaacaggacaaaacctttaaaaacatacttgaaggttgtttttactcaagatttccaaacagatacaaactgttttcaaagaaaagccagtctatgtggttttcaacttagacatacatgagcagggaagcagctttcccagatggaatgtgggtctttcatagagaacttgtgaagctgaaaactagtcttgttaagtcttggcctccagacttgattctttcactgttatatttaaagtgaagtatgtgtagtctgaatttttcttaaggatcaactctagaatggggtgcatagtgcttcagggaaaataaatgtgtttatatgctaccagattttcatctagtaaatttgagtgtcttttgtggaccttgtttttaaaagctttatggtaagaaaacggatataaaaacaagtgaaggtgtgaagagacagagaggctctaggtcaccttgaaggagtcaggagaggattcctataagaagtaaaatctgagctgggattgaaataccaagactagagaaggaggaggcgttccaaacacaagtaacagtatgtgtaaaactacagtgagttaagaggccatggcatcttgggaagcggcagacgtttcagtatgcccgagggatgtggagtgaacagg

SEQ ID NO: 32631 - DNA, 847 bp, Bovine  19866881408543
catgcgtgctgtcaagtctgtgctcactgctgctggcaaccctgaaactcaaggatccagaggagaatgagagtgtcctgctgctccgggccttgcttgatgtcaacctggccaagttcttggctcaagatgtccctctgtttcaggtaggcaatggtttgggaccttggccaaacactgagattctacttcccaagatgaaaaaaaattttggcacctcttccactccttacaccctttccattctctagccagcatccctattgccagataccctccccccaaatattaagtaataatgataatagcaatatccctaattcttgatgtttaataaaaatagtttcactaataggataatatttgctgttgagtgtgagtagttagtttttcatatcaaatataattagttttgtaactattttaacatctatcttccttactaagctgtaagctcttagagacagaaagcatggccattttgttcattcctagtgtaatgactgaaatagcacagacattagctatttgctgactttttaaattattgggaagaaacatcatgtttaacaaatattgtaggaatttgtatttgtggataaggtacatgattttggtataggaaaacaggtttggaattttccaaggattcctgctatttgtagattccattaaaaaaaaatgttgaggttatatatctgataatttatcctttttacatcttgaatttttgttaacagggaattatatcagatttgtttcctggagttattcttccacagccagactatgtagtttttatggaagtactaaatgcgaacatcaaaaagagaaacttcagccagta

SEQ ID NO: 32632 - DNA, 2455 bp, Bovine  19866881624027
cctcttttttttttttttttttggcctttccctagtggtatgagaagcccagaatgacagttcagcttccagttcaggggaaccattattgcgccttctagggcaaactttcctccttgagtactaaaaatcttgaaactagcagagctcatagttgcaagaatagaaatagaacttttgcaagtagctctttaggtttaatagaggtctgtggtataatccctcagagcgtagttttgctcttaactcctcagccaagtatatacaccaataacgtgtttgaaccttaaattcctcttaatataaattaatggttacacattcaggaatctgtttcttgggtttaagcattctcatgtccatttggctaggattccataaatctttggacatgacaagctgtctctggtagcagattcattggcactctcaggtccccctggacttggtgagtccccacaatagaggccagagacaaaggcagatgatcttagaatattttaggctgccccttcagctaccttttctcaggtaggcatgaacctcatagtctataaaaagaattttgtttttaaaacaaagaagccttaaaactgcattaccctttgcccagaagttctacttttactaagaatatcattataagtctctgcaaagtttgctatagatggatgtccctgctgctgctaagttgcttcagtcgtgtccaactctgtgcgaccccatagatggaagcccaccaggctcccccgtccctgggattctccaggcaagaacattggagtgggttgccatttccttcttcaatgcatgaaagtgaaaagtgaaagtgaagtcgctcagttgtgtccaactctttgcgacccccatggactgcagcctaccaggctcctccatccatgggagtttccaggcaagagtactggagtaggtggccattgccttctagtaatgttatttacagtaacaacaatctagaaataatatgcttcagcaagaggaataattagataaaatggaacaccttgcagtcattagaaagtatgattttaggtaggcctctattgaataggaaagatgttccctttatgctaagagagaaaaacagattacatatatatatatataatcccattaaaaataatttgtgtttacatataggaaaatctagaaagacatacatcagagttatctttaggtggtaaggtaatggggtgatttaattttttctcatctttacaattctgctctcatgaatgtatattatatgactttttaaaggaaggaaaagtaaaaggagacttggagtcagtgcacttggggtagaaatgaggtcaatggagaggcaggctgagtcttctcctttgttcttgcagattgacagaagtggttcacagaagcctcatctatcttggccgagcaattaaagggcaggttctgatgtcctcagagctggaggatgtcttcagtagcatgcttgtgggtaaagtgccagccatgtggatggcaaagtcctacccatcactgaagcccctgggaggctatgtggctgacctgctagcccgcctggccttcttccaggtacctcggagtcagggtaactgggcacctgggattctcattcaggtggagaggacattctgaaatgacaagttaaagctggaaggggatagggtagccacagagcatcctggattgagcacctactggaaacccttactagggttgaggacaggagggagattttcaaagtccttgaaaagtttatagcctataaaggcaggaataggaatgagaataaatgccacaaaccagtgtgtcatgggctacatacagctcatgggctactagatagatttcatttggctatctggtaatttaaaaatctgagggcttccttggtggctcagtggtaaagaatctgcctgtcaatgaaggagacagtggatcgatccctgatccaggaagatcccacatgcagttggagcaactaaacccattcaccacaactgctgagcctgggctctagagcctgggagccacaactgttgaccccatgtgccacaactactgaagcccaagcaccctagagcctgtgctcctcaactagagagtagcacctgcttgctgcaactagaggaaagtttgtgcagcaatgaaaataaatacaatttttaaaatattaaaaaaattaaactttgagctagcatataaggattattacatataaaaatacagatgtttttcttgcaaaaaaaggaagacctgaatcaatggacctgcatacctgcatggcaactactgctggaattgagtagctgttgcttagacaagacatatattctctactgctatagtccctcccactctctgctgcatccctgacaccagcttgcaccagtgctttttacttcaaattgggaaaatataagataaaggaaaatataagataaga

SEQ ID NO: 32633 - DNA, 950 bp, Bovine  19866881624589
ctttccttttgtccaaaggaaagtgtaccttgtctcctgaagtctatccctctgctatgctgtctaccactctgctttgtatcatcaggatccttactcaaacaggaattccttctcagactttcctggtagcccagtggttaagaatcctcctgccaatgcaagggacatgggtttgatccctggttggggaagattccacatgcctgtgtgccacaactactaaagcccgcgagcctagagcccattttctgcaacaagagaagccctcactccccacaactagaaagaagcccccactccccacaactagagaaagcctgtgtgtagcaacgaagacctagtgcagcaaaaaataaataagaattccttctctttgaagcattatcaacccctccctttctactgactccttactaccatcaagataagctcaactcttctctagctaaaactgacccaccccagaccccacattcttttctatttaacttacctccctctccctttcactggccaaaattccatctccactgctatcttacttcacctattagtcatttctcaacccactatgaatgaggctcttactctgccacttcactaaaatgtttcaccaaggctattaaaaatctctttaaaactaatttaactttactttgctaacactgctgaccatttctttcttcttgagggctctttctccccaagatcgagatcttcttccacaagatcaaattttcttttggttttcctcttaagtctagcacatggacacatgaaactacacaggtgataaaactgcagaacttattaatacataaacagaagtgactacaagtaaaagtaaggaaatatagataagatctgtggaatacatcaatgtcaatcatctagttgtgatatgatgccacagttttgcaaaaatgtaggtacagaataggaataga

SEQ ID NO: 32634 - DNA, 1955 bp, Bovine  19866880052499
acatttttatctctcttaagacagcaggaggaaacaaactagtgatattttttccttctctatacaaatttgaaaggaggtttctcttaaaatactgtgttgccataatgacacctggtttcacctgaagtgaactattctcaaaccttgagttaaccaatgcatttttcttatggaaatgtttgtcttaagctatgttaatgtgctatgcatttaccccagactctgtcttcaagtcggttctgcctaatggctcagaacctacttgacaaaacagtatgttatactcagatattgttcccctaatctatgtaaacgaaactacttgtatggtaatctgcccttctacaagatttaagtcaatcgttttatggcccgggatgaatcatctggtgccaagattatcccaaaatgcatcttatggatgaggggcctggtgccattctaagtttaaagacattcctttctttcactaacagactgctagtgactatataacatccagctgaagactagcagggggggtactttttctgcccccttctgatgcctatgtcagaagctttctctatctcctttatactttaataaaactttactacgcaaagctctgagcaatcaagcctcatctctggccctggattgaattcttctcctccggaggccaagaatctcggcatcttttgtgattcagcaacagcctttcaggagctgcaactacctgaaaaatttaggctccattcagaaggtactcaaatttcaaaaggtacttaaattttaaaaagtaactgatatactgtgctcaccaaataaaatacatttgaggaccacattgggcctggccccttcaggtttacataatgtatgcatttagagatagcaacagtcacctaaaggtagctggttttggagaaaaatattgttctcaataaatattcttcccacttctctccttccctttctttcaccttctcttccttaccatttttccttaagacctaaaggtgaattagcacagtatatgtgttcaattcttgactattcagcaacctaataatatgggcagtgactgtaaatgaaaacacctctaggctttctagtcagagaaacaggaagcttcaattaaagaacatacatcagttatggaaatgggaagggtaggggcttgcaagacagaaaagaggtaatgccactcctaacttctggtaccgactttcaaggatgcagagagggctaatttccagaggaaggatcatcttaaaagtatgaataaggctaatgaggctataaagtttttatacaatgactggacctgtccactctgtatccatggtctcttcctgggaagttaagattgttctttggcagttctctgattctctgatgtcctaactggtctgtgatagggtttggattgagtcaatcaatttgttagcatctgctatttatatttctctgcaatctatgtccatgccatgttgcttcaggccgtgatttacaatcataagctgtggtttatacttatcaacttcagttatgagaaaaattgggcaggcgggatgtaattacattgtcatgatcaaccaaaacacaaacacggaggctcacagcagtgacacagaagtcaggcatacatcagatctctactgctccaccagcaccgaggctgtgctgtgttttcagctgctttctttaggttcctaccaaactggaatagcattttgtgatagagatgtcagcattttcgatagtactttgtgatttttttttcaagacaatgatgggctttgtaggagtttgccatcatttggataaatttatagtgaggtttttaagccaagaattaacagggaaaacctaccaaaaactaaattgttagttcaaagcacagacttcaatcctttaatcacagctaaacttttacttctggggcaccaaagctgtcctcacagcag

SEQ ID NO: 32635 - DNA, 1127 bp, Bovine  19866880116070
tcatgtacggatgtgagagttggactgtgaagaaggctgagcactgaagaattgatgcttttgaactgtggtgttggagaagactcttgagagtcccttggactgcaaggagatccaactagtccattctgaaggagatcagccctgggatttctttggaaggaatgatgctaaagctgaaactccagtactttggccacctcatgtgaagagttgactcattggaaaagactctgatcctgggagggattgggagcaggaggagaaggggatgacagaggatgagatggctggatggcatcactgactcgatggacgtgagtctgagtgaactccaggagttggtgatggacagggagccctggcatgctgcaactcatggggtcgcaaagagttggacacgactgagtgactgatctgatctgatctgatctgaggatgccgaaggccacttcgtggaatgcctcttgactagaaggagagtcagtgagcacactttggctagcccaatctacagaggaaaagactgtagtgtgagagtatgatcatcatcatgcaagaagaataaagacatttccttgttgctgctgcttctgttgttcatttattttaacccttggaatggaggaagcaaaaaaaaaaagtaggattacagagtagacagatgtttcatctgaaaagctcaaagggaaaaggcaaaagacagtaagtaaaggaatactttaaaagagtcctaaagattaatcagctctgtaataagggtgaccaaaatttgattggaattagagacaggaaattaaaacatttaggaaatgctaatctttaaaagtatactgtaaaaatggttggatttttaaaagtcaaaaaagccacaaaaattaagcactaatttctaaggataccaggataccagtaagttttacactagtctttagtgttccgattttcttcatttggtcatgttttcctgatacatttctattcaaccaaagttgcaaagcagtctgtaatttcaaaatttctagttgtttctgtttgcattcctttcatattaaagtcctcactaggtccaggaggcaaataacatttttttgtgtaaaactcagtattacacataatagggataa

SEQ ID NO: 32636 - DNA, 830 bp, Bovine  19866880355877
caatggcaacccactccagtactcttgcctgggaaatcccatggacggaggagcctagtaggctacagtccatggggttgctaggagtcggacacgactgagtgacttcactttcacttttcactttgatgcactggagaagaaaatggcaacccactccagtgttgttgcctggagaatcccagggacaggagcctggtgggctgttgtctatggggtcgcacatagtccgacacggctgacatgacttagcagcatattaaaataaaatttagatgtctgaaatatccaaataagggacaagtcctatttggccaactgtgtactgtgtgatagatgctttcttaactgctgcttgtgttccagtagaaacatccttcctagtagttataaaacctttagctctttcttgtctccactctgtgctcagggacatgctttattacagagtcattagcagtgtcgttttgacaggttttgaagttccttacctaacatgattttttactgcttaaatattttgacatttaaacctctcataagtcctaagcatctggtatgggctccatcactgactatattggcattttcctgctgttataggtgtatcaagcacacttttctggaaattttaaacttacaagcccaaattatccaaatatcaagcatacccaacactggtagatcaataacctcattttgttcttctgaagactgatagcagaccaaaggacatatggctttaatataagaaaatacatatactgactgtgttactgattctagaacatgaagaaaggcagattgtacaagccactgatagtcaatga

SEQ ID NO: 32637 - DNA, 1205 bp, Bovine  19866880482146
ggaagtacagcagtgggttcacgttcatggaattcctttctatcatgaagcacgtggcttgactgatgtaatagctatttgtaaacttgtgctaaaggggtggcaacaccttgagagactagtgagatgtctccttggatgtggtatatgctctaaagccacgtccaaccatactgttctcctgttactaagattcctgggtccatgaatgaaatggtagaaatggaagagattccgttcactattacccttattactctactagtaaaacatttctttgttccccagcatctcatcttgactctaggctcttctgggcacacagaaatgattccatccacctggtagctgagactgatgcctggactctttgctttccttatgcctctgactcagcagggaaagatgaggattatgctattggctagcgtgtttgatcctgactgttaagaagaactagaccactaccatacagtgttataacaccagatgcaaaagtcaactgccttgtagagactccttaaccagcttaagctttcatatttgtaaggtcaaatcttaaaactatatatctgtttatccatctacctctattatagttttctgatagtctgctttttttttttttaattgggtctttaatacaaagtgtccatgtaaatgactacaaagaagttaaagtgttactttctaataagaatcaaatccttaagccactcaagaagatgagaagtgcttttagaaaaggactttttgactaattatcactaaggttggaaaagatgttttccctgtaggagctagtatgtgtttttcaatgaaacagtgtacatttacccaaacagtcctgctactttactaaatagcatgtagcttgagtgggtctaattagttcagtagcaccaagtcttagaaaaataatttctgtgtctcagacaaatgtctgtgataagacctctagaacaatctgctttatattgaggattgcttgggtgaggtaaactatggaaggaaccagaaaagatgatcattcaatagaagggaaaaacacaaaattgaaatttttggagaatgtctctctctgatcaaatgtttggtagtatcctttggccttggagaagtagtttaagagactgttttcccaggaactgtttaagacgaaatttttagatcctgtacgcagtaataaggatggacctactttg

SEQ ID NO: 32638 - DNA, 613 bp, Bovine  19866880496539
atacaggatgcttggggctggtgcactgggatgacccagagggatggtacagggagggaggtgggagggggttcaggatggggaacacatctacacccgtggaggatgcatgctgatgtatggcaaaaccaatacaatattgtaaagtaattagcctctaaaaaaataataaataaaatttaaaaagaaaaaaaataaataaaatttgtgaatcatgaagttgtacaccagttgatttgttgtatcacaaataactatacctcaaaagaataaaaatttaaaaataaagaaattccattagcattctcttgcattacacccacatcacagcaggagttgcacctgctcctgctccactgtttccctcttgcaaagaattctacttcctctccagtcatccaggagcagctcaggagtctctcttctctatccttacccttactgaaattaaagtagaccttaacaaaaaacaaaaacctaagcctaggtgttttcagagaggattacacaactaagaatcattaaagcaaaacattactttatgaaatactatgtgaacatattaatttaccaataaatggcattttagaattagaagggattttagatttag

SEQ ID NO: 32639 - DNA, 1380 bp, Bovine  19866880501433
gtgactgcagcctgaaattaaaagatgcttgctccttggaagaaaagttatgaccagcctagacagcatattaaaaagcagagacattactttgccaacaaaggtccgtctagtcaaggttatggtttttccagtagtcatgcatggatgtaagagttgcactatgaagaaagctgagcgctgaagaattgatgcttttgaactgtggtgttggagaagactcttgagagtcccttggactgcaaggagatccaaccagtccaacctaagggaaatcggtcctgggtgttcattggaaggactgatgttgaagctaaaactccaatactttggccacctgatgcaaagagctgactcatttgaacagaccccgaagctgggaaagattgaaggcaggaggagacagggatgacagaagatgagatggttgggtggcatcaccaactcaatggacatgagtttgaataaactctggcagttggtgatggacagggagagcctgacatgctgcagtccatggggtctcaaagagtcagatgtgactgagcgactgaactgaaatgagctgatggctctcagcaattgaggaaacccccacagagtttccattaataaagccaccttgaaaaaaaaattcaacatttcttctcaacagagctttatgtattaattttaggagctagactgtcattttttttctttaacgcagaaagaaactgaataccctcaacaaagaggtgcttttttaacctttgaaggattttcttccctgcttcataaaaattttatcataattttatgcccccattctttatggcttgttacttggtccattactcttatacttaacttgataaggtcctggttcctatgatattagtttttaggttttggtttctcacaggagctgctttgaagtgcctggtaacattggcagccttagacagagctggtggcttttcaacttattctccctctgctcactgttctgctgcttctgttacttcatacttgaatgggtgtaattctcaacctcacccttctctacttttaaaagagatcaaaccttgggctcttgtgagtggctaattggtccatggatgggattgggcagttcattctggaagtaatcacttctctccttgagtgtgtcaggacatgtcttcttcgggaggttcatgggatttcagaggggcgcccacatgaatgggaacgcggcatctctcacagttcctgtgcacacagataatgcctgtgctcttttcacatgcacacacacattctttttcttattgtggtccctgcagctctagagtcatggtctttatcaaaaggtggcctctcctaagaggatacatgccaggcatgaccctcaactgt

SEQ ID NO: 32640 - DNA, 1256 bp, Bovine  19866880507005
tcttcttcttttcaaaagaaaatgaaattcaataaatgagagcattcagatgaaaaacttaataaccatacttaaaaaataaaaaacaatacaaagcattgctacttaactgcagtggaaatgcttaaaataaagatttatggtatgaatccatgttaagtggacaatagagtgccattctgattcagagtatattttttaaatccttaaggatttcttgaattataaagagaatatatgtataagcagctcattttcctttgagatttgtaccattataaggagagaatatgtctaataatttctccaattaaattatgaacttcattagtgtgcagaaaaacaaccctgtttaggagcttgtctctttatcctaactcctcagtgctagagatttttttaaactagtggattgttaaagggaagatgtctcctttataagaaaccaaaggatatttttcttccctcacttaattgagcatttttataggaagttatgttctggctacatctatatggccaatcagtgggaaataggcatacacttagcttttctgtctagcttcagaaccatgttttttattctaattcagtggttgtgatctttggaaggtcttcttgatttttttgtccctaggatcaaaggtatttcataacacattaggagttctcggccattggttgatatttagtgtaagagattttgtggatctgtgtgaccaatgattcagtagaaacgttctttccattcattctccaaatataagaacaaaagtgttaaggtcctggtttttatcatagtaatttgactgtgtggatagatatactgattttgtagccatataagtataaactccaattcattaagccacttttagaataaaaaatgttagcataatcagaattaactgtgctgtatataaattcatgattgctatttctgcctattttataggtaagaaaactagaaaactgtatctaaacaagatcaacaattagtggcaaagggatttttttgcttttttatttaaaaatttgtatacaattttaaagattactttccatttatacttattaaaaagtattggtatattcctcatgttatataatgcattcttgacactatcttatacccaatagtttgtattacccactccccaacccgtatgttgcccccaccccactggtaaccactagtttgttctctatatctgtgagtctgcttttttgttttattcatttgtttgttgtaattt

SEQ ID NO: 32641 - DNA, 754 bp, Bovine  19866880518419
gggattatgccaccagcgtcactgtccctgatgaaaaaaggctgccagaaatgtaggctgagagcaggaaagcaaggatgtttccacttgatggctcccaggttccagtctgtacattcactgcctcaccattgcaggggcgaaagattggccaaggggcagtattacccttgctcttctgaaaacacagcttatgcactctgattggcgcaggagaatgtgcattgaatgcaagtatataaggtcacctttgagaaaacaggcactgcctgtccacactgaccttgcaagtacacagcagttgaattaaaatattcaatagctgcgtgtttgaccccatgctgtctcaagattcatgccctcagaggacagacacagatactgtctttgaaagagtacaacatctacttccttttcacttcaagtaccttgaactggataggtagtgattaattcattcttctggcagatatagaaataagcacctcactcttccactctgagcttctagcattaagggaaactgggaaggtattgaacattaacaaagtatactaaggttttatgttttttaaagcaccatcacataattcatcttgaggctcccaacaactgtgaggtcgatgagtaggccaagtgttattatccttgccttagaagtgcggaaagagaggcacaaagaggttaaatgatttccccaagttcacacagcccattaaccacagagaccagacttgaatcacaagttcttcac

SEQ ID NO: 32642 - DNA, 1521 bp, Bovine  19866880539638
gaagtgagtagctggggggactgagtagggggtggcgacagaacatgaatggagacaaaagggttgctccagcaaaggtcatatttatccaattttttctgatttattatttcttcctgtataaagttttaaattttcatgtgatcatagttattgatattttatttatggtttttttttgttgcttttatgcttagaaaattcttccattctgaattttgttaaatatttacttcatcttattgtttaatttatgtaacattatttaacttatatttatttaagtaatgaaaattctgtgtggagtttcaagacatacatcaaaatatttttaaggatttacagtacaatattttacaaaacttaaatttaccttttttatatgttgtcaaacaaccatattgcattgtttactttttatacatatattttgctcagatcctgttatattgtacaaagtttgtcatagtatatactatatatatgtaataagggaataatattttgaagatatataggtatttactattgagataatttaggcttttttgttggattacagactaggattgcctctcctaaactttctttagaggtagaaggaaaaaatatttcatggctattgagttcagagtctctcccaccttccattgatctcttttctccttgtaaatatatcctccttaatattgcagtttttctcatcttaatttacacagtggcttctggggctaagcctaataaacctattattttaaaagatctttagttttaataatttatcatcaaagtaagaaaaattaacttctgcttaatttgaaaaatgtcatagatatatcctcatttccaaagcaatgtagaaattctttgttttagagaatttaggaagttttatatgttgccatgaaaaattaggtgtttaataaatagcctgtcttggggggcccaattgtaagcaagtagaataatgacttcaatttcctacctggcatgttgcttctaatgatctgttcaggaaacatgcctgtggatgtccagataccagaagttttgctcgtaacttcttaatagttcaaatggcccataggaatcatttgatgcctttattcaggcagaactttacttcttgggactaagaattcttccttcacttgatttagagcacatagtaaggattaaatagatgaataatgaaagtattcatgtgtttccccaattcacctactttcgtattgctaatattataactgttaatttccagaagaagaagctcaccatttaaaaactatattgccatgctttagggatctcatattttgaagttttgaatctcccatttaaattcaaacagtattcaagaacagaatctggccaatggttttgaaaaaacaaaatggcaataccttcttggaatctcagactgttcaaagattttttttttcctagcaaaacaggaagaaattggaaaaaagcatatggactcaggttgaacatatgatgtattttcaacttgaatccgca

SEQ ID NO: 32643 - DNA, 850 bp, Bovine  19866880579229
ttccagaagttgggccttagcacatttacaaattaactgtattatgtggcaaatgcttgatttcttcctttcttaaaaatgctatttcaagttcccagaccttcattctatctgatcttttagggaatcaaacatatatcccccttaattctaatatacagaaatttatatacaactttgagaaatcagagatccttttctgttatccaagaaggtgacgagtacacttctttttgtatcagctttcatttaaattaatcccaacctcaaagcaagactcaaaattcaaaagctagaagaaacctcagaatgtaatatacttaaataagaatcgcttgtggaggtgctgattcagaaacctgctttttagccagcccccaaagccatggatgtccataaaccccaatctgagaatttaaattcatctaactcaacttccttattttacaattaggtagttaaggcctagagaagtgagatcacttatgcaaaatcacctagcaggaaagtgtcttaatgaggtctcagctggctcttagtcagtacactatcactagattttcttaaaaaaaaaaaaaaaaaaaaattatctgaaggattcaaacatataatgattttaaactaaatctgtatttaagtcagtctcagatttttctgttgctgaaagtctggggggttctgcttttcattgcttaaaagagctatgagcattcagctctccttgactatcaatcaattcttaatatgaggacaattgcaacatcttaacagtaatatatataccatgatatatgctaactgacagtctagctctctctttattgcaaactcagccttcaaacaagtgggg

SEQ ID NO: 32644 - DNA, 787 bp, Bovine  19866880623386
atttatgggtgattttattttctgcattgttaattttgaaaatgttaatctgaaattgctacagtatttcaattaatttggacgattaaaacttagcaccagaagaatcctttgcagaagataagacagataattagcgattctgaaacaaacaactgtggacactggcactgaaacatgctgggtggatgacacccagcagaattcactctgcttaacaggtttgaaatggaaagaatgatttctggcagtctaaatattaaacttgaatgcaattgattttttttaagacagccattttaaggagttaactgtttaacttgatgtgtgatttttgtaatagcatgcaattctgaaaaactgcattcacattattttggaatgttgtcttttgtataactgtagtagtgacaaatcatatttttcatgtcatgatatttcctactttttatattgatttgatgatttttaaatttaaaggtgaagtagcacatgcttgttttgttcgtttgatgacactgaaacttaggtaaatcagagttctaacccttatacactgttgttgggaatgtaaattgctgcaaccactatggggaacagtttggaggtgccctaaaaactaaaaatagaactaccataggatccagcagtcccaggccttagcatatatctggaaaacaaaagcactaatttgaaaaggtacatgcaccccaatgttcacagaagcactatttacaatagccagactatcgaatcaactcaagtgcttgtcaactgatgaatggaa

SEQ ID NO: 32645 - DNA, 825 bp, Bovine  19866880690787
ctttccctaacttcatagctgccactagactgtaagctctgcagaagcagctgcacggtccatctggctcacactgtgtgtccatcatctggaacagtgcctggttggatgatggatggatgtcactaagtggttttgtgataatgttgaaagccttactgcaaagtgatgactagtcagatctagaactcagggtttatgactcttaatcagcgttgttatcactaaaccatatccccagtcatggccagccataagtaagaacagatagaaaaaatgtacctagagttcccccgaaaggccattagacaccagtctatagagtttcttctacacaccaggagctaatctgtagattcagttttacatctcacatctcaaaacttagtaaaacagccaccaaggttgaataaatgggttattattacagcccttcatctccctgccgcaggctctcaaatgcctcaatcagagctgtgtgttgcaagcatgcctttgttattagcctgtttggtggaggttgttcactcttccacgtttctttgaaaaggacagaaacaatttggaatatctttccttcagcactcctaggcttgtttcaggtggtgaaggtagaggtcactttattaataaaaccatcaaggaaggctgtcatggtaacacattgccttgattccttgaagtgcaggagacaaagccagaaagagaaactttcaagtctataaatacaggcccagcattgctcaagcctagcagcttaccgacagggcgaacctaaatgtacatagctttgaacaagacccaaacagaaaaaagaaaacttcc

SEQ ID NO: 32646 - DNA, 988 bp, Bovine  19866880694259
cacagtgggtctttatggtttaccaagttgggtccacgttcattataaagctctatgacaaccttgtgagtttggaaccctgaatgtgttggtacactgagactgtgtctccccctcagggactgaggcccaaaaaccactgacgaagacaagccaaaatccatgtgtactgagcaaggcgacaggtgagcaggaagatgtcaacttgaccagctctctgggcagcattctccaaattattagaagattgctttagggatgtggaatagacctagaaattatatatttgaatatgaaatggtgttaagctctgatagtttgacgcattcatctcgaaggtgggaatgtggctagtaggtcccctaacttcttatgttggattcatcaggcatctcgtcctaaacatttccaaacttggaaactctggagtttctctccctatgcccacaccaggtgatgtttataattataccccacggaagaggattttgatggcccctcatagccccattttgggaaccaatgagaggttattatggagatgagccagaagagatcaaagactgagccatcaaagactgaccttctatattagggataagcaagctatatttctgtaaaaagccagatggtaaatatcttatgtatggtgggccatatgatttctgccataactatccaactctgtaattgtaacacaaaaagtgctaatcacaatatgttaacaaatgttccaataaaactttattcaccaaaataagcaacaagctggatttggtccatgagccatacttgactgacccattgctcctaccccccaaacaaacagcctgccctagattatctctttgttcacaaaatctttctccaaaaatagttcaatagtattgattttttttctactactaaatcttaattatgttcaagtttatcctccctgagagcaatctgattggaatttgtgatctttctaaagctacatacaagt

SEQ ID NO: 32647 - DNA, 2286 bp, Bovine  19866880733736
ttcataggggtcagttcataatatgcccaggacactgctattctgtgcagtacactttaattgttattttttatgctttgtacccaagggaaaatttattaaagggcatgtttacaaagatgtgtaagaaataaaaacatttcagggctgacctttggctacataaagattgaatttgcataaaacttccaaccattttgtctagctaatacctgaaacttctaaaattggaacggactttagggaatgaaaaccttttctaaactttttttttttaatgatgaaactgaggtctgggacttccctgatggtccagtggttacgactccatgcttccaaagcaggggatgtgggttcagttcctggttggggaactaagatcctgcatgcctcgtggcatggccaaaaaagaaaagggaggaaaaaaagcaggtatagagaggattttctcttgtgagaaaactgaatctctattgtctgagaatttgtcagggtgtgttcataaagaagctacattcatggtgtggataatacaggtctgagcagatttgctctgaccaccttcttcttagccaggttcctgattctgggtatgataaagcttgggagaaaaatccttctgtatctaagaactctctgaccccctaaatcaagtgacactgccaagttacaatcaatttacaatgtccaggaaagaaatattaaaaaagaaggtgttggggcatctatcttgcttccatattaggtacctgatgttacccctgctttacaggaaacaggttcagagaagatgcctgcacccacactgtccgtattcagttcagttcagtcgctcagtcatgtctgcatgcgaccccatggaccgcagcacgccaggcctcctgtccatcaccaactcccggagtttactcaaactcatgtccattgagtccgtgatgccatccagccatctcatcctctgtcatactcttctcctcccgccttcaatctttcccagcatcagggtcttttcaaatgagtcagttattcgtatcaggtggccaaagtattggagtttcagcttcagcatcagtccttccaatgaatattcaggactaatttcctttaggatggactggttggatctccttgcaatccaagggactctcaagagtcttctccagcaccacagttcaaaagcatcaattcttcggcactcagctttctttctagtccaactctcacatccatacatgactagtggaaaaaccatagccttgactagatggacttgtgttggcagagtaatgtctatattagcttataaagaaggggccaccttcctgagggcttccaaatctcaactgagtgtatctgattgggagaatggccacaggagaaacctggcctcaaggagttttgagaatgcagtgagtattgaaaatccacctcccgaactgaaaaagcacaaaatagagatcaaggcaatccttggaggaggcactgtagggaatgcgttatacgaattggttttggcatcttttcctggccaataactggagaaggcgatggcaccccactccagtactattgcctggaaaatctcatggacggaggagcctgctaggctgcagtccatggggtttcgaagagtcggacacgactgagcgacttcactttcacttttcactttcatgcattggagaaggaaatggcaacccgctccagtgttcttgcctggagaatcccagggacgggggagactggtgggctgccatctatggggtcgcactgagtcggacacaactgaagtgacttagcagcagcagcagcatggccaataacaggggcatagccccatgggcttaaaccagccctggtttatttcttcagttgacagtttggtcatttctttaagtacagttgagccttgaaacacatggtttgaactacaagcccacttacatgtatatgtatattttttccccaaaaaatgcttccctggatttctctagtggtccaatggctaagaatatgccttccaatgcagagagtgcaggttcgatctttggctggagagctaagatcccacatgccgaggagcaaccaatcctgcgcattgcaactactgaacccatgcactctggagcctgtttgccacaactaagacctgacaaagacaaaaatttttaaatacatatacacatgggtaaattgggggggattttgtgacaatttgaaaaaacttgcagacaaacactgtggcctgaaaatattgagaaaattaagaaaaagttatgtatgtga

SEQ ID NO: 32648 - DNA, 756 bp, Bovine  19866880798029
atctattagaaattctggtctctaaattcaaccaatttcacccacaaaatgataaaataatagaatcctacagtaggcaaagaccttagagattttctggatcgagcagttaaatgttttggacaaggtaaattgtcgaacctttctgtttactttcttgatccgataatgcagtcaaaacaattgaactggttgcatgtatcattcctgaacttgaatatttggtttttcctaaattgaattatttgaccaaaacaagctctatccagactgaaaaaaaagagagaggtgagattctcgtttttcttgtcagctcatggttgtagcttccaaagggacactctgcggctcacacttaattaaagcccagtccctctgactccggcttgcccactaactcactctgtggcctctctctgtgatgtttctctacactagaagggctcggggggctgttaatgccaggaatcaatgatcaaaaattaattttgaagcctatgttaagagctcattaacgtgaacagtgcagcctgcctaaccgagaatctgagcggcacagccgaaatcttccaaaggatttgagaacaaaattttgcagatagaatgtatcttgagataatgatgcatgtcactaataacctagtgctaagttataagcctaaattggagactttgcagaggcatacacagcctctgtaattttccagtttgggtgtaataatatggaaatggcttttgatgctgggattggatcag

SEQ ID NO: 32649 - DNA, 3673 bp, Bovine  19866880803289
cccattactaatttatttcttataattacatgaaaaggatgtcttctgaacactctaagcagattcttgattaaaaaaaaaaaaaaaacaaaaaacacttcagtattctaattaccctgggacagcaaggagatcaaaccagtcaatcctaaaggaaatcaatcctgagtattcactggaagaactaatgttgaagctgcaatactttggcctcctgatgcaaagagccaattcattggaaaagaccctgatgctgggaaagattgaggacaggagtaaaagggggtgacataggatgagatagttggatggcatcatcaactcaatggacataagtttcagcaaactccgggagatggtgaaggacagggaagcctgacatgctgcagtctgtggggtcacaaaaagtcggacacaactgaacaacaacagatctggaagggcagcaagggtaggtcccaaggacaatcagcggtgccttgaaaggcaactctatttgaagaagctatcatagatgcctcaagaaaaggaagactaacccacccagcattttccttgctagtgaaagcatcccttccacctctcagcactgctttatatcctttccttcctatcaaaagtcttttctgaaattttctgatggaacagttctcctcaggatgcatgggggttttatgatgtgtcaagttggttagctttaactatatttctcaagattctcttcctatacattctcaattacaacaggctcaagaaagacatttctgtgagatttggaggacagatgtaggtgagacaacagccatttcatagatcacaggaatcatcaatgtgctgatccaccatgggacatgaggaagcagcttgtgcctgaaagtgctctatcttgggacctttcttctgctcctctgactcctggagcaaggtgtatgtgtcaggcttcagagttaagtgtttgggtttctgcaggacaccctcactacaaatcagaggcaacaagaaccagtcatgaaacttctcatgaattctgctcatgtttataggttccagtttgttcttcctcatgttatattcatttttctgtcctgattctacctggcctgtggacttaaggttcttccaccaaatgtgaagaataagcttcccagagattgtttaactagctccagctcccacaattgcatgagatcaattccctgtaacaaattctctacctatctatgtctctctgtctattctgtctattgcctatttttatttcctagtgattctgtttctttgataatatccttactgatacataatttgacactggaactgggagggttccatagaaaccaaatcttaaagatgagttccttatgttggttctggaattttctggattttatggaattggtcctctgatatgattaaatttaaagacattaatgatcctgtagcccgtgataaagtgggccctggtgatctatggcatgcataggcatgtaggcaacacagtgactcaatttataatgtctgtatgtctgagtccccttgctgtccaactgaaactatcacaacatttttaatcaattggctatactgcaatacaaaattaaaagtttaattaacatttcataatgtttaaatatttgtaatcaagtgtatttagaagggaagggtctttgtgaactagtattttcagccttaaaatattacaataaaaataccgagtataatggggttgggtaattgcttgtaacggtgctggggaacttgaaacaagaagatgatacactcgcagtgctttaaattgtcatctcagccctcagaaaggacgtgaaagcttgtatgactactgtgaggagaaccctcacttcctataaaggtgggatcgggatatctgaaaaccatacccaaagtctaatcctgtaggtggttgaactgtaatacaaactgaattcccaaccatgaagagtctcttttctaaagttatgacattgactgagaaggaatgagatcctgaaaattaaaatgggacatatgggcagactctgatgacccagtctcctaaaatcttttgagatttctttgccagtggaagcagcctttccacccctcagcactgttatagatccttaactgggatataagtgactaagaggatataataataaacagcaaatatccttaatagagaaactattcagcataagaagctctgtagaaatttatctaccttattctacaatattggcttctgatttcctttattgatatcttaccaaaaatgatgctatttgtttatttcccatggattctgataaagatttcttttttttccccatggaaagtaggtgtagatggcctatatgattccaatggttaaaaatttagagtctgacttccccctctttcacttctttgagatattcctacataactttttcttcatttgcaaaagcaataataggcttatctatatatcatagaatttctgagtttattaaacatataatggttataaaatgttatgtcaatccttaaaggttgaatcaatcattaagtataactaaataataactgaaaagtaaattaataataattatagccagattattatgttcctatagaattatttatggttttcatttccatggtagattataaaattgaaatatttttatgctactaatatctttactaatagtattagatcaaaaatttttgtttgcagagattaatttgctaagtcatctgcatttttggtagagaaaataaccatggtactgtctcagttatgaactttctacttagaaactgccagtttcatgtcccattttctttcccctcactcacatgaacttttgttccctccaactctaactaaaatactaactagcatttattgaataatgcttatatggcaaacacatggcttattgatttaatcctccaaaatttgaaagtgaggagttttaatatgtacctattgttttagtatgactattttcaaacaccatatccatcttgttgaagaaaagaacagaaaaatagagaggctgttaactgtagtaaaatcaggaaaaacatagggagtcaggaaagcacatagtaagaacttctagccatcctcaatgaatcagaaaaggtttccagaggaagtgagatgtgaagaatgttttaaaattgggaaaaggcaaattgggagataagagaacattccatagtgggactagtttatacagagcctgacagtgaaaaacaaaagtttgcagaagctacaaataattaagtggtccaggatatagaccatgaagatataagtggcaatatgtgacaatggaaaggtaagcagagttcttctaaagggcagaagaaaactttgatgagtatattctctcctgaaaacaaggaggagccaccaaaatctactctacacaagtcctaagttattttaggaaaattactctggatgcctttataggatgaaatggaaggaaagactagtttcatacggaccagttcagagatgaaaggtgttgtgacctcaactaaagcattgtacaatgaccttaaaaagaagggactggctcaaaggacattgaactggcagattttccaagtcttttctttttttcccaagtcttagtacactgattagatgagaagaagagataaaattcaaggt

SEQ ID NO: 32650 - DNA, 914 bp, Bovine  19866880825966
atggctggatggcatcactgactcgatggacgtgagtctgagtgaactcccgggagttggtgatggacagggaggcctggagtgctgcgattcatggggtcgcaaagagtcggacacgactgagcgactgaacagaacggaactgaactgaatcctacattgtcaccaaatatgtagcaaacataatgcctcatgcatcatgtttctcccctatcttctccctggctccagggtttgaaagaaaggaggaggagggcctcatggctaaccagccgggtccagaggaaagcgcacccggatcttcttaccttcattagcacagcccctccccaggcacagactggagtggtgcggagggtgacgctatgcccggatctctccccaaattgaattgagggagataagaaatagtgctgtctttatcctgtgcttctatgtgtaacttctaaggaaattaacgtatgagtttgtgagaaaagcccttaatctacatatggcatttcctgtcttcggatgttaacactcagtcactcaggtggtgtgatcatttggtaggtcccaagagactatgctttctgagttactttgtgccagaataaccctattgatgctaaataaggacaaagtgaaacagggaatgctgctttgcgtttgtaaaacttctttcaacccaggctttccaagcgtggtacaaacattaagagaaattattatccccactctacatagagaaacgtttgatttctttagtaatagcctctttagcagtttccagatgtaattacattggttagaaatgccaacttgtgcaacgaaattgtcagcacattacatgaaacaaataaaggaaaacaatactccctagaacatatcaagtacaaaaggagtttcctgcacatcctactcccactcta

SEQ ID NO: 32651 - DNA, 931 bp, Bovine  19866880866283
tgttataggctgctaattggcataccagatttctttctaacactgtgctttggtgacttgatgcgtgtatgtttctagtaaatcctaagaattataaattaacagattttattttgttttctgtattctcaaactgatcttataaataaattgggcagaatgattggtcaaatctactgccccccaatctcacttcaaaaattggttgtaaaaaaaaaaaaaaaaatggttgtatcttcaaccaatctagtgaatatattttgttaattagctgtcaccagtgtattggcataggtgtatattttgtcttcggaattaattcctataatgttattggggcatgccctctggtaattattgatttctactgattaaaaacacatttatattcataagttatccattgcccacaggtacaataatgaagcaaagcacatcaagattttaacaagagatggcttttttcacattgcggaaaatagaaagtttaaaagtttaatggtaagcattgattagttcttttcaatctgtggtccttagttttctcttattggaaaggtcagtttagttctatagtttcttggaaattttgcttgctgacacatttaaagagaataatatcttttttgcagcagaatcctgaaaattttaagaattctagttcagttttatattactctaaacatatttttcattgtaaactaagtttgcaagtttaagataatatttcagggtccacactatatgattcttagaaccatagacacattcaggttcatttcatgcaaaatacaatatactgtcaaatggaaaacctttttgtattttctagtctaagtgacttgtgctacagttcttcttcattaccttcgacaattaaacattaacaagatcacacttttaccatacgacaggatttcatagcaatttt

SEQ ID NO: 32652 - DNA, 593 bp, Bovine  19866880913370
actcttcttgttgcgcccaacacacacacacacccatccacccactcacccccagtaggtgaagggcaccttaggacagcttgttctttcccgcctcacagaaagcccttaagaaatcctcataccatcttaggacacagggctctggcattcaactaaagatctaaaccatgtcaagccaaggtacaagaagccgaggcggaccacaaagcagaaggcagggcaaacagagcgtacctagatgtttgcatttacacaaagacattagccggctgattaatgggagatgccggctggaggcggaggcgaccgcgccggcctcgttacctgggacatctgcggcctcaggttgatctccttcaggttgatggagtgcgcccggaggttgttgagcagctggcagagcaggactccatcgcggagggtctgggccaggtcaaacacctgcgccgagtcccaggtcacccggtggttggcgggcagcaccttgcagtggatgagccactgggcgcattgcttccacggctccatgcccgacggcgcctggacgctgcccggccggggcaggcagcggagatgcagccgccgccgtt

SEQ ID NO: 32653 - DNA, 1027 bp, Bovine  19866880915025
acacacacacacacacacacacactcaacaacacagagatacacaaagtgatataacgagaaattcatttaatgaggaaaattaggaaaaactaacttaaaattgaatcttctatgagggcaggtaaggtgtatttttttttaaaagaaggaggaaatgagcatttccggtgagaagaatagagtgtgtgaagacatgacatgggggaataggcgagaacagggctggaaaagttccataacatggttcctttctgggtaagatctgcccagcagccaacactacatgctgggcttcacctgacaaagctttatccacaaaaaaaaacacgtctgtagacattcaagttcaataaagacccaatccatgttagaaactcactgttacctactattctttgaatgcaataaacaatatacatttatatgacattaactatttgtttctgggtctcatttgaaaaccgatttatcaattttgacaggagatttaaacaatataaattatagaaataatttatatacaaaactgcacacagctaaacactcaatattataagcctgtttcagaagatatgtggatattttaaatatctttagaatctaagaaacaagctaatagtaactttattcctttaaaacttctaaggttcttctgagactttgattaatctgtcttctctggccatggtatatttgagaatgcaaaatgagaaaaagatatttgaaaggggttttaaaaacaccagagcactgtataaattcaagacatttcaaatgtaattattaaacttctatattacttttcagttttctgttaatttcccattctttaggaactagtcttttcacacaggcacagaatccatgaatgatcattaatgatacagttagagctgcacaatcttattaagatccagaagggatgatattaatagtccataattcattggtcctctaattcacttacccaccatttcatcctttccctttttttttttttacaaagtatagagtacatggcccat

SEQ ID NO: 32654 - DNA, 2240 bp, Bovine  19866880933883
tggttctcccccgccaccccatacacaagcctggtagacagggatctctttatatgtacatttaatacatgagtttacactaacaatgtaaagatggtttttcctaaaaaaagatttcaacttctagggtccctacagggcaataggaaatcatcagttgattcctgacttattatgttttattatacttaacaactcagatacttcacagcactgcaaattttgctggtatctaaaatatatttcctgtaaaatacacctacagaaaatacatcttccataaactaactaaatgtgcatacattagattatatatgaatataaataactgaatgttacattttgacatgtcctataataaagaaacacgcacaaaacaccttttaagctgttctacaaagtgtagatcaatttaaaaaccgtccttagtaatgggaagattcttcatcctaacagaaaattagtatatcaacatttcaatccaagaaaggatacactcaggccatgtgtcaaatgccctctgaggactgaggatacagagatgaatgggctgcaaggcctaccctcaagaagcttattatccatcagggaaacaaatacaccaacaaatacaagttcactaagacagttcaagtaatatgatgaagatgatggaaggagttacatggttctctaagggcacagggaatacaacggttattccatctagacggtggggttgggaaagtttcctagggaacttttttcaatccaattattatttctaacaaatgaattacaaagacatctatttctttcactatggactcagaaagacagagtgtcgagagcacagttacagagataaattaagacaaagaacctagaggtgagctgacagaggtaagcagccatcaaacactgcatatcacttcctagcacttaagttttgcgaaagtcctgagcaaggcatagttccctcctcgagaactgcacagcccactggaagagagacacagggacaaatcattacaacacaatttgctgatggctataagagcggtgtgtctcagccatgggaacagttaacagttgatgacacaactacacggtgagggttcagggaaggctgaagaaacaaggagccatgtgtgggcttggaggacagtagagttcactagatgaactttctgcagcagtagaatgtacctgggctcaacaagatcctttgtgctgttacttcatcatccttgctgctgctaacactttagttgtgtccgactctgtgcgaccccagagatagcagcccaccaggctcccccgtccctgggattctccaggcaagaacactggagtgggttgccatttccttctccaattcatcatccttagctcattctataaaacccgtattgttcccattttttagttaaggtacatgtggttaaacaggtgaaataacttgtccaaagtcaaactaataataacaggtgaggttgggttataaaagcagaccaaaagtctcacttggctcctttggtttttcccagacagctaagcacaaaacataaggcttactttgatcggtatcctggctggtttcaacctaatttcttcaggagtctcctttaggtctttcaacagttcagtctccataaaatttctatttcttctacagattcatacattttcagcatgcttattatgtatcagcaggcatttgtagctcactaaaattatccctacttcctccacttttcaagaaacttcaacctgctctggacacaccacaaagtaaaactcaactcttgatatttccagtaattgaaacaaacatttatctatggatagacatccatttgttacatagtatgtaatctgaggtacttaggcaacccactaaaaatgaacagggtatatgaagtgaaaatatgatacagtgtagtcacaaagtagcactagctacaatgtatggaagagataaaagttacccaaactggcccaccgttgcatgcaaatttaatatcttccctacatccttctggaaaaaatgtctttgctcatggctgaaagtcatcagtacagtatctaacagttggttttaggtcatcaccattaatagagagaggtggagaagttttcttttccacacaaacagtgaaatgtcacaccttataaagccctcacattgaagtagccacactgtatcagacccacatccaatctgttgtcaagacaagtctctaaactgtgagagcata

SEQ ID NO: 32655 - DNA, 1872 bp, Bovine  19866880936127
ttgctctgctaacaacacttcttagtcacaatcagtgtgtgcaggctaatacccatctcagagttgcagatgactattcctggttctcatcacaacagtcgcatcatgcctagtgccacacgactcagctgtgccctcagacaggggcatgccgatggttcaaagggagcgcactctccggccattattggcctttttcatgatgacatcattcctctgccctttcactcagaggtgagctgataatattttatcaggcaggatagatttttaggatttggaataactctggcaattaaatctcacaaaggaatccagtagtttctgtttaggatatgaaattatttcttctgtggtccatggtttaacattggcttcttatgaatatttatattgctagcatcttagctgcactgccaggggaaaaggcagttctgttgaaataatagctgtaattatttgataggttcccttttttttgacagcagtacatccttcagctttcactgttataccaaactagatattaggaggtagcctagctgtggaaaccaatactggaaactgtccatccatcatgaggaatgatcctttctctgaggggaattttctgctggattgccaagtgcataatattcccctggagcaaggctgaatgaaacaatgctgctgtgacacgtcctgtgacatttaactctggagggtctggaagccagcgcactgggggtgctaattgtattctttagttatcatcatgacttaaagcccagaaggtcgaaagagtttatctaatcccggggtagaaaagcaattaaaatccatcccagccaagatagctttcacaaaatccgctatcccttccctgtttttaggcccataaaggaaagatgctgggtaaaacaagccatagaagcctgcagtttatttaataaagtgtactgagcatgaattctgtgccaggtactgttctaggtactgagaatatggtgataagaagacaaacatagatcctgctctcaagagctcatgagctggaaggaggcagacgggaaacaagtcaagaaataaacaccaggtaggcagacaccacttgaaactggtagtcagccaatgcttttctgagaaggtaacactttgaatgaaacctgagtatcaaggaagagcccaccatggaaagttctggaggaagagtattctggacagaagaaatacttcctgagaaagccagaaggcataaaggagctggggcaattgagaaaatggaaagaagcaagtgtgaccggaatacagtgagtgagagggaggtggcctgagacgaggaggaagaagaagatagacaggcactagattacaggtccctgatggccagaacaagaagtgtgggtttattctaaatgcagtggacattaagcaggagagtggaatgatatggctgtttaaactttaaaataataattctggtactgtgtagacaatagattgtagaaggggtcagggaggaagggctagaaggtgactaacaagactccagcagtccacatgagaggtgttagtggcttggagtaggttgggaacaaagcctgtaatgaaaatgttggattaagagcctgttttagtctgtgtctgcctttgctgcaaaacttaacattaaatctaaattttgaggcgtctgcaacagagatgtgttctttctgctttctcttgctctcaccacatggataccttataattgattagtacttgattctattcggtagagaaggaaacagaacgacaaaaagcagtagcagtcacagcattccagcatatgggcatagcaatcagaccgaatgacaaagggactaaggcctcaggactgggtgggagcccagg

SEQ ID NO: 32656 - DNA, 655 bp, Bovine  19866880967218
gcttcactttcacttttcactttcatacattggagaagggagtggcaacccactccagtgttcttgcctggagaatcccagggacgggggagcctggcgggctgccgtctatggggtcgcacagagtcagacacgactgaagtgacttagcagcagcagcaacagcagccacttgatatcaattactcagttattaaatatttactgaggccttctggaaggctttgcccttcctcaaagagattcaaattaattacaaagacaagaaataaacataaaatttaaagtagcaatattaaaacttacgcctatccacatatccatgaaaaataaggaacacaggaggtcacatgctataggagtttagaggcaagaactctccttgtggacttggatggcctcaaaggaccacactagaaatgtagttttgaactgatctcagtgaatggcagatgtgagtcatgaaatggctgctgtaatagttgtgctctaggtaccttagcaaaaatagttttaaagcactcaatcctaaatctggctattttcctgttttccagagtcatttttttttaaacatgggtgaatctaaggaaaaaaaaagacattaattcttaaattaacaatgtttatcattatttctggatggaaccaaaaa

SEQ ID NO: 32657 - DNA, 2160 bp, Bovine  19866880973029
gggggcatgcttctacttctgaccagctgctctctgtgagtctggcactatttcacctggggagtgaaagtgaaagtgaatgttgttcagtcgtgtccaactctttgtgaccccatggactatacagtccatggaattctccaggccagaatgctggagtgggtagcctttcccttctccaggggatcttcccaacccagggatggaaactcaggtctccagcattgcagggggattctttaccagctgagccacaagggaagcccaagaagaatggagtgggtagcctatcccttctccagtggatcttcccatcccaggaatgaaaccagggtctcctgcattgcaagtggattctttaccaactgagctatgagagatgcccctaaaaactaccacttattggccaccacttaagaagtctgtgtgacctagggatgttttttaacttctctgagcttcagttttcacagaagcattcagaataattccactttttcatttattttttaaagaagcctttatattaaatataaatattatgtattcagtagagaatgcattttaatctttactgaagttgcaaaactgtcacttgggggctctgccagaaacatctgcaatggattatatctggcaaaatcttccttgtggaagctttcaagagtggaagcactcttggatgagcttttcattcatacaatagaatgcaaatacccacccactcttctttacaaagtctttatcctgtgaaataactcagatgcagatgcttcagcttgagataataagctttctggtttgtgaagtaaatgcgtgtcatttgcagatccaagtctctgaggagactctccactaattcacaattgatgctatccgaaaaattcacttgtcccttgggagatgcatcttattgcccaagaatctgctcataggctattagggggagtttacgaaacaaggaggaatgtggtattccgatgtcttattctccttttggagaaaacactatgaagagggaccagactgacgatgatactcacaacattgactggatattgatgcctcaaagatgatgttgtggaggaacagacagacttgaagaaatgcattattaacagcacagttgttttcacgtgggtctcctttcacttttcaatacttctcttgacaggggtgggaatttctcttgaaggtacagaatattctcaatcttcctgtgcaaaaaattacatggtctttgaaaggaaaaaggaggtctttcttccctctctggagccagaaagtggggaacttggactatgaggcatggaggtggctggagattccagctagagatcatgaagatgttcctccttggcccagctatcacatcaccactgtatgacaccttctgggagttgggagccattcaaatctgaacgtggtgagaatttcactcttgacatggtacttcagtgctcctcaaaccttccataaagtgttgttaaatttaacaatcttgttttaaggaagtaggtgtctaggattggagaaaacaggtatgtggcaaggaatctgattagcccctttaagcagcaagtgaggccggaggagtcctagagccatgtaattacggctcagggcactttggtcttctcctagcaaagcagcatctccttgatcctcctgactcactgttatttctaaatggggctctgctgtggaaccagtgactatgtgggcaaaggctgtgataatttaagaagaggtattactcagatagttctgagtgaactgtgaatatgaagagcaggcaaagaatacaaagggtaggcacttaggtgtacactggtgcctgggaaacagcaagactagaggtttatccagtaaagttcactctaggtaatacgttaacagctagaaatctccatatcatacaaattgagagtcggagcaaagtatgtcagaaactcaggaaaaaagaaaacagaatatagggcagatgtaaattccaaaattaagggaatctgggcagaaggtaggcaacactgcacagtgggtaggattttgggctcttgggcagggtttcctggttggaatctgctctttcctctttcaactagctatgagaccttggacaactttcttttcttctcagtggctcagctttctggctta

SEQ ID NO: 32658 - DNA, 863 bp, Bovine  19866880979780
ttctttcttctcttttcacttcttgagaattttactgtaattagttcctaaaccttaagcatctcatgtactgaccaccccatctccaaaaccacaaatgtgtttctcacctctgaagttccttctatggcccatgccccacgtattctgcccttcagttcagttcagttcagtcgctcagtcatgtctgactcttttcaaccccatgaattacagcacgccaggcctccctgtccatcaccaaaccccagagttcactcaaactcatgtccatcgagttggggatgccatccagccatttcatcctctgtcgtccccttttcctcctgcccccaatccctcccagcatcagtgtcttttccaatgagtcaactctgtgcatgaagtggccaaagtattggagtttcagcttcagcatcagtccttccaatgaacacccaggagtgatctcctttaggatggactggttggatctccttgcagtccaaggtactctcaagagtctaccattttaaatagaagtacaagcttacctgaaacagtcccaggatagcaaagaaaaggaggaaaaactaaaatgttaacttctcatcttaaaagagattaagtattcttgttctcttacaatgtctatgtagggaaataaaatgatttattaaatggtgttttctctggaataatcataaacaaatgcttctcctaaaatgatttcttagaattctccttgcagtgctcagctatgatcagcttccttggtgccctcttgaatagaacaggttatcttttcttcctcatcttttacctggtcaggcaatgagattcttgcagagttgcttgttctgagctcggaagagacagtttct

SEQ ID NO: 32659 - DNA, 1078 bp, Bovine  19866881014946
ttatcttctcctttcctactacatttatttgcactttgtcatcaaaactgatcagacttaaaagtgcactgcctgatccttttcccctaaactgttacaccattttccttgctttcattttagacctctccaacatgtgttttgagcccctgcttcctcccctcccctaatttttagaaatcattccatcattctctagtatgatagtttctgcctcaactctctattataacaagtattttcaaggtcattgacaaccactttcaagacaaatcagacgatttttcttattccttatattctctcaaatatgtggcactattaatcatatactctttttttttaacctctggccttttaaaataaattttttatcaaggataggaattgcattttcttggaggtcatattaaatttgtatgtctctcctgaacatatatcatatattcagatatccagagtgccctaattttatatatatatatatatatataaactcaaatgtgggttgtaagctgccaataaaatcagttgtaagtaaatgatgtgttcacatttatgaccaatacatgaggtcatcctttttttaggggagttgattaattcctacatgattggtccagaagaagttcctgcacaaagagtaactcatcccctaaccctaaattctggaatgacattaatactggggttgaggaatttctatttacctttctgaaggaacttaagtgcatccttgttgcagtttgatttttgaccgtcccgttcatattcttttcatgtaatttttaaggaaccttttggtccttgtggctgctctttgtttgactttcctagccatgaaaaacacaaatctcagacaattcttcaaagattccctattattctatttctcatcttagtctttgctttcaccagcaggtcagactgtttttcatgccatctgtactcatgttgcccaaagcaaacacgtccaggatatcaagtgcctatttccattgatggcaaagatcatttcaatctaaattacaagaagtagaaggaccattatgaatattcacctgtcagagagttgtta

SEQ ID NO: 32660 - DNA, 951 bp, Bovine  19866881038119
ttggtaggcaggttatttaccactagcgccacctgtgcaaaatagtctagcaaaaattataaaaatttaaaaaatgaaaacaaaaaagatcaaatggggttactagtaatagaagaggacatagatgaattgttgaagttgggtgatgggtacagagtgggtcactgtactattctgctctagtgtgtatttgaaaatcttgtatcaaacatgtaacaagtggtggatcctggcaccctatcttggttgtgctgaaccaagattactgggggtggattcctcgaatctgcattcttagaaagttccccaggtgattcctaggtgcctaaaatttgagaaccactggttgatatttaagatggcaggatcatttctctaatatctgtccctccccaagacaataattgctgctgcttaagatgtccaagcaaacctttaacttcaaggatgaaaatatcaacacatcaatcttaaaggtgaatagcaatagcagcgagtctaccacacagagccaaattataagggctcagaaataaacttgatctatttcatgaaatagaggacatggttttagaaattacccactttttatgcctaatgaaataaaagaggacattgtctctattgagaaaaagcaggcctgggtaagaagagcatgctacgtaatgaaaatgacaataactgaaataaaaatcttatttgaaagtagtaaaaagcagacttgacattgcaaataatcaaatcagccatatccagaatactgagaaaatgaaatcatgagtttaaaaaatgagaccaagtataatgggcatagaggtcagtcatgaagataaaacctatagactaacaaatggatcaaaattaatcattaaagatgtaataacatatatcttagaattctgggagaaaaagaccccaaaataccagtgaaagaatttatcatgtcccaag

SEQ ID NO: 32661 - DNA, 1262 bp, Bovine  19866881046377
ctgcaagtgaagaccaccaaactgtttccaggaaactttttatgtctcttttttcttggcaacaggtgggtgtacttttcctttccattactaaggcattccctgaccaaatagctgtattaccatcaagtggtataatcatcttctaccattgtttgatgcccacggaaatgctttctgctgttgactcactgcaaattaactcgatagtgctgaaattaatcacccagattctttatctctatttagaaaaacagggagtccttggctttttgtcagtggtaccatcaggaacccaacttttacatcatttatagttctttgtaattgccttaaaaagtctaattagtatactggattttgttttccaagagtttgcttatttttaatgggtttactctcttgttaaatggtctaaatgactttccaagaagaccagctctcaacagaggcagactgcttatcaaaaaaacgactactaatccaaaatgttttttccccatgacttttaagtttaaatatttagtgttgggttttcaccaattataagcaattaagctacattagtagtgaaatttcaaatctcttaacacattttgcatgattttaagattaaatatttagaaatggactttgggcaatctaagtaaatgtgttctgttgaaaattaaaatgtcactgtttattcaagagatattttccaaatacagtcaaaatattaaatagtaattatatcttatacctaaaaagtacttcaaagtatttttataggcattattcatattaatcaatcttaaatatgtcaataaatagtggaatacacatctttgaagatccttatgtaaagataaatattctcttcatgtttctttttaatgaatatttttacagttctttacaaactggataaaatgtgttgggaattctaatgacttgcttaaatgaaatcatttgattccatacattttctacagaaaaataagaaaaagatcatggaagatactctatgggatagtactcacaccatctaacaagatacaatatatggtgactctgttttaaagaaagaaaaaaagaaaggtgctctcttagatcaaaaaagtcaacacactcaacagatgccttttggagtattcattgggtgtctcactatttagatcctggggatacattagtgaacaaacaagtaatctctgagagactagtaatttagtattctagtgtagagacagcaagtaaacaaagtagtatacatataaaat

SEQ ID NO: 32662 - DNA, 1573 bp, Bovine  19866881062981
gataagaaatggcggttgtgaacacttggtcactggcttcatgcctcacaatggaagcacggagctgagggcagagagtgctgactaggggtggtgtggcagaagggtgcacaggggagaagcttgttgaactgagcctgtaaaggatccttcttggccctgagaagccagaaaggaggcaggaattccaagcacccttaccctagaccctctaacacctgagaggccatcctgagaggtgaatcctctctcagctgactccctccagttcaggaatctgtgacttccttgcttccctccttcccacttcccactttcaagcactgaagaaaggagttactgcaggggtgaactcctcaaaggcattcttagacagtgaccctttgccagctctctacccaagcttctccagaatctaaatatactgattatagggagatgccactcaccacctaaccctccctcttgggctaccagagcctcgacccttctgagaagccagtacaccctgagaaatagcacccacaggagctctctcaagtctcagtggccttctggcctgagcactgagatacgcacagctctcatccttacattttcctcctgcccttttctctcaagccaaaaaaaaaacttcttctgagtttccattctcagttttgtttgatcattttaggtgtttctccagtaaaaataaagaaaagaaatctgtccggagattaggagattctcttctaggatataccaagatctttgtgatattggctcccaacctggagaaagctcctttttcagctgtcaaagactcagaactaacctccttccccctcttcctatactgtatctttccacatttccagggtctctttgacttggaggaagacatcagtcccaaataagtccaatatgggaacgggggaccctctccaggtaagtatagcttctcccaccccaagagtaatagtcttccagaggtgaatttttctctcaaacatctgctctgatcttctcagattcagtaaattaccaactaaacaagtcaaataaactctgagcaggaaatttgaatcctcaaggagactttcaatattaaaaccctttctcctccagatcgtgatccctcctctagtagggattggggggaaggacattttctccaaaaaaaaaaaagttttgggtggatttgaaataccttcttaaaatgggatactgtgaatttatattttaaaccagctttcctgaacatacctatgcatatttatttacataattaaataaagagcaatcagaaatttacctagctattttcttggcatcttttctccagcatcctctgcttcttccacttgtacgtgtgtatgcatgcatatatatacacatgtatgtctatatacattaaatatatatgtatttaactttctttgaaagaatgattttttatttttttacttaaactttcaactcttctttcactccctttagaggagaattatttgatctttcaattctctgacttcagatctctggctggtttccatgcattcctcattcttcttcaacttagattttcatc

SEQ ID NO: 32663 - DNA, 1559 bp, Bovine  19866881076234
aagttggtctttagggtctgttctctagtgcaggtgtaaggcacagtttctactgagtgtaacatatggaacaatcctgctcctgattgggctgacgataaacttgttgcagtatgtgataataaaggcttaataactgagcacatccttcaggctgaaagagatttttcatattgggacctttattttcccagaaaagatacaaattaaagagtgagaaataggcaagtaaaagtcctgccatgccatctatggtatccattacaatacagtgctttttatgtgttttcttcttaggattctcattgtcttaagctttattctgtgtcctatatcatggggttttatttgcttcattgtcatttatgaatacccaagtgttccacagggagaattttgtaagctaattggaaccaaaaggcaattataagcagtagaactgtaatcagtgtgccaaaaatatatatttttatccacaatgaaagttaaataacctagaaaatagttgtgatacttcacacttacaaatcttgcatctacatgatctttattctaaggagtgaaaatgtttttacactcattctgattaattcacagaaatctgcataaagaaggtaagttttaagtgtggtttttaaagggccaaactcattatccatttacaggatggcatttgcagaattaaaattagactctcttccagacttctggtctgctacttcagttctatatgttagaccatcctttgttttaggagagtcccttgtaatttttaacacctttaaggaaaacacattttttaaaggcagtttagttctgttttggtagaacaagcaggaaacaaaacattgctctatgtagtttttgctttttaagttgttttagctctttgcctcaaaggaaagaagaaaaagtcagaaaataagttgagcttcgggaaattctcaagagaagggaagcatttctactcagactgaaactggaggcaaggagcctggagtgggattggctatgggcaacaggtgttaaatgccccttacccctctctgagccctgaagacagggtggcagtgactgcagcaccttgacccttgtcttagtttacctggtcaagaaattttgcttcccacatggctgctatatttagtgttcaaacatacaacagtccaggcaatattttttcacaagttcatttttctcttgttctaacctgaaaaaaaaaaatggagggttcaattgaagggatctttttcatagaagacatcctttctcaaaccttcggtcatattttaccttctgcctgaaatttcctttttacccccattcacttagataatatttcattaccatcagtactcaatttggtgggtcaccttctctgaaccaaaacggcttcttctatcttgtaactcatcatactgtatcctgctgctgctgctaagtcgcttcagtcgtgtcctactctgtgcgaccccagagacggcagcccaccaggctcccccgtccctgggattctccaggcaagaacactggagcgggttgccatttccttctccaat

SEQ ID NO: 32664 - DNA, 1592 bp, Bovine  19866881083668
attcagtccttgggtgggaaagattccctggaggagggcacgacaacccccctcccagtattctgcctggagaatcctatggacagaggagcttggcaggctacagtccatggggttgcaaagagccaaacacaactgaaacgacttcggatgcacgcacgcaagcctctatttccctgtttgtaaactagtgaattgattagtgccacacagttaggattggtgtgaaggttaagtgaggtgtaatgagcacattgtgttttatcacagtatcggcacagagtaaatgcacagtgaatgtcattttgcagtacgcttagtattttttttttgcatatgtgtataatatacagagaatataaatgataaagtaattttgtttaccttttatttagattgccagaactctgggttgtttttaaggaagacatttttaatgatcagactgatgctttgtttgaactcttttgggaaatttgtattcacttttatagatcattacataatccacatacctatttcgacaggaactctgtggaaatgcagcaccccttcccctccctcctgccccctgcagctagtttctattttggtgatgtggctagagaaaaaagaaatcatcacacagcgtgaatatccctcaggctttgtgtttttcctggcaggttgacctacgtggccagtctgtaaagttccctgggaacatgcaattctgagccggattcggttgcttcagtctatatgttgctggttctcacacagtcagattttggtacctattttaatgcaaagcatttggcttaaaaacattgtgtatttaatagcctgtttgtctgaatcacctctctacccagtgtaaaattgatgaacttagactgatgctgtgttgtgaagctttcttgaggatgttacctctttccttttgtctagatccaacataagaccagactatgcagactccaacttccacgagttcaagatgcacaccttcacccgggttacatcctgcagagtctgccagatgctcctgaggtcagttggcgtggtcttggttttcagtttaaaggaactggtgtaactgccaaatgtttcggcttccctagggtcccagtcagaatgttttctaatgggtatatgccttaccagtttggatccatcagatctttccttggccttgtgcctggaccgttccttcagaacccaggaaggttctctccattggcttgaaggggaccctgcatagtgctgtgttctcttgttctgcttcctggcgctaatggttttctagaggcagaattttgcaccttttaacctatcactctctgattttcccttgcaggggaacattttttcaaggttatttgtgtgttaagtgtggtgccagagcacacaaagaatgtttgggaagagtagacaattgcagcagagttaattccgctggtaagtcatgtttattgctgtgattgggcttttaatgagaacataaaacttgctcaacataattaaggcctaatttactctaaatatgtgtttattataacatatcggcttttgacactattgtttatgagcacaattagaaaaatggtttg

SEQ ID NO: 32665 - DNA, 1826 bp, Bovine  19866881101539
gtctatgagttaaaaaatgcattttagctctgcctcctagcatacattaacacttttctccatagaagtagattgtaaatatcacttctaagcatttctaagtagttttaattcattatgattcactgtagtttccttttgaagtaaaatgaaaaaacagttataagcgaaagtcagaaataaatgtctgaatatgcatttatacttgtgatcaggcatatcagagagagtcatcaattttagttttgatccatttttatacaggaagcaatttgtttttcaggaaaaggcatattttatgaatcataatttaatattgttttgtgtctgcaccaatttatttaatgaaagttataaaggtgcctcttttcttaccatatacagcccatagcctattttcttaggtactttccaaagagaatattttcactagaatggcccaatgtgtactgttagatttacaaaagtcccatcacataatgcagagaatgccctgtaaaatgaatgcatataaagacagcactgtttgatacatcagatgacatataactgtaaatgttttcaagttgaccttgaagatgttaaggaactcaccaccacaaataccagacaggagattaactagaagacgactccctatctctggcatttgtaataggcataaaaggaatgacaagtcaattatctgacccagaataaaatgcccgcataggaaaagaaggaggaaattcagctacatgtctcttatcaaggttagtaaaaatttcataagtagatcatcatatgaagtgcacaaaatcaatggctttgaaaatggttgatttcatagctataatcctcagttccagccatgcataggggattggcagctgctccacccattaatattaatgaattatcaatgtacagcccacgcacaaccaccagggaaccaaaaataccccacctacacactactttatttttcaatcttccaaatgttttaggatggctactcccttaataagtagagaatcgttaagtacagtacatattatttcatgtagctaaaactgacatctcgtagaagttagtgaggaaatgtaactttattcatctgttaaggtgtgttaaattatctcacttctttttgattgaagagatgcctgtgaccattaaggaaatgtagcctgtactgctagcatatttcattaagagaaaaattcagaatgaccctagtagtctgcttagtgaaaaattccttctccaagaagatatctactagtgttaaatgcactgtcacagaacatcattgttttttctaaattctgaattcaatagagtaagctctgttctttttctgatctcctcccccgtgatggttccttcctgctttttagttagactgatttctgtaagctctgatttcttctctctacattttcttccacaacattcttgctcctatgattttaaatttccccgctgtatgattgccatctaactctgtgttatccagatggattacataatcacctccttgactttcccccgagtctttaactcccattgtctactcttcccctatctaatccacaggcaagtcctgaacactgcagttaaatgatatcgctagcacctgttacccttcctgcaggcctgtctcctttctatgacactatttttttaatgacattctcacctaccaagccatgcccatctacaagccagctgcatattgatgtcatattagttattctaaaatatataatccctttactgagaccctgtggccagtgataaatttcagatatcatagtcaagctgggtccttagctttctttcta

SEQ ID NO: 32666 - DNA, 681 bp, Bovine  19866881143028
agtactggagtggggtgccattgccttctccgaagaatacctactggtattctccaaagataaagttttcatcagtttgttttataggcaagaggtatcccttgtgtagtatattcatgcactcgatgaaaaatatggtttagaactcaattactttgtactttctactgatgccattagataagaattggcagaatcaaataaaaaacaacattgaatattattagcagttagtaaggatgatttgggcttcaaagaatttccttagaatataataaattgttttgatttgcaggttaattaatagcaagatttttggtcaccgtattataggattgagcctagtaaatttagacagagtctttattctatttgatggtgtttaaaaataatgtaaataatgtgattgtagtctcaaagtttaaatcccctttttagaggtaaaggaattgggaaggagaaggctcatggtctgagcctaaattctggccagttatcagggtggattgagttctaaatcaatgtgtgtgtgtgtgtttgtctggtacttaggtaacactggctgtgaattacataagtcactggaggtatgaacgcagtgtgacaacactgtcatttttctccttcaggataaactttggactaacattgaatagcttcttcttcctggggagagccaga

SEQ ID NO: 32667 - DNA, 1587 bp, Bovine  19866881157234
ccttgaaacagggacttgcaccaagtttatgtacataagagaaagctaggtgggagcctttctttcaacataccccgttttaagaatctaaacacaacacattacaaacatattacaactgcctatattacaattactataacaattgcaaagttaacacatacaatttgcatatgaattttgcattaagtggctgtttcttttagttttatttggggggagggatacagatcgatttaaagatgaaaattaaaaatggacaagattcaatcccaatgctaattttctttacatcccagtttacctgtttagaaatagaaatgacaaactccattacatttcaattcctgaaaatgactaacagttaggaagggccctgagatatgcaagagagtaacttggcagagggcaaagggtatctctgagaggaaagacacactacacgtggaaaagctggtggggaatatttttgttgccttcccccatatccaggagtacttttgcatattataatttctccagactgtagaaaaacatctcatcattttgagcctatgctatatttttgccaaccaaaatgatcctctgaagaaggatctgagaagagaagacactgatgggaacatcaggagagaaagggtagttctaaaagagggctctgtagactgaatgaacctctaatagaggttccaagaagcctcagatccagagttcaaggggaaaagtaccagaacacctgagtagctgtcagattgctttacacaggaagactgcctggggcatggaacaggaggtttggggcccttctgttttttaaaggactatacctgattaatggaactgaagaggcatgagcaaaaagtcacctttctggagaaaagcaaagcctgcatttctttttcaatgtcaactctatcatcctaactttcctacataactgctatgaaggcatctttgccaggtctgaagctggcctttacaaaggacaaaaagctatttcccttctcctctctgctagaaataggcaaagtttcaaaagaaagattgcctaagagaagttgtgtagggagagggtctatgaaagtgccatttggctggatactgtgcccaaactgagaacccaggttaggtgaactcaggttcctaacagacaagttgtgatacctgttacactggtttaaccagaaagacctataagccagaaaagccctacactactttcttcttctactgtgagttagagaaagagcctgaactggaaatcgcagacaggaagaagcaccaaaaaggaggagagtttaaattttccatccaagcagctgaggaaagctttgctatttccagatgacctctcaatgggaaaatctcctgtctttcagggtcggtgtttaaaaatgagagtgcatcttaattttaattcagaaatatttttttctgacactgcacagaattgttgttatgtcctggtgaagttgatctgttacaatatgtttaaatatattttatttttagcataaaacctaggatagcccacatggcagtagttggcacatcacgttccagtagtgctctgggtttcctcaggaa

SEQ ID NO: 32668 - DNA, 681 bp, Bovine  19866881163244
acagagagaaagcaagtttatagagataaaaatatgactgctttattcctattgataactttatcctctttactcaaagatattgtcttattcagttatgctttttaaaatgtgtgagattattaaatgcattaatgtctcttaattttttaaatcttcggataaagaagtgagaacgttaagggcaatgacagaactttaaagataatgaaacaaaatgtaatatttgcaacttagaaactaatgtgtctaaatccttattagttcagttcagttgctcagtcgtatccgactctttgcgacctcatggactacagcacgccaggcttccctgtccatcaccaactcccggagcttactcaaacccatgtccatcatgttggtgatgccatccaaccatctcatcctctgccatccccttttcctcctgccttccatcttttccagcatcatggtcttttccaatgagacagttcttcacatcatgtgaccaaagtattggagtttcagcttcaacatcagtccttccaatgaatattcaggactgatttcctttaggatggactagtttgatctccttgcagtccaagggactctcaagagtcctctccaacaccacggttcaaaagtgtcagttcttcagtgctcagctttctttatagtccaactctcatgtccata

SEQ ID NO: 32669 - DNA, 1665 bp, Bovine  19866881280286
atgtaggtcatgtaccccttccattagcttttcccaggattcaccaaggaatatcagacactgtttcctttggggtttacctgcttgctgtgagttttaatctcagctcccatggtagtattacactgtttgtttacaagtccgtcttctctaacagaatataaactataggaaagaactgccttattcatcttgttatttctaatgtcgttcctaatatagaggagttgttcaattcttgtttaagaataaggaaaaaggaagggggaggggaacaagaaataatttctatgatatcataagaatcttatgattgtgctattttctatgggatttcaaagtctggagaactgactattgagtttctttctggcttattgaagtaagaagagaattcacaatacctctgatttcattcttctctattacacattgaggcaggatttaagagaattagtcatctaccttacgggagacagtgttcttgccaaaggagatgtcagcctactgggacataaaggccgcctggcacaaacccatcttcctcactggaaactaacccagcttatctccattgcctctgttcagcatagatgctaacctatgaaagccattgagccaatacaaacagcagtcaaggccatcatttcagaacagtaaacctcaaactaaactcaaaagcagaagttaagaaaagcagggagaaacatatgggtagaatacaactcaaactaatggtgccctgtaatcttagacttctcttctgtgtctgctatttttctgttcttggacaatgttttatcatggatattctcattgcagtggttaattcaccagattttagctcagcccctattgcaacatacctcacatttacagtataagaacctcttacagagactcttaaacaagagcctgggctctattgtagtattgaccaatggcctgacagagatcttggaaaccctgtaccatcatcttaaatgtatgcatctttgccccatcctggatataaaacaaatgcccagacttgaccattattactatatttctcttaagcaacctctagtgcaatattcagtcagtcagttcaatcgctcagttgagtccgactctttgcgaccccatgaatcgcagcactccaggaccccctgtccatcaccaactcctggagttcactcagactcatgtgcattgagtcgatgatgccatccagccatctcatcctctgtcgtcccctcctcttcctgcctccaatccctcccagcatcagggtcttttcaaatgagtcaagtgatggcataagatggccaaagtattggagtttcagccttagcatcagtccttccaatgaacacccaggactgatcccctttaggatggactggttggatctccttgcagtccaagggactctcaagagtcttttccaacaccacaattcaaaagcatcaattcttcggccctcagctttcttcacagtccaattctcatatccatacatgaccactggaaaaagtgtaatattaaagatgcacattacagctagtctaactctcttatcccacataatagtaaagcatgagagacagtatgagagttttacacttcctctaccacctaacaggttgtgtggcttccattaacatttattaaatttaaaga

SEQ ID NO: 32670 - DNA, 2433 bp, Bovine  19866881337915
tcttcgttttctgaatgttgagcttaagccactttttactctccccttcactttcatcaagaggctttttagttcctcttcactttctgccataagggtggtatcatctgcatatctgaggttattgatatttctcccggcaatcttgattccagcttgtgcttcttccagcccagcatttctcatgatgttctctgcatagaagttaaataagcagggtgacaatagacagccttgacatactccttttcccatttggaaccagtctgttgttccatgtccagttctaactgttgcttcctgacctgcatacaggtttctcaaaatgcaggacaggtggtctggtattttcatctcttgaagaattttccacagtttattatgatccacacagtcaaaggctttggcatagtcaataaagcagaaatagatgtttttctggagctcttttttccatgatccagaggatgttggcaatttgatctctggttcctctgccttttctaaaaccagcttgaacatctggaagttcacggttcacatgaacttgctgaacattgctgaaaccgcgcctggagaaatttgagcattactttactcatgaatgaaatgagtgcaattgtgcagtagtttgagcattctttggcattgcctttctttggtattggaatgaaaactgaccttttccagttctgtggccactgctgagttttccaaatttgctggcatgctgagtgcagcactttcacagcatcatctttcagcatttgagttacctcaactggaattccatcacctccactagctttgtttgtagtgatgcttcctaaggccacttgacttcacattccagaatgtctggctctaggtgagtgattacaccttcgtgattatctgatgaatttaaatttagctttagatattataatgtttgacatatacaccaatgtcccttgctcaagtgtaattatctgaaattggattatttttaacttatttctttttttttcctttttaaaattttttattattattttttcctttcaatattggattggttttgccatacatcaacatgcatccgccttgggtgaacacgtgttccccatcctgaacccctctcccacctccctccccataccatccctctgggtcatcccagtgcaccagagcaccgagcctcataagtttaaaactgtaggacatcttgagtcaaattaaaatatgatggtcaagttaaaactttacaacttacacagtgattacctaatgaagctaccattaaggcagtatttttaaaataaagatacataattttcattcaagagaagagtcagcaagtggacaatcaaaccttcattatattctcaacattatttttgaatgttactctcccttcttttcagagtcactgtcaaaatcctgcccaataagcacaccttcaatctctagagttatagtttctatagtcattgtaaatcttagggaaagagagaccctcagactgagtttgaaggctgagtgtgaggtgatgcttggttgtcttttccccagctgaaatgcccctatttctaaccatgggcctgatttggaaatatttaatcaaatacttactataagccttcaaaacatagtctttgctaaaacagtcttctgcaagtcccagcatgggagcgggaaagctcctttataattggtttctttgtgcctccctcatgttttctgttttgtggttatttttattcttgatgatttctgccttttttcacccttattgtagaaccaaagtaacatgggggtgaagggtaatggagtcccattaccttgctctaaaaggtagctcgtccctattccaatttcttttctattaggattaagagttgaggccaagcacttgactggatgttgtggaagaatcatttctaccctttatttactttcaatactaataaacattttacctttatggggtctcagccccccaactgtagttaatgccagcagtgttagattctttacttcttgagcctataacttagaacttgaattaattttaccccaaaagttttaaactgatttccatacataaagtgaattttaaatgtatatcattttcattcttaacactgtgttaagatggcataacataacaagtgtaagatacaacctcagtttccaaggaacttaaaatgcagctggcaaaatgagacccattcattacaataatattagcagtttgacctcctatttgagacttatgatccagaacttgttacaagctatggaagcaagaaatcagtgaaatagttatccatccagtgaaccgcagcaatttacaagacataagctaacatgtcagggatgtgtccccagttcctgcctgagaactctagtcaaacacacaaactcaatatggtcattggagctactggt

SEQ ID NO: 32671 - DNA, 1452 bp, Bovine  19866881453878
atgcatccctaagcccactatattggctatagtatggtggtcagttgtcaggcaggcctcatgcttgagtagaataaacttttctactgtcttctaggactttattggtgccaggtcttactctaagttctgggattagcaaacattcttgcgggtggtttctagcttttatcacctaatgatccttttacaacttagagggggcataaagccatatttaccttcccagctccctgccctttgtaataatgagaagtgccataggacaggcacatgcatagtagtatgcagtgtgtttgaggaaagtgcatggtgaagtctaaagactggatttgagtactgatatgtaggaatgtgcctgatagaccaggagaagagagcaaagacatggaggaacaacgcaggcttcctgaagcccaactgtgggtttgtggcagtgataagagaggagatgggattataatagccatatgtggcatgcctataaactttatcctttgggaagtaagatgcctctgaaggattttaaggaagggaataatataattggagttttgttttagaataatcctttaaagaacagtgtgaaggtgaattgcagtggagatggaagccagcaataatggtttttgatggtatctatgaaataaaatatttattcaaagatataagcattttatatatttatatttatgtcaaatgcaatgtaaggtattgtgtggagaagaaaatgtagataaggctcttatctgttctcagctagtttaaaagctggaagtgaaataaggcacacatatgcacacacagacataatcctgaagggaacacatgataatcactctaagaagtacagagaacttgtgaggaaattcagtaaaagatggattccttctgactagcggagagggaaatgtttgcattttctttgcaatcatttaaaaatttttaaaaaataatttctttgaaaaatatatagttttacagtgaaatgtaaagaataggtggggagcttcttaaagagaaatagtttgtaaagttcaactaattgggcagaattttttctgttttaatcgtagattatccagagatatatcagtttttaaagatcaccatgtcatagctaccatttgtagcatttgcacaaaatactgtctctccttccaagtcaatagttggtggacatatttactacccttaaatggtagcaagggcattgttaatttatagctgactgttctcccaggtatggctttatcatttatcttttaatagctcttttttgctcattacctagtggggaagaattttatgtctgtttgtcttagagttttcacagtggagggccatgtttatacctatgtttttggtggtttagcagtgaactcctatgcattttatctagtgtctcatctgttaaatgggcatcagttgaataaattcctataatgctaa

SEQ ID NO: 32672 - DNA, 1821 bp, Bovine  19866881595349
tactaccacagttgagtttttgacccaaactaaaataagaaaatagtaagttgaagcatatgcttgttaaccaactatggtttacatggagaggcagcagagggtagctggaagcaagacagacctgagttcgaatcccagctccttcactcgctccttgatagatttcagaaaaaattgtgtaatttaaatatctcagagtctcagtccccctcctctgtaaagtgaaacaaatgccctccatgttagtgagctgttttaaagattattaatgtctgtaaaatggaagtgcatgttaaataaatggtggttattatcatgggtccaggactggtagtggaaattgaatattatgacttcaaaagcagtgtttttttaaattatttttattagtcttactacaatatattgaacctatcaacattaaccatgaataattttctgtttttactaactctatcttcctatattgttggactgtattttccatattgctgagtttatactaatatataattcatattctgctgtacctttgttaatgcacttacctgtcttaattgtttcctttccctttaaagacttcagcaagttaaatttattgctgccatgtttcaagagttctctgttggtagaaatccccatgaaaattaagaccggggatagcaaaatgaacagagtaggttcaggttttctgaggttggcttcttgagccctgggtaaatgcagctatcttataccccatttcctctgggtcaccgatgggcatttgtcctgaccgatgatgaatggcctactttgacactttgcatggatgactgttgggaatgaagactgtagttataaaagattcattggttcatcctacactcctaacattgtcaccttgacacacggtgacagtattgcaatgtccattgaccttgttggtcagcagaaaggagaagaaaatgtctcaggatcatctaagacagaaaaaaagagttcaggacttcttttctgtaggatgcaatagctgatgcaactttagttttgtttttcctttggcttccgggaatctgctttggaaaggcagcaaaagccctgtgtgctggtgaggttcagggtcaccaacttaagaagcacatccagttcagagtcaaatccatgggtcatgagggaattggagcagagatttagcaggtaaagggaaaaattatgtcagctcagaagagtggacagttaagaagatattatataaaaagaattatatattatataaatgatattcaaacacaattaaaattagtcactctttgttaatcaccttttttgattagtaatatttcatctctataatatattgagtatgttctattagtggactttttgaaaataaatattttgctggatttgggagtagattaaaaacattctaacatttaaaagtaaaataaaactgacttatgagtacctcggggaactctgacatataaatgataacctaaatttttaaaaaaatgtataactgaagcattaatagaaccataaagtaccataccatataattgccataattgtaagacagatgtcaaagttcagacttaagtgctttatacaaatgaaacagtaaactataataatataaaacatagaggagggctctgaacatttagatatgcgtctttacactcaactaattagtcgctactgaatgtttttgctttgctcaatggcatgtggtacataaatcactgcaatatgttaaatgcaaatggttgttaatagaggaaccatctgctctgtgctgaagagtttgttaaaaagaatgtggtgaaccca

SEQ ID NO: 32673 - DNA, 1136 bp, Bovine  19866881708979
atgtcattttaaaaagatctactacctgtatgtgaatataattctgaatttgctgcgctttatacatcttgtatattaaatttcttgaactgtagctgcaaaattattagtcatttctatttttgttctactgagaaatcagaaaaattccaaccctgattattccttaaaaatgcattaaaacatttatgagacctaaactcaaagaaacttaatcaaattgcattttatgaaaaaataataaggaagacttaggcagtcagtttctgagatatcatgaaactaaaaacatatcacagaagaaaatgataatttattttgtaactttgggatagtcaaatattgattgaagaacttaaaaggtacagttttcaagaaatacctattttggtcacttaaaagattttagacataaaagtataaaatatgaccataccttttagaaaatcagcaaactttttttccccttaacttctcttgggttgtttgatattttaaatttcaaaagtatatttagttccatgatgtttttttttaagtagggaaagttttatctgggataccacacttagataaaaattctagaaatgtttttccatctcaaaataatatagagtagaattagtttgtctactgtttagaaatatgttgagtacatgtggtgtgaattgaacattttctacttactactgtgttttagtgggtaaataatttttgaaatgccttatgatctgcaatcacagatttataaaattaaaatattttattgtgggatttgaaactttgaaaactttacttttattatttaatagaggaaaagcaaaaatagaaatgaatgtaagtgtaacaagtttattatacttaacagattcgatgtttataggttctgtttactagaaacactaatggttttgaattcagcaaagacttctgaatggcttccatgttccacattatagtgtgagactctcaacaatataaaactgccctcctcacactgacaaatctcactgtttagatagggaaaatgaaaagtaatttgccaaatacaatacaatgtgataagtatgtacaaaggtggtacaaataaagacctagttaattatggcttgaatagaggcctctgtcgtaaaaag

SEQ ID NO: 32674 - DNA, 2763 bp, Bovine  19866881720998
tagaatggtagagtctgtctacctctgctactgtgttgaggattcacttcctgggggaaccacatttgctctgttagggaatgggaagcagcttcccaagtggctcagcagtaaagaatccacctgccaatgcaggagacacaggtttgatctctggctggggaagatgccctagaggaggaaatagcaacccactccagtattcttgcttggaaaatctcatgggcagaggagcctggcaggctacagtccatgagattgcaaagtcagacaggacagagaacacatggacacacacagggaaatggcaacagggaatcctttgttgagtgtctaggatctgtcaagctgaagatcctatatagtgaaggtggctctttgaggcccatgagatagagctccagtgggacttccttaaacttgggattgtttgggggttaggaattgaaaaacttgtgttcaattgtcaagaattagctgtatagtcttacgctaaattcttcaaaatgtgttaactttttccctaatatgtaaggggcagatagttacctgcccaccctaacaactacaccatcctagtcttttgcccattattttttatttactggtttattctgtgaacatattatacctacttggagataggaactatgttttactggcttctatcctaagtgcttatcacaatgactaatatactgaatactcaataaatgtccactggtccagtgagttaatggaaatagctggagagtttcactgtgctaaataaatgcaagctatttgagggaagcaggtaaaacttaatcttgttttcctctccttagggttggtaggtccttcctgttgcccaaatgaccctaaggattcagtaccagttcatacagagtctggacagtgcctgaatgttggtgcatctcacaatctcatccttctcgaagtatcatcacttcccaggggtttgggcttcctttggatcatgtggtgtccagtgtcacactgcttatcatatacagccatgttcacactttcaaacacctgtaaaaaaatcaaaacgttgcctcatttattctgtggtacattttctgtgtgtctgagtgctccaggtttgcatgttaattttctataattacaacagcaaggatcttattatgtaccaggtactacgtgcttatgtgtattaactcactgtatcttcacatttctatgggacaaatgtgattgttgtcccatttgcatgacagcagtagaggaaaaaacagatactaagtattttgcccacagtcacacagttaagagtgatggagcctagattgtagcatgagatgtctggctctacaggccatgacttttcaccactacactgttgcctcttaactgctttagctgtatagctgtatttttatgataatccatcttacttgggggaaacagttacaaaaagaatttttaattctaattataaaatacttacctttacttctatagttaaccaaagttttaactagtgtccctttctgtgcttatactggtaatgagaactttataatacttgtataagacatatattaaaaaatggaatttggaagaatgctttcaagtactcatacaacaaagagattgtggtaggaagttaaaataaacactggaaatttactcaaaactgtacactaaaatgctaataaatgttcaacataaaatatagttgaccctaacacaaggaactcggagaaggcaatggcaccccactccaatactcttgcctggaaaatcccatggacagagaagcctggcaggctgtagtccatggggtccctaagagtccggcatgactgagtgacttcactttcaattttcactttcatgcactggagaaggaaacagcaatccactccagtattcttgcctggagaatcccagggacagaggaacctagtgggctgccgtctatggggtcgctgagtcagacacgattgaagcgacttagcagcagcagcagcaacacaaggaactaatctgtaactctagtttaaactagacctaagttgctatgactgtaccatttgcttaagctaactatcctaataccaacaatggtgacaactgtaaatgtattgcaagtcaaggatcttgtaaagctgatgactttgtacatgtatagttcccttactaagggcagatctcatgtgttgataccaaattttagcaaattagttatacttaagtattttaatacgtaatgaataaagaagaaaaaactgttacaataaacagaactatgctagagtgcttccgaagaccagattttcacacctgttttctattagcatacaaaagctactagtgtaaagaaaccatacattaagcataattgattatccttaagctatgctctgtaggggttatcacaccatttttaagaacaatattaaaaaggcaaaagttataactcaaacagtacacaagacttcttacttcatctataaaaatagagaatgccagtgctttatttgccagagataaggagggaaacatgggtaaaataaatttgataacataactcacattacaaatgattttcctaaattcacaactttcacatttagctgacctaaataaaaagaaaacaaaccaacaaaacactaacaaaaaaattttcacttgatataagtaggccaaatcacatccctctgaatgagggattttattctcaagcgggaaaatattttcattacttaaatattacccaaggtataaataagc

SEQ ID NO: 32675 - DNA, 736 bp, Bovine  19866881980903
aaaacttgatctttgaagaaataattattagagatgcaagttacatgacagggactgtgaatgaattttagtatctgaaattgcttgctttatttattcaaactgattttattaattgatggacatagtgaaattttgataatcagggtttcaccattgcatttattattatccctggaaatcaaggtaaccttggattctacttcctatatttacaaagcgataaatatcctaataggctattaggcacaaatgcagtgctcttcctcacactcctcccatgaaaagctttctctcctcggatctggctgccaccttgcctggagcatgctgcctgccccctgccccaccctccctcctcatgcttgccgctggctcccgacttcctgcatgcagcgctggaatcacccgcagagagaatggcccaccccttagaagttcttggtcattctatcagtactgctttgcattttaattccattcatctggctccaaagccctgcattcttgtatgaggcactatccttgaacagccctggaggtcacaacaggtcccagttccgtgaagagaagatactgccaaacccggagtatcacatttctttgtacttgatagtctgaaatggacaatgataatatccaagattgcagcaaaaaataaatctatatgaaaaggattaatatgatcaaaacaaaggcagcaaaactacatttgtttggaaatcgggagtcacat

SEQ ID NO: 32676 - DNA, 648 bp, Bovine  19866880434528
ggggagctggcatggaactacaattatccgtccctcctgcccctgccttccggcaggccttctcgaaactcaagtcagttttctgagcatcttggctttcttctcatctccttcagtcaacatcatcagcaatctttggccttgaagcggggcaggggaggggggaagccaaaagctgctctcttttttaaaaaaggaaagcctttgcatttggaggactttgtcttgccagggcaggttacactcccccctccatcaccccacccagccgcaataacacaatatacccttggctggatttatggcctccctcgctccccccttgccggggagagaaaaagggcacagccttgagaaaaacaagtatcaagggttgatgtgtgtgctgaactttaaaatgctaaatgacggtgaaaaatattttggaaaagaaacgatcttccaaattgtgctacatagtaaagttaatggagcccatatggcctctactaaaacttagaaaaacaaactaaaaacaatactttagcgcctgccaggctgaaatgtgatctgcttcttaatattcactcaacccagagtaaaatgctttaaaatggtaatgatcccaaagtgcaggctgaactcggtggataaacaacagacctcaaa

SEQ ID NO: 32677 - DNA, 625 bp, Bovine  19866880517715
taaagatgagtaataaaataatagatatcatcctgccatcatgaaacaaagtataccaaaaataaaataaaaagatcacatcaaaagcagtcattaattctttaagatgaagagaaggatacatttcagatagaagtaatggtaagtaataagcttttagaacatttgataatccaattaatgagaaatgaatcataagaatagaggaaatatgtaagtttcttgctgatttgacagaaaatactactatgaatgaagataacataaaattcataacatacgaggaaaatgaggacatcagtgtcattgattcaaagagcatttaagatagaaaatcagaataaaacctcaaatgtcctgaaatcttacagctcctctatgaaagaaacatggtagttggtttgcttaggtttgacaattctaaacattttcttggcaatactgctcatgaagctagaaaaactttcctaagctctccacaataaacataaatatttcatcaactatactaggtaaataactgaataatctgttttttctacagaaaatatcacaaaactactgtcagataaaaccacaatcaaaaagtatgttgataaaataacttttaaaacaatgttataaa

SEQ ID NO: 32678 - DNA, 1455 bp, Bovine  19866880557595
agagcttcctttctacttattacctatttggtccagagttgctgggggaggtaatcagaccgtattgtcacatccctggaactccctggagaacttaagcaatagtaaagcatgtgggatccttatcaacactaactctctcgggtcctcctctcccatcttttgtacctgggcacagccactcaactcggttcagccattcattcactgctgctgctttttatttcaagtccattagaaagctgattctaggaagtacaaaataacataaaaacctgtgtcagcctcccaagtttcaaagcacgacctggggatggggggtgtttaacatgaacttgatctctttgcaaataccagatcaacagcagtacatatcgattctgcaaacttaaaaccattacaagaacccttggtcttcagtcaacattactgtccctatttttaactttccccagaagcaaaaacactaactttttttccctctagattctctacattcttttccttccttaacctcaagtcaggacttttattatttttcacatcaaaaaggtggctttacaaaatttctacagattttaaggatgttaacagaaaaagcaaacagaaatggaaacattacttttaaaaaaatgtattccttcccaggaagatctaaacagtgcaggtagtggaagaatatggagttatttcaaaatgtagcatattggatttaatcgttaattatgagcaccaatccagtgtgacaataaattaccagaacaatacaacaatagatcccagttaccagtaaataaaacaccttttacttcaacaggcttcattctgaaaacattctcctaaacctcttataaacctgataattacactactgtcgagatagaatttttttttttcctaacttttcccccataccacttggacttatctcacatctggtcaataaatctaaaattcagagacttaaatcttaattttctaaaataaagtttataaaaaggcatccatcaaaagttcttataatagactaagcaatcttgagaaagaagaatggaactggaggaatcaacctgcctgacttcaggctctactacaaagcaacagtcatgaagacagtatgttactagcacaaagacagaaacatacatcaatggaacaaaatagaaagcccagagagaaatccacgcacctatggacaccttatctttgacaaaggaagcaagaatatacaatggagaaaagacaatctctttaacaagtggtgctggggaaactggtcaaccacttgtaaaagaatgaaactagaacactttctaacaccatacacaaaaagaaactcaaaatggattaaagatctaaacgtaagaccagaaactataaaactcctagaggaaagcatagacaaaacactctgacataaatcacagcaggatcctctatgacccacctcccaga

SEQ ID NO: 32679 - DNA, 975 bp, Bovine  19866880662537
aaacctgtgtgctattttaatcagtttttccaattaatccaaccattaaccaatacctagtccagatcatgtcatgtaagaaggcttctctagaaattttagagtttaatgagatttgtgtatagtagctcttccccctgtgagatgcccttccatgaaactttaagtatactgtactatgtccgtctttgctaacaatattttaaaccttttcaaaaattttaaaatttgctaaacagtgttttcaacaacacagcaatcacttatcacacaagaaaagagtcatccttggggcttcccaggtggcccagcggttaagactctgtgcttccatttattgcaggaggcgtgggttcgatccctaattgaagaattaaggttccatttactatggcccagccaaaaaacgagaagtcatcctcaatagcagtcacatctataccaatttgaaatataaaaagtgttattttgagtctaagtttatgaaatattactttactatggattagaacaagacacacattctatctggcaacttcaaatcaatatttggcacctctgctgggaattctgtaaaaattgccctttatgttcaaactgacaaaaacagctggatattacaaactcagaactttcttaggaaagatgatttaatgtgtggttaattattcattaagggaggaaggaagaagactggaaaagaagttttgtttcattatttcccaactatttggaatcaaagaatcatgcaatttggaactaaagtgaaacttagaggtcagcaggttatgcttctgtctcgtggcagaaatttcttctttagatcaaatggtccccattctgttttattaccatcaaaaatgaggtgttccccatattggagagaaatatgcttcattcttgaacaactcaatttagaaaattctttcttgctatcaattttatgctgtcatattgtcacctctactcttagat

SEQ ID NO: 32680 - DNA, 3235 bp, Bovine  19866880710369
tctatgaactccttcgcatattctgaagcagaggaaacctcggattcttttctcaccgttctttcaccccggaaactcgatacacacgcagcaggaagtcatccttcaccagaaccatgaagaaggtacccgggaggcgtctctctcgtccgagatgtagcccaaccccaaagcttccgctgtctctgtgttcttttcacgtgattcatttttcatttgaccaacatttattgagtactgactgtgtttgagaccctaggggaaatgcccaaggtgaataataagatctctctttggttctctgcaactcccagtctcgtggaggagatgagatagatacgcatgtcaataacaaagaatagctataacaggcaccataaagagacgatggaaggggagatgacagccagtgcaggcatcaggttcagcgtcacgaaggaggtgacctgcaggactccttgaaggtctgataagcaggaatgaagtgggggaacattccaggaggacccaaaatggagttagagagcaatctctaactggaattgagagcaatagaatagagagcaatcacgtacctttgatgaagaaagatttcaaacagaccccaaatagggagaataaactaacgagagccctgtgagccatccccctgtctcaacagtgatccacatttcgctgctgtagaaccagtccaaggaggtaagattagaagcaggatgtggaggactttgatttctgggctgtggagcaaagtaatggggagtcattgaagattttgagcagagggtcacatatgctgggggaagaaaagagacccaaaccctgtgaactcgatgggggtccggggggggtctcgtcctcgtgctcggaaggcggcgtcttgccgtgtgtttggtgggaggacttagttcagacgttcaggcaacgctctgctctgtccagttacatggttcttatcaaattactggtagaaaacagaacaaaagaccagaattgaattgtggccccagacagagttccacagcaggtgtttggggacaaaaatagggtgtaaaaaatcttcctctgctccctgttctgttaaactgcaatgtatcaggcctcctgggagcatttcctccacatctttctgcctgaattggaaaccaaagtaattcttttaaatgtatccttcagaccagattatgaggggcctaaaaccctgtgttttttgtttgtttttctagaggcatttccttaaactgatggagcatcccccagagcagcactatttttgtttcattgttggcaaattaaaaaatgagaagttatgtgttttcttaattaacacttcaccaaacagagcctggcttcaggcgacctgaccggcatctctttcgtgtgccaggcatttcacagtgggttccctcgcctccgtgatggagaataaacctgtgcttcttgcaggctccctgcctgtgcctctcagcctgtcttcccccagcgttacctttgctgaatttacctgctgcctctcaatcccagtttggtttctctgctcttttacccttcctgccctatacatttgcatagtagccaatagctactccagagaacaggaggtgagtttactgaagcttgatattagggcaagaagcagagtatgtaggctgcgtcttcaaatacaaaatgtgtatgatggcttgttgggggtggtgcatgcgtgctggtcacttcagttgtgaccctgcgaccccatggactatagcccaccaggctcctctgtccatggggattctccaggcaagaatactggagtgggttgccgttcccttctccaggggaccttcccaacccagggattgaaccctcgtctcttacgcctcctgcattgcaggcaggttctttaccattagtgccacctgggaaatccagctgggggcggggttgtcttttatttgttttctctttgtccttttgtcggttttctctctctttttctcattatttataaaaaggaaaattcctatttggaatttctcttcccctttttatcctcagctgtgattggtggccgatggcctcgcctcatgacaactccctcctcccctcggcctgacctgactcctgagcaggtgtgtttgttgttctcattggcaggagccactcggtagggaacgccagcccctctctgagcccgtctcccaccaagaaaatacaaatgcactaccaaacatgccctagtgagccatgccctcaagtgctgtgctgttggcagtagtgagctcagcaggtaaaaagatggagctaaggaggccaaggtcaagggctgatcaatcgccctgtggaccagatagctctgcttcagacctgcccttaaaagtagccccttctcagagatggttccttcaagctgttggccaggaatcatgatcgtgctacctgccctgctcctccacctgctctcacataagcaggtggacacacagaaaggagcctaggtctgtgtcagatgggatcacgtgagaagagctgtactagccacaaggtgatatgaggcgcctgccggcccccagaactccagatgtatgggtggatttggcgacagaaagggaccaactggagaggtgaatgatgtgtacaagatccctacctccaaccacctttcctttcttttccatcaaaaaaaatatatatccagcttaacatgagttggccctaggatcaatactgttatatcatgaatgaaaggaaaactgttagttgctcagtcatatctgactcattgccaccccatggactgtagcccccccgccccaggctcctctgtctaaagaattctccaggcaagaccactggagtgggttgccattcccttctccaggggatctttgcgacctaggcatcaaacctgggtctcgcatgttgcaggcagacactttaccgtctgagccaccagggaaaactggtaacacattaatatgggcatgtgttcacatacagaaagatctgatcttgcgggggagaaagtttgtgaagtgaaattataagcatccaatattacatccctaatgatttgtgttacataattggggttacagaacaatgtaaaagtgtgttgctgttgacttgacacagagctgagaatgaaaaaacaggacactccagagagaatcaactcagcccctcaacaggctggcaccgtgaggcatgcagagacatggaaacacaaagctttattcactcctccacccca

SEQ ID NO: 32681 - DNA, 3114 bp, Bovine  19866880877128
gagcataaagaagagtcgaagaattcatgttttcgactgtggtactggagagaactcttgagagtcccttggactgcaagaagatcaaaccagtcgatactaaaggaaatcaaccctgaatattcattggaaggactattgctgaagctgaggctcctccaatacttcggccacctgaagtgaagagctgactcgttggaaaagaccctgatgctgggaaagatagatcaaaggcaaaatgagaaggggaagatgagatggttagatagcatcactgactccatggatgtgaatttaagcaaactccaggagatagtggaggacagagaagcccggtatgctacagtccacgggttcacaaaagagtccagcatgacttagcaactgaacaacaacaaaaccattcaataatgcaggcagacctcagagatgctgtgggttcggttccagatcactgcagtaaagtgactacagcaagaaagtgagtcacacaaatttttttgtttcccaaagcctacagagttacgtttacaccatactgagtagtaagtgcaatagtactgtctaaaaaaaaaaagtatacaccttacttaatattaaaatattgctagaaagaatgctaaccatcatctgagccttcagcaattcatagcagtaatatcaaagatcattaactacagatcctgagaactaatacaataattttgaaaaagcttgaaatgtcatgagaattaacaaaaatgtgacacagagacaggaactgaacgaatgctgttgaaaaacagtgccaacagacttgcttgaagcagggttgtcgtaaatcgtcaatttgtaaaaaaatgcagtgtacacactgcaaagtgtgataaagtgaagaacaataaaatggggtacgcctgtcattttaagtgttatctcttatttccattgttattccaaataaagccaaaattgactattggtcaagtttagataaggaattataaatcatactgttacattttaaacttacttaagtttagaaaatgcctgtgtattttatttctttgaaaaaaaatagctagaacagacccaaagtagatttggccatgtatcagaactcacttatcattgtctccatgcaggctaatattctgctagaattctccctaaggactcccttttgctcactgatgggaaaaggggggggggtgtcattttaacttagaacacatattttcatcatttaatcattttgctggtgggaataaatttaaagttatccaactggatgtgtcatttacaggaacattactgagtaccaaaagatttattcaaatatttaattggaaggaactacatctggaataagttttattggaattcttataaaaaggaaagtaaatccattagaattaatatcataaacagtcaactttatctggaaccagaaacattagtgaaatggagcctaggaatcctaacccttcttctctgtaaaaaagccagtcgctttccaatttatgtggcaattattctttattgctttaggtagagctttgttttcatctaatggtttagagacagatcactcaggccaccccatttgtttctttgccccctttctctttaaagaacaagcaaaaagaactcagtaagaggcatctgcctgtcttcaaaacacttgaaaaatcctgcgaagatcagaaagtcatcagaaactcgctgcagtgaggccagtagtaactacacgaattaagagatagctagtgttctccttagatgtcaacgtagatgccattgatcaaataatcaagcctcgagtaacgttttctgcggagggattctaggagcattctgcccaagagggccaggcctatggcaagaaagaggaccccaaagagcacagtcccaatcaggagccactgctcaacggcaaagccttgctggcttcctggagcattgctcagggaggggtcgcctggactggccttcccattctcctgggaagctgtcttatttgtggcaggagaatccacatttgacaaaggaaatgtaacagaggccccggcatcctccgcactccaagtcagattggcgatgtctcgaaagggcactgcggcgggtgggcgtcgcgagtccgtggatgccctagagagggaagtcgaagccgcagttgtggtcgtgctagtgatcgtggctagggttggggcggaggtggctctctgaggctgccaagtcagagatggcatcactgccatgttggtggcagggagggatgcggagagagacttcggagtggccaggacggtgtgcagagaagacaccgccatcgtagaggggaacgccgtcacattttcaggcagcagattagctattgctggtcctgaggaagactgtgacgtctgagagtggccttcttctttataatcagatgacggtgggctctccagatcaatcttgagtagtttctccaagtgatccgaggatccagacgtctgagaaaacgaatctctccataagaccgtgggctctgagtcatgggttggaggttggtgagtgggagtgatggcatgggaagatccgccagggaagatggagttttcctgagctacccctgggtttggcaaatcagttctggccaaagatgggaaacctgaaaatggaaagaaaataataggaagacttcggacattttcatatgaaaggaggacagaagagacaaatgttatcagcttattcaataagacctcagactgttgctacctgatatttcatggtatgtgcatgggagctaagtcacttcagtcgtacccgactctttttgaccctatggattgtagcccatcaggctcctctgtccacgggattctccaggcaagaatactggggtgagttgccatgccctcttccaggtgatctttcagatccagggatcaaacctgaggctcctgcattgcaggtggattctttaccaatgagctgtcagggaagcccaatatttcatggtgcaaggacctggcctctcctgcagaagctctggtttatttctagagtgatggcacacaggtttatttctaaagtgatggcaccttccttctagaggaaggaggaggtaggaggggccagcaaaga

SEQ ID NO: 32682 - DNA, 1208 bp, Bovine  19866880892549
caagcctccagaacttcatttgcaattcggctgctcctttggcaaaaggtcccctgtgcagctgttccacccagagagcctctgccaggtaaactgcacgatgcctccccaacgccagcctgatggctacagaatgtcgctcccgctcccagcattcctagctccgggcaggctctctggccagagttacagtgggcagcaggcgagggagggagcccaggctcaagcagggagcactggcctgctcttcctcgcctggttgaggcgagccccaaaacgctctctgatctgagccctctgccagttctggaaaggttgggcttgtcagaactccaaaaaagagcaggaggctacttagctatagatgaataataattgggcctttgtctaacagcgactgtgctgatgaataattaaaatttttattacaattgagaagcactctgcccacatggatggtcctgtgggctgtgccaggggaaacacaggtaatgaaagagtaccttccaggttctgcagtcacagtcatcattgtgtttaagatggttggggtcttcagaaaagttatgcgttaagcagacccaaacactctcttcctttacacttcttttcaggatctaataagataaatcagttcgagcagaacatgggcatgcaaatggctgaagtagctagaagtgaaaaccaggaggcaagagataaataggccattagccattagccagacaagtatccttgagtcatagccgatgataaggatggtgataatgataagagggcacagctggcgtataatgggaggcaaactgacctcaggagtcagaacacctaagttcaatagcttgcctacttctcacctgtggccttgggcaaacttaactctgcagacctccctttttgaacctataaaatggggaaaatactactcggtccttgtgataccctgagggcttaacaaagtagtgttaatgagagtatttggtgattctaaagacagcgaatgcaagtaattatagcttacaaatcagaattaaaggcaactgagtccaatcagcttgagttgtgataggctgagcgaatcaggattcagaaatagtggaaaagaaaatctgtagtatttggattagatatgaaattactgcaaaaattctatagggttcaacttaaatgcattaaaaaggtaaataaatccctctcgtgttaaacag

SEQ ID NO: 32683 - DNA, 1725 bp, Bovine  19866880903952
gagagctgggcatgtccttttctgttgctttagggcctctgtttcccttctcccctttgctctggctgggcgccagctctcggttttctgagctgagcctgcagaagcatcaccaaggtcccctgccccataccaggactaccctggtggcagctggcatcaggctggaggcaaggcagaggcagtggggaggggcattctgctcacatctctttctcctcaggtgtcttttgtcattactaacccccttccaagatgctggtagaattctaatttcctaagctctccacattgttttttgcatttgtctttctatataaggtttccttcaggggaaaggatacaaaccggatctcacggtgaagcctgagagagaggtgcagagctcgagaagcagggtcatggatctgagctatcgtgatgtggatactaaactattgccagtcagtgaatgatggtgtcaaaccctggcatgactcagaacacctagcagagatgggctaagatctcagagaggaactgtgggcagtgtttacgatgccctgtccacacggtggtgagatatacctgctctgagaaagaaattttgtctcctggtcaggtttgagtgatcatctgtagtttgggtccaaaatactggaatctctctcttttttaaacaaggtttggtttacaaagccaggaaaggataaaatgtttaaaattggagtggaatctacagaaatgatatagatgatcttttttgcaaaacagaaatagagacacagacatagataacaaacatatggacaccaaggggcgtgggatgaactgggagatggggattaacatatataccctactgatactatgtataaagtaggtaactaatgagaacccactgtagagcacagggagctccactcagtgctctgcggtgagatctaaaagggaaggaaactcaaaaaagaggggatatacgtatatgtatagctgattgactttgttgtacagtagaaactaacaacactgtaaagcaactgtatttcattaaaaattattaaaaagaaataaagttggtactactctgggaagtcacagtagacctgaatttccttaaaaaagatttaaatataacaaaatagatacaacataacaaactctagtgaagataattttatttttctttgattcctgagtggataatgcaggatattacagaagtttgaggtcactattaaaaacatcagtcgtcactgtactggtgaaatatataacgtgccagttaataatagctttacaaagtcacagaagatcagataatagaggttttactgtaactgggttcataatagttgaaagaaatcaatgcttttttccaaaaaagactaaatcacttctaggaaataactcatgctctatgagaatagggcagggtttacaaggaagtgctcagtactccctggaagaaaggtattatataattgtaagttgttcatcctgtgcctgcggtcttatccaccatgcatccagcctctccttaaatggagtggaagatttctccagcctttcctacatccaaggaacaacatgcaacttggattcttaaaagaagaactcttttaaggtcatgttcagaaggacccttttgcttacaggaatttgggctggaattagagttcttagctctgacttgaagaaagagagggaggaggtgatgaaaggagggagggagaagagagagag

SEQ ID NO: 32684 - DNA, 961 bp, Bovine  19866880944554
ttccagagggcagtgttaccaaggaccattgagtgttgctgatttcacttgttagcatcagaggattctggtttggtaacctgaagcatccatgtgtgtttttttggggggggcaggggactgatttttctggtctcttctgaaggaagatagggtaggatttgagagatttaagcaatccctgtccctaaccacatgctgactgtaaattcccaagaataattagtcaccccaccccaatatttactgctcccagcttgggtagctggactgaaccccattcttctgaaattagtccttgtttcctctagatcatgaacagttgttgttcagtcactaagttgtgtctgactgtttgcgaccctatggactgcagcacatcagactttcctgtccttcactatatcctggcgtttgctcaaatccattgagttggtgatgccatccaaccatctcatcctctgccgccccttctccttttgccttcagtcttccatcagaatcttttccaatgagtcagctctttgcatcagctggccacagtattggagcctcagcttcagtcctttcaagatcatgcacagaaatagcctcaaatggggcactaagatttcaatcctagaaatgcagaccacatgtgtggatcctggatgaagagctctgggtatgtggtgggtacagataggatgcctgtgaggaaaatcctcacccatgcagggctgtgcagagaacatgttgtttgatcagtttctgctggggctggattctctgggctggagtaggagctttcactataatggttcacttcaaacaagaaggggaaggtttgcaaggggatagataacagtcactttttaaaacaaaagatatctaggtaagtgttggcgaacagcatgctcttaaaaaatattagagggctatcgggtaattatgtagctctacttggcactccactccagta

SEQ ID NO: 32685 - DNA, 1837 bp, Bovine  19866881037651
attttatagcagttttatataacctcaggaggctttcaataatgtttctggacaagcctggtgggaagtatcagaaacttaatatggaagagccatccaaagataaggtcagacacagcacatctgaggactcagcctggaggggatgattagtgacttcagatgtcgagggagaagttttagctacaggataaaagcggaagataggctgtggatgctacagatcaccctgcttgaaaagatgagcaataatgggcagaaaagtagtcagaggtggaaggctcacaggcttccagtagtgatttcaataagacagaaggaaagaagagcactatttgtgacaagggattagtcatttttgaggaaatgaatgtcgaaaaccagactcaccccaaaacgaaggcttctcagtatggaaccgggtatgtaattgagttaagtgttcaattgtagggacgcttggagatttttggctctttgatggcgagactgagctcagagaatgagtcagtctcagacaggggaaggagtcaagagggttccaaacaaaggcaaagctaaaggtttggaggtcagcatgagctgtgacttgcatcagaaaaaaagactggccggactggaatagagttcacgctcgtaaacagtggaacacaggagtttcctgggttgagacgacagagaggcccaaggagcaggccaaagagtgaatccttgacaagtcatcataggcttttgaatgtggagtgaggacagaaaatgcctgttctaagacaggtcatatggtaccaggcagactataggggaagggaatggtgtgtaggctgtggaaagggccttcctaccgtaaggatggaacttttgcacccaggctcccttcctgaaccatggtcatggtcagaatgtgccactgatgttaattccatatgaacccagtgaccaagaagatgaggcttgctgcaggcacccagctgccaaggaagacagaataaagggagtgaatggctagcatttagggtgcatcagtgataacgccaagaaatgtctttctcttggcctttctaatttcgaaaagctccattgtctggccctgttacccattccatccagcatttaattgtatccttcaagttagattcaagttttgaataccatcacttgagcttatagtctgggatggagatgggtatatatctcccagggtcctctcagatggttgtgcaggaatgcactgcctgctccatcttcttcaccatcctcccagccttttttatagttattttgccagctttcaagcagtgagagcctggggtatctttttctaagaaaatgctaggttagcattaacgaccaggttcagtagccttccagctacgtaaaagtgacgggctcctctttttaaagagttcaaggtgaagacagctttagggaactgtaacctcttcatgccaccgtttcctcttccaaaggtttatgaagaccccagatgaaatcatgagtggccgaacagaccgtctggagcaccttgagtcccaggagctggatgaacaaatataccaagaagacgagtgttgaaggaagtggttcccagcttagtgggccagcagccaagggcaccccccctccccaggatggatggggcaagatgaagcagaaaaggagagacatggatgtggcagtaacactcctctcgcccagcgcgagggatcccgcggagcaccttagacaaaccactcagcaaagacggcgctggaattctggccgagggcaccagcctgggactcgcgttcacggttccttctcgatcggaatctcttgtctgtgattcctccccctcccc

SEQ ID NO: 32686 - DNA, 2134 bp, Bovine  19866881072570
catcagttctttggcgctcagtttttttcacagtccaactctcacatccatacatgaccactggaaaaaccatagccttgagtagacggacctttgttggcaaagtaatgtctctggttttgaatgtgctatctaggttggtcataactttccttccaaggagtaagcgtctttttatttcatggctgcaatcaccatctgcagtaatcaataaatgtggttttaatacttctgttttgaaataaccagaaagaaatgaaatcaggcctttgtccttattcttaacaaatctcagctggtactttgaaatgtaaacttgaaaatgtgataaaagatgaaacaagtagcgttttgttcattcttctcatgagaaaccatttttttgaagtaattttaacccgtattagaatttagtttagctggggagggaagaaagctcaaatggaaaacatttgtttctggttctaccgagcctgagagtctagggcagcatcgaaggtggcaggcaggtttgagaggggatggaggtttaatttaaatttaaaacaggaataaattaactttgttgtgggctgtatagtcaccaccattaaattctaatcctgcacagtccactgtgggagtcagtggccatgtatgtccacagagcacctacagtgtggttactctgaattgagatgcttaaagtgttaaatgcatactgagaagactgtaaatattagtattaaaatctcagcaaaagttctaaagattacattttgaagtaaaaatattttggatatacttgaataaattaatatatatttttttaaacttaaaaaaattctggctcctagaaaaatttaaattacacaggactcacatttgtgagttgtattatactttgttcggacagcactattctagactcaactcagttgtaaaaagctacagcagtcaagaatgggaagatagttaaggggagtagtcaaggggataggtgtgcttacaaagttatattgaaagtgtctttagcatatcttagttacactgttgaatttgaaatagagctgctacatctagctttaagttagtactgtatttactcccagtaccccccctcctcgcccccccgccaaaaaaaacccaaaacaaaagatttttagttttgcctttcaagtgagagaagaaggaatagctagctagaagggactaatgttctaatgtgctaaagctatatagaatccttagctgtggcttttagggaactgtatttgagtccttggactctgctattctaaagattatcatttgttgttttgccagatgttgctaaaagttaccttaccttttaacttttaagcgtgtcctttgcatgtttttttcttttttctgagacccttgcttgcacttagagcagcattaacactgatctaagcctcagttttgtcaggggatcagagtaaaggtcagcaaagcactcctaacctgcagtccttatgtacaattctgaaatctaaaaagctctcaaaactgaaaattgtttttgttaattaagttggtaaagaccctgacttgaagtagtgtaagaccaattgtagtctctgtttatgttcctttgtgggaatatgtgtatgtctttcagcaaaaatattattatgcttggcaatgaagtgttgccctggacccaggtagaggtgatatgctgtgtgcattgtgttaacttttctatatttcaagaaaaaattctgaattccaaaacagggctaattaaccccaagaaaagggattttttggacctctattattctgtggcttcctaggtggcgtggtggtaaataatctgcctgtcaatacaggagacttgggtttggatccctgggtggggaagatcccctggagaaagaaatgacaacccattccagttccgttgcctgggaaatcccatggacagaggagcctggtgggctacagtccatgggattgcaaacattcagacccgcacacacagacacattatcatcccatgaaaattgaaaatattttattaactataatacttaagttttgggggaaggggctgtgctgggtctttgttgctgtgcaagctttctctagttgtgatgggcgtggactactctccagttgcggtgtg

SEQ ID NO: 32687 - DNA, 836 bp, Bovine  19866881116907
cagggaaaacctgtcgcgctgcagtccacagggtcaccaagaagtctaacaactttgcaactgaacaacatcacagcagcaaaagctctgagtcctaaccactggacctccagagaactcccctccccgttggtctatactcctgccttgcttcttgtactaagataaactttctccccagacacttggtgatgggttggaaacataaactcaaacagtgcatgtggcatgttttcctaatgaaccaaactgaaacaaagacttaggaagagtaagggggagttggattttagacttgaccattaatgtcttaatattttaaaaaattttctaatttaaaatgctttccaaacaaacaagcatattttcatggataactataaagttcagatcatttctttatcagagatgacacaaaattttgcttccaaaagctctgccccgggcccccaggagtatctgttcacttgcctttgacattgggaatttctagatggaaaagcctgaaacaggctgctctgctgtgcagcactacaaagaacaagtctaattcctctcccatgagaccactgggtgaaattttcataaaatcttacagctggaaggagactcagaagttgtctaaatgtatctttcttcagcagcaggcctgacagatggacacccagcctctcctggagcaggctcagagcagagaccacatggtaaacgctgccatcccatcgccggccagctcgaaatgttaggatgttcttttcttaagccgagcaacatgcccgaaggcctgggaacgaggcagacctgagctgggcttcaggatgagtcacttaacctca

SEQ ID NO: 32688 - DNA, 837 bp, Bovine  19866881170903
taaaaagtcgactgttttttatcagggaaatcgtgtggctgactgctaggcatgggaggaaggaagaggctgtcttttccatcatcagtcttcaccttcaagtcacctgttgagttctaagttcagccaagttgtagtggaaagcagttatgacccagcggacccagccatatcggggagggcttccagaatacgatagaaaacagtcagataacttccctggtcccctccctctcttccctctgtatgggctggctttcttagtggaatgaattctctttcttactctctaggagactcccctctggaccctgagctccttgggttgagtggtgattatctttttgtgtctggtgcccaccttggcatctggcttagatatatgtgtcagtcacattggctgacttgcagtgaggcatggaaggtggtcagggccccttcctctctgtcctgtgtgcgtggagtgacttaacgctgcatccacaagctggcatgaagtggttgtagagtcactctgctgactcagggaggcctggggcactccctagggcatcatcagtagaattttgaccttataatttttcttactttggtgatattttcaaaaactgctttagtgtctaaaaataagcaaaaacgtggagttgagtaaaagataaaggggcttgaggaatcactggagaaggtccagctgaggagacttctaaagttttcactgggttctttagcaattgaattaattagagactcggagttgggaggctataaagatcacctgggccagcgtcttttatggcaaagaggtccacatggctaaatggtttgcttcagctgata

SEQ ID NO: 32689 - DNA, 1290 bp, Bovine  19866881249013
gtacaagcaaagttttataatgtgagctctgggtgtctggtgcttcactgatgcttgcatgcttagatatcttattctaaccagactcagctgtctaaagcctcagaaattaaaaatagcctcccagtgctagctgtggaatcaaaggagagatactcagcagagaggtcagcgttgctcatggcacctgactctcaaaactgtggatttcattgcacctatgtgtttaatctctcgagatcattttagccttatgcaaaactgttgcccctttgttggggctatgcagaataaaacagtcatctcggatttgtgggcatcagtttcattaggagtctggatgttggcaggagagagccattattttccttggtggttcccagagacaaatggtaccttgttatctccccatgcagatgtcagtggtattggctattgatgcatacatttatttgtcttctctctcccacttgggagtaaatacttcaaaggaaagaaccacactgtctatgctcattgtaactgcccacaaaacttaattaagcatcttacacatcttaacatgttttgcgaccattgaatggaccaaggcaatatttcactagtgttcatggcccccctctagaaaatagcataaatactatgttatttgcttacccttccattgtttgaggttctgtgttcatgagttgtctagagtaaatcagcatgcgcacatttgtgtgtgtgtcattggatgcagattgcattgatgctattttttttctttaatctcgatgactgcttccttcaaattgaacctcagagtgtaatatttgtaaaaacaaagcaagagcaattaaagcagaatatatttaaaagataaatttaaacatgaataaaactggaggggacgaccctgaaattgatgtccaagagctctgtctgtccgttggtggacagggtgcccccgggcatggcctaccttatgaaacttcttgcctgcaattccctgcccttggaaccggagccttgttagcagcagaacaccagctgttctggcccaggtagtgactcagggaggagggacactctccagggaaatcaggccaccacatgggaagtcttggtgccaaagtggaacatcttgagttacagttgggagccactgcaggttatacagagttgacttcctaaagacattcactgaggacagtgcctggcctatagtgagaacccaatgatcactggccaaggtgcaaagaggcccccgcccttatctgtggctcaaattcagaaagccgaggaaga

SEQ ID NO: 32690 - DNA, 1701 bp, Bovine  19866881259847
tacttccttctccatgactggtatgttttgcttataaccaccctgtatgtacacagatggacttggctgctgtcctagtaaaaccatagtatccttagttaccaacttgcatattcatttacatggcaattcctgtaaacctgcctcttaagaaaaccagacaaaatgaagttaattatcgaaggaaatcaactgcaaaaatatccaagccttaattctaagtagagattacagaacatgtaatctctaaaacaatgtaaactctgatgggggtctgtagaagtggtgaagcaattgttcttacatggaaaaattactgggttctgtataaatgcaattgtactcgtaagcaagataatggaatatggcttcacatttactaaattgttgagccattattgggctaacatttagtttaaagagtattttttgctagttaaagggaagtaaaggtgaaactgagaagttcatgagcaataaaacttgatgtttaggagaatatgatttcttattcacagtgtataattttgcaagagtaaaaaatatgttcattctgccacaaaaattcaagattgcctaaattttttcagttagaccacacaaggagaactttcaaattcttacaaattctccttccccatgaatttttattgactgactaaatcgacaggaagttctccattttatccggttttaaaatacacatttttctctttttctatacatgaaatttatgcttccttatatattatttttcctttacaatttaaattccttggagaatgttttaagtataaaatctatttttataaacatgtattcattatctcatgaagcaagatgaactatgaaagcaaaggtccacatactctttttacaaagggccacagagtaaatattttagactggcaaatctcatacagtctttgttgtatatccgtttttgttagcttgtgggccatgattcatttgacctgtgggccttagtttgctaagctttgaaaagccttgatttcagggcttccctggtggctcaatggtaaagaatctgcctgccaatgcaggagacacgggtttaatccctgatccaggaagatcccacatgctgtggagcaattaagcctgtgtgccacaattattgagcttgtcctctagagcccaggaacctcaactattgagcccattcattccaactactgaagcccatgtgctgcaactgctgaagcccacatgccgaagagcctgtgctctgcaacaagagaagccacctgcaagaggcccatgcactacaatgaggagaaagcccatatagcaatgaaggcctagcacagccaaagataaagagattatttttaaaaagccttgatttcaaaattttacacgtgtataattataatagaagtacaatgcttctattgtatattatttgcacacattgtatattacttctattatatagaaagcagtgctataaaagagaagtacaaattgtgtccatatgcagaatttggtcctcttccagcgttcttcctagcaagggcatcattatccatataattatgaagtcagagacctcagaatcatccttaatatgaacctctcccttcccttgccccttgtatttaatctattggccaggttcggtccattttacctcctaaatatctctcatattgactcttctccgttgctgccatactc

SEQ ID NO: 32691 - DNA, 913 bp, Bovine  19866881287180
caggcagtggttttacccataatgagaaaaatcattcacataagctttttagactagaaatagatgaacacctatttctcatgtaaatttaactcagaaatcttctggtgagttggaagaaaagatgttaattcctataatcctaaaggttgattaaaatataagacacctctggcaacccagtgaagagacaagaatatctgcatcagatcaccatcaactcaaaaacccttataaaagtggttttaaagtgaaaaagcaagaaacaaacctcaattttgtctgttttggcatctccccagtatattttgccttcatcataatccaaggctaaaccatttggccaaccaagagaagtgttaaccaacactactcgatcagaaccatccaaagctgctcgctcaattttcgggatttctccccagtcagtccaatacatgtacctacagaagtatacagagtatgagctaaaaacggacaataaactgtaaatttcagatatcctgaaggtgagatccaacccttttgtacactggttaccagttaacatctacagaaggaaaaacaagatttaaaacatacaaagagtctgtttaagacatttataattgcagtgtataagcttgtaaaaaattttttcagatcaaacagtgttttctaggactgataatgaaaaatgccttccaataatgagattctatgtttaggtttttttgtgttccttaccaggaacaatcttctctctcttgctagcttattatctctgacaaaaaaaaaggttatcccagtagtaatattcagatggaaaaccaatttccccaaataactaactcttctcgtagcactgattcttgtggctccgaaagtttaaggggctcaaaggcattggcatgcacgaagtgtaataatctgt

SEQ ID NO: 32692 - DNA, 1089 bp, Bovine  19866881317742
caagacttttctcatccagaggcatataggccaacattgctccaatttgtgcaaatggtctgaacaaatgtggcactccatacacctgggacgtgggtgcattagagaggtctgcaaggatttcagagtactgaaaatctctcaaatttgtagagaggctgagtgcccagctttacagtgaagtattccttttcctttctactgctgttgctgctaagtcgcttcagtcgtgtccaactctgtgtgaccccatggattgcagcccattaaacagcaccctccttactatttgtgtttccttgagattcctataatttgcataatcttctagaatggaatccacattcttgttggcagaaagataaaagagctgttttttgccaggtaattaagtcccagtcatcaaaaacccatagttttagttcttcaggaacctttactttaacttcaactctgtttgtgaatgtttcctcattttcagcagtagtagctacttgggctcttttctcctgaggagactgaggtgtctcactggtaccttctctatctccaggtgttttgtgtttgttcttttttgttttcacttcaacatttttctgttgcagaccagaggtcttctttccaggggcagcccctcttggtcttccactctgcatactgctcctgattggctttttgaagttctcattgtttctgcagattggtgcccatgtatttgagtaccctcctttggaacccattcatcccaatttttattccaaccactgtaatgtatttcacttgtttatcctttatggccaccttcacacaatttggttcataaagaaaagccccctaccctccccccaaaaatagaataaaataaagaagaggcccatgaaagcacaacactctttcacactcctggaatttaggcctctgatcctgctttgtcaccatttataagtgatttgccaccactgcctcctccttctcccagccacccccaccagcatctgctactccataccacccaattccgcatgagacacaccttcagacaccaccagctctagatcctgggccggtttagctcaacatttttcaggg

SEQ ID NO: 32693 - DNA, 1096 bp, Bovine  19866881319744
agagtttgtggggtcttagttccccaaccagaatggaacccagggctcctggtggtgggagcacagaatcctaagcgatggaccatcagggaagtccctccatttcattttcaaatgatggatctagctatgtttggattccagatatatttctataagtttctggtttaaaatgtttcatttttcacagcctcccaccaacaagtatgtacctactcctttggcattgccctcaagaccctgtttttgagcctcctttccaagacatctacccggcctctgtatacccaggtatcacttgtgaccttgtgatcttgcccccacccccaaggtcaacctaattttcttcacaacacaattttgcttctcaccattggccctgagcatctttgccatctggcctcattcctaaggttcttgctcagagaggtcaggtctgtagaatatctgcccttcgtcaacctgatacatctgtagtctccaaagcatctggcttcacaacattctagccagcactaaacttaagagtgggttctacttcaaaagttcatttgtaagggacttatttagaactcacgtttttctcttgaagtagtattcttcatggtggtgagttttgccagaccagtccaggagagcccatttaacttgtaggggtaagctgaagtaccagcactgtggaatccttaggagtggtaatggtggtgtagaataccatcacagtgtagaacagtgcttctatgggaaaatatgttcagaattccaacttggaatgctgactctcctgtacctgtagttagactgggaatgcctctcccctctatattgaaagaaaaggaaaaaaaaaaaaaaaaaaaacccaatacaatttattgagagattactatgtaccaggcagtgtaaactcattatgtgagttgtattgtttcatccccacagggaccctctgatggagcagtgtaggtactgctattattccctctttacagatgagaaaatggagaccagaaaagactaatcttagtgactttagacagagattctaaaaaaaaaacaaaaaaaaagagtactgggaatgccaggaaaggaacttcaa

SEQ ID NO: 32694 - DNA, 1869 bp, Bovine  19866881346681
tgtgcttctaaccatgaagtataaatcagaaagtcctaccaccttcttcttcctagggtttgattcacatgctatagtggctcacagaactcaacaaagattttacgtactagatcactggtttagcataaaaggatgtaactcaggaaaagccagatggaagaggtgaagagggcaaggtctggggaaagggcaggagctccatgccccctcccagcacctccacatggtcaccatcccagaaccctctctgaacccagtcctcttggatttttatggaggcttccttaaataggcatgattgattaaatcattggccatggattactgattcaaccttcagcccctctataatgaataccctctataatcacaggactggttcccctggcagtcaacctgaatctttaagtgtctccaaaagccacctcattaacaacaaaagacatctgtaccacactcagtacttaggaaattccaagggttttaggaaccctgcgccagaaatagggaccaaatacttactgcttattataaattacaatatcacatctcctctcagctactgttttcctcttagtgctttgttgcctgctattatccccttcaatgtatttctctaggataccgcaacaggcactttctccttcttattgcatcccgtgggggaaacgggggtggggtggggtggacggaggtgggtgtgaccacaactgtggcgaaaaacacaaaattcacgttaaagcgagagttgcttacatagtaacagcggtttgtggggcccaatcccagagttgagacttctggaccgaactacatatgccactcttgctaacaaatgtttgcaaacaatgaactttgatgaccaaaaaaaaaaaaaaaaaaaaaagggtttagtctgaaaattctaaaaaaggcttagagctattctttttcaagtgaatttcatgttttcctttcataatcctttccttgatttatgggtgggtgtattgttgatgatcatcaggaaaggccactgcaggcttggaaagagaaaaacatatgctcctattattgggttgaccaaaaagtgcgtaagatgttacagaaaaactcaaacttttaaaaaagggaaaacaaattatttatttggctgtatcaggtccttgttgcgacatgtaggatctagttccctgaccaggggttgaacccaggccccttgcattgggaacatggagtcttaaccactggaccaccagggaagtcccttgaatgagttttttggctaatccagtacttcagaatgtgctaaggtacctctggttcaggaagttaactcctacttttgcaaaacttcttgggggcaagactaacggcgattggataccacctgccattcttctgttccaaaaagaaaataaaatctgtgagtccaatcaaacagccattaccctagtaagaaaaacacccctggccaggtgcatcgtggttccctggaaaggtggttagtttacatagatacatggaggtaaagcctccccctctttaaatatgtgttcctgcctggcagtgactaaaacccgaaatgggttatttggttagtctttacatatgattttattatgtgactactattttttctctctcatccacctttcaacaggttcagaaatgaaaaaaaaaacaactttcatttctgaggtttcacggcacagctgtcaccctaatagcttggggccccacctgctcatgactaatgagccctgcacacttagagatccttgccagagccaccgcttcctaagcggaagcctggccacggaagcctggcctcgcacgtgttcattgaaagcccctatgaatctaaatttttcttcactctaccaa

SEQ ID NO: 32695 - DNA, 2376 bp, Bovine  19866881364570
ctaaagctgggaaccatcactatttaagataactgttttcaggatataaaattcttttagagttagggagagtaatgttaacttaggactttccccctatgaatagaaaggactcatatggactccttgagttcaggaaagttgcatttaatatataataaaggtgtgaaagcaacagcaaaaatgattaggtgtaacaaagttgaacagggtgaggataggagttcctgagatgggagagataatcaagggtgtcattgtctccacatgatgctatcagacttttttggttctaggcccattttcatgagtctaccgagtgatggctcccatgatctgctctagtatttttttttttctcctgctgagaacatgactctgattcaagtaccattgttcaatgagaaataccctgatagtcttcacacattcagcgaatatttattgaggccttaatgtgttccaaactctgggtgaggtgtaggggatatgaaaatatataacatgacattcttgccctcaaagaactcacaggtattcataaaacatccctcacactccaactcactgttgttgactgacactgttttattagcaaagatcctgtcattagcttttagggaaagataggtagatatggaaggtcttattctggtgtccagcatagctgttctgtgtagctggttaggcaaagggtgaggatttttttactctatgtcaggagtgataggcagtcttcaccctaaaccagtacagcacaaggcctggtgcacagtgggttctcactacacattagtttgtgctgtgctgtgctaagtagctcatcatgtctgactctttgtgaccctgtgggctgtagcccaccaggctcctctgaccatggggattctccaggaaagaatactggagtgggctgccatgccctcctccaagggatcttcccaacccagggatcaaacccaggtctcctgcattgccggtggattcttaaccgttgcctgagccaccagagaagcccaagaatactggagtgggtagcctatcccttcttcaggggatcttccccacccaggaattgaactggggtcttctgcacagcaggcagattctttactagctgagctaccagggagtccccgcatattactttatttaatccttatctttattacttcaaattactagtaagtaactattctaaaaaagcacaagccacacatcacagtaatgtattttggaaagggccaatggaagaaacatttttttaagagtaaaacttaaagtaagcatagctggcgaatgagtccttggttaaaaacaacaacaacagaaccctaatcagagaatgattactgccttccttataaatctcagggtttgcttgtttttttaaactcatgatttttttaaaagtctctgaaagatagggatatattagttaagtcgagaatggcaccccactccagtattcttgcctgaagaattccatggacagaggagtctggcacgctatagtccatggggttgcagagtctgacacgactgaatgactatcacttaagaatgcaggtaggcatgtgtatacctgtggcggattcatgttgatgtatggcaaaaccaatacaatattgtaaagtaattaacctccaattaaaataaataaatttatattaaaaagaatgcaggtaggcagaagggtggatagagaatgaatccagtctggggctttattatcactactgctaaaactaattaaatctgtaattgacagaaaaattgtagtagtgatgggataagaagggaataggatcacttccaatgatgacctttctctagtttttttgtttttgttgttgtatagtcgctcagctgtgtccaaatcttttgcaaccccgtggactgtagcccaccaggctcctctgtttatgggatttttcaagcaagaatacatttccttctccaggggatcttcctgacccagggattgaacttgtgtctcctgcttggcaggcgtattctttaccactgagtttaggggaattttaaaattgtatatatgggaaaagaaacaattgattaattgattcattcaatctacagatacagccaagcatgtgccaggcacagtgataggtgctgggaacataaaaatgaactcagtgctcttccttttagggagcgacgggcctgatgtctaaatgaaatcccaccaggaaagtcacagagtggagtattttacgctgcagagtgtgccggggagctgtcggcctcgctttgcagccctctgtttactccagttatctggtgctgccacctgctggacatttgctttttcacagcgtttaaccctaggtatggacggagaaaccagaaatt

SEQ ID NO: 32696 - DNA, 968 bp, Bovine  19866881578773
ctctactttccaggtgatggctgactaatcaagatattgtgataatgaattgccaaactgcccggccctgcttcttctcctcaagcatagatttgattaggagcctggtgaaaccaattaaccaattaagtaataattccttaagactttatggactatcaaccacatgtgtggcttaccgtgccttgggaggctaagaaccaaagagggaaaagacacaactcccagtccagcaggagagagatgcgcggaggtgaatgattataatagccacttgctgtaaggcacatgtatatgtgtagacagactattgtggaaggtcaggaggaaatgattatttcagtttagggaatcggagcagacttcctgggaggctacagaggcctcgtgcatggaccacacagccagacaggtcacacatctagctacatgtgccctgcaaatgcctaaatgaactgtctaaacagttaaggggcttccaggtggctcaatgataaagaatcctcttgccaatgcaggagacttgggtttgatccctgggtccttgttgcttacttcccacgacttagcgacttaacaacaaccagcccatcttaagctgtgttctttattgccatgccctgctggctcctgactcagcactccctcccactcctgccgatgagttgatcttttaaaggaaggtcagacattgttctcctcatttctggacaaaggtttgttctctctgattatcataaattggggttttgtgagagctgattctctaacttggtcacagttaacccagcatgacctttggaggtactaaactctcttgagttccttaaaaaaaacctgaagtgtaagaggggaaaacaaactcaaatctgagaatttctctcaggtttccttattaggtttcttctaaaaattaaatagtcagcagttctttcttcacataaatgggagagccctgggaagaatgg

SEQ ID NO: 32697 - DNA, 736 bp, Bovine  19866881697926
cctagaagtactgaaaatgagatgaaattaaattttctagaggaagagaaagagttctgaaaacaatttctctccatatttttcatggtcatgatacaaccttggcaaaatctgcagccaacacccaaagtcagcaagtatggacttaatttagaaagaaaacgtattaaaaacattcaggggaaaaaactagcaattcattaacttgaggttttattccaatcactgtattctaaaaatgcacagtcattaaagaactatttattgcaaagcaacatatacttcatgttgtttttgtcaatgttttgggtacctgcggaaatagaaacccctggcaaaattttctgtcagtagagcctcttacccaaccatgggatctagcacaatagcccggggttcctctaagtcctctgaaatcaagatcttcctcatggtcccgttgagccttgtcacttctatccgatcagtgccagtgtctgtccaataaagatttcgggcaacccaatcaacagcaataccatcaggatgggcaatttgggcagtgaccacaaactgactgccagatccatctatgaaggagcggcgtatggccctcacttcatcatcagtccagtagatatagccttccacgggatcataatctatggcaatggcatggcggatgtcttctaactgtagaacaatgtcagtgaaatctggtgtatccaaagaaatgcgtctcaagtctgtccttcgg

SEQ ID NO: 32698 - DNA, 902 bp, Bovine  19866881768672
ctgtagagagggcatgttggagaaatgttctgatttaggacatttcaaggtccttctggtttgggagaatgccagttctctttttcttcttaaagagaatgttgttcttcattcttaaccctatggaccaccatctggttctctagccacaagacctggtaagaaaattgtatgtagcagtggcttctttatctaactctgaaaagtagaagcctttatttaggagtcggttagagttccttgcctggagaatcccagggacatgggcttccatctatggggtcgcacagggtcggacacgactgaagcgacttagcagcagcagcagtagagtttctggcaaggggatcagggaatcagagagatgggattgagttggtatacagggtatttgtcatgacttggcattgataaattatcctcctggtcagaggtgaaactggctgattcttgtgacacgtttccatggcaaacaataatttggtttcaatttaaaacaaaaggtttatgtaatgttgcttttttgttaaaaaatgtagactttaaaatagtggatttattttagccatagtggtctgtttacagccttagagcagtgcaaatgtacctgtttaatgagcatcttaatttcagatatacatttggcatgtagtagcccttaagtttggagaaggcaatggcaccctactccagtactctttcctggaaaatcccatggacagaggagcctggtgggctgcaatccatggggtcgctaagagtcagacacgacttcactttgacttttcactttcatgcattggagaaggaaatggcaacccactccagtgttcttgcttggagaatcccagggatgggggagccctgggtgggcctgctgtctatggggtcgcacagagtcg

SEQ ID NO: 32699 - DNA, 695 bp, Bovine  19866881853223
aaaactacagcattttaaaaaattcaccaagttgtgagtgactcagcctgcaggccagacatgtcagaagccctagatcatggtgatggtgtctccgagtgagtctttcctctgctcagtgaccaatttcagctccaagaaagatggagctagccatgcattagtcacatatttcccacagaagcccggggggagcgacgcagctgctcgtctgagaaggagccccacggagcagccgggtgtggctgtcggagcccttgcaagtgtggcccatttgctgtcagctctaaactttgctttcctgctttttcaaaagccttcctttctcattagggtctggtggctttggaagacctgacccaaccctgactggctggtctcatcagaggctgtcgccgtagaatgatctttttttaaaaaatggcttttttaatgcagtccctggaaactttgcaagcaatgtatcgatttgcgatccttgagctgagttattgagctctggcaaagagaaataaataaatctttcccattctccacgcctgttgccaagtgctgcttccaggaagcgatgactgtcctttctggaaatgaaatgaagctcaaaacgatctaacctccttcccttcacttcacgcccccagctctcccctccgcttgcaagtcacggacaaaagcactttgcagccattcctcat

SEQ ID NO: 32700 - DNA, 4687 bp, Bovine  19866880107301
tcttcgcatgaggtggccaagtactggactttcagctttagcatcattccttccaaagaaatcccagggctgatctccttcagaatggactggttggatctccttgcagtccaagggactctcaagagtcttctccaacaccacagttcaaaagcatccattcttcggtgctcagccttcttcacggtccaactctcacatgcatacatgaccacaggaaaaaccatagccttgactagacaaacctttgttggcaaagtaatgtctctgcttttgaatatgctatctaggttggtcataactttccttccaaggagtaagcgtcttttcatttcatggctgcagtcaccatctgcagtgattttggagcccaaaaaaataaagtccaacattgtttccactgtttccccatctattggccatgaagtgatgggaccagatgccatgatcttcgttttctgaatgttgcactttaagccaactttttcactctcctttttcactttcatcaagaggctctttagttcctcttcactttgtgccataagggtggtgtcatctgcatatctgaggttattgatatttctcccggcaatcttgattctagcttgtgtttcttccagcccagcatttctcatgatgtactctgcatagaagttaaataagcagggtgacaatatacagccttgacgtacataggattgatggtaatataggatttctgattgctagcgcttctgaacagttctgggattcatagtcttgcctatgccacgtggcctcttacttcctcacatttctataagtagaaaccttgagacaagaaggttgactgctaagactcctggtgccatatgtactgggtagtgtcacagcccttgcagctcctgttaagtattctttctttttaatatcagccaaactgacatgagagactattcttcaacatcaacttctcgtcaaagattgcaaaccatttggccttcgtgtatttcttcttttgtgaattattacaccttttatttgcttttgtattgaggtgctcgtcttccgcttactggtttgtgtaagttttgcatatatggatataaatattctgtttgcctatataagctgcaaatacttgtcccagtgtgactcttagttgagtttctgtggtttggccgcccaagattttgctttttatggagtcagatctatcactttgtataaatcttttcttgctgaggagattggccttccaggtcctactctgagcctgaagagatcgccttcccccttttgacccctttttacatttgaaatgtcagggtagggaagagaaagtgatacagctctctttaaagtgcaggaagacgagtggagtgacaaatgggaagaccttctccagtaggtttctgtctaatcagaaatgaaataagagctgttcagaaccacactcaaacccattttctgcttgactccctctgaccacagcccaggtgcctacatcaccacatcagagccatcggaactgattttctacaggaaagaccttttcccgtgagagcattagacatggtgtcttgtaaagattcccctcccctatcgccggtcatcatctgggctctagcagtgaatcaggagagacaatgattgaaacagcatatggcatcatcagatagtggtttttctgactctgacagttttaagagttgtcgctgacttttttctccagctgaggtttagtggctttccttccctcttcactgtggcattaaggatctgtttcagtcctcggtcagatatgcagagctcatacatatttaaatgtttcaaagtgttgtcctgattcctgtttcaacccatgcctccacctagctgacctcagcagtccaccctatcgatttgtgtatgaagagagactgtatggatttttttttatgttttcttttcagttattgcagtgctaaaataataagggcatgattaaattttctatgatgtctgtgaacaggcgataaagcactgaatgttgaacttaatatatgtaacaaaaagcaagggtgacgaggcaattcaaaaagagggcaggccagttcagagatgcaaactgaactcctgatagtaggatttgagatttggaatagaggacccaagttcatcggcttgcttccatcccttggttgttaattacagttttcaattaataattcagtgtcctgaactattttgataactcctcattaagagaatcaaagctgatcattaaaggatgggtcacagaccctatctacagagagcaaaggcccaggtgagcaatttgaaagctttaccattgaacaatatgaaagcaataccattgtgcattcctctcatgggaaccgacgatgaatatggatatagcgccaaagagaagaggaaaaaactcaagcacgagctcacagtgccctgctttgttcacagccccagatcaatagtacaaagactgcccaacgtgcttcagtaaccagtcatcaattatttaccgggctcttttgttcagagtttctgtttacaagattactttgttactagaaatggttgtttcctttcatgcggctgctggctgggggcttgagtcttttacaagatgagcctgaaagagtggtatttgtgtgtatgtcctacatcccccaactcagactgcagattcaaatcagcatcactgtgtagtacatctttccactggtgctcaggattcccccaggtaggtattacagactcaagactgacctctccatgtagaaaagcgtaagcattttcagtatctgccaaaggacagcgaaagtcagggggaagccatgcctcttgagtcatttgcagaatttgtccttgcccagctttctcaagagatttaactgactaaaaaaaccaggagaaaatacattaaggtctagttttattgttgttcagctgctaagtcctgtctgactctttgtgaccccatggactgcaacatgccaggcttccctgtccctcactatctcccagaatttgctcaaactcaagtccattgagtcagtgatgccacccaaccatctcatcctctgtcgtccccttctcctcctgctcaatcttccccagcatcagggtcttttccagtgagtcaactcttcacatcaggtggccaaagtattggagcttcagcttcagcatcagtccttccagtgagtattcagggttgatttcctttaggattggctgatttgatctccttgaaatccagtggactcttaagagtcttctccaacaccataatttaaaagcattgattctttggcactcagtcttccttatggtccaactctcacatctgtacatgactgctggaaaaaccatagttctgactacatgaaccttcatcagcaaagtgatgtctctgctttttaataccctgtctaggtttgtcaatgctttccttccaaggaccaatcctcttctaatttcatggctgcagtcactgtccactgtgattttagagcccaagaagagaaaagctgccactgtttccacttttcccccatctatttgccatgaagtgatgggaccagatgccatgatcttagtttttttttaatattgagtttaaaccagctttttcactctactctttcaccctcatcaagaggttctctagttcctcttcactttctgccattctagtggtatcatctgcatatctgaggttgttgacatttctcccagtaatcttgattccagcttgtcagtcatccaagctggcatttcacatgatgtactttgcatataagttaaataaacagggtgatgatatacagccttgtcatcgtactcttttcccaatttttaaccatccattgttctgtgtctggttctaactgttgcttcttgacctgcatacaggtttctgaagagagaggtaagatggcttgttatcctcatttgtttcagaattttccacagtttgttgtgatccatacagtcaaatggtttagcatagtcagtgaagcagaagtagatgggttgtttttttttttttttttggaattcccacgctatctctataagtgaacgactgttggaatctgacctctggttcctctgccttttctaaatccaggttgtacatctggaagttctcgattcaactactgttgaaacctagcttaaaggaattggggtataaccttactagcatgggaagttagcaaaattgtctgatagtttgaacattatttagcactgcccttcttcagaatttgggtgaagactgacgttttccagtcctgtggccactgctgagttttccaaattcactgacatactgagtgcagcacttgaacagcatcatcttttaggatttgaaatagctcagctggaattccaccacctgcattagttttatttggcgcaacacttcctaagatcctcttgacttcacactccagaatgtctggctctaggtgaatggccacaccgtcgtggttatcctggtcagtaagacttttttgtacagttctgtgtactcatgccagctcttcttaacctcttctgcctctgttaggtctttagtttttctgtcatttatcatccccatccttgcatgaaatgttcctttgatatctccagttttcttgaagagatctctagtctttcccattctattgctttcctgtattttttccca

SEQ ID NO: 32701 - DNA, 1502 bp, Bovine  19866880394894
caatctgtgcaaaacggaggcaagagttcatgaaaggcaagaaacattgacaacttctcaaagaagggtgttcttgtcttggcaatattacaaattattttatgaccctgggctagtcatttaactttcctgagctttgcatcctttctttgtaaaataggatagttgggtaccactcagtctaaaattcaacagcatccttgatgtgtgcatccttgggtggctatccagattggggtagggaactttggaagctgctactgttttggggaaaaataaacacagagaaagttctctgctaaatattacatgttgtctaatgcaaacttactattagaaaacatagcctctggatgtatttgccacattatttctttttaaatgatcttgtcaattgccttcctcattataaagccattttgtagaccctattaacagaaattgcaggctgtttatctctcttataaatttcatcatcaggatgggggactacatttatagccaatgacattttaagagctctttcttttagccacagaacagaccactcaaacaatgggatcttggataaactgtcctgaacatagtaatatcagttcaactaacagtttatgcttgatttttactatttcaggggtgatgtgggcaccagtatatttgtccctatatggacaccagaaataggtatcattaaagcaacttcttagccattaaatagctctggctttcagtttcttaatcttatggtcagggattcaaaatggacataaaggaaatctggtattgaatactctcaaaccgttccccatagtaactctgtgcatgcttctatccctgcctggaatttatttcccccagggttttgcttcgctggcgccttctcattactcaggtatcagtacaaaggttacattttcagagagtatttccctgtcctctctaggtaaagtagattctgcactttgcattagttgttcacctgtttattaactgtcttctcttactacaagggaaattccattagcataggacttattttgattgatttgttgctgtatcatcagcatctagaagagaactggcacatagcaggcattcattaagtacttcttccgtttttaaaatcatgcttttggtgtaaagtttaaaatctctttgtccaactccaggtcataaagatttgactccatgttttcttttaaatgttttatgcttttccacttaacacttagatctatggaacacattttcagttaataattgtataaagtataagttttgggtaagattctttttttttttaacatatgaatttctaattgttcccaagccacttcttgagaaagctagcatttctcagtacaatcatctaagtcctttgtaaaaactccgtgggtcatttttgaatatttctggactctccatttggtcttattgctctatgtatatatcgcttagtcaataccacattctcttgattactatgtgcatgcatgctaagt

SEQ ID NO: 32702 - DNA, 1318 bp, Bovine  19866880482500
ctcagcaagcagaaaaagcattatcagctacctcaatattaaagtgtccccaaatacttacagttcaaacaccgcagcccagtctggaaggaaaagcaaatgggtaagaccagctccatgcattccaataaatatgtctgtgttatgcgtgattctcagctgatctaaaaacccaagttccctgtgaacataatgaacaacaaaagaaaggggaggagagggaaagtactgagttgagtaagctcacgattcatggtaacaacatttatacaagtgtctttcccagttaaaagtacatttcttcatgatatttgccaatttcaagcctacttccataactaacagcttacttaataaataaacattttttctaagttaagcttgccttctttaaaacttgcatgttcttattttagaaggaaacttttatacctgtcttaaatggaagactaataacacatgacataaaactgtaaaaatgggtataatcaagctaaaaaacattattccaaggtaggtaggtaacactacaaggcaaagctctgatcccaaggctcactctttttttaaaaagtggaattagcaagcattacagtgatgttatgatatatttagcaaccaactgaaaactatttccttaagatcatacaagaacttttcaaaaataaaacaaattcttgcttgcatgatttgagttattcaattgacatctgtgcaccgctaaaattatctcagataccatgagggcattttcctgcctgtgcaacagatgaatccacaattttatgcgtgctggtctttgaattcaagacactgaaagatgtgcaaactttgaaacgaaagtaagaggcaaaaggtccacgaatcaaggtaaattgcaagtggttaaacaggagatgataagagtgaacattgacagtttaggaatcagtgaactaaaatggacgggagtgggagaatttaattcagatgactattatatctacgactgtgggcaagaatcccttagaagaaatggagaagccctcagagtcaacaaaagggtccgaaatgcagtacttgggtataatctcaaaaacgacaaagtgatctcagttcatttccaaggcaaaccattcagtatcatagtaatccaagtttatgccccaaccactaatgccgaagaagttgaaattgaatggttctatctagacctacaagaccttctagaactaacaccctaaacagatgtcctttttatcagaagggactggaatgcaaaagtaggaagtaaagagatacatggagtaacaaaatgaagcagggcaaaggctaacag

SEQ ID NO: 32703 - DNA, 1184 bp, Bovine  19866880558400
ggaagcccataacccatctactggtggaaaagtctcagaaattttataaaaaggaacgcctattgagtggttaccaggtgccaggaagtattcgatgctccatatccctataaaccattagatgctctgtatccttacaaatacccagctgcccaagctctcttgtccaaattaggtcttggaaactctcgcttctgcatgtggtcatcccacatgctctgcctcctcaaacaggcaagatgtagaaatcagaggcaagagggagtcttgattgccaggttcagattcctgtccgggagatataattacagggttctctagagcctatgataagctgatactaaatttgttcttggtagaccgtcttgggatgtgtgggggcagggcggaggagggggaagtgggggcttaggtgcaaggatccttttgtaatctctgatctcctcgtgtttgagcatgagtatatttcctgaatactggtcttaaatgcctagtagtcattcagatgtaagactagtctgcaaacgtccatgcccgagacagggaaacaatgctgagtggtttgctgtatgcaaactccttcttcctgtcttttgtgcatctggcctgagatttatctatcggcgagatatttggacaggatgtctctcgtggtgtaacaggtaaatggtgaaggacttctgacatttttcttattgactgtgctgttcactaactctttcttaggttaaaaagaaatcaagcatcagttgaacggctttgttttcctaactttaactctgtttctttttcttttttgcagaagaggaaaaatagttcaggatatgcaaaaagatagagtgcttttttttttaatttgacaatagttgatttagaatattgtgttagtttcagatgtacagcttcaggttcttttccattatcagttattataagatatgaatatagttccctgtgctatacggtaaatccttcttttccatttataaaattgtaacgtatgataaaggtgcattatgacttatcaagaaaaggataccctattcaaaaatactgctgggacagtttgcaaattggaaaatagaggacaaaaatagcaactcaccataaaacagataccaaaataattcttaaggttaaagattcaaatataaagtataaataagtaaaagctaaagcaaaaa

SEQ ID NO: 32704 - DNA, 905 bp, Bovine  19866880609378
aaatatatatatatgtatgtatatatgtataattgaatcaatatgtatgtatgtatatatgtgtaactgaatcactttgctgtatgtttgaaactaacacaacattgtaaattaactacactccaataaaaaattcattaaaagtaaacaaaattaaaaattcagttcctcagtcccactagacacatttcaaatgcacaagagccacttgtatcataccagctgctgctgctactgctaagtcacttcagtcgtgtccaactctgtgtgaccccatagacggcagcccactaggctcccccgtccctgggattctccaggcaagaacactggagtgggttgccatttccttctccaatgcatgaaagtgaaaagtcaaagtgaagtcgccaagtcgtgtccgaccctcagcgaccccatggactgcagccttccaagctcctccatccgtgggatttttccaggcaagagtggctggaaaagactggctaccatactggataatagagagaacatactcaacggcacagaaaattctctttgcatagccttggtcgaaatgatctttaaaataaccttcagctcttaacactgcaaagaaagacaaactgaaacaaactaatttcttcattgataggaaacaaagctactggaatttcattgcctaatttcaacacaaaaagggttcatgtcactgttttgcagtcaccttgatgagttcccttcagttgcatttaaattgggttcaatagatgtgttcatggaaacagcctgataacttatctgcttcaacatgcagagtaaattcttgagttatttatggggatttgagatctcaactggtattttaaaaagggagataggagtgcggaagagaaaaaagctctatttcatgttgcctgaag

SEQ ID NO: 32705 - DNA, 819 bp, Bovine  19866880644171
ctttagaaaacaaaggaaattgtctcatccggaggctgcaaagctcttggctataagaggaaggctgtggaggaagtgggtaggattgggtagagagacaaacgtcaaggaaataaatgtatcacaatagcggctgggatcctatccccttgtcataatccagcacagtagcgtggccttagaaatcaatcaactgtctctaaatcagtcctatctaaaactatttaatgatctgaaggagtagaaaggaatgtaacatatccaaaatgcagtcctattgcctggattctattatggtgacatagactcatgtgagatgatcctgctattaagaatcaggacataaaacctgcctagaagtaagaccatcttgtcatgcagccctttcaggaatcaggaactacatctcttagcagagaaactaaaatattcccagaaacaccaaattccactccagggcacattctctgtgttccagtgcaccgtttatttggtcattcatttggagtacacagaaaactgtgtactgatgactattggaatggaggttattacggtcgagtaccccacccccaccacaccctcgccatggagagagggctcagtaacagtgggaagggtgggagatgggcggtggacaaataccgctagttgagtaggattgttaaatgtatttacactgtagactgtttgaactggaagaaacctcgtaagtcactttatccagtcccctcatgctcttactgagtagttggaaatccagagtagtggaggaatgctcctaagatctcctgtgcattaggagcaggacacagtccc

SEQ ID NO: 32706 - DNA, 762 bp, Bovine  19866880681067
agccttttaattttgtccttttaataggtatgaggtggtatttcttatggtttgaatatgggtttccttggggctaacaatattgaacatttcttaacatgcttattgcccagctatacgacttctgcaaagggcaattttcaaggtaagagatataaatttcacatgtgtaagaatttgctttattttagaaacaatttttgaaaaatagaacttggaaaaatatttactaaaagagtcatgaaatattcagattatgaagatcaaatatatttagaggctaaactaaaaataatgaaggcaggaatatggtagaaaatattcacattttatttgctttgtattttgcactgtacactcatctaatgctctaagaaactaggggactggaatttgaagaaaggagctcagactgaattaacttgatgtcagtgaagaagggaaaagctctgctcttttcccttccaattattccttcttccctagacttcattttatagatcatgggctcaattattcactgtatctttttatatctagtctcataaaactgtaagatgaatcattacaaaattaatattcaacaggctttatataactctgcttaatgccatgtataactcagatttttatcaccccaaggcctctcaagatctataaatgccactacattaataaaataccatgtatttaactctaacattcccatcacaactcaataccacaaaaccactcaatttaaactagacaaccagacagaca

SEQ ID NO: 32707 - DNA, 2034 bp, Bovine  19866880710651
tgcaacccccatggattgtagcctgccaggtactctgtccatgaaattttccaggctagaatactggagtgggttgctatttcctcttccaggggatcttcctgacccaaggaggatcgaatccatgtcttctatgtcttctgcattggtaggcggattctttatgactgagccacctgggaagatccatatacagtatactcaccattaaaaatgtagttcccatctgtagctctataattggccccctttacccatttccttctccacagattaagttcttgctcacataagcctctgggtcaaactgctacaccagctttcaaaatgacacctatgaggtacacatcctttatgggaaagtgtgtaattaatgtgtaaacatctaataaacattattgataagaggcttttattttcctttccaaactaagcagttttttttttttctaaatctctggtaattttgtccccttttatagctggctttgcctcctagaactttccttccaaaggaactggactggaaagcctgtgcctgaagtatctgggcagttttcacagagctaagcagacaaaaaatcaaagacaacggttttggtatattccaaaatatcaaactgctctcatttcccccacaatatctttcattttcagggaaatttgttgtgcacattatattagattggcaaacatattaggtatgtaaattttggttaggccaataaggaaattactgtgtaacacagagttattgaatacaaaattcctattcagctgtatacaaaacaaagacttcagtgaatggataaataattccataaggttttcaaaaataatttttaactgcttctggaactgaacactatctttaaaaacaatagagggtctgaaaacaaaattaactgggtttcattttaatacatgggaggagaaaaacacaaccaaaaaaatgtgtgtctgtctgtgtgcctataaaaatttacctttattttggttgtatttgcttataaaacaactaacaaagacatactttgtttcagaaaaaagtctcagtttagaagtatataaaaagttaaaatccccccatcccttcctcagttatcttagttacctctcttcctcaaggataactattaatttgataaacattacaacagtctgtttctcatatacatttacaaacacacatatatatatagtgtgtacatgtatacatattcatatatacacataaatatacatgtaaacaaaaagaatactatacctagagcttattatttttttcactaagcaatctttttattatcttcaatagatactgctcttcttcatatttcttcactgctacgtattctaacctttctaaatttctcttttaggaaaaaactcaagaacagcatgaagcgataggcaaaagcaataaaaatatgtcccagtatttaaaagaaaaacttaacagtgaaatcattgcccataaaagagaatcacagggcagtgacaatgtccaagaaacaaataatgatgataatgaagatgagggggaagatgaagaagatgatgcagaagatgaagaagaagatgaaggaaaagaagacagtgaagagagtgatcaacaaaaaaagaggggaggaaggtgagataaaggagcaaataaaaaatggtgagaacacgggccaacaggtaactagtaaagtaactgaagaacagaaaggcagaccagaggctcaagacaaaattgagaaaaaaatatcaaaattggatcccaagaagttagctctagataccagttttttgaaagtaagtgcaaggccctccggaaaccaaacggacctggatgggagcttaaggcgagtgagacaaaatgaccctgacatgaaggaactcaacctgaacaacattgaaaacatccccaaagaaatgttgctggactttgtcaacgcaatgaagaaaaacaaacacgtcagaccttcagtttagcgaacgtgggtgcggatgagaacgtagcattcgccttggctaacatgttgcgtg

SEQ ID NO: 32708 - DNA, 2205 bp, Bovine  19866880713966
ctgcctgctgtcagtgccctggggaccggccagtgggaggagccggtcgcccggcctaggcagagatgctctgcctggaggctgttgtcttctggtttgttcttccccactgcgttacagccccccacatttccgaacacactatcaggatgcaaggtccaacacagggttattatttttttttctgatgaatgttttgatggacatgaaacatttacaaaggtctaaaaatcaaaagcaaatttcattacatgcttaatgaacttatttgtcagaaagaaatcaggattcttccgggaaatctagaaagggtgggtgtcatccttctagcaattcctgaaaaccctcatggattattaattttcctggagggaggggctgtgatggcctatattggtttgcaacaccagaagcatagctgtatttgtttcaaggaagaaggctcaacttcttttttaaaaaggtcattctttatgtacatgattgcacttttgatggaggctaggggtggagaagggatgactattatataatgcaataaaatgtcaggtatcacaaatctttgaagtttggggcagtttagctaactctgaggaatccagattcatgagcagaaacctttctttctctgtgcctggcaagacattgatgaccccattgtggatataatgagaagaaaagtcaggctgagaatttaagtatcatctgccaatccattagcaaacaatggaaagtcccgcttgcatgtgagactgtttttctgaaaatgacaggtttactgtatgaagttaagaagccaagaaaacatatttatgatgtgtctgtcataggggtcaagacttgtgttcaaaacccaactccacaactgacttgctgtttggggacaaagcatgttatttctctgagtcttcatttcccagggggattgggctttcttttagtgatcagtacaagccacccagccctaaaccacatcctgagtcttccaagtttccttttttgtagcttggatatattctaacaaggattttgagaaccagtaattgatattttctaaatatcccactattacttatagactatatcatatatattcttttatgttatatgacatagtatacatttatagaatgtatgttgtctatgtatattttggataggaaagttatgagaacattctaatgagatcttgatattgacttttttgagtgcacatgagaaggaaagccatccttgaccctcctgctgctgctaagtcgattcagttgtgtccgactctgtgcgaccccatagacggcagcccaccaggctcccccatccctgggattctccaggcaagaacactggagtgggttgccatttccttctccaatgcgtgaaagtgaaaagtgaaagtaaagttgctcagtcgtgccggactcttagcgactccatggactgcaacccaccaggctcctccatccatgggactttccaggcaagactactggagtgggttgccattgccttctccgaatgattccgtcattatttgaggttgataattagacaccataacccagctcttgtaactcaacgggtcaaactctctttatattgtctgtgcttgcagaattttaaaaagcttggacatagccaaagacttagggatagcaagcttttaattaaacactaatgaagagcagaaagaaagttttttttcctcccaggaatccaggcaaatccaaagggtccatccatccttatttccaggggatgggaatgatctgggccagggtcagaatgataatcaacttccacagagtgccacgaagagaaagccaggggtctgaaacgtttgtcagcattggtcaggccaaagagggcaccttccagagcttaaccacagggccgggcacaggaaacagagatcacttgacagtcagcgctgacgagaactgcagaaactgccagcttccacaccctgggctgggcacgggcggggacttgcagctggtagaacacagaagcgggggtccctgactgaccctgttttacaggggtgggaggaaacatctcactctgctctctgccctctgtttccttaacggaatgactttcagagaactactcgcaatcagcttacactggcttggggctattttccataatgaaaaagagtaaacacacacagacacaaatccatttcaacacacacagcctcgt

SEQ ID NO: 32709 - DNA, 995 bp, Bovine  19866880742535
ctctcttactgaacatttttgcatataaagatggaaattcagtttccagagaatcagtctcacttataaaaacaataattaaaaccctaagcaatcctttatcagataccttctttgggtctggtattcagttctttatgtacctgacagctaacgtttatttatgtccttgtgccactcaaggcattcagtgttacacacattatctcatgaattttttacactatccagaatgccaaggcttcagttctcctctcttactcaggaggaaatggggctcagagagaaaaagcaatccactcaaggtcagatttgctcaagttggagcccacagcctctgccgtgatctggcatgcctgctgcccatcactgccagctgtctgccccagggggctaacccagtctgttacggtcactgaagtaccctagattctgtccaaagtgcctcctcctggaggcaaatgactcctttcagggtttgcaagaaattctacctttgagacgttggagatgaaaggaaaatatatcccaagtaacaaactgagggctttgttagaacacgtcacacttaataaaaagcagagagtgttgatcctttttcaacgacactctcccatcattttccgcctcaactgtttgttaagcctaattaattgtgataccgcaacccatctgggcaagataaaacaagagagatatatcagcttttaatactcagccctaaatggaagagtgaatgtcccatgtctgctatgtcgaccaaattcaaatctttactcatcaagcaagtctttgttaaaaggcacgccttggtgcacgcctcaagtctgctttttatttagttgcatgactacagaaatgccttatagctagtatctttattattcatggtttctggcaaattaagtctctagcctctccaatatctagaagtggaggaagtattcaattccaaagaaattatgccttcccggctgtgctggccaggcaatgat

SEQ ID NO: 32710 - DNA, 1204 bp, Bovine  19866880907292
aaacacaagaaaatgattaagtatagttatctcttggtagggaaacttctgtgcatgctctgtgctgtttcaaattttaccgttatctgtattagcttttaaaagcatttaaccttgaccaacgatcttggttttctactttgtaaactggtaataatacttgtcttgttaactttagatggtatttcaaataccgaaagagaaaatgcaggtacattgaaaaagatttatcatctttacatagtaatgcatagaaagtaaaagttgctcagtcgtgtccagctctttgtgacaccatggactgtaaagtccatggaattctccaggccagaatgctgaagtgggtagcctttccctactccgagggatcttcccaacccagggatcaaacccaggtctcccgcattgccagcggattctttatcagctgagccaccagggaaacccaagaatactggggtgggtagcctatcccttctccagcggatcttcctgactcaggaattgaaccaaggtctccagcactgcaggcagattctttactagctgagctgctagggaaacctgtaatgcatagaagttaggtgttactgctaatgatgatttttttagctacaggaaatcattttataacccaggatttacaatggctaggtatgaggaaaatttttagggaaaaggatgaatgagaaaggctaagaaccctgctacaaattatgagtggaaaaaggctttggtcttgtttgcctttaaggtcagaaaagaaaaataaaaaggggcaaaaaatatatacaaatgctcatgtaaactttaaaaaattgttaaataaaaactcaggcctatagaacattttcaaggtccttaaaaatgaagataaaaaccttgtgtgaggttgcacaggagccttgtaattaaaggagagtcagtggaggccaaggtgatcgaaagagaaatatgttccctccatgctgagtgcattttaaacaggtgtttgcaggtatcaataaagctaacattaaagagaaacagaaaaacaacgagacctcagagtattctgcggagactgaaactgcaacaaactcaccccctacacttcctattaaaagctcattaactcccagctgttcatccattaggcggagaggaagggaaaatgcatgccctcactgccaatatttatacccagaggttttcatctcataaa

SEQ ID NO: 32711 - DNA, 2190 bp, Bovine  19866880923655
acgcaattgttcccctaagtcaagacacgctgtacaagtcatcttcacttgtcagcaaggtcttaagtttaatttgacatctttgaagaatcttctgtttcaagagcaatgaactctatgttggaggctaacctagctgtgggatgacagtgaagatactcagagagagagatgtctcttcggaaaattaacaacttgtcttctaagcaaggcattgactttgaagggacagagaggattgaaaagttgggtcctgatttaatctgaagcattcatttgattaaaagtcagcctgtgtctactgtgtgctttgttttaggctctgggccttttcttgctggggatgtgtctttaggatcctatgggacattatcagggggaaagaatcacacaaatgcagattgatagtagttaggatacagtggtcagggaaggccattgtgttgggttggaatgatgacatgtagccagctatgggacaacctggagaaacagaaatctaagtaagcagtggggacagcagatgagaacggcttggcaaaggtagggaggaaaaggaggccagcgtgagaaatactgacggtgagagaggattgtcgtgtggccactatgagaagaagggagtgacccggggccaggggtacagttagaagcatggctgtggaagtagtctaagggagagatgctggggcttggctgagtaatggcattggggaaaaggagagaagaacagatggatgggatgtgttttagaggtagtgctgcaaggatttgatgaatgggaagtggggcgatgaagagaaaggatgcatagttttatggtcggagcaaccaggaagtgatgggggtcttacttgggagaccacctggagtgattagttagggtgtctgcatcctttgtctgcctccagagcagtgactgagttgctctgagggctgaaacagcaaaagtatttgtaaatatcctggaatggggactctgtttgtaaagactgtatgatctcctttttgtgattcagacgtgctaataagtgggtgctggaaatgtcatgattttctaatcacagccttcttttgctatagccattttcagcagacgccagttcggagcaacatccaaaccctctctggcttctgttgtttgctgctggctttactgttggcatgccactgttcacagcatgccgactgggggtggggcggggctctgaggaatttacttttgctctgggagactttgggggaggttgcctgtttttgttaattatggcttgtgaattactttgtcagaaattttgaaacccagaagtctaaaaaaattacaaggcattgttaaatatttaagtactgctaatttctctatgtggtatgagattttggctgagattggatctttgggctgtttagtttcatccttatcatcttgtgtagagtcacaggggcttccttggtggctcagtggtaaagaatctgtctgccaacgcaggagatgtgggttccgtccctgggttgggaagatcctctgaaggaggaaatggcaacccactccagaattcttgcctgggaaatcccatggaacagagcagcctgccaggctacagtccatggggtcgtaaaaaaggcaaacaagacttagtgactaaacaacagcatggagtcacagatccaattttgcctattaaatcaaattttacatttgtttcatacagtgtgttggataagcatatgttgggacattgttttgtattcgtggagagtcacatagtaagtttagtacgggaatacaagcatcttagcttgtgaaaatgtctgagtaacaatgagaaatgttatgttttaaaatgaattattcttttctgttatgaaaatagtataagctcatcctaaaaaaaaatttggaaggtgtacaataaaacttgaccatagcccaatcacaaagaactccgtacgaagttgaagcttctcaggaactggaaggccctggaaggggcttgttctttgattccaccgacgtctcactttgcatgtgaagaaactgtctgaatggaaaggtcagacccttgagaatgggctgtcctgtataattcaggctctcggcagcattcctttacagaagctgcaagccagtatggctaagcacaagccacagagcacccggggttagaattagagaaacagattgtatatgga

SEQ ID NO: 32712 - DNA, 790 bp, Bovine  19866880946828
ccagaagcagccagattgtaatgtaaacatctgttaccttttctctgctttcagaactgattatgaaaccaggcttcacatcagagacccacagctttcttcatctgtattcctggattaattccttttctctctctcatggacacatccacagactcaaatcaaaagagccataaaattggttaccatgagctcagtcctcccaggataaaactcctatcttctttgtgttctgtcctgctctttgcagactgtcgggtcagctcaggagtgtagagctccattaaccaagctggaggatgactgagtctgtcccctggtacctctcattctccatgtgtactgaattcctaccacctcaaaccctaggggctgatgctcagctaaggaagtttgggaaactaacaggttaatatttaaacatccccaataagggcacatagggataagagtgatgtgcagggggtgtgcaaggagacatttacatggagttgaacatttgatagtaaatgtctctttcactagtttctgctggtatttgccatatttacattaagggatgtttgaaatattttgttgaccttttaaaaaatgatagtagcaacaatgactatcatttgttgaataaggatattgctggctagtgcaccaagcatttacaaaaattgtgttaaaatacaaataatagaagtttacctacttaataccattgaactgtatgctttaaaatttgtaagtccgttcacattgttgagcagtcatcaccaccatccatcctcagaactctgtt

SEQ ID NO: 32713 - DNA, 956 bp, Bovine  19866881039664
catagcggtagctcttagtggtgcaataaggggaaattttatgcttccatgtgttatcctaagttttatacaataaatgtaaatttttgagtaggcactatatttatgtttcaaaatttgcacttataaaaggtatacagtaacaaagtctattttcctagtcctgtcccccagacaacccatttctttctccaatagtatccactagtattggtttcttgtgtatctttccaaggatctattgataaagtttgtatgaatatatatacgtacattgtttttatgctttatgacataaataatagcatacaatacactgctttgtacacatctattatttcacccatgtggggggtatatctgtagaatacattcctacacactgaaagtatgcatttggtcaaagagagtatgcatttttcatttggataaatattgccatattgtcctctgaagttatgaaaaagaaaatattttcataattgcttccagtactttaatggtttgagttttttttttaatatttccatttagatccatttacatttttatcctggcttaatggatatttaataagaaaaacaaattatttaaaatattaaattcctcactcatagtgaaattcaagtgctgctcatccccatctgttagatcacaggatctggatgcaaataagggtatcttgcagaggttcagcttacgccgtgggtgagtaacatagccagacctctgctcgcctgtgtgctgttttatcggcttccagagtctcatggtagtcaagaggcaagcctgagagcttgatttccaccttcaaatgaatttttcacttcaatagacctcaaggtcgctgtttggatttttcttctgaaatattgtaagttgctttcatcatttaaataagaagtggcctctcctgcagtacttgggtatgtgtatgggctgcatgaatttgtata

SEQ ID NO: 32714 - DNA, 3437 bp, Bovine  19866881070971
aactaagatctcgcagggcaacaaaaatacataaataaaaataaagatatccaaatgccaacagtaaagataaattcagtaagttatggcatttttacagtgaacaaatgatcactgtaatagaagccataagatgaaaaggtacattgcatttcagagcttccccaggaggagaagggccacatatctgaatcactataggaaatttttttaagagtcacccctccagtccccaaaacttcctctttcctggcccaaattctgatactgtgtcctggagatagtgagtgtgatcttgggcaagtccgttgtgaattaaaaagagatcaggggatacaaaataactttgcagagtaatatgcaaatataagaaagtatctttttttttttttttttcaaattatagtgtttatgaaaaagaaaaatacgataaagctttgctctgaagaggtttcctctctattaaaatgtagcattaaccttatggcagtctctgtgccacatatttgacctgtgtcctttcactgggcttccctggtggctcagtgataaagaatccgcctgccaatgtgggagatgggggttcgatccctgggttgggaagatgcccagtagtaggaaatggcaacccactccagtattcttgcctggagaatctcatggagccaggcacattgcaaagagtcaaacacaacttagggaccaatcaacaacatcgtttcactgtttcactgcttcctgagctaaacacttgcatccttcagatttacagggaaagactttcttctggttaatatctcccaggatgcaggcagcagctcagaaacacatgtagcttctgcatggacggaagaaaacatttcaagtgcaggcacttagttgtcccttgatgaatttcagaattaaacctttgtctttgctttagttataaaatctcagtggtgggtgctaactccaggtgtgacatgtgtgtattgacgccccataatttatgtatgcaccgtaattcatttaacccatcctctgttttcctgtgagtccaaacgcccccaggctgccaagggactcctccaggcctgggttgttatctgcagctgtaaattatcttccacaaacacaaaggcctctttggtaatgcagcccagatgtaagcatttgaaaagcttgatagtgagcaagcaggcatttaaaaatcagaagtggggaggttagggaggggattgggcgtgacctcattggaaaagctcccatcgcctcagaggaggaggtggctctggctggtaccacccagctccagcagagccagggtcttgggtctttccccctctgctttgcatttatcatactgcctcttgctcttttttttttcttttctttctttctgtctggtcttcccgctcttcttccccctctttttctcctctttccaaaccaccattgtgaggttcaggaactgtaagtgacttctcagaggtaccagtaagtattgtgtgtgacacttggagctgagaattggctgtgtgtggagagttctggtaggagatgtggagaaacactgctacctttcagtcaaagttgctgcaaacagagtctttgaaagacttttttcaagtcttttatcaccccctggcctgtttctggaacatgtagaaagagtttaactcaaggaggtatcatgactacaactcatggatccacatcattccagttgtttgcttgcttgttttttaaaggaagacaaacatttggaatacagcacaacaggtaaagattctggtgaagaaagatttattgatagagaaagatgctcccaacatattctggggaataaaagcagaccacaggattgcacttaagtaaaagatgtgattaggaaaaaaattaaaatattaacagtaattaatctctgggtagagtgatttcctcaagggaatcaaccctgaaaattcattgtaagaactgatactgaagccgaaaaccccagtactttggccacctgattggaagagctgactcattggaaaagaccctgatgctgggaaagattgagcataaaagaaggaagggggcagcagaggatgagagggttggataagatcaccaactcaatggagttgggcaaactccaggagatagtgaaggacagggaaacctggaatgctgcagcccatggggtcacaaagagtcggacgcaacttagagactgaacaacagagagtggttatgggaatgattttttgcttgtctatttatatattcctacgataaacacataaagcaatttttaaaaaatgcaagtgtgacgtgtaataaaaggaagaaaagtaaagtgtttgtggctggatagccatgagttattttagagctatcaaagagtaggtgatttacagtaaggagaggacaggaaagttcatctcttcccagaggaatgtgattaaaaagcacagagaaataaaggattccttctgccttgggcccaacagaggtatttgaggcagatgtgtgagtcagccagacctctttgcccaccaccacacgccaatctgaacgttatcccagaacctggggaaagcatgtgtcggttgccttaatattgactgtgacctcctggcctaacccatacttgaacttccaggcagttggtaagcagcctctgtctttgaggatccaccatcctcattcatatgagagttccagaaagacacaaaatcattcaaagcacaggctgaacctcaattctactgtcttacaggattacatttctgtgtgctccctggatcacatatcagacagcatttgtgggaatctgctcagtctcctctctaatctgtcctcagtgtgacatcgaaagggcagaggaaagcagtagtattatgaagggtgaaaaggctggagggtgcagaagttcagagctcggccatgaactcagggtttctggctagcattccgggggaccaggtaattcctcattgtagggagccaagctgttctatgggatgtttgcagcatccctggccagtagcattctcttaagtcaggaaaatacaaaaaaaaaaaaaagtctttggggatatatgtatatttatgggtgattcacgtttttgtgcggcaaaaactaacgcaacattgtaaagcatttctcctccaattaaaaaaaaataacaaaaacaaaaaagtcttcaacataaccagatgtacctcactcatcccttaaaaaccagtgctttcaccttgctcttgacttttaaccctaactgttctgtgtattacctttgtggcctttggcagcctctacgggctttgctcctcatctagaagacgtaataggaactgacagtaatacaggggggttgttggaggatgttaacatgtcatgaagaccctcactaaatgtaaactatttttagatataaaaataacaaagactgcctcaacca

SEQ ID NO: 32715 - DNA, 1764 bp, Bovine  19866881103410
ttaataaatctgcaatgcctggcattgtacttgatttatagtaaagtgcccaattgatgttgctgaatgaatgaagcaatgaatgaatgattccctttggggatgtgtaagccctctcactctctacaaactcctcacttcagagatttctgtggcacatgtctatcaaataccatttgctggaaattccacatggttttctgtccagatggtgcccatgacaaaggcaaggcattctggcacgcaggaaattcagggtgccagatgcctagtcaagtcactgtattattcatcatcaaatgttgttggccagggaactgagggctgtcagctgagccccgcggtgtccagtgaagagtctggtctctaaaattacagcagctaggaccctcattagggagagaggacgctgtggtaggaagatagaggttaaaaaagggagaagtttctcagtcttgttttggctttgcaaccttgggcaagtcacttcacctctctggttctctcagcttagtgtttttataaatgaaaacaaattgtcatcagtatttcccaaacctggttgtgtcctcagaatcttcgggaaagctttttaaaatacagattcctctagactagccattagcaaacttggtcgatgaagggccagagagcaaatatttcaggctttgtaggttgtatgatgtgtgttccagctgccatgcttgagtctcccactgtgtcatcaaagcagcgacggaagatgatgcgtccaccaacgaacgtggcaggatttggccagctttcctggtggccgtggtttgctgaccaccccccaatcgcaccccctgctaggccaggcatggggctctgctgggtaatgaccggttttcttatttacaaaagctcctccagatgacagggagaggcagctgcccttgggatccaccagattagatgctggaaggcttcttcccgcccttactggagttctcattctctggttcttattttcactgtaagaagtggctactctgagtcagcactatttagatagagatcttaatattctttcaaatgcatcccatttgggtattagctttcaacatctgaagtttttattttctcaaaattcaattctctgttccacgctttcaacatctcaagtttttattctctcaaaattcaatactctgttccaccaggaaaggtttgaacggtccttttcattgcatttagaccaaaaagcacttctgtgtgtgacacctttatccattcttcataggtgacaacttcactgctaacttgcagatgcaaagttgaatattatcctgtttaggcactaaagggatacagtgaatctcaactttaagaaaggataatagaaaaaatatgaaattatgaaacaggtatgggtgttgatactgtttcctttgtatggagagttccctttctactgaagtcatgactgctgggtgataagacatcctgagccctagagacactcctgtttttcacttatgttcactgagcaattgccatagttccctctttcactttcaaaagtgtccaatttggatgagaaattacatagccattcttatgggtgacctggagggaagatagtcaaaacgatgctccattgattttgcactttctaaaaggcaggcactgctctgagggttttattgatattatcccaactaatcattatagtattttgccgatggcttgtgtcttttgttgttgcttcagttgctaagtcatgtctgactcttctgcacc

SEQ ID NO: 32716 - DNA, 1170 bp, Bovine  19866881150254
cgccaatgacatctcccgggggcctgctggaaatccagaatctcagacccccaccccagatatactgaatcagaatctgattcccaactgagtcttgtgcacagagttggacaaacattgctctaatccagcatttcccagacttcagtcattcacatcttcccttttatagcttttgccattttccagtactacccaccctatgtttcacctaatatatatttttaagtgattttacattgacactgtcttgctagcctcaccctaagcaataatattgtctgttaataatttattaggcgaggcaagacgaaatttattatttaataaagtttgaagttctgagtgtaaaaacaaattattttggcacacattaaaataatcactgaagtaaaatggttctccatctatcacctaaaatttactcatatacccccaggagtttatgtaccctggtaagacagtactagacattttgtagctgaattagaagacatcttcccaactccagatccagtatttccagttcatacctgctctcaccttgctgggtggatgcatttgtcctcaatttaccaatggttgtggaaggcagaaaaccttggttctggcctgcaccacccttaaataacttgccaagtcacatcacatattggggtcatttttgaaggctggcctatctcaaaactcccttccaagtctaacaatataacataataaatgagagcagaggctctgaaatcaaaatgactgggggttgcaagtaatggcttcattacttgctaatgtcattaaatctcggttttcctcatctggaaaatgggagtaataacaacaacaaatggccataacattcagatcacaggacttgtaaaaataaagaaaatgatagctaaaaaaattcttagacttaaatgcggcacatagtgttcaattaaaaaaacataactattactatttttcctagcttcatcaaagcacaaataatagttaacatttattaaatatttagtatgtagcaggcaccacatgaaacaattttattttatcctctatccacacaatgaggtaggaactctgattctccctacattagagatgaagaaattaaagcacaaaaaacgttaagccactttcctttatattttaccaggtaaacatgcatcctct

SEQ ID NO: 32717 - DNA, 906 bp, Bovine  19866881268537
catcaaatgaggctaattacaccaagcaaaactcttccccgcagcatatggatgaagtgcaccatggaagcagctgggagagatgtaccccctttccaaactcactcagcaagatggaagtgagctgaggcagcgtcccttcctgaagtttctaaatctgcatgatcatcaaaagcatttggtcaccagaatagtaatacgaatctgaaagcttacaagcaacaattcagatcattttctcaggatagcttcctatttacatgtaaatgattttctattttctttataaacgtgctcagttctgtccaactctttgcagcaaccccacgaggctcctctgtccatgggatttcccaggcaagaatactggagtgggttgccatttccttctctagacaatcttccctacctggtgactgaacccacatctccattggcaagcagattctttttcactaagaaacctgggaatcctatcacaattccacctaaaagcctctgagttgctttctgcatgagcaacaagattttttaaaccatttttgtttattgccattaatatattggtttctgttatgaaagtggtttttataaaatgtattacatttcacagttgccgttgtttttcttcaggtgtttctgtggttatccgtgaaatatgaaactggcaatatttaacgtgtattgagggtttgctctgagccatgcaccatcctacttaatttatatatttacatcaatatctatctgtatcctcatttaattctctcattaataacatatggtgaatattactctcagatatcttttatatgatgaggaattagaggtcagtaagttgccaaacatcacacagttactaaggagtgggagctgtggtttgaatccagcagactgattcaagat

SEQ ID NO: 32718 - DNA, 1250 bp, Bovine  19866881274793
tgtagtaggatagcctggctggggagatatttggggggcatggttcccttccccccactgccttcagtcacacctttgccagcagccagccagcctgcattaagaacctggataaataccttgaacctgcaaagtgagctccacaagtggtttaatatccattttaacatcctccacagaggaaaatacctgagtactgttttctttcaattttgttaatctctagtggttttctgaagcccagagagggtttccgtagggctttctgattttcagggttttaacagaagaacaggtgagtttgagctcttgggtcttaaagggacagccaaggaatcccagagcacttgaatgggagccagcagcaccttggtcctcctgttttcagctcagccagttattaattctctctgaatgcagcggcacacacacagatgaggaaggttgattaacggcttcctgcttgctcgctcatctggtcccagacactttgaaaatgcagtgggaagagggtgggggaaactaggggtgttcactgggcagaaaaaaagaaaaacccagtgtagtgttggatgtcccattttgcactggtgctgctgttttgcatttaattagtggccagtccttaagccaggcatgtaacattttggttgtgtccttgagctgctacagtcttttaatcacaggccccctgccccacttcttttgatgtactattctacaggcaaataaaagacccagatttgattccacgggactggtaaaagtagaagcgggggggtggtttgggtttgtaggtctttcctgatgtttcatgattaaaggggccctggcaggtgaagagaaagaaattggcttgtgtaacccttaaggagagggtttccctttaatgtctcaagaagtggaaaacagacgatggggaaaataatagaatgggataatggaataaaggtgcaggaaatattctgtgagcctggaccaaaagaatgaaggagaaggatcagtgattcacccaaacgtagcggatgaaacattgatccaggggagcttacaggaggggactgaggcctccgaggtgaggtgcagagaattaaaatgatttcacggcgcttgggctgatgagttgggtgctagagccctccgtgtgggtaaggtagccctgtctgctgacacacacatcccaacatacagacaccctctccaggaaggtttgcggcattttatttttctgtttcagcttgttagatgta

SEQ ID NO: 32719 - DNA, 1080 bp, Bovine  19866881548785
gtcgcacagagctggatacgactgaagtgacttagtacacccatatccacggtgcatatatgtcagtatcaatttcccagttcatcccactacctgcttgccccccttggtactcataaatttgttctctacatctgtgtctctatttctggtttgcaaataagagcatctgtatcattgttctagattccgcatatgtgcgtgaatatatgatatttgtttttctcttgctgacttaactggcttgtgtttttcatgctaagaaaatgcagtatatacagcttcagtgtttctgtttatgatcgatggccttttttctgcagcagtcctgtaatagtttgccttcttatttttattattctcgctgcatactaatacttgaaacattttagtaaatcatggttctctggttcctacttcagactcatttaactaatttaatgagctctgtctaattatcgcatttcacctttcatacaagagtgcagcaatgctttcactgaaatagctggtaatagctccaacactcagaaagggaagaaaatgaggatgtataattcaggactcacaagagttcagatagaattcttacagatatatgtatatagatattctatgtataccttcattaattgatccattcatacattctttatgtatgctccaggcatcacaaaagacatcacatgagcttaaacagctctttcttaggcccgtgtcccttttaggggagaataaaacacgatggttaataactcttgagctagactgtgtatacttgcctcctggccgcaccatttcttagccatgtggccttgggcaagtcagttagccagcttatgactcaatttccccatcagtaaaatgggcattattatatatgggattccctcatagctcagttggtaaagaatccgcctgcaatgcaggagaccccaggtcaattcctggatcagggaagatctgctggagaagggataggcaacctactccaatattcttgggcttgccttgtggctcagctggtaaagaatccgcctgcaatgcgggagaccgggggtttgatccctgggttgggga

SEQ ID NO: 32720 - DNA, 1247 bp, Bovine  19866881586125
tgggatttttaaaaattgacactctctggtctttgatgtaaaccgtgttttattgatcagctgttatcaacttcatgtaaaaagcatgtgatcatgagggacaatgaaaaatgaagactattttatttatgtgtatgtgtatatgtatacgcatatttatagtctctaagtacataggaaatataatttgaaattatactaactccctttaaacctttcttatcttatctttgtacaagtgcatcctaacataaacatgatctgtatgtttcttggtttctctaatattgaaatgaaagtttttgcaaccatattttctatgtattctagaaagcagttgtttaaaatgcaaatttacccacgttccttcaatcctctttcgtctatttgccttgatttcccttgttatctaaagaatttttcagttcaggcattcctatactttgaaatcatgtccttgttacttgttattaatgctctgtttatcataccaaaaaaggaatcccaaccttggatttttgtttcattttgtagatgagcttcagataacgcagttgtagatctgccgcttctttaatgactaactgatgaattataggttttctgatttgaagtgtatttagaaaaagcaacaaaatgcaattaatctgatagtaataggaacagaagttaatattggcctgaagctagactgctcattgtaaacatctagcctgcataattgacagtcacagaggctcacttctggctcctaaaaacggtcctctcattactgcctgcacagcccagcttgaccccattcttctgcagagttctgcccagacatttccaagctcctgcgttggtcactgacacaacagcagctgtgcctctctctgagctttcatggctctctcattgctctggcctggtgagcccctgaaggggagtggcagagggcacacctgggttcatgaccttaactcaaggctcccagctttgaacttgggtaagactttgaccccagggaccacccttgaggcatgcttaccttgagaggtggctgtaaggatgagcagatattgtctacttattataggagctccgaagagctctgacaccccccacagggagggaagatgccctgcagtattcactgttttttttttggatggggcggcacttcccacccacagctcccagccttgagttgggatgttgttaccagtcacagggtacctcttccctgttctctctgctcctttcca

SEQ ID NO: 32721 - DNA, 1887 bp, Bovine  19866880453695
ccaaagcctttgactgtgtggatcacaattaactgtggaaaattctgaaagagatgggaataccagaccacctgacctgcctcttgagaaatctgtatacaggttaggaagcaatagttagaactggacatggaacaacagactggttccaaataggaaaaggagtacgtcgaaggctgtatattgttaccctgcttatttaacttatatgcagagtacatcatgagaaatgctggactggatgaagcacaagctggaatcaagattgccaagagaaacatcaaataacctcagatatgcagatgacaccacccttgtggcagaaagtgaagaagaactaaagaacctcttgatgaaagtgaaagaggagggtgaaaaagttggcttaaagctcaacattcagaaaacgaagatcacggcatccggtcccatcactttatggcaaatagatggggaaacagtggctgactttgtttttctgggccccaaaatcactgcagatggtgattgcagccatgaagttaaaagacgtttactccttggaaggaaagttatgaccaacctagacagcatattaaaaagcagagacattactttgtcaacaaaggtccatctagtcaaggctatggtttttccagtggtcatgtatggatgtgcaagttggactataatgaaaccagagagccgaagaattgatgcttttgaactgtggtgttagagaagactcttgagagtcccttggactgcaaggacatccaaccagtccatcctaaaggagatcagtcttgggtgttcattggaaggactgacttggaagctgaaactccaatactttggccacctgatgcgaagagctgactcattggaaaaaaccctgatgctgggaaaaattgagggcaggaggagaaggggacgacagagaatgagatggttggatggcatcactgattcaatggacatgggcttaggtggactctgggagttggtgatggacagggaggcctagtgtgctgtggttcatggggtctcaaagagttggacacgactgagtgactgaactgaactgaactgaactgaacccccaataagaaaaaaaaaagaaacgatggttctcctctgccttgggaaatggatgtaccagcttcacaaagacctcccaatactgtgagccagtatggaagggggccctgcttataaatggtttcattagggtgagacgttcaatctctccatgcttagccatttcatcctaaaaatgagatcaaaggagcagataccttatggtgctgttgtgaaaagcaaaggaattgatgcacggtgagtggttttaacagtatgtggcaaatggcaggcactcagaacacatcaggcactactttcagtctctccctctaggttctttcatggggaagggccacccctggttcgttgcatctccagggctggatacagtatatggcttacaaagcaggtgctcaaagcaggcagaaaggaatgaggaaggcaggaaggagggagggagggagggagggaggggatattcacagacccagagtttagagctttcatagaattgtcggctttgccctcctcccagaccatgccttctgcccacgaggtagcaggagtgaccaaggtgacttttgcccgggctctctgcccctcgctggctccatctcagagggagtgctctggagaccaggacactggactcaaggtgaggaggcagattgggtggcgtttggctcagaaatagctgcctgccgttttccggatgattcatccaccacagctggcctcctgccggatccctctgctcttcctcccctgcaaggtgggaaccaggagactgacctacatcagatccccatcaataccccgggcgga

SEQ ID NO: 32722 - DNA, 1199 bp, Bovine  19866880454931
cctcgcctctaactgtaaggatggttgggtcttgtgagcatgagaccttgccccaggggttaacatattgtcatctcaaaggaaactggaattttgtgagcaagggaggagaaagtatgaatattgggttaataactgatggtgtctgacactgagctccacggggaatttgagttttctagatgttgcccttcacacaaacctattaccaagactgtgttggcaattttctccttggagattctctgaagggttttcatgggagacatcacaaagcaagaatcaggactctatcaagcagcttgctcccattctttgatcctcagaggttcactgaagacgccaactgaaatctcgctctgcgattgctattttctttctttctgtagccgtcttccactttgcagctctgacactaaatggaaaagatggcaaaagcacactgcgttgacaatagcaccatcttctgtccagagaaatgtcagcttcttgacagatcagagttttgggtcgtgcccgtcattccagagcagacacgcatgtaagacactgcacttaagaagaagtcttttgagtggggtcttgagccctgtgcaccaatctttttaaaggtatttattttattgaagtatagttcatttacaatgttgtactgatttctgctggacagcaaagtgactcagctatacacatgtacattctttttcatattcttctccattataatttatcacagaatattgaatatagctccctgtgctatacagtaggaccttgtcatttatcctgtctgtaataacagttcgcatctgctaacttcaaactctcaagccatccctccgctacccctccaaccttggccaccacacatctgttctcgatgtctgtgagtctgtttctctatcacagatgcatccatttgcgttctattttagattcagcatataagtggtatcatatgatatttggctttctatttctgaatcacttagtataataatctctgggtcccatccatgttgctgtaaatggcattatttcattctttttatagttgagtggtaatccattgcatacatggaatcatggtagatcatggcatccagtcctatcacttcatggcaaatagatggggaaaatgtggaaacagtgtcacatttcattttcttgggctccaaaatcaatgtaggtggtgactg

SEQ ID NO: 32723 - DNA, 797 bp, Bovine  19866880510049
ctccggatatgcccaatcccaagatcccaagctatcagcagaaaggcaggatacaaagctgaagcccagacacactcactcactgactctccactgctgcctcagctccaaccctccactagggaaagacgccagctgctggcggaaagtgacatgtcaaaacttcttaagccaagaagggccctgagtcctcaaacctactcctttcttctcatgtatatagacagatagacatccagaagggggagaaaccggctgaagtcagtggtcccagaactgggccccaaacccgcagctttggcactaggtccagtgccctttaacccacatgattacaatcccctacactctgcaaggatcacctaaaaacaaatcaacaagcactaagactcagctcagttctgccaaaactagtagacagctttaggggttaggaaaacttacaaaataaactagtgtgtgtctggagcccccgcaaccactcctagtttcggtgattcaccgggactcagcatacaggtgtacatacggccatgattcacacagcacaaaaatgcaaagcaaaacccatcaacgggaagaggcgcgtgacgcgaagtccagaggaaaccaggcgcaagcttccaggagccctctccaggaaagtcgcacaggatggtctttattcttctggcatgaaactgtgacaacatgtatgaagtggtattctaccaggaaacccactggagactcaagatttttcctgggggctggtcacacggcactctctgcctagcccataccactcttaatagtta

SEQ ID NO: 32724 - DNA, 1216 bp, Bovine  19866880513172
tccttaaacagctgtcacactgtcccagttgtttatcaagaaggaggtccccagggcttcatcgaggcagacttgaactcaacccctgcagtgttgatctgttccctttcatgtccccctgggcgaggggtgccacagcctgggtgcccatgggtagatcctggcagcctctcagcttctgcagctcatcacctgttgatttctacccagaatatgcgtttggacatgtcaagatttcagcggctcctacaaaggcaaactcctctggaggaacctgagatttcttctgcacagaccagcctcacaccctgtggggcagtctgtcagcaaagcgtttacactgggcacggaagtaacgcattagatagggtaggtgagggaagccttcattcagcacttgatcttgaactttgtatttgccaagggcttttaagtcatttccgttagctgttactcttgaacgtccttaggaggtgggtagaaactggtgtcctccttttgagaaaaaggacatgaggagggacgtgtcccccagggacacatccatggagtgaaaagggtcagagaccttgctggggaggcgttccgctccacctccatccactctcagccccctctgcatacagtaagccaacagggaggatgtttctggagcctggctttcatccaggaatcgtcctgcatgttagcctgctagaagccaggttgaggtctttgtcacagtcatgtggcaggtgagggggagcctcagaggggtatgtgctgtgcagtaaatcacagaaggatgaacaactgctgggcgcacagaaagctggcgctcactccccagccactcccgagccagctttgaagcaagatgtatttttaaacacaagccacgtacagaaaatgttcccttgcgtgtccccatagcctactaatggggcaacagttggcaaccaacaccaccagcccgtgctcagggctgtgttctcaatttttctttctattcttgtcccctggcatacgataggggttgctgtcccgggagactacaggcgactgacgaaaaaggttgcagtcgactcttgcctgctctcaattttaagactcggatttcgttcagacactgggcctgtgagtctgtgtctgtttaccaagtgggaactattatttttttaattcttccagcagattccatgaaactgcccaatgtttcccagaaggctgttgtccc

SEQ ID NO: 32725 - DNA, 1371 bp, Bovine  19866880579885
cccgctgaaggatactgtctggaggtgagcagagaagagcgtgtgtgaattttctcccttgtatgatgaggttaaccgtccctgcagccgtccttacataataaccgtccctgcagcaccgccttcacgtcgtaaagctctcagtgtactttgtcaccgtgtgcagatggcttgctcgcgctccgctcttgagcagtgaaaattggctagtcattttcactttctgtttctcaggcagtgtctggcttgtaaacactggaagggggaatatttaactctgaacagaaatctgttctgacattaaaaggaaatgagtgaaaacatttgtgcaggtgagatttgttgtatgaagcccattgttatgaaagatcaaaaagatctactcttttaagtgcgtattttaggttctggatgattgaaattgtatagcaaatgatctatcacctcactgatcataatagataatgtgcttacgtaattttaagaaccataaacttatttattacagttagcatgtgaaattaacaatatagagattattaaaatgtatgtaaatgattactactttcttcctttttcaactgtaattatcatgttttgcctttgatttttaactgtgtgacctaaatttaaatacacacacacacacacacacacaacctgggacctttcctctaaggaacttggaagtatcagtaacttaagctactgtgcataagagtcgttgttgctgttgggttatttttgtgtgtggattactaataagctggccttttaaaaaagaaatatagagatttgtttattgtgagatattcatcatagaacattattgtgtggtttctgttgcttaattgcaaaaattatttaggagttttcaaatattttaacatgctctgttctatgtcctttagcacccagaatgctttgtttgacatctttctgaaggactcttaataactctgtagtgctaagtcagccttttctattcacttctccagcaggagtaagtcccttgcttcccctcttccttcatcctgactttgactgcctcaccctcatatatttaatatattttattgtccattaattatatgaatcataaccgtgtacgtgtaaataaaatagtggctcatgagaactcttgtctgtttatgcatttggagctatacttagtagctgcttaataaacacttagctgcatccaagccagttaaagtttgcatgaatattgttaacaaagaaaccgtattcactctaaaagcttttatgaagacttgcacaatgttagaagtttgttatttcatttttaaattgcctgttgtgcttctgcttcttacgcgccttgtcacctttgaggatttctggatctca

SEQ ID NO: 32726 - DNA, 880 bp, Bovine  19866880588295
tgctctgagtgataacagagaatccccaaagtgacactgcccgtggctgggcctctggcattgatattttgtttgtcttttcatctctaggtctggcacacaattcagacttcagcataagcagcttgtaatattttggactattttcatatgtgttatttctgtctctccatctagattttaaattctaaatctgctatgtcttagcacaggattaaaacattggttcactcacagaaataactctctaatgtacatgaagtcagaaaggaaaacagactcataagttgcctcatcctatagttgagaaatctgagttcagaaaaccatgaacacttaagacagtgaatcatttattcatccaagaacaaatatttagtcaatgtctaatccagttattgtagtagaaatataaagatgattcagtcatggaccttgttctctaggaacttcatgtctgatgtgtgaaggagataagatatgaatgaacatcagtaactattctatgtgaaaggaagctgtaagcactactaaggtgctaaatggactgtaaccaggtgctaaaaatgaatagagttgatccagcaatcccattgctaggcatatatccgaacaaaactctaattcataaagatatatgcatctgtgtgttcatagcagcactattcacaataccaagacatggaagaagcctgtatacccactggcagatggatacagaagatgtgcacatatatacaatggaatactatgcagccataaaatagaatgaaacaatgcaattgtaacaatgtggataggcctaaagattattaagtgaaataagccagacaagacgaatatcatatgatggtcacctgtaaacgggatatgaaatatg

SEQ ID NO: 32727 - DNA, 2725 bp, Bovine  19866880604569
aactgagatccatgtgctgtaaccagagaagcctgagcaccacaaccaagacccagtgcagccagaaaaaaaaaaagaagaagaagaagaaatagcctgcttggccctcatgcagtcccaccggtgcttctgaagcttcctaagccaagtgggaagggttctgacacactccaggtacttactgagtcgtggtttgtgctcagccctgggaaggatcctcagggcatgtgagaaggttagatactggctcctgaccccaaggcatatataggccagatgaaaagcaagaaacgagaaacattatggaccatcagcaggaagaataattaaacaccaggcagggtgacctccatcgtgagcgtgatgagagatggtgaaggaacaagagagatgcttccacaggagagttttaaatgaggaaaagccctcctttcctgctgctaagctgggtacaaccctgtccactgacctttccacaggcctctgtccttttcttagagggttctccaaacacagcctcaccaactctcatcagcatgaggacttctttccatttggggcctgtacctgtcagtttacccttgtctaagctgaattttatatcctcagctagacctcatcgggccctcactgtgtttagatctgggtttcagatctcctcctactttgcagcttcgcctaaaaccacccagctcctccacttaatacagcccagagcataaagatattccaatatatgcttgactagtggagatttgcacgtgaggctttagttacaagcaaccctatttccgcacgagctgatcgtctattatggagtcctttgaatgcacttgtttgtagctggtagagagttccttggcctactatttctggggttgttgctccagagcaaagcagtgcctttgtgtgtatctattacaagacactgggcttcccaggcagcactagtggtaaagaacccacctgccaatgcaggcgacttaagagactcaggtttgatccctgggttgggaagatcccctggaggagggcatggcaacccactccagtattcttgcctggagaatcccatggacagaggagcctggtgggctacagtccacagggtcacaaagagtcagacatgaccgaggcgactcagcacacccacacgcattacaaagacattaaccacacacatggcccatcttctcccttacatggcggcgcagccaggggtgattggaaaacgacattttaaaccccaaagcaaattacagcaaggaatcggtgtgaaattactatcctctcctcggagttcctttttaaaagtcaggcagcgggagcccaggataaaagttggcctgtcagacaagcccattcaagcttgcaattccgctgtcatttgcccgatgggcttgtgataaagagcaaggataaaaaatctgccaaaaatagtgccaccgagaaaccaacacccaggccaactcaggagccagcgctgtgccagctctgccctccccaggaagacagtggctctgaggatctgttctgacagagatgtcgtgtgacctccaatttcagcaccaaggagaggaagggccgaaaagagctccagctgtgaatccctgaagaaaggggagggggaacaaagtttacattgaaaatcttggctttccaaacagcatgttgagacagccccacagcagacaggtttgctgcaggcctggaacttgcctggggtggccgcagcctggagattcacctagaaagattgtaacactgagcttccctctctttgtacttttgctgggccttcgctccctggagtggtaccctaggggcctgagagaaagagatacccctcttagtagcctcgagcaatgggagcccaggcaaatggaccaacgggtgaactttggaaaagcccacagccacgtggcagcaggcgctctggatatcccaggccgaacagaacctgctcagcccaggctctgtcaccagatttcggggggggaggtggcaggctaatttcaggctatttgcccctgctatgagggggtaagacagaaggacacccacgcctgccaaatgacaacgctcatagaggtaagaggtcacacccatggacagaatcagatgttactgtttcagctcatgtttattgtgcctctgggagtgaggtgcctccttggaactccccaagtgccctgacaggcaggtctcagtcccagtttacaggtgggtccactgcatctcagaaaagctcactaacacgccccagttcattcacactgttgtgaaatgggtaagccaggagtcagatgccagtctttgggacccaggtccagtggtttccatcagaggcatccaccaagcctgcttcagaggaggcagctcccacagaagcggggaccattgtggggtctgtcttcacctgcagggtgtagcatctccaaaccctttgtctgcatcttcttgtcttcatgtctgtcacccacttgccatatggaaccaccggccagattttaaagtagccacaaatatctggcaacatataacctgacttgtgtttggttgataaagaccctcaaaggaaataaacacaggaactgcgaggagtccagggtggtaatcttttcccagaaaggacccctccaggggccagggtgtcagggcaatgtattgtctaataggccgcaaagaacaacaatcatcatggcggttatcaggaaatcaccta

SEQ ID NO: 32728 - DNA, 2176 bp, Bovine  19866880677481
ctgcagtgcaggaggacctgagttcaatgccctgggtcaagaagatcccttggaggagggaatggcaatacacttcagtattgttgtctggagaattccatggacagaggagcctggcaggatacaacccatggggttgcaaagggttggacacaactgagcaaccaacactttctgtgttgagaaccgcaggatcaatggccatatttctgacagaggcataactttgagtcaaggtttgggcaacgttaagaagccctgccctgtgcaggacctgtgcctgggctctggcgatgcatgaatgcatccaacacaggcaccttcgtactgtaatgaagattcagatagataaaagatattcctataccaggtgggaatgctctgaggcacgcacggggagcacggttcagggactctgtgatctgggagagctgtgaaaagtttcctgcaaaggtgggagcctgagtagagcagatgatgtggggtatggggagtgggacatttcagcaggaaggacagtgtgcagatgtgaagcagcttgagttgccaggggcctagaatgtcaactccaggagatctgggtgtctgggtcttctcagctctttcctgagagccttgacctgagctggacaccatctggtacataataaatattagcagaatgaacaaatgaacatatgatttttatcttctcaggggtgtggggctaccgagagatgaggctgggagagcagcaggaatgccatcacagatggaactctgaaccatgttcatcagattttatccataaggcagtcattctcagtaagttcaaaaatgaggacccacattgagtgagggggaaaaagtcttctcagacactcccatagtcgcagcagtacttttagtaccatagatggagaaaatgcatacagactttaaaaaaaaacacaaattttgcgatctttacaatgaattctgtgatcactgtagaaacatacaagtaatgtatttctccttaacattgaagggtatgaaatgtgtgaatcatgaccgtttgagctctttctagcaaacatagagggggaaagtctttctcagtccattgtctggctgagaactttgaagaactccagatctcatgtggtctggtctgtgctggtcccatctcccgaaggtctacagagatgtgtgtccctcctgatcatcttctaccctccttgcaaatcttgccaaggaaccccaagatcaggggggttttgagggtccagtcttcccagaattcacttcaccatggcctaccagggcttcacaggtggcgctagtggtaaagaacctgcctgtcactgcaggagacataagagatgcagggctcaatccctgggttgggaagatccctggaggagggcatgtcaactcattccagtattcttgcctagagaatctcaaggacagaggagcctgggctatggtgtatagaatcacaaaaagtcagacatgattgaagcaacttaggatacacgcacacatcctcatctccacccaatgagataggtactgttactttctcagtcttacagaaaagaggagagagatcagggaaataggtggcaaattttaatgaaaaactagatggaggaaggaggaagtggatggtttaggatgattcacagattctgctttagtctatgaggaaatattaagggagctggggacgcaggggaagagcttaaagccgtattagtaactttatggtctttaaccttccatatttattcttactgttcatattcctcttgtactacatttcctacaacaacttctaaatcattcatcagtaattaaccaaactactaactatcgattaaatcagactcagccaaagagataaaactttgacactgacggtgaaaaatggattctctttacactcttttccaagtccttcaccatgaccctgattcattagaggcagtctttaaatcagccttggaaacgcaaggagaaaaatcttatgaaattgggcatgtgctttacgcaggcctagggtcctggggtgtgctgcatcctggctccggggaccagctcccgagacagcttttgtggtcacgaagtttccaggccagcagcagtctctctctcatcctttgtcaggtgctgctctcaccccgcagctgacctgaggcccgtggtatga

SEQ ID NO: 32729 - DNA, 1475 bp, Bovine  19866880711220
aatccttcccctccccctcctcagattatccagttatcagtgtccctgcaattctctgtcctcagttctgaaccagaatttaccacctccttcaaagaatgaagtttcattgctcctatttgcacttccagggacaccgagcaggatcagaggaggtatttgttgagtaaatgaagtcatcttgtccaccatcctgtgcttgagttccaccaagagttgtattttctattttggttttatatgtaccacatgctggggctttcttgcctccccttagaagacataccacacaagctaataaatattctttgctaactgccttccatcactggagcctgtctgccatccacacagagacagccacagtagggggaccaccttatcctgtgcatccaaggcaaaacaaaatgattcaacacttccaaaactagcacacaagatgcaaatggtttcaaaaaatagaccccaagccaaattgaacacaaataccaagggaagagaagcagacagacagaaagagctacatgagagtctaggcatacccagggcaggtttaattagctctgccctgcagactttctctgacacacacacaggtatcccatacaaaaaggcaactggaggtcttctagtatcactggaactctgcagatgcttccggatacttccaaaaacatctagataccccacacatgtactctttttgagagcagcaacaaggttcaccaaaggtgtgagacagtctgtggctggaggattgccagacatttattaagcacctactgtgtgccaggcatgtgccagccaggtactgtcacctacctacctactgacctgaatgcattcatttcccaaagtcccctgaggtagattgttagttctgttccacagtcgaggaaactgaggctcagtgtttatgatttatacactgcaaggggggagtctaatcccctgagctgcccaattcttagtttaatatacttcccattagccacagacatgtatgtgcaaatgttaagaaagcaaacctgggctctgctaggcgatccatgtgaagagtaggctcaaggctcacctggaggcagccctaagggacttgggggagggaatccccgttttcactccttggaggccaaccctaggcctggctggaggggggcctgggcctggcaagtcacctttgccctctgaagtacctctgaggtcacagtgcccagctctggaggcctctccattcatgcccagcctgcttctgcgtgcctcctgggaggtgtcctgcccaaagtgggctgggggctgttatggggaggtaccccataactaaagagcagggccgaccgatttgacttcatcagtgaagacagaggtacttcccatgaagaccccatgaacaagaagacacttccagcttccccaagggacacaaatatccaactcttcccctccccaacttacttatacctctgggcaagatc

SEQ ID NO: 32730 - DNA, 1409 bp, Bovine  19866880980163
tgatcttccgtgcggttttttgttaatgccggtccagtgcatcaaaggacgtgacttgagttataaattcctgtgctgtcagggacctgtaatactgcaatccttacattatttgcataaaaataattcacatctttagaaagggaaaaatcagtacagaaaaagacatcaaggtgatacccggatcgtaaacacacaatgtgtttgttcttgtaactgagcagttttggagtagtttggcactctctgaatcagttattatcacttttgttagccctctctacccaggttgatattgttttctgctttactgataaaggctttgattctcaaagaaggaagattgcagaggcagtggcagatgtctggggtgaagctggagcagaatctgacctggagaccccacagatgcccagatgggctggacggctggtcaggtcatgtccaccggcatcaggagggcactggggctctgatgtctctccaagtcaggggaaagaagtgcctagaggctccgctgcttccctgatggaatcctcctccagaaccagcttctccgcctcccccgcaaggctcctgcctgcctttggtagcccagacacagctctttctgacagaggggtgtccaccagcctcctccatgcacacactggcttcagatgttgtgtattcttcaaaggtggtggcaacaaaacctcccattctaggcactcctcctccagggacctcaccatcctccagttgagaggtggggtctatgttccctttgaaactgcatggggattcccctggtggcccagtgcttaagaatccacctgccaatgcaggggacgtgagttcgctctctggttcgggaagatcccacatgccgcagagcaactaagcccctgcaccacaagtactgaggaagatcccacatgccgcagagcaactaagcccctgcaccacaagtactgaggaagatcccacatgccgcagagcaactaagcccctgcaccacaagtactgaggaagatcccacatgccgcagagcaactaagcccctgcaccacaagtactgaggaagatcccacatgccgcagagcaactaagcccctgcaccacaagtactgaggaagatcccacatgccgcagagcaactaagcccctgcaccacaagtactgaggaagatcccacatgccgcagagcaactaagcccctgcaccacaagtactgaggaagatcccacatgccgcagagcaactaagcccctgcaccacaagtactgaggaagatcccacatgccgcagagcaactaagcccctgcaccacaagtactgaggaagatcccacatgccgcagagcaactaagcccctgcaccacaagtactgaggaagatcccacatgccgcagagcaactagcccctg

SEQ ID NO: 32731 - DNA, 1470 bp, Bovine  19866881029897
cttgtactgcttgctgcacgacaggccaataattgaaaggtcagttgctggagcaaggaataacaactttattcataaagctggcaaactgagaagattgtgagttcatgtcccaaagaaccatccagtctgggttagaattcaggctccttttgtactaaaaggggagagagtagagtcgaacacttcctggttcccgtcagtctccagagaggatgtgttaatttcttcctctctacagtcattcacaagtaggtctagtcaggttatttcctgtgagctaaacaaaggtattttagcttaatgcacattacttggggagcattatgtataatttaagcttgtaggcatcatccttttagtgataaacttgtaatagaatacagaagtttcttccctattatattattaatctaccaatttctaaccagccctatattcaatggaaggactgatgctgaagccaatactttggccactggatgtggagaaccaactcattggaaaagaccctgattctgggaaggatggagggcagaaaaaagaggggggcgacagaggatgagatggttggatggcatcactggctcaatggatatgagtttgaacaaactcggggagacagtgaaggacagggaagcctggcgtgctgcagtccatggggttgcaaagagttggacatgacttggcgactgaacaagaacaagcagccctataagtaatgtactgttattacccttagctcctggttctctgctcagagcagccatgaccatggttactaccacagcaaccctagtcctggaattagaactagtgtcatcattacaaaggctttcctttttgcgacacaatgacctagaaaaccgtgaagaacttgaggataataatagacttgcttttctccttcagggcatgggtttctggatcccactgtcagtccctgctttctggggattctggcagggtagttgccacttactcaataagaggactgaaaatccacaaaggtttccccatggaatgtcatcaaaagagctccagtattccactttggtaaagtagaggatgacaggaatacaggtgatgaacaggatgttaaacacacccagaatggagagaaataaggcggcttctccaaacttagcactgccgaggaggagcttgaacaggacctgccggagagagcagaggagcgggggtgacagtctgccttgggctccaacgtgccagggagaagcgagtgcccttggtaagctggggctggaccacggggccaacggccacgtgacggtaaattccacctcacgtggccttcagtgaagggcagcagggttcctccatgctcagtaatgtggcgatggagagttactcctcgggtacacagagagcattttcaggaatcatgggttttcacaccacgcttattcctccgtgctgtatccatacaccacatcgcagcctcaggca

SEQ ID NO: 32732 - DNA, 856 bp, Bovine  19866881293903
caaaattgcctaatcaatggactagaaatatagtcactgtgaatataaattctttcctcttctaatgatcccaggctaatcgttgcagttcttctggctcgttttcctgattaaaccaggagaataaagacaacaggaacatgtgactcctgcattagcaagctaagccatgaagcatgagaagaaaccagtgagtgaaagggggatagtgagtctagtataatccattctgcggcacacaccttacctaatatttgctatattgatagccgccctccaaccgccaaagtgttactcttaaatattgggggaaaaggggtggggatttagagttagcagatctaaatttaagtagaggcttctctcagtaactatatacaataagtcccctgcatatgaatgaattccattccaagagtgtgttcataaatccactttgtttgcaagtcaacaaagttagcctaggtacccaactaacacaattagtatagtactgtactgtaataggtttataatacttttcacacaaataatatataaaaaaaccaacaccaaaagtaaagaaaacatttttaatctgacagcacagtacctggaaaagtatagtagcacagtacagcagctggcgtacagaggctggctctcacattagcatctttggaattttgcaacttgaaggtcctggtggctcagtctgtaaagaatccacctgcaatgcaggagacttgagttcgatccctgggtcaggaagatcccctggaggagggcatggcaacccactccagtattcttgcctggagaatcccatggacggagaagcctagggtctacagtccatggggcgcaaagagtcaga

SEQ ID NO: 32733 - DNA, 931 bp, Bovine  19866881329770
aagaaccatgttccagactttgacctggagctggtatttcaggatcgtgctgccaaacttggaaagtcaatcagcagactgattgtagtggcctcactcattgataagccaaccaatttaggaggtaaaatggcagttttccagggggcttgcttacggtcttttgatcctgaaaatctatactcaaacccagtgccatctggggcctcctgtccacattccaccttctccgggagcttcagaggaacgcccgggtcctggtgggcttggccctggactggcggcagcatccctgcttgtcccgtgcagggctgtgccggacctgtgaggtgttcggggccgcggcgctggtcatgggcagccttcagtgtgtcagagacaagcagtttcagcacctcagtgtttcagcagaacagtggcttcctttagtggaggtgggtggaaagtgcatgattattaaaattttcattcaccagactctttatagtactctgtcttcacctgtccatccttttgcagtagtccagcctgtcatattttaaaaataatactaaaaagtaaaatatagcccactctgttctcccattcttttttttatctctcacactattatatttttagaaatcatcaataatgtagactttttagtaaaatgtgtcctgttgtaactcactctggttttataaatgtatgtgatgttgggagcattcttttttatagtgtataattctgtctttttcctgttaacaaatttcagtttcatcagaagttttttttttttttttttttttttactgcttttactcccagcagggctgtaaatgaacgatttaatattctgctctttttaaactaaggtaaaaccacctcagctgatcgattatctacaacagaaaaaggcagaaggttacaccatcgggggtgtggaaca

SEQ ID NO: 32734 - DNA, 1088 bp, Bovine  19866881502393
gaaggaaggaagtgctcagtgcttccatctaccaacaatgtacttcctggatgaagtattttctacacagaggtgcttaaggacacgtgtgtgcctgcgtgctcagtcgctcagtcgtctctgactctctgcgaccccacgggctgtagccctccacgctcctctgtgcacaagtaattataaaattattgctattctcacgctttagtttattttctataacctgttacacagtgtcaataagaaacagatctaggcttagaacatatatgaaatagtgattattttcaatagtctagaaatcaataagaacctatagaaacaaacaaacaaaacaagtaaaagcaaatgaaatcatattccatcaatatggaatcaacagtgcacaatgaatgcaaatgctaacatgtcagctccggacgggcagtctgctccttcaacgctgcctccccagcaccacgcagcaaatatttgctgaatgtatgaggttaaagaaaaaggtcaggtatttcttctcattctgagtaccaatgatataccctgagtaccaatgatatacgtggcaaaacaccaacagaagctattgatcctcaccatcttgggtaccggaacctttcaacaagcaagtgtgcagtaacttcaacagcaactgcaggcatcggtcagttttcagcaagggcatgtaggcatttgtaccaaacttcacaagggcatccaggagaggatctaagaatatccttaatacattctgtgtcctccgcttttcactagacattaaaagacatgcccaaatcaagcatttcaaaagcatgaagaaactgtcttccacctacagttttggttagctaaagattccactggacggaattactcttaaggacgacctgttaggacggggctttccactcatgctttcccagtgagtgcagcaattcacgggagaagaaagcacaagaacaatacatgtccttggttttgggcagaagtatgaacaaaatcctagatccaacttatcagcaaattaaaatgctgagacctcgcttccatatttcagaaaaaaaacaaaacaaatatatactagtcaagga

SEQ ID NO: 32735 - DNA, 528 bp, Bovine  19866882157371
atcttcttccttatcggagagaggagtctggagggtaagagcttttaatagacgccaaactagaaagcatttggcagatggctgtgttctctggggccaggcacttattagtcagcctaatttagaacagatcactcttctctttttataaataactgttgatgctcggcaaataatatgtaataataataaggttctcttgtgcaaacaacgtttttgtttattctagactatggatcagctcaggggagtggggcggaggacaggctgtgcagctcttttccttcgaagcagctgagatggggaacatcacaaacattgcttgaacacagaggtcagaagggaaatatttagcaggagggagttttggagcacatggagcatgaacttcctctgacaaggcggaggtcagagaagactgctgtcctgccacctaccggtctttgtctctctctttccctctctactactgggtgtgggtgtattgttactttttgcttatcaccaaattaattcagctcactcgca

SEQ ID NO: 32736 - DNA, 1725 bp, Bovine  19866880164378
attggaatgaaaactgaccttttccagtcctgtggccactgctgagttttccaaatttgctggcatattgagtgcagcactttcacagcatcatctttcaggatttgaaagagctcaactggaattccatcacctccactagatttgttcatagtgatgctttctaaggcccacttgacttcacattccaggatgtctggctctaggtcagtgatcacaccatcatgattatctgggtcatgaagatcttttttgtacagttcttctgtgtattcttgccacctcttcttaatatcttctgcttctgttaggtccataccatttctgtccttatcgagcccatctttgcatgaaatgttactttggtatctctaattttcttgaagagatctctcgtctttcctgttctgttgttttcctctatttctttgcattgatcgctgaggaaggctttcttatctttccttgctattctttggaactctgcattcagatgcttatacctttccttttctcctttgcttttcgtgtctcttcttttcacagctatttgtaaggcctccccagacagtcatgtgaagtgataaatcaagagaatggattgagagggtggggaggtcaactggagattgggggaagatgaaaaggtttctggcagggaagctcacattcctatttccattctaagtcccctgactggggccatgctgggttatttatcttcaatgacatacaacttcattatcgattagtatgaagagaaccaaaagttatgacaggcaaatagtcgttataattgatgtacttcatgttgctgtttctttcaggttatcgggggtgggggggagaagccaaatgttgcaaaataatctaaatgatttcctatattcttctacttatccagggtttctgttggtatgcagtaaattttatgatgtatgctattatgtctaagttttgaaactcgtttcctgaaacatgcttagttatagagctgaccagaattattatttactgggtttaaggctgcccggtaaaagataccttttatgtgtattgtatacaagaaagagacagtgaggtcttcatgttactatgccaacatagctctagagtgtgttcattcatttcttttatagtgattagtttgaataacagtcatttaatcttctcaaatctccatttcttcatttattaaacctgtcctgaaaggttgcctggactaaagaagttcatatatgtgaagacacttggtttcaggaacatacgggttctgaatttttctaaactttactgattcatgaagtagcagctatgagataagtgacttgaatcaatgcaaagatatacatgacgtgttctctaccctaaatttctgaggtacattcatgactaggtcagtaatagaacttaaacatgtgaccccgtgcactgtagcccatcaggctcctccatccacaggattttccaggcaagagtactggagtgggcaccattgccttctccaaatagactgagcccacagtactgttctgtctgtgacagtgatttgtaaggggtcttttatgtacttcctgccggggttatggggacactttctgccaggagctcagaactctttcagcactgactgcccagcaacagcagtgctctctctgcataagacgaccccagatgccctgggctgcgagtctgtgcaaggtgccatcactgagtttccccatg

SEQ ID NO: 32737 - DNA, 1344 bp, Bovine  19866880592467
tcgctcagtcgtgtccactctttgcgacccgatgaatcgcagctcgccaagcctccctgtccatcaccaactcccagagttcacccagactcacgtccactgagtcagtgatgccatccagccatctcatcctctgtcgtccccttctcctcctgcccccaatccctcccagcatcagagtcttttccaatgagtcaactctttgcatgaggtggccaaagtactggagtttcagctttagcatcattccttccaaagaaatcccagggctgatctccttcagaatggactggttggatctccttgattataaatatatttaggtgtaaatcatcaccttgttacttgttctctttctgtcttatccattctgtcccctttcatctcttattctgcattcctttagattaattgaatgtatttccactttatttttttcccttggcttttttattattgttgctattttagaggctgctctatgcctcatggtgtaagtcatcatattaaacctttgacatgttttcacttcacatatatgacatttacaataggcatacttccatttctttttatctggtctttgcattattgttggcatatgttttgcctctacacaactatgaatcccacaatacttctttatttttgtttaaacaatgaactgtcttttaaagagactgacataataaaatcacacatatttctccatgggtcttaagctccatctcctcatttctggtgctctttatggctttgcacaaatcattattttcacttgttatcattttcctttagcctgaaggacttctataacatagctgcaggtgctctggaagataaattattaatatttccttttttaatgtctgaaaacttgtttcacattcatgttgccttactggccactgtccttctaatctgttaagatggttcttttcctggactagcaccatttctttacacatctctctgggctctgctaaatactagagggaatcctctgcccatcaacccagtccagctttccatttcagtgttttgtcttgcacattctagctgtcttggaccttcagctttgtcttctcaactcgagagagtctgctgggttttctatggatttcacatcttgtcccaccctacccacacacaccatcacttgaaaactctctcaaggcagcaaactgctcacctagtttgtttcccatctctttgagattactccccttcataatttggtatcaggtgtcttgaaaacattttttcccccttagagtctttctttttgtcttcttcttttgggtatttcaagaagagattaaatctagtctctgttaccccatc

SEQ ID NO: 32738 - DNA, 1280 bp, Bovine  19866880711222
gttcctccatccatgggattttccaggcaagagttctggagtggggccccattgccttctcccatttacctgctccataacagaccattcaggccctcccaggtactagcttactggattcaaagatcattaatcttatcccatcctccatatatacggactccttgccatgaataatttcctttcctttctggcaatctcaagtatattttaagttcaattgagtacacgtcctcctttctcaatgaaaccatttgacagttctcaccatgaaaacctctctccattattaattctcaaaactcattttgaacttcttgtttatttcagtttaacaattaagaatgtattactggaaaaaaaaagaatgtattactgggtttcctgaattacacatattttctccaaaatactgtttgtttcaatacagaaaccgtccccttgtcttctaatatgcctaagtgactaccatacgcatacagtgaaaactcagcagatgcttgttttttgatagttgttaagttggtgaagaaatggtggctccattatcaataacttaatggtcaaggactaaatgctactttaaaaattctagcttaatcttgaaatagaatactctgtatctggacttacccaagaatcctgccatgtattataaatctatttttatgaataattatagatgaaattgtagataaatggctcttgtgttcggttgttctgggaagtgcttaacattttcaaataatgctatttactttttcattgtataacaggctttttaaaggctaatgccaaaagttgtttacttatgacttatttgtgctttaaaaaaaaaaatctgatgtttaaaactgcaaacacatgtttcccattagaaattaacccaaaaatgttcatttgattccttaaatggaattaagctgatacatgttttatagtaaatcatatgttttaactgagcatttaaaattcttcccataaattattatttcatattcatattacaaagattacaatgagcccaatactcatattttttttaaattttcttgaataaatgcagaaatcatgttctctctcctctcacttaagtgactgttgctaaaaacttctgtaggtgcatgcatcttgcatgcatacgtgcttagggggcttcagtcatgtctgactctttgctaccccatggactgtagccctccattctcctctgtccatagcattctccaggcgagaatactagagtgggttgccattccctcctccaggggatcttcctg

SEQ ID NO: 32739 - DNA, 847 bp, Bovine  19866880788258
agaattgtattgaatcccaaatcatgaaaagttagtgacctgatttttccaggaagcaagcattatatttttattttttttctaattaagaaaaaatagaatgcaagacatttttctaagttgactgtaaccaactatggtggaggaacatttctaccattggttaaatggcaaagtgtatgggaaattgtgtacatcatccttatcaaaattcataagtaatcaataaaaacttagtacttattattatgtggcttttaataagtctcatagatgtaatatgtcacattttaaagcttcttctgctttaacttgtgttttatgtttagttctctgaggatctaaccctgggcacaacggggccttttctgaataacctgtggagtaatacatgctttccacaatgagaaaatcagggcaattctgttttttcaacagtccccccagcaccctgacatcacaggaataaactccactcttagagatggaaggccattccaactccattgtgcttacttttcttttttgcaacttttttcaaaagtaatgctgacaaaaataacttgggggagtagaaagaaaacttaattagttgaaaggaaaaacaacacatcaaagtctacacccctgagctaaaatgcaaaacagtgttattgttcttaccagaaatcctttcttggctttcaatatgtgaaagtgtggaggagattaatgaccctttagttgaaagactccagcagaaagtatctgtaaatcatttgctggtttcaagaaaataccctgagaaaatatcattagatgttctattttagtaatagattccactttttcttctcgcctttttcct

SEQ ID NO: 32740 - DNA, 1103 bp, Bovine  19866881035864
atatattttcagtaataatccactctcaaaaactcctgagaggtagtatagtgatcattttctgagcagcaaatttgaaatgcatatgctgaaaatctatgtgagggaatatgttgctcagttaaaccatgtacattgcaaagaaccattcattatctctacctgttggaacatgtaggaaaactccccttgagatgatttaaattttattctggatataaaatgctctgaaaataaatttaactaccaatgctagctcctagccataagacaaataaaatttaggcaagaaagtatattcatagcagaacgaatttgtgaatttttctatttgtgaatggcttggaataaacacatcgtgaatgtcactggcctagtatgatcagatatcttaaaatgtcattaagatttaattttttattaagataaaaaagtttattagaataataataaaagtttgtggtggttagatatgtgtgaaagaagaggaatataaatattatcagaaatacttattaattaaaaataattttactaatgtataacatgcaaaatacatatgtaactgacgatcttaatggagatccgaaacattcttagtctacgatttagtgtttggtctagaatcatcctttatactgactctacacatatactgcactctcttttaggcttttatggtcagttgaatagactattattgtcatgtaacagaccactgatccccccacaggtcatattcctgcaaagagccatattccatgctgctacaagtcaaactgacaaaccagcaagcaccttctgaacacttgtttagtggatcaccagcttaaatccacaggtgaatttctggagctcaaaatctaattgtggacctaagatagagtcaagaacaattagagaatgagatgacaagtgtagaatcagtactcagttgtttcaaagagaagaaacatctatgtgacttacataatcagcagagttttcatggaggacacaggctaagtcacattttgaaaattaagtagaattttagtgagtggaaagaagcagaaagagccatcaatacagatagcctgttctttatcccaagggggttcaag

SEQ ID NO: 32741 - DNA, 949 bp, Bovine  19866881619921
attatttaagagaatgttatcttcttcaacacaccaatatctgagtaaaatgcccagaagttgctgctgttgctcctgctaagtcacttcagtcgtgtccgactctgtgcgacccagaagttgcccttctttaattctctttctgtttacttatattgagctgcatttgcaacacaacactttattgctctgtaaatgcataatatgggcttttggcttgcttcattttgtttgctttttaacttgcattataaaagtagtgaacactaagttatctgtagttttgctgaattggaaatataacagcaagatttgtgttctagcatatagtatatagaagataaaagcagaagaaacatgaaatagatatgctggctactacacaaatctgtctggagaagtttactctgcctaatggatgttagtatcggtcagcttgtgtgttagtcctgttgagttaaagtgttgtctcctttgtaatatcattgatgacagactactctttagaagagaaaataattgaattctatactgctctataggttttcttttcttcccatgggcatttgtaggtgtgttatttacagtgtaatttcacctattagttatttatgtgactcttcaaatttccatcagacacaggcagtatcatgaagtatatagattacattatgatacatatcctttgttacattagagtgttcaagccttatttttttttgacaacacagatattttatcctgaatttcttacaatagtgaggagacgtataacatgactcaaaagaaatttgaagttaatatgtcttttgatacatctaataaaattgccactattttccaaaggcagtatagcgtatcattcttattaagtgagagatttttgagcatttttacaactaataagttgatttctgattttgggagagtagtttttaggtcacggaaa

SEQ ID NO: 32742 - DNA, 745 bp, Bovine  19866881807184
ataatgattatgaataacatatacacaccgaaggatggtcaggatgcttggtacaccagcaaaagcagaaaatacaattgtagcaaagataaaagcaatgaacaaaggtaatttataacactttggatcacatgtcccttttgtagcatcaataaaatcaccttgatcatctgaggttgttaatccttctttaatgcaagaacaattgtagtatgtctataaaaatgaagataggaaacaatctttagaaatataatcataaggtaaaagctattatagtcataaaataaaaattaaatcattaactgtagggagactaggcagttttattagtaaatattttttgccgtgttgctgatatttgttgttttagtcactaagttatgtccaactcttttgtgaccccatggtctgtagcctgccaggctcttctgtccataggatttcccaggcaagaatactggagtgggttgccattttctcctccaggggatcttcctgacccagggattgaacccgcatctcctgcattgcagacagattctttactgctgagccaccaggaaagcccaattagtaaatatgcctacattagatcgtatgttgttaatttataaattcaggactaacgataaataatatcaaggcattttacctaacaaagaattgtgtacatgtgaatatacaattagtagttacttaggaaatattccattaatttaacaaatttcactaaaaatattta

SEQ ID NO: 32743 - DNA, 1480 bp, Bovine  19866880393821
tcctcagatactggcaaagcttcaatttatttcctttcatttgccaatgacaatattcttcatttttggcctccactgggggtagctttctgatgaagtttcctttacagcatatgtacatccttgtacacacacacggaagtgttcatgtaactctagttggtaaaagagtcaccagcagatgctacacagatctttaactgtagctgattgctacagctacatcatgtcagagttaaagctagtcttaatttttctctaatacatattcgtagatgtaaaagcctcaagtctaatgtcttaaatggttgttggcctcacattcctagtgtctctaagtttacacacaaggaccattgctcacgtctggtcaatccctttatgtgctagcatcttcagcacggtgtgacgtactttctgtgtaattctctacttttcttactttgttttgaggtagccagacttcaaattgtcatgtaagtgacttttaaagtatacttttaatgttttcccaaaagttctttaaatattattttgaagctaatatgttaaagtctttctatattgaccacaggataactgtccatatttaccttggaaattaatatatttgttgctgctgctgctgctaagtcgcttcagttgtgtctgactctgtgcaaccccatagatagcagcccaaaacgcccctttgtccctgggattctccaggcaaaaatactggagtgggttgccatctcctcctccaactaattgttgaccattactatattacatttatcttcattattctcttcttagactctaaagtgacctgatctggaattaaattctctaagcctcagtagcaagattccctcttttgtcttatttccttcatggttattatgggacaaagaaaggtacactgaattatttcaagaagttgaggtcagtctagaggtaatctgttctgtgcctcttcaagaatttactttgctatccaaaagagatttttactgtggggaacaccatgcacaatggcactctatattgagtcttgtgaaacagaaagagtaataatataccataaaatatatgctatcttgttacttttaaatttaacaatacatattagtgaacttgattgattagaaattcattcaaaattgttcatataggagggaaatatatcaagtttcaacttaagtccaagaatggcctgaccaatataacaaagttcttactgtcttcaaaacatcagagaacttactatccgtggcttggtctttgaagtcaccatgacaccatcgcctctgataaaagagtttatttataacttgctcagcttatgtcttttcccactgaatcagcaggctttctaaggtttggggatataatttcaagcactgttaaacctctgtcagagtttggttggccccctgaggggccctgtgtttcaacattctctttactaagacaagacttctcaagtaaggtt

SEQ ID NO: 32744 - DNA, 1750 bp, Bovine  19866880406543
actttatggcatgggtttttcacaccttgtgagacaaccatgtacagactagtcatttctcattaccttcatttctcagtctactgaaaacgcctggtcacttcactgatgaagctgtcttgaaactggagacaagtgctcacagaagagatccctttttaaagtcatgtgtttcctaccactttgctgaaggcactgtcaggcacagtccgccttgagcctgtggagcctactgcaagtttctgaggcctttagggttgtctgtcacagaactgtattgctagagttcccacggtccatgtgggtagctttcttcaaaccaggtaccaaactgagaagagaatcagaggcctgtttcatgcaattaccaccaagagttgcctggtgtcactggaaggtcttttgactaagctaattgtgtgaaatttttctcttgattattttgggctctaaagggaactctgaaagtcaggatttatagattgaggaccccatactagcccaaagaagtcatctgggaacaatgtccacattcataaaatgatagtggtgggactgatgatgtgaaagatctcttcctgctctaattattggagaaggcgatggcaccccactccagtacctttgcctggaaaatcccatgggtggagcagcctggtgggctgcagtccatggggtcgcgaagagttggacatgactgagcgacttcactttcacttttcactttcatgcattggagaaggaaatggcaacccactccagtgttcttgcctggagaatcccagggacaggggagcctggtgggctgctgtctatggggtggcacagagtcagacacgactgaagcgacttagcagcagcagctctaattataaatgattgtgattcttctgatttcatgttacgtatcactcttggatattatcaggataaatttgttacagcagaaaacctcacatttctgtgaggctgtgaacccctgaagaggtcagcaaattgttttagacaatatggcacatcagaataacccagagttttaattttcaagcattgtatttttccctcagtaagaaacatctttattccccaaacacaatcaggacagaagtgcaattttaataaaatcattcagtagaaatgacaatgatccttcaaagtttagtctttatgtatgtgagtactgagtcagatcttaaatagctgagacctttgcaataaaatttattgtgtattaaatatcctgctaagttaagattaaacattcaaagcttggcttttatccaaatgtataaaattcttcactcagaaataatcccagactttaaattaaatatagcctttagcaatgcctataaaaacaagggaaatattctacattaataatgtcgataaaggacagaaatggtatggacctaacagaggcagaagatattaagaagagatggcaagaatacacggaagaactgtacaaaaaagatctttaaaaaatgggccttagaaaacatcactacaagcaaagctagtggaggtgatggaattccagttgagctattccaaatcctgaaagatgatgctgtgaaagcgctgtactcaattatgccagcaaatttggaaaacagcagtggccacaagactggaaaaggtcaattttcattccaatcccaaagaaaggcaatgacaaacaaagctcaaaccactgcacaattgcactcatctcacacactagtaaagtaatgctcgaaattctcca

SEQ ID NO: 32745 - DNA, 1061 bp, Bovine  19866880454603
agggttgaagaaactcaacaacttgatcgagcctcctgtgtagtgctgttccagcaggatgttattatttgccttgcaggggatccccagaggagcagattccatcttagtcaaatgtcagtataaaaacaaaatcacttgattcagagggcaagctgtcctgggagactctgtcagcttggattgttcatccttccctttccttctgttaatacaaatgactggcagttgtttatagttattgaaacattataatttttccttttaattaattaggtgatttgatttgcttgatttctgcaaacaagattgacaacaaaaatcccagggtcatatttcccatgtgctttaagttatttaagtttatatgttcagatccatgaatattatttagcttatgaaaattgcagttaacttacaaataataagaattttcagggaagttagacatcctcctggattgaagggatcaataatatttgttcaaggacctatcggatgtagggtattgttccaggtgtcatcggtacaaagaggacacttttcacaccaaccttagcatcatggaattacagttaaattggagaaagaaaacttgcagatacagaatttatgaaatgcaagacagaatgcttctttgggggaaagtgttcacgttaacagtctgttgttctcctcaaacaccactttttagttattatagtctaacaacaagaaaacattgtggtaaacttttcaagggaacttacctaagaacaggaaatattatcactggaagacatgagacattttggtaagacaaagttcaatttcaaaataaaagcattcactcttctaattattttgtaatttttttcataccatcttagttccaaaggacttgacccactatttatacaagtctttttaaagaaatgtataatgccagagaagaaaatttcagacaaaccagagcatattttttcacaaagttatacaccaataaaagaaaattacgataaaaaacattttgtgactttaattatagcatttttctgccatacacgacttccataattata

SEQ ID NO: 32746 - DNA, 1429 bp, Bovine  19866880495509
cgtggtagtctatcttcttgttaagaatgtcaattatactcaactgtcagttttattggtttattaactgtagaactttttaaaggtactgatgcttgcaggagtttcctgtttgagttcattggactgcaatggtcgatccttaagaggaatttagattgggagatgtacagctctcacaggtcttattatgctcactttgcccacatatgactgttttttcatacagcacagttcatgctcctccatggtcccaaggagattgtacatgtaaacaggaattttctcttgtggggtgagagaggagtcgagcaggatgtgaaccaggctaataaaatgtgaatttataggtgttctgcttctcagcccactccttgtgtctgctaaggaccagcccttcctgatcctttaccactgtggagaactgttcttcttcatttttgtagttaatgaatatgagaatttattcagagattgtaaaaagattgtagcaagctgatgaggctacatcagtgctcacatgaattaggaagaaccaaagcccaaaccgaacaatctctcagagcttgctaccatgacattttatctgtgcaaggactttaaaaagggacacactgtttccttacattttttccctctgaatgttttagtgcattttgaaccagtccattgtcttaacaattgtctacacatttatttttaaacactaatattgatctaaaatcttcatatgtggttaaacagtaagtattatcccagagccatatggtaaccatgctgggaaccttttaatttagtatttaatcaaacaagcaaacagatattcctcatgaaaaatagatattgaacccagcatttctattacactcacaaataataaaacatgtggttttgtaagctatctaacacttttctcacagtgaaacgcttttcaaagttaatgtcaaatattcccagagagcgattcttaaaatgcctaagaatgtaaatggccaaaaattgaagttaacctcttttgacaattctataatatctaccattacagattcaaaacagggcaataattacatatgaacacttggctcgttatgtctgaaaaaaatttagaataagaagccatgcaggatgctcccacatagcattgcataaaaatatgatttgatctgatcatcatagtctggaacatatttttcttggtatttggctgtttcccccttatgcttgaaataaattttctggagtctgtgtctttgctacatgctatgtattcagaacaaaaatatctttcttctctagggagtgactgaggcaagcgcttctttacatgggatattttactgcctgaagtttttcaggttcttttgcttagaaatgttactcattacatttttaattcttactatttttttttaatgcaccaagtatcttt

SEQ ID NO: 32747 - DNA, 1052 bp, Bovine  19866880505464
tagtgtctgacgcatagaacccaaagtttctggtctttaaaaacaatcaaacaacaacaaaaaccccactaccgagtcttaatgtacacattcctcacaaagagatgcctgtagaaacagataatatcaatagataattcgtcaaaatgccaggtaagtatcagcaaaattttaaatgtttgttgaaagatataaaaacaaattattctcttctaaggagaaagaggacaaaagtctcactgccaaaaacattccttggaatcccatttcccaaatgacctaggtttttaatttcaagacaaaaatacctgattttaaaagataagtatctaccctctgggaaaaactgatgatttcttatttttattgccataaaaggaggttcaggaagcctctaaattataggtttcaagcaaccatttaatttagattaaattagacagcaattgtatgttaaataaatatgaaatggctctgcatgtatttgttaaagattaaaccttctgtaatacttggcttctattacacatttgttattgctgatttttaaaataaatcaccatttaattgaaatacttaaagaacatttacaaaggaaagtatagtatttagcaagacccatgagaatctaataagcccagtagggtagctctttcaaaagtagccaattctccaacattgtggtagaaaacttgtagtgaaattgtggccagaatcctacacaatctttacaaatggcatgattcaacttgccaatatgaaaccaaaaagagttttattttaaacattttttatcaaagtagttttggtctgtcataggttcttcccatctgccattaaaaaaaaaaaattgaaagaattatagacggatgaaaataggaactccttcatctccatcagacacttgagtataactatcattttggaggggaaaaatgaaataccccagaggacactgcattgtgatttttatcctgctttcctaagttggagatgtgcaacagaaaaaagaggcttcccgagatcatgctaaaagtaggcatcttaaggca

SEQ ID NO: 32748 - DNA, 2374 bp, Bovine  19866880520510
aattgcagcacgtcagacctcccctatccatcaccaagtgccatactaagataattttagtatttttaaaaataaagttttaagaaatataaaggaaatatgtttgaacaaagaactattcctgtaggatataccttaccactaacataccaaagccataatctgggcatttatcctaatgtcagacattatctgtctccttgtccaaaatccagtcagttactaattcttactgactcagccaataaaatatcccttatttctagctcttccttccttataatgatggccactgctttactcaaggcaaccatcaaagggactatgccatcactccctgccttacctcctagtatccaaaaagaccattcattctggactgatcatcggtcccttggctgacattcttcaaaaccaaagccttcaaataaagcatgaagttcttcatatgacatacaacttcctgcccagcattgctttcttctcctctccgatttcacactatttctgctccataagctgcagacataaccaacactttgaagtccctactatgccaggtcactaaaatgctgctagaaatgatgtttccttcccctgtaattccttccttcccttctcactgaaaaacattcccactcatccatgaagaattatttcacaaatatctagcctgggaagccattcttgatacctagggctgcaaaggactccatcaacatgacttattagtatttaaagtggtcaaaatttcttcaacaattgccatcttccggcactgtgactgccttatacaaatattcaatcaatgtctgactgtatgaatgaataaatgattaatgaatcagtaaattagaacttgttaagcatgagtcccagcaaacagcagacaagagaatcatatcttactacttgaagatgggaccctaatcatgtaggctggtctctgcactgcagtggaaagtggatgagtttgaaaactgcgtctatgcatccatcccattaaggagactggagacttgctagacagcactgaagaattatttagacaaaaacactaaagaaacagattctaagagatacttaattcagtcagtctcaagcattagtcatagagaaagcaatagcttaacacagaccaggaaaagacaaacacttctatactatactgttgcagcagctcaacatatttgagactctttacacagaggctacacttagattctttataacaggatgaactgacactccatttttcaagaaataattaaaaaatgctgagtccttgaaaattctgagaaccattatccgtctcaaaaagatgcacagcttcctgctgaaaaacacaaggtcagggttatgaagaaccgtggtggctaaacagatgtttctagaccatgtacatgagatgtgaataaaagtcagtctttggttaatgaagtccaccagctactaccaattgctgccgatgcctaacatgggaggatttagcacaaaagaaatgggagatgcacttctaatgactttgatgtccttgttgaaaaaaactcaagcacttgagggcataagtggcatcttcttatcttccagctgaagatcatgaatttagatagaaaataataatgcggttaagaagtgggctggcgtcagatcatagagcgaagaattctgacagatttggaatttacccaataagcaattaggagccactgaagttctttgcagagggaagtaagtttgcattctaactcataagttagattcatgtaaattgaatttatggaatcaattaagtgtgacataaatgcctctagaatctactaaaactataacactttataagacttgaagacagagtactaaatcttaagtggcaataaccctactaagctttattgggccttggaatcatggctaaatattcttcagtctcctatacataacctctttattttttaatctgaaatcctaagggtgcttttgaacagtgtacatcaaattaatagtcttgcaagagtgtgagaatggtgcccaccccaccatctatagagctacatgctgctgctgtcgcttcagtcgtgtccgactctgtgcgaccccatagacggcggcccaccaggctcccccatccctgggatcctccaggcaagaacactggagtgggttgccatttccttctccaatgcatgaaagtgaaaagtgaaagtgaagtcgctcagtcatgtccaaccctcagcaaccccaaggactgcagcctaccaggctcctccatccatgggattttccaggcaagagtactggagtgggggtgccattgccttctccgatagagctacatataaacctccaatacagcattcctatttataaagga

SEQ ID NO: 32749 - DNA, 1046 bp, Bovine  19866880532581
gcttaaaatatttaactttgttattgccttatgtgtttgttttttaagtgctattgtgaaatttatatatgtgtatttgttttgaactgtggtgttggagaagactcttgagagtcccttggactgcaaggagatccaaccagtccattctgaggaaatcagccctgggatttctttggaagggatgatgctaaagctgaaactccagtactttggccacctcatgcgaagagttgactcattggaaaagactctgatgctgggagggattgagggcaggaggagaaggggacgacagaggatgagatggctggatggcatcactgactcaatggacgtgagtctgagtgaactccgggagttggtgatggacagggaggcctggcatgctgcgattcatggggtcgcaaagagtcggacacgactgagtgactgatctgatctgatctgatctgatatttgtttcacactttacctaaaataactttatgaaaattgccttgaactaaggattgtgacaacttttataaattaatctttactgaactctgctgaatgattatcctgatatttcatttttacctaaacctagcactcttcttttttaaccttcctagttacatttcttagagagttttctacatatgtcatttttttgaggtgagaaagtaatttattggactgtttcatgttttcctttgtttaatttaagacaaaacatatttctggaatggactgttgcagaggaattgtgtcaaaagcaaagtatctaataacctcttcactgcctttgcaagagctcagtattaaaacatttgtctagggcattaaaatgacgtacagagtgatgtttattgctctggaataaaaagccctgcatgctgtttttccagaaattcttttctttgtctcactgcatacttggatttgctatgcaatatgatttttattccttgagcccagacttcctagatataccatccttgatctgttcacttcttgtcttctatacatcaaacaatgcacgcatcattggagtctattat

SEQ ID NO: 32750 - DNA, 829 bp, Bovine  19866880534279
tggaatggattgagaatgcaatacataccacagagaaatacattttaaaaacttttcttgctccattacaaaaaagtgtccaaaagaaagttggtcaaaatctttacttttttctctttattttttccttttatttatttatttatttttttagctttagttatgtctactccaagtttgcctctaaagtgttctttggacattttggcgaccaagaagaagtttttagcatttgccttttaaatgtgttggcagtacaagttttccaagttttgaaatgaatcaaactcaaatgtagagacagttaacaaaggaacttaaatctaggctgtgagcacatacggtctctctccttgtcacatgtggattgattaaatacacagaatatccaacatttggcttttcttgaatctgctgatacgcccacaaaggcactttggcagccctctttatgttttcatttgttttccttgcagagagcaatgagctctgtgccagcgtcacagaccgcagcctccagggcaatgaaggcggattcagacagttgaatgggaagacgaataagttgttccgccccagagctgactctaatgagtgattttaaaaatggcttctttcccatttttaaaaaaatcattgtttttgaaagtaggaaatgaatgagccatgtatttcatacagtaaaatacaaacttcactactatagcttaatacatttataaatacctctcttaatcctcccaccacttatggccccttgtgatgacataggcatattgcctctgggttataacaggacatacatcttctccaagctgttggttcccag

SEQ ID NO: 32751 - DNA, 1951 bp, Bovine  19866880538932
taaaatgctaagatgcatagcaagactacatcacccatgtcattcccagatattctgctggtagaattcaccacagattttgtggtgtcatattatttgacagccagattcaattataccacattataccagaacctcaaaaagcaaagtggaatccagcaatgatgtcattggtgtccatcctatgagaagaaccgtagacctctggagccataactagattattcttggagaagggttgatccgtgatcgtctgtcatgcgacccagtgctgggaaaccagatgatcctgggaagaaaacaaaatgccccaaagggcctcatgcatggtatatgaggccttcttagagtctgctttactcttggtgatatagtgactgttggtagaatagtgatatcttgatagtagcaataagaatttaaggtcattttcagcattacccagatgcaaaataactttgaaaataaaggctaaagttgacttcagtggaattggttctgatcaaacctatttgtacctattgtgtatgtcttagtcatagtgcattttcctttggcttccctggtggctcaggcagtaaagaatccacctgcaatgtggaagacctgggttccatccctgggttgggaagatcccctggaggagggcttggcaacctgctctagtgttcttgcctggagaatctccatggacagaggagcctggtgggctgcagtccatggggtcacacagagtcagacatgactgaagcgagttagcatgcatgcatacacagtatacatgtctaatatattttagatatttttgcaatattttccatgatagttgattttattttaaagaaaaagacataattacttataccgcatcttaacatatggaagaaaaatatccttatggaactgttggtactatacagatgtatatatgtttttaaaatgattgatattctagaagtaagcatactataaatgctaaaagccacaccaacaccaattacactgttttatatagtcattgcttgataatattttgttgaatatatagatataaacttgagagtatatttggatctagcataatagctgagcgatctttgagaaggtacttctgcattttcattattatctatgaaaattatcataaagacccatattcttagattgttatgagaattaaatgaaataatgttttcaagttttttaaaagctacaaaagtagggcttccctggtggcccagtgtaaaaatccacttgccaatgcagaagatgggtttgatccctgatttgggaagatcccacatgactcaaaacaattaagcctttgtgctgtgctatgcttagttgcttagtcactcagtcgtgtttgcttctttgcaacctacctggactgatagccagccaagcttctctgtgcatgggatttcccaggcaagaatactggagtggctttcatttcctcctccaggagatcttcctggcccagggatcgaacccctggggtctcctacattggcaggcagattccttaccactgcatgacctgggaagccctacatcagagctgaggttgtatgtttagaatgatctcatccctgtactacaaacaatactagtcttaaatattagagaactaccttgaggagttttcagtgaaaagcttatgtttgattgtagcacatacaaatgaaattttctctccttaaattttttctatttctcttttgggcactgaggggaatcttgcattcttgagatctagaccaaaggctacgtgagtgtatataaataatgcaggcttttcaacacatggctaatttccatggtcaaactttctccagttcttatccaaatctcttccacatcccttctggagagagagatcttaattttctgtctaaaatctgtttgtattcaagacagtcattcatatcagaataatagaatttaa

SEQ ID NO: 32752 - DNA, 1013 bp, Bovine  19866880636246
ctcatgtgcacacataaatacctatacccgatcatgtatgtgtattgtgggctttttttaattgacggtggagttgcatttattgtacttcaggcctttgtaaatgcacgtgaactattgtaaactagaaggcctttgtaaatttcagttgccatcctctttattttcttgtgattataagcaccttgagggcagtgttgccgtttttggttcaccacctggcttgttacggttcttctaatatggcaggtgttcaataaatcccattgaatgaggatctgtggttgactgattaacttcttggcaagtgaaacaaatttaatattccccttgagttcacaaatggtttatgcacttcacaaaggaccatactcagaatcattctggccttacaagtatatgaccaacaacttttaagtactacaatattaaggggccctaaaatgaagactgcctcctatccacatggagtgttttcatttatattaccctgttattgcacacatatcagacaggaatatggtttacacactggaacctccaaccaagcagtctcgcgctggtctttgtgtgctctctgttctttgcgaatcacggattagaactgcagcctttctgacctgcaataaaactcacacgtttccttaaacatatgctactatacaatgaatttcattgaaggagaaagtgaacgtgaattctccctgactgattcttttcagctttggggggctatggttagtaagatcaaataatgccagtcatgtcaggtagtgccaggaacttcaggtctccataaattctgatcctggaaactgcatgactgaattagaaagaatatttttccctgtcaagacttcagacttattttaaactttgggcccttctactcaacttttctgtgacttctcagacaaagcaaaagcaaaagccatatttaaagagaaggaagtggcacaaccctaaatggctggaaataaagctcactactggaaaatgccctttaagagttt

SEQ ID NO: 32753 - DNA, 820 bp, Bovine  19866880660525
tcttgcctggagaatctcaggacagggcagcctggtgggctgccgtctatggggtcacacagagttggacacaactgacgcaacttagcagcagcagcagcacattcagtatactgacatggatatgatctactgatcttgttagagacatatttttaactaacttgtgaacatactccaaactgcactaaatatctcactctgtcctcatattgttccccacactcttctccatgattatgtgtttgattcctgagtgagttatttgccatgttctgagatgaagaattaaagagagatatcaggtacttgggggagggggtggttggaggcaagaatttgaacatgtagagcaggggatcccacaagacacccagttcaagatgtttggcagctatttggcttgacagctctgcaactctaatcccaacactgtcatgcctagctggaaagcaagtattataattaggtcaaagaaaccaagaaaaacttggccacctttagaaaaaaaaagcaccatcaacaacagttagtgtatctcctggagtatgttcctctaggaaaactccttcttccattccttagggcttctatttacacctctccttggcctctacagtgaaatgtcaagaatacaaagaattatttgattttgtctgaggatagagtttattttaaaagatgttaacaaattcaagtgatggcagagtctagtttctataatataaaatttcaaacagccagtttctgttcttccatccctttgatggggcccaaactaaacatctccacattcattacaaaagacctctgtagagta

SEQ ID NO: 32754 - DNA, 1204 bp, Bovine  19866880712651
atctgggaaatgtggattctccttacatagctgtaaaacatctatgaataaaaatgttctaccatgagttctctactgaggaacagtctggagtaaagactattagatgggaatcaacaaccttaattaagttgttctagggcagtggcaaactagcctaatactttaattaagttatttaattctctggggcagttttttttttttttttttcatttgttaaaaaaaggtggttttgtttgagagtctcctttttttaaaaaaaaatcaaaagtaataaaaagctcaaaatagatgtgtgagaacaccaaatataaggatttaaaacagacttctgtctgtttgaacttagtgttatttgtgaagaaatttggtatcatactttgcttagaagtaattatctggggaaactgaaatttcattttcccaaatctattagttactgcaaatttaagctaagataggccatttctgtttaagtaaattagtcaaaagccaaaagagaagttgagctcaatgagagattattttcagaatctctttgtatcatattcaaacattacaacttaattaacaaaggctacagctctaaaagcgcctgtaaattccgtttcttcaatgtacctctctccctgtgtccctattcatctctgaaaagtcaatactttctagactgtaacatttgctgagactttaatttccaaataaatttattcttttcagttcttcattttattgaaactgtaagttgacattcaagaacaattcaccctaatgttggaaaaaaaaatgcttttccattattgctattttgaatgacttccaggaaagaaaacagattacaacttttgataacatacgaagaaaatattattatcacagcttgaaatctgttaacagggactttctaaggaacaaacattaaagtacaacagaaatttaattacaaggagattttccacttgtcagaaatatttgcattaatgtcagtaataactgcaataaagagactattgtctcgtgttgcaaaaaagagaaaagatgaaagagatccccataatccttgttacagacacactaaagggtcattgattatttagcttttctttgggataaccctaaacaaaatatggagaatgcaatgggcaacccactccagtactcttgcctggcaaatctcatggatggaggaaggagtctggta

SEQ ID NO: 32755 - DNA, 811 bp, Bovine  19866880735662
cacgtatgtattttagtgagggtgttgatgaaagtgatgtagtactcataatacttcattcaaaaggcagtagacaggacaaaatagtgctggaaaccaaaaatataattgtgtcctttgggaacacaggacatatttgatgatgatcatgaccatgctgatgatcaattttgaagacaacaaaatgccttcatttcttagcgtacaccatctggttttcatttcttttgaagatgaaaatgccctcctatggattggctcagcaggtgtgttgtttcctactactactttaaaaaaaaaatttactcagtaagtgatttcattcctgaatcaggaaaagaagatagatgctgctagaaatgacaatgtcaaactcatgacagtgattatttcaagctcagaatgaatcacttttaagacaggaacctttggtttatttgttttgcggctattaggcatttaatacttccactgagacagagtcaactttctaaagataaatagtaaaaaaaaaaaaaaaatttaaattgtcctaaaataaatgctaggataaaaaataagtatgaaaatgctgattggagagaaattgtctcccaggagaacttccacatgatcactttatatccatatggaatcttcaaagaatcctagtaaatccacagagctttggggaaatccttctgaattaaaatggtactgaattgttggggaagaccagtcttttagtctttgaaatctttccgtgaggagctgtcctgctttcaaatctaccatgttgccagtgagaggtgtgggagaatttgcaaaggtt

SEQ ID NO: 32756 - DNA, 1479 bp, Bovine  19866880822017
atctgagaaaacatgatctatatattgtttctgttcattctacgaaatgtattcggggcacgaaaaccttttctgaagcctcttatagattccactctttttgtatgtgcctgatgctcttggtacatggagatctaagcagtcctctcctatctgatcactgaaaatctgtcttgttcctacagaatggatttgctgtggtgaggcccccaggccatcatgctgaggaatccacagccatgtaagtaccaaggactgctggccatctcccagcgccacgattcctggcggtcacctgccccatgcatgtctctgaagcctctaattgttagcagatggactgagaaatcttgcgaggtactcccagaagcagatttatggcttcagagatcatatagcattttaaaaaatgctctgaacattatttataatggttttcctggctgatttgctttcttatttctctgttcttctctattccgcagggggttctgcttttttaattcagttgcaattaccgccaaatacttgagagaccaactaaatataagcaagatattgattgtagatctggtatgtattcctggccagagctgcattttcagtgactctagataaaagggactgaatttgtatttctctgttaggttgccttgtttttagcacttgcaaacaactgaaggggtgtgtttcctttgaatgtggaaactcattaaattcaggaattgcagttctgaaaccataaacattcacgtttcactttcatggtgttaactgcaatttaatgagaagaaggcgcagatcggggcaacttttatgatccttaaatgaattgatacttccacagttaaaataacccaacagaacctgaatttacttttccctgcagaatatagactttaaatagtcagatgtgctggaaagaatgttgttgctttggtaaccaattggccacttcccctggttagcaatcatgttgcttgttgtgcaacagtggtattattaaaacaagtcagcgtgtctttttttttttttttttttcctgaaaagatctcagatcatgtatgccagtttgggatgactgccggcaggaaccctgcgtgattaagagtcagaggcattcgattagtcttgccttttaacatgatgcgttcttacacaatagagttataatttgtttaacaaatggtttgtttaaatgcagatgacacttggcatgttgtctatagtagattcacaaataatgagctggatatctgccgcatacaaaaggaccagcccaggaaagggcgaaagaaaactgactggtgatttatgagccccgttttctgtttgcctccagttcacgaggaggtgtaataggttgtctgacaaagcatagacaggaaatgaaccctggcatccaaagcgaacctgctgcatctgcacttaattaatttttgcaggtgataaaagatttaaaggcaaaatatgttagaa

SEQ ID NO: 32757 - DNA, 1195 bp, Bovine  19866880831555
aggggatactgaggagctttggggatgtcatcttcagtctatccctataacacatggagagctccacagagctgttcctttctgcggttgtcccaccgtgttcaacagggaattcatgccaaaacacaatttaataagtgcagtttgaaaggatagccaaaaccacaccatctatgcacatagctttctgattggctaactttatccaggaataaatttccatgctatttagcagactaaataccctaggatgtatatccttcagtcaatatttttaaatattacttctcagaaaccaagttttgataacagtcaggtcatcaaggttatcctttgtcacatccaggagtgtagggattgcatatagctaatcctgattgacagcgtttccaattccatattggaaacctatgagattccagtctgaattgtctcccactccaactccaccaaaaagcataccaaggcaacatctttagtttagatagtgacaagattactttaaaaacagttctggttatactaaaaacacatacattgtataatgcagcccacataaccttagagtttaagctcttcaaaagtggggatctttatccattttctttattgctattttcccaacgaaatagtgtctggcatatagttgatatttaacaaaaaattggtaataattggctagcagagtgataaggaataaagcttttaagaatcattggtgattaaaaattgaacttatattattaacaatgcaaatatttatatgtaataaatggtagtatgcaacatttttagtgtctacaaataatgtcttctgaacatgtgaactcaagaatgtcttatactaacttagatgtcccccaggaacccatgatccattggttgggcagtactgaataaaagttttgtttttattattttggccttgaaatttgtctcaaaggatatctgaaaatacctaccaagttgctgagaaaatggtgtgattaagtacatgggatatgtactctgctgagctacatttcactcatggatccactgtgttctagcctggatgaccttaggaaatatactttacttctctgaagtttttgaaaaaagcataattacatctgtacatctaagtgttgtgaggacaaatgaaataatatatgtaaagagtttcacacatactaagagctgtataaagtgctcc

SEQ ID NO: 32758 - DNA, 1973 bp, Bovine  19866880843938
atcaattttctcaccatacagcagaggtatatacatgcaaatattattaatcctgtttgcctttttctacacaaaaacccagagaaggtagtatctcagttttaaaatatacatattttatatacactttcatccatttcctcaaggaagtatttctgcaagttccataatgttcatctgcttctatcctaaatagcttcaaagcacttctaattttcttgacttaatgatagcagacagtgatgagggaaaataattttttcccattattaattatggtattgattttaatgcctttaaaaatcatttaaaaaatcaatctacttcagcttttatgaacagttttaggtttacagaaaaattgtgcagaaagtacaccgagtttctatatattattcccttccccaggttctcccattattgacatcttgctttggtgtggcacgtttccaatatacttttaaaatatgttttgggtaaagtaaatattaaggattaggctacacttaatagatactgaaagcacattatttttaaaagaaatttttacctttatattaaaagtacacaaaagagacatatatacagttgtgactatatttttctacaaaagatataaataggacatacataatccttcccattttcatgatgttttataaaattctaagtctgctctgaagcttccttttaaaaatatatgcacacaacagtttattttctgaggccacatgggccttttacttcataatgtgctaattgctctgactctggcccaagctctttgcggggctgcttgcctctctctgcctgctacatctgtgtttacatgtataacgggatcactcagagccctgctgcagatcctttcagcttccttaaagactagacctcaaggaatctaacctaagtacaagtcacccagatcagttactctaaaaaccttaccctgattggatctccccttccactgacattttgatgcaaaatcacaggcaatctatcccctcaacaggatagttcagttcagttcagttgctcagtcgtgcccgactcttggtgaccccatgaatcacagcacgccagggcctccctgtccatcaccaactcctggagttcacccaaactcatgtccatcgagtcagtgatgccatccagccatctcatcctctgtctcatcctcatcctccccttctcctcctgcccccaatccctcccagcatcagcgtcttttccaatgagtcaactcttcacatgaggtggccaaagtactggagtttcagctttagcatcagtccttccaaagaacacccaggactgatctcctttaggatggactggttagatctcctcgcagtccaagggactctcaagagttttcaataccacagttcaaaagcatcaatccttcagcactcagctttcttcacagtccaactctcacatccatacatgaccacaggaaaaaccatagccttgactagacgaacctttgttggcaaagtaatgtctctgcttttgaatatgctatctaggttggtcataactttccttccaaggagtaagcatcttttaatttcatggctgcagtcaccatctgcagtgattctggagcccagaaaaataaagtctgacactgtttccactgtttccccatctatttcccatgaagtgatgggaccggatgccatgatcttagttttccagcgtttctcatgatatactctgcatgtaagttaaataaacaggatgacaatatacagccttaacgtactccttttcctattcgcaccccagtctgttgttccatgtccagttctaactgttgcttcctgacctgcatacagatttctcaagaggcagatcagggggtctgatattcccatccctttcagaattttccacggtttattgtgatccacacagtcaaaggctttggcatagtcaataaagcagaaatagatgtttttctg

SEQ ID NO: 32759 - DNA, 967 bp, Bovine  19866880870082
tactttatttacatttgctttatcgttctactgcctatgctgtgttggaatttgaacctgagacatctgatttacacttatcttcatgatactcaccaatggaatatgtttcagaagttgaattaactaatcaactcagatgaatgactagtttgagtaataagaattttgcttttgtttttattcttcctctctctctctttggtagtagttaatgcatactggtaatcagtttgcattgttactcttcaattaatttggaagatgcttaaaatagcctaatcattatatagagattaatctttaatcagatgccttttttaaaaagatataaccttttatgcaatcttaaaagactatatcctttagtaaaacaggttctaattagagacattgtcctgctgttcctaagtagtaataatttaggaacaattcatgggccaagggattatataaatttccccaaaattatagatactgatgataaaaatctagtgcagaaagaaaaacttttaatagttcaatgggaaaaaaagaaaaactatagcaagcaaatcattcacaagttaaaactaaagaagatactttagaaaagaatttgcatttacttccttttacaaatatgctatttttttctgaattctcgattaaaaaaacgggcatagtggtttacatatccaaatatgtatatcattttttttagataatcttgtgtaaaaaacccaagaaattcttcttcccattttagaggtgcagaaactgagtttcagatatgtctgaatcacttgctggaggtaccatagctagttagcaatggaacgagccatagaactctttattctgagtttcagtccagagctctttccactgcattacccaggccctcaatttgcagcagaagttttgccaaagtaacacagaaataaaaagtctagtcccaaaggtgcttcaatgctaaaatatgaga

SEQ ID NO: 32760 - DNA, 4605 bp, Bovine  19866880871716
tgcctgtgtgttggtcctggaggagctatgctggagttgcgtgcactttggtgcacagggccaggttctgcccgaggagcttagggggcagggagggcttcctggggtgttcaccaaacccatgtgtgcacagctctgaagtaagttctcaaagtcctctcccttcccacaatccagttgtaagataagtatcattctgaagttctcagatcactctgcatataaattaggtctggaaaaaatgtttaacttaatgatcctaattctaaatgttctccctgaatattttcttctctgaagtggcatcatcatatcactcactgacttctcagaagtgggctctggaaagaattcagtgttctctagcaggtccttgccacaaagagcaagcaagaattcgattagtcttcttcccaagccagtcttcatgactgtgacccacccttaggcaaaaaaaaaaagaaaaacttggagacacggtaccttgataccatttctaggacttaaatgatctcattaaattccaatgctagatatcatgttgacatttgaggaaatatgattattgacaagatgtaagcctgttatacactatatcacttcaaaaggagaagggccattaggccataattacatcagaaacagtatacacatttggctggtttataaactgtcactttcagaagtaccaagacatataaaagtctccaaaggttccattatggccctatttccaacagtattctctgacaaactaaataaattactgcatgtattggacctttgaggcttggggcaaagaatggaaaaattatttacaaaagcttgaaaatatttaatcactaaggcaggggggcaacggtgttttaattagcaggtcctcgggccattggctgactggaggctttctcaaacaacccaccaaatgcactgaatagctgtttgccagccttagggtcaggcctgagatgaaacagataagataattggctctaatgaaatccagaaggccttggctttcttgtttgagcttggatttgaaaagtgcgtgtggaagtgaggcttaattcaaaccagaactgagctaggcccgtttctcagtgactttgatattgtttgaagttctaaaagtgttcgccacaccactagcctgctgggctgggcctccctggtacccttaattactgagctttattgctgactttactacacaggaaaggggccattatatgttccatcaacatcagctcttctcagattggaggaaagggcagggttaaaggccactgtaggaaggcagaaacttcactttgaggtagtcagatcgtttaccagtgttgggtttcaccgttatgcgcatacattccttacaacacagaagcccgatttccattttttaaacaagtgattacttttcaaaacatttttgtttgtgcctgttttttgcagagaggacatttatttttaggggctgatatggttgcacctgatatattgaagggagaaaaaaaaaaaaaaaccgccacactccccaattaatcatcccaccagaaaagtctgggtggattctgtaataatgaggattattattaatgcccctttgaagtggaaataagtgaggaaccctcctatggtgtgaaagttgttttgacaccctgaggaataaagacccctcaggagactctacaaaattaaaccccagcttctagagtctctcacagaggggtgagacaaaagtgctctcaatctagttcgaagccaagaagcagaaactaggagatctccctcttaggggttggctgcagagtccccaaggcttctgtcctctccaagcttgctgctgctctgtagctttttgtctatttggtaaagacgtgttatgcatcttaacaaacttgttcaacccttagccctcgtgatagggggaatctagtcgtgctagaaagccaaaggacatggagttcaggcctgcttcctgtcccgcttatcacctcttgggtaggaaaggcatgagcgataccatctgagtgtgctctttttgaaataaaaacttgactgtttttccattatttatgttagtttgacatgaatgagttccaatctcacgcatgatgctggggaccattcagccggtgctcctgtctgagtgttcttatacacaggctccgctggacacactctccgcacgggtgagagaccatacggagagcctagggaatcagtattgagaagacgggactgtgagccttcacttcctaacctcctaagagaaatgaaagggaccttgacagacttgacttgtcagtgatgaacaagatgtcaactcagatcaaagggaggagagtcgtagggtattcagctaattcaaaatgtatgtttttattaagcagtgttattgactgaacgcctttgtcctcccacaccccccaatttcatgttgatgctctatgccccacccccttgtgatggtatttagagataggccctttggggaagtaattagggtttaaatgaggtccctagaccagggccctggtctgatgagattagtgtctttataagaagagacaccgtaggattttctgtctctctccccctggatgcgccaccaaggaaaggtgctctctgtgagcacttggcgagatggtggccctctgcaagccagagagagaactctcaacagaatgcaaccgagatggtaccctgacctcagactttcaggctccagaattgtaagataagtttttgctgtttaaaccactcagtctacggtattttgttatggtggccgaggcagagtactacaggggccccaaggatctggggaaacagttcaattatggctctaaatttgaggcatcagcaaaagtattttccacactactctctgctaaaactatacacagaagacattaataagcacttctcaccaataagtaatgtcgtttggtaaaaaaatctcctcttgataatttgcaaaagcatattaaagacttttagaattgcagtagtaaggaagtcttagattatttaacacgtttcttcaaattacttgagcgtgaaattctccactcccccagtttcttttcccccaaataactgtaaatattacagaaactagcattccacagtttgagaaatcctgatatacagggagcaaatttagctggcatgttagacagttcattgttagttaaataaacgtgagaatagaaaataagtatatcaatactttagattcaagcaatctaataaaaataactgtaatatattgcataatatacaataaaatattttattatcacatacactgaccacttgggtgagcgatattccacagactgtcttctccatttcctactggttgcttccagatggttcttagataacacatggttataaagacaaagaagggaaggagaaacaggaagatcaacaagagaggaaaaaggggaaagagggtcagtttcctttgatatcactgttaaatcatccagtgaattttcttagggtaacgttactgccattcaaaattatagcaaattggtgatattttacagtcattgtgtatattttgtttcagtgtaactatgtgagcatatttcccaaacttattagatgagatgtgacacacctaaacgcatggatttgttttttttaaaactcttacaattggcaactaattgcaaggtgaacatctaattggttttatgggtaaatccatttatggacttacagaatagtaaaaccctcattttgttattcatggctacattctgctgaggaggaaaaggggaaaattagtttgtctttatttcaataaggggagagtttcaattaagtaaatacccttcatgataagaaagcacaccctgaaataacacagtaagagtttaactacattacttctcctggttaaaaaagaaactggctctggggatcctatagtatcatgatgtggtaatgtcatcttgtttccaaagataatattactagacgtacacatgtcctgaactttagcaaaccactgctctggtcatcacatatttattcagatgataattacagttatcagggcaataaatcggcaaagaccttcatcattttcttaaaatgttcttttgttttactgcatgtttaaatgttcaatcagtgtctttaggttgtccacataggttgaattatataagtgaaagaaaacccaaataaaagcacaagcataagccaaaaaattatttatatcaaagcattcagaagtcataaatagcattatgacatacaagccttcatgacatttaaccgattcaaaaaaaaaaaaaaaaggagaaaatacttttcttgaataacagaacaatgtagctttccttggctgaactgatcctgattccaatatgccaagtatgggatgagcgtggggaatgtggtgtggctagaagacgcagtgatataggctcttgtgctgggagaggtagaagtgtgacatctctcatcccaaaatgactgttgagggaagttttccttagaataaacctgcagaatacttttcctccatgaatcatcaataactacttcccgggcccaacattaaaagaaggatctttcttc

SEQ ID NO: 32761 - DNA, 1516 bp, Bovine  19866880879696
tgtaagaaaaaatagttgagacttttctttaaatgagcttgtaaattccagtcaatcttacgttcacttcatttttttttccaaaaaattctcccatatgaaatatttaaaatcatattaattaaccagaaaagaaacagctattttaaactgcaatggctatcaccttactcatacgtttgacatgaatatgtgtgtgtgtgtgtgtgtgtgtggtgagagagagagagaaagttgtttactatcattcccaacagccattccattaaaatccttgaattggaaaataatcaaattaatgaagaaaaatattttacatgttctgttcttaaattggagaaggcaatggcaccccactccagtactcttgcctggaaaatcccgtggacggaggagcctggtaattatcttgtttgtttgtaccaaaagaaaagttttaattttagaaaacaaacgcagtccattaatttaaaagcagtatttttaataattggtcacccttcatcttccattacgtagccattttggcagataatgtaggaatgaaggattattaaggttagatgagactggttggtactcaagtctcacagtttaattagcatattgttctaagacaagacatgaaatcatttggagcctcagcttcttcatctgggaaatgggaaaaatgatatttacttctcaatttcacagagctgatgagagaatcaaataatatgacggctgtcaaagtatttcataagtggataactcttatgtaaacataaaatagtatttttcaaaagttttgaattactcttgatatttcagctttttctttgtgagaggatacattgatgacagatccatagttgctggaagttgtactttctaagttttaagggcaatttaaataagagacaagaagtttttttttgtaaaagtagtgtttgcattctgtcttttcactcagctgtgtccaactctttgtgacccaatggcctatatagtccatggaattctctgggccagaatactggagtgagtagcctttcccttctccaggggatcttcccaacctaggaagagaacccaggtctcctgcatttgcaggtggattctttaccagctgagccaggaaggaagcccaagaatactggagtgggtagcctatcccttctccagaggatcttcctgacccagaaatctaactaaggtctcctgcattgcaggtggattctttaccacctgagctacctgggaagcccttaacaaatgataggacacctgaattataaatttttaaaaatcagactgttttaaaccaatcaattggtcgatccaattgacccagttataaattttcagaaaaagtgcccataatcttatttcaaaacactccaggatgcttaaacttctcactctgttgacattttaaattactttgcagggaaaccttctgatacttattcttccatttgctaaagttccttaattcaaagctccctatggaattgctaacttataggcattg

SEQ ID NO: 32762 - DNA, 657 bp, Bovine  19866880911127
atgagtaggaagatttgtttccattacatattatttgttctatactttaaatattgaggtggttatacagcaataaaacactttacaagtaaatgctacatttgagactggaatttgtttcaggaagcattctttctcatctaagttatttttaaaatatcatcaggactttgactaaaagtatatagtagtatcagggatgaagagttcagcatggtttagaggagagacagttgtagacagagtctgaaggaatatgtagcaattttagtcagtatgagctaaatcacatacaagcaatggagtctggacagtccaaaaccaagaaccagatggaaagactggaaataggcagattcaattaccctggggcaggcaattaaaactacaaactagaaactgaaatattatccatcagaaaagcagatggacagcataaaagcctagaaagaagcaaattgtgcagtgggaacaccacaggcaggccaactaggcaacaagcccttggttgctgagcaaagaacattagtaataagtaggctcaccttttacttaatccaagagcttttaagtatttgcatggtttgtccacattcagaggtatgggcatgtgggcctgcatgatcagtcatgtccaactctttgtgaccccgtgga

SEQ ID NO: 32763 - DNA, 913 bp, Bovine  19866880919922
ggatggagtgattctgcttctgctgttcttaaaatgacactttggtcttatcctaaataataggcttttaataaaaacatccaccaaaggcagacaattaaacaatacataaagcaacagggggcaacctcgtggttcagttatagtctggagccattccaaaggagaacatgtgggtattttacaaggaacaatacacttttccaaagttattataaaacaacaaaattttaaagtgggcctaataagcccttcaaacttggtacaggatttcacatttggctctgacagtgggaggatctgtttacatcctaattttttcaaaagcatgtttagagaactatgtcaaacattatgcctatatatctatattagacatatcactgcttttttttagaagacatacaatatgctaatttgcttactttcaaaaaactgacactagtaaactaacaggtgtttactagtaaaactaactagtaactaactagtaaacttccctggtggttcagcagtaaagaatcggcctgccaatgcaggaaatgtgggttcaatccctgggttgggaagaacccctggagaagaaaatggcaattcattcctgtattcttgcctgggaaatcccatggacagaggagcctggcggactacagtccatgggatcgcaaaagagtaggacatgacttagcaactaatcaacaacaacaacaagaccatagtaacaggtgactgatccttctttcataattaaatattttccatttggatcctacatttgatttgtatcaattgcatatcctcaaataactaaactaaagggaatatattaagcttctgacagacttcagttttctgagtaatttacaatttaatcaaataactttaaactaaatcaattaaaacatgacatccc

SEQ ID NO: 32764 - DNA, 2309 bp, Bovine  19866880982200
agtcttctccacaccacagttcaaaagcatcaattctttggcgctcagctttcttcacagtccaactctcacatccatacatgactactggaaaaaccatagccttgattagatggacctttgttggcaaagtaatgtctctgatttgaatatgctatttaggttggtcataaccctccttccaaagataagtgtcttttaatttcatggctgcagtcaccatctgcagtgattttggagccccccaaaataaagtctgacaccatttccactgtttccccatctatttcccatgaagtaatgggaccagatgccatgatcttcattttctgaatgttgagctttaagccaactttttcactctactctttcactttcatcaagaggcttttgagttcctcttcactttctgccataagggtggtgtcatctgcatatctgaggttattgatatttctcccggcaatcttgattccagcttgtgattcttccagcccagcgtttctcatgaggtactctgcatatcgacctcttaaatgaaaagacagcacctagtggaactctgctgatagaaattcccaaggtgaaaaacacatggcaagtcctctgtggttctggtggcccaactacacatatgtggcccccagagcaggctttgattgcaaaataagaggctgaatcttggttttaggaactctacctgtaccacaggattaaaggtacagaaataggctctcaactgtttcctagcagcctgcccagataatatgttaaagagctgagcattgagcttccaattaggaaatacttccagaagtacagtttcaaatggagtcactgtgataggtgcagttattagtgatctcagttgagagactggaagtttgactacctctgagtcacaggctactaaaaaatgatgatattcaaattttcttgatcatgttgcacataaaaaggaaaagatgcattctttctcactacaatgcaatggacacatttttttcccacaagctatccattttaaaatgatggaacaatgaaaaacaattaaaaagtagtggctcttattttaaactgaatactgaaatttcaatctagtttctttataactacagttgccataaataaatgcagccttttggtgtgtcaatgtacattcatgtttgtatggtgtgtgccaagatgtatgcatgcatgtgtgcatcagtggatttgaaagttgttatacagtgagaaaaattctagggtaactgctcccaacattagacaactggaataagaatgtgctacataataaactaagtgttgccattttctacaatcactcacagaggtttttgattcactgcagtttctgtattactgagaaaaatggcagttaattacctctaacacctatgcaggaacagctgggggaaagaaaaggaccatgaaattagcactctgtgactgagttaaatataccatttagcttaacagaatcaactatcataagtcaaacttgggttataaagaattaatttcttttttttgccaaaacgcctttgttttgatccataaatcccttaatgcaccctgacttttattgattctgttcctgaaaagggtccactgccaaaagctgaactgcaagtaggtctttccaacagttttatgaataaaccagaacacacaataaccacttacttctatgattatagaaatggttttacattgtattctagtaacttgatggacgagtgtgcttattttttaacccccttctcatgggggaacattcagtttttgagaagttaaaaaaaatttcaaaagagtagtgtacagaaaaaatgatctttggttgaaaataattgtgttgtgtgttaaatcttaaacaactgtgaagtaccaaaacagaacgtagcttataaattacttaatacagcttcctacatttataggaaaccctgctatagaatcagcaaatttattgccaagctatgcagtcacatggttctccatttactcattccacagatatttatggagcacatgccatgtacatgacaacatgataggtgctggggatgcagagctgcgataaagactgacatgaatgatgtgcctgcataaattctaaatttccttccagagactacttccagtcactgtcatcatctgagttttccagtaaactagttaaaattggaaaataaggcatgcacgtgcatgtgtactaagtcacttccgttgtgtccgatcctgtgtgaccctgtggactgtagcctgccaggctcctctgtccacgggatctccaggcaagaata

SEQ ID NO: 32765 - DNA, 753 bp, Bovine  19866881005333
ttaagagatttcttatggaggatttattctttagcctgttatgatttcatttttatagaagcagctgtacttgttatcgcactctgccacatcatcagtcatctagctactgcagagaattccccccggcagaacaggacattcatgggtttatattactgccataaattctttcactgtaagtttttatacaaataatcccatgtctcttgtatacattacgccaattggttaataacatgatctctaccaggggatttctggaatgttctatcatttaaaacaatggtccagagtacattattacatacactaaaaatactccaaatgaaatcaggcactctgaggacatctatatgatgagaaaatacgttttcccttgatttttcaatttaacctggtgacttttcttttagctgaatgacatgaaaacaagtgttggaaaaagggatattataaggttagtatgttaaaaaaaaattaacaatagagtacattctcaaatgagaataagtttcaggccatgaaacttttcacagtttttttcttccattgctgttcagaatcccagcatttccatcatgccagttgttaagtagttgtcagattttcggccattagcaatttcttcacacaatagaagtgaagagtacttaagaacaccaattggtccattgactaaagcatgaatgtactaatctgattttcttttacctccttttatgtgtgaagaatacgataataggatctcaa

SEQ ID NO: 32766 - DNA, 2713 bp, Bovine  19866881027138
ttaatcacaaagtaaagatggataaaaaaaaaaaaagaggtgacaataataaaaagcctgaaagaacaggatcaatcccagaaggaaggaaaatgaggacgagaacatgaaaatagcttgacctctgcttgctgggaagcagaataaagtctctctgtggtcccctgagcacaaatcacgtcagccaagggtgaaagtcacctgaagaaacagatataagtcactgggtacgtttattttccctaccacaatccagaaggaggaccaaatacagtcaggatcccagaatccgtggctttgcccgcatgagtgatagcaggtcattttcagtgggccaactccagcactgtatttattcagtactgaaatgtagtgagagaacagaaaattggttgacttccagaattatgaaataaaacatttgatcacaaaattaaccaaatgaacaaatgtcttttgaggtttgctgtggtagctgcattttgcatcaagcctactttgggatatatagcattttcatcttatactacatcaatgtgcctcagtcaatgaacatcataaatgtcagaatacatatgatattgtatattatgaaatccccatcttttctctgaagcccaacagaaatccatacctggatccttaataaggaaatttgctctcaacacagaccatctagccagggagataagtctttaattttttttttttaattcccccaagctaatactaacacatacactgaagttctgttcatttaaattatgcaagttttctttgcagctgaggttgaaattggttatccaactagacataattaggttatattctctcagctctggattttgttgcttttcaataaatggttgataaaatggaatgggtccaccaactctatcaaaatctccaagtttggaaggaatacagtaagttaagtattctttgtctgccattgtgaattgcaaagtatagctctgaagcacaattttgaataagagctataaattaccatttcacaatggcaaaagtaacttcttgttttgtatagtaggagtaatgctgtaagatcagaagacctgtttatttgtcccctagatctggaactaactatactttttatattagacaagtcaaacctccctgttttttagattcttccagtgtaaaacaacgtaatgggctagatggcctctatgagtctttcctatgattttctgaatgttgaaaacaaatttagttcattcaaggcttctatttaaagaaaaatctagaggcaaaacatgtcttaccatgaagtcacagcatcaaatcatttttgagtaggcttcataattgctataataatgatagccacaactatcattatatagcatttatcaaatatctgcatgctcacatcaccatgctagactaaaaaatatatatgttaaaaaaaaaaaaaaaagcagatgtggtcctggctagactcttaggagcatagtgaataaaaagagaaaatgatttcccacattcaactgctccctcaaaggaattattcttcaggtttttccttcaacattattcatgatgtgtagtattctgtttacttttaagttacaaaagaataaccaagaacagaaccgacaaaattaagtcagtcagtgccacctgtagttggaacattgacacaaatcctaccactttttacaggaaaatttaatgaaaactgttcagaagaaaatcaatgaagccatcaaatattgggtacctgttagatatagttttcagaaacagagggtgtggagtataagatgaaaatcagtaccttagtgcatttatatccttaattccagaaattagtcatcatcttcttaaaatagttgtagtttatacacagaaatataagtgaacacaagacctaatggttggcataaacagaaaatagtctacaggctgagcatagaatgactgctatgatctttctgaagctcagctgtgccttgaatgaggtggggacatgggatatctttccatttatctgtatcttcttcaaattctttcatcagtgtcttacagtttttagctacagaacttttacctcttcagttaaatttatttccaagtgttttattattgttgatgcttttataaattggattattttcttaatttccttttcagataattcactgctagtatatagaaatgaaactgagtttgattttgtatcctgcaacatacatgaatttatttggtctagaagcttttgatgaagtctttagaattttctgtgtacaatatcatgtcatctgcaaacagagacagctttacttcttcctttatgatttggatgctttttatttttcttgcttaagtgctctagcaagacctttcagtgctaactagaataaaagtgatgaaagtgggcacctttgtcttgctcttgatggaaggaaaactttcagcatgtaaccattaagtatgatgttaactgtggacttgtcacagatggccgttattatgccatatgtggcataattatggtaaatttcttctattcccagtttgttgagagtttttattatcaaaggatgttgaattttgtcagataattcttctgtacctatttaattgattgtacgtttttctcctttaccttattaatgttgtgtatcacatttattgatttgatttatactgaccatcctttaagccttcaaataatgtacttgat

SEQ ID NO: 32767 - DNA, 1456 bp, Bovine  19866881066487
ctgtaaatgggagtaatacatgatgtagaggtcatgtgatggataatagaatttggtacagtgctcagtagagtaacaggcacgtagtagtagtagtttagttgctaagttgggtccaacgcttgtgacccatggactgtagcccgccaggctcctctgtcccggggatctcccaggcaagaatactggagtgggttgccatttccttctccaggggatcttcctgacccagggattgaacccatgattcctctattacaggtggtctcctgtattgtagggggattctttaatgactgagccactggggaagccaacaggcacatagttggtgcttaatcactgttagctatcaatattattatttaccctaaccagaaacttacattcaaatagcaactgcgttttaatttactttttcttctttggtgaattctcatagtattataaagggaatttacttgcaaataacattttagcgttttgaaagtggagcagctatatggcacagtaatttataattagtaatatttattcaacaaatatttgttaaacagctagtattcagagtttaattgtaggcactatcgaggtagaaaaataagaacacttttatttcaaataggttttattcactctacaactagaggaaggtctagttcagtagaaaacacaagacaaaaaggagagctttcatattctttgaaggagaatcatgacgttaacatcatcaacaataatctggaacacaccattggcttttccatttagtattttgaaatacaaaagaaaaggaataagaaggtgaatagtccatgagcatattcaacaatggtattgttattaggtattaatcctttattagataattatttttcacatctgggaaaacatcactggcagcacaattttaagaaaagtttggcaacatgtatttttctcagcagttctggatgacagattttagtgaatgctagccaaaaaaattaagggcaaaaccactggtgcacagaagacaacaaactgatcttattacagaaacagatagcagaccacaatataaaagacattttaattttacaccaagccagaaactccagattgattggcatacacatcaacaagcctggtcagtgtttaatcatgagagtgacaagtattgatttcctgcctgctctgcccaccttatttaaaaaatatcaggatatttgctttcaaatgacacaaactgccaaggctataatctacagaatgaccactcactgttaacagcatgcctgtttatgcccagtcgccactgaaaagacaattacatatcacccaactgtgcagctagacgttgacactgcttacccagaaagagtttaggaatcttacaatttaggaagagcatatgaagatccttaatctaaaaacagtctttgcatacccaaggaagtgccattcctcttcagat

SEQ ID NO: 32768 - DNA, 1066 bp, Bovine  19866881077076
ttttgtttaggctgaagagtttcaataagatgatttttataaaactctaaactggagccaatacctggtaaaagataacagggtatattaaaaccatgttagaagttttaaaaagtccttaaaaaccttgaatcaggaaacaaattgtgtgtctgtgtattgtgaagcctaccctcatttgccatacctttctttcagttcaggtcagttgctcaaccatgtctgactctttgcaaccccatgaactgcagcacaccaggcttccctatccatcaccaactcctggagcttgctcaaactcatgtccatcaagatggtgatgccacccaacaccctcatatccttccttatcctacttcctttcctgtaagtcaggccaccatctcctgtagccagaaggattggtgttctaactagcatcccttgtgtacagtttgcactctgccttaaaattccggattcattttttattccaaaatcaaaatgatctaaaatactattctgatcatggccagctctctgtctaatacctctccattggcctcaagatgaggtccaaatccttcaccatggttttaaatgcagcattgagtctgctggtgctgctgctgccaagtcgcttcagtcatgtccgactctgtgagactccatagacggcagcccaccaggctcccccgtccctgggattctccaggcaagaacactggagtgggttgccatatccttctccaatgcatgaaaggaaaagtgaaactgaagtcgctcagttgtgtctgactcttcacgaccccatggacttcagcccaccaggctcctccgcccatgggattttccaggcaagagtactggagtggggtgccattgccttctccgagcattgggtctatccctgttcaattaatgcatccctcacaaccctctccttcctacctcttacatttacccaccttatgctctagtattgtatgaagctttcatttatctcccagtctttgcaatgttttaaaactcttcctggaatattttccccctgcatctcataccagtcatctgctaacttctaaca

SEQ ID NO: 32769 - DNA, 832 bp, Bovine  19866881136414
aatccataaaagcatattgtcaacacttgctgtaaaatacatctggaatccaaccatatttcttcatttctacagccaccatccttgtccaactcaccatcatctctcacctggattattgtaatagtctcataatgggtgtccctgttcttctcaccctttgctatttttcactgcagcagccagtgattccaacagagtatcgtggtaatttacacatatttcagtaacttccccctcttgcttagagtaaaagccagtatgtttctaatggatcataagtaactacacaccatatctatgactttgtcccctgcttctctctgttttgctcactcaatagccttggccactttactttgtcatgaacctgccaatcacattcatgtcatggaacatttgtacttttagtccagtttgccaagactatgtcccacatatttacttgactcccttcatttccctcagatacactctttctattaagacttatttccctgttctttttttttttttttggatgtggtgttcttcattatatttttgacactcaaacaaactttctgtctagttcttttgattattgtctctgtccttcaattaaaacgtaagtgaaatgagcttagggatttctgtatttggtttattgtcatattcctgagcttgcctggcatatagtaagtatcaatactatgtgttgaatttatgattttcaaaataagtaaacatttttcccccctgtgagtgtatagttacggacccaaaaccccttacttctagacgtcaggaatttctccggcaaaaacaatttcaactcagtgttatctctcct

SEQ ID NO: 32770 - DNA, 2089 bp, Bovine  19866881215363
acatgtgtgtgggcacttttctttatcacaaccacatcatagtcatctccaaccagcaacagatacaatatgttgaggcatagggtgtagctcccctaccctcccgtaactttttaaaaagtgtcaaatgtgagaactttggagtcctttttctttaagcgataaactcagttacatatcaatgtcaataaagtgttctaaaggacagaaacaaaggtggcagaaatacaggaaattatgtcctatgagggaaagtgtaagacataaaagtagcctagcttagaaaacaattgattatgggtcatattggaaaattttatatagtttaaaattccatttgacgtccaggaaagtttggttaaaaaatgtggatttgagttagaataatcaaaaatattagcatcttaaaacggtaatgttttaccaagaacactgagaagggtaatctttcatttgaggttacaagaaagttggcaaatgttttaaaaattgagactttattgtttttcccttgactatccatatgtctgagtttgcctggggaagtgatattgagcagattggaggtgtttttttggttgttattttattttattagacttttagtctctgaaatattcagggaacatacatattaatatgaatttaaaataatatgagttacagaggtaggtaaggccaatgaagatgttgagaactttgtagaagaaatgaataaaggatgtcgataggtcttaatttcccaaacttgcaaaacttctgcaggaaccagctttccgtgctttgggtttcttcatttttattttcttttattatgttttttactacttgttctccatttatacaaaaatgtttcagtcagtgcagattacaaaatcaagcatgatttatatttacaacttcagaggcaaacctgactgtttcatggggtgggtcaaaccaaacattttttagagtcatctagcctatttaatttgaaaagtagttgacaatggcatgtttttgtgtaagttaatgatgtgagaaatatgcattgcatcttgggctatttcaacattcagaaaggttctccaccaacagaatttctaatatttttttttacccctttcatgacacatttagttgcaccaaataattcaagttcagttatgtactgttcaagtgcctggatatttcaaataagacattcttaaagagtttctttgccactagggatggttgggcaattggagcaaaatcttgtcagcttttttttcaaagaaaaatcttgaatgttttccttacttagttgaggcacaaaaggaaagcaagatggcctctgggcaatgttctacaaactatgacctgctaaggacctcagttttcaagtttattttgtccctttctttcctttgttttccccacagccacttgctaggccagttattccaggattctagcagagaaaagaaaccttgagagatggttgccatgaatatatttgtatttgttgtaactacccttttagataggtaaaaaacagaggcatatataaaagagcaataggagcatagagcactgaagaatttctgtatcccccaggcctctgcctgtagcatttataaaaactgagagccactgtctgtccatatgtttagagatgggatagaatgaaaacaccacagcttaggaaacctagaaaacttgattctggtctcgttgtggccgctaatgctgtatccttagtttggtgcattatggtttcctcagctgtaaaatggatactgtcagctcgactctaagcttctttcttattgtataaatttttgttgactgaaggtgtgacaaagccagacattatctggtcagtgtcctgtgtgtgtgtttgtctgtgtttggtcccactctggtggaccccatggactgtagcccaccaggttgctctgtctataggattctccaggcaagaacactggactggttgccattcccttcgtcagaggatctttctgatccagggatcgaacccacatttcctgtgtctccagtactggcaggcagattctttaccactgagccacctggggcgtgctctgtatcgtctaatgaa

SEQ ID NO: 32771 - DNA, 1466 bp, Bovine  19866881279244
actttggccacctcatgcgaagagttgactcattggaaaagactctgatggtgggagggattgggggcaggaggaggaggggatgacagaggatgagatggctggatggcatcactgactcgatggacgtgagtctgagtgaactccgggagttggtgatggaccaggaggcctggagtgctgcgattcatggggtcacaaagagtcggacacgactgagcaactgaactgaactgaaagtgaagcatatcagtgaaagtgccagaatcttataaggatgttctttgatctctgtataaaagagcagagataaaaatataaaaaatgactatgatgtcatctatgtgaaagatcagaaaaaagagaattccagccacttagaaactggaacactggtcttaaagaggtgctacactattaagtttccttcacttcattgtacattttcacttgtaagactttataaaaatatgtgtgaataatccacaggtatgttgaataaatacaaaaaccttaataaaagaaataaagacatctatcttgtaatagcctgcagattgtctccaattaggcaaatcctctcattacaattctattctttataatctgttatacagtaacttagaaattgttatcaaaacaggtctcctcctgttttggaaacataatacttcatattttaactttcttctagaactttaattgtcagcaatttttcactaaatcaactgcaaatgatattagaaaaaaatttatacaggaatttcaggcagaataagcattttaatcagttattcacttctcctttcaatgacaacataactaggggatgtggcttccaaatgttttagtcttatgtcctcaatgtgaagctacttcatgttgaggaaagccaaacaaacaagcacctaacacattaaggtgcagaaatgttttttaagaaactatttcacaacctgtttgctctaactctcacatggaattgacaatattaaacaatggttacaaaacagaaattgtttctcatacttccccatttgcaaaccttttccacacattaaagtctttgttgcttagtatcattgattttttcccctccatccaccttggcagtgaccccataagcaatctgaagatccattactagtgtttttctaattgatactcagtttcacaattaggcttagaaaatcatgaataaaaaagttataattctctacaaactccaagtgatatttaacacagaatcctgtggaaaaaagtatttgttttcttgttatataaataacttgagaactaaaaatgcaatgtattacataaacaaagatggcttggcttaagagcaattattttctaagaacacattgcatcttgtataaattctttgatggccaccagtctgtcagtcttgggtgggttgcattccactgctgatgtatttaagttttttatttaattcaaatatg

SEQ ID NO: 32772 - DNA, 1174 bp, Bovine  19866881296193
acagatgaatggataaagaagtcatggtacatatacacaatgggatattactcagccatagaaagaaactcatttgagtcagttctaatgaggtggatgaacctaaaacctattatacagagtgaagtgagtcagaaagagaaggataaatactgtattcaaacacatgtgtatggaatctagaaaaatgggactgaagagtttatttacagggcaacagtggagaagcagacatagagaatagacttatggacacggggagcggggaggagagcgggagatgtatcaaaagagtaacatgggaacttacattaccatatgtaaaatagatagccaacaggaatttgctgtatggcttaggaaactcaatcaggggctctgtatcaacctagagtggtgggatggggagggagatgggagggagtttaaaaaggaaggagatatatgtatacctatggctgattcatattgaggtttgacagaaaacagcaaaattctgtaaaacaagtaagtatccttcaataaaaaataaattaattaaaaaaatttgaatgtaatgaataaagtggctatgaatatcttagaatatgaggtattgaaatatttttatataatcattcattttgggtgattagtattttttcagggttccttgcacaaacatgtgaatactcacccaaaatatgcattttgctgtcagaatcttgcttggtgatctggcctgcaagcaaccaaatttgaaagacactggactgtaacaaaatatgatgggatagaggatgaacaggaacttcctttagtgtcctaaagacattgtgtttagatttctttcctttcttgttcatgatctcataaatatataggtaattttatttactaatacattctaattttaaattctaatttatggtcctttttaatggatgaattaccttgtatttccaattgcttactaaggcaagaattggtaaaatatttcatttgtcctggtttctccttgagttaataagtaccaaagcatatctaataattacctacagctattgagactgcagtttatttgctattgaaatcctggttgcaaatttatatttgctgattttgcttcttaattattgtcttaattcttaattattgtctcttatgatgtactaaatttttgccattataaaaa

SEQ ID NO: 32773 - DNA, 1195 bp, Bovine  19866881298518
gtatttttcttttcagcttttgatgggaatgtaaaattttcaagcttccttgaaacaagtgaatgagtgaactataagctgaaaactagaagtcctctttatctttggatgtgaaataattgttcttcttttccttttcagtttcttctttgtggcatatgtggaatattgtgcgccaaaaaaaaatctggacttgtcgtaagtttttgccatgtttgtattgtgcactgaactgtttgaaatgtaagaactcaaaaagggaaataaggactagccaactttcatatcctgagtgttgctcatctaggataaaaagaagactgacaaataaattctttttttcttttcaaagaaaaccatcaagattattacagactgtgacaaaagaaaaagaaaagctttgatatactctttaaatacatgaatctgcaacctttaatgactgctgtggatggaagtctccacttttcatttatagacttccagacacaggaatccttcatcgagctaaaaaagacagagcttgaattcatgggaaatttaactgtttagatatggacgtgagcctaaagattgctggctttgactgtgaagttcattgtgcaaagcagcaaaacagctgtgttgttatagttgcagttaattcccaaagattttttaaatttaattttatcttctgactatgaatgcaaatgtcagaattctcagaagctttatggtactgtcttgcgtcttggggggtgctcccaggtcactctcatgtagactagagaaggattccagcatgctgaagtatggattccccctgtctttcatgacatttttttgagaattagaaagtagaaaaaaatcaattattttattgaggactataggaaataacataggcttttataagttggcaaaattaatattgtacatggaccctagaaagtagtctttgagactaaaaaaaggagaaggccagggaagggggactatgcagtcctttgtttaactcctttttctaattatagctctcttagtgatggtacctattgtaacagaaaggatgaagcccccattgcttcagaaatgtgaggtgtgatttttaaacattatcttaaggaaatgtttagatagacattttttggaggcttgtaatttgcatttgtgattcccccatcactctttcccatggttttcttactttcta

SEQ ID NO: 32774 - DNA, 1323 bp, Bovine  19866881300794
aggatggatatccttgattattgatacctctccctttgaatgtatttaaacaaatatatcattttgtgtcttcctgattgggcttataatatttaatgattatttgagatgcattatttagctttattttttaaggctaagatttatgggtaggaacaatttaatctagtatctcacactgttttgagaacatgggagcttgcacagttgatcaggtggctttctcagtctcttctggaaaacaaacagtgatcaggacttggcctttatgccatcctgcctggctcacagattgagagttgggagcaaataatgaggtcaggcctcagtgaatgactttttcattttatgaaaatttcccatgtttcacacaaagaaattttctctattgattatgaaataagactgccctggctttaaatactaactcagctgattaaataatggtgtaccatcctagttaagctctttttcctacataaattttacaaaacaaaacattgttcatgaagttgttaatattagaaataaaatgtatatgaaagcatatggaccatagttaactattaataaatcatgcctagtattatttctgcaggacaagtagctcaaggctccctgtcctccatggtactatgcttaaccactgattttatttctgccttattttttcccagtatttaataacagatcatgaactcatggaagtttcaattgcttcttgagttgcattactgctaaaaatcatggtcactaattaacatgagagttagttatgctttaaaagctatttgggtagttcagacaaaaccatacaaatttccaagttattgagtatctttgtcaaaagtgttaattttcacttttattctgactttataacaataacattattttacatatgtgttttgaggacttcatggtacaaaagtagttatcatatcctccctgtttgacatgcctaatttagataactgtctaatttatctgattatcaaatatctttatcatagagcttccactaccctctccacctccaacagaaaaacagacagagacaagtgtcttacaatggcagcagttcccccattcagttttaagctgaatatctacatgacttttccaaatatattttagtatatttttgtagttgctaatgtataatgtatataatgtaagtaaaaaactaactagatgctatacatgaacatgcggggtctgtagctaagttggtaaagaatctgcctgttatgtaggagacccaggttcaatccctgagacaggaagatcccctggagaaggaaatggcaacccactccagta

SEQ ID NO: 32775 - DNA, 2507 bp, Bovine  19866881323301
aggggcagtatcgtgtcccttagaaatcggattttcttgtcgagattaggattcaaaccctagctccactgttacttcagctgtaggaccattggtcagttccttctcttggctttagttttcttataaaatatagaaataaaactctctctctcccccctactgcctccatctcacactgccactgggattgtttaagggcttcagtgagaaaacacatgtgaaatatggagctcattgcctgctgcagtgggtcatcaatgaatgttggccaacatgcctgtgtgtgaaacaaggtaaggatgctgaagtggattgtctgctatcaactcagcattacacccacaccctcctaaggtctgggaaattgcatcccccaaactcccctttcctatttcatcctggatagaatttccctttgagagaaagttacatgaggtttggacagcagaagagaagttaaggtcattattttctgatgtggtggcaaccagacctgtaggcaggcatgagaatcacagcagcatctcaagcgagcacgtgagagccatccaaatcattgctgcagatggcagacgtcttcacaaacttccctagcttagcttcagtacccttgattttccatggcaattctctgatcttccctccccaatttctaagtgaaatatagagactatttggggggtaagtatagtaggcttaatttccccaagtgatcccaggctgacaaggctagttgtggtcaggttcagagagctgcctgagagtggaactcacctggagtagggcaactgctcctgtcctcctttgagagggcttacgtgtagatgatttgaataattctcctagactgtggcaccagtgcagtgctgggcacattgcaggaactccatagacatttactggaaagcagcatgcctgtatgactacttctgtttgcccacaccattcattccccttcatctcaaatacattctttcttcctctccccccactgtatgtttaaacaagagccacaatcatcttagaccctactcttctgatcacatttcatggtttctaggttcacctggctaatcaaagtctttctgaagagattgtcaagtgaaaacaaatagaagagcctcttactgtatcatcatagcccggaagctagctgtagccattgtttcaacacggtggaggaaatctgtctgaaagactgtgatgaacatggaaatagcagacctgagagatggtgatagaatcctcctgcagtagtctccaatgagtggcacaatccttaccattgcagtttggtcatgaaggataatccatcacctttcttgcctaatcaagtttgagttgagtctctgtcatcacactgaaagagtaatgtctgatgtctttgcttgtaccccaggagtttatgatgcccctactcctgccttcactgctggttacatccttaaccatctgcttttgggtggagaaaatgatagaggcaaaagttaaagaactgaattaggagagaaaatatggacacctatacagggaaggcaggaagagtgctcctgagtggtcttcaaaggcttagatgtgaggcatcaaaattactattaatttttacaaagtgtttaaaataaaaacatcctattctgggtaaaagagccaagggctaatgttaggacaacccttcaatttcacatagtgattagtcacctcatcctctgcgttcatgctaacttataatcctgttgagtcacatgcttacctcgttatatcacaatttataatcctgttgagtcacatgcttacctcattatttcacaatttatctacctagtagtcattgcgcttcattaccctgtaatctttaggaaagcagaggtcttattttatctatattcacatgttcaggatctaggatatagcttaccccacagttggtggttaataattttatgttcaatgaataaaatgtgttcacacaaagtatataaccaagcagtatctctgttttgacacaatttttaaaaaggcaccaaatggaacattcattaaagaagtattggacacattgtagtttaatgaaataaggaatttggacacttcctggacattttgattatgtgaggaaaaatatatatgcatatacatatgtgtatgtatgaggtgatttcttggtgtctcttccttatcgccttctctttctcctttctgagtaccaggtcatatgctatcagagctagagataataagatgtagaagctctcagttcttaccctgatgataaaacctagcagtagaaatagacacactggcatcaatctatctagctgtctatctaacatgcttaagagttatgttaaattgttaaatttaatgacttaaaagtggaacaaatatattgaaaagagtactcaaagtgactactttggaataagagtaatagtgataacaatagtgtctaatatctgtagtgtttaccaagtgccacgaactctacaattacataaggggccata

SEQ ID NO: 32776 - DNA, 847 bp, Bovine  19866881333388
ttaaaaaataggaaatgttaatgaaaaccaagctttgaggtattcaaggaagtcacaggtcatgattttacactgaaaaaatcagcatctgcatttcttgcattgaatgaacgtgtgtagctaaatcgttttgaatgtcattgaatgcagagtagtttaaattactttttctttttcatgtttatggtctcaggaattgagaatgcatttttttcactggacacattagacgttaattgatctaccttcattgtttctcagtagctatcctgtgtactacaggtttcagtaatagaatttgcacttccaatgtactggaccagaactgctaactctgaagcaatgttctttcttctctaacaagtcacaggtcctcatgagtggtatgtgacccattttcaccatcagtaaccaaatgactttttgtacaaaaggaatatcctttataactaaaaatcaaaatcttgtgacacattgtgaaaattatatggcctgacattgggttttactatgctttaggttattcgtgaggaacaaagaagatcatgctcaagactgaaaaggaaaacacttaaggaggtctgggcagttttaacagcatgagtgaaatacaacaccaaacaggatgtctttattccctttgaacttgaggcatcccatggaccctaagctactgaattctctagttagttatgtggtgccagactttcagtggcacttaatgaagataagtttctacctcatacttttaaatgcaatggtggatgaatcctgcctggccaaactgagtgttttatcaaagtctttttgcaaagcggagaaaatgtacacatttttcttaggtctt

SEQ ID NO: 32777 - DNA, 1893 bp, Bovine  19866881337917
tgggaaaagaagtaatattttgtctaacagaaagtaaacttgagatggagtgggtgggtagagtcagtttcaatgataaacacctttggtttaatcagatttgtcaaatggcaaatgttacttcatggttctttgctttaagtttttacagtgaaatgatagcaattgaaaaagtggagtataagtaaaaaataagaatgaatgtttacttttagagttaggttaaaatacttccaaatattataattactgcttagctttgtatattaatgttaatatcaatttctgtgattctcccaggtgaccacaaatggatgattcaccacatatcctaataagtacttcagagaaaatggatagctcttctttcagatgtcctaaaaatagggaaacaagagtcaaggaaggagatgaatgaattccctttttaaaatcttttttaaaaactggaaataaatcttgcatttatgttagatcaactcaaatttaaagttcttagtatatctagaaaagccactattaattctgtattcaaaacatacatagtacaaatttttatatactcccacatatattctttgtttttcctccagaaagcttaaaaaatttaaaatgtgatagtatatatcaacttaattagtaaaaataccttaaattatatatttatgaatatttattcttaattgtatatgaagactttatatccatgttaaatgtggttgtttcaagaatgtatatttttagtacattatttttttctctttgctaaacatttgtcttagttgtttcatttattcttaaagaaataatatttattaaaaatttaccctgtgttcctatttaaatctcaaaacattcttgtgagtggagtaaattaatagatgaggaaactgagaatcacatgccagaaaaaagcccatttactttactgctgcccaaactgttttatccagtgtaattaacattcactgaatgcttactgtgtcacatatattcagtgttttttgtaatagcattgaaaagagcaagaaaattggtgatacaactatataaaagaaatgaaaatttcattaaatttccctcccatataactgcaaaagcaattttgccagagttttgaggttagaattgtatgatatgaaggctttaaaaagtgtgacctgttttttcttttttcctccatagaattgtaacacagaggcagacatagaacacatacaagaagtatttgttgtctaaattacatatgattatattcacaggaagatttggacaaaaatctatcaggagagtagatatcatttcgggtgtttgttattgtcccttttatcactaacgtccttaatgtcaacattcaattaaaagtacctaatgttgagaattacaaagtagattaaatttttagacatcctaaaaatccccttagaaattgctttctgaattgcagtcatttgcatttctctcattatttctttttttaaaaaaatcagttaattataatttctggtacatcaagttccagataatcaagttcttcaataaccatttctgctttatttcatttgccctttaatgaaacataattttcaacctcttttactttcaaagcactgatcttaagcagtagttttcagttctttcatcagaacccaaactctgatagactataacatcctcatcagacagaatgtatttataagggggtttctgtgccattaaaattattctgccattttggaagttataatttccccagtttaaaattcggcccatgcttaactaaatgcattctaacttctttttatgattatatatatgttcatctcttctaagaaactattagattaaaccccagcagttccacacagccatacacactgctttgcaattggg

SEQ ID NO: 32778 - DNA, 748 bp, Bovine  19866881365145
accctgattttatccctgctagaatgtattctaggtattccctgctgctttacatttctggctcccaagccaaactccactgcaggtgcttctgattagagcttagctttatgcaggcatcatagcttcaaaggtctgagcaagcaggtatctgatgtctatggtgggggaaaaaatgtcaaacagctattgcatttgtcaaggtccctattacagaatgactccctaaattgaatgcatcattccatatggcttatgcagtattcagtatgcagcacaattaaccctcttcatctggacagaatacataattatgttaaagcatatactaagattatatgaacatttttaagatccacatcaaagggctggtttataattaagcttgcagttagctataatcctaaaacattcaccttttattgctgtttagccatgtgttctccatcctgtatttgtacaattgtgttttgatttttaaatccaaatacagaactttatatttagccctgttaaatatcactttgtttgctttggcccatatttccaactttttgcaatgccttggaatacggtttctgtcattcaatacagtaactccacagtttttgtgtcatacacagattggataaacatgcttttgtttacattcacatctctgataaaatgttgaaaagagtataaactgctatgaataccacaaagtattttcatctaaggtggcatctaaccgttaattaatatgtta

SEQ ID NO: 32779 - DNA, 1392 bp, Bovine  19866881371556
cacttgatttttttgtttgcttctcctcattcttattttgttaactttgatacagtactgcttttactgctttgctcaacatgctgcagagtggtcattaagaagttatgtagaaactatgtgcagtggtgggagagcaagtacttaagtctcgttccaagcattctggaggttaggaaacttgccttacaggtagatctgaggactagcagatctatatggactaacatgtccacttaatccatgtgcagagtttcagataaagtggaaaatgaaatccagtggcaaaagcattgacttagaaataaggatgcctgagccatatagacttggatattactgctgtgtggtcttgaaaaagtcttatattttctggcctcactttcatcctctgtaaaatggaaaggcttagttaaatggtttcattagggtcccttccattgtaaaatgtattctgttattttagaatacaaccttagtcagagagttgaacatctgttcactaacctatttggtggattaggaacttacttaaatcagtttataaaatgtgcattaatagtgtcagacaggactccctaaggatatctgttttattaatttttaagaatactggaattgccatgcagtgtgagtaccaaaaattccaggactcattaatagaatgtatattttgaaacaccactgcgaatagtgtgtaactattctcagtatctataagaatcaaactttcctgaagccatttaaactcggtttcttgttctgaatttcgcagaagataaggagagttacatgtcaatttctcttatataacaaccatctgttattattgatagcctcctcacattatttgaattcacaccgctggctctctcttctctataataaataatcttttaaaattttacttgccaatttaagggattttcagtgaagctaaatgatgtaaaatgaatgttttgagtaattgttacttagtgaactttgttatatcacagggcataaaacagaaatatgatctccttaattttgattctattttctacatgttccataacttcctccatcaatacaaccaaagcagctgaaagttagaaaactgtggtacttgtcttcaaatccctttgcacttaggtagtgggtgtgaaaacagaaatgtaagaaacagaacatgtgtgatatatgaatcaaagtgtagaggctatttggtgtgaaacaatgtgatccttgtagctcctgctaatgcatcattcagcaaatgcctgaagaagacagagctttcaatggcaaaaacagtctcctggaaataaacccttcattcattccctggcatgaaacgttattggatgaaaacaaaggaatatctttatcttatggacttcatatagatgt

SEQ ID NO: 32780 - DNA, 631 bp, Bovine  19866881599483
taatttttcttctttttgataaccgactgtttacaatggagaatgtattttttccttttttattaaaatagttttttcattatttacatatttagacatttttgaaatgggtatgtgattgaacttgagaaaacccaaattaaattttaatagatgaataaatgaacacttagatccaactttgaaataaaaaatgatttgttgtcatctaaaaatcatactcaatactgcagaattgatttggggtcttattttgtctataagaactgtggttgatgcttcacggtcttcaaatggattttcaattgctaatgacaaccaaatatattatgctcatgatagtatgtattttcccaaggatgttgaagacattttgggaaagagggtggaatttcttgaaacaatttgccaatatgaaatactgtacatatcaaattggccctactaccatctttcccagaccatttatcatagctcacaaatcaagcccacattttctttttctgaaagacttggctaataaagaagatgtggacttcaaatctgaacttgtcagtcaatcttgggaacaaagcagtaatgattttcatctattgatattttatttcagtgaagagcaatacatacgaaa

SEQ ID NO: 32781 - DNA, 1983 bp, Bovine  19866881648501
ttgtgtgtcaagtctaagaatttattgtcaaactctgtaactttgggtttgtctctttttttctttcggctttgtttttcctgccatattttgcaactctattgtccggtacatacatatttaagattgctatgtctttgtggattggaatgtctctgtttctggtaatattttctgctctcaagtatattgatactagtgcagtcactcctgcttttctttcattaatgtttccatgatatatctctttccatctttttatcttctatctgcttatctcattatatttgaagtgattttttgttgtcagcatatagttgggtcatattttttaatccaatatgccaacctccattgtttaactggtatatttagactatattttgtttattactgataggacatggctttagcttgccattttgtttttgtttgcttcttctgttcttttgtttctctgttttcttcccaagtcctcctgtgggttacttgaatacattttagaattcaatttggatatacctatagtattttgagtacgcctgtttgtacacatttcctgatggctgtgtgtgtgtgtaaaatcacatagcttattgattccctcattttaccagctcaaatgaagtataaaaacattagtttttatactaaaaactactttactttccattaccctcatccacttataattctcttaaatattttctctctatatatttagaatagctttaaaatttttgctttaatcatcaaatataattttgaaaactcaaaggctattgtatttactcatattttttcttattatgttcttccttcctgatatactaagggttccttcttattttgtttcctttctgtttacagaattcctttagccattcttttggagtaggtctccttggacaaattctgttagttttccttcctcttttttccccttcattcctgaaagacatacttactagctgtagtgttgagctgacaactctttttcctattacacccaaaaatactatgctgcttcctttttcctgtctgcacagattctgataagaaacctgtcactcgaattactttttctcctatacatgagagattgtatctctatgatggctttcaacattgtctttaactttcagtagtttaattttgatgtgctttgtcattgatttctttgggacttattcagtgtcctaaatctgtaggcttctatatattgccaaatttaggaagttttcagccattattgctttgagtatttttttaagccaacatgtccttctttctctccttctaggactccaatgactagaatattagttcttttgttataatttccttggttcctaaagctctgttcatttatgtttagtttatttaatctcagaatgagtaatttcaaatgtagctgttcttttctttgcctcctctgttctgccattgagcccacccactggcctttcattttggttattgtatttttcagttctaaaattactgtttgtttcttctttatatcatctatttctttgctgagactgtccaattttttatttgcttcaagtatggttttagttgctcactagagtaatttttatgatgattcttttaagatttttgttaaataattctaacacctaagtcattttggtaattgcctcttttcgttcagtaggagattttcagtaagcagtataagtgatttttctgttgcgcaggacatttttattttatgacctgagactctggatattacttaaaccttatgctttagctagctttctctgaaactgctctggcaggggaaggggagaacagcatcattattgttagatggtggtagtacaagcctacattcccacttatcctccactgacacaagaaagaaagctcctcattactgctgagggtggggtgctttagctgttttgaaagtcttgactgttccctagggattctctgataccagcctaggga

SEQ ID NO: 32782 - DNA, 812 bp, Bovine  19866881686357
taagacctagtacaaaataatagtatgagattataatagtaactgaaacagtatgatattataataacagtaagataatagtagtgatcaagactcgagcatagataatactgaaagaaaaagactgttatcaacaaatgccccatgataataccacttttgtcataatgctcatatcttactacagcagattctcattcactcaatagtggatctaatagtcccaatatcttttggtgtatacatacatgtattcaattatatgtatgaagtttcaaaaacttaggacgagcaatgtacatataataactattattaaaatgtctaggttcttcacatagatgatttttaactttggccatattcttcttcctctaattgtaaattttatttttgtatttaattctaattctccatggccatacactctaataagaatagctaccaacaattaaactggtcaagtcagttaaaactaggcaactgaatcaaaacttcaagcgaagaaattaaattatatagcattatgtagaaagaacaccaactcaactgcctggacttttcatttcataagttcgtgtgtgtgtgtgtgtgaaattttctgctatataaaattatgaaggtgtaaaatacttatgttctccaagtgtgtatgatatgtgtgatttgaacactgctgtcaaaaagccaaacagtgtcttttgcagaaattgaaacaaaagaaacatctgcattatatgtaaatcagcaggtatcaaatttaatactatcaaaagataaaaaacaaacataaatagtaggaagattgtttc

SEQ ID NO: 32783 - DNA, 1580 bp, Bovine  19866881730557
cagaaagattccctggaggagggaatggcaacccactccagtattcttgcctggagaattccatggtcagaggagcatggtgggctgcagttcagggggtcacaaagagtcagacacgactgagtgactaagcacagcacataagttttatacatttctgccattcgttaactttatataccatccaaacatatcttggaaaagatcacatatttttctcaacttcaggttcttcttatgtaaaatagactggttttgtgaactgaaacatgtttaatatttctttattactttaaaccaatgtgaataagttattaagtcaatgtttgtattaataagtttccttccacttatgtttgataaaacctcctgtctattcttacctaactctgtcatcatcctgttttggtcagctacacaataagtactttgaaaattataaggctgaacagaggaaacttctctatgtagtaattatgtaaatatagtctttattctaaagggaaatcaaaggacttttaggaaggcagaaggacatccaaataatgtccaagatatcattagtaattatcataaagctacatgagagaataactgatagaaataaattcattccatgagaagattaattaattgaagggagaaagttttttttttttttttttaaagtcactcctagctaaagagcagtatttctgttgtaaattgaaaaacaatcctgtaaattaattggtagctgctgccaccaagtggtaggaaaatatttcttcaaagataaggatccaatagcctttagggggaaaagcttccttatcacaatttagtaattaactgtggacctgaatttatttcatcccttcctattgcataataaccacccagaacctgatcttcattagatgctcatctgtctttgatttatattaccacactaccaaagtatctttctgttcaaagagaaaacttaaggcttattttgatgtctgtcccaggagctttctccaatacagaaagaaaaaagaaatataaatacaatgaacacggagagagttgggataaaatcacaatgggaaaatcctaatgtagttcagaaagatggatgcttgaactttgccacttaccagatacaggatgtgaaaaaaattggtcataggatttgttttcttaattgactatgaggattcaattacatgatatatatgtaaaatgtttagcctagagcctgatatcctccagtgctcaataaatgataaccagttctttttattactatgactgttatactacattatcagatcagttgctcagtcatgtccgactctttgcgaccccatgaattgcagcatgccaggccgcacataaatgttgtatatagtcatacaattatgactatatacaacatttatgggcttccctggcagttcagatggtaaagaattttcctgcaatgcaggagtcctgactttgaccccttggttgggaagatcccctggagaagggaatggcaacccactccagttattgttgcctgaaaaattccatggacagaaaagcctggggggctactctccatgggatcc

SEQ ID NO: 32784 - DNA, 1213 bp, Bovine  19866881865683
aagtagaagataaacctgtttccatttttaattcttactgaagcagaaaatcacttttatcttttttaaaaaagagagaaaacaatattttttattgaaggtattttagttttaattggtaggattctattttttcttttctactgaagtatagttgatttacaattattcaaggtattctaaagcttatacacattccaattgttggtgtttttggaaaagacaagaatcgtgcctattgtaattatgagtatttcagtctcagacattcagcagaatctctgttcccaattgtagccagcattactctgattctagatcctttgccagttgcataaaggtcatgtggaggtgagcagagtatgaggtatctggctctaattccacttgaaacattaaagtgactccagattgataaaatagagagcgggaagagcgtgttggactacaaagaccgcaaacccgagtgagccaattggtacattcttgactaacagtggctgacaatgaaagggagaagagacctgaggaatgaataaaagcttcattttagtttaagatgtagctaagacttacgcgagaatttggtagaaacatgactgaaggcacgagagtaaacagttggcaagaaagacaaaaaagctgttcatgtttcctgcaaggatatgaaaactcatccttttcagggtcaaatactggaacttggtgagatagaggtaaaaaaggaaattaagaaagttaaaaacaaactctatggctgtcttcagaaggcacaggagaggacattctactggaggtctatttctaagagtggcaagagaaagatcatataataaagttaagaaaggtgaaaatgaattaaagcttgagaggattattaccaattaattctggtcaaacttaccattgcttaggccccatgcaagtattttacatgaaccatgaatacaggattatttctgtctaataaatgaggaagctgaagtttagagaggttaacaactagcctggagttcgaacaaggctgagtcaggacccaaatccagctttgcccagttccacagcccgtgtggtaaataactactaggctgaaaggccatcgattctcaaagtgttccttttctcctgttgtgatcaatcaacttattctctggcttgaacatgcaaattgtttgcaaatagctcatgagagcaaattgctgaatatatttgt

SEQ ID NO: 32785 - DNA, 1572 bp, Bovine  19866880489560
atgagaaagtgatgtatccttaatggacagaggccttcagacagtttcttaaatgctaaaggatgtggaaactctttgagacagttccataaaacagtaataacttggcataatcccatattgagagattttcgtctcactcaagtttctccctctggaacagtgcagctgccagtgatattatccacttagagtggaggttactttgcttttcttactgggttcttgtctcataaagaaatggtaggaaacattgagctctttcaccttcagagtgagagaataagcctcatgataactacagctgaattcctccagtcagtcattcaacaaacactgctcagcaccttcttgcgtcaggctctgggccaggtgctgggtttagagcagtgagaaggcctggcatcataagattttaagactgggagtgacttatcgtatcagcatatctgaaagatcatcctgctgtccccatgacaggcagcagagctggcgtagactgacgaagacgtggcgcggtaggtaacttgcaccagcatggtggctgtggcagtggagagaaatgagcagattcaagaggtattccagggcgggtccaaaaggcgatggtggctgattggacatcacggatcagagaaagagaggagctggggagaacgctaggtttttggcttcgggagtcccacggaaggtgatcccaggtcctcggagctcacacagcacacacggctgggggtgcagtaataaaccatctaggaaatactgccgtctgtggctagtgtgcgtgttcctcctcacagggacaagtggtgccttattcttctggcatgaggccaagcatgtcaaaggcatttgatccatgttgacaaaaagacaagttgagaatttgcagcataaggacataagggtggttgacctatggtgtagagtgctcccctctgcccatttaaaatttcattttaaggaaatgattttgaaactggactccattattaccctaccactataaagacctacaagcaaaggcaacagaagccatacccttctgcctcagggacataagaatgtgcttcgtgacaggcagagctgagaccaggtgagcagaaggagtgtgtgtgtgtgagtgtgagtgtgagtgtgtgtgtgtgtgtgtgtgtgtgttagtcactcggtcgtgtccaactctgcgaccccatggactgtagcctgcctggctcctctgtccatgggattctccaggcaagaatgctgtagtgagttgccatttcctacttcagatagtcccttcccagcagttgaacccctgtctcctgaattgcaggcagactctaccatctgagccaccagggaagcccatagagggaaattaaagccactccaggtcatatattaaagccaatcaatagccataaactattaaaagaaatatatatatatatatttacatgtatatatgtatttatagccatatatcagtgcaagctcagccagtcagtcgtgtctgactcttagcgaccctatggacagtagcctgccaggctcctctgtccaggtattttccaggcaagaata

SEQ ID NO: 32786 - DNA, 1280 bp, Bovine  19866880564128
tcccagaagtgataaacagtggcaacgtaagggcaggatggatgtggggagtggagaggtgctttcatgggaacataggtgggtaggcatactctacagcagaatatttcctttaaggatttatcacacggttgtttgttatggggccatgccatgaggcatgtgggatcttagccccctgaccaggaatcaaacctgcagcccctgcagtgggagcttggagtcttaatcactaggccccaccgggacgtcctcctttctttctatcaaagaaagaaaaagtgaaagtgttagtcgttcagttgtgtccgactctgtgaccccattgactgtggctccccaggctctctgtccatgggattctccaggcaaaaatactggcgtgaggagccattcccttctccaggggatcttcccgacccagggatcgaacctgggtctcctgcactgtgggcagattctttcccgtctgagccatcagggaagccctcctatcacagagtttctccaaataagcacatttatagagtcccgtcacaggctgattgcagcttccacccagcactgacagtgcctgagggcagaagttcttgtagagtaaataggacgccagcctcacagaaagaagtcacctctatcctagaccaacggtatgaccttggttagtgtcctggatgaatccgcacttacaaccccacctccacaaaatgtagggagatggtggcttcctgcccagctggcaagatccctgcttacaaagaacgctgtgctggggaaacgaaggtcctcacactattaccagcactatttaaatatgcttggccgagagccttgcccgttataggatttctgccttgatgcccaaggcattctctgcccaaagactgtggtaccgacagtacattttgctgttggcagaggtggaagaagctaagcaggctctctttggccccaaagacctaccagacagccctgggtatcctgcagatgctcactctacagaagcacctcatccagagtcagctttcagatggccaccagctgggccagtgtgatcagaaatggagggacagtcgaccttggatgtacttcctacagccccactatgagtttctgggtccacagggacccggggtggcctgctgtgggcagattcctcctggctgggccactggatacgagtcttctaacagtcagtggctgagctcatgaaaggaagcaagcgacggggtttgtcatcagcttctccttccagtgcagagaagtctcaggtcaggccc

SEQ ID NO: 32787 - DNA, 1049 bp, Bovine  19866880582632
ataaatcgtatcactcaggcattgctggttggaatgtaaaatggtgcaaccactctggaaaagagtctggctatttgctttaaaactaaaatcagtggaggaggaaatggcaacccactctagtattcttgcctgggaaatcccatggacagaggagccaggagggtgtcagtccatggagtcacaaagagtcagacacgactgatcacccatgcacacacaaagccaacttaatcttggggcggagccccccttgcctgctggcttgcatctctcacaatcatcctatattaataaatctgcatcttgcctatcaaagaaaaaactaacctaaaatcagacttatcatacaacccagtaccttcaccttgggcatttatcctaaagaagtgaaaacttatattcacacagaagtttacacaaaccaagtcacacaggaccagccctcaacagccccaccctgagatatcaagagtggagagtaccatgacacatatctagtttgtttgttgaatgagggaacaagatggacctgactgggctaaggatacactcaaatcttttgacaactcaaggcaggtgaaaaacttcaaactggaaatattgaattttctgctcttcagtgatgaattagaaaaataaaaaccatatgaccaaatgtatatcttgagttatgaaacagctccatactggactaaacagaaatagaaatgcagagaaaagaatttgtttctagtacagtatttttctttttttagaactatttccatttttttagaacagttaatgttttattatacagctatttgtttgctactaaataacagcttttaaaaggctttgctgctttctgtagtcaagttgattctatcttggaaggacaatgtagatgtaataatagaaaatttgtcattcactgactagggcatctaataagggatcctgatgctgctgataggtactgataataacagtgttattttacaggcatatatgatgattacgacttacaaagtcttgatttgtgattctctcctgttaggattttt

SEQ ID NO: 32788 - DNA, 3512 bp, Bovine  19866880624068
ttgtatgtttggggctgtccttagtgccaggcacaagaggactattgcctagcctcgtcctagtcagctcatgactctgacacaaggacctttcacttgtccttgccttttagaagtggtctctgttctgtttcctgtccaggacacagcatgatggacacattggctgtcgccctacgggtggctgaagaggccatcgaggaagccatctccaaagcagaagcctatggggacagtctggtatgccccccaccccccacaatgtctgtctggaaggtggtgcgggtggggtcctggctgccaagagaaagcacagcttgtggggacaccatcatcatataaccatccttgaactgagcccgtcctccccctgcatttgtggtcaggactcccaagaaatcgattgccaagtcccccaaacacacccacagctcacacccttcccttcttccctctgcaggacaagcagaatgaggccagttacctgcgggaccacaaggaggagctgaccgaggagctggccacaaccatcctgcagaaggtaggcgcgccctggcaaccacacggctgcagtgggccacctggtccagaccagggccttcggtgagcggaagagccgccgagggtaccgctgttgtcttgggcatcgtttgccttgttccttctcacttttgcccttgtactccggggctaaggcagaggggttgcattgcactgcgacaaataagcagtgtgaacgtgcttgcccttagggattgagctagtgggtgaggagccaggaccttggcccagagacctctgtacaaatggacttattaaatctaagtgaccatgcccaacatagcaagcggtgcagacaagctgaagccttccttcgtgacacttggtatctgccccctccttagggctttcagacccttcctaaagtcagggtgtacagccggagactctgggtttgagatccagctccactgttgatgagctgtgtgtccttaactgatgacctctgagattaactctgcatctgtaaaatagggggagttatagtaggtagctcttagagttattctgagaattcaatgacgtaaagcatatatggtgtcaagcacagggcatacatgatgtcaagcgaccccagggactgcagccggccagtctcctccgtccatggaactctctaggcaagaacattggagtggctttctattttcctctccagcggatcttcccgacccagggattgaacctgccctcctgcactgcaggcaaattctttaccatctgagccaccagggaagcccttgtactacatggtgtcaagcacagagactggcacacagtaggcccttaatagaaaaggctgtcagcatcataagaggactacttttaaactgtaaagtgctgtagaatgttcaaagctttggttgtgctgttttatcacaaggcgggtctgaaactggctggtattccgttgaagctaagctcttccgtggctaaaaatttcccaaagatgatccccatgacaccacatagcgctggaagtctctccaataatgtgtgccctttgtcacctgcctcctccccagatcataaggaaacagaagagcaaaagtgagcagcgcgcggaagacgagccggagtggccgcagccccagagctgcggtgcagaggcagctgatgcggggaccacagccgccccgggaggcccccaggcttccacgaccttctgggtgagcccctatgccgccccggcccacccctacaggggccctgctgcgtgcagctcagaaccgttctccccatagaaatggggctgccatgcctaacatctgtagtcagcacatgtgcccgccagacagtgtggattgggggccaggaggcctgttctgttacacgtggaggtgggtttttacacagagaccaatttaggaaaaataacactgtcaataagctttttacaattcattctgaaaagagctgcactgagtcccgtggggagaatggctttctcagggccgtgtgtgttctcacaacctgagcacttgctgtacggaaaccgaggactgtgagagagtgaccgctgccttctgaggccgcggcggcccgtgggtggggcatcaggatgtgggcagacctttttgttccttctccccagtcacgaagcacagcgtccatccagtgacccaagggtctgggcccgtttcggctggggagggtccccaagcccgtaaagtccttcggtgtgtgttcctccttccccagcgagggcgcgtgtggggcagaggatagaggctgggtcctgggggtggagattcagcaagaaaagaagcagggctggccggcagggcttgtgctccgtcagctgcagggacccaagtcatagcatgggggagaggatggggcaacacacaggggcaatttaaaactggaaaggcaggatagaggagaatgaaatcatgccatctgcagcagtggggatggtggggtggggggcggtgggcacaggctgggggctgaagggtgaccctttcgtggcatcttgaggagggaccctgagctgcagaccctggagggccctgagccactggcctcccggcagtgctcccacctgagccactggcctcccggcagtgctccctcctgagccacgagcctcccggcagtgctccctcctgtgtcctcagttctccacggatgtggatgctgtggctccaggggtaactgcagaacccccataacactgtaggactcggtccttgggcttaactgcaaaacccaaacttaatccatccccagtgacaggatttctcatctgttctcttgaaagaaaattcagtgtgatcgtccctctttttaatttcctctctgattgtgtggctctccgccaggaagggggtcagtgcagtcttgattttcaaagccttaagatgcaatatcctaacaggcaccagggcgggggttatcattcatttagtgccggtctccttgggcacctgtatgtaaaaagtcatctctgtattcatatggtggtcctagtgataacaatgatgagagcagaggctgggcatgcagcatgcccagcgactgagctgtgtctctgtctaactttctctgtctcttctccatccttttctattttcttcagccatttctctttgtgtttgtcattttcctccctcacattttgctctctcctttaatgactatagggcagacctgaagtatttttcatgactgttataattattggattgaatttaatggctgtgcctgaccccagaaatacaaagcaatgtctcagctgttattcattcgaatattgttgacccctttgcccacaaacccttgctactaaaaactttcactctgttcacccctgatgtgggctccttgagagcagagactattttgaagccccagggagtctgccctgttggtgatgatgataatcattgcagtcatagcaaccatataccatcgcaagagatacagggagggcaggatgctgctgc

SEQ ID NO: 32789 - DNA, 1314 bp, Bovine  19866880712840
aaaaaaaaaaaaaaagaatctcaaggaaacagaccaacctatgcattgctgtatcctgctctcctgttgagaatttatcatctcatatgttcccagattaggaaagtcttgctgctgctgctgctgctgctaagttacttcagtcgtgtctgactctgtgtgaccccatagacggcagcccaccaggctcccccgtccctgggattctccaggcaagaacactggagtgggttgccatttcctcctccaatgcatcaaagtgaaaagtgaaagtgaagtcgctcagtcgtgtccgacccttagcgactccatggactgcagcccaccaggctcctccgtccatggggttttccaggcaagagtactggagtggggtgccataagtcttagcctatggcaaatggtccagaagcactctgggcctgaccaggaaaggctgtgctgggatcccagacatatgctcatttttgtattggctttggtgggaaatagggcaatgcttattaattctaccactgggaagaaactgattagctttctcagttccaatgaaaaattaactataaataaatagataaatgatcagatgctagtgctggaatcagcaattgtgactagggagtggagctgtggtgggatcttggatggcaacaccttggcagtgatggaggagcagttcccagaaacagggacgtgttctcagaatgggcatgctctaaagaccaggtggtaagtttccactgtggcaaagttcactgtccctttttattgggaaattaattctggcttttgaatacagagctattttaggcataactgatatggaaaaaaaccttgaactttttttccaattcaacagaaataggcaaaactttccaagaatcagtacaaatttaaaattatttagaattacactgggaaatatttggaatcatcctgtatagcacacaaaaaggtaaaataccatcaaatatcactgattccagcaaacctcaaaaatcagtctttcatctggcaaaaacgaaaccttgtacaattcctggtgaaagacacacttcctctgaccccatttaatatcttgtttccaaaccccttacattctccactttgatatctgaggactagcggcagctagaactgaaggtcagttttaattgccccatctatagaaagaagggtgatctctagagaggcacagggcttgaatgtatctgaatttagcacctttaaattatcagggcccaacaggcagatcccgcatctggcaggggaaagattttcaaatagaaatgagttcttacagtctttaagaac

SEQ ID NO: 32790 - DNA, 706 bp, Bovine  19866880843412
ctgcaggatgccttttcggaggcccttggtaaaacactagtaacgggctggtggccaccagggcagtcagccacaccaccagactcagggctgtgcccatgctgattgtcctcactttcaaggcatatacggcatggacaaccgccaggtaccggtccatactcatgagggttataaagaacatgctgctgaagaagccgatgtaataaaagccagagaccaccttgcacattacggtcccgaatacccactggtccagttgatagtgggtctgaaaggggaaggagaagacaaaaagcaggtcagacagggccaggttcaagaggtatacatccgtgacactcctcagtttcttgcaggcgacaaggactaggatgaccaggctgttgcccagaagaccaaatacaaacaggatgcagtagaagacagcaagaagcagcttgctctctctcccctccccatcgcaggggctcgagtagatgtcaggatagtagaagtcagttgctgttgtcaaattgggctcaggtgtgtaatccatcaaggcaggaggaagccagccacagaggcacctaagagacattcatttcttagtgatattttttatttaaaaatacggactgaattgtgccccaccgctccccaccaagttcatatgttgaagccctaaagccctgttatggactaaatgtgtccttccaaactttgt

SEQ ID NO: 32791 - DNA, 1284 bp, Bovine  19866880851455
agaagcccacaacagagatctattcaccagatgtgcacggatgaaaatacaggtacaaatgaatctcccactctcttttggatcagcaactaaattatggtataatgattactagtattcagaatgtcaaagtggaatgtagaatcagcgacagatggagcaatcaaactttcagtaagagttacgcactttagaaaatgatcccaggtgtcttacagtattctaggcttggggaatagagacatgatacacttccctgtatcaggcagaggcactgcgacccacaccaccacttgttcacgtctgacaaacccacgtaccacagagcacagtgaagttcatcccctacagcctcggactctcctcaggagcttctgtccatctcattgtcttaactgaatccagccagtcttctgagaacaatgcctcgtctgtcagcctgtcgagtgaggaccattttacactccgagaagctccagatttgagagcaaggcagcatcctccccatgccacattcagaccgcggctccttcactccctcgtcatttctccgtaacctgaagctgtgctgcatcccctgcgtcagtcttcatctgacttcccggtcactccttgtcattcactgatagttttgttaccagattccgtgctcccccactccctctccgtttcagttgcacccacctagacgacgttagtgtctgtgtgaataaactcttcaccgctccagggaattatgcgctctgccgcatccacccgctgccatgctggaacttagcaatactcgaaactctcctctctgaatcaaatcgcgcaaacatctagctagcacctgattcacaaccttcctttctttcaactttgttaagtgccccactacaaccattctttcaccaggtgcttcggattgacttgccccttcatctccccatccatctatgaatccatttacttatcccttcatcaatgcattcacccatccattcaacaatcactcctttcggcctttctttctattatgaatagactctagggtttatcacttcaattcttctgcacattctctagcaaaccccaaccctggatgcacctatgcgtcttctctgtgtctccacccgggctgctgcgaacatttggagaaaaacaccaggcggcttggtatcactgcaaattaatgggtcagtgacctcgactgggccaccagtgtaacttgtttcaaccactaccgtggagacggttcctgttaaattcaccaaatatctccctatcccttaagcgaatgta

SEQ ID NO: 32792 - DNA, 1305 bp, Bovine  19866880933254
catcctttgtttgggaaatattaccaaactggattcttcagatatgcagataaaaatcatccttttttttttttccccagagaaaactttgaagtcatcataaatctgagtatggggcaattgattaacttgattacaatctctttggttaagtgaatatattatggctttaacagaactgttccctggattaggtagatactttcaagtttggggttctgctcgtggtgttatttaatgttgaggaactaagctttggagaaaatgtatattaccgatttacctattagggccctttatctgggccaccaaagtcaccctggagtttgaggaagtatttcgacttaaaggattacgtgtttccatggtgaacattttcctgtatcttccaatcctgtaaatttattgtgggctgaacactgtagtagcatgatattaggtggcagaggttctggattaagctaaattactggaggatcaccttggtcctgtccaggtttggttttaggccttgttagggcttgtttgtctttgccgtttctcctaggcatgctcccctgccctagggtgagatctttctggggcttcaactgaaagtctagggtgttcaccagggtcttgcaattgccccagtaatgtgcaagccctgatgtttctacttagtcatcaacctctttgtgactggtgggtttcttccccctgggcttcccacagtttcaccctgcaaacgcacaactttggaactggccaaggatctgagaaaagttattgtatcttcttagcaggtccctactatctgttgcttgcatctcaaaccccttctgggtccctgcagtcttagcgacccctggctctgatctctgactcttcttctccacgctcaggctcttttcccctgtaggacagtttgaaaactatcttcaggcagaaaaccaggggaaatcttctcttgcttcctttctctcaaggatcaaagccctgcaatatttgctccccagtgcctgcaaacaattcttttgcatgttttgttcagcttttgtggttgtgtaagttcaatacttacagtgggagtgtaagttcaatacttgttagtagatcatgattaattttttaagtaagaaaacttgtagagtcatatgatttcaattattctgtcaagtagttgggagaagaggaacattctagtgatcttcatctgatctgacagaaaaatcttacaaagatttatacagttagacagaagttgccaattacatcattatcactagaaaaagtatcaactaagacaaccagttagaattacag

SEQ ID NO: 32793 - DNA, 951 bp, Bovine  19866881216445
ctacagtctatggggctgtagagtcagatgtgactgagtgactgagcatgcataatttagaacaacactgaggatggtgttagagtgatttccacttttcacattaatcaactgagggctggtgatgaccaggccagaacctgccctcagctctgtgactcacattcttaaaattgaggccccatttgcctcgtcttgtacacaagttgaccaggcctgactttaccaaacgtttcactgtagatgaaccccagcattgtaaaaatctgtccgatgggctgcattaaatcagttctaaattcttgcatgctagctgttaggaagaagtattagagattacaaagctaatttagcttcattaatcaagataacactaattgctccagtcttcttaatgaaggacagttaatgcatgcaaaaacacttcatcgaagacagcttccaggtacctcctccagggcctgtgctcagagaccaaactcttctgcataaatgttctctcctgaatggactcagcaacctgtactgctcgcctcggcagccagaatgtcccttggaaagtaaaactcctgttccaggtaatccctggggcaagcttcaggtgtctcaggaatcgatgactttggcctgtgtggcactcaggatggtctccaggttgatttaaatcctttgcaaatatcaggaggtacagccaaagagaaccataagtaaaatgattacaaattcagttttctccagcactttttgttgccataaaggtgaatttcacaacctcaagaattcaagtgactgcactttcaacttgaatcaatttctagggactttcctgttggcctgggaacagtggctaagactctaagctcccaatacagggggcccgaactcaatccctggtcagggaactagatcccacatgccgcaactaagagtttgcatgctgcaagtaaagct

SEQ ID NO: 32794 - DNA, 991 bp, Bovine  19866881225609
ctccagtgttcttgcctggagaatcccaaggaagggggagcctagtgggctgccgtctatggggtcgcacagagttggacacgactgaagcgacttagcagcagcagcagcagcaaaccactctgaatcacaaaaaagtgatgacttccaaactttctgaaaccattatcgctcagatacaacaacctcacaaagagcacatgcaagaaggaaggaaagaaggaagaaaggtgggagggagggaagaagggaaaaccaatctcacttacagtggcaaaatattacaggcaggaaaaatataggaatccttattatcactgtagttatacaacaaatacatgtaatataactaatacccaatacaattagacaagagaaagaacaagagatataaataccaggatatcaaaaaggcataggcaaaaatttactatgtgtcaatgatataatctaatttctgaaagtttaagagaatccattgtattttacaatgcaataataatatttttttccttgaaggcatttttttttctaatctagatttcttttcactttccttcatttaagctttacagtcacagtggctttatattgttgcatccggatcttctgagctagacggtgaaaaaaaccagtgagttctcagatgaatgctgcatggcaggagcactggtgaatgttctcagaggtgggttcctggggcctgaggttaactgagccacccttcccttttcaaactacttctgtgattgatggatattttagatttatctgcatattagtaaaatacagcgttgccatctgtgtccctttctataaccagggcaagcaatacatctcctctgttatgagggggaaaaaaagagagagaaacatataatagcttccttttctatgatttgggtggtaatgtcaactccctaatacattaaactgtaaagattttgaaggcaatatgcatctcagctgggaaatctaaagtaggaataaa

SEQ ID NO: 32795 - DNA, 1128 bp, Bovine  19866881305264
ttaaacaaccaatttcatccatcatcgttcgagtctgtggagctgctctccaacttcatcttctgagtcatctaataattgtgaaatgttgttctctcagttttttttcctttgccattatgaaaaatttgaattcccacctgtatacagtgagctaaaagcagactcaaaatgacgatgatttatttccatgttgaatcatccttctaagtaattccatttttctcttttgttattctagtctcttttttagcataattggaagtatttgatgagtaatgatgaaagataattcccaggataataaaacagcaaaatatttccaaagataaggaaaatgagatcatgaaaatcttgtcatgtgtcttagatttataaaaggatccaatgaacccagataataattgcaagatggaaggagttttatttacagaattagtacattttctctttgttcttcgggagttcttcaataaagaataaaagtcatgaaagaccaagccttttaaacagatagaacaactcaaagaggaaattcaaaagctaatattgtgtgcagtggaccctgatggtactctgggggttatcttgttaaaattccatacacatctgtccaacatgaggtgaagaatagagtgagacttaacgatttccatgtcttcctggagtttcccaggcccggtcagggctctactcatagagggagctctaggagacggtaggagccagagatgtaattgtgtgactatcaagggaaggtggcataatattccttaactgtgcacaagaacctcacaccatctcaaaatctttgtgatctgcccagaatacggttctttcctctctcccttttagctgggtaactgctgcactttgaatctcaactcaaacaccacttccacaagccagctttccctaactcccagccctcccatcaggcgccccttagcagggctgtcagagcctccatccccacccctgcttctctgcacttagcagggttttagtgtctcctccactgggagctggtggaggtttgctcagacttgcatcctcagtaccagcacagtgatgcccctagtagccactggataagtattctgcaaataaaaacacgaattcactttt

SEQ ID NO: 32796 - DNA, 2769 bp, Bovine  19866880272274
ccagggcttactttgcttgaataattagaaaaatatgggaaaagaaatattaaatacttagggaataaattaatgaaggatcatggtgaaatgacgtccagtccttaaatatgaaagcatatcttgtccttgtttatcatttgtcattctaaaattgagctgtaatatatataaagtgcaccaatcttaaatccaaaattcgttaaaatttatatttttatatagccatattcataaccacttccctgatggaaagagcaaatttctggacatcaggggaaagagttacagaattaaccaaacgttggcaatgtcctctacaggtacttgtcatgctttgtggccaacttaacttctactgatggagaaggcagtggcaccccactccagtactctcgcctggacaatcccatggacggaggagcctggtaggctgcggtgcatggggtcgctaagagtcagacacgactgagcatcttcactttcacttttcactttcatgcattggagaaggaaatgacaacccactccagtgttcttgactggagaatcccagggacgggggagcctggtgggctgccgtctatggggtggcacagagtaggacacgactgaagcgacttagcagcagcagcagcagcagcaggaacttctgaaaacctgctgatctttgggaccttcccacatcctgattctcatctacccaagggataagccacaattcactctctcagttttctttgcagcagtcatgtgaccttggcttcgccaattaaatgcatcttagtgaaagcttgcatcagaataaagtaacatgaggaagcaggtgctcaaagtaggtttcattttctggtgtgaaaagcagtggagttgctttgttttctcagcaatcggtaggtaagattcccatgcccacagcagtatctgtgcttagtgtggtctgaagccgtgacgtcatcagtactcttgcacgtgtgatttggtgttgcccccggctcatagactccaagtctctagccctttcaagattccataaactgattaatgctctttaataaataatttttctgcttacactaagtacagtggatttttaaaatttgcacaactagaggaagggatgccctggacaaagtatccttcactattttctaggtggaaatgcagacattgaatttacagagtctgatgctatgtaaacatttagctgtaactcccttgcttatgagacagcttcatgattatcttctgtgtctactgggggaaaatgcaatgaacatgctgatgtgttctaagcactaaaatcattacacttctcatttttaattcataaattataattatggtttttggacaagtcttatgtgggtttgatttagaatgaattagacataagagataaatttattctctgtatgctgacaaaatcaaattgccaaacttaaaagctaggatcacaaactgaatctagttacatattttttgagttagctgacctcttgtaaagacacaagcagcccctttcttgtgaccctttgatattgccacaagattttccttttcttatttatagttattcataaaggttcaagaatgacttatgttaccatttttggacatattaaacatgttaatacaatatacttttaaaaaagagcaactcacctgtaacagaattttctaaatcatgtgttaaaattttaggttaaaccaagtagctgctcctcttcataagctcattcaatctgaataagaaattaagaatcaatttattggaattaaatttaagttttcagttttacatgtaaagtggaaaagaggagcaatggaaagaaatcgattgaaacatggaataatctccagataatagaaaagatattcactcaacagaattcttcttataggaataattcccctttggcattaaaataaagcctattgagtgttataggactctttgtacctgatctatattttctcatttggtaaatgtatcacagtttcttccatattctttcaagtaattgaatcaatttaaaaaatcggcttggtgaccaagaaataagaagctgcttgttgagaaacagtaatttagatttgatgattgtgattcagtctgaaaaggttcttctatgaaaaacataaagtgaaagtgttgaaggacacttcagggaattaacagtaacatagggtgtagaaagtgccagactaaaaaattcccaaaagtcattcattaataggaagtgttgtatgcaactccagctattagagagtggatggtaggtagtattatggcaaactcatcctaagctaatcattgcaatcaggacatttcagtgaattggttttaatttaaatttgatggaatgaaatcaattgataggataattttggaacatatgaataaatacatatatttgaacagctgttagagaagatgtggagtaactgaaactcttacattgttgacaagagtgaacaacctcaagtatatttggaatagagtttggcaggatctaccaaaattaacatatacctaacccatgactcagcaatgctacagttatagatatgctcaagagaatgaatgcatgtgcccacaaaaacacatgtgcaacagtatttatagcagctttattcataataacctcactggaaacagtaagaaaattctccatcaataggaatggaaataaattgtggaatattcatataatggaacattaaatagaataaaaaaaaaacaagaagaagaagaaattccagata

SEQ ID NO: 32797 - DNA, 1471 bp, Bovine  19866880460115
actttttgataactttgcttgatatcaaattccatacaggttaagatatatgcctcccagtcatttttttccacagtacatttaagaaggaaattttattgaaatgattttaagttaaggcatactattgaaatacttgtgattcccctggtagcttggctggtaaagaatctgcctgcaacgcaggagaccccagttcggattcttggatcgggaggatccactggagaagggataggctacccactccaggatacttgggcttccctagtgactcaactggtagagaatctgcctgcaatacttaaaatctgtaaagaaaggtatatttttgatcctgtctgtgttttgcgcatagacttttttccctttctttcaaaacgtatataatacattcttatttgttttagtgtctaatatatagtttaactatactgaatacctaataaagataaaattttgcctatcttggtatcagatctaaataacctttagagtaagggcctgaagcatagaattatcacacagtggttttatttacaaggtaatttgataggtttgaaatagtgatgtgcttttgactctttggataaaccattggcattttatgttccaaatagctacatcccttgtatgagtcatgcagatagatagatcttttaaattgcttttaagcaattttgataatttgcctttcactgtcaaaataatgactgacgttaataattctgagtgattcagttaaaggaaaagagaacagaaaagtgtgtgccaaataattttgtgctatgatttttggctgtaactctgaagatgcttcatttcatcaaagatgaatgtaccagcattttcagtgagaggaaaatgagggaaagaaaaggagtgtaagattaaatcagatgtcatgagatccttttttgaaaaagatttatgagctactggatacatcgggcagattttcttccttttttaatcctagaatgtattcttggagttggtatagttcatttttctactgagccctttctagtacagggccacttaatcttctggtgtaacaatttatgtgaataggtagtaaaaattttgatttcatttattctcctatttgtgggaggagaacattggagaaaaaccagtgaagtggtaaatgtgtttgaagttatttatgaagctgattagagtttccttttgcttctttctctttcatccctgcaaaatgtaatgtcttatcccctatacatgcatgcatggaggggatttatgggaaaattagttgttattaaaaggaggtaaacaaacccatgcttcggtttattcaattaattttataactatgcaagattttttcacaaaaataaatcaaaataaatgagtagagcttgatgaaagagttattaccattgaaaatatacctgaaaaacaagctcaaagggggacaaagtaatttgagaattgagtgagatttatt

SEQ ID NO: 32798 - DNA, 1297 bp, Bovine  19866880461142
ttagtaatttagtccatgtcaaatgcatgctctgtgtgtgtgtgtgtgtgtgtgtgtgtgtatgtgcgctctagtcacttagtcatatctgacactttgagaccccatggactgtagcctgccaggctcctgtatccatgatattttccaggcaagaatactggagtgggctgtgtttcctactccaggggatcttcatgacccagggattgaacccacatctgcattgcaggcagattctttaccactgtgccacctggaaagtcccatgtcaaataagtatacgtttatatggatgggaaagaacaaagaatctgagagtattccttgcagtacagagaaccaacgtggccctgggctttctgtcttgtgtactgttttctcctttgctagactacaatttgtgctggcttctgtgaagtcggtacaggatatatgttatatatatacatatatatataggtgaattatgaggatgtgtgtgcctcattacttagctaaaatcatataatatccagaatacatcatcaccaactgtttaatagcagcaaattgcagcttttttagtgacaggaattaatgaataacattgccaaaattgattttaatgtattgggggaatgatttacttattgcttattctcaacagaaaattaaaaattataagctgattgctgaaaatatttaatgatgagtcttgattgccatgtgttctcatgaccttgtgtgctattccaaaaatacatagaactactgaaagtgttgtcatttaatggcatcaatttacatctgctctaatttgattgtagatagttgtctccttccattttaatgagataagtgtaatttttttcaacctcatagacaacatctgggggaagatgtacgggacttcacaaaggtgctgaagaataagttcagatcgaagaaatactttgccaagcatcctcggcttggctacctgcctgtcccagacagttcttgaaggtgacaacttagagacgtaagtttaattttactattaaacttgtatctgtatgtgctcttatacctgatacttttatattagtgacaaaagataaatctgatacccaaaaagaagttgtgttttggtaaaatgtttcatctacaagaagggcaaataaacttggactcagtcttggcaacatgaattttgactgtttttgacagcacaggtttaattttgcatgttttcctaaacttttgaaatatgtaataatgtgtccacctttgcactggtcatctcttttcctcttaaaaatactttaagtaaatt

SEQ ID NO: 32799 - DNA, 1764 bp, Bovine  19866880517598
ttgcttggagaattccatggacatatacagatagaaacctaacatagtaaaaacatgtgtgtttcttcaagagtcaagcatttctaaaacacaaatatgaaatttaattatttgtacatgtgaaatatttagtcaacattgttttatctctcagaatatcaatatttcaaatatggatttttatgcagctttttagttcaagaaagttacaaattttttataacacctttaaatctaaatctacagcttagaaatgccacagaagccacggaagatatacccatatccaagaacctgatgaaggtggcattgctagccccaaaaaaaaaacagaggaacaaacaaaaatctcaagtactagaagtggtctattgaggctttttgctggatttgatagaatgttttgtgcaaagatcacattcttgaggttgtggtcgtgctgaaggggtaagaacagaggacgaggaaagagtctgaacaaaggaagatttaagttgactggcagggcgaaaaatccccacagaggagtctgtaaattcaaaagcagtggtgggagttcccgctggaatactcggagatgaactgcataaaataatagaggcccttctgtgggaaagcagcccaagctggcagttgctcagacgagtccacccaccaggaccagagtcgatgatggctctagggctctctcagtttctgtggaagagttccctgtctccagcctctcaggaaaatggcctgcaggcctttaagtcccggctaaagtgattcccaccatgctggattgcacctggaactgaagaagcaggaggattgttgaaaaacatcttatgagctcattgactttatccatatgaatatctttatttttctctacaaaaacaaaagtaacatttctggcatgttccctggtggtccactctgaacttccaatgcaggggtcatggctgtgatccctgattgggaaaccaagatcccacatgccatgtggccaaaaaaaaagtagcattcactttcatgatcaaatatctaggtattttctcaaggttttatccattgttcagaaaacagtattgctagactgcatgttgtgcccctccccacatgtattcttcacgtcattggttgtaattgaagctgtgttcgagggcacacagagctgccttgaataaagaccatattgtccagttttcttttaactgcaagctgcaatgtgaataattggccagtgacttataaatggtactggaaagcttccaggaaaacatacttaaaagattgtgtcagtgtgccctttgtctgctcctgggaacaccaatttcatgactgatacttcagccattgtattggaccataacgatggaggtcacagcccagaattgggagagaagtgagttggtttttttcctgatgccttagtcaagtctctatcccaactctggactaccaaccttcagactttcatgaagactgaaataagctgttacttggagaagatttctttcatctgcagccaatgctagacctacctgatattagtacaaattagtttaactattagtataagaaatacaagaaagaagtcactaaccatctccccagaatactctagctttttctttttttttatcatgtcctctcaatccttctctgaaataatgctatagaatctaaaaaaaaaaattgttaaattttcaatttctgtacctgaatattgacttagagaaatactcacatacttaaatttttttttgcttctggcct

SEQ ID NO: 32800 - DNA, 1029 bp, Bovine  19866880568537
tcaaggctatggtttttccagtggtcatgtatggatgtgagagttggactgtgaagaaagctgagcaccaaagaattgatgtttttgaaccgtggtgttggagaagactcctgagagtcccttggactgcaaggagatccaaccagtccatcctaaaggagatcagccctggatgttctttggaaggaatgatgctaaagctgagactccaggactttgacgacctcaggaagagttgactcattggaaaagactgtgatgctgggagggattgggggcaggaggaaaagggaatgacagaggatgagatggctggatggcatcactgactcgatggtcgtgagtctgagtgaactctgggagttggtgatggacaaagaggcctggtgtgctgcaattcatggggtcgcaaagagtcggacatgactgagcgactgaactgaactgaactggtacactgaggaactaaaaggaggctgaatagttagtaaacaagccagtctctagaatctaccccacaaacaattcccagataaaattcgagacacccagttaaactagaatttcagataaacaacaaataattcttagaattttccaaatattgcaagggacacattgatactaaaaaaatatatattcataacttacctgaaattcagacttatttgggcattttacatttttatttgctaaacattacaaccctactgccatggaaactgatagaaagtgaaatcattcccaattcatacaaagttttggtaatatttattctcagataaggattcctgcagtagagtacccacagatttctaatggaagcattttcttcttttaaactaatagacattctttcgaatttataatttctccaaaaataggaagcaaacagatgtttgtatgttggttagattctcgaaaccagtcagaagatatcagtgccggatggctccctagagagaatgcattccttggagggaacttttttaatctactgctttcttttaacagataagttagaacaga

SEQ ID NO: 32801 - DNA, 1210 bp, Bovine  19866880568742
ggtgtaagtcttaaagaaaaacctttcagcattaacagcttatttaagccttttaacagcaggctactggagagattacttaatggtttccatagcagtgcagggaaacttttaaaaaattaaagcaagttttaaaatttctgtttactggtacttgaatttctccacaaaataatgttgatttttaaaaaagttttttatttactgctgttcattgtggggatattctaagagatgtgtattgctattattgatgtctatacaggcagtccctattcaacagagaacaagtcagctcggttctggaattagatcaccaccccttcccacagattatctggttgaaattaacaaagttttactttccatggatgatgttgaattatcacttaatgctccagagctaagctctgttgtctatgaagaattctcgtttcaggaagattctctgaaggtaaatatccagggagtacatttgaatacctgcagttaacatagaaataaagcaaggaatttgtcactgtgcctacttaaatggtctttagccttttacatttgtgccaaggaatcaataatatgtatgaaaaacaaacttttcctatactgccaatgaaatgctgtcaaaaattttaatttattaatagttggtatcgatttttacatttacacagtttttttggcaacatcagagatattttaaaatcaaacacatgtacaaattatattcctgtactggaaacttgattgtcatttgatgtaaaatgtcagcatttatcttaccacctagaacgaacaatttgattgtctagtggttggaaatggaatgtcatgttgattgtaagttaattaggggtctgaaagttttcaggtaatttgcaaaaactatttgatatcatcaagactcatgtattttgattgcatttttgtatcatgtcataataaacgctgatagagttgataggtttatctggtaactcagttttgtcatttaaattagcattattagatgtttgaaagtatatgtaatttctagctttaaaacacttcattacctttacagaatattattaaagctttttatgtcctgtacaaatgccactttgaacatcacaagatgtttttccctgctgttagaatattatgtagcatacctcatgcattggcctgtactggatattattttttttttaaagtttcccgttttgatgag

SEQ ID NO: 32802 - DNA, 1652 bp, Bovine  19866880619725
acttttattgcatttttttagaaagtgtatgttacttttaaagaaatagattcaagaatattcttctcactattggttaacaaatggggaaaaataaaatttcatatttttagtgtttttagaggtatagaaaaatcagtttccttctgaaaaaaacagaaaaagttttatttttaaagctaaaagtgaaatcactcctttttttacaaacaatatgtcactggcaagaaacaaaaagaacaaaggaaaaaaactaggcatagttgttttgtcgacccctccctactcctgccaacatcaatgtattcataggactataaacatcaaatatagaacatgcagattcattcttgggaaagctctccactgagttagtgtagtttgtttctggcagtcttacttcttcggatgagacttgggacgttgccaatatgctaaaaacgcagcatcattgctatttctctgacctcagcatcctaagtggttttttagttcttgcccagtctacattgttatcccagtaagttgagtgcatttagattggcgttgttcacttttaaggtgacatttgaacaaaatctattgtttggatgactcatttaccctacttattcttgaccccttgatgatttttttaatgctaatattttggtttcatgtttttccattagaactgagaaatgctctgaagcttgtcttactaatttcatcctacctatagaattcagtgtctgaattcttgttgaatatcattgttgaaatcactgaaacttaaagcaaaactgagaggttgtttttcattttttaaaaaactattagaatgtctttaagattagccctatgataatgcaatgtactttttacactttgcatctgtcatttgagactattgactatatatttaagaagtaaatgttgctaatgagaatcttgttcaacagtggtttttgtacttgtgcgtggcctaaatagtattatttaattattctagtcatgtgccaaagatcatgttgtttcttacgtaaccttgattttcctccttgttctagcctgttttcctctgcctataacttatgcatatatgtagttaagttaaaaatatgatgttgggagtatttggtaaagaattagataatactgctatcccaagttatgaattgaccaaagaaatttttagaagatttaaaatgaatatagttttgttttttgaaatagaattcaagagttaaaaatgatctcatgccagcttacacaggagttttgggggttttggtagagagttactgcaggctgccttttataattcagcaacacattttaaataattgatttgtactagttggtagggaccaagtcaagaactaattacttgttattatccaaataagttttcattattatctcactgctacttagtagcagcatagtagtgaaagaaaacataagtacccacttgtctatgtaggttcaattttaaaatgtttttcacagtgactcaccttcgttagatttccaaaaatgacagtttgaatgaaagtccttgtttgaataagtgagttctcacataattgttacaaatcaatccagaaggattcaggggagatggtggtagcagtgctcagagtttttcagcctattgcctctgccatttt

SEQ ID NO: 32803 - DNA, 1031 bp, Bovine  19866880646453
taaatctcactttataatacaaacatgcagctcaaccccaatggcggagttttaactataatcttgcattacgttgacatgaagcaatgaagccaatagcataatatcttaagacagcaaagagcaaaaacatacatagtcagtaggaaaagaaaggacagtgaacccagaaagaggaaaacatcggaggcagagaaatatggaactttaatcctttagacataaactttaatcctagaaaaatacagaaagtgagacatgaaggaagattttaatacatagatttacataatataaaagaaacattttaaagacagcatgtacttattccaaagctaggaaggtatagtatatatatatacataaggacaacaccagcttaatcccctaaaacaaacctcgaaatcatcataaagcacttagaattttctcagagaatcaatttaacttgcaatttaaggtaaagtttagaactgaaaaaaagctgacaaccaaaattctttctgcctgttggtatcagatttcatatctttctaatagaagaccatctggcttgctttctttatgtatgctgtcttttcagatgtggcattatttgcttctgcttaattttgtaatattctcttttcttcctttacagctttcttctcaagcatgccttagagaacaacagtctctagaatactgctgaattgcatgacttctgagattcttggggaaacatttcattctttatgctatgagaaaactctttgaggaaagttattagtatagtacattaaaaataataaatatttattagcccaagtgagtaggaagttggtctagatttttttccccttccaattttattgagttatagttgacatacagaattgtgtgagtttaagatacagcataatgatgtgacttacatacattatgaagtgattaccacacaagtttagtgaatacccatcatctcatgtagatacaacattaaagaaacagaaaaaaattttttccacttgatgaaaactcttaggattact

SEQ ID NO: 32804 - DNA, 1934 bp, Bovine  19866880680281
taacattttcagaaacttggagtagacgtatatgaaactccatcacatatagtcgagaactcaaggtagacttttttgaaggcctataaaatatttgtccaaaggaactcagcagctatccccactcaattctcataaccactgaacagctgacgggcctccccgacacactcctacctgtcttacctggatcaaaaccactgaagctgaagctgcggtacttcacttgctaatccctgaaccaggcagccctccctcactgtaaaaaagagatctttttctggcttcccgcaggctcgaggggaaaagagttcatttagatttagataaggctgagaatccatctgagccccaaagccacaggaggctctccccagctgagggctcaggcgcctacatctctgccccagagaaaagcagccatggctccagctgagcggggaatattgctcctcttcatccctccctcctccagggccttgtcatgcctgccacacactttttcaatatagattaaacacttgtaattccatttttagttaaactgtattttgtcagctcccaggtgtttcctcagacaccagtgtagagatgagcttgtgatttatcttctgagttctgcacaggataacaggaaaaaagagctcagtgtgttgagggattttggggggagaaatgcatgatcatttaatataaaggaaatggcccctggccttggcttctttatcctcaggctgcgcaaaaatccacctccacaggaatatgatacctgcgttgtgtgaagcccaacacatgttccaaagggtcaagaacgacacccttgtagttcaggtgctctaaacaggtaggaagaaagaaaaaatggtgaaataaaggaagagaaaaaaagggagggaaggagagaaaaatggaggaaagaaggaatcaaagaggattaagaagagattcacattttcatgcagttcgtttatctgacatttatcaaccttactgagcgctgtgataggaccaagccaacttgctgctacctctccagccgattggaagggaaggaagctggtgcacactccgtgcttgctgtgtgctgggtgcctcacatattctgtaataaaaataagagcttatatttattcaactccgtgtcaggcattcgtgggacacaatttatgtactttgttttaatgtttacaaccttaaacaggtactgttattatccctgtttaaaaagaggaaaatggatgatgccctaggacttaactaagtgccggaacaaaacttcaaacacaggacactacaaagtcaatcagctttatttttaaaaacttctgactgccttaaaaatgttttagtcctgttttaaaatagaaataaacaagaaaactgagtatggacctaagttatcgaactcatcgaaaatcaagcttccattgagtgggaacagcatctgaacccagttctatgatgcccaaagcctaaattccatctgtggcaccatcttaacttcttgatttctgactgaaatccctgtgtttataatctaaaaagtgctgggtgatggagactttgaattacagtgttctcaccccacccctcctgccttctcccatatacaagtcttctaagaagttgaacttgaagttcacctccatggcctcctcattgccacaactcacctcgcctgtattctggctctcagcctcaagaccgtgaagtccaggatccaaggaaagagggttccaatagtcattcagcagttttgtcctacagtagatccagacatgcagcactcctgacattctcaagcatccattccacaaacatttactgattatcccagtatgaactatgataagtcttcaagctacagaaatgtttgtagtgcagtgagaactcctgcccccaagaaaagccaatgtccagtatagaaacagacg

SEQ ID NO: 32805 - DNA, 1315 bp, Bovine  19866880712900
tgagatggctggatggcatcactgactcgatggacgtgagtctgagtgaactccaggagttggtgatggacagggaggcctggcttgctgcgattcatggggtcacaaagagtcggacatgactgagcgactgaactgaactgaactgaggctcctcagtccttgggattctccaggcaagaatactggagcaggttgccaagctttcctccaggggatcttcccaacccagggactgaacttgcatctctgatgtctcctgccttgtcaggtgtttgtttaccactggcaccacctaggagagctctaaattctcaagttcttgaccactgggaagaatgcacatccacaaatcccatgcctggatttgtcctctttgggcttcatccaccagcctgaacacctatctggagatggctgacagcaggaattcccttgggcagccttatctgactgccagcttgtacagctagacgtctgcagctaacagaacacctatcactgcccatcgaactccagaaccttccacctcctaagcagatactaatcagacaatatgtgagattacagaacagttaagtattgatgaaacattttctgagaaagtacaaaataagatttttttaatttattttcagtttcctggcgttgaataaaatcatttggaaagaatttatcatactgcagggaagataaagaatgaaaattatcctaacagatcactaaaaatatccagtcaatctcacaaacagaactcaagagaatatttgtgtattatagcacattaaatggtaggtgtttctttttgatgattattccggtgactatctcaaagaaaatgtgcgttcactgagaaaatgtcctcactgcaaaacaacagataattcaataccacagttctgaaaaataatgtatttctgttttcaaaatgagaagtaggagattatatttcaagtttcttaactccttaaaaactatattatctgactgagtaggtgaaagaattataaatctacactcccaattcattctcttaaatgcctctttgcaaataagcaatgaagtattggcaaagtactaaattatgccatttattaattgcctaaaagcatactgaaagaaaggtaaaagtttaaaatggtgtatactcttacacagcatctcaaacatttgtgaaagctaatcattggtaggttctcattattaccacagaatgaaaataaacatgtaagtctagatattagcagccatttgagaagtgagtttcccgtggttcaatactgaaaacaaaattttataaaactgtatatctctg

SEQ ID NO: 32806 - DNA, 1385 bp, Bovine  19866880738659
tctcctgcttgcagcaattctttacggtctgagccccagggaagcccagttggagcatacgccaactttatttccactaaaaatgtctcactcacttcaagcacatgtgtctggatacttagattttttggttgttttgtgttacattaacagattttaatgtgaattacaaatttttaatttactttttgtgtcctaactgtaagactgttggcgatgtctgtattccctagacatgcagcttctttattgaaatatatgtttcttcagttctaaaaaacattttgctcctatatttgctttgaatgaattgcttgttatttaactactcacaattcacttaggaaaacttttactttttccctaaagataattgcaataaatattcacttgtagattaaagttgtttttccttttttactgacctggtgtctttttctaggcattcaagttctattttgtctttaaggcgtgaagtactctaggttttctattcactgccaatttatgatgatgtttcttaggaacaaagtggttgacttgtttatttttcaaatgcattttgaactgtgtaagaaatacatacatactgctcattgaagacattgagtaatagagacggagaatgagcattgagaagttcccgttctttcccaatgagcttccctggtggctcaaatggtaaagaatctgcctgcaatgcaggagatccaggttcaacccctgggttgggatctcctgcagaaggaattggcaacccacttcaggactcttgtgtgaagaattccgtggacagaaaagcctggcaggctacagttcatgggtttgcaaagagttggatgtgactgagtgaccagctttcacttttcttccccaataccatttcctttcctgggagcagtgaacagtaacagcgatccttgctggagataaacatactcaaagtaagaaagaaaagttcatgaatatgactaattctaatcattttcccccttactaacagaaccaagtgatactgggactccatgagggactgcattgatactcccagtattacttgtatctcagtatcacgtctatttaaatagatggtatacaaatgcatgaatatggattagagtatcaatttcactactcaaaatagtaatgctttttattgacacagcacatttaaactttgagagtattttcaaagctgtgtacttatagtttccctaccatcccttcaatacttgtaaggtgatccttggtatctttttatgtgccaattttagttttctgttatttgttggcaaatagtgtttttcttacatgcctgcctttcacatatctacatggctggtttattttatataggatagtggtggggccagcattgttattca

SEQ ID NO: 32807 - DNA, 781 bp, Bovine  19866880762965
tgaaaaacgatgtcatgaatcctagggtgcactttataccctaggtcttttcagtttcatccatttgtagtatctgcattgtcctgagacacataagacgcattctgattctcatcccatttctttactgggagtagatctggtgtcacagtcctcacaattgtggaccattaagactagattgtcttcgagattatttacctgataaatggcttatatcatactccagcaatatagccaagcctttatataattgcctcgttacaaagggagcaatttaaagtctttgccagcataggggatcatttggttcaatgactaaatttattctattaacaaggcatagagtgatgcttagaaatgtcatctggtgttaaaccttagaagatatgtttatatctgattaatttgatgtggtgctttgccacacacccaaaagataatagagaagtatcatgttatttacctttttcttgcaaattgctcttgagacaatgctactccccagagccaactcaccaaacacttgtttctcagaacttgcttatataacattcaagccagtttaataagcattcttagagaatctactatagcatgcacaaggtattgggctaggtactaggaacccagcaatttacaaaatgcacctactttctaccttcaagaagcttggcaggaaagaagggaagtcggtcggtggaactgctatctacgtgggtggcaaaatagtctccacttgtatcccaacccctcagatactatctggattttcccagtc

SEQ ID NO: 32808 - DNA, 759 bp, Bovine  19866880783294
catgaaatatctgtcctctgtttatgttgtctttgatttctttctcagtgtcttatagtcttctgtatacagttcttttgtctccttaggtaggtttatttctaaatatttttttgttgcaattatgaatgggattgattccttaacttctctttctgatttttcattgttttagcatatagaagtgggagtgattcctctgtattgattttgtatcctacagctttgctaaattcactgattagctctagtaattttctaatagtatatttagggttttctatgtattgtatcatgtcatctgcaaacagtgagagtttcatgttgatgtttggcagaaaccaacacaattctgtaaagcaattatctttcaattaaaaataaattaattaaaaataagaactctggataaataattatggctagaatggtcttatttttaacaaatgagaagaaacaagtaaactctaaccaaatctaagtgaacaaatgataaaaattaaatttattttaattaaatttgctttccctatgtatgcttttaattaaagtcatatttcattataattagtgtcaatatcactgagcttggtttatttgcttgaaaatttactgttgacagtgttaaatctagccttattctctttaaaaaggaggggagggcagaggaatgatacattttgatctgatactaatttatcaggtgtaatttgaaaatgggttttaggatccaaaaaatatttactctcctttcttcta

SEQ ID NO: 32809 - DNA, 1296 bp, Bovine  19866880796923
tggtcctctttgatcttatctttttccttaggtcagctgcttatttcctatattcagagcttacagaaaagtggatcaaagtctgctttatttgaagtctgcatggttacttttttctccccccacagcattgatatttaggcattaacaatttattaagatttgcttttcttcaatgagcagctcatagatcataacgatgtaccttcccaggcttttatgatggaactgacggctcaccagagcagcgtggggaacgtcttgcaggcaggaaaccaactgataacacaaggaactctgacagatgaagaggagtttgagattcaggaacaaatgtccctgctgaatgccagatgggaggcgctcagggtcgaaagtatggacagacagtcccggtgagtggaggcccgggagtgaacactgctgcaagatggggcctagttgttttctttaaaaaaatttttttaaaatctttattgagtttgttacaatattgcttctgctggtttatgttctgtttttctgtccacaaggcttgtgggatcttagttccctgagcagggattgaacccttaccttctgcattagaaggtgaagtcttaaccactgaaagtcccagttgcccactttaacacaactaaaagtccgcatgtctgtgggaacttgccttgtcaaattttgactcttttctgtatgtagcattgctggaatttttatgatctttatttcccctttgatatgttaaccaaatgaaaaggtaaaagtggccatacagaaatcagcaaaaaaagggcaaagacattgtatgtggactttgcagtattaaagctggctaaccaccaactctgacatgaagatagggctatgttttatttatctagaactcccttttgtaaccttttttaagagtacagttcattttatttcgtgtattgtatgttaaggagcaaactattccactgcaatttccacctatttaataggcaggaattcctgattaaagaaacaatgattctgatacaaatagagggtgctgttatttgcatttttggagtgcatttaattgactgcatttaggaagaaaataagttttttgctggtttctatatttaaagactaaatgttgctttaaaaggttagacaagagtgtgttccctgccccgtttccttgatgcctggagtgtgtgtttgcctttgcaaagggaagaaggagtagggataacgctctgctccccttggacaggttgcacgatgtcctcatggaactccagaggaaacagctacagcagctgtccg

SEQ ID NO: 32810 - DNA, 1587 bp, Bovine  19866880800337
tcagtgaactaaaatagatgggaataggtgaatttaaaagcaaatggccattatatctactactgtgggcaagaattccttagaagaaatggagtagacactactatgaaagtatttttaacatgtgatgagcatttaaattaatgtactttgggtaaatcagattattctccataacacaggtgggcctcatgcagtaagctgaaaacctaagagaaaagactgaggtctcctaataaggaaggaagtctacctttagattcccctaccatctcaagattgcagaggaatcttctcttgttctccaatctgctaggctgctctccaaatttcagacttaccataccctacagtcaataacactctttaaaataaatctgtctctttctctgtgtgtctctgtctttctctcttcatatatacgtatggtcttgtttctctagaaaaccctgagtaatatatccatgggcactgtattctttggctttgcatttgctttggtcaacaggaggcatagacaaggagattagagggaaaggggagagtgaggtgtttcttggctcccttcttgtaggacccttggttagcaatgactgtgtcccagttatggctgtggcacctgcgcagtggctctttcccattttaatgttctatgtctctctttttctgagttatgataaccactctgtcatctcacctcttcaggctaggtgcagctatagtgtatcatcactgttcacttgggatattcaccacagcttttcaggtgtccttcaatcccatttatatctatgtaaatagttatttcagctaaattctcctaaatgtgtacatttgagtgtgccagttatttcctattgagactgtgactctgattcacaaacattcaacaaaatctcttctcatactttaataaaaaatagttttgtaatatagagtatattgggatccaatgagtggatcattatttcacagtgtctattaattttttataggtaaattctcttcagtgtcagcctatttacaagcagaggattttgctcaaaaagttttagaacaagaaggaaattgattaattgtccagttcagcagtgatccagcacaattttcacactgaggaaattaaatatggagagctgaaaagaccacataggattacacagttgccattgggactgattctaaaaactgtgttaaactttaaattgttaaggaaatttttaagtcttaaaatctacgatttcaaaaatatctcagatgacaagatatgtgctaaacagactgcagaagaactgctataaagtcattctacagataaaaggcgatctaaccagtgaattcctgctcactgggtgagccgatagtgtgttttattctcagtttgctccggttacaagcttttcatcccaaagtattgacacttcaccctcttagcctaagtatatttttgcacaaagaactgtaactgctcatacagagacctcctcccaccatgataaagtacaattaacagataatgtcattgatgccttgggtggtgatcaagggtttggtgaattattaataataaaattgtgcaactggttt

SEQ ID NO: 32811 - DNA, 1271 bp, Bovine  19866880852341
cttgtgacctggcattctcttcccatggaagaggtgggaagaaaattgtctgtataccccagttgctttcctgggtaacgaatcagaacagcttctgactattaaatcacatttgacttatgtcactttatacagtgctgtactagataaaatgatctctgactttgtgtatttaaatttggaacttttttgatttaatgattctatattcttaattcctactgtatgcactaaacttgattatgtgacaccctttctcttattctttcagccaaaacttggaataaaaataataaaagtgatgacatcacatttgcagtctgttatgacattgcattttcaaattgctttggttcataatgaaatgtaaagatatataatgggtttgtttccttaggagaacacttaggctaatggttggaaatttaaaacaggatgcctcattaagtgtccttaattactattgacaactgggtagattttaaatatgtaaatgggaaagagtagacataatggtttatctgaattttttctctagagtttgcagaatgatcttgaggctgaacaagtgaaagtgaattccctgactcacatggtggtgattgttgatgaaaacagtggcgagagtgctacagctattttggaagatcaattacaggtaaggacttataaagtaggatagtgctaaggcacctggggtctgagcctcagtcacacattgttcctattcttcatgttcagtctgtttatttaggttagtaaaaccatcttctttaggttgtacttcccagctggggttccacagcatgggggtttataggagaaccaaggtatcattcatttacttcagcctttgggtgtatgaacaagattttgaagctcaagaactgatcccaacaaatgatccacagccttcttgcccagaatcacttgatgaatttgttaaaatgcatatttctgggcctcactgggagtggggccagtgaatatgtaaaaaaatgtcaagtttgagaatttcagtcatgtaggatttaatatccctgtttctttagtagatcaatatgtaaatgtcagcatcagttttgggaaccccaacaacttgcttctttttgctcagtgactatagtgtatgcttacaagtctttataaagagagtttttggtacagttgactcttaaacacatgggggtttggggcactgacctctcaagcagtcagaaatcctagtataatttttacttccccaaaacttaactaacaatagcctgttg

SEQ ID NO: 32812 - DNA, 2426 bp, Bovine  19866880876498
atgactttattgcttacattttcccaagtcttacctaattttgtctttctgtaccattttacatggaaatattctccaagtgttctcatctcttggcatatcacatactcttacttttattgctgtagttggctatctcttccatttattctttgttggctttctctcctttgttcaatacttagctaattttccagaattttgtcctgaaacagattttattttcacttagtgcactcttctctggcctctttctctatttgctgatgactttcaaatctttatctctagaccttgactttcttgagctctaaattcttctgtctaactgcttactagatatttcagttggtgaattcacagatcttttaaaacccaaatccatgtctctcactgtattcccttttcccccttaatcttgctcagttacccaagacagaagtttaggcatcctccttgaagattttctctccatcatttgtcacatccaggcaatctaataccaagtcctattgcttcttactttctttcttgtcttactgcttttactgccattatttcttgaatcacaaaaccatgtaaacagagaaggtaaggtaataggttgtattaggggtgtctgcaggaagctgcaatgggagttgctaggtagagggaggaggcacttaaccaagccttgagatgtcaaagtctagaagttgccatctgcagatagaagaatgtattagcattatcctggccaaagggacatgaggccttatcaggggaatgagagagaggatatattcccaggaaaggctccagcatgtgccagaaactaggcaggtaacattaagacaaaactttaaaaatctaacattaaaaaggagtttaggaaaaatggtttggcaaagaaacttctaggctaaggaaaaaaaaaaaaaggagagaaactaaaagagtcatgatcattacattaaatagaggaaggatcatcttttgaaaatgggagtttgttctgtgatatcagcaggaggggaaggtagggcaatagcacaagggtaccatttccccctgctttaatagaaagaagaaagtttaggatctgctgcattgagaggcaatctttactgttccagatgttcatatagaaactggaaaatacttatcaagtatattgtagatggaatcatcatactgattgttacaatgttcatactgctaataatacaattatgggaaatcattatattaactgaatcattatataaaggtagcttagagggtcctctaaagtccacttcaaacatcctttgctatgatactaaagaacttcagacacttaatagtttactgttaaacttgaaagcgtttgcaagaataaactacttaatagacaaagtctgaactttcttttgtatctattttctgatcaggtatcataaacaaaatgtatatatttattctcaactaagattattagtttataatttcctgagaaattgccagaaaagaaatattttactttatttctgtattctttaaagagcatcttgcaacatctagatttgaggtggggagacatagaatcatgaaacagtttatatttatttgttcaaagctctggtctcatgaaaattgctatatgtataaggttgtttcaacaactgttattattaggggtttgtatgaaagtctgccaacatggtctcaatatttatattatagatcaaaatgttttgaaagagctgcttctcaactgtgatctttgttgtttttgaaatccaaaatgtactggagttgttttcatttcatatagttgaaatagtttgtcttgccagtctttttttcccctcttttatttaaagaccagaagttcttggacaaagaatttctatctcagactgataagaaaaatgagagaattttttctggaacagagaagggtgagaattaataaaaattacacccttaaatgttagtatcctagtgatcctaacacattctcatcaatgataataactcattattgaaattattctttggtcctaaggtagtcatgagttctggatatcattaagcaatgtatattaagcaatataacaaaatactaattttagagtttcagcttgccttgccttcagtaaattcagttgagcaggactcagttcctaaggaaaaaatacttgagacctgaataatatttccatgaataaggtaattaatttgtgattggttcatttgatgcttttaggttcacagaaatcttagtgctcagaaatcttgacacaggcaatgcaggtgtttacatgaatataaaattagcaactatatttagctgtaattaaaatctagtgtggtatgtaaaatctgtttgtctttgactataacttattccaagttaatgagatcttaacaaggcatagagtgtatgtcctttttgcaaa

SEQ ID NO: 32813 - DNA, 980 bp, Bovine  19866880930952
ctctgtctttgaaagaatattcttttatttgaagactatttgaatatttgaatattaatctgggattagtaaagcagaatctgttaaactcatacatgcttttctactgagtagaacagagaagcatttgacttttattctatttcagttgactctcctccatttctctaattcattatcttcatactggtattgctgtggtccatcttgattcccttgccactctgcttctattgttaccatctgcaaagattagaagtcaaggaatacattatgcatgaaaaagttattctttcatcctgatctctgagcttggtaaccactagagctcagatgttgctgctgctgcttctgctaagtcacttcagtcatgtccgactctgtgcgaccccatagacagcagcccaccaggctcctccatccctgggattctccaggcaagaatactggagtgggttgccatttccttctccaatgcatgcatgcacgctaagttgcttcagttgtgtccaactctgtgtgaccccatggacagcagcccaccaggcttctctgtccacaggattctctaggcaagaatactggagtgggttgctcagatggtagttgctgattaaatatgaggagctcaatttatgctggctgacagtggtgttaaatttcaagagtagcatcttgtgttctctggaatgtaaaagtgtggcatttgaatgcttttggtcacaacaaaccaagtacctgctaatgtaattttgatagctaaccaggaagaaaaggaggtacccagtgagccagagacacgcgttccatttaaaggcagctgaaaataagattggcaatctaagtggaacacctcactagcactgctagacgaagaccaggaagaggaaatggaaattcagtaggctgtgtgcaattgttattgatttgcagttaatttctcagggtaccaaatctgcattttcaaatgtagacagcta

SEQ ID NO: 32814 - DNA, 1144 bp, Bovine  19866880958505
ctagctggatactattcaaagttcctgggccttggtttcatcatgtacattatgggataatatctctattcagaactaaataagacagggtacataaaagtgcttgaaaatagagacagaaaggagggagggaaggagggaagatggaaagaagggagaaaggaagaaagagagaataccaactgtattccaaagaaagagccaggctttttaaatttaaatttaaggtaagagtgtacttgagaagtgttttgttgtaacactgacttcagtccaccactttttgaactaagtgcactgagtgctgtgactttgttgagctgcttgttttcttgtattattactcgaatgacatattaacccatcatacatttcacctttgaaacagttgaattgcatttcagtgcctgaccatgagttactgtggctcagaatacttaagaaagttgactacatgcataaaatttgtgagtagcagagtgagaacatggcagaatcccataaatcacttttattgagagttgagtcactctttgctatgaaaataatttatagggcaatgttccatttcagggaaaatgaaaattaatggcatttgtcaagataatgatgaataaagtttccacaccagtggaaaagaaccagtttcacagaaaatgtaaactttccactatattatttatcattataaatatttcaggctctttggtaaaatgttaggaagtttggctgaattggatattgttcacagtgctagctagtctctgtgtgttctcccagatccattttcagcccttctatctgctgctctgagccccaagagttcctaaggcagaatgataattggcagaatatttcctcttcactcccttccaggcttgacacccgaggtccttggcagtagctgtgtccctgattacagcagctgccatgcagctctggtctgcttataaatctggggaaggaaagccttctgctggcacttgttctggatcattccagaacatactatatcatatgaaacatatggtttcatatggaacattcataccgtatgaaacctgcctcaggttttctttcttggttcctttcacctgtcctcacctgtgtaaacttaattagtgctaagtcacttcagttgtat

SEQ ID NO: 32815 - DNA, 1054 bp, Bovine  19866880963899
caacacacacatacacacacacacaaacctcttattttctatcagatatgaattcagtaaaggaataggaattagcctgcagtttttcaattatgagattttttttttaatgtaacaaatttggaacacttactagtacagaactgccctccacaccacaaaaaattaagccaacaaccttggcccaagtcagtgtttcaaggagacagaaatttgctagcaaaattggtagcatgacaactaaaatcctaaatcatgttactacgatcaattttttggatcatatatatagaaatttataccaaatttcaaatctcaaatttgttcaactctccattacaagtcaagtagttattttaatgtttccaaaataaagatatgtaagcagataatacaaatttacagataactggattatttatatgtgtattaagtgagtataattaacatgctaaatatattctttcaggtttccaaacaagtgttttctttatatttgaattttagagaaaacatctaacttttgaaagccttttttggcttagtaaatcttacccattaacgacctttctccattagggggacaaacacgtgactgaattaggagaagaaaaatgtgttaaatcccttaaggctgattttccaaattcttcctctaaatattttgctcttcttaaaatgcttttgacaagctcacacagatccaagggccgctgcccagcctggaattttatttttgtgatgggtaagagaagtgaagcaagaaacatcaacaaaaccatctgataaatcttccaggaaactagctaaaatttttgttcacttcaccagctcaagggcacatcaaaaattcttttagcagaacctagacacaaatctcaatttaaatcttaatcaataatgtttctgtaaaaaaaaaataataatccaacactacaaccataaaacaaaattctgtatttccataggtctatctatatgtatataatataaacataaacttaggataattgctgtacaatattctcccttcagctcgctgtccacaagtctc

SEQ ID NO: 32816 - DNA, 1923 bp, Bovine  19866880994664
tttaaaaatctttgggggaaaaagtcatcaataaatactgaagatcattaccaattggtttcagcataaaatatataggaaatggatgtcttaaactgatttgggttttaaaaattgatgctagtgataatttacatgcatgaaatcatgcccacatacctaaactgcaggaagagaaagaaatgggtgactaaggtaatctcaacacaagatggtaaagcagttagtttgctcaaataaaaaaaaaacacactaacactggccatgtaggtgagttacatgagagtataaatatgggaaagcatacatgtattaagctctcagttgctaacttttaaacaagtgagcctattttaaaaataggagggagacaggaatttggaacaagggccaggagttacttgtttgggaaagttacttgtttgaacttgcctggggtcctctggggaccatttctctactggggtatcatcactggcaaacactgaaataatatcttttccagaagatccagaataatcatatgcactatttcttaattcgtcattatgaatatcaggatttttttcctttccccaaataaatagagcaaacagaattcaaatacttttaacaacctctcatcactgcccaattgtaatgactgaagacacattgagtctttaattattagcaatctggctagcaattcataacaaagtctacttgctaattgagatgaaatgcattttgtcatctacaaattgagacaatattgctatgcatgctacaatatttgtttctctcttttccgatcctaatatgaaaagatcattagtttagcaccatttggtcatcataccctctttgagtttcagagcaattccaaagaattcaaagttattttgatacaatgcactcaatctgctgagctccactcattaactttggaaattaaatgggtgtgcttaataatatgagctttcaccactctccaagccttcaaattggaactgaaaaaaaaaaaaaaaggcattacataaatccgtattgggaaaatatgaataatgccagtgttcttttttggtaggggagggattcttcaaggacaaaccaaattgtttctgttctatatgcataggttggagagaagcagcttatcaaaaagacaggaaataaaagagcagggtaactattatagaacttcaatttagaatttttgatttctttgtgttcagcctatagctcatggtggtgcatctgaaagtcacaaaaatcaatgagagggtgtttgaagacacacagcatgaaggcccaatctgacgccttaatgcctgactcctcagagctgagaaggaggttaatcaatacttatatattttagatttagatgtatttcaggttggaatatcttctttgaaggatgtggatatgactagattattggcctcaaagtctcttcttggccacagtaagtctgttttctctttcagttggtgagtctagaaaaaacagcagaggaatgccctcagttttgtctcagcattcacgtgtgctgacgcagcatgagagaggaatgcgccaggaaagatgagaaaaaggcagtggtgaaaaagtttccaatgaattgtgaactctttctttctctccttatgtaatcatttgtggtgtaatccacagcattgaaagttaggcttttcagtttctggcactttctgcaagaagagttcactggccttacctggggaaagaattatgccaacaggcagtagccagcagtgacctgaacaatttcatcttccgcactctctgtcatcttgtgtcccaaccattcatctcagcgtcatcctagtccttaaagaaatgagactgccatcttctggtggtcttctgtgtgctctcattaacatagtcattttctttgctatacagatgactctattt

SEQ ID NO: 32817 - DNA, 1003 bp, Bovine  19866881068363
tgggttattttgacttggattcgctagaggcacagataaggatttggatacagatagtttcttggcagggggattctaggaaatactgacaaagaagtggagaaaaaggcactgggataaaagggaagccactgcggatacgcagtgagaagagtctgctctgggcacttagggctccatgtctcaggtggcctctaagccactttgtaaagcagagctctgggttctcccatccagaaggggaggaaactggggtatttatccgccaacatctactccataattggttgacggctgctgccaagcacattagcaccaaggaattcgagcctgggttttgtacagacagagcacagagaaaaccttgagcagaaagttagaaggtggcagtcagaagctgtgggtgtccctgagaacagggggtgcttgggggagagatggacagaacagctgcagcctctgctgtagtgttcccgagccacctcctgtgtgaggagaatcactaaccaaacaccgcaggtaatgaagggtgagaatttggtcataggattctgggacctgggtgattgtttctcctcttgtcttctgtctcccctcagagacagaatttacatgcaattctccaaggtttttccatttcatttggagaactgcatgtaaataagaggaacacaaaagcaatctccccatatattctatagacaactttcagttctaccactttactaaacagtctggccctccctcataacaataataatttatcggttctgtcttgttagttcccaaagtgttctcactcttattaactcatttgaccttgtggagacaggccattctcatctacattttcacaagaagctaaaagcacatagttattaaatgaattgctcaatagagccggggataaaacctccgtctcaataaatacatattgaacatctatactccagaaactgtactcagtttaggggctataaagattaattagacatgtccctca

SEQ ID NO: 32818 - DNA, 1291 bp, Bovine  19866881081923
ctgctcctgaaaagtgtcctcggcagaaagcaccaggtcgcacttcctccagtgctatctgataggtgtctagatccatatcaacctccgtgacagtgctgggggtttcagctcggggactctcttgctcctcctctggtgccgagctctatgaaaacaaatccaagaaaatccacaagcatcgtgaagaccagaaggtgttcaacaaaggcacactggatggagacccaaggtaaaacaccactgtgtcttaaggcatctgttggactctcaggagctgggtgagcaatgctgtgaactagtcagaaagcatttattcatgccaggatggcaaagagtacaaaagctgtatcactcatggattccatactcagacatactctaatatagctgttattattcagtcgctcagtcctgtccaactttttgcaaccccatggactgcagcacaccaagcttccctgtccttcactatctcccagagtatatagttgggaaaagacaaataacccacatgaatcacttctaaacaaaaataaaaaggctcttaacaaagttataaattccatgggtctaacaagggatgttatttgaattcatcaagggatagatcaggacgtttcacagaggatctggaacatggtggaccttgaaagggtagatgtcatttaaagagagcaattagaacccttgttaaattgcttttactgaatagcatcttagcattgcatttcagacactaaaagacagccatacatatacaggctactgtactgatgatatttttctgaggcagtagccctccagtttactagctgtttttttttgtttgtttgtttgtttgtttttaagagcctgtggaataagttattccaagctccttctaagcaatggagtattttcttatatacttcagaattgtataaccaaactaaccacctatctcattcactagttcccttccagagcaaagttctttaaaatttgcttatagcctgtctctaccttttcacctctcatccacaactttcatgtatctgaaacatacaaacatgtatagaaaacaacataagaaaaggtcatgtatttcgcaactgcttttgttaacactccctttcatgctgatcaggtcttggtccctaccacacacctggaaagtattttgccactgctaccaataaccttctcaatgacaaatacattcttctagcatcatcttcaggatgatcatgtaatgaacacaaaaccagaacattttttataaccaaagtgctagaacaacatacataag

SEQ ID NO: 32819 - DNA, 2383 bp, Bovine  19866881118862
ttatgggtttgggggacataaaaaattgagtctatagcatactttgatgtccttttactgctttgcttcttctaggcccgagtagagaattgggctaaatgtactctgaagtaatgggagttttagcacagaaatcagagatataaatattcccaccctatttgggacctatagatagatctcgggcctcaatcatgagagttccttaaaactgcaacacacaagtagtcttttaaacagaagttattctgggacattccagtctgaagccaaaaatgatctcccacccaagaaaggaactcaaaagaaaaacaccagtgacaataaatcacgacaattaggaaaacaagacaaggaaaaaataaatcacacaaataaactcagagaaataatctgtccatttaggaaaatgctgaaatctgtttgtggggaaatctttaggataaagacagggcactaaaggagtagaaacagaccaaaatcctttaatgaatcatggaatctgtaaactggtatcagatgttctccatcagtcatagagccacagggagccttagcaacatttcagattcttccaaataaggtaaccccagtcaaaagctatgctcttaaagacaacaatttcctcttacctgctcatctacttggtttagaatgaaccaattgttttcagaactaaagtgcctttatacatgtaagattagaagaattgtaaagaagatttctttacacacacacaccccccaccccccacatttttactgagtcagactttccaatgtcagttggagagaaggatttataatctgagaagagaagctgtctgtggtttcacttggtggttagggagcgaggacgatgtgttttcccattgtaacatagcaacttgatttcattgccgttcctctgtcatatgtacaaagggagatgtcaaatatcccaaaagagaatattccagaaggtgcagaggtggtctttagttagcctatgagtttgcagacctagagacaaaaggtaactacttcatgttttatgggagttgtatctaaaacttgattagatttaggttaaacaattttagcaagaatacttcatgacaccacgtgttttatttgcatcccatcaggagacagtgtatcaccagagatggagagggcccccagtgctcactggagttttcattcattgctattctctgcaacagcattggagagctgacaaagtagaaaaatcattttatttgatgggttactagtaacataaactgtattaatttatgtgaactgtttactattctttcctaatcagagaacagattatgaaaatgtgaagtaaaattcgctcagtcgagtccaactctttgccaccccacggactataaccctccaggctcctctgtccatgggattctccaggcaagaatactggagtgggttgccatttcctcctccaggggatcttcccaacccagggatcaaaactgagtctcctgcattgcaggcagacgctttactgttgaggcaccagggaaacccctattaatgattacatatttcattaactcctgagcctaaatcattttgtgacatgttctatttactcagactggaaaaccttacacatgtaatcttcatagattgctgttgggccaaataaacaaacaaatgcatattttttaaaaagaggaataaagcgagaatctatttatttaggatttactaagaaatgtgtctatttgataaggaaaatgaatgcaggtgggaaatctttgcatctttttatcccatccttattattcaatatatttagaggaagactctcatttattatctaattgtttattgctcctcggagtgtccctcccctccatctactgctccttataataccaataagaaaaattcagatagttcccttgggctatcatcttgattttcttctatagtaatgtaaacattagtaatttcactgctatttgattcttatgttacctttttattgtcctgggttattttccctgatcataagaaagtagaagcgttatctgttttcacatcaagcaatcttaatgtttatatgattataaacatcatagagtgaattcaatagatgatgttttctgaactttggtcatttgaatatggtctttactggttttgtgccagtaccatactatcttgaggactatagctttgtagtgtagtctaaagtcatgaagtgactctcctcctttcttccacctgctgctccatcacttctcagtttttatactttaatttgttcgctattgaaaaggcaaaatgtattctattatttgctctatgtataattctattttctttcatctgggggtagatatgaatgtttgggggaagcttttcat

SEQ ID NO: 32820 - DNA, 2128 bp, Bovine  19866881174779
taagtggaccttgcctagaatagctttttcgtccctttgcccccaaggaatcttcacatgcattatctcatttgcttctcaaagcaattccttgagatgaataaagttaagtaaaactctcccattttatagatgatgaaatggaggcagagagccagtgagtgaattctagaaggtcacataggtgtcaagtaacagtaattagactgaaactcaaatttactaactgctggtccaaaatttcctctaaatcactgtgcctccttacaccatgattaccttacacattttcctgagcttggcctgcatggtgatcctcaggggaaaagtccttctgacaaaactgtacaagattatttgactcatttagaagtctcctctcaacacacaaagatagaaagggaaagcaaggagaaaaatgagagatggagggaaaaaaaggagagaaaaagaacagaaggaagggaaggagggaaagaaaggaaggttggtgagagagggaaggaggaaaagaagaaactttgcattggggtctaatcggggtgtcaggatagcatcactgactcaatggacatgaacttgagcaaactctgggagatagtggaggacagaggaggctggcatgctgcagttcctggggttgcaaagagtcagagatgactgacattgcacacatgcaatgtgatacagataagtagatgttatctacttatctgcaacatttcttcgtcattcatccttgccagtgaatcacaaacttggaaatataaaatcagaagtaatgatatcaacacaaagcaggaagcgcaaagctatagctgtctaagcttctagccctccttgggcaaaatatacttgcccaaggagatcagcagctactaacaaagcccacacaaactgcatcaaaagaatgaaatttggcctcagagcctctttttatctttcaagggaaaaataactaggaaaaaaaacacaaaagagagtgcaaagacgacacagatcacaatcgaagcagtttctgcaggtattggctgagctcctaaaccagaatccaacactgaacttgcaacagcagggaacagtcattcacacacaagttctttcaatcacagttacatccaggagaagggcgagctcagcttttggcagcagaatcttaaatacttaaaaccatgaagtgagctttgccataactcaagttaattcttcagcagagccaagacattcccaagctaccaactccagtgtccagatcctccatccctctctcgatgtactacaagtagaactatccaccctcctatttgcatcctaaagattttttaaagatttaagttcttccgatcacaagtcctgcacacacaacatctccaaacattacccaatgccttcaaagtcatgcaaagttatctctattaaacagtgcaaagtaacctactttcacatggcatttggcacacctgcctatagtcacccccctactcattggtgccctctgcctggaaattctcctccagcccagtacccccatcagtgttcatatcagctggtaatctgtctttcaagaagcctttgacagattttctccctctatccagctctatactccacccccaccttttgttttttgagtttttgtggggtttttttctttttggttgtgctgtgtcttcgttgctgcacatgggctttctctagttgtggagagagggggctactctctagttttgatgcacagacttctcgttgcagtgacttctctcgttgcggaacacaggatctagccacgcagacttcagtagttgcagcacatgggcctcactgctcctcggcaggtggaatcctcctaccagggatcgaacccatgtcccctgcacccaccaagtggatttccatccactgtaccgccagggaagtcccactcccaccttttgaattcacattgtattttattcattacttataacaaaacaattgggggattttgaaaattagtaatattatgaaagtgttagtcactcagccgtgcctgactctttgtgaccccatggactgcagcccaccaatttcctctgtgcaggaattctccaggcaaaaatacggagtcagttgccattcccttctccag

SEQ ID NO: 32821 - DNA, 811 bp, Bovine  19866881184044
atgagccatacaaaaactgacagtggaaacatgaaaagtttagacataataataggatgacttactatgtatcggttatgttctaagagatcaatacagatttaaatgcagtctttgtttctttaaatagaactataaggtaagaaaactgagacacagacgtgacacggcaggtgagaggcagaaccagacaatgataccacaggtctgactccaaacccaggttctcaaagtccacactgaattgcaaataaaattacgagagcacggggtcctgacatatagggaagaacagttaatcagaggtgaggtgggaggagaaaaggatggggtatattaatttaatgacttcccaaagacagcaaacaagatacatgccacaagtaaatgaactaagaatgaaaattctgtttcaagttcatggctttaaagcacctctggtactttcaaatcacaggctctaaacatgggatccaccctcggaaacagctggaaatgtcagaagtcattgctgaataaaaataaaagttgattcagcccgacagttaaactcttgtttagatttttaattctctgccgaggcttatctgcagaagcttctctgacagagagaatacagtttaataattcaattggacaaatatttggtgaataactcctttgtgcctggccctgcagaaatgccaaactcaagtcaccctccccatttacaagtgagggtttccatagtttttcaataaacacaaaatagtacaaatgaataatcctgaattgaaagacaaataagacttgagcagcatttagcattttt

SEQ ID NO: 32822 - DNA, 741 bp, Bovine  19866881236951
tgccctcctcgctgttcgaactccacataagtcatgctttttgaaaactggctccttacccaggattttttttttttttttcctttttcttcctgaaaccagtgtgaatggaggaagttggtaatgcttggctctttatttttattctttttttttttctttctttctttttttggccttctctcatgcaagtttccaggatataacttctttttttgctgtgcgtaattgagaccaaactctaagtttggggcccaggagagaacagttgtgggctgcaggtcattagtgaggtgaacagaagggactcctaagcttcccagagaaaaaggagaccatgccagcctcgtggaacgcagctagcagagaacataccgacaggtcttttccttatgaactccgaagtccatgaagtcccggagcctcagtgaagtggctaaaatgtcccaatgcaagctgctgctgctcatggaccatagctcaagggcaaagcttgtaaaggattttacaaaggattttaaagtatagcctgaaaagatacggtttttagaaattaaatgctgttgtctgaaggaagtttgccggaaagatgtaggcttcaagggctactggacaatgattggtctgaacttcagcttacgggaattgctgacaaaatttgaaaaggtatgcagaaagcagacttcacaaatgtactttttttttcctctctcttcttcctttcctgtcttcttctttcta

SEQ ID NO: 32823 - DNA, 795 bp, Bovine  19866881257788
gttaagaatctgcctgtaataaaggagatgcgggagacacgggtttgatccctgttttgggaagattccctggagtaggaaatggcaactctctccagtattcttgtctggaaaattccatggatagaggagcctgatgggctgcagtacacagggtcacaaagagttggacacgatggaacgactaagcagcagcagaaacagtaggttgcgaatgaatgaccaccgcaagtcaactaaattgcaccacacaaggccagtgagaaaaatgaaaaaaaaaaaaaaattgtactttcctttctacaattctaggagattggagaaataaataaactagaacataggatagacttttgaccttttaagtccaacaccatagggattgaactgtgagtatcatagatttaaatggtttaaataatttaaataatctgatagatttaaataatctgaatcatttcttcacccaactatattaaataccagtatgagtatataaaattcagtcttgccatacttgtcaattagagtcacacatgagcaaattttttgtgtttgggattaaatgggaaatgcagtctgtataatgtgaaagaaaattaaatacaatggctgtctaactctgataaaaaaataccctaacatttgctgatctcttcatttttgttgttcttggttgttgttggagaatgagctctggatcagcataaaacagtaatatttgtgccagaaaattcagtctggatttttcagccaggaatgatcatatcataatcctacttgagatctaactga

SEQ ID NO: 32824 - DNA, 1131 bp, Bovine  19866881272482
tgacttttgatcctttgtgaataaacattagcatggtcacaagcgaatttcccctcctggcactcttggaattaaaatgaaactgtattcttaaatcctaattgtatgaattgtctagttaaacatgacttttttttcttgctgtgtttgtatattgttgcacataacactttaagaattcctctatcttggattaatgtcccagttggtcctgatagcatccttgaattatggccttttaaagttttcttttaattatgcatgttgagtttcagagcagagacgcaagcatttccatctcttcctgacaaggagttaatgaagggaatgtaatcatgttgcctattaactgatatactaaaatttccattgactgccgtaactaattttttcagtgtaacatcattttgttgttgtttttttcttttatgtcatccaaatatacaagatgctagtagtaagatgaatattattttcactaatagactaacaaatgctttttaattattatttttatctgcaggcatattcttactgtgaattgcctatatttattgagcttgattgacattcatcaaaacttcaagacctactaaaatacaatgatttcctgatttctttaaaatatgtattttatgatttgttcaagagggtacttgtagcctttatttaataaaaggctacagggttaaaatgttgatttgcagcaaaacagatttgatttctgtttggattcggctgtttgttactgagaagagaagcttacctctgcctatggtatacttcatgctcatgcaactaaggtttccctcaagagggtgtagttctgtgcaagggtaattcccctgtgtaaggaagtccactcttttttccctgatataacttacacaattggtaggacttgattattccccccaatactactggggtgcacactttccctccagggcatcataagaagcttccacttcttgctctttttctcatgaagcacctactgtgtggtcacaggttttttgtttttttgtttgtttcccttcaaaaagggggaaacaaaaaaatagaatgatgaaagtagtcacatgctgttgattagggacgatctttaagacccagaacagatgctactat

SEQ ID NO: 32825 - DNA, 723 bp, Bovine  19866881322397
ctgggattctgtgagccacaattttgttgtattttctctgctttatagataatcatatatctaaatcatatctaaatattaacatgtttatttatttccccccgaaatgcagaaagaaaataaagagaatgacttgttaactactatgaaactggaacactgtggtcgtctcagctttgataaatgaaagatcaccttggaatataattcatttttaattgcctcttccatctaatctaactactgctgtaggctgtcttaaaatatttacaaagtaaaagcaaaaaaaaagaactggagttgctaaataaagcaggccacacattccaaagtgatcaatttttccggtattgtttacaatataaacaaagtcataattcttacagatggaatatttggaaacacgggcgaagtacgctgaaggatgatctctctcagtgctacgtttggggtttctatctgagatacaattgatgtatgcaactatattcgcttaccatgatctgatacatgtatatattgcaaaatgatttgcatagcaggtttagttaacattcatggccacacatggttacagatttttcttgtgatgggaacttttaagacttagtaactttcaagtacacatacagtactgttaaccataattaccatgctttacattacatccccagaatgtaagtttgtactttaaagatgcttttaattccccttctttcccac

SEQ ID NO: 32826 - DNA, 904 bp, Bovine  19866881347409
cccatctagctgtctctctgtctctctcttttttgttttgtattagcaactacatctgtgcatgtataaactgcttatgatttgaaattgtgttttgtgtaggatgacatcacaaaatcaatatagcaaagagatcacttattttatttcccaatattagatactgttttataaatagtactgaataaaatgaagttcatctatggtctctgattttgtcacatttcaggtcaatgagttataatcagaatttatttccattaagttctaataaacaaataccctcaaaatatcaataaaatgttaagacatagaaaaaggtcacaaaatacattccatgtttaactttccaagaaagagtcactgctgtatgaacttaaatatcattaaaacaggtatacaccttaaatattactctttttagcaactcagaaaggcaaacatttacaaagaaaagggagatccaaaattagactagacagctgtctgaaaccctaaaattatttctcctgtttcatttctaaatatcttagataccaaaaaacttacttaacctgcatttatactaatgaaatctgaaaatgaaaatttatcactttatacctggtattaaattcagttgttagatataaaagattgaaggtttaaaaaaacactgcacacactaaagttaaaggattctgagattcgataccaaaaacaggtgacgcaattaatagaatattgattcatttctaagtaattttctacaagtagttgacaggttatttcttgccaaagtgatgataagggaaaagttattcagtcataatgaaagaagaatgggaacagatctggaattgaagtttaacaatgatattgcaggggaagttctattatcaatgccctgccgagcaactgatat

SEQ ID NO: 32827 - DNA, 1521 bp, Bovine  19866881400236
atacacaaatgagagagacagaggggcagtgcacctgccctgctcacctgggcacccaggtcattgtagagaaccttcagagaagtcagctgctcatccatccccttagggttgtcggtttgctgcttctggacaatgtgccttcctgttttgattacagtctccacttcaagcttgacttcactcaaaattttatagagtttcttaaaaatagagccagacaaattatacatattagtgaaaatgtggtaactggaaccatttcagaacatggatgacaaagattgacagctaaaaactaaccatggagatcaaagggctttatctctctcagatctggttcaaagaatgagtaagatgaaatcaaggttgaaataattttttaaattcagataagaaaatacactcatagagattgcctttttttaaaataagactagtataatctcatagagattatactagtcttatttgaaaaaaggctcaaacctgtatcttaaaggcttaggaaagtacttgataatatgaacatttttcctacaaaaaatgggaaaacatgaagactaaaaattgaaagtctaacatttttttaaattacatttttcaaaatcctaaatgccattactagaaaaaagctaatgctggctatttctggctgtgggaatttggaaatattaagattcaattttttcttacagttctctgaagtacaaagtctaccacaatgagcacattagttatataatgaaaagacatataaaacttccatacatcaatatgtatatgaccatagaaagttgaagttatacaggtcaaattcagagatgccctcatcctcgttgctttgaaactgaaaagcgttatcctgggcaagttatcttatctctgttcatcgtagtgttgacctgaaacacccatgtggcatggccatggactagatgacacaaggtcaagggcagtgcttgctttggtgatctctgtgttcagtaaatatgcatgtacattcatacatgcacatgcacacatattatgtataaaaattcatcctattttttcatccttccattcattccagtttttaagtaatcaaacaaccttcagtatgcaatagacatgtggagatcgcagttttgaaaagcacaaagaactcttcccagacttttcttaacatgtgtcatcttcagttttctcatgattcttctcaagcagaatactaattctaagactgtgaatactcaggcacgtgatctttaaatttctgtgcaactgaattttaaagttcaaaattaaaagagtaataaagtcttttaaatatttttttcttttacatcttaagtttagatttgatttaaaattttattttcctagagaatgatttttatgctaccatattactgacatccattctaagtataatttcttctttcacactttaggcttaaactttataaattaatatttaaaattttactttctttgagaatgaatttgctgtacattgcaatattcctgacattcatt

SEQ ID NO: 32828 - DNA, 1418 bp, Bovine  19866881404486
aaaattagaggcccggagtctgtatgcacactacaggacataggctaagttacttttactaccatttgtacactgttctcagaaggaaaccacctaattttaccacctctgctatttactagatatatgctttggggtaaaccactcaatctccaattttctatggagcttgggctagttgagtaaagggctcatgtcagaatcagaatctctagcggtcctttgaaaactgcagaggccaccagagattataaaacccactgcaagagtttatccattcgcactccatccctagtctcaaattcagcttcatgaagaatcactgcatgtaaataaaatgttactgatgggaatggatatgtggtgcagacagcaaagaggtcaggaagcactaatgtgcaagattcagtcctaacatcacatccagcactgaatttacactaggccacgattctcaatgcagagctcctatctggcactcctggttgctacatctcaagaaagatcagaacagagctggaggaagttctgagaaatgtaaatgagagggtatagcagaaggaacactggcaatgaatcggaaatagttttaagttcaggaaattgtggctactagataaagatacagaagttttttttttttttttttaatctttcaaaatcccccaaatcataaagcataaagataggctgaaaatctaaaatacacaagttttgatgtttagaaggataattttagcagaaataaaaagtttttgttcacacagaagtaacagattatagaattctttagaggaagaaatggtacagaacaaaagtataataacttaccataaaagatttatggaatgcatgggtgaccaatttataaggttcatattaaaaggaactgggatttttaaaatgcaaatgcttattttttaaagaaaagtctgttatacaagcaactagctgatatgctacaaaatagcttacagtcattttgcagcattacaaaacatggtcacccacataactgacttttttaaaagtgtgattttaaagtgttaaagtaatacctcattttttaatctataagatataatattgtttaatatgcacgtgcttatcattagtctaaagaatgtctgaacgtaaataggtgaatcttttgtttttttaaagacttcaatggaaaagaatgtcttagcaaatctagagatgtgtcttgctaaattttggtatactttaaaggcgacctttacagtcacatgagatttaaatacatttttctcttctacagtggaaagtagtagcatcagtagtttgagtggcatgtataaaacttgcaatgaaacaattccttaagctttccaatgagtaccttcacaaggtaatttgtcctttggtgtataaaatatcatttaactaggaaatat

SEQ ID NO: 32829 - DNA, 869 bp, Bovine  19866881408285
cattgatgcaactctgaaacaaaagtgagaacaatccttgttgcctctttttccatgtgaagatagcaactgagccattcccattactctaaaaagtcagaatttacaatattacccaacaagttatgcaacagcacgaaatgtcgtatatctttgaatagagaaataagtgaaacaattggatatacaaaatggggaacactttactaagcaactttgtactttctaaattaccttgatactgtatccactagaaagaaaaaaagtatataaactaattgaaaacattcaattagctcaagaaagataaatgaaaattaccaatcctaaaacttcttcctactaaaaataatcaaattattgagttttacaaagaacttgagtgagatacacaaatagtgtctggtatccacaaactcagaaggagtaaccagcaaacttactctgacagatggtttcatagtcagcaaaagtcacagaatagttagaactcagaggaggctgagagacctacaagagcccttaactctggcaattctctgcactcagggaaaccacagtggaaatgaggaggctagacaaacccacatgaaatattaaccaaaacccttccttgcttgttctctgaacactgaatgagtaacaggcaggcatataggaatttagagcaaggggtaaacacgtggactggattatctcagaaggctttatgtcagtttcatataatggaaaactataaatatcgagatttcctggtaaatctaaagaaacgctgaatgaaacattttgttcatgcgtggagaaaacatttcaaaacttcaagtgttagatatttgagcattttataatttcaaacttaagtgagtttg

SEQ ID NO: 32830 - DNA, 1366 bp, Bovine  19866881480834
ttcactttcactttctttctttaaatacagaactggacatagagccctttcatgtgctggatggctgtgtctttacctgataggagtccttcaagcttggcaaggactcctggggagattctgaagaggcagtgtgttttacccactcttcttttgtctttatggtcttttcgagctcatcaagatgcttgaaataagcattaatatcttcctgcagctgtatttttcttgcctgatcttccaaacgctgtgatatattcttccattccaataataccttctctaaaatattttttacttcttcagtaggaagaccttctatgtagacataaaaaataagcagacactttaggtattattacaaaatttgttttcaatttgctgtaaacattttaacacattgaaaataatgaggcagtatcgtatttactgatcactctcttaagttcctttttacacaacaaacattaaaatgatgctctcaaaaataattatgcttaattccctgataaaaacaggagagggggagcttatactagcagttcaggagtggggtgaccatcacaaaaagcataacagtggagtgtcagccactgccttctctataggatgtgtgtttctgtccttagcaacctactgctctactagtttttagtctgagtctgagaaataaaatgaagggtttggatttgtctggggctctgacatcagaaggtaggccctctgtcaccaggaaaaagagagaaaaaggaggagacagtttgagactttggtgaccaaacccacacgtcataggaattgcaaaatgaatgtctagagcccctagtgctgggagcaacctggtaagtgcaggaataggaagccagcaggcaggattcagcaaaaggcattagcaaacctattggaatgttacacacagaccagcaaatccagtgctgagattatctactttagaaacatatcaggaaaaaaaaaaaaacattatgtttattgttgacatctcataattttgtttgtctcatatttttgagaggtagagaatgtacataaaaataagttatatataataacaggctttatcatagtctttcccttaatataaaataccatcaagtcataaaattactatgaaaattatgggaaatctgcaaaagaaatgttatctcctgagaagggcatgcatgttgaaaagatgggcttaacatctttattatttaagcaggagggcaataaaactttgtaaatatatgccatcaaaatccagggtaatgagagctctaagggggaaaaaatggcatgtaagacaaaagatcacttaggcatccagagatgatgcaattttaaaatttttctaacacaccacatc

SEQ ID NO: 32831 - DNA, 657 bp, Bovine  19866881555479
agaaaatgccccacatgtgggactgtaccaatgaaacacaattagacagaacaccattacactgtatttaagtcttgcatagtaaacactgtctagattacaaaattagtacttatccaatgacaaaagaactgtgattcattgaatgaccttttgcaagtaagacataaacaaaaataacaataatttccttcctttaaggatttgttttgttccaggctccagagttgcaaacagcgacgccagtgcaaatcatgcctgtgccccaatttgatccttccacatacaacaaggtcactcaagaggggaggtggagtgagataccctgatgccaacggcctaaggaaatgtccttgggtttcagctactcagatttcccaggactatcctctttttgagacaggcccagttcattctttgaaatgaaagaaaattaagtcatatctgacttgcaatcccaagaaccatagcccgccaggttcctctgtccatgggattctccaggcaagaatcctgggagtgggttgccatttccttctccaggggaacttcccaacccaggaattgaacccagggctcccacattgcaggcagatgctttaccaactgagctactcaggaagccctgaaagaaaattagtatctttaaaatgaatg

SEQ ID NO: 32832 - DNA, 2466 bp, Bovine  19866881579353
taactctctccttagattgactcagacactgaaagaaaaataccatgacagaatgagggctagggcataggtgttattcctgaggctggtcagctacttccatccttgttccaggttttgggtgggaatccgttttccaaagctctttcaaattctggatagctcttctaagtttatttctaagtattggtgtcctttcttattgcttccagattatctcatacacaacctttatttctctttaagctatcatcagagttcattttaaaccaagtcttctttttcttattaatttttttcattgtaaagttgataatcttattagtgttaagagatttgtgaaacaaagttggattactatgagggacatctgaagccagattcctgaagtcaggagttgctgaactacagccagctggccaagtggccctgcagcctcattttgtaaatatgtttttattggaacatggtcacatccatccatttacgtatattctctattgctgccttcttgctacaagagtggagttaactaactggaacagagattgtatggcctgcaaaactgaaagtatttactatctggtccttaacagaaaaatgtactgtttccatgccttatggagtcagatcactataagaaaaaatggtcaactctgagaaaaattagttggctaccatcatgataattaagtagccagttctgtctaaaattgtccaggattgcaatgtgtcttaatgagatctgacacttgaaaacattttctattttgatggttcaaaaggggacccaaattaccatcttccaatggaaattaccgaggttcttctatatgaagattctctcctgaaagctacctccagctaattagagttgaaaactgaaaaagcctcattgcaggtcgttttggtgagaaaagaaaaggaaatgacagtcaaaagtctagattacatttagtgactggggggtgggggtggagaatacctccaaatttgaaaatctttgaaagaaaatttgaagaacagtttactaaaaataagtaaagttcctgtctcttttctcttcacaagaagccaactgtatatcacaggggtatcaacaccagactcagtattctgagtcaaatcttaaaacaaataacgagcacttattattaatttgcattaataaaagaaatatattcttgatgggttgttccattcgctgagtaagagacaaagtttaggaaagtgtgaccaaaagaaggaagaccagaggagctacttctggctctttatgcaaagacatgcttataaattctaaaataagtaaggtatacttcagttaaagcaccagagaggatcatgttctattaaaaatgaatctttctaacatatctttatttatttggtcacatgtcccatgcagttctccttttagtgggttgtgtacatctgggtcatatacattctgaaggatgtttagctttcactgactttccttaattcaatcacccatgaaatttgcctcccagttaaaaccgtcacatctcttgtggaaagcaatttgaggaaaacattttaggagacacagagtgttcacagcctttgacctagttatcccactgctgggaatttatcttaaggaaataattccaaagaaggaaaaaaaacttcttattaactaaagaattatttataatagcaaaaaaaaccctttacatccaaaaataagagaataatgaagtgaattatgatacatcaactagaagaactgttagttatacagtcattaaaatgattatggaaactatgtaataatactgaaagtattcatggaataatgttaaggaaggaaagcagaatgtaaaattgtatctgcattgtgattacaatatgaaaaacaatgtctgcatgagaacaaggaccggaaggaacacaaaaatgattttttttgatgaactgaagtacagggattacttagggtggtagaatgaaggctatatttctttctttaataaatgttgtttataagcttaaaaacagagaacatctcacttttctccttccctttaatatttaaaataatttaagaactgtatcagtcatggtccagttacaaagaaaagaaaccattccaactagattaagccggatggcatttattcctggactgaggcaatggttgaggaaacagactctgaactgactttccagagatgtcttgaggctgtcacgcagaactggacaccccaaaatgctgcttctcctgccatgaccagtaagcagcttgcaaaactagaaaaggaacactgcctctatatgcactgcaccaaggagatggagcttcatgcttttttctcttactgtgtaactcagttttgaatataagtttgaaaaagagcatcagattgacagtacctaggtcacaagcaaaaggctttacagcttccctggtataacctcagatatgcagagacaccacgc

SEQ ID NO: 32833 - DNA, 1399 bp, Bovine  19866881647703
agagcatgaaactttctttaaactgttatagtcaataagaactttccgtcccccttactctccctcagcttggctctgctttagttctggcaagatttaaaatagcttggtctgtggggaaagggagaagaaaacaactagaaatgtatctccccaagtggtgggcagctcagctataactagtcctagctcaaggagaagaagaagataagcttcatctttcaatgagagttgaattgtgattggtattgtactggccaattttgattattggaatgtttgcgaattaaagaagctgtagaatcattcactacctaagaggggccaggctcttctagaggcagagaacattctaccccatccccttacccgacaggtttaaaggacagtggggacaatatgtaaatttcctttatgaattcatcccatctttccacacgttaaatgtctagtaggcttgctcattcttcactaccactgagatttttagtcccttaacttttcctcttttcttccctgttcattctcatgatttatcattctaatctattcagaacagaccccacaatttgttgcttcaaccaaattcttttctgagtgtttcaatgattatccttgtttttccatcatgaaatcttgtaataaatctaacctttagagaacatcacacacctgagttctcagtatcagggtttttttatggtctccagtctcagatgacccatttacatggctcatcaagatttctgtctgcctctggtcagtttcctctccctgtccccatgtttatcacagattttaactcctctgttcaagctcctttttctgcacttgccctttcctcttctggttggtaaagctgctgtctgcatcccaaagataattgaagttgaagtgggataaactatgctcagtcacatcttcacttctttccctccagccttagggaaagacacttctatttgtagctgatcttaagctcattcatcttctctcctgtcttctatatttacccttcttctgtatttttaaacttatcctcttcactagcttctcaacacctcagaaacatgctaaagttgttctcatttagaaattaacctctgtgtaagtcccttgtattccttctcttagagccctgtatcagggcaccccttcacaaccaggcatatggaaaagtagtttctattttttatcttcactttttcaggacccattcactctgcttttagaaatgggtgtgtatatatatatatatatatatatatatatatatatatatatataaaatctcttctgtttgaccaatatgatgctattaatactttctcatttgccctgtaagatttgatagtggtgatgccccctcctcctgcagactcctcttcttccttgactt

SEQ ID NO: 32834 - DNA, 1529 bp, Bovine  19866881773182
agtggagaatcctttgttcatgctaccactgcctaaaaagtagcaggacatcagtttagtataaggcaggtaataattttctccagtttgatggtaacttttttgcattggtagttagtttaacaaaagtaagtagtgtttcttagaatctcatgttctttcttgatctttgactataaaaatggctaagttgcagtaaagcttgtatgcatcaaaataggtgagctaaatttattgaatatttgatagtggttacctgcatagaccttaaaagtgggattcttctccaggttatttggttgaaataatatggtttacctggaagtttttatttttgcctggaacatttgattgtgctattttggacactatttgagtagttaattaatagataattatcaattggagaaatttctaatattgactgtgtacacaaaaatttgagtgtgtttgtgtgtgtccatgattttgctcagccctttcttactgattctggaagattttgtgttcttctgtctctgagatatagggacattgagaatatcaaaccatacagacataaatatgaaaattagcagccattttttaaatataaagaataaaattctttagtttggtcctgaaacatattgtcagtgtctaaagattatgtgtgaattatgcttgtggttaaaatttgcattataccctatgcttaatataaaacaaacaaatgatattgagactcattatttctttcttaaatcttaaataatttttgtttggtaatctctgtcttcatagcacattcatttgattcagacttatttttactgacttcatatacatgactagatatcctggatctaaaatactaattttaattatttcctcctgataggaactcataaatgtagagtacaactttttctcttataaaagaaatgagggttttatactgtttgtttgcatttaccgttgacatttaataacctctggcattctggagggcagcctgaaatggcatagttttatcttgtagtattttcttaggtaaactttgactgtaacccctaaagagaatatgagagggccataaaatataaaaatgtcaagaagcatcagcattacactgagaagagagtttgaactattcttatttgggactttattttcagggattagaaaaagaacagatggaaataaaaccccgactggatgaattaaaccaaactggacaaatccttttggagcaaatgggaaaaggtgagaatgttgctttttaaaaaatattttcttagatggtgacactgaatgctgtttcagtttagtcactcaggcatgtccgactctttgcaactccatggactgcagcatgccaggcttccctgtccaccaccaactcccggagattactcaaactcgtgtccattgagtcagtgatgtcatccagccaactcgtcgtctgtcatcccctatgtcccaccttcaatcttccccagcatcaggatcttttcaaatgagtcagttcttcggtcaggggcccaagt

SEQ ID NO: 32835 - DNA, 1568 bp, Bovine  19866881788873
tttcaccctttcctttgtccataaatatgagagtaggagttgaaaagagtaggtttaagaatgagataaatatgcagatttctgtaagacattcttcatattctttctgagtcacctttcctgtgcaaaaataattaggccactgatttaacttgtcaggagcactggatgacttccacgtgctggagacttccattctggaaaatgtttttaaggactgttttttctccttttttattgctattcctatctttacagcacataacttccttttaaacaacaaagcacactccttacctggaaattggttggaggaaaaacaggtgcttgaaaataggaatgaattgtctctctctcaatgacttgggagcctgtgctcctagtctgtgggtatggtcctgtgaagtgtttctatgttactcagatcggatgagatctgattctttttctcaagaaaaagtccttgactcaaacagaattgcaagtcaaggggataccaggaaggaatacagaaatgttaacaagagaagaaataaaggttcagtaacattcataaggactgatttgcagtgttaatctatatgtgtgcagtcttcacttctttcgtaccctgcaacacaggcagcagtaccattaggaagggagcctggaagttcacatcttttctggcaggagtacagatgtcccagcaccagagaaatgtttgtctatcatcttttctttaccttcaactcagatgaaaatggtagctttgattaatgtgtgtcaagatcaaaagtaaaataacaaaggagagttaaaaataccttgtaaaacttcgtttcagcaatataactgaccaggtatcttactaccgcctcccaaatgttggtaggcaaaatttaacaagacatttttattgcatggttgagttttaaagacagaaagggaaaactcccatgagaggaaggtgaaaatcaagtagttgaactgtcttaggggcacttgctggatttagtgaccaggctttaacttccccttggagtaggagagagacttgttctctgtaagatggaacattaattaaatttaactccatataaaaccagaatcctaacagttggtgaaaagatgggctgagaaaaaaaaaatgtgccagcagagatagactatgagaaaaagtatctatatctgtggtagatagaagaaaaaaaagtcacccctgagaatttgtaagcctaggtctggcctcactttattcactgttttgaaaagatgtttgcctcttgagtacttgtgatgataatgcatactagcattgtccccaggacacactacactaatgcaaaagtgagtcatttctgtagggccatgatctctacattggaccaagagcaagtgtcaccggaagtattacaaagcaaatttaggtcctctaagaacttaacataatgagaaatcaagtttcatattactttctttaaagatgtagtataaatcattataaaaagaagaaatgaaataaaaacatgataaattaatcaatcattagaatgaagcagacaggtttaggaaagaactgaaataca

SEQ ID NO: 32836 - DNA, 1577 bp, Bovine  19866881929878
agccccttgaccctaactgccccaggctcaccttcatttcttcccagcactctcaagttcttctggtgacttgtattcaaagtccctctccaggtagtcctcttctgcctgggtcatccattcctgcatctccgccaagtcttttttcaggttcaccactttttcctgactttccgacaacctattttttttaatagcaatctacaaaggaaaagtcattcgctcaaataaacaaatattaatatattaaatgtcaacttctagtctttaatatctaaagacagagtaataagtttccaccaagaatctcaagatttaaaagtcagatgaagcccttaatacatttggtcctgatgctgtggaatataagcaataatgaaaacaacaattataactgggattcactatcacattttggacattaatgtggaaatatctagtataattttgaaaatgcaaccgaaggactctaacttacatcaataaaagcatacatctcaaggaaatctattaactgaagcagccaaaatgtccattttctcctccttaacaggattccgcattaaaactgcatttttagaaaacagagaagagggacttcgctggtggtccagtggttaagaatgtgccggctaatgcaggggtcacaggtctgggaaaattccacatgccgcagggcaactaaccactgacggctaacatgcatgcaccataaatactaaagtccacatccctagagcccgcgctctgccacaagagaagccactgcaatgacaagcccatgcgctgcaactagagagaagtccctgctctccacaactagagaaaacccgcagccacaaagatccggcacagccaaaactaaataaatcaaaaataattcaaaaaatagagaagagaagactactactaaagatattcataaaacactgctttacaaaacttgggttttgataacctgctctactggtatatttcacggagctacaaaaaagttacattagaagatagatatgtgtctgaatctggttcaataactttgtcaactatttcagggagcctgaaagcacccttcagagagatcctacctctaaccacacactgatttctactgtgaaagaagatatcataccacgtagatcatccaggactcatttcactattcaacttcccgctcaaatgaaatctcacggtactggtcaccttgccagggcttggttggccgtgaaactgatggtgacggaagggcagtacaggaataggatggctctcacaagaataagggggaattcttactggctttcctgttccactgcccaaacagggtcatggtcataaaaatagacgggcactaaacaagggcttggatttcactgcccaacatggaactcagaaagcctactgccagcaacccacaacagccctgctgagcaacacttcaacctgatgagctttaaaaaaaaggaaatacagatttcggggacccacattccccaaattcttttcacaagtagtcagttatatacaattttcatggagtctcagagaagtaagaaagataaagacactgcagcaaa

SEQ ID NO: 32837 - DNA, 1543 bp, Bovine  19866880367778
aaaaaaaaaaaaagatgggagggaattactgggtgttcaagatcagggatgtgccgaacatcccttaagtggaagataacatggtcgtcaaatagcttactgaatacaagttgaagtgaaaaagccatttaaaagcatcccaaggtagaaacaaactccattttgtgtataaccacaaatcatacagtttacacagtttcaatatggactcacatttctatattatatatgaaatgatcatgtaaatcaaggaaacattgtattgtgtttttcctttcgcagtttcaccaataactgtgtacccattcagaaaatcgtatctctgaaaggcaactgcaacgtgtggcgttgtactggagtagccagtacaatacacctgatttgataggatttggaattcacaggaattttgtgaatagggagaggaataaaggtatttggccctcatttcacattgggtaaaatacagtatctaccccacagtgtccttgtgggtatatattatttccataccaatcaacattttcaacagtccttggcaagtaggaagacttaggcaggtgttagctgttatttatattatcatcatcactgactttgtagtcattattattctagagatccagaaggtacaggttatttttgaagtttgtggcagacactctctccaagatgagacaacttctttttctatccatttgtctctcacccctcttgaacaccaaagaggcaagcctgggtatcagctggtgcctcttacatagaaaatgtataaagaggtcaagacgatacagggggaagtgcctagaaagaagagcataaaacaggcatgaaacaggaaaagtcccctctgttcactgttgcacattccgagaagactcagattttatttatcttggaattcacagcgttctatttccttcctcaggttttcttgcatacaaattttcccatgaaaagtctgtccctgtgcaaagaatattgtactcaaacccccttgttttcctggagaacctctacccttctttcaagcccaaattgaagatgacattggttaaaagagaagagtaacaacctctgggaaattatctatttcttaaaagtaatgagaaaactggcgatagaactgcaagctttctggtgttttaacttgtcccgtttccattccgtccccagcttcatggcaactttgagaaacaacagcctgaaactgcagtgaacaccaacagcctggtagctgccagagagaacagaacaggactggaattccatcaaagacccattcccagaaaattgttattatttgacctgtctggtgattccctggaagccccggtggacaatcactcacaaggttgtctttatttggtctgactcagagctcacccgatgggaaacaaattttccccagggacaattgtccaaaactgttagaggcaatagtaccacaactgcctccagaagtagataaacaggtggagaagacagtaggataaccaaaatgttaaaaggaaaattagagaatagatatgtccatgtagag

SEQ ID NO: 32838 - DNA, 868 bp, Bovine  19866880493454
agatgattgggtagtagattaagatctgcaaggagatccaaccgtccattctgaaggagatcagccctgggatttctttggaaggaatgatgctaaagctgaaactccagtactttggccacctcatgcgaagagttgactcattggaaaagactctgatgctgggagggattgggggtaggaggagaaggggacgccagaggatgagatggctggatggcatcactgactcgatggacgtgaatctgagtgaattccgggagttggtgatggacagggaggcctggcgtgctgcaattcatggggtcacaaggagtcggacacgactgagctactgagctgagctgaactgattaccttatagacagttgtaaagccccccatacctattttgcaccctcatggactgtagcctgtcaggctcctctgtccatggaattctccaagaatactggagtgggtagccattcccttctccagggatcttcccaacccagggatcgaacccaggtctccaacattgcaggcggattctttactgtctgagccaccaagggaaacccatacctatttttattagagactaaatttctaacttgttcaattggtttgtttatggcagcgttgcttctgctgttcctaggagaagacaattttacatttaaatggaatattctaactttgcctagtaagtaatgacctagaaattacaatgcagggaaatgggatttcagtgtttcatgaaaaaaaagttcctatcactagagcatcacatttttcattctttggctaggtaggcagatttctgcatgttctgggaaaaagtcttgctggagggaggaggaagcaaaaatgaaagacattagca

SEQ ID NO: 32839 - DNA, 1239 bp, Bovine  19866880541457
aggaagctctgcagggaaaggaagctgaacttaatctagaagcaagttagaaacaagagccttcacaaatatagcacagttgtgtcttataaaattatcataatactctctttatacttgatacgattatatcaataatatagattcacttgttattaaggtttattataaacatgcaaagttcattgcatgatgcatttgcaaaacatattaaaatccttccagcaataaagcctctctgagctgatatgcatccaggtttcctgactctgcagcgccaggcgtgtcactcgacatgacacaccaggggaccgaaactgtactgctgttcatctcagcggacggggacggggggactgggtcctggggctgcggctggagccacactgggtgagctgactgtacatcgtactctcgtggacaccgcagccggttcaataaataagtacaaaagggctggggtgcacgcttccacgccccaggcagcaggcagtgaaacggcagtgtgtgggcggggttggctaacaacactgtgagtagtggcatgatggctgatggcaccctggaccagagtcatctcccggagattatgaacgtctcacacacacacacacacacacacacacacacacactggtctgtccttgatctgatttcttgtgctcatttagcggattccttagaagatttggcctcttaaaaagaaatgcaagtagcaaaacagttatcaaccaagtcaggtacaagatgacaaacacccccacgcccatctagggttctcttcctctttttctaaaccagtgaccgcagtaggagaatcatgagcgggtacaaccgtcagcgcctgggagcagtgagcttgcaaactggactagacttctcccagcctctcgggttctggggacagtgtccatggaggcagaggacacaagcggcaggttttctgaagaccccccaacccccgagtcctgcctcgctcgcactctgggacccccattcttttattccgaagacgtggtggatggacgtgtttccggccccctagactgtgtgggttcatttgaacatctctgattgggaaatctggatggtgaaaatcaacagaggttttgggaaacacatcaaacagtacccaaaaaaaaaaaaaaaaaatggggccagagtctgtttgctttccagaaagggtcaatcccccgccagatgtcacctctacgtcaagcagatgccgacgtgacgtca

SEQ ID NO: 32840 - DNA, 1202 bp, Bovine  19866880576190
ttaatgggaagttaaaataagaccgccgggcacacagcgcctctgtgactggctaatgcttctcgaagtcatatcatggcacatgcgaagaattattcccccaacgaaaacgagaccctgactcaggacaattttgtgcccagccagcatttggagggtaggggagggagtgtgattaatgcttggcacaccccctaatatgttgatgttgatgtcaactaggtttacaatgtctgaaataaattctgggttgcacaagcccagcattaataagggacttgttaagagcaattcatgattgtctcttctctctcagctcagtcgtaagtcctttagactctttggattgcatcctaccgggctcctctgtccatgggattctccaggcaagaacactggagtgggttgccatttcctcctccagaggatcttcctgagccagggatcaaacttacatctcctgcattggcaggaggattctttaccactgagccatctgggttacttttttaacttgaaaagggctgatgatctttaaactttcaggtaactaacaactgaaggcttaggccttcactaccgctgaagtttagagatttacattgtaaattgctgaaaaccagagtcacagctttacaaattaatatttagttctgttactttagctggttttactgattaatatcatgaataaaatgaaagtactgtgcttcacttctgtcagacctttgatcttgaaaggaagcagaggacagtgtttcacagataataaacagatctccaaattattaaaaaggcattttattataaatacattttagttgtagcagtaaaatacattttgtgttaccatgaatcttttaaaacaaaagaatttcactgagacaatgatcacaatgtaggaattgtagaactctgaactgaaaccttgttctaaggaaccaatgtggccaaagtaattccaaaactaagttttaaaagaaaatgacaaaaagagaaggaaataaaaaccctagggagtggctttgggttattttatggtacaaagtcatttctacttttaaggataaactctttaggcattagaattctcagatgaggtatcattaaccacaaagaaaaaaataataattttgccataaattatgattattagacagatggctgtacagctggtactttttgaagagatggaaacggat

SEQ ID NO: 32841 - DNA, 1527 bp, Bovine  19866880620699
tgtttgccctgtgccttgtagggtttttactccatcttgttagacgaggctgcccaggccatggagtgtgaaaccatcatgcctctggcactagcgactagacacacgcgggttgtcctggctggcgaccacatgcaggtaggtccctccaaggcagtgcatcagaaggagtttgtgttaggttttgatgtttcatatcttgtttgttttctaaagcatcctatgaaattgtgccatgcgtttcagttcaagtactttaaatgtttctgtactaatagtgaaaaatgttggtatttctgaaggaaaattgctaccctaccactttatttcctttggatagagagtagaatgaataaagttatcagtgttaccattttcatgtttgttaatttgaatttcaggtctctacagtaggaatatttgattcttttctttactgaataaatttaaatcatgcttcctatgattccccagttcctgtccccaatgtttgttttcctgaagcgttaaatttttcattacatgggaaattaaaaaatgagtcaaaatctcaaggaacttttctgatcttattaatacctatatatgaaagagaattacagtttttctaataaaatatcagttttacaaagatgcaaattaaggttctttctcttttgtcacagttaattgatcgaacgcatagagtattgtagttgtccagacctttaggaaagaattgaatgtagaggaacaaagtctgtttattgctttgccagaagtagtttagtttttgttcttagcgtctaagttatagtcgagaatggttcgttacactttacgagagaagtatggctttctgctaattattaaaaagaagttttttagtcataggctgtgtatgttgcctgcttaccatttgaaatagttgattaattttagtgaaacagtcgtttgactctaccagtgatacaatgggtcacattcctaaaattactaaggtagtagctatttattattaagtctgagaagtcctttattaacctggatacagaaactcaaggttagtgttgacatactggaaggaaaagttggaaaacttagcctcattatttatagtagtaaagtttttcctagaatatatgtttgactctgcttattgcaacattcagcatgctgagatttagtatatcagaagttccagcatggtggatttttttataagtatgttaataagaatactatttgtatatttagttaaattttctcccatgtgtttatctgttacagctcagtccttttgtttacagcgagtttgccagggagaggaaccttcacgtgtcgttacttgatcggctctatgagcactaccctgccgagtttccctgtaggatcctcctgtgcgagaactaccgttcccacgaagctatcatcaagtaggtgtgagctgctggctctggcgcgctgtctgtggcctggtgggaggtgactgagcacagcactgtcccagggacaggttattcccagcagagctacatggcatcccta

SEQ ID NO: 32842 - DNA, 808 bp, Bovine  19866880637625
cgggaatcttttcagttcttgctctgttggtgttaacacttcctgttctgactgcatcagcattaatgtctgggatttatttgtggtcttcagggatttgatgcacaatgaaaaactccctctccgtgaatttgagcaaactctgggagatagtggaggacagggaagcctggagtgttgcagtccatgggatcgcaaagagtaggacacgacttgctgctaagctgctgctaagtcacttcagtcgtgtccgactctgtgctaccccatagacggcagcccaccaggctctgccgtccctgggattccccaggcaagaacatggagtgggttgccatttccttctccaatgcatgaaagtgaaaagtgaaagtgaagtcgctcagtcgtgtccgactcttagcgaccccatggactgcagcccactaggctcctccgtccatgggattttccaggcaagagtactggagtggggtgccattgccttctccgggacacgacttagtgagactgaacaacaacaacccctccaagaaagaagaaagagagagagaggtggggggaaagaagcacttagctttttaacagaatatcattgtgttctttgtcctggcagggagccagtgcactttatccaggctcccccaagtccctggagaatcttcttgcgcacatttctgagaacagatttgggatccgggtggtgccgtctctggaatgacataaatgaagatgccaaaatgaccagcagtgctcctttcgctccgttttaaaggatttttgtgaaatgcatctgcaaacctattgg

SEQ ID NO: 32843 - DNA, 1852 bp, Bovine  19866880676051
ccccccaccctcccatctcctctggccgggagccccccgatgctgtcaggccccccgggccgccttccacccccgcccccgctccccgcagctcccagctacaggaagaatgaaggtctccgtgggatgcgcgcaggtggaccctgccgaccgtcctgccccggggaggtaacagcgcttcaccccaagctgggtggagccccacttccagacccccggccgcgctgagagcacctaacaagctactcacactgcttgcggctccttgaacttcccgacctgctggatgtggtacatgaggtccccgccgttgacgtactccatgacgaagtacagccggtcctgagggccgaggttcgaccggtgagcgggctcctccgcgactgggggccccgctccagcccgcggtctgctttctcgttggggaaacgtgggccgcgctggcacgtctgcccggcggagcccgtcacagttttctccccccaagaaagaattagtaaaaagccccgctgtgtgaggacctcaggaaacataaagtcacgacacagccctgaaacttcagctctcggttgccctgtccactcctctggttacagatgctcccaatgatggaaacggcctcgaaccttcctcccttttctcctacacacagaattcatttctaagttggggctggcgtgaagagtccacacgggccaatcctttaaccagtggttggcagtgcagtgatggacgctgatgtgtttgcccagacgtgtctgagagcagacctcatgggtcagggggcttgtaccccgtagacctcagggtcgtctgccgtgggtggggctgcgtgtggggaggccgatcggtgctctgcatccacgttcgcccaaatgctgtttctgactttctctctggctgacacgctacgtgtcggcccgcgaagcacatgtcatagaactccgtgagtctgcgcatttataaggacattacactgggacagatgggaggtggagggggcttaggagggagataacagcgcagcacaaggtaaacgctggcctctgctctcttccagaaaacacctccatttcacagaggttattaaacattaaagtggtgcgcagggaggaaaaaaggacagaactggagccaacagccaggaaagggcgctgggagcctcaatccctcgctttcctgttatgaactttaatttcaattttatttctctgctttgtagctttccagagcttaatcagtgtaacctgggtaacaggatcccggctggggcttttccctctcctttgcctattgctagattctcatttggacgctaccgggaggggctgggagacggaccatcactcggctgcccgcgcctggctgccccctggtggccgggactggctctgcggccccccatccactccggactgcaggctgcggccccgtcactacagttacggctgccgatcaccgagccacatgttcaggacagccgttgaggtgtggagagcttgcctttgggaacgcctcactacggtgcggcgtatagtacacacacatatacatataaacatctaagtgtttgtatttcttgtaggttacctgcaagcaccatgccccagacttggctgattagtggaaattttgtcctctcttaagttaacctgtgtgacagggctctgcaaaccttttctgtaaagggccagacaggaaatattttaggctttgtgtgtgtcttgcaactactcagctgtgcctttgtagtcagaaagcccttgatgccaggttagtgaaggtgccaggctatgtcctgagaaaaccatttatggaccttgaaatcatctaatttttttgtgttacaaaa

SEQ ID NO: 32844 - DNA, 1296 bp, Bovine  19866880677012
ctggggcggggcctgccacttagcgattttccatctctggaggcagcgctgtgcctagggtaccggtgtgcatgccaaggcgcctctgtcctgtccaactctgtgtgaccccacttgactgcaagcccaccaggctcctctgtccatgggcttctccaggcaggaatactggagtgggttccatgctgtcctccaggggatcttcccaacccagggatcaaaccggtgtctcttaagtctcctgcgttggcaggcgggttctttaccactagtgccacctgtgaagcccacctagggtacagcagatacttaataaatcagaccgagtgatggagacagtgattcccaccttgactgcaggtgaatctccggagacgcagctgagcagctccgagggccccgcactccctggtttgttagtgtcccacccagagggctcaggctcccccaccggggtgcaaactgcaggctgagacccaccgcagagtgcactcggccccccattttgcaccgtgtcctggtcactctccggttagtgccggccgacgtcctgccttcactgtaaccagcaacggcaggaaccggatccggcggcccccctctccccgcccgccccagcacctgcgctcctctgctgagcatcactagcagaaactcagccctcacaggtccccgaccctcacgctacatgaaaggcagaggagggagctggcaggggaaagaaaagctcattttcttgcagaagcagaaatgagatatgctgtctctgagatccagaaaccagaagctggtccacatttgcccagaggctgcagagaactgtgggtcccagcaggtctccacgacggggtagggaggattgtcctctccatgttgacagcccctctccccacaacagaagcacacacccatggagtccagagggccagcaaagcctctgtgctgcgggcagcagggcctcgatacacaccgataaatgattcctcttttatgaagaaagaacagcccgatggaaatctctgctgcatagaacctgcaacagaaaatgtctgtcaggagtccggcttgttccctctggcctcctggatactttctgcctcaagatcaggcatcaaaatggcacaggaagggagaccctgaccgccagagaccagcactgccctacaggcagctccaaccttctgcggttttatgaccccagttccccaagggatgacacagctgataaaatcagtgaagcaggtttattacctgcctgaaaacaagcccttcttgtctggggcaggtgggacaggg

SEQ ID NO: 32845 - DNA, 1761 bp, Bovine  19866880704498
tgtagcacaaatctctttcagttgctaagactactatttgatttcactttctccatttacctcattctatttttttagtgtaaaaaatgtgagtttcctatatgatgaatatttcaaaagcacaagaaaaatctttattttatggaagttttcctgttatgccaaatacagcttatgttcaggtaatgaacagacttactcgtggcccctggcttgacaatgctcactatccagaacacaacaccaaactcagaaatgaactctctgaactgagagtctgtgtggtttattctcaagatgcccttgagtcctcactcagaatctgtttattaaagcagaactccaactttcaaatcttatgactctgatcagctcctggcttaaacaaatcagccattaaaaaaaacacacatacacacacattttggggacaaccaggtaaatctgactatagattgggttttggatattagggaattatggtcacttttattaggttaatagtaatgctgtggttatacagttatgatcttatttattacagatgcatactgaagtatttaggaataaatatcatggtatctataattacttttaagcagttcagaaaaaaattaatcaagtaaatatggcaaaaaggtgacaacctaagtttcaagaatatgaatgcttattatattatttcccctagtttctccttgtaggtttttcataataaaaaagaatttaaattttttaactccatgacaaagactgcctggctggtttcccatccctgtgtgagaaagtgaaatcaggctcagaagcaagtggagggagagggggggagggtagctgcaatgaagcctgttgagagctgcaaggaatgcaagctgatactgacagcaagggatcctgcagtacatcaaatgcaaactaggtctggggccctgcagagggagctgctcgggcacccagcatacaaaccagtataataattaacaaaggccgagactctggtcttgttttttattactaactaactgcctaaccatggtattttatcttatataaaaataaccttgctgtatacctgaaattaaagtaatactgtaaatcaactatacttcaaaaaaaaaaaaaaaagttaccaaaagggaagaggaaaaaattatatataatataaaagcagaactctacaactagcaatatatacacataaacttttgacaatatttccaaatgtctacttcaaatgaacaactttacattaactaagcatttccatgttcttacaaggaatgcatagaatgtaatcattgaaccattattgcaagctaaccaatttcccccttttccacacagcaccacaatgaaaaccattccacagacaattttttccttcttttgaaatatttacttgggacagtctcccagaactgagattagtgggtcaaaggtacgaacatatgaccaagctgtattctgcttcataccccgcccgccgccaccacaagcacacactcacttcactacaaccttatctgagacagtggttttctccccacattgcagaagcagaatcagtacacaaaaactgcacgtaaccaatgtacagtctggtgagcttggacacacacacactttcatgctactatgctcacactccaggtaacaggcctagccttcatctccaaggtttccaggttaaatttttatattgttaattcagcagttgtaaaataatacctaactttaaatgccaagtaaaacaattaacaa

SEQ ID NO: 32846 - DNA, 1363 bp, Bovine  19866880713026
ctggtgacacggccttggctggactgcccggcccttggaaggaagcctgggtgtcctgagatgtccccagggagtctttggggagccacggtctcctcccagcttgcggtgtggtctgggggctggaggtgagccgggctcccgcctccagacccaccctcacgggcccccccgtagctccttgtgcagggcggtctccgggcattgtgccacacccaagcaccaatgtctccactcagctcctgccagcagatctgcccagtaggtgttgttaatgtacccattttacagagaaagcaactgaggctcagagagaaggcaatgactggtcgcagggctcgccgccagtgggaggcagagctgaactcaaactctgactcactctgggccccgcacctcacgtccaccagcacgtcctccaaggagccactcagctgctagaaatctcaaatctactgtgaggcaggtgtgtgcagagccctgtgtgtttcccatctatcctcctgacaaccctgagacaggcctttgcagaagcacaggaggaggccctgccgttgggtgtgttctgaggctctgtcctcgccgcgtcctctcctcctgcgggtccccagaaccagacagcaagctcccgggccgtgtggtacccactgagcccagcacaaggccaggcctcagcaggggccccctgacggcccagggtgcacgcttcactctctgaggaagcacccggccctgcattcgtggggccaggggagaacaggagcagcggctccagcctcccctgccctgcaggccagccaccgcctccctgaagcctcagagcccatctcccctgccccgccttctcccaccagtaatctggggggtggagggggcatccagtgcaaagtgaaaatgtgggttctcctcttcaaaaatgatcaagaatgttccactggtgatgacctgttactggggcctggggtctttccaggccagtcttgatgtaaaatgttctgggttgtgccccctcctactccaccatctctgcctgcccgaatctaagagtgccagcatttcaggatccaagaacacttcgtatactgcctcacgcatataaaaccacatgagaaagtctgtgctctgctattttatctagaactttggctcagaaaatacaaagatcccactgctctctgtcccgctgcagaaccggaggcggtgggtcagcagtcatggcctgacatcctgtcacagggaagcccctgccagcatccctcggtgatggatggcggatgccccgccccctggtcccgccccccctgcccggtgtcgggttagccctctgaccggcccaccagaagcctcctgtcccccaccccag

SEQ ID NO: 32847 - DNA, 1858 bp, Bovine  19866880787155
acatgagtttgagcaactctgggagacagtgaaggccaggaaagcctggcatgctctagtccatggggtcacaaagagttggacacgacttagcaactgaacaacgacaaaactaaagtagcccaaaactgtgcagggggtgggggggaagggcagagagcgccacctcgcccaccatcctggaaacactggcatggcatccccccaacgcctggaattgcgcgcggccccgtctggcccccgcggcccccactctggccaccctgacaccagcctgcccggtgctgctccctcttgtcacaaatgctcacggctcacccccagctcagcccctcgccaccgagggagacccgcagagtgaagggggtgatgtctgggtccacagcagcactctcccctgagccatcaccgcaggccaggaggcatctgcaggcctttcggtgtcagctcaggtcccaggagaagaggcaagtgtttgtccccattctacagaggagatgaggtgggtaattaagttgttcgtgcctgagtcacacagagcatgccatcgaagcgtgtcccacttagggtgccatccgtgatacccttagctgtcccccactgtcctgaccaaggccagcctgccccacaggggccctggagaccagcaccccagctctgaaggcagcagttcaggacccaacggagggatacggccagctgtgggcacattgcctgcttgagtggtctgcctctgtgcgccgacccccttgccgagctccccgtcatgcctgggttgcccttctgctcccccgagcccagagcctgcccagagccagacacacacagcacgcaagtctgggtgaacagaggtgggggccctcgggacactcacacagttcttttcctctgctcccccagggatctataaaggacactgctttcggatcaaccacttcccagaggacaacgattacgaccatgacagctcggagtacctcctccgtgagtgtcaggaccctgcctccccctgtttgtgggacgggggacgagaggcaggcaggcgctggaggaaggataggccccgtgagggcagaggggccggtctctgggtgctcccgacactcccctctgactcaggatactgagttcagaggatggggtatggttagcctgctgtgacacgccggtcacccccatgcagttactggctgggaggacacaccagctcagggctggcaagaggggaggagggtggggcgtcccgctgcccggggctgctacaagttgctgccttcagaggagttgatcgcaacagctggttctgaggcaaggacgttagagacattggcttgcccaggcccagcatccctgaggggctgagacaccccaaggatactgcccggccagcactggacctgcccacttctccccacccccacccagcaatctattcttgacaagtcagattaaatcacacactgagacagccggtgagtgccaggcagcctgtgggaccagcctcgggtccatgggcctcaagtctctccagcaccaactggtggagcccccagctctgcccctgagccccctgcccaggtcctgagatggggctggcccccaaactggaaccagaggtcagaggacaaacccagccccacgccccaaatccagatctcatccctgggctgtggctacctccctgggaggaaggatggagcctccttcctccaggggaggaacctggaaatggaaaaccagcatggttttgaagtcgtctccccttccacatcagcccagacacatgcagagctgctcccatcccctcccccgggagctgggccggcttcatttaggagaatcgataccagcgtccaca

SEQ ID NO: 32848 - DNA, 2115 bp, Bovine  19866880802667
cttttgtatctcttacagttgtgacctcgtacaattgtgtttctgtgtcctaacactcactcagcaagcaacaaccagtaactaataatgttagctgttatgttgatggtaacattcatacatctgaacgttcaggcataccttcatgggtattgcttcaatccttataccgactctctgcggtaggaactattattatgctcatatcaccgaagagaaaattgagggtcagagagggtaagtgtcttgcctgaagtaagacagtggtagatctggaatttcgactcaaggagactggcttcagagcctgcccgggttttttgtttgtttttgttttgtattttggccactcaggatcttagttcccctggactgaacccctgcccccaatggaagcatggaatcttaaccactggactgccagggaagtccctgcagagcctgttttaaaccttacattctactgcttctgtgattggtgtttgaggaccctgtatgagattggttagataataaaagtgatactagtttgtgataatcgttgttgtttcactcttgcattcaggacttaaaaattagtctgggagggccttttctgaactgtggagatatagcgtttaacagttctggctgtagaaggttcccctcctaccgcgtcccgcttttggatcactgtgtatttgacacctgggtgtttagggactacttgcattcctaaattaaatatatcctttgtttctccctcctcttaatgtcttttcatttctcttggttacctgcaacttcttctcatggttaatactaaaaataaagaggaggtgaaatgagagagtttacttgattgtcagtggcttggacaaaaaacctcttccaagaaataggtcatttaaaagtattggattggcatttcacttgagttatttgtggttaacatgttattagccttttcttatttgggttgtttaaggagacattaaaagatcaggtcatttaggagttaaaggacacaaacatgtagagcgtgcagatccccagcatgtattgatgctgaacaaactccttagtcatttacctcactgacaaggattattttaatgagaaaacggagtcataagagtcacatgttctaacaggttgcttttggtagctctaaccgtcttgttcctctgcactgaaaggcagcatcgaggaggtaggattgcaaggatgacatgtgaatagagaggaaaaggaggaggaagatgtttagccataggattgaacgtggaagattgggtgaaaagtgggatggtttgagaattgggagctgcatttaatgaaattgatgatagtgtccctcagcactgaattgtcagctatataatttgtcacattctgcttactgtaacagtaagaatcaggaattgtaagccgagatcaaatgaatagttcaggtcaacgtgggttcattcgacacatgctatgcgcaagttgctgcaaggtatacaatcaaacaagggtatatgtgtccaactcttttaagatctcacgggattgtagcctgccaggctcctctgtccatgggattttccagactggagtgggttgccatttgcttctccaggggactttcctgatccagggattgaacctgagtttcccgtgtttcctgcattggcaggcaaatcctttaccactgagccacctgggaagccccaatcagacaggtgttagtcactgagttgtgtccgactctttgcaaccccatggactgtagcccaccaggctcctctgtccatggaattctccaggcaagaatactggaatgggttgccatttccttctccaggggatcttcccaacccaggaatcgaacccaggtctcctgctttacagacaggttctttactgtctgagccaccagggaagccccaatcaaacaaagtctagccctaaaagaacttacaaaacactttggagacatggatattaataactatgtacaggtgtaaaggggtgcaccagtatgccttcagaaacaccactgtaagtttgggtaggtgccgagcactgagctagtggcgaacagtacagacacagccccctgctcttactgagtacattctagtgaaatta

SEQ ID NO: 32849 - DNA, 1833 bp, Bovine  19866880838979
ggaaaggggaggggccaggcccaaggcagggggacagggattccagaggccagttgggctggcgggaaagaaatggcagggggatcagggcacacaggccggctggccgcagtgcccgggacccttggcctgtcctggagtattacctactccctctgcccatctcttcctcagcctacttcttaagcttatgggtatctgctctctggagctcaacttcagggtcagttctcgttgtttctgcagcctttgaggggaacaccagccccttgatggagatcagttctgccctccccactccaccaaaactcgaggtcacagtcctggagccagcacccttctcttccttgggctccttaatgaacccaccggtcaaccccacagcacacgatggaggaagcacttccttctcgggttgttagcttccatcgctgacgtgccctcatttcatgtgggaacccactgctgggccctcccagcctcacatctggccctgggcaccctggggggcttgtgggcagtgatcctggcaccgggcaccccggggggcctgtgggcagtgatcctggcaccgggcaccccggggggcttgtgggcagtgatcctggcaccgggcaccctggggggcctgtgggcagtgatcctggcaccgggcaccccggggggcctgtgggcagtgatcctggcaccgggcaccccggggggcttgtgggcagtgagcctggccccaggcaccacgggaggcttgcaggcagtgtgagcctggccctgggcaccccgggggcttgcgggcagtgtgagcctgaggccagggagtaagtgggcagtaagtgggtggcacaggctcggtttactgctcctggtcctcagccacctttctcccttctgctctgggccttgggtggctgatagcagggaccggatcactggggtcccttcactctggctttggagacattactgccctggcttcctcctgaggacgaggacggggctgaggtggctgtgttcctttgtcaagccacagatcctgcctggcggcccgggcctcacagctcctctggtccaggagcccgtacctgcctctgtcacccgctcaggccaagggccagaggtccttctgctgctcccgcctgtgtgctcactgccccttccccatccctgcacatctctgtaatcagtccttcactaaacgcccttccttcttcctgtctgagcatctcctctgcttctggcggggaccccaggaagccacacgtctgacctctgggctgacgtgtcttggggcccatccagagatgccagccctctggggaccagggtgggggcacggcaggaggtaaagaggaagagctggcgccagttaacctcaagttcaagtgggaagtgggagggaacggatgcttctctggtgtccccttccccacagtcccaaggcccagcagtggagcagacctgccccagagccttgggagtcgtctgcctgcccggtgggttctgagtcaggcctgagcaccagtggccaccctagatggctgtgcagcccgcacaccgcacaactcatggtgttattcatgccccgctctatgccaatgccatcccctagtgtgccccgtggaaggcgtgtgctcggttcagtactggcccccagaaagcagagagagaagacaggcaggaagaagaggagaagcggaggggagggataggaggcagagccggtaacactgtttccggttctggctctggactccatggggaccacatgctgttctgtttcacgagatgactcagaaccagagtcctttctcttagaaaaaacagtccataagcagg

SEQ ID NO: 32850 - DNA, 899 bp, Bovine  19866880921034
cagaaaaaggagtgagggaaatagaaagcagcatggagagatgctgacccggggggtgggggggtgggaccagcgccaggtgatggcggggggcctgggtggcaaaggtctgcagtacccccaggaagagggtgctccagtctgcaccgcattccacacaaaagacaatcggactgtctttcagcagaacaggcacaatcaccctattgtccagccccatgaatgacctccagagccacaaagcagggacaggaaaggcaggagcagccacactccctcattagagccctctggtctcaatgtggctgctcgtgagctccagggaaaggattagagcttgcggatgcaaattgtattggactctacagccaggattacctgatgtccctgctttacagaaacacacaggaatcagagtgcaacgcacactaaaaaatcctaaaagatgctgggggccagggagggggcgtggggggaggctggggagacggaggctacaagtgaatctgctcacaccaactgtccagtcatgcacaggatgcggtcagcaggcttgctctttgtaaagggacagacagcgaggactttcagctctgcgggcccttcacgtgtcacgatcactcagtcgactcttgctagagggccagggcagccacacacaagccacgcatggcacagctgtgtgcccgtgagacgttctgagcacaggctgggatccagcccgtccagctgtggtctgcaagccgcggtgcaggaggaggacaggagtcttcacgcaaagatgaaactctccccaagttgcttcctcaccctcactgacctcatccacctttgtcctcgtcttcagcaagctgaggctgtggttttttaaaggcatttatttacttggttgcaccgag

SEQ ID NO: 32851 - DNA, 3205 bp, Bovine  19866880998368
ccgtctctgactctttgcgaccccagggtctgtagccagccaggctcctctgtccatgggatcctccaggcaagaatactagagtgggttgccatttcctcctccagggcatctttctgacccagggatcacacccacatctcttgtgtctcctctgttggtaggcggattctttaccattagcaccacctgggatctcctgcatcagcaggcaggttcttttactgatcacgccacctgagaagcccacgatccctgtgaaaggttgttttgatcagagaaaagcgtcacctcatagcccagcatgtgatgagcatggtcaggcttcgcttcattcttcctttaaccaaaatgctagtgcagacctcacgccgagtgcagcactggggctgggtctgcagggacaggggtggaggctcgtcctgtgaaggcacagccgccccgcagagccaggcacgagcagcccaccgggtgggcatggacgaaggaggcttctgctcagagagggggcatggacgattccttgagagccttctcagccactaaagcaaacacgtcagatcccacattcccccgaagagcagagcaccgacgtcctggtggtctggtcatgcccaaaatctcccgaaagcttcttcacctcctgccatctccctgggagctgttaacttgaggggtgttaaccgagtgaccagtgggtaaaacccctctggggaactcacaggtcacgacccaggatctgtcgggcgcggagagcaccgcgggatccatgggaaaccagatgctcttacaggtcaccatttttcaggagtccaactctttacctgaaaaagaaacctctgttctccttcctgtgccttttaacacagcagtgagtcaccccacagtctgccatgaaagcgttttcctccagggaacacactctccctcttcttgcggctgcaagtttcctttctgcaaatcttagattggaaaatctacaaataagggaagaatcggtacacagttaattacgtttatttcttttattacattagatacaaagttatctaacgcagttaaagatacaaagagtttcttgtatgggtgagggcagcttctcattcctttgtaaatgtcggccttggggtgagtgcggcgatgacggtaggaatagacatctcgaggccccgcttcctttcctcacccatctcccctcccaccgcccccccagcaccggcatccagcttagtcagagtttcctgtcactttgtccctgaggaaatggctgactgttttcacagtgtgtgttattgtttagaaagccaagcttggccctgccggcaacaaagtcatcagtccctccgaggacaggagacagccttccaacaacctggacagagtgaagctcacggacttcaacttcctcatggtgctgggcaaaggcagctttgggaaggtgagcgggccacgtccgagccggggggggcttccgtggaggacgtggggccggtcggtccaagtctccccgaggactccggggcagccctctagatgccccctggttccgccacattttcaggggcttcccacttcagcgcattaaaaacgacttatccaaaagccagacagggccccctgtgccaccatttcagggttcaggatggagtcggcgccccacaatggtggctgaataattttcaaaactgaaaattaaatgttggcttgtagtaaatgaacataatagttaagagataccagaccgggtttcctccgtgtccagtctgcatatctgcgtctgcctctctgggtccaaatctcacggtggagccaggggctggcttcaatcctcctgctttcttttggatttgggtcccgacttcctggcttgtgaggagcgtgtaaaggtcagtcaggtgtctgctctgagggtgctccagagatgacggtactcctgagatgacggtgctgctgaggtgaagatgctcctgaagtacctgctgatgcagaggaggatgtcaggcatcattttcagcggccgcaatggcgccctcgtgtggttatggcccacacagcatgtacatcttggtggcctagaagctatcagtccagtccggtcactcagttgtgtccaactccttgcgaccccgtggactgcagcacgccaggcttccctgtccatcaccatctcccagagctttctcaaactgtatgctggaggagtttaatgtgcagcagtctatggcgctgcaaagatctggacacaaccgacaactaacacacacacaaaacgcagtgtttgagaacggcacctcctgaagtggagctttcttgatgtcggtgaatctgctgggacttgcctggtgctcagtggctaagacttcagcttccggtgcaggggctgcaggctcagtccttggtcggggaactaagatcccacatgcctcttggccaaaaacccaaaagcagaaaatagaagcaatattgtaacagattcaataaagactttaaaaatgagccacataaaaaaaaatcttaaaaaaaaattgacaggtctgtacacacatttcccgcacccgcccccccacccccgtgccgtgtgccccgatgttcaggttgccctccgtctgcctgcaggtgatgctggccgaccggaaggggacagaggagctgtacgccatcaagatcctgaagaaggacgtggtcatccaggacgacgacgtggagtgcaccatggtggagaagcgggtcctggcgctgctcgacaagccgccgttcctgacgcagctgcactcctgcttccagacggtggtgagggtccccggactgcccccgccccccacagggtcattgcgccgcacccccagccttcctcccgggagaagacagcagcccacatcctcctctcccaggcagactgggtaccactggggaattcagggcatcccctgcttacagacttggcattcatcccatttgattctgtgaatgcttctgtcaaaggttttcttaacacacaccgggcaatgtgttaaggcttagagatacaaaacggtagctcacagtcccggctcgttaaatcctggtacagctgccaaattggcatcagagcatcaggagacccatgtcctagaagaggatgttcttgggtaatgcacacgcaggggtggtagtctggcctgttttgtgtggatggtcccttagctctaagagaggctttataaaa

SEQ ID NO: 32852 - DNA, 1988 bp, Bovine  19866881043864
tggcatcactgactcaatggacatgagtttgggtaaactctggggagttggtgatggacaaggaggcctggcgtgctgtgtgcggttcatggggtcgcaaagagcagacacgattgagcgactgaactgagctaaaattttcccacagttcatgtgggaggtcttgatccctgccccctgtacaatgtcatgaacctccgtccatagttcttcaaacactctgtcaggtctaatcccttgaatctgtttatcacttccactgtgataatgcccttttcatttttaaaaaaattcttttttctttttgtgtttcatcaagcattgtttctactgctaatgccttcaggttcactgtttttcttctgcaatgtctaatctgctcactccatctggtgtattttcatcttgggcgttgtagttttcatttctgaggtttagtagtaaggctatttttggcacagagttccagtggcattcttaaaagaatgttttcaaggaagaactcaaattaaggattctttcaagaggtttagaatatccagtagttagttcttatagattaaaagcctttcacatgcatgaactagtgttatttgtctattataattgtgatttttttaaccttaatatgcttcctttattatttatcatccacttatatttagtttgatatctattacttttgaaaatagaactgcattcttttcagaatatctttatttagtttagattcctttgcgtgcatgtgtgctaagttgcttcagtcatttccagctctttgcgaccccatggactgtaccccaccaggcttctctgtgcatgggattctccaggcaggaatactggagtgggttggcatgccttcctccaggggatcttagattcctttactaaataaaatagacagattatttggatttttgcttaattgcatttgtaagtggccaaagtattaagccatacataggcaggaacaccaaggccttttctaagtctagtctacaaaaatgaggctgtaaactcctagagaatgggcagttatcttttggattatctgttttaaggttatcccttactgagtttttgccttgtcaaagaaatttgctttatttataaactttctttcttgctgagaaattgcaactccaaaattttaagaacaaaaccaaagtagtaatactcaataatgggtgaaaaaatgtttaaaatatcctactttctgtctaatattgaatagtcattggaatttgtgacgtctactggagacactgtgtaacagctttaaaatatttccttaggtaaaagtgatacaaataatcctggacctgaaattaataagattcgaacaccagagaaaaaacctacagaagcaaaacaggtatgtgatttacctttggtgaatgcattgttctcatggatttaatttaattgatcatcttagaatcctggtgtgttatagaaaattatgtccccttttaggttttgttgtttgatgagggcacattgcactctctccctctgctgtttcgtcgctacattattttctttatcagagtacttttctcaaattatgttattcagtgatagactcaaatttagagacttcttatgataaagtagtaagtgaagacatagctatagttgtgtcattaaaaattatctcagattgggaagagctgttacagtgaaggaagacttaacattctcaagtcccctctcatcacgcctgctgtgtccatccttaactcttaacctgtttgttcatctgcgtctgtactcatgaaccagttagggaaaagtcaaatcatggttgaatcagtgctactggagattcgtgtctcctaatcggggcgcccgtggggcaccttcatgtgtctcttacgtgtgccaggctccctttgcccagtttactcagcagctcttttggtgactgggtaccttctgccattattctcatgatcagaagatgacctcgccttagagattaa

SEQ ID NO: 32853 - DNA, 1191 bp, Bovine  19866881079736
ctgtgaggggtcgtcccacagcttctcagtgggctctctggggtcactgaggggctctcctcccgtctggctggcagaagtgtgacccacacccagggagaggctaagagagacccgggcagaggtgactccaggccacttggcatacaggggaatgaccgcaggccagggccatcacttgctggtccagactgccccccaccagccactccctccctacctcgggtctacagggccagaggggaaccttcaaggtcagggggctcccctgtgccccacaggtgggcccgtaaggagggccagtctcacggcctctccactctgtctctgcccgccaggcatcgtgcgcgcctccagcgtcttccccatcctgagcaccatcctgctcctactcggcgggctctgcatcggcgcgggcaggttctacagccgcaagaacaacatcgtgctcagcgccggcatcctcttcgtggccgcgggtgagctgtctgctcgggtcccactgcacgcagtgctcccccgggggtggggggagcaggcaggcagacggtaaaatccctgtgggtaactcacctcagcagtccggggggcgggcagggagtgaggagcagaagcccagtgggtatcaggcctccttctggggtgataaaatgatcaggaactagatacaggtggtggctgtactaaatgacattgaagtgtgcacttttaagggttagttttatgttctatgaactccacctcaattaaaaataataatagctagtccaggtgtgcaaaataccacagaggagcgccttacaagcctgtctcaggggagcctggctcaggcgggggtcagggagggacacagaggcactctcagaagccaagccctgaaggagctgcccacgtaaagacaggtgaggggcacacggccagagagggtgcagcagcggggaagccagcatgcctagggcagggtgagcgaggaggcgaggggttagggttagggatgaagcctcccctgcccatccttactgcccgtgtctcctggccaagagacaccactcccttcccggcggctccaaaatggcttcacactcgcttgtctgagcccggctgcagacagcatactatatgccccgttgctgcggacgcggagaagacccgtccggtggagaacccggtgggcctgaggtgctggtgtgg

SEQ ID NO: 32854 - DNA, 812 bp, Bovine  19866881086697
ctgagacgggccccagtgtcagacacaacctcactgccttcaggaagcagtcatgtctcagggaggccctctgggtatgtgatccagcccatactgtgtgtggagccacccggcctcatcccacaatcactgaacacacagtcccagcctccccctccaggaagccctccttcacctgctcagcctgcagccatcgcctcctaccagttgcccctttaaccagcatttcccgactccacgtgtgctcagtcatggttgacctcggaaaccactgagacacttgacagattcacaggtgccaggatgactgtgagggggacccaggcaagggcatgaaggcaggacggtgctctgctcccaaatgtctgcaatctctccccaggggagatgctgttgagttgggatgtaaggaatggagggaggtttcctcagcagacagagcagccacacgggccggggtggggacagccttccacttcacgccgccctctgactttcaggcagacaccgtccagggcaggcgtgtttctccagactccgggggtgttgggtgccccctctactcacgcctggggtttgttctgtccccccagcctctcccccgtgcccgtgggctccccgacccccgctcgtgtccacgtggagacgatcccgctctggcgaggggcgtgctcctttcctcccctctcacataacgcctgtcaccacgttccggcagccccagttgctctctggtgaaaataatagataaataattcttcacaaaactaattagcagataagaagatgctaatgtgttttgccaactgtgt

SEQ ID NO: 32855 - DNA, 1171 bp, Bovine  19866881094548
catgtggcccctccctcacgttataacctcagaatcctaggcatcctacgggcggcttcacccccgagttccttccttcccttctcaaggtttcacagggactctgaacacatcttagaacctctgctcggtgaggttttgccgggagaggccgagcagggagaggagggctgggctctgcccacgcccgaggctggaggacctggccggccggccatccccagagggctctcagttcacagatgaagataatgatactcatttgagggctgccttacgccctgtgttgcatatacaaaccagccttaatgggtatttaaaaaatttcccacggggaaaataggccctgtgaaagtgccagcattcacctgtcacttcctcccgggaaagggagaaccgacaggcctgccagcggcgccagctgccgctcaggttagaagcaccaacgcttctcccacagctggcaccctcagacctgcgcccggggaggggtgctgcccgaggagtcgagggccggcgggctggggcgcggccgggacggagggagcgctgtctgtttctttgcatcaccctgtctggcatccacagcgcagccttcatcagaggcgcccggctgcagccaccttgctgagaagcacaacgtcagccattctgcaaagtcactctcccccaccctccgtcctccgaccgactcagaatacatgtcctggaaaactgccgagtctggagggccttttaaacccataaagccttcctttctcagctcccgagggaagggtgtgtgatattaggggctaattgtgctcaacgggatcagcttcactcatatggcttcccttccttgcccatttctgagggagagtctagaaataaggttctagaaataagagagaatcaagatgatggacagatggacagaaggggcgcaggggagaggcaggaagtgttcacacctgcagtttgggggtctggtctctccagccgtgacctctctcgagctcttcggtagggactcaaggaaagcggacacgcagtgtccagaaagtgagcttccctgtggcttggatggtaaagaatctatctacctgccaatgcaggagatgcaggttcgatccttgaatcacgaagatcccccagagaaggaaatggctacccactccagtattcttgc

SEQ ID NO: 32856 - DNA, 2665 bp, Bovine  19866881111002
ctccttgcagaaactgctggttgtcaaccccaatacttgaagtaacctgaggcccaaaacagctctgacacctcagtgtgttctctcgctttaacctcttcgactttactaacgggctttaccttggggggtgattgctgcggtttgttggtgtttcccgcgtgctgtgctcttagagcccggggtataaattcaggtgccagtggattcaacacgtatgtcttctttagttctaaagcctctagctgcgctttgatctgttcaaaagtgattccatgcaggctattgttttcatgacacagggcaataaaccgctcccaaaatttcctacagaaaagatttagatcagtttgcaattaaagtggacaagatcacagaaatgactgtaagcaactaaagataatttaggatcccctctcccactccaaccccaaacccttaggtccaatattcatctatgattcaggtataatcttcccgccagatcacaggactttggaagtgtggttctgaagctcagttacatctagtaccgtgggatatacaaattctcaattcattctggtggaccacacagtcagtgctcgactatgcatacaaaaaggtttgttatccacacaataggcaaggatttcagaactgataagaagtaactaattactaccatacttttcttttaattaactgatgcctgtcacagcacagcttataacattaattgactaagttaaaagagttaaattatgaaaaatacaggaagttggaatgctaattttaatgattatctcctaatcaaattaaaaaatactaatggagaaaaatacattcaaaattgttccagtcgtacactgttgtcctaaagttttgaaaactgatctccaaatagtaaaaatattacatatatattacaaaagacaacatataaaaagtttaaagattttaaatgattattataaatatgcatcagttcactccagttcagtcagtcgtgtctgactctttgcgaccccatggactgcagcacgtcaggcctccctgtccatcaataactcctggagtttacccaaactcatgcccactgagtcggtgatgctatccaaccatctcattctccgtcgtccccttctcctcctgccttcaatccttcccagcattaggatcttttcaaatgagtcagttcttcgcatcaggtggccaaagtactggagttttcagcttcaacatcagtccttccaatgaacattcaggactgatttcctttaggatggattgattgtatctcctggcaattcaagggactctgaagagtcttctccaataccacagttcacagttcaaaagcatcaattccttggcactcagttttatgtagagtccaactcttacatccatacctgactactggaaaaaccataactttgactatatggaattttgttgccaaagtaatgcatttgctttttaatatgctgtctaggttggtcatagcttttcttccaaggagcaagcatctttaatttcatggctgcagtcaccatctgcagtgatttgggagcccaagaaaattaagtctgtcactgtttccattgtttccccatctgtttgccatcaagtgatgggactggataccaggatcttagtcttctgagtgttgagtttcaagccaactttttcactctcctctttcacattcatcaagaggctctttagttcttcttcactttctgtcataagggtggtgtcatctgtatatgtgaggttactgatatttctcccagtaatcttgattcctgcttgagcttcatccagcccagcatttcacatgatgtactctgcatataagttaaataagcagggtgacagtatacagccttgacattttccaatttggaaccagtctgttgttccatatccagttctaactgttgcttcttgacctgcatacagatttctcaggaggcacgtcagatggtctagtatttccatctctttgaagattttccacagtttcttgtgatccacacagtcaaaggctttggcatagtcaataaagcagaaatagatgtttttctggaactctcttgctttttgatgatccagcggatattggcaatttgatctctggttcctatgccttttctaaacccagcttgaacatctggaagttcatggttcatgtactgttgaagtctggcttggagaattttcagcattaccttgctaacatgtgagatgaatgcaattgtatagtagtttgaacattctttggcattggaatgaaaactgaccttttccagtcctgtggtcactgctgaattttccaaatatgctggcatattgagtgcagcactttaacaatatctttttttgaatttgaaatagctcaacttgaattccatcacctccactagctttgttcttagtggtgcttcctaaggcccacttgacttcacattccaggatgtctggttctaggtgagagatcataccatcatggttatctgggtcatgaagatcttttttgtatagttcttctgtgtattgttgcctcctcttcttagtatcttctgcttctgttaggtccataccatttctgtcctttattgtgcccatctttccatgaaatgttcccttggtatctcaaatttttgaagagatctgtagt

SEQ ID NO: 32857 - DNA, 1673 bp, Bovine  19866881136279
caactttaacatgcatcacacaagaagaccgtttttattgttacaaacctaaaccagtaattttcttttaatatgagaatggaatataggctcaggttttcgttactttccccgcaaagctgaaagcagttcgctcgccttagaggttttcctttcactgtgttctgatgtgacgttacctttcattaatcccttccagctaagcaagatttaattaaaaccatctcacgtgatggcagccatttatgtatttaaaaaaggagctctcagaagcttggctgcctgtcttccgctctaaatgaagtcaaactattaaatttagtaggctccttttttgaattgcaggtttgttacgtaatggcttttaccccattaattttggacaacgggacttgtatgcacatgttccattttacatgactatgagctgaatttgaaatgatatggacttaagacttgagggtgaaaggaaattattgtttaagcaaaatggaaggtgatacctaagtatgtactttctcccctcagcaagcctgtgatccatgtggtgtgtgaacagggatgaccctgttttacacgtagaggtgacagccggtcccgaggatggggtggagagctgggctctgggggtgaggccctggtttccatccctggtgctgatgctgaccctttgcacagagacgtgaaggtcggaggagcccatttctaatcctctgagatcatgtgagtccttggctctgaaaactcattttttcccgcgtctcccctctaatctggcatggactttatgtagaacctaatgaaatggaagtaaatacttccttggttttgcagccaggtccactgggaacaaaaaaagccgtaaatctacgtaagcaagactccacgtctgtgcatcttatttataacgtcataaatctcactccaggttgatgcataatttaaattatatcgtggtgagcctgggatgctacagtccatggggtcgcaaagagtcagacatgacttagcgactcaacaacaacaaagtgtgtgtaacttagaacttgagattttaaccgtgtttacacgcacagctcgggggacttagtgcacacagacggtacaactgtcaccaccaagcacttccaaaaccttttatctttccaagcaaactctgtgggcttgaatggagagggtctccctgctccctcttcgtaatcagcaaccccccgcccccggggcgggggtggggggagcaggttccttttctttatctcatgtctgagtccttgaacccacctggatcactcaggggggagcagctctctgggggcttttgctgccccttcagattatattgttcagtgcgggcctgattgcaggatatgactggactggggattccaggtgtacagtctatgcagttcccgctggagagctgagcgcactggcaggcacagacaccagcctgatctgtaggggtttatcagctgtagcctggactagaggaagcgctcgaaggctggcgcgctgagcagggactcagcatgctccgtgtccgctccacatagcgtctctgtaatgaaccgtggagaggaaacgggccctgtggcccttgtcttcctcattccgcgagtggagccgagtccgtgttggggagagtggctgatgggcctggtcttgaacgtccg

SEQ ID NO: 32858 - DNA, 1356 bp, Bovine  19866881157797
cccactctagtattcttgcctggagagtcccacggacggaggagttaaacactcaaaactagagtaccaagaaggctccaccttgaagtatcagaagagccttgtggtgcccccgggggattcttgagggttccaggggccacctgctccttctggaagcctgaggtacaggatcagcggagcaggaatgcctacatagcgtcttatgtttgagctccgtgcacaggactcttttcagggtgtctttgctgctgctgctgctaagtcgcttcagtcatgtctgactctgtgtggccccatagacggcagcccaccaggctcctccgtccctgggactctccagacaagaacactggagtgggtcgccagcgccttctcccggggtgtctttagttctccgcaataagactgacctttagtcctctccctgtcttgcccatgtaatgtcagctggtgaggaatgccttaccaagccaggcgtatatttgttttacgcagaataatatttaaatatttgaggataggtttaaaatatcaatcacaggttcttttaaaaacaacaacaaacaaaagcaatgcacgtaagcctccttggagataaagagttcgctgaggaaaagaacattttctgaatatcataaactcagccccacaaattctcaggaaggcataagaaattctttggcagaaagaatcccgattaaaatgtgtatattgcttgcctccgtgtacataaagtattaattagtccctggattttgtttgctgttaacattgtaggcacgttcgggagaccaggcgggggtggtctgcctcagttgcggctggacagacatggatggagtattttagggatgtgtcactcacaggagcctgtgctgtgagggacatctgctagcagtttctttatgtcaccgacgctcgatagcagagtatcgagttagagggtggctcagttccgcttctgttcacgcaaccaaaacacagagcgggggtggctccgggccacgcgcagcctcaccctttgccttctcgacttgcagcctgtgatatgaacgtgcacaagcagtgcgtgatcaacgtgcccagcctctgcgggatggaccacacggagaagaggggccgcatctacctgaaggccgaggtcacggatgaaaagctgcacgtcacaggtgaggcgctcccctcggtgtggctgggccgcccgcagccttcagaccaggagaggccggccccgaggccgggatggacgcggagccgctggctctcgtgcagccgtctcccgggttcacagacactcggcgtccagcgagtcatgagcgccgtgtgagaagggctctgagagcaggctgtccc

SEQ ID NO: 32859 - DNA, 1684 bp, Bovine  19866881204063
gtatgtgtaaaaacagattctcttctgctttgaagattttgaagtatttcattgagtaatgtttaagatttgatattttcatgtactgatttcaatggtgattttaatatgaaaaaactccacttcgtggtgatgactaatctgggtgctttcctggcatgacgggtgtgcacgtgagcatggtccctgctcacgagtggtggcattgctgccactcccttgggaacactgataatgccctttgaaagtgtgtgagtgttttcagtcaacagagagctatattttaagaactataacacataacacacattgatcgaaatgttaagcttggataaattggaaagctggacctctgtctcctacagtgtttttttttccccttcattagaagattttccttagaagagactgactagaatgctctttggtgctttttcctgctttcttttggtcaggaaattgattaataagattcttgctctttgggtgctcatagactagaaatccttttcttcgagattgctgccgttttctagagtgagtctaggagtgagtgggagaagggttcagtgtgcattctcacacactcttggtgagagttttgcacagctcagtgatttggataatggagtgcttcaattatctaaatggggaaggagggctgaggtgtttaacgtaaattaaagttcttttcctgtttgttcttttgtgtcaaaactttttcaaagtactagctatttttgttgtaaaccttacagaatgtaaatcttatctacttctgtaacatattggacacattgaaccattcattgaagatacagtgacctctctgtaaaccttgcttcatagaattgtgcaccttgggagaagactggcctttgagagatactgagtgcaatctttactacctgtagatgtttaaaggttgctaacaagccctataataagtcgaataacacagaagggcccctgcccctcccccaagaggaggtcgtgacgttagtgtgctgcgtcttcttcacctttctctgtagtgagcgcaaatgctcgtaatacatgacatacgtacatgggctttttatttaaaaattaaaaaagaattatgtgatcataacaaaattgcttgctttcttagcaatatagatcatggatatcttactgagttaataatgcatcagctccagctcctataccatagtccgtggtgtagatagccaccatttattcagctgttcccatggtggtgggcgttcgggtggctctacttttctagtttgtcacaattcaccctgtaataaccatacattgtttctcactgctgcctttgtttctgtgtggtagtcttaaaagttagatacctggatgaaggagttttaaaaattgaatgtctgggttaaaatatacatataattttaatagacactttcggattagtttcaaatgcacacatttttaaatagttcagaaaaaaattagtgaagtaaatatggcaaaagatggcaacctaagttttaagaatatgaatgcttattatactatttaccctagtttctcattctaaatttttcataatttagaaaattatgaaaaattttcatatctcatttcaccatcttacatatcagcaatatgtgagaatgcctgtttcctgtgatctcagtaactggaaccctctcagtcttga

SEQ ID NO: 32860 - DNA, 2715 bp, Bovine  19866881226809
tcttgtttagggcgttggggagggggtggggggtaccatcccatgagagtgtgatgagaccgtggttattggtgggcttgttgctgcaacatttgtcaccgttcctggcacatcgtaagcagtcaaccagcactgagtcagccagcgagcgagtgtcacagctgtagcggcccctgtagtgaagaggagacaagagggcacaagagcagcagggaagcttgacgtctagggcgtcaagccggctatccacggcagatggctgacagatatgaacgagcgcggtggaggtgctggagcagagggctgtgtctccatctcagcaccggtttgctttaactgtgttgatcagacccagaccgagcctggtgttccagcgccagcaccgctgtccagcttacctgttctcaaaatacccccttctccttagcagctgtatatgcgtccgtgtatagagacagacgtgtgcacatgtgtgcacgtcagcgtgtgagcacagtcgtcagtttgtgagatcagttaacagtaatgaggttctggtctcttctttctatgccacccagatttttccaagcatgtactggccttagttgaaaaaaagaaaaaaacaaagatgctgaatttaactgttgttgtttaatctgctacttatcaatgataagtgaaagattgctcaataaatcatttggaataaactcattagtaatttgggagaaaagtgaatttagacactcattgtataccatgcatgaaaataaacttaagagagatggaaggttaaatataataaagccgaaccaaggaaaaaccaggaaacagtagaattgaagaaggctagtgaagacctcatgcaaatttaaggactccaggagacaaattggcaaaagaattcaaaaacaaagcccacaatagagggaatataattaaaaacaaacagaaaatgttctgacaaagatagtaaagttaaaaacaggaaatgtcattactcgcatatttaattagcaaaaagctcttttaaaaaggcaacttatcagttgctggtggtgcatcagcagtatttctccatgtttaagactgcatcgtaaactcttagctagcacagggcaatatatatcaagaactctggaaatcttgtggctttactacttctagaaatctaagaccagaaatacagggtttcatatgcatgaatatgtccatgcatgaattcatgtatgcattcacttgaaatttattctaaagtcatggtaacatgtctaaattcatctaatattaaatgaaaagtaagattttaacatatgtataacttaaagagagacacattttaaactgtcaaataagaaatacactggagtgatgcatgatcgagtggtggtggttgggattcttggaaatttttttcttcattttcttactctgtaacgcagtttttaagaagcatttaaaaccagttttataaacagactctgagtccctaagagtgtgttcctgagaacaacagtccccactcttcttggcaccagggacacttgtgtggacggcagtttctcccgtggacagggttgccggggtggtttttgatgattcaagtgcattactcttactgtgcactttatttctctgatcaccacatcagctccgcctcagatcaccaggcgttagatcccggttggctgagggttttgaccattttcatgtgttcattggtcactatatggctcctggaggaacgtctgttcagagccgcagctcatgctatacttggggtgtttatcttttcattgtggagttgaaagagtacagtacttattttgttttaagcacatgtctccatgtgaatagaaaatggatgaataaatagcaaatgttttaaacaccaaagagacacaagaacagagcgattgccctgtggttctgtgtacttggagttttaggagcgtttggtggttggagaaatctgatattgattgtgtcaatatagtaaatataacatataggattctgaatccttttatagcctattaggggtaggtactgagttactgaagggaatgctgagttagtggggtaaccgatttactttgagaacattttaagatttgtgaatttttcataaaagtgttatataaatttgaaactcacacgtgcagttgagactatttcactgattctgttaagggttttgggaaactaagttatatggaagctcaagagataagtgtctcatttgtggtattgtgaatttttccaggggaagaaaacacttttttttcttacaaacagttgcaggaaattgattgtttctgtctttaagttatcataattgcgtttcttcatcacaggccttgtaaaactatagaggatgtatgaagtcatgtttattcatttggtattttgaacataagtatcctaaacttgattatgttaatttcagtagaacataaagttgagaattaggcaaatatacataagtttcaattgtgtacaagggattgcttatagtccaggataaaatcgaatcttgtccccaaatctaattagtggctgtttgttggtatatttgatgtacgcattttctcacctcagtaacagatgaaattcagccttggttcctggagttctcagccagtgtcctggaatctggtacagtctcaagagttgagtccagtggtcaggggcagaactagaggtcagctgcatagcagtctacaggagaga

SEQ ID NO: 32861 - DNA, 1304 bp, Bovine  19866881238279
taaacggattttgaaagctaccatcctcttttcccaagtctttggcaccaagataaaaaggctttcgatcctacatacaggctgtatgtgtgactgtatccaacacagggggaaaactaacagttcttttgccacctgccaagtcttcacagtgccataaagaagaaagcccacgctcaacctgcctggaaggggagaagccaaggaggggtgtgcagaggtctcccaaagtgccgtcttcccctttgtatccagaaagaccttaaaagagccccagccaaagagactggagctgagtatgttctagttaacatcatggataatgcattattcatggatgataaaattctcatcattgggataagaatgggcacccacatgaggcagttctgatcttccttcgactacatacagactatgtaagtgaaggattactgaatttttttctccacaggcacgtgtaatcctagttgccgcaccagggattgaacccataccccctgcattggaagcagagtcttaaccactggactaacagggaacccccgaggactactgatttgattagaagaaatattggaaaatatgtctgaatattaaggcactaagtgcttctctggggagaaaatatattaaatgtcaggaaatgcaatgggaataaaaacacaagtagaaaattgaacggattcatgtcgtgggtctccaggaatttagaaatctggctacacattgagattttttttgctccattgcttctggctgcattcagaggcgtgctgacaggccgtgacttaataattcctgagaatcttcctttgaaggttttcaaatcgcatttaaaacaaagcatgccattaaaaaagactcactgatcactgatcaataaaatatattcctttccacagagagcctttttatagctccaatgtgaaaagcattgctttcctgctacccccttggggatcaaaggcagactgatgtcaagcgctcagaacacaaagggaaaaaaagtctccgataactttgtgctttatgtacagccagaggtggatcattctggtataaaaggatttttttttttttttaatgaatccattgactctgtaatgcaggaaaaaagagggtcttccctttctcagaattctcctgatcccatatttaatgtcaaaactagaaagtattcctaataaggaggaaagactgacttcactcttagctctaaaacacgtactgaatccacaaaacttgagacaaggatgcagagaaggctccacgagtctggcacggcaacttgagatgatgtt

SEQ ID NO: 32862 - DNA, 1378 bp, Bovine  19866881288992
taaaataagacaattataagtgttttagacttttaaaatgaaaacataaaataagatgattttcgttttaagattcttggccttgttcttctctcttattaccttaattgaattagcagctttacatctgataatcatacacaaatatatgtaaagttttatttttgatatttataatcctgttctgtataaggttacaaatattatttgactctcattttgttaccatacttttggaataagtgacttaagttttgtttataatttctgtgtaaccagagtagtagtatttttggttagtgaactggtactaataaaaaaaaatccatctagaaaaagctaacagtgttactcttatttataattacacttgatatacttaaaaatagcaacaatttgttatttaaagattgggctgagctgatatttaacctgtaagtgctagtggattagaataaagacattaaactaaagactgactaatgaaaacagagagacaatacatattcttcagagaaatttcaataccaaatcaatatttgattataagattataagaattctagcaatgtgaaatgtgtctgctttccctgaaggtctcagtaaagaccttcttgatgttgcctttctgtcttggggtctgagcatataaaaagggtgttttcaaaagtacaatacgttggaacctaaaagccacagtggccgattttcttattcttaccggctcttctgatgagggtgggcagttcaccggcacccctccccgctccccgctccaggctgagagcaacagtgtcagcacaggcatctcctgccgctgcaggctgttgcagacgcagactcacagatatacgcgtgtctttccctttcagcagttacagatgctttaagctttatctcatcactcaaacatcttcctccagtttttcttgcgtatttggtaaatttattttgataaattttttttagaggagatactttcaattcatacttgaagtgagtttttagctcttttataaattctgtgtaattggaatcatattttaagggctagtatgggactgtaccatttaggtcttgcttatagaatgttaaaggatcatttaatacatctttttggtgggtatagagtctttataatgtgaataattatgtcctgatttatttgctagcttctacatagtcttaaacttggtccttgttttacgaaaaaaattgagttgtcttcaaaaactatttagtaagtagtttgagaatcagaaagctttttcctggtttagttccagcccagcctcaaaagggtccaatttaatcagtaacatgtaaattacggtgatattgcttcagttatatccaattagcatttatgacattcttt

SEQ ID NO: 32863 - DNA, 813 bp, Bovine  19866881471965
catcttctgtgactactggatacaaatgcttcagaactgatatgtcagcaatcctgttttctactctgtattaaaagattccttctctctctttcagaaattataaagagctctgatgggctatttgggtaatacccagtgcagtgaactgcaggtgagtaaggcttgggagaaccttgtttagaaagaaagaacttgatggtgcgtgagaagagtcttaaactagaggagtgtctgctcaggaggaatgaggtgggacagcgtggagagagcagggctctggcgcagcagttggacctggagcttcgggtactgatgggatgatggtgaacagaccacctgactcttcgtcagtgtgtttgaagagaagtgaggataggttaatcttacacttctgttttgaatgagtaaccgcacaggagttcaacctatctgcataagattggatcttaagagtgcttcaggtttcatgtcaacattcttgagtggtagtcaccctgtgctctgatgagctggttaagtattaaattgtttgtttttcctgttatctgctgtgtgcgtgcgtgttgtcatggatgactgtacatgtctgcatttttgaggatctaggtactgagaacagatcagtggaacgaaggttcaactttttttctaatggttgtgttcactccacacaatggtggttttagtctttcagattacttattttttgctgaaatgccctaagaaagacaatttagtcttgagtattatttcacagtaattagtattcttagtctgttatagtatctggccattcagtagtaaacttag

SEQ ID NO: 32864 - DNA, 1146 bp, Bovine  19866880066246
aagatcatggcatccggtcccatcacttcatgggaaatagatggggaaacagtggaaacagtgtcagactttgttttggagggggctccaaaatcactgcagatggtgactgcagccatgaaattaaaagacacttactccttggaaggaaaattatgaccaacctagacagcatattcaaaagtagagacattactttgccaacaaaggttcatctagtcaaggctatggtttttcctgtggtcatgtgtggatgtgagagttggactgtgaagaaggctgagtgccgaagaattgatgcttttgaactgtgatattggagaagactcttgagagtcccttggactgcaaggagatccaaccagtccattctgaaggagatcagccctgggatttctttggaaggaatgatgctgaagctgaaactccagtacttggccacctcatgcgaagagttgactcattggaaaagactctgatgctgggagggattgggggcaggaagagaaggggacaacagaggatgagatggctggatggcatcactgactctatggacgtgagtctgggtgaactccgggagttggtgatggacagggaggcctggtgtgctgcgattcatggggtcgcaaagagtcagacacgactgagcgactgatctgatctgataaatataaatgatatgtaactatgtgagtgtgaatcgacttgtggttcatgtgttgacatagctatatgttctagacatttaattaaaaattcattaattttgattttgcaattttctttgtatgtattgtggccaatattcttttcccccaccttggggttcaaatgtttacaaaaggccctgaagagcttacacgtttttccatcatgtgccatgcctaaagtgctgaaaagatacaaagatgatgagtctaggaaggactcaggactccgcttttttaacaagaatgccagggtgaccctagaggtggtcctcagaccacaccttgaccactggccttcagaggagggagggtgatccccagtgcgattctgcattaccactagttgggaagggaaggccatctgggctggtggggaggaggaatgaaaagagctttgctgcccctggggaatatccccagactccagagaagc

SEQ ID NO: 32865 - DNA, 3712 bp, Bovine  19866880195227
tcgcttcagtcatgtccgactctgctcgaccccatagacggcagcccaccaggctcccccgtccctgggattctccaggcaagaacactggagtgggttgccatttccttctccaatgcatgaaagtgaaaagtgaaagtgaagtcgctcagtcatgtccgactcttagcgaccccgtggactgcagcccaccaggctcctccatccatgggattctccaggcaagagtactggagtggggtgccattgccttctccccaagatgatgatgataatgacaacaatattaaacagtcaccaccacaacgtctggccctctgcgtggccctgcaataagccaatgccaagatgctgtaaaaagcatgtctgggttgaagtcccagctgcagcactggctggccacgagaccttggctgctttactaacagttcaaccctcagctttctcacctgtgaaatgggaataaccatgatgccatcctcaaacatttactgtgacaattatatcaaaagcacctgtcatagtaaatggcacttggaaggtccacagagtatgtgttatcaccatcagagtgagatttaaaatactccatatctgagataatatggcagtagccaatcacctcagaggccagccatgagcaactggtttgatcctaacaggacataccagctatcagtcctgaacattagcattatttccacccaccaggtactaaggtgagcactgggcatgcactatctcatttaattttcacagcgcgttggctttattatgttatctattgaaatacatgcaattgcatatttgcaaataagactgtgcctataaaatcagttctaggtaaaagacttaacatataccttcctactgccctaatgactcttggcatgtgaatttcaggttgctttgtctgggggttttttgccttcattatatagttctttcttttacttaatgattctctcaatagtctttggaaagcaaggataatggtcaatgatctcagtttcttcatccatcagataggtaggcacaaacactatcctctctttctgagtctccatcactccaccctaaccaaccctgggaaaaccaaaggcttctcaagccaagactaagtcacacaaattggacgtcagacacttctgctaatccccagccagcacttcaaggtctcaggtctcaggtccccatttgccttgctcttgagcagatttcaaattcagcctccaatgatattggcttgaagcagtttgtccaacatccccttgcaaacctcgcttgccctgttctctcctctcctccctcaagagctgtgctgcattgctgcctcctggagtttatttgactttctatcacccacgtgatgaggtttccagtgttattaataagtgactgcttattaattagtattattagacatgcgttatgcagcacagacagtaacacagcgtatccaagaagagaagttatacagaaagaggtgaacctgcagcccagcaagaggacacagggccagcacggagtccagtggagtcaagaggaacccttcccaaatcggaaagccgagcacctggggtggagaaccgcttgtcatgggagggagggagagcacgtgaatgtgaggttcacagcgtgtgaggacacaagcccaacgggcagcctgagcattcaggccctgagggggccagttcctatggaaccttcctaactccaggcatcccttccacccggggtatcagccattgccacccctgccagcccagccccgacaaggctgctggaaaggccagctcccagaagggcaaaaagtctctaacttccagctccagtctactctcattttcttttctggcttattccatgggaaataaaatattctcaggcacctgcagcagtggaagcctctcagccatttccccgaattcagcagcccaccactagctgagaggaaccctcccctcgggacagggctgccagcaccagcctggggagatcccaagctgggatgcggaatggcacacctgggctgtgtccttctttcccctgagcaccccggagccagcaacctggctagatccacggcaatagaacatctcaaccaaaaacttcacaagagaaaaactagaaggaaactctttcctcccacactgatcattttcagagcagttctagaatttcctgcttggggatcacattttaacatgggccgggtatatttggagtgtttaatggggttgaatgtttgagtggcagggagttacctattaatacttgatggctgctttgaaaaaatcatcatttgctccatttatgatggaagttcttgtgtgttttaaacttcattcctcccaccagatagatatgagcagacagctggcacagccacttttagatgaagtgtcgagagggcaggacccacaattcagcgtggtgtagtggcaaagggtgtgaactccagctgcacacgacacaggctggaatcccactctaccgcctgcaagccacaggaccgtgggtaagatgcttgacccttctgcacctctgtttccctttctatgtaatagcaacaagatagacctgcctcatggagtctgcaggagggttaaatgagctaatatttttaaagtactcaaacagtggtagtcatggtgtagaggttatataaaagttaatcaagtaaaaaataaaacaacttcccatgggcgctgcttcccaggttgtgcttcagtcactaaatcgtgtccgactcttgcaaccctatggacagtagcccacccggctcctctgtccatgggattttccaggtaagaatactggagctaccaagggacaaatgtgtgtgcgcttagtcattcagttgtgtccgattcttttcgaccccatggagcttccaccaggctcctctgtccatggaagtttccaggcaagaatactggggtaggttgccatttcctactccaggggatctcccccacccagggatcgaacctgcatctcctgaattggcaggtggattctttaccactagtgccacctggggagccctaacttcccaggaggcccttgataaaagcttcacaacaatggcagtggtgatgtgctgcttctggaatatctcaggatcgtgggcaggaaagatatcccttctgctatcattcctggagggtcagtcggtcccagttctgatgcctgttgccccatgtccttccccagcccctgcttcccatcctatctccctctccctctgctgggacagtgttcatatcatccctgcccccttcaactgtgcagcggctcagcctaagagcaggcaggggcggcagcgccaacactgaggattttgtggaatccaaagcacgccccatccccatcttcatccccggcaaccattctctctgacccacgcactagaactatttttaaacaatatacttttgcccggttgtggaggggaaaaaaaaaaaagaaaagaaagaaagaaacaccctccccaggattcaagctgaagatggaatgattgccaaatgctaacagcttttcaaacaggacgcagttaaaaatacgtctgaaatggttttaactcaaattcaaaaaatagcttaaccgactggggagctgtaggcagtgggggctggggaagctgaagaggcaacgggattcccttcggaggggcctaaggcaaaccttgccacagggacacagggcg

SEQ ID NO: 32866 - DNA, 3454 bp, Bovine  19866880415065
ccagggggccaagccacccccaggaaggttggcacctccaggggagggatggctcaaagaaagaaaactctttctccagcagttcagggaccaagcccctctgcagcaaaaccaaacgtctggcgagttagatgtgccctcggtgggctaagtagtccatcttgaccacaagaaaggtgaacagaagcaggtggggcaggtatccaacccaaaggcacagacggagagcgggaaagcagaccgtggtgccttccccctgggaacggctggaaaccctcccgggacgtggcctgaggccctgagacacaggcttcacaggagaggacttccagaggtggagcatgacagtgccatagacagggatcgcggggctccacggggcagaaacggggcaagcgggtggagacacgacggaagaatgaggggtgaagagacccctcagccgcggcaggggccaccgccgggcagggggcagcgcgtccactcagtgtgaagcaggcagcagccagcagagcagagcccagacccagccagtgagcctcagccccttcaggtgcagaacgagctcctgaaggttgatcttccataagctgacggcctccctcagagagatccgggcccttctgaagagtgaacgggtcttctgcttcttgtgcctacaggaggggcgcgaaggaagagagaagagacgcagagttgagacgagcagcgtcacttggaaaaacggaaggtggtggctctgccaagtcaccactccgcctcccccaggagacaacggctcctggtcacgcgatcagaccactgcccaatccgggaccagaggaactcagctggtctacaggcgttttccaggtaagtggggtaagtaaaagcagatgttgcacacctcatcaaaggcctggaggacccgctgggtatcatgttccaaagtttctctttttccaaaagtagagtttatattcatcaagtcagaatcccccagactcaaatgaaagagctctccctaattttctgaggctacgaatcacctggaaacctagtcaaggtggtcctgggaggctggggccatgatggattccacccagctcaaggccttctgcaccaacaaaaggacatgatggaaactggtgtttatgaggatcacctactcaagacttttgtttgcttttttttttttagccataccacacagcttgcaggaccttagttccccaaccagggactgaatctaggccccagcagtgaaagcaccgagacctaaccactgagctgccagagacctcccaagacttcgtttccggaacctcagaggaagaatgaatcgtgttcagcccttccctaggcagtgtattttgctgtaactcagtatttgatagcgggtgcatgatgcatgtggtcaacactgccgtcacctgtttaccagaatgacccacttgctgcctaggatggaaggatggcttgaagctgaccaggccaggcctcccctcttgggtgcgaacactcagccagagcatgggccttcccatgtatatgctaccatccagtagaagagcctgggatccctattcctctactactgcctccctggggaagcacccttcccttcctcatcaacacctccaggatgctgaggcatctgaaaagacctgagatcctgagagagccagctagtgacacgtttcctgagtcacagccacactcacagggaaaagaacactggcctcgctgcctggcgggtgctggggacacagtcacaggaccaggcacggatgagatatgagccagggcatactgatcccaagtctggggactctcgggtgggactgagactatcagaaaatgctgcagactttattgagcgtacgcgtcacgaggaaagcttgcccaggaaggtgaggtcccagaacccacaattttaaccagcagaggtggctctcctggaccaccttaaacatagcccccaagtgtcagccagttccctggagctggtttctgcccctaacttcctgcagggagagctggagactggggagctcaggccgggccctgggggctggaggagaaaggggaggcgtgcagacccctggggtggatcagggagctggggtggggtggcagggggaggccggagcccacactcacgcggccagtgctttgatgcagcatcgcgacatgttgaggaaagagctggcgctggcgcgggtgcccagggcggcctcgatgccccgcagcaggtcgttggtcttgaagatgagcagcatctggcgtggcacacggttgaggagctggctgatctgggggaggtagttggccgcgtggttgcggatctctgagtcctgaacagaaagaggcagcctgagtggggcggggggcctggggcggcagcaggcatccgggctgccagcgatcggaaggggctgtggggagggtccgggagggagggtctagcacagcggcctcagcagcactaggaaccttcccgggggagaagctcagcccaagtggtgttgtagccagacgaacctggtcaggacgtctcccccaacttccagcccagcaccggacaccacaccggagcctcatttctactgcctctgccgtcctagctccttgcagctgaggtcaccaatacccatcccccaagcccccaggccagtaccgatggggcagggagtctacctcccctcctcaccaactatctgatgggtcccgcctctcagcccaggggtccacctttgtgttattctccaaggctctgtgctggccaccaattttcaggccaggtcaggaatgactcttgggagctggtactggctgaatcaccagtactggctgaggcccccatccctccagccaaacccaggctggtgcagtcgagacctctgagatcctgaccccaaacccaaatccaaaatcctgccccacaccctgcctgacccgagccccaccagatctgtttgcacagccatagcccatcactgtcctccaggcttgacccagcatcagcccgcccatgcctaaggtcctcaggacctcggggcaggattcagggctagcccttgcccatcctggtgggtaagtttcagggtcagtttcccagccttccccatccctgtcatggttctgagaagataactgcctccagccagagtcctgagtatagagcgaggctctgatcccgtctcagtctccagggaagcaatgatggcgatggtgatgacaagagtccatgtgtactgagcatcactaaggaacccgggcactctgacatgcttgcgtgcgttagctcatctcatcttcacaacaaccctattaggtgagcgtatatccccattcgagaggaggaagctgaggcactgagaagtaaaataacctccccaaggtccacagctagtgaggcaggagtcaaacccggtcattcagctcccaagcctgcaccctcaccagcaggcta

SEQ ID NO: 32867 - DNA, 1317 bp, Bovine  19866880482963
catctcctcctcaggagatgttcctgacccagcactagagaaccctggaggggcccctgctccagagacaaccccccaccaagcccctccttcccgtatacagactcgctcccatcccttgcagtcccaaaccctgtgtttttaaggcgtctgcctctatcttggcccagctgtccccaaggtcagtcgcagacctcactgcctgtcctgtcgcctcccacacactctgatgccagatccacaaacgccctggtcttgaccgttcagcctggctgccccctcaccttggcccagtctccctgacgtgcatttgcattcggtgctcgtctgaggtgcggcgatttatagcacagggctgaggttattaaacccactggaagaggcctcacccaccaagaggtaaactctgcactgaggcttaattacgcacagatgttgtgatggggtgccagtgtgcaaagcaatctatctcctgtttgaagagctgaactgggtgcgcggcgcaaaatttgcttcccacttgttatgtgtttaggcaaaattaattactcgggagccttaattccaccattctcttaggaacggggtgcaggcttgagaagcagcaggtcaaatcgttacattaattattcacccatttggcatcctcgtttcaaaaatttgtgttattattacatgtcttggtctgacagatgctagttggccccagccaggggacaattttgctgtttccatgggaacagtggaggagatggttctgtttgtctggctcacagtactggcgccgaggaccacccctgctgggtaagaggcaacacaatgtccttagacgagcaccagagttgaagtcagaaaatgctgtttgtaccccagctcttctcctctaagactgccatctgtaaaatgggatgatggtttttggaaggaccttgtgtccctgtgtctgcctagtactcagagccacagaagaaacattcagtaacttctgcctatccccttgcacaatcaacacttcttggaagcccccactgagctccttatctgggcagaattagatacttcctcttgggcacccacagaaacagagatcagtctctgccatagtgccaacaatctgaactacagaacccactgtgtgtgtgtcccccaccaaatgcgaagtcttctcaggcaggagccaaccatctctggcttaatctacacacccccagatcctagcacaaccacaggctcaggaagtgctcgataaatgtggaataacggaatgaaacaaaaggaataggtaagcggaagagtcatttagacccgacaacaacg

SEQ ID NO: 32868 - DNA, 833 bp, Bovine  19866880591417
agggaaaggaacccctttcatattggttccacgctgttcacaggaggtctcactgagtcctccccacacctcagggaggtaagcaccacgatcaccacgttcacaaactaaggttcagagagatgcaaagtttgtctagggtcacacagcatttagtcctagagcccgtatctcctgactgcagatgtcatgagctttctactacctcaatgatttgattttgttaaagttcattcgacaaatatttactgagcgactccagggtacatgccaggtgctgtgtttatctttgggatatagcagggaagtcaggacccggcactgaaggggctctgagctctggctcaggagaggcccagccccagcccctgtccaccgtccatgctgggagatgcgctcctctatgcctggagagggaaggcgtgaagcctcctccattctcctcccttctccctcttcccttcctctcatccagaaacaggcatgcccttctccctgaaaaactgctagaattcagctccagacgcactggctcggaactggcatgctgacccggtgcaaatgaagtcactgtagcccagacccccgctgggcgtggcagaactggccgcgagcaaagagacgataaagaaatctctaacatgtgccaagggagggattatcacatgggctcttgctttttatgaaataggaaaagtggatttttctagttgactgcatttgatcgtttttcctccatttgttttaaagttgaacatctgatctggcagagacttctcacattcagctgcaaaaaaagatgtcttttgagctactctcccagcctcccatca

SEQ ID NO: 32869 - DNA, 2397 bp, Bovine  19866880595276
tcagatccctttccaattagccagtagaagtgagaaatagattcaatggattagatctgatagacagagtgcctgaagaactatggatggagatccatgacattgtacaggaggcagggatcaagaccatccccaagaaaaagaaatgcaaaaaggcacaatggttgtctgaggaagccttacaaatagctgagaaaagaagagaagcaaaaggagaaaaggaaaaatatatccacctgaatgcagagttccaaagaatagcaaagagagataagaaagccttcctcagtgatcaatgcaaagaaatagaggaaaacaatagaatgggaaagactagagatctcttcaagaaaattagagatgccaagggaacatttcatgcaaagatgggcacaataaaggacagaaatggtctggacctaacagaagcagaagatattaagaagaggtggcaagaatacacagaagaactgtacaaaaagaatcttcatggcccagataaccacaatggtgtgcaacgagtacacacaattaatgactatgcagatgatttatttaggctttgttattaaactcagtgatataagaagcatctttgggaagatgcttcttcaccaaaaacaccatatttggtgctgtttttgatttactgtgaaaaatgccctctaaactactgttctacctgtgatgtccaataaaagtactcttcattttaaaaaaaaaaaaaaaagtgaggctgctacttgtccaccataagctccaagcttatgggagaaaattccctgccttgctttgtagtgagtggttcatgttccttaaaaatagaagcagaagttttatgtttaaaagagtgcccctctcctgcaaatcactcacctttaaaatccatacacttaacccaatgatttctcgtggcttaacgcatttgcagaactctgcctttggatataatgttaagtcagattgatccacccaaggaaaccaaatttattactttatagtcagaggagttggtcggttctcctaaaacatattagccagtttttataatggagttacctaggcttggttctaaatgacatctggctgtttccaaaaataaaattcatcctttttaagaaaaatatttggaccactgagaatgttcaaagcaatgtgccacaacatatttttaagcagcctaaatgacagtctaaagcttattgcctcaattcaatgaataaacatgtatatgtcagtgtgtgtgtacatccgtgtaggcagatgcataaacaattaccaggaagatatacattagttttgacaggggtcttcttagggtgctaagattatggatgagctactttttaaattgtgttttcctgtactttccaaactttctgcaacaaatctatatcacttttgtaatcagggggaaaaagcacaataaatacttcataaatatagttttaatgtgccaccgatcctgaaggcaacttcagatcagaagttataacaatgcttggctcaggaaagcgtcaatggattaaatgccttgccttccacgctacaacttttgaagggcacaaccctcatttagatgtacaacttctattatgtctgctgttgtttctttaaattactctccattaacttagggccacactgtataatgtcattccatctgtgccagtggcaagctaagcacagtaattcagaccttacaatacgtgcagtcactaaccccccacggacaggcccacgacaaagcctgaattgtgcccaacgtcattctgctacatggggtcatggtccagagcaaggccccagtgaatttcctttgaaagcccctgcaccccactcaagaaacatttctaaaggagaagaagaaaaggcatgaccccatctgaaatgtaatctccagtgttctgtaacacaagatatccaagggcactggcaagaggcaacagtaacggtagctgtaagggcaaggtggtccaggcgtttcaaagattgtaagcgaatggaactgctgcctcttgtcggggaaccacggcttggagatccaaaatgctctatgatgtcacccttgattccgaccaccaaatgggatgacagaggaaaggcagcgaggtagggcctgacttgaccacactggcaagagagaggtaaggttcttgcaataaacaaattggagcacttggatgcctaagatgagctcttcaaatttccagcaaatcaccttttcttacaggaatcaaaatttctctctcttgttaccttgcatttactcaattcgttaaatcatctcctccaatcattctaatgtggaatcacaaggaacactcagtaataacaagaaaaagtcttaaatactcctgaggaaaaaaggggaatggagcaaagaaaaggagcgta

SEQ ID NO: 32870 - DNA, 1153 bp, Bovine  19866880631085
tgccttgcaaatctatgtggatgggtgtcagagactatacaccaggctgttgggtgttaatattctctgctattcccaacgtgatttgtaagttttcggccactaaaacgccaagccacgggccatccttgtggcaataattctgcttctgtccaggaagggacttcttcctggggacctgttatcccttaagcataaatctgccttctttggtacctctccccctccctcctctctgagtaagcaagggacaggccaccagggtattctcccctcagatccaagatgtggaaggggacccgagagcgggctctcagttctggagtgggcctcctgggggcatatttccaggacaagaatcctagctccatagaaactcggaaagggctgtctgccgtgggacctaatccttgctttgcaaaaagaagatgtgccatgttggctgatagtctgcggacttaggcaacgagaccaggaattctgatcagctaagctgagaaatcctttctctttcagaaatctcttcctaatccaacatggcttgagagagagcagccacaacccaacttgagttctgcacttctcctgtacaagttatacagcaaaaaagcctacagctagtcctgagaaccagcactcacagcctcttgagggtgaaccctgcagtcacagagtgctgcagaaactcctggcttcccaggaactcaagagcaaacgaaccaataaaatagacttataatgtgcttcatatatgtagccctctgttctgaaaaatgtcttataacatgaagctacagcatcagcagtactaatctctggtcacaagagataggggcagtggaaagacagaccaacggccaagacccaggaaaatcatttcattttttttttaacgttcaagcacaaaatatactaatggaattgattgtcctattaaaactttcggtcactacttgtagctcagtgaaaaaattagtaaatgcaatgaactacataaactattcatttagtaaatgactgtctggctccactggggctgggcagaactggggcagcaggggttcaggaggacagggagtgggagcagatgctgaaaccaagatcatcatcaaggaggaaggtttgaggaacaaaagcatgaggcaactcggag

SEQ ID NO: 32871 - DNA, 4207 bp, Bovine  19866880647772
cagcaacctgtgctttcacagtcacatggatacgcataccacactcctatcccactgtcacgagaagcccatgcaccacaactggagggtgatccctacccaccccaaccacaggaagcctgagcacagcaatgaagacccagcacagccaacaataaaagttaattactttttaaaataaaaatgcttaattatatgattattggagggcttcccaggtggcacagtggtaaagaatccacctgccaatgcaggaaatgccagagacacaggtttgatccctgggtcaggaagatccccaggagtaggaaacggcaagccattccagtattcttgcctgggaaatcccacagatagaggagcctggtgcgctacagcccacggggtcgcatagagtcggacatgactgagcacgcacatactcgttatatgaatttcaccgcaactttttaaaaacaaaagacaaaaaggctccctagacccaccctgggagaaggcaatggcaccccactccagtactcttgcctggaaaatcccatggatggaggagcctagtaggctgcagtccatggggtcgctaagagtccgacacaattgagcgacttcactttcacttttcactttcatgcattggagaaggaaatggcaactcactccagtgttcttgcctggagaatcccagggaccagggagcctggtaggctgccgtctatggggtcacacagagtcggacacaactgaagcaacttagcaacagcagcagcagcagacccaccctgaggagttgcccattctactgtgagctgttgaggacagagagcccatccaatgtctcatcccagccgcagggtctggggcaagagacaaagagcacagcgctggggccagagagacagggcaaagtctgctgttcactggcccacaatccaacagtgtccaggagacaggtccagggacccttgggagggcgttttcaagggctcccttctggatatgatcaccatcaactggaaactgtgtgtgcccagtcgtatctgactctttgtgaccccgtggactgtagcccaccaggttcctctgtccatgggattttctaggcaagaatactggagggggttgctattttcttctccaggggatcctccccacccagggattgaatctgggtctcttgcatctcctgcactggcaggcggattctttaccaccaagccacctgggaagcctgaggatcaccacagccaattggaaacagtaggtgggggaagaacagggccagggacaaagcattctaattgccccagcttaatgcagactttgctcaagtcctaaaatcaagcaggtgtcacctaccctgtgaaggatcatgcccccgccacaagtcacattcctaagggcccaacacaccggaaaggagaagggattccacccaagacatttcaaaaggatgcacttctctgactgtcctgccttcctttcttcactcctctgacccgagagaccccagcccagtgggaacatgccaacttctccaaagccaggagtttatttgcaatgtaaagacaatggtctccatttctctttctgacgaccttccagaatgttctgttgtcactggcaaagcccactgacaattccccggaaataaaaatagaatctggtaataaaaaagtctaaccttttttccccttggtgcttagtcttagttccatttgctcacaggtgccttaggcccctgtgcaggggcctccatccccacttctcaaaccagagttcccagggccagacacctcagctcagcgggccgtgtgcagaagcactgctcacaacactgcaattcaggatggcgatccgggctgtgtgacgacacctgggaccaccaggagccgcgagcaggcacagctgctcaggagaactccacctccctctctgctgccgagatccctataaagcatgcaccactcctggcctggtccctagggaaagtggggagcaagtgctctattttatatttttttggccataccacgtcataccccttgcaatggaagcacagagtcttaactactggaccaccgaggaagaatcaagtttacctttgcttctaaaccaagctcagtctcactctattggcctgagtgatgccaggcagaagcactcttgtctgggacctacttggggcatctgtaacactgcatccccaagagtccaatgtacaccaatgtcctctcctgtttagatgctgtttaagctagggagttggggaaagcaagaaggatgattacagagcctagggacctagacatctatagtggatacttgctggtggtccacagttgaaccaccgagcccctctttcctctcctaccctcagtccacatgacctagtagactcccataggcaaactttattcaacctaactcagctaccctggccacagtagattgaaccaagagtgagcacatgacttaagctagccaatcagagacctctccttaagaaatctagcgctatgagcatgagaactgcgtctctccataatgctctgggtacatgtataaatgtgagaatggagggacagccatgttcacagcctgtgatctgttctgtggtcagctactgatgaaagagtcccagatggtctacacatcctgacattcatgtccatatataatcccctccccttgattgtgggctggacctaatgacttgcttcttacagacagactgtggggaaaatgatgtcacttcttgagattaagttataaaaagctacaatttccatattgctccctttctctccagctcttcacatttgcttgctctgataataagcgccacatattatgagctgccccaagcagcacacgtggccaggagtcaaggactgctttctgccaccagctagcaaggacctgaggtccaacaactgtctaggaactgaattcttaccaacagccatgtgctgagtttagatccttccctagttgagccttgaggtgaccacaactctggctagccatctttgattacagcctacaagaagaagaagacccagctaagctacaccaggatgcctaacctgaaaactgttgataccataaatgatgttttaaggcattaagttttggggtaattggttacacagcaacagataactaatacatggtctgaaaaggaggagaaaggagagccacgctgaagaaagaagagaaagaagcagataaatatagagaaggagaaatgacagagggaaacttggtagtcagagatccccacagattggaatggatgtggggaaactcaccagaggcgattgctgttgttcgggcaagagatgaaggtggtttacagtgcatgctaaattgcttcagtcatgtctgactctttgcaaccttatagaccatagcctgccaggctcctctgtccatggcattctctaggcaagaatactggagtgggttgtcatgccctcctccaggggatcttcccaacccagggactgaaccaacagctcttacatctcctgcattggcagacagattctttaccttcctaataaaggaagccctagtttacagtaagggggaggcaatatccctttctgtgattgagaagaggtgaagggaggaaaatgatcagggagaaaatccatagatgagttttatttgaacatatggccagttaatagctcatgacataattgaactccgcaaacatgtattgaactgtgttggggctctttcagcactgcaaagatgaggaagatgagttccttgtccccaaggtgctcacagtttaggggaagaaaatcaagatgatccaatgtataatgtgctgcatttggcctgtgagcagagagttatatgttgaagagaaaagggaatgattaaccatgtctcagaagacagaaaggcttctcagaggggtcatcaacatgggcctgatgacacctataggaaaatgcatttctgttcagtaacaggacataaaaagaattcaaaggaataaaatgaatgcgtttctaggttccttgtactcttccttgtcttgagggcataataaaacaagtctttcttccagttaggggaacatcgggacttagatcaaaggagtgaagggagactgtgaggcaatctggatggttcctctgcctcacagatggtagcctctgcccactttgaaaaaaacggatcaaggcatgag

SEQ ID NO: 32872 - DNA, 1075 bp, Bovine  19866880714275
tgaaataggcacgttgttatggccattttacaggtgagagagcaggcacagagaggttgattcacttgccctgggtcacacagctaaagagtgctatacaagaattttaacacaggcagtctctttccactacatactgaacacctactatttgcaaggcatggttgaaggtgctgggaatacaatgtgaccaagactaagttcctgcctttgcagagcttacattttaatgggaggagacagataataaataaaacaaacgcatataactttaaaatcacaatctttatatttacatctcatttccccattaatcactggtacgaccttgagccattactaaccccctctgaacctcaactcataatcatatgtagaactgggctgatgtgggagcaaaataagaatacttgtaaaatggcttttcataccatctgccacatgctgctgctgctaagtcacttcagtcgtgtccgactctgtgtgaccccatagatggcagcccaccaggctccctcgtccctgggattctccaggcaagaacactggagtgggttgccatttccttctccacataacaggggcttaataaatgttaatggttgaatctggatcccaacaaagtacgagccccacgaagagaagcgaaaggagttttggaactggagaactggttgaaggagtctacagagaatctgactgctcagttaggaaagggtaatttatcttcttggtctagaaggattccagaaccaagccagctcccaactcccttttccccaagttattatctacatctgctggagacaaaatagggattgaccagattggggaccaagatatcaatttctggtgctaaatcaccacttaggacatacgagaggctgccagtatgtttgcattaataaagccttatctggcctatgaggatctcaataattgttccagaggccagcaaggagaccatcatcaatagagtagacctgggggtggacagtgatggaaaaatgagccctaggtcctaattattgatgggtctggtcttctttcataattgcattgaattattaataca

SEQ ID NO: 32873 - DNA, 1857 bp, Bovine  19866880818651
atgataaagctaacaagttgaacagaccctgaacaggccagctctagaaagaagcaaatccaggccttgatgccggggccaggcagttcctagtgaggagccaggacgactgcccagggcacctgagcaggttaccatggcatcagcagcaaacgacatctggctctcgccctcttgagatggcccaccccacacctggctgggtgccagcagcctttggctgccgcctgatggggagaaggacaagtccccgtgctaatgaagtggcaggagtgaacggtacccaccccagcctgaggcagacagcagagccctagctggttagaactgcaaaacactgtccaagcctgccttggagaggaaatccattgccccctctgggcagcatttcccaggagcctgcccccagaatccctacatctcacagttgccccatcaactgctaccccagttgctgcaattcctgccccttgagtaggggctggacttaatgaccatgactcctaacaaagagcacgtagaggaaaggacaatgtccagtttccaactgtcactgtgatgtcctccttgctttctctcctggaatgcttgcgtgggggaaagcaagctgccgtgtcacgaggcccctccagcaatctgtggagaggcccccgtggtaaggaactgaggcctcctgctgaccgtgagccatcttgaaggcagctcctccctccccactcaggccttccgatgcctgcaccccagctaacatcttgactagaacctcatgaagagactgagccaaagccatccagcgagtcatccccaagttcctgacccgcagagaccctaaaacatcagaaccctgttgttttaaggcactgtgtttatgggtaatttgttatgcagcagtagctgattaatggaccccaagcacaccctgccagacatcactaatcaatcacagcttcactcctgctgggtccagatgatgcctcaaaatctctctcaaccctgagctccaggcagccactaccaactgaccagagttagcatatgagatgaaaccatctgccattccttagcctaagatagagggtgagacagttggatggcatcattgactcaatgcatacgaagtggagcaaactctgggagatggtggaggacaaggaagcctggcgagcagcagtccatggggtcgcaaagacctggacacgaccgagcaactgaacaacaagcctaagccaatcagtcaacaaatatatacatgacagaaaccccagtaggaacatgggccaacaaaacaggcagtcccgagccatgaggagaccttggtccagcagaatgtcctactggaagaaggcaacagcctctgaaaaacacagctgcattctagcaggacctgctggagagggtgcccccttcccaatgtgcttcacccaaccccaagggaccttctggcaaggtaagcagaggggacctccaacaccaccatacagatcctggggggccaggggagaggacagggcatccaactgtctctccgtctccccactcaacagctgccctgcctcaaggtgggggcacccccatctccagctgccaactcagaacaatttattataacaaaaatcacatcaacaataacagctcaaggacacctagatcctttcatggaagttgtgttctctctggggttctaaaagatcaaagcgtcggttctgcagagctgttacttactgctactgccaagctgggccaacagcagagcttgaggcccttctcaacaagggtcacccccagaaataacaaaacatcattcctgttgaaattcttgcaaggaggctggcacaacactcaactcttaccaatttg

SEQ ID NO: 32874 - DNA, 771 bp, Bovine  19866880920132
gctccctgaccctcactcgtggggaggacggcaaagagccgaggtgttcggtgggggagacagggcgatggagtattccagggagttgagaagactggagggggagaaggcgctccgtctccggcgggaagcctcgtgagccagcccggctccccggagcaagcccgtgggtgggtgtgatcatcgtggatgacgggtgggcggatgccgacggggtaggggggggcaagggacgaggtgggcgaaattgagggtttccctcgccacctcagaagccccggacagagcgcagagatcggccctgccctcctgggcaccagccacccttgggcggctcggccttgtcggcggaggctgcagccccagagagctgcagtcgccctcggccgggatggcatctgagcacccccgcccccaccccataggctcctgggcttcggctgccttgactaccagacgccattttcccttttcctttggctaaaggtgtgtctctctttattaggaattatatatgagatgggaaaacatttttcctaagagagagaagaaaaaaaatcctcggagcaaaatgctggttgtcggacgtttcctatgtccacactcccttgccagggctgaccttgagccgttagggagaaagggttacgtcattgccggagaaaggggacaaatgaggggtaggatgatgactcgggggtggattcttgggccagacacccagaggagaaggctcttgggatccccctgctgcgttccccttgtatcagc

SEQ ID NO: 32875 - DNA, 1315 bp, Bovine  19866880952623
gtccaattgcattttcctcttgcagccccagagtcacacttcagatgcgcgtcctctgacgaagacggaaggcagcctgtccgcgtgtctgagcgtgtcacggccattctggctctgcccaccagtccatgagctcctctccggaggcagtgtatttctccgttctcctccagcccaacttgtcagcagcccccttgggcggcaaacgtaaaggttgtttggcttcaaaggtcagctcggtacccgttctttgcctctgccgccagagtcctaggaaagccgcgggagtgcaagccgtcctggaggcaggccacccctgctcccacccccgttctcactccttcaccagcgcccccctcgcctgaacagtgtcttcagccaaggaaggacagacgctcacaggctgtgttcccaccgccttcctcgcgcagaaaagcttaagcgccaaagctcggcacacacagttgttcaagtcacacagcagaagccaccaagggggtcagatagaaggagccctggggctggggggctgaccctttggtgtccgtgggcctctgtgctcaagaggcttgacagtgcagcgaatatagcctggttcaaagtcagggaggctgtttggctacattctcaggcagtcatttctattaatgaggcacctgtcctaaaaatgcagctctcaaatcagggtccagggcctttggcaccctggcagattcttccagatggtcagcaggctgtcgcatccaatattaatgcttaaactatgacagcatcaacacctctgcttccagcatgacaaaaccacgtcctttccttgtgacatctctaagaaccatggactgtcaccactcaggaacttggagagttccaacctatcctcacttcatagatgaaaagcctgagaccaggagccaggaaaagccacgccgtagcccttaagattaatgccaggtagggcaagaaccccagtgcagattttccttgagctacaatacctgaactgccttaaggaaacacctactgtcaaccatagactttctcccactcaagtccagtgaagggtttttcctatcaagggtgggttcagtagctagaccatggggaactttgcttaaatcactggagaacctctgttgttaatcagattaaatccaaagaggatttattaagtttatttttcattagacaatataaaaccagcaagttcaaggtcttctcagtctcagaggtctaggctgtgtccagaaccctacagtttacctaccctagtttacagctatgactctcaaccattactatgcatcagaatcgcctg

SEQ ID NO: 32876 - DNA, 3936 bp, Bovine  19866880986326
acagcctacagctaacgtcacacttagtggagaaagactgaattcttctccttaaagaagaagatatactctcaccagacccatcaacatcatactggaaattgtagttagtgtaactaggcaagaaaaagaaataaaatacggattgaaaaggaaaaaaatgtctttcttcacaaacaacataattttctaaatatacaatcctgagaaatcaataacaataacagcaaaattcctagaaacaataagtaagtttaacaaggtcacaggtcaccaggtcaacacacaaaaatcaatcatagttttaaacactgaaggcaggaggagaaggggaagacagtggatgaggtggttggatggcatcaccgactcaatggacatgagtttgagcaagctccgggagtcggtgatggtcagggaggcctggtgtcctgcagtccatggggtttcaaacagtcggacacaactgagcgactgaactgaactgaaaaatacataccattttcatatttcaagaaacattaaatacttaagcataaatctaaagaatatacaaaggatatatgtgctgaaaagagtacaaaatgctaatgaaagaattcaaatttggcctaaataaatggcaagcatggggtcacaaagagtcggacaccactgagagactgaactgactgaaatggcaagatataccatgctcatggactggaaaattcagtgtagtaaagatattcatttttccagctagatctatagattcatataatttcaaagttccatcaggattttttctatagatttgggcaagctaactttaaaatttatatggaaaagcaaagaaactaaaatagtcctatggactgactgtgtactcctaaaattcgtatgctgaaaccctaattgtcagtgcgatggtatttggagacggagatttagggaggtaattaggtcatgagagtggagtcctgataatggaattactgcccttacatgaagagacaagagagagcttgcttcctctctttctttcttccatgtgaagaatatatcaagaaggcaatcaactatgaaccaagacgggggctctcaccaggacccagccatgttgattccctaatctcaaacttccaacctccagaactgaaaactaaatgtttgttgtttaagccattcactctatggtattctgttatagcagcccagactaaggaagacaaataaataaatcaattttggaaaatgaagagtaagattggagaagtcatactacccaaattttgttaaagttatagcagtcaagacatggaattagcaaagaaatagacatatacatatcagatgaattagaatagagtccagaaacagccccacagaaacatggcaaactcatttttttaaaacaaaggtgcaaaagccattcagtggggaaaagacagtgttttcagcaaatggtactgcaacaatcatgtaaaacccaaccacactaaaaaaaaacttcacaccatataaaaaaaataactggatcatatatctaaatataaaactacagagctcactttggcaggactaaaattagaacaatatagagaagattagcatgcttgacttagtatgaatagaatactagatttctaattaaaaaatagatatgcaacaagtaccaaagggttactgtagagcaccgggaactatagttgatatctggtaataacgtgtgatggaaaataatttcaaaaataatatatgtgtatttgtataactgaatcacattgctgtgcacctgaaacattgtaagctaactacaatatatataactacaatatatatacaaaatatatctatattttaaaagacaaaaaaaataaaactaccaaacttcaccaaaggcataggtaaaatctttgagatatgaagttaggcaaaacattcttagatatgacaccaaagtataaatgcataaaggaaaaaaattgaaaatcagatttcttccaaactagaaactctgatctgcaaaagacactatcaagagaatgaaaagacaaactattttcaaatcatatatccaacaaaggacttgtatccagaataagcaaagaatgttcaaaactcaacaagaggaaaacaaataacacaatctaaaaatgggcaaaggactgaaataaacacttcattaaagaggatatgtggatgtcaaacaaatatttagcattattagccattgtgtgcctgcatgcatgcatgctaagtcacttcagtcatgtccaaccctttgcagctctatggactgtagcctgccaggctcctctatccatgggattctccaagcgcaaatactagagtgggttgccatgcccttctccaggggatcttcccaacccagggatcaaacctatttcaattgcatctcctgcattctttaccacaggcagattctttaccactagcaccatctgggaagcctgttctttggtggaaggaccccgaataggtgtctccacattttcttggcctcttggtagtaaaatgtctgccaaagccacatcattaatcaatgaatttccactgtaggaagcaggagggcaggatgaacaggaagatcccacccacccaccagcttcacatcaagaagaaagcaggtgtcagacagaatagagagatactttttgtctgccttctcatatcagggagtgaaaatgccagaactatccccaacatgttcccttttcatctcattgggcagaactgatcacttgttcactctaagatcaggacctgggcccacctccccagagatcacaggaactgaaacctgaacaaactgaagatcctactggcaaaggagaaaaggaggggataaactgtcatggttctgcccaaggtcacccagctgataagtgcagaagccagatctcaaacccaaaactgtctggcagccaagccagtgctctcagtctctgtccattgctctttgggatgcaggtgatgttgtgatcagctccctctctaaggcagcatgccaggagggctagtggagattgcactgctaatgacgacgcaagccttagaagagagagcagagcaggatgctcacggtgaaccagagtccgggtcatcctgaacctgcttacctgacgcaggggaaagcatgtctgtgaaatctccatcttcctgtgactctgtctcccttggcctctccccactggcctccatcttcgtctttgaacaggcccttagagactctaaagggaaacagagttgggtaagggagctgtaaaagtctgcctctctgccttgccccctgacccagccactttgggttgctcccttagccctgttcattctgctccctgctggtttccccagggtccctgatatccaaaataactccaaaagtcaccatatgtgactctattgcaagtgtaccctcccttaaagtgagggctgcaaactgtatttcaatgagaaaataaattagcaagtaataaattgtccctcctttctctgtgttcctagtgggccttgaaattagcaagaaccaaatgtcacattaatttcactgtcaggagccagcactaaagggtgacatcatagtgtcccctgggactggaatccactagcctgggtgagaggtaggccagcctcaggccctgaagtggaccagtggggaaaagaaagtggacactcttcgtgaacagatcccatgccaagtcctgttgtgttttgtcctgggctgtcttccaagaggagagagctgggtctctaaaaagttaaaggtattatggttttgggcgccagcataaatagatctgcccacaccggttatgttcccaacatgctgcttgtacctccagccccgtttcaggaggccttgtaggcaaagagcatcttgttgtatctaagtggtggtctctccattcccaaacaatttctgctacagta

SEQ ID NO: 32877 - DNA, 786 bp, Bovine  19866881083170
tgttatccatcatctaggctatttgctgctaaattattccatcctccctggaaaactatggtttccagaaatccctcagcctggtcaccctcccatcttgctttcacctttgacatatgggtttgtcttctctttccagccagatcacagggcctctgacataggggtggttgcctttttctttgcaatctctaggtgcaagccttgggttgggtgcggggggaagctgaatctccttgacgaatggaaggcctcagggggctctggctgctcccagcatggtgccctgctcccagtggaggtttccgggcttggctggctggtctgaggatgaataagtgttttgggggaggcagccctgagctggctagcagtctcagacagcccagctgccatccaggtggttggcctataaatcactaggccttaccctccctgcaactcgataaagctgaggcataaacagcatcttgtgtcagtgatgaagcaactggcacctccctcagctctggatgaagcctcctggagcttgtttaggccctgattctttcttgcacacagctgctgtgctatttgaagaagtcgggacactctcccgcctcataacagatccatggtgcctgtattttaccattagggatttatttgttgagggtgaacagtgcttcctttgtaaggttttgtttgaaaatggtggtgccttgggagaatggtgtcttactcagcctctagaatcttagtgtgaatgtgcttatcagccaccttgctcctgctccacttccatct

SEQ ID NO: 32878 - DNA, 1368 bp, Bovine  19866881242652
ctccaatgtacagatgtgggactggagactcagaggcaggctgtgctttcttcaggaccatgcaggtgtgtggcagatcctggacttgctcttggacatccagatcttgccgagtcccaggttctttgccctctatacttggttgtctccctttttatccacttgcaacctcagggaaagcaccaagttggataaaaagtagagccaaagatgtctgtgtggcttctcccctagtgggagccccgaagctgtggttctgcctggggtgggcttgggaaacagaggagagacaagggcgatagctttctccctgggatccctttacttatttaatccaccaaccaaagagctgttaattcaacaaatattgggaggtttgcattccccaatggaggggagtgtagaccctccagaggaatcagtagatgctagttcttttgttttgggaaagtgtttcaactcttgagctgctgaacaactgctggttttgaggataaccacattctcagctttggagaagggaacagctacccactccagtattctggcctggagaattccatgagttgtggagtccatgggttcgcaaagagcgactgattgagtgacacgattgagcgactttgacttcacttcacattctcagcttggtgagggtgtgataattcaataagcattttaaagatcttcttgctgtgcgaggggaactgtggcagcatctagctctttaggaatattctctgaaacttgggactgtcctggtcaaaccagtgcatgccttcaccattcttccgtccacctgttactttaaccggcattaaccgagcctgctctgtgccaggcgctgtgtcaggctcaggctcagaggatctaaagggaaataaggcttaacctctgcccttcagttgcccacagcctggttgggggagcaggcatgaagtctccagttgcagaagatcagtgtgttttcattgtagctctggccccgtacagcagctaactcctagccaagaggttgggggcaggagccctgcctgggaggggctgctaacccagctggggctgggggtacctgcctggattgcctcctccgcggttgccttttctaatggtgccactgttccagggcacgtttggtgtctgtcaacctggcgtggatgcttttcagtgagttttcatggactctgtcctgcagactccttttgctgctttcgtttgtcatcatggaatattttgcctcagagtgtgctgctcagagcgggagggaaattgaatccttgctgccttgatgactggctttctcaaagtttgtgataatttctgcaggagcatgagctgcatttaatttgctctggttgggtcatctga

SEQ ID NO: 32879 - DNA, 876 bp, Bovine  19866881285507
ccagaatagacttaaacgttatcaaagatattctgatcaaactataccatctctaatgtcatcttgttttttagatgtaatctttgctgctctgttttaagtcccttggaatgcctttcatttcaatttttccctcatgattgaacacagagttgggtggccagtcaaggcctttgattcatcttttctctattgccctaagtttatgagaattttaccttcttactagtatctgctctttcttcaaatcctttcccagttattaaaaaaatataacagcaagttcaagacattatttagatagtttccagctaaacctgaccgtacaaagggtggtgatcttgctgaccctaattgtggaagaggcagcaaccttatgctgtggttcagcagaggctgctagtttccaaagccttgaaggggccgtggatgaccgtcaagtaaggccctgaagactgtgctcctgcccttcaggaggtgtgacttccttgtcaactacctgtattggccctgaacttgtgtctggccaggaggtggcgccctttctctgcccagttggtagcagttggtccttactgtggggagggaaaaagaagagctttgcttgggctgtcgtttcagaggcgctgagacgcagaggcccttgtttccctcttctgaacagacaatagttccccggacgcgggattctggttggggcttcttttctgcagggtcagagccacttctctgtccagggtatggcctgcacctctttccctttagaggtgccactaacacctcttttctttggggttctctcccgttagaatgagcagtcggttctgagagaaggatcagaatagaagactgttgagggtagaatggaaatggaaa

SEQ ID NO: 32880 - DNA, 1288 bp, Bovine  19866881301170
ccactcacgggaaagctccttactggaggcagaaactgcaccagaaatcctctgcaggtccccacagcaaccaagaaagcattccatttggagaaaagaggcacagtgggaaatccaaggctgtttgtctaaccaaaaatacactgttaactaaagccatagtatagctctttttaggggaaaaaaaaaatcagtgacaagtttttaacagttccatgtaaaaagaatgtgccactcacataagtgatttcagtaatcacgtaacccctttatgtttctaacagtagggaggggaaaaaagaacagaaatctatttttttttaaagtttgaataaagaattaaattagtaaataatatctaaatcagagttatttttttatttttctcaaaacttgagttgtttgaaagcactttaattattctataattacatggattaatgtattcccaccccccacgggaaagtctatgttcttgggggtgtcatggaagcaaggccaagatattaataatcacacaagtagcccgatattaagtataaaaaggttagtaatttgagctctctttgccatttccctggtggccacccaggcttctagaggcagaaccacagccttcagggccagacaactgccccgaccactttcccctccgcctcaatcccacccctgggatatataagcctcagttcctcactgcttcccaatcacagagtggtcaatctcggccagcgaagtccctgagagtgaagacagaggggacttcagccacacatggctgggagatgtagtgaggaagaaagaggaactgggttcactgacaggaacctggggaagtttctctcatctcggagcctccaggagctcggtgagagcttctctagactcggcttgaaccgggacagtgcttgagaacaagggcatggagtatctacaggccaataagggcccctggctagtgacactcacagggtcatggctaccagcggggcggggagtggatccagggccacggctccaggaagacacagatatcaacctctgacatccccactatgggcagcaattcactctgaagaaatatgtgtccacatccatccaccctaccgaggtcagtatttaaaaaaaaatgaccaaagagtttttccctaaatttcccccttcttttggcaaatattttattgccagagttccaataaaataggctgtgctgagtatggactgtgggtcctgccccacctgcttcacgtttcaatcatcaaacaatccaacacttgttttttttttt

SEQ ID NO: 32881 - DNA, 1598 bp, Bovine  19866881302259
atgtttaaaaagagttgaggggttgcagagatggatctgaagagattctgcctgcaaaggaactacagactagagattatacagaacaggtatttatttatgtattagccatgccacgtgacataccggatcttagttccccaaccagcgatcaaatccatgccctctgcagtggaagcatagacttaaccactggacaccagagaaataccagaacaaacatttaaacacatgactgtttcagttttaaaaaaagagaaacacatcacaagaaacaaagacataaaatgtgatggaggttcagagcaagagaagatgggaagagtacagatagggagaggaagaacatagaatcatctggaaaggctttttgaaagaatttaagggaacataaattcaagttataaactttatagttcaagtttttctgaaaagggaaaaatagtaaatcttttaggctttgtgggtcatatggtccctgttagaactattcagctcttttgatatagtataaaacagctaagtaagtgtgtgagcatggctgggttccaatgaaactttatagaaagaggtgggccaaatctgtcagatctcccattttaagccatgttgtagccatccacttgcataatcatgaaagaatttatagacgatacaataattctttggttaagctttggtgaatggatagaacttgaataggaacgaaggacaactcagaagtaaaataaacaatttttatgggatgttgcagagagcaagtcttcaagagtttgaaatagaggatttggtatgggagaaatacttgaaatacagctagtttgagtaggagtattttatggaaagggctttagctggtggctcagtggtaaagaatctgccaccaatgcaggagatgtgggtttgatccctgtgttgggaagatcccctggagaaggaaatagcaactcactccagtattctggcctgggaaatcccatggacagaggagcctagtgggctacagtccatggagttgcaaaagagtcagacaggacttagtgactaaacaacaaggccagattttatggagaaccttgataggcaagtaataaagttttgatgtaagacgagaattagggaaccagtgacaggttctgagctggaaattatggcatgcaaatatttttcaaatcagtgagtcagttcaaggattgacatctagggccatgcaagcaagcaaagcagaggtcctgaagactgtctccacagggttaaaaactaaccctttattccccagccaacaatggtcatgatgctacctgcttccacacacaactggagctggtctgcacctcacacagagctgggcccagattcccagaagtttcaaggtgcccatcagggtctggcttggtttccccaaagccttgggtgtttttgccttcctgtcctctaccaaggggactgttcctccatcttttcccctgctgtctgctctgcctcctgcatcccagggccctctcactgctgggaatcgcatgttatcacaaatgagttaccaaaggctccgacaagctgctcgtcgctatccccagcaggagaaaagcagccacgac

SEQ ID NO: 32882 - DNA, 980 bp, Bovine  19866881360420
gcaaagaaaaagaagatgaactaaagagaaaacagagcacctccgttttaacatggcaagtttaaagcatcacaattcccaacatgtcttgttatgtgcagagcatggtgcaaagcgtcaagttcccgggacacaacagggagaagcagaaaaagaactgagactattagaaagatgccagcaatgagttgtcacctggggtgccaaacccacagggaagaagaggtcccaggtcgcacgcctgggataggaccacagacaggtggaagggaaggctgtggagaagggaacttcttccctcactcctgacattttcttccagagaaggaagcttaactagtggaacttctggaactctctctgccccactgctccagtgacttgctgttaactttggaaagagtacttgggcccccttgactccgcccacatcttgtttctcttgggtaactgttctccccaccttcttgcttttactcttttttttttttttaaggagtaggcattttacttatgtatttcagaacaataaagacttttattacacgaactgaggtaggaggcaagagggtttatttttgcttttttatttattctgtttttttgttttttttgagacttgcaggatctcagttccccaaccagggactgggcctgtggcccctgcattgggagtgccaagtcttaaccactggaccgccaggggagtccttgcttttacccttaaagagcaggaggtctgtctccagtcagtgttgggaccgagtaggtaggtctgcttaaattctggggctcggtattagcaaactccgttggctaaagaatggtctctgaccgccaatagaggtactatttcaccttccatacttacttttgttttacaccttgacttatgcaaaactcaggtggaaataagaatgctaacacttgggagccacttgaagcctgtcgggttatccgctgcggcataacaaactccc

SEQ ID NO: 32883 - DNA, 1244 bp, Bovine  19866881382740
accgcaaaccacacaaacgaccttaggacagtgttagccaacgtcctctacggtgaggagggactcagcattaagctttgtgactcccgacatgcccaggtctggcctgggaacactgaggagtatattcagtgttggtgagacttggattgtgcagatgaactggaatctatcgagggctgggtgagacacacgcccacatcggcaacaaagtctaaagtaacgatgtgttagtcgttcagttgtgtccgactctttgcgaccccatggactgtagcccactaggctcctttgtccatgggattctcctggcaagaatactggagagggttgccatgcccttctccaaaataataactatcatttattgaggactaagtatgtgccagaccctgagtcagtcagactcctgacctacagcatctgatttaatcctcacagcaaccccatggagtagggattgttgttaccaccatcacacagatgagaaactgagaggagtgagctgcctaactgataagtgttagcaccagaattccaatctttagagagtcagactccgagtcctgtgcccttaatcaccctacaatctgccttccaacaaataaagctaccatctattgaacacttcaatacatgccaatgacgggctggctatgaatatcatctcataacataggcagttaagatgagtaattcagcaactctttcatctgctgaggactaacttcatacaccatgccaaaatgtttcctaagtgtaaaggaaacaaatgtcactgccttcaggaaggtcatcattcttccaactgacccataagtggatcctgacatgttatcaggatgggttttcctactggcacagtactacagcaagaacacactgaagtatgtaaagagagccatctgaattcacttaaaaagtctaaactatgaaatgctttaaaatacaatccttttcacttttaagattcactttttcacttcttttacattttaagaaaaactaaagctagacctaaggtaacaatgtattgccaagtgaaaaccctgagtagtcaagaaaattttcgttcatgattgctttgactttctgcaaattaaagtgcttctacagcgcctgcagacagtttattcccttaagaagatgagagtccctctgaaatccagcttctgcctgagttatgacaaatcccaaattagtggtccctcagtaggctctatactaatgaccgtacattttat

SEQ ID NO: 32884 - DNA, 1725 bp, Bovine  19866881383076
agagaacgagaaagctctcatttttgtttttaataagggcactaatcccattcaaatgggctatatcttcatgatctaatcacttcccaaaatgcctacctgctgctactgtcacaatggggtgaggggtaggacttcaacatacaactttgggaaggatacaaatatccatcctacggcaagttatccatcacggctgtgaggtttagatagagatgtctagcagtcatggtcctaagtcatcgctaacatccagagccgctgactagtctgatcattgttacctgccccttccttcttccatctgctttataaaaaagaaactctaagctctcatgggtattgtctgcttatcattcagatagttctccaaaacctcacatgcgaaactttacatcgtgaaatgatgtcattatcaaaatctagaattattcttgggctcctagagtagaatgtttaccctcccctgactcttttcaaacaggtgggtagacccaggtggcaagcgaagaaaaaaaatggcttaaaataaattgtaatattttactgtaacatatcatttgctgaaatcaagctttgtccaaactacattaccccaaaagtaagagagtgtccctgtctgatgctaaattctaagccagctgcttcagagctctgtgctgtttccttctccatggtctgaccttaacggccagacatttatcagtgttcttgctgtaaccgaacagcacttattccgtattacatgctgcttaggctgcaccacagagacagccggaaaacgccttagcagcacggctttttgcatttccacggagaagttatgcctgaagcagtcatcttatccagatgtatcttcccccctccagattggatcttatcaccagctcagtcaccctcttatcctactcctgagaagtggagattgggggccagaaaatatggctgagcaggaccctggaagactcacgcacaagcacatctttattctgcagttaaaatttctgagaggttccaacctgagagatcccattattggaaacttcaaagaaataaaacgaacatcatagttccttatgtaggacaatattccaaagttcaaaacgttattccatctggaagacaagatagggcctgtctgtgtcatcgtgtgcatgaatgtgtgtatgtatgtgaatggtcttaacagactggcagcggtgtgatggatgacctctaacctcctatgatcctgtccaccttaatataagcttcttccttcaggtgagatgctgctgaactacaggtaatgcacgcacgtaactccaagtaactcagggctcaatagccttcgtttcagaaattactagtgagcttgccgagagcaaaaggagccccactaccttctgacccaggtgaccacgaggcacgttttacattgtctgtatgagagttctcaaatttcggaaagtttgagatttacagaaagcaacattggtctagaagtgaagattctcatccccaagaaaatgagttctagtgagttctagtgacctatttggatgggaggaatggtgaggattaaatgcttcatatttattgagcacctgcagtgatctatgtccttttcaaaacatagcagaggagacataacttctctttcaatcaggttaatgaggaattgatttttgaagctttttaaaaacacaaagtgcaataccagcgttaaacaccaatcagatgggg

SEQ ID NO: 32885 - DNA, 1398 bp, Bovine  19866882064109
aaaaagtttcttggctcaagcctgctgtcttactgctatgtgaactttgagagctgggatgagggaagaacttattccccctaatcgcttgaattaactgcccttgcttctttatctgtaactggaataagcccatgaagttgttggggaattgtggcatgctgaaagcctggtccttcctccttcctgacatcggtgggactcataggtgtcactcactcacatggcactcggcagtccttggtacagcccaacatcttggctgcttctagggaaatctagtatctttttggttattgggtgtccttagaatcagagggaattagagagtatatgagttaggaatgcatttgtttgtacataactgacagctccatctagagtgttttaaacaaaaagaatgtattttcctcacataacaggaagacttgccacagttgcctgttgatattgtctcagtggtctgacggtgtcagaactgggatctctgtgattttcttagaattttcctcatggttataaaacagctgctgcagctccaggtatcacttcactctcaaggtaggaagagaagggtaagaagagttgcaatatttataaacatccctttttgttaagaaagtaaaagccttcccacatcctctagcagacctccacttgtgactcacaagccagaactgtgtcacatggccataactactgcaaggcaggcagggaaagtatttcgtttttcctggggaagaggaggattgggaataggtgttgggttaggcttcagcacactgtctgccacagaaggcttgcagggaacggtcatgagaaaactcaggacttcctaactgaaaaatttatcacccggttaaaatttattcattcacgtatataataattacacccattgtacaggtgttgaaactgaggcagagtgtttatattcacatgaggagcctgaaataagcctggtgagagagaaatagcttttaaccccaactgtggctcagatttgagaggttccatgtacttccccctaagccccacttttagtgtgttcccttcattgtgtctggaaggcactgaggaaggcggggaacttattctctggtccccaagcagcaagggcctggggccttgctgggggaggcggagcagcctgcccttccttctcggcctgcctcctgccttccctgcccctctctgctggggtctctctgggccttccctcctgttcccagaaggtgtgtgggctgatgtctggcccacgtgcctatctgtagcccttgcccagagcccccagcctcccagcccttcctgacctgtgctctcccactccaggtcccccacatctactgggagctgtccaccaagcgggtgcttctgatggagtttgtggatggcggg

SEQ ID NO: 32886 - DNA, 820 bp, Bovine  19866880363675
ataagaaataatgaacatttttacaatgatgaaaaaataaatccctttcctgtgtccttctaaatttactttgactagctattgaacaggcgtttcatagattcaatacatcacaacatattaagtgcggctcagctcccgccacccgcgctgccctgctgtggaccgtctctttctgtttgcatcttggccgtcctctgtgcatataaactaagtgtctccatttctgctctcagagtgtaccacgccatacaaccgagatttcaagaacaaatatcaacagtggctaagccaaacatatcttgtcaagagagtgccactgcagtgtaaagattgatttgttgagggaggtcttgcatataagtagatgtgaaggcaaagactgaggttaacaagtttccactgtgggagttgatttataacaaaataacaaagggacagttctgcctctgccaattactttccatctcttctcgtatccatcgccacagcagctttattcatcaccagaaatccagtttctccagtgcagatccatgtaaaactctgtggacaaaatgactgccctcagaacttatgctttcgtgtagactaggataatttcataccagtcagtactgtttggaggagctctctgtgcccagatagtgcttggatacacaaaagggataaaagagaaagagaagaggaggaccttacatgggaggtgttcacagacaccagatctacagacaaaagtgtgtcaagagtgaattgcatattctgagtccttttgcggaccacctgaaactatcacaacattgttaatcagctatccccc

SEQ ID NO: 32887 - DNA, 1564 bp, Bovine  19866880511592
ataggtagtataaaaaccagaccaataaattcagagaatatgcccatataaagaaaactctaaatgggaaacacagctaatttctcctaaaagagctaaatttcaattatttagcttccatctgatatctatagaaatagggacttggtaagaatggaaggatttgatgtcatctcagaaaatccattccacctttctcttggtggacatggcctgatattttaacatatcctaagcttctagataaatttcaagagactatctagtgtcagagcaaaatagtggttccttagagtggttcctttttcagagttccttagaaaagtgtctcttctttgactggactgaacctgggccctttccaaggtctaggatgagcaactttgctttttttttgcagttctgtatggctcgatgactctcaatctctgaccctccacccttctgtgctgatcaatgtcttcactccttgaaggtcagagcttctgcagactgcctggattaaggtctccatgtcagagcctgttatctgctgcagagcccctaatgccattagcaagaaaatgaaagaagcttccaaacaaccttcagatcgatgctaacgttgtaacttccaacagctgctgctcagctcctttatttgttaagacctcctcctgtgtggaaccttcttgactcaagtttaattctgtccatttaacaaagatgttttgagcagctgctttgtatccaggcctggacaaagccttgggaaagtgaagcatacaggatggggggtgcggggtggttctttcccacctgataataagtatccaactggaaagaaggaaatcacaaagcatataccagcttgagtatggtcaagatgatttcaataataaaatgtaaatttggaagttagtctgaagaggaatattgatgctggtaaagaaggaagaaagaggcaggactgctgttttttggacgcatggtagaaaattcagcacttttcactgcactcaatttctagctcttttctatcaagacttagctcaggaataacacaaaaactcccatggagcaactctatttatacttgagggtgcttcaatttcttatagtgaaaggaggaggaagaaagtggtataaaaaattctaatagttgtttcctttattttaggaaaacagggtaacggaaatgtggtcctctttcacctagttcatgaagttctaaaatggagtctctcctatattgatataaaaaaatcgataggcagggattttagcatctggcagcctttcttcacactgccaggtggatggttctagaatcgtgtctccctatcttcttgtgggtcagccatgactgatgctttcaaggtcttaacaaccctgagaatacttcttggagaaaatgaaaatacttatctgcccattcaaaattctcagcaatctgggccaggctcttgcttttccaatctcatcttctttccctgttctattcacatcttctattattgacatactcatctccaaaatatcttttgtacatcacatgggctttattgctcaccatttctctatc

SEQ ID NO: 32888 - DNA, 1683 bp, Bovine  19866880518336
gattgggaagaccccttagaggagggcatggcaacccactccttattcttgcctgagaattccatggatagaagagcctggagggcgacagtccatggggtcacagagagttagaaatgactgaagaaactgagcacaatacttgtcacttcaaataaagtgtcagtgaggatttctgcatttctcaattgtttgactgcattattgagcccagggcttcctggtggctcagcggtaaagaatctgcctgcaatgcaggagacacgtttccatccctgggtcaggaagattccctggagaaggaaacagcaatccactccagtattcttgtctgggaaataccatggacagaggagactggtgggctatactccatggggtcacaaaagagttggacacgacttagcgactgaacaaatattgagcctatcctgtatttataattaaaaactactattaaactttatttctttattcaaggatgcacaaataactgtggaaagtatcttagtaactaactctcctgttcttaaatccaaatgcctccttctagagctgcttctgttattgtagcagtccaaatatccatctcatcaagctcttcagtgctcaaatgttatccattctgcagctggaagagctctcattatttttgcatgtagaaaatatgacacctgaagatgaaaagaaaaaaaaaatctcattcagcttttgcagctttataggttttggaacatcgttatcaataactgtaatataaactaagcagatgtttctataactctacaaactttcttatcgttttccagcagacattctgcagggcatgctttttagatacaaaatattaattgataaaggaatctggccaaagaaactcaatgaagcaccatgtcctacagtctttaaatatggatggacaaatatgcagacaaaagaaataaaaactgctataaacacctcacaaagttgcaacagaaaaattggctcaggagagtacaaacattacataatttttaaataaatttttatttgatcatagtttcttaacaatgttgctagtttctgctatacaacaaagtgaaccagttatacataaggctttaatataattttattcaaatctctgatatatttttgcaaaacatgttttgttgcctagtgatggtgataagtcatttgttttttgactagctcagtgaaagaagcatgacagaactcttctagacagtaatagataaatatctgtatgctattccccaaaaaaatgtttacatatatttcctcatgataccattagatgccttttcaaagaactgaagaaaagttaaaaagaaaagtaccctgtattgaagctgatgctttaaagaagaagacagaaaataaaaaatatagcacaggatagtgaggttgaaactacagaattattggctaggatagagtgatatcttttgaacatttcttgttttttaaatctacagaatcgattgctaacagaagtatgaagaagtgaaaagtgtctagagttgtagataacattatacataccctccagaaatccctgaataataagaagccaggttctgaatcagacaatgtatataaactctttttccctcctcagaatgtttacttacaactacagaagaaaataaattggaaatctttactttcaaatggaaa

SEQ ID NO: 32889 - DNA, 703 bp, Bovine  19866880588902
aaaggacggtggttacttttccgtctttctggaaggtagaaacattgtcagaaagtccctcatgtcttcgtccaggggaaggagcattggtacaaggtaaagaacctcttctactggtcacaccaggcatcagggctttcattgattaatatttaattgttttgtttttcctaagagctttgagcaccaccccttacagcacttattgtaatagttcttaaatctaaacatcttcagaatattatctgggtttcaaacattttagtaataaatgacttgctcaagtattattttctgtattaattaaaacactgcaggtgtgatcttcctgtcccagagcagtaagtgaggaagtatatcatgtggaagacagagctgtaactaagatcttcctcaataatgtggctatgtttaatttcatcacctctttttttactaactcctcagtgtgaacaagttttctctcctttatctctctcttcttaaattagaagtaaattctaattaagaattatggttcatttgtgtcctggttagtggaggctttcctagagggtgataagtgacatactccaccctcccttcaatcaaaaggcacatttcccaacctcttaagaagcctgtgcttcttaatcagagtggggtgttatttgcatttgagaagtaaatagcgctccaggacagttcatttcacccagcagag

SEQ ID NO: 32890 - DNA, 2011 bp, Bovine  19866880590998
gggttgtgtctttcagcaccccaggtcctaagcggtcttcctgtttggataacctcaagtgacaaagtgctggtcctcgtatatcacagtctttcccagcaaggattaggtcacactgggccaaggttttactaatgagatcatgcataatcaataagggtcggctgacatcttgtcagctccatcactgtcacccaggtctggggtaaagcaacgaggaggggagacctggcggctacctggactctgaacagatgggcggcattggatggagccactgcccctgagaacaggtccaagtcttgttagcagaggacacaggtcattcgctcatttgtttgctcatcctttccttcgtccattccacagagagtaatttgtcaggtcccatcggtactattcccaccatagaggatgacacagaaaagggtcccatattttgaaacttcccctaaagcacctcattctacaagggatgacacagaggacaaagagcaggaaagaggaaggaagggaaaaagaagcaaagagaaaagagaaggaagagacgggacgaggcatggaataatattaatttataggcagagaattaacataggacaacacgcaatagaaaggcccagagcttcagtttgagcagtcagaagtgaacagggctgtctccttacccaggcacgtgctgtttaagggactcttgtcaggtctagtccgagcttttgtgattatgaacaaaaggttgaagtccatcttgctcatgttaatggcttaagtttatttatttctcattagaatcataaaacttgtaatggacaataataccatttctgaatacaaaatttaactctgattctcattaactatataaaattctcaaactattttattgggttgtggaagtgttatattcatgaagacaaatgtatgtgtgtatacacacacacacacatatataactgatgtttacattcagttataaaatatatatatatatataggagaaggcaatggcacccctctccagtactcttgcctggaggagcctggtaggctgcagtccatggggtctctaagagtcagacacgactgagcgacttcactttcacttttcactttcctgcattggagaaggaaatggcaacccactccagtgttcttgcctggagaatcccagggatgggggagcctggtggctgccgtctatgaggtcgcacagagtcagacacgactgaagtgacttagcagcagcagtagcagcatatatatatatatatatatatatatatatatatatatatatagctaaagtatcaaggaactaagcactttacaattttaatatgagagatcttttttaattaaatgagagaagttagcagctattaataatgactaagacaattggcaaattaggttttcaatcagtgtctctgtctctcaaaccatatttcctaattaaagaatttaggagagttctcaccattggctgcaagaaataccatgttcttttttttctcttagggaaagaagaaacttctttacactaaaactttttatcccctcttgtatcatgtttttcttttttctttttaccctgaccttgtcatttgatataaacctagtctatttctctccgaagaaactatactttgaatcttatctaaggctattaaagacttttattagagtgagcagttcctacatacaagttttaggaattttatttcacaaaataaaaaataaacagttaaataagtaatgtcacatccctgcttgattttttgttactatgctttcacttctgtgaatcttctagatgagtattgtcatagttgactattaatctgctagaaatataataaggattagaactttttgctgccatcttccaggtggtctcctctagaaggtaacgttgacacttgtaactgctgtgagactcaaacctgtgaaaaatcacacctctccccgaagcggctcaaagccactgggaggaagctacgggtcaaggcag

SEQ ID NO: 32891 - DNA, 3234 bp, Bovine  19866880620684
cacacacacacacacacatatatatatataaagatagtgataagtcgtgtccaactcttgcgatcccatggactgtagcctgccaggctcctctgtccatgggattctccaggcaagaatactggagtgggttgccatttccttcttcaggggaacttccctaccaaaaaattgaacccaggtctcccacatcacaggcagaggctttactgactgagctacacaagaagcccagacaaggccctaatatatattttagaggtctgtatctgtggtttcccctagagaaggaaacagcaatccactccaggtattcttgcctggagaacttcatggacagaggagtctgatgggctatggacatgactgagtgactaacacctaactaattgtggttagatccaggaacacacagcaatactgctgcaaagcaaaagggccctctcccaacttggagcatcaagatgaaaagagaattcaaagagtgcttagatacttgaactgagatatggctgacactccagaatgatagtgcaaggaagaagttctagaatattctagtccagtcctcttgattgcaagagggagagaatcaaagttcatgaagtacacgtgtctctgtcaattctggtttcctcggtgtgtatgaccagcagtgggattactggggcgtatggcaggtctatttccagttttttaaggaatctccacactgttctccatagtggctgtactagttcgcattcccaccaacagtgtaagagggttctctttcctccacaccctctccagcatttattgtttgtagatttttgatagtagtcactctgactggtgtgaggtagtacctcattgtggttttgatttgcatttatctgataatgagtgtaccacaatgttcatcgcagcactgtttgcaatagccaggacatggaagcaacctagatgtccatcggcagacgaatggataagaaagctgtggtacatatacacaatggaatattactcagccattaaaaagaatgcatttgaatcagttctaatgaggtagatgaaaccggagcctattatacagagtgaagtaagtcagaaagaaaaacaccaatacagtatactaatacatatatatagaatttagaaagatgataacaatgaccttatatgcaagacagcaaaagagacacagctgtaaagaacagacttttggactctggaagaaggcgaggatgggataatttgagagaatagcattgaaacatgtatattatcatatgtgaaatggatccgccagtccaggtttgatgcatgagacagggtgctcagggctgatgcactgggatgaccctgagggatgggatggggagggaggagggagggggcttcaggatggggggcaccatggtaccccgtggcagattcatgtcaatgtatggcaaaaccaatacaatattgtaaagtaattagcctccaattaaaataaattaagtaattaagaaaaaaaaaaaaacaaagttcatggaacaccagggcccaatgtcacatagatagttggtgtcagaggagagatcagggccttggttgccagtgcaagatattaaattgcataaaatgccttgcactcaggagttactcctagtaacttcagttctgaatttgttaacttctcttttctgcatgcagaacttaaaaagaagtggaaatattagtactagaccctaagaacattagttagaaagctggttcttttacatactggtatcatttaggcaaagtacagatttggggcctcagtgtattcattccaagttgaaaaattagtttggtaggccttccatagatctaacactcataatttgaagcattttcattttaaaattaaaaatgatctgcctgcctaataaaagagggatgagaacacaaaaggggggggaaaatgctacaatatcataagtctttgtcacttggtagctttgaaataagtttgctattgttaaatttgctggtgccatcttagcaaggcaaacagaaatataatgtttgttaattgaactatagaagtaataattaactttgatgtagaatgcaaagtcctcagtagtgaactctggttgtataagtggaagcagttatcagaggccaaatcagattagaaaggaaccattccagttacacctgggtggtgttgagagtacaccagtcactgagtgccttttacacatgtaacgatattttcctcagatgctgcaggaaaacgggacgaacgtgagaactcattgctgtgagtaaccagtgtctgggcagaaagctgctgctgccactgctatgtcacttcagtcatgtctgaaagctagaatctcttaatcagcaccctggcctggggagaggggtggtaggtggagtaaaatgttgagatgctatccgagagatgctcttaccacattcacaaggtgagatgctcttattcctgtagtacttgattgagtagatcaaactttcctctaagaagctattttgcccctaaaatttgtaccagcaaccctatttggggagatgaaatctaccttcagaattcagggtgctggggatggagtatacacagttcccacaggctggctcggcacaaaggacagtgaggtacctctcagaccagcaaggtcacctagggggaatggacactgcctcaccacctctgatgcctgcaggacaggtgggacatcaggtactatgctttttctccagtcctgagaagtgttaagattgagctatggaacaacaggccaatcgtgcctccagagaaatagtggctgggatctctccatactgtctgctctggctcatgcctacggtatgcttactatccctgtctcccacctctacaatgagcatctcctggatatcatctaagatgtgtttacttgttctgtttgtttgtttgcttttctcttgattcccctgattcatgcctaacaagtgatcaggttgaaaaaggatgctcagtagatgattgctgattggggagctgattggggacttgattgactcatttggaataacttgtccaaatctagcttaccacagattctcacagaaacttaagagagaagctgttttattatctagccaaagatatgtgtgaattttgttagggatctttttcagaatattttcaatgagtattttattatacaacaaattttctttggagaccccccttcctcctacttacagctctca

SEQ ID NO: 32892 - DNA, 1989 bp, Bovine  19866880637000
acttttgacctataagccttttcccagtaatctgttcacagagggtcttccctgcccactccatctaaactagatggcatctgcccatgtacacaatccctttcctgattattgttttttcttagaattctaaatatttagaatatctctaaaacatgctatattttacttatcttgttcatttttacttatcttgaattttcccttagaatgcatcacagtaggaatttttgtgttttattattctttcttcagtatccaaagcagcgcctggcacacattgtgcactcagtcatcatttgtaaggtgaataaaaaacctatggtgctcatgtgtaacccaatgtttattactcccaatagaatacactgttgttgttcagtcactaaatcatctccagctctttgcgatcatatggactgcagcaggctagtcttccctgtccatcattccctggagtttgttcaaactcacctttactgagttgatgatatcatctaattatctcattttctgtcacccccttctcctcctgccttcaatctttactagcaccagggtcttttccaattggtaggctctttgcatcaggtcaccaaagtattagagcttcatcttcagcatcaatccttccaatgaatattcacaggtatttcctttaggattgactggtttgatctccatactgtccaagggactctcaagagtcttcttcagcactgcatttcaaagccatcaattctttggcccttggccttctttatggtccaactgtcacatttgtacatgactattgaaataccatagctttgagtatgcagagctttgttggcaaagtgatacctctgctttgtaatatgctgtctaggtttgtcatatcttttcttccaaggagcaagtatctttttattttgtggctgcagtcactgtctgcggtaattttggagtccaagaaaataaaatttatcagtgtttccactttttccccatctattttctatgaagtgatgggaccgaatgccatgatcttcatttttttgaatcgagttttaaaccagcttttcgctctcctctttcactctcaacaatactggccatctattagagcaaatgtggtgaagtgttaagctagagtaagaatactcactgactacatgatgtagtctcagatttttcacttaattctttgggtcatcatcatcttccctttcaaagtgatggtgctatattaacctgggatgttaaaaaatgcataaatgagtgctttgtatacatagaggcacaagaaaattgcaagagggtgagtttctagaccttcttcctctacatttacctccctttatttctttgtttattttaatatattggccttccataacatatttcatattttatttacctcagataattattttaaaaagcataaatggaagatccactcagatcattaacaaaaaactctatcgttgtatctgggaacagtatttgtactattactatgaaagatctaaagatcacatctttgacccacctctttataattatataattagacccctttgtgttggatgagattaaaataggatctaggtaacacggtgactttgttcattgttttaagatagaatcacatgagatcatccagatatagcacttaacatcatgatcagcacataacagtttgcctttatctttgtaacttattttagggttcttagtataacaatgaagtctaaatgttgttcttcaaatcgtccatttaattagatgttatgaagagacaaagaaaattatgtttggtatcttccaaaatataagcagaaatgagttttataaaaagacacaattggttgcaaacttcctctttacttgggtcccacactttcctcctgcctctctagtcactaccaagtatatctcttcaccaggctcacatatgtgacaagataaaaaggtctgtgcgggaaaaatataggggtaataaatcaa

SEQ ID NO: 32893 - DNA, 1827 bp, Bovine  19866880653492
atttaaatagaacactagaagattctgtggacatgtttatatgtgtaaatctgacatgtagacaagagataaaactatgccatcaaaagtccatgtgaaaaatagatgctaggagaggaaatgtcaaagagataagataaagttctaaaaaggaaacattttacagttagaactttccaaggaggaaaagtagaatcttcagaggtattgagtcagctcagtggaggggaaaaaaattaggattttctagtatgagatgtgtgattggcaggaataacctttagggttcctgtcaaacctgaaatttgatgactttatgcctacaaaattaccataaaacttccccctccactttttattcattctgccctctgttccccttgtcactgtttcttttatattttgttttcagtaagccttctgagaaacccgtttagattcatttattctagacattcaaatttaagatttgacctctcagtcagtggttaccagacaatagtagcaataaactatttcatttctgatttgatttcatcttgcatttcccaagatacacccaaggaactttgttttcattgactcactcccttatttaaaaatacacatgcttattatgtgtctaggatgaagaaagcattataggatcaggagaaacttggagaaataatgtcatgtttcctgcctccaatccaaatatctattgccaaattatccaaatgatgagtttctgattgtttcctgaacaaaattctacagtttcccctaaatatcattcctaaatataacatgattccttataaattcatttaaatttgaagctctataagctgaaactccagtactttggccacctcatgagaagagtttactaattggaaaagactctgatgctgggagggattgggggcaggaggagaaggggacaacagaggatgagatggctggatggcatcactgactctatggacatgagcttgagtgaactcctggagttggtgatggacagggaggcctgatgtgctgtgattcatggggtcgcaaagagtcagacacgactgagcgactgaactgaactgatgatcagcttggaacaatctcatacagagtttgtctttcattaattctcatataaatatatattaatttctaaaaaatatacagttcctcatgtacaattagaattttcaatatgtcacaggagtggatatcagaaaattacttatattctgttttagtcacaattaggtgtgactgtgcatcacacatacagaagtacacgcatactgtggtctgtaagtctgaatgtgaatcaggacaggttcagtggcttactggggacataagctgcttttcaatggtgactctgctacaacatctagcttccacccactttttggtctcagagagtagttccagattcatccttcatctctacccctcagccatcagaactaaagatagggaaggagagagaatgtcccctaacttgaagacaactgcctggaagtgacagacatcacctcctcctatttccctttttgcgacccagtcatatggtccaaggtggcaataagtggggctaagaaaaaccatggtatctatatagctacctacccaactatgaatcagggcatttattattgaggaagaaagggagaattgggaataactaacagtgtcttccactcttttcagtatttgaatttagccctaaacagctgtgtattgttctctctagagttaatatttgaatttggctctgtatccaaaataataataatgtgaaatgtattaaaatatatacataacatgtaaaatatatta

SEQ ID NO: 32894 - DNA, 1921 bp, Bovine  19866880714493
ctaggaggattttagttattgtatagaaaaataagaacagcggccaaatcagtaaactttctcaccttttgggaagaaattagaggattgtagagaacaaaaaataaaatcagcaacagtcaaataaacggacatctagaacaaaagcaagacatgggtcaacaattcctcttaattatatataaatttttcactttctgggaatgactgaaaagttctaagaatcatgatctccatgagtcaggctatggcccacaagtgtggaaaaataccaaaatgagaaggcaaagataattaatggcaatggattactctatcctctcatctccaccttgatatctgatagttcacaatgtataacaactagagattcctggtgaatgtctgtaataccctacataatctcacagtttgtaacactggatcagtaagggctggagaccaaagagaatgctgggaatgcactggttgttattttcagaagggacttgtttggcaaactgaaggaaatattgagtgtctgttactgaaagagtaaatatagtcgtggattgttcgtgaaagttggggcatatcagttgcagtgatactaaggtaaatagagaagtggaacccgaatgaacaaaggcagccatgttgttgggtaagggtgggtttatcaaatattgacaaacatgaaatgattgtaatcagtcactgtcaaaggagaacaggtcccctcctctcttttacaaatgatccaattaaaggaaacatgttggctataaaagtcaaaatcaacaatgcactatactctgacaacccatccaacatataaaatcaatagtgcattctgctgccatgcagcacaaagcgacagcagcaacttccccacctctttagtcaaatatgacactgtatcaatcgatcaaaactcagtacttattgagcaaggcttctgaagaatgcatactgcattgtacttctatatccaccccctgctcattttattttgataaattttaacttaaaggcataataccttagaatgttctgttgacacatggagtgtttatttgtataatcaccatacaatttggcattgactacgtttacaacatgattataaagcactgtagggctagaaatgcaaatgccattaaatcaagaactgtaattttggttctgtctccacaccattgctttgtccaagtcccccattcagagtgacaaacaagacatagatggttccaattagtcatcaggcttgcactagaactaaaaacaatctgaaagggaaacaagggggtgctggatatggaacaaagtgtgagtttgacaggataaaaaaatccataactaaatatttgttgtcatgtgaaaagggcagcagagaggaatcagattctgactctgtgtgcccttgaacaaatcatttttctactctggatcttgagcttctataaaactaaggaatgggtttaatggactaaagtaactatacaatgactaaagttttaatagtcgaatataatgctgtttaaatagtctcttcccaagatccgtagtcagaataaattttctattatgacagactgaattacattttataaacagtatttaccagaactacgtgcaatgctcgctgatgttttctagtctatcagttttcattttctttataaatgctgatcatgactgccaatggatcacaacccacagcttgaaaatcattgttttatggccctttgctttttcttttccctgctgctcatgggccttctttcctcctttctccctttcatttaagcatctcaactgtaagttccaagctctgatcccttgtatttagctgaatttatattttctccaaatattctatatttctccatcccatagggctcgcacaatacaaggaacctcaactggttctcaacaaatt

SEQ ID NO: 32895 - DNA, 4017 bp, Bovine  19866880867539
cacaactcttgatagagaatcatttctttttcctacctagagctagcactggtaacatcctagctctgcacataaaatctcagaggccagccttcttgctccccaggactgtgcagcctgccctctccctttgtcctgtgaaggactgatgttccacaagttgagcccactttggattacagcctgtaataaagagaggatgttcggcctcctccttagaactcaacttacttttcaggcaggaactgaccagggtttttcaggagttttgaaaagagaaatacgcaatgctgtgcagcaagtgctctaggtccctttgctccccatatagaggtcacaaactacctattttaagaaaacaagcaaacaataaacaaacaacaaaacaaacacaaaaaccaattttaaaaaacagttctgtaactcccagggctacaactagggctgaggaagaccgctggcagcccttctatcattcctcagctgaaagcaatcttcctggtaatctgtggacatgggtagagcctgatccatcttccatcccctcaaaaatgttgcttgtccactgaggttcttttagatactttcttgatttagatcttgtcccgtgacttctcttttttcccactttcctcatctgtgtttcctgttgtccctgtcactgatgacatcttttcaccatcaagtccctcgctccatgaagtccttgtctttccccttgggtacatatctcccccaaaacactagatgttctttgaggagaacaattaggcccttcatattctggttttctttcaaaggacatagctctcaaaagctatttgttgatttttttcttgataagttgatatgccctagaagttttatactccatataatcaaagctatggtttttccaatagtcatgtatggatgtgagaggtggaccataaagaaggctgaacatcaaagaactgatgtttttgagttctggtgctggagaagactcttgagagtcctttggacagcaaggagatcaaacggccaatcctacaggaaatcaaccctgaatattcattgtcaggactgctgatgaagttgaagctctgatattttggccacctgatgtgaaaagccagctcattgtaaaagactctgatactgggaaagattgagggcaggaggagaaaggggtgacagaggatgagatggatggctagtaccaccaactcaatgaacatgagtctgagcaaactctgggagatactgaaggacagggaagcctggtgtgctgcagtccatggagtcacagggagttggatacagtttagtgaataaacaacagcaaacaacaacaaaaagtttgatagccaggaagaatgaatacagatcactcatttatcaattttttgagtgtctactatctgtgcgaaattttaataaatgataccttatttcttcaaagttttatttaggaacaaagataaagtaaacaaaaaatgagccatagagagaagatggaagtttctgctaagagagggagtttgagtttttaccattgctgtttagaaccccaggcttacaagttctctctctatttttatttctgttcatgtgtggggaaagccagagggatatttctgggtttgttgaggaaaagatggaggtgttggagacattaaaataagtttttctggcctctacttccaaggttgtactgaagaccagaaagatatatggatacagagcctccggctaaaaaactgttttgcagagttcattttaggaaaataaagcttgcctctgttcacagacaagtcagaagattactgagtgggggtagaagtggagagaagtagtattagcagatagaactttttgtggcagaactctgtacttccttgtcttatgtaatccttatccactcacccagggctgtcattcctgcctccgtgccctcaagaacaaacgcagccagtatagtgacattttaataataatactttgtacttatacagcacctgtcagccagtgatctcaaagtacttcccctgagattaactcattaatcctcacaaggataagtgactttcccaaggtcacagaaaagtgaacatcagggatgggtgggagcctcaagttccctgctcacatcaaaactcagaggctgtccacttgcctgcctgtctgccacaaaactgcctctcacatagcccacactcgcaaagccaccgtgcctttgtaactgcatgcttgggttttccatggaaattgttttgttcaatcaatctagtaataatcaaaccagctctgtttagaaagtcccccatccatagctggaaatgtaaacattcttggaagggggcagagatgattagaatgtactaccctgtagaatgtgtcacctcgtgttttagatttgggggttagctgcacacattttgctcatcccagcagagtgaagtatgtgggggaaggcatatttaactcaatctgcttagcaaactgcttcatgagcaggctgactaagagcaagattcagccctcaaatgtggctagatcctctctttcccatggaagtaaataatatccagtttcaggggtttaagctggcacagaaaggatgcccagggcaacaagaacacaaaaacacaagacacaggggccttggacagctgttgatctttgagcactgggacagccctggaaagagtctttttctagaaggtgcagtccaggccctccagctggggtttgtagtgggatctcactcctacacaatgtctggattaccacacaggtgcccaggaccagagtcatatatatcagccttgactgaagctcatttttgctagaattgggggatgttgaatttgaagttccaacaaattgtgaacgtggaggaaaggaattgggagcatatggtttaatccatgtttcgccagtttggagtcatggtcacagaaagcttacctgaaaatactaaggacatccctggaaaatgttactggggaaagtggtgcataaacagaggttcaaagtgtcttcagtattttctgaatcacttgggactggctcaagaatcagtgcaggaaaatgcctctaggtgagcagggagaaaagacagaggtagggaacagtctctatcaaccttgttcgatgtacagactctatctatgtgcttgacaaggtaattaagacaaataagtgagtgccaagtatcttataaatacactaaaagattttagaagagataaaagttaaccagagttagtgttatcaaaacaatttcatggtgtgactaaaatttacacaaggcccttgagacaggttggctggaattgaggggttatggaagagtaaaatcatcataataattgctatgtattaagcccctactttggagggaatgatgctaaagctgaaactccagtactttggccacctcatgcaaagagttgactcattggaaaagactctgatgctgggagggattgggggcaaaaggagaaggggacaacagaggatgagatggctggatggcatcactgactcgatggacgtgagtctcagcgaactccaggagttggtgatggacagggaggcttggcgtgctgcgattcatggggtcgcaaagagttggacacgactgagcgactgatctgatctgatctctgatgtacatattgcttatatcatctactaaactctaaaaatggtgtaataccctgatagaacttggtggaacatggtcaggtgatgagggcaaaaatctttaagagagtgtttatccctgctgatattcagctaacatatttcactgacataggacatttactcccttaagaaaggtgttgcttgggctccttcaaagccattgttgttcattcgttaaatcatatccaactctttgagaccccatgaactgcagctcaccaggccccttctgtcttccactatctcctgggaggttgctcaaactcatgtccattgaatcgggtggtactatccaaacatctcatcctctgttgctctatt

SEQ ID NO: 32896 - DNA, 1854 bp, Bovine  19866880915224
tgactctgtatacaggattctcctgtcctctgaatcaaatttcctcacagtgactggtgactcccatttgtatttggaagctctaatgaacctgaaatgaaatttgtagcttcaaagctcctataaatgtaaaatatgactatcaaacggtctttgagaggaagaggatatttcctgctctcctgccccctgggagaatattactgactatcatgtctctttcatttcttctttaatggaaaacctccctgaaggacaccttgggctctgctattgtcttcatttccatagctgtcttgagctaagctttaccctaggaaactcctattgtgaggctacctttctgcaggttcctcttcccagctctctcttctctctccccttttctcacctctcttttgtctcttcctgtcctagacagcgtctgtccatttcaccctctttctcttgtattattacaatttaagtatcatgaagtggaagtcagattgctgagctttcggagacagatgagaccaagcagtccgccgggagcactcggcaccagcgtgcgcagtagcccagcatatggagttgaatctccagatactgacattaacactcctgcttcaggtaactcatttagctttggtgtcattttacaataaatataccatccaccgacacaaattagacagctattgagattaattttgaggcactatcggcaacatcttaaatcaaaaatcattctttattagcatgcttggcagtatagtgtgcctgccctcccccctcctgatccctgccacagaataaatgaggccccatggttgacatagcgcatcaagtgttttataatagtctaattgtagctaatggtttgtgcagctaattaaggccctatgaattactgtaatcagtcaggctcatcctttaaaccagatagttctattcaaccgtccctttagtaagaaacaatatgtatatgcacacacacacatacacacacacacacacacacacacacatatatatatatatatgtataaggacatatacacactcacacaggctgtaatgatcagccaggttcatctgagcacaaagagattaataagacttttctctcttcattacaaaatattgatttaaagaaggacacatttccagcagcagctccagtccctgtagatggggccaaggtagagtcttctgtatgtcttctacctgaaaactgaaacatgagttaatgcctagtacagcagctctctgactcttctcataatccatccaggttgcagcccagagttaccttttggggcatttgttaagttgtgggaaaccagacacttcagagaaatggtgacaaagaagccacctgaacagcacagttgaaaattcagaagggaccaaactccatttgtgaaccagctggttgacaacactatcaacatgattaagcttctttgatagcagttaccaaggatttagaggaagaagttactgaacaattctagaagagctttcctctgttaaagaattgtaagaggaatgggataattttttttgcagtgggtttgctttgatgagcatattctaaacagaagatctgtcagagtacagaagagttttccaaaggcctgaagcatatataatttcttggtttatttgaaacttgactggacatagcaaaaaataactttggaagcaattctataaggccttggggaaacagagaaaaggagcagtaggccttctctagtaattgtatctgactctttgagagggagaaaacatcctatagaaatgtcatccatatgacctctgttggaaaacatgcaatctggtccccccagggtcccattgtcaatg

SEQ ID NO: 32897 - DNA, 1735 bp, Bovine  19866881014842
aatatgtcatttgttcttgaatttgtttttaaacattgccagtctgaagtggctatttggatttgtcaaactttttcccttataacttctgcagaaaatgtacaagtagagataatcctagtaacttattaaaatacacattttgagaaacaattacaaaaactgtttttttctttcacaattatttgaagtctacaagaacgtatttttattcactaaaaattgaaaatagtttgtaactgaaagcttgcttgactctagcaatagatcgtttattttactgactgggaggtggggtagaaagagagatatcatttagtgactgacttgaatacaaaaattaggctacaggatgaaggcatttaaggcgtttggtgtcttcctcccctcagggttaactgtgcatagcgctgcatccctgcaggcaactgattttgtcacaaaatcctaccttagtaggaattcaattatggcttgcaaagtttatgtgaaaaaaaaaaaaatgaacgcagcaaagttatttcatagtctcaattcagataaatgtaaacgtagtagggagtgcaatgaccttacacccaggaagtgtgcatttcaacatctgtatctgtgaatctcaatctcatagggccacgaggagttgggacccaatttctcctccaattctaaattgttgaaatttgttcttattcagttttaggcctggactattaagtaaataggtcaatactccccttgtttttaatctctatatgaataagctgttttcccttcctgagcctttccaatcccaaggccttaaggcttagccagaaggacccgaatatatcaacagtcaagagcaggaagctcactagcaaagaaagtctaaaacacttgttctcatctgtgtacaaaaaaaaaaaaaaaaaaattgcagtgctccctgaaggccaactgtacttgactttgcagtaaagagctatatgcaactaaaatactcttagcaagcattttggggcagctacgatttttgttgtgctaaatttatggaatttaaataattataatgaattgatttctaagataattacacttataatacaattttcagagagtaaagactacatagtaaatttgtaatattttatccattacaaaatttaaggaaatgaaaagcaaaacaaaaatacaaggaatcaaaaaaagtcttatttatttaattgttaatttacttactttactggtgcttgggagttctttggctggggtgggtgtatcatacccttagaaacaatttttttttaagtacatagatttttttcctctcaatacaaacatttctagtatgaactaaagaaatgtttgctaactaaatattatacattgtgcttctattttaaatcccatattgtacctattttgtcataaattgatttctttataggttaagtctcaattcttctttgaataaaatgtaaaattcaagaaaggacacccataagctcctcttttgaactttacagttgttgcaggcaggtgaactgcgggctcacaaatattagttggaactcaggtcagtggcctttattgtaagggaaaagaaatcaacttagaacattctagatggaaactttgcccttttgctgttgcctttcctcttagaaaacaagttaaaagataccattggccaggttaattgacttacaagtgtgtctttttaataagtgtcataaagtatgtcaggctgctgaaa

SEQ ID NO: 32898 - DNA, 1067 bp, Bovine  19866881033407
taccttgtcttctttggagacagagcattgttacaactaaaatctgaggaattgttgatacgctccaccatgtcaccagtgaaagcctaaccctagaggtcacagagcttggagagggaaggtccgggtggatggagagatgcaggaagggagtgttaagagggagaggtgcacattaggaatagaaaggacattctggggagctatatttcttacagtctaattgctcgatgttttatagaacctgatcattaggggatcttgggcatgattccacagagatgttcttgtgaaataaagcaagaggctattaaacagaaagtttaaatatagctacagggagacatccttcccgacaacttgacagatgtcttggaatgacgactccttccttcatcgctaattacaaaatcatttgtcttaaggagaggacaaaagagaagtaattatgaaaaacatgattcttaagggataaaaagataacatcagtttaaaacacggaagcaatcataaccacttagaatcattattagtttggtggaaccaatgacaggttgctttttagaaaccagagggaatggggctcctgaagcagagggaagaaaacattcagtttcttgttatgctaaacttatccccagactcccgagacttctttgatgaacagttcattaaaatttccgaccgcagatgaatttgagctaaaatacacaaatgttttaattatacattcctttttaattacactaatgacttgtaatgtgtttatgttggtttagagtttaatttcttcccttagattaggtggttgacttaaggactgtgcttttcagtaaaatagcatgattcatcaatgtttgattatgaattaatgcccaaatgcagaaaagctgctgccagtggagggatggccctgcccatgaacaactgcctttcctctggggctctggggcagagcatatctcgccattttgcaggcataagtgttggggagttctgagaaaaaagttctgaatagtttccagattgggaagatgctaaggagggtgataggagagtggataaat

SEQ ID NO: 32899 - DNA, 1003 bp, Bovine  19866881060493
aaaaattctgctttcccccatattacttgttttttgattatgaatagatatttatagagcattgggtacatccttaactctcactattttaaggtaaatgctatgatcattctcattttaccaatgaggaactgaggcccagaggagttaaatttatctgtgatcacacagctagtaagtggtagaattgttatccaaacctaaatgccttggctctaacgtctgtgcttttgaccactgtgtctttcccaaaggcaaaaattagggtcttctggataattatcacaaattctgaacaggttttttgttgttgttgttaattttcacctgttcagggagtgtctaatttaggggttaagcagaacccctgttaattgttttaaatacccacagctttccctctccttaatgacttgctcctaagtgagctctttctcatgacttggacttagatacacagctgtgctagacacagggttgcggatctctgtgcatcagagatcttgggtatatttcaaagactggaaaatgttcagtctgtcatacctgaattaatccctcagttctctgtacccatgggaaaagccccagactgattgctgttttgtatttccagctgttttatgtagtcaggctattccccagctccaaatctctagtgggtctttactttcagctgcactgagtctaaactcctttgacaagatgtcaagacctttcattatctcactattccccacacagcccatctgcttggtatgggtcagcatacgtacttccacttctaacttccacatccaggagctccatccatctttttattattattatttctttgttttataggagtgtagttgctttataatgttctatcagttctattatacagcaaagtgaatcagtcacacatacacatatacccccctcttccttggatatccttgccatttaggtcaccacagagcattgagtaaaatccctatgctatacagtccattctcat

SEQ ID NO: 32900 - DNA, 852 bp, Bovine  19866881089622
atctgaattcctagaggacacgaaaaagcagcactgggacttcattataagttggtcctcttgtaagttgctgcagcatggaaatgggaaaaccttctacaaaactgacatggagttcatttcatagcatgttatccagattggaaacacactccaacttgatttgttcatataaccagtctgtctgtgactgagcataaagtggaagacgtatatcctgagttatctcaatgtcaatgttatttcctataaactttgtaaactatgatatgtcctatcaatttaattatgataatgcactctcaagagtcccatttagccactggagggacagaaaccatttaccaggtgatgtgtccaaatatcaaattcaaagaaattaactggttaaattatttccatcatttaagccttcttgaatataaaagttgagtaagggaaacaatactaaggtttagaaatttaaatcacaatttagacctgactgaacatctggaaatggcaacccactccagtattcttacctggagagtcccatggacagaggagccgggtaggctacagtccatggggtcgtaagagttggacgtggcttagtgactaaaccagaccagaccagaaacatctggaatgagccagactttatcaaatgggctcagatttagcacattgattttttgaaggaattcctttaaaaaaaaaaaaaaagacttttgctgcatttgaaagaaaatttctataacactgtaccacttactgctctgcaagatggcttacttctcttacacatcttaaatattctagcagattattaactccttgatagcagggcactaggaagtaaagaaccaa

SEQ ID NO: 32901 - DNA, 2889 bp, Bovine  19866881239680
tcttatgattttaccatcacaatatctcaagtagcaagagagccagaaaaggtgaaacaggaaggatgacagtagtcatcttgaggtccctaagctgatgggcatttcataaggccaggatatgcctcttaaggggaagattcaagccatatcaaccacccagctatccagggctgaatcacagcaacagtaaaacactaaagataaagctgttaatgctttcctaattgtttcctatgatgtaccaggacagtgtttgatactaaatgtttctgcatttgtatttccagttttgaccttgtgttataggatttaagggcttccttggtggcttagatggtaaagaatctgcctgcaatgcaggacactctagatggatccctgggttgggaagatgccctggagaaggccattgcaatccattccagtattcttgcctggagatttccatgcccggaggaacctggcgagctacagtcccatggggtcgcaaagagtcggacatgactgagagactaacactttcgatacaagatttaaagattcttttgatggtgagaaacaaaacaaaaacacttgaataggcaaaattctttgttacttacagatctaaatgagagaaggccaccatgcaggaccacccagagggttgtgtcttgggacagggtaactgcaagctagaactgtaaaaggaggtgtatttatggtaaatactgtggggttagttagtttcactggattcctcaagtctgggtgttttgagtaattctgcgggtccaagaatgaggggactgtcccaggatattacgtgtctggggacctcttgaatttgggtatgtatatagtgtaatccagatgtatttgaacttaataagagaagaaaacaaggggcaggatagaactgagaatttttggccatgacttcaaaactggataaagatagcacttaggaaatacactattgatctctcccttcaatactccagtactcttgcctggagaatgccatggagaggagcctggtaggctgcagtccatggggtcgcgaagagtcggatacgactaagcaacttcactttcacttttcactttcatgcattggagaaggaaatggcaacccactccagtgttcttgcctggagaatcccagagacggcggagcctggtgggctgccatctgtggggtctcgcagagttgaacacgactgaagtgacttaatagtagtagtagacaattcctcatggatgtccactaggcatctctacctcaaaatgtccaaaactaaactttttatcttcctaacccatacttgctgtttccaagtctgcccccttctctgttgctataatgttgccttttaccttgggaagtgtcaagtcttacacccatttctgctgtccaatctcagactttctcaccttatgtcatgcagtgagaagacatggttggcagcttgaccttctctaaaatgatgtagacaaaagtgttgaagcaacagaaaacagaactcaaacagatagaccagcagtgacttgatttacagtgagcaccatcataagtttttataacatgtcaccagcttagtcttagtcaatggcgttaatcttgggtgacaagtcatgaatgataagcagctgtaactgaagtttcccccatgacacatttgacagggccagaaatcttgacctgagataaaataccagctgcttgctcactagctactttcaaaccaaaccttgcagcataaagcatgggaaaaaatgtcaaaagtccctcaatctgtctcattaccacataataaaaattatctagcagtcatcttgaaagggacaaaaagttagtgtgaattagttttttattcacggtcttttcaaagggttactttctagtccatactactgtgaactctagtctacaatagctctccactgaccttgataattaacattaaatatatggacaataaacttaaacattgtggaaataagatttttggatggctacactggtcgctcggaccgtaaagaatctgctagtaggagacctgggttcttatccctgggtcaggaagatactctggagaaggaaatagctaacccactccagtattcttccctggagaatttcatgtacggaagagcttggctggctacagtccatggagtcacaaagtgtcagacatgactgagagactaacattaactctcacactttcttttccattgttgttgtttagtcgtgttttactctttgtgaccccatggactgtagccctgccgggggtcctctgtccgtgggatttcctaggcactggaatgggttgcaatttccttctccagaggatcttcgtgaccaggggatcaaacatgtatctcttgcattggcaggtggattctttttccctgagccatcaggaaagcctgcgttctcttcctgttgtgtgtgtgcctcttctacaggactataaaactgaagaactagaaagaattttagatttatctggtctaaaaagctcatttaaacatgaggcaactggagctcagtaacagaaatttttccaagggccacattgctattaaattaaaaatttggaatttcaacttatatcttccaactatgtgtcaaggttctttccattcatcactcttatcagcctttttttaggaggatattgaattgattgatgatgattcaatcaattaaatgaaattgtgttctttgtatcatctttggctacacttataaataaatgtgcaggcgcttctctggtggcccaatggttaagaatctgccttccaaagctggggactttggtttgattccttattggggaactaatatcccatatgctgccaagcaacaaagactacaagaaaaaaccttcatgc

SEQ ID NO: 32902 - DNA, 1752 bp, Bovine  19866881252042
gcatgggactgagtattcctaatatctgagaatttgttagtcttttgaaatccttggccaggcctatgttgaatatggatgacactggccttgattgtaatactgatgttgatcctgataatgaaaatgatgctggaagccaatctcgcatttcatgcatttctttattgagcactgtctttatcctctgaaataatcctctctcacctccaggactctaaatacacgttgactccctgaagctttgtttcactgatattgttagtaatatcactcctctccatcacccttctaccaagtcaagcttttactgtggcatgctctccttctatgactggagaggcagccttacctttgcttcacctctgatacctgattataacagcctgatgtggggttaagagacaacctcaagtggagaaatattgaatcagtagcacgatgtaataaatatgcaaatctctcctttcagaagccttattccaggccatctaataatgcctccatatttcttcatgttattattctctctgctgcagcagggaggaggctgcttctacagcagtgctgttctgccttcccacctgtttacatttactatatgactgcctagggaaccctgcagaaaataatgcttgtgtgagccatttagttgactacatgtcaaaaagtaatttgaatcaaagagtcactaacttaattgatggtgatggctccatccaaaaacaaccaaagaaattgatgttgtgcaaattgcacatatattgctcttgaatttgtgagcatattcttgtttgccttgacaggattcaaattatcttccggacagctcgacacattacttaagatgtgcctgtatgtgaattttagctgctaaagggggcaataacaaccttcctgtgaaattaattcccatgacttcaacttcatcttgctctttcttttactcattccctgcacatactccttccactcctttacaattgtgttctaacctctaagtcattctagtcaccatggaatacagacctattgtctttgcagaccccatagagacctaaggtcttgaggagtaaaagatgacagaattttaaattctgtggacacattcagttcagtgattataggctctatttttgacttgtcattaggtattttttgatgggtagagatcctgaaaattaatttccaagtgagcatatatcccagcgagagctggtatttagatcctgggctgaggaggctgacccagcagtcatgcccccagagtggtggtgctgtgggtcagaggacagggtcagcataagaaacagtcagtttgcaacacttggagttatctgcatgaagatataagattctcaaaaataactctcagtggtgctgtcccagtaggtgccaattccagcagactatacaatgaagtgtataaagcattggatgaggggaagaaacacagctatcaggcttacctctgacactaaggagctgtcagacatgagccacacacaaacaaggtagtaatgtgagaagatttgaggttttctggcactaaggaaatgaattattataagatcaagaggaaggaaaattaagcagcaacccacctgcttggtctacccttctgttcatggcaatcattttatggagctagatatctgtaaatatcacctgaaaaaaacaaagatgtacatgatgttcaaagggtctgtgatggttaattttatgtgtcaacctgattgggctaaaggatgc

SEQ ID NO: 32903 - DNA, 1291 bp, Bovine  19866881299310
aacatttgtatccctcctggtcttgcaaagtgctgcttggtaaatgttgattgattgaaggttatttgattaatgttaagtgaactttacagtttattcactcaccataaccactactctggaaaatgaaatccatgagataaatattgtattgattaacctctctgcaaccacaatcatcaaataaaatgaataattcactcgctcttattttcacatgccagcctgaaatcttggtttccttttagaacaaacttggaattttcatgcagtaaatatagaaagtaactcaaaatctcctaaatttcaaatttatagactgcttgagagcattcaaatattgttaatactgccggctatttagatagccagaagacgtggaagggcctccatcactaatgtctcatggtttatttgaagtagctggtgtcatattgattgtaataccattgcttctatgtttcgttagaaacatgacttctaagagaataaaagtatcctttaattttaaaagttactgaatttcatcatgtttttctaaaaagaaatggaaaaaaacaaatttccgactctatcagctcttctctctgtttggtctagcagctgccttggacattttgcaaaaacatttttgaaaatatgatctgcaattttagacactcgatttttcctgtaggaattataaacactttttgagtccggttctctgtgcttcagtttttactcaaacttgatcaaaacccaggatgagagagatgtgtgaaaactcaaactcaagttcctctaccaaaaagttaaaatggataattcaaacagcaaaagtctgtcgatttgaatgtaatgtctttaaatcaatggttgcattttaatgtttcatatgattagcacattattgatatgtcatggataaataaataaaacattaatatctatttctaggaatttcaaacaattattaacttcatgcatgggaatttctaattttgtttacattttatgttactaagcctggtactaaggtatggggaaaatcaataaacctctagcaccagaggtagcatacccaaaagatatcatacagggaatggcaccaccaccatgagtgactgacacaaaataggaacttgcaaactggatggaaataaaacataaatacacaaaatgagaagaaaatattattttaactgttgctgctgctgctgctaagtcgctttcagtcgcgtccgactctgtgtgaccccatagacagaagcccaccaggctccgccatccctgggattctccaggcaag

SEQ ID NO: 32904 - DNA, 946 bp, Bovine  19866881584314
aaaaacaagatacagacagtatcacacgtgtatatctgctaagtgaaatgtagctataggatagggctgccattgttaagcagaaacatcagaaaggttttcagaaaagggatgaagctaggatggtagaagtaggaattagacagccaaagaatggagcagtaacaccattgcaggtggagagagtaacacaaagctcaaaaacagggaatccatatgatggaataagtagatacttttgagatggtagaacaataaaaatctaaggatgtccttctctgtatgaatttccaaagatggaatagcaatttaaccagctctttatcaaatggtagcttctcttatagcatcttatattaaaatatcatacaatcagcaagacatggttatattcttgttgtttctgaaagttatacaattatcttgatatttttgtaacattaagtgtgaaaaatttccttgttttctctcctcgtcttttttccagccacttttagcagcctgaaaatcagctttcattttgactgccgcttaacagaatttgattaaaaaaagtaaactaattacaacggaaacgcagccctgcgaagctttaagaaaaacacattattttgttttagggttcagttactatacattcatttatcatctttataagcgatgtgcaggcgatgatgaataggccctggctttgaatcaggaaatgtaaattatcctttttctttctttttttcattttttttaaacaaataatgagtgctaggtaatttgaagctaactgatgtgccaagaactcaaagatgatgtcatgcatgaaagcaacaaggtctacttatctgataggctgaagcaaagacaactcctggtccaggggatgcacacttgagttgaggtggttgtgtcctgcggtgacctagcggttggaggaccatcattaagagccagg

SEQ ID NO: 32905 - DNA, 726 bp, Bovine  19866881585993
aactgaggactttgctagtgcgggatcctgtgtgcctcagattccccactcacacgtgagagaaatgcacatagttacatagataactggttttcccaaagaagagcatctaaggaatatcaagtgtaatatatgaatacaaataaaagagaagaagcattgtttagttccccaaccagggatcaaacccacaccccttgcagcggaaacacagcatcttaaccactgcactatcaaggaggccctaagggagcatttcttaaactgaaggaagacctatgtgtgcaggttgaaagtgctttttgctatacaggcaaagtcaacaagaaaactgacagctaattaattctgggggaaacaagatcttatataaagaacaaacctcctataaacatcaagaaagaaagaaggggagagagagagggagcctggctctaagattaaaaatccttgcagaagggggaagatatagagttgaatgaaagaattaggtttgcataagaagatgggtacctcttcctccaaggctttcagtaaggatgccatgctgtatgcaaatattgacaatttaaatgagattaacaatttgtaaatcacgtatttcctggcatgtggtttatgctcattcagtgctagccctcacccattatcagagcaccaggcacctgaatgaggaactcctgactcatctctggaaggggtcacactctaggtactagagtctag

SEQ ID NO: 32906 - DNA, 1064 bp, Bovine  19866881821206
agatgaattgtttattcttgtggaagtcctggtggcactgcgccttgatctctggccatctgatgctggggccagcaccctctcaaatataccagtcgtgatggtcaaagagagccccaccaccaatcactgcattgtacctcaactgggtccccgacttccctgactgtcaagaacattgagtaggtggtcttgaagttgtccaatgaaaggattaatgcactcctgtcaaaagtagctttaaaattctgattagaaatcactctctcttgcactgaatttgtctcaggaaatagagaaaagagaagctgtttagagacgtggttaaatccccaggtttggcagtcaagctgcctgtgattaaagattgggtctgatgttttatagctggttcaaaaatgggaaaggagtacatcaaggctgtatactgttaccctgcttatttggcttataagcagagggctgttgttgtttagtcaacaacaacaacttgagccacttcctttcttctcttggccctttgcacttggttgttgttgttcagtcacccagtcatgtctgactctttgcaaccccacagactgcagcacgccaaggcctctctgttcctcaccatctcctgaagtttgcccaagttcatgtccattgcatcagtgatgccatccaaccatctctcatcctctgatgccctcttctccttctgtcctcaatctttcccagcatcacagacttttctaatgagtcagctgttcacagcacatgaccaaaatgctgtaatttcagcttcagcatcagtccttccaacgagtattcagggttgatttcccttaggattgattggtttaatctccttgttgtccaagggactgtcagtagtcttctccagcaccacagttcaaaggcattgattctttggtgctccgccttctttgggggcttccctggtggctcagatggtaaagagtctgtttgcaatgcgggagaccagagttcagtccctgggttgggaagatccccggagaaggaaatgacaacccactccagtattctgtcggaaaatccca

SEQ ID NO: 32907 - DNA, 1362 bp, Bovine  19866882171462
agatattaagtgctcactgcagcctctgcagtaagagttatctccgaagattatggactgaggggctcagtgaggaattcatagaagaggggagacttgaactgtgccacgtggggtagcaaggccttggatagacaggtgagtatagaggagtgagaagttgtgaacaagcatcacccagaagatgcagagcagtgcaaaggcatgtatggaggaagcataagtgtcactggcagtgctgactgccaggacacctgagtcctgcgtgaggcctgagctgccaggacgcctgagtcctgcgtgaggcctgagctgccaggacgcctgagtcctgcgtgaggcctgagctgccaggacgcctgagtcctgcgtgaggcctgagctgccaggacgcctgagtcctgcgtgaggcctgagctgccaggacgcctgagtcctgcgtgaggcctgagctgccaggacgcctgagtcctgcgtgaggcctgagctgccaggacgcctgagtcctgcgtgaggcctgagctgccaggacgcctgaagtcctgcgtgaggcctgagctgccaggacgcctgagtcctgcgtgaggcctgagctgccaggacgcctgaagtccctgcgtgaggcctgagctgccaggacgcctgaagtcctgcgtgaggcctgagctgccaggacgcctgagtcctgcgtgaggcctgagctgctaggacgcctgaacaagcctgttgtctaccttcatcaactttgcaagaccctcctccccttcctcttgccttctccctcacctatatggaaagtgatcagggctttccttgtaagtcagtgggttaagcagaggcacagtcctccagtaagatttcaggttaatggagggatgaggcaagagactgggcagaaacatcctcatgccttttgttccttctccactcaaatgtctagacaggagagagatttgggacaaaaggactcttggcagtatctaataacaccttgacgttatgtgttgaatcaaccacaggcttatatccctttcccaggctggagaaatgttaattaaatattaattcaacccttccctttcctgaccccattaggtcacaaatatttgttcagctaacctctcttctattgtgtactctcctctgtctcttctgcttggagagatgtcaggcagatttccacagtacctcccacccttcaaaacattcatccctgctctccctaagtgaacaggtctttttgtttggtttgagtttacagttgtttataataataacagaaaggaaaaaagctcttgttttgtgaatctgccacttggtaaggactaagataagtgtatcatatgcattagctcatttaac

SEQ ID NO: 32908 - DNA, 2859 bp, Bovine  19866880291489
gggttaagtgtaagttccagtggccctttggagcccagtccctggaagcagccagcagagtgttggcagggtcagggctctaggtgtggtgtcaggagactgtaggctctgctggcctagaaaagccccaatggccagctacttggagcaccgtcactgggcgtggggggtgtccaggtgcttctaaccctgctctctctgaggccctcccactattcctaatcctagatggagaggagcttcagcctctttcaggcacagaaggaatgtccttcccagagttgactgacacctccctagggatgttgatactcccctcctgttcgacagaacctataggcagagtccctcccagccagattataccttcttgttttctgcagagttctcagaaaggcctcgagagggactcggagagactccagatggggagacttgtggtctctctcttccatttcggaggaatggagcccaagcctctatctatagggtagaacaaacatttagcagcttggaaccttctagatttctgcagctgacttggagaaggcttctgcatcacatggtctgtcagtcaatcgtggcgtgacatttgtgcatatccttagctaccccttgggccctggtggctgtggacagtgtcttctgtattccgtgagccgctgtggctccagcgtgggctggactcacgggatcctggtgttgttgacctgccggagcacgaccagaaggaacttgatgttctgagaaaggaggaagaaggaagttgtgccttgcagcttgtggtcattgagggccatccctaaaaataacagagtgcattcgtcaggattagatttggctgcgagtagtaggaaaagccaaatgacagcggtttacacaagatggaagtttatttctgtgtcctgtccgagcccggagctctgcagtccaggccacgatatggtgattctgctatacagattcccggggtgtggctttcatgtgctcacagctcaagacggctgcaaaatgtcagccatcatgccctgtgttccaggcagcaggctggaggaaaggagtaaagggggctcataggggaaggatccggaatttgccaaggacactgcccctcatgtttcattagctaggattagtcacctggcccaagtagcttcggggggagatcaggaggtttgggccctggctgtaggcggtcacatgctcagctagctgccctgtccctcgtcccggtttgtttaatacagatgaagggaggggagtggggctgagggggattgtgggccttccttttttttggggggggctgctatgcatcttattgggatccttagttccccagcctggaattgagcctgtgccccttgcagtgaaagcacagaatcttaaccaaaggaccactgggggaagtccccactgtgggcatttaccggaggtttttctcaggctgagaagctgagccagtggttcaaaggtggcagaatctccaccagggagatttctctggaggaggccagtcctgccttgggaccagaaagccacatgctccaggacaggagtggaagcaggggctgagcccaagacagaaaggctttccaggggctggagccagccccatggagtggtcacagtgagggaagtgggccaccctattctcagagggttggtgtgtgctgagacagtgtgggcctgtctgggctgctaggacctgggggaagaggacacgcttgggaaagatggaagacccacaggggcggggacacaggtggaccagatacggtgcttgtggggctggcccaggacgagggctctacttgagcactgtccccacctggcccacaggcctggggggtggcaggggcccctccaggggcgtcccacagcaccctgttgctgggcatatttgggttctctggagatctggagttgtatttgaaattccttgactttcaggtcctagcagctaatgagaatggaaagaaacaaaacccacagggctcaagcactttgcctgtgtggactgaagactttctccttccagatgagctgccttctctgaggcttcagtgaggggaatgtttgggaaagtagcttcttataaggcacagtacagttcagttcagtcgctcagtcgtgtctgactctttgcgaccccatgaatcgcagcatgccaggcctccctgtccatcaccaactcccagagttcacccagactcacgtccatcgagtcagtgatgccatccagccatctcatcctctgtcgtccccttctcctcctgcccccaatccctcccagcatcagagtcttttccaatgagtcaactcttcgcatgaggtggccaaagtactggagtttcagcgttagcatcattccttccaaagaaatcccagggctgatctccttcagaatggactggttggacctccttgcagtccaagggactctcaagagtcttctccaacaccacagttcaaaagcatcaattctttggtgcatttctagctaactgtttttcatgcagtcgctaagagtccgacacgactgagcgacttcactttcacttttcactttcatgcattagagaaggaaatggcaacccactccagtattcttgcctggagaattccagggacggtggagcgtggtgggctgccgtctatgggctcgcacagagtcggacatgactgaatcgacttagcagcagcagtataatataatatacttgtttattactgatttgaaggacatacaatttattcttgtgcttttatcttgtatcctgtgactgccttcatgttaatttctaatagttggtagattacttccaatttgtatacaatgtagaaaaaaattcatca

SEQ ID NO: 32909 - DNA, 1105 bp, Bovine  19866880357482
tctggtagctttgcctccagtgttgcatctttgagtctccgcttccttatccgaagattgggcaccatcgttcttgtccatgccggggtggttataaggctccaagtgtgcaaaagtgctttgtaaactgtcaagtgctggtcttatcccccgtcccccacgcccacctggggccaggctctgaacctcaatggctgctgtgggtcccaggcttgctcctgtcccgacaggtggcagatgacctcgtctccccggatgcactcagcaccatcagagagatggacgtggccaacttccgtcgggtgccccgtttgcccatctatggcatggcccagcccagtgccaaggtgaccaccctgggggcacacttgtggggcagagggagggtgattgagccctttcgctgatggccttcctgtcccccaggccctggggagtatcctggcctacctgaccgactccaagaggaaactgcagcaagtcgtgtgggtcaacctgagggaggaggctgtgctggagtgtgacgggcgaacccacagtctgcggtggcctgggccccccatggcccctgaccagctggaggtggggctctcctgccttgtaccacccctccgttggaggccttctggggagctggcctgaaagggtcttcagaagcttgtatgctcctgttgtacagttgcagaaacgggccccgagaggagcatctcagggaatgactgattcaagactgtcatgctagccccgggtctggttagaaacctggaggctccagaaggggcagtgataggccccaaagccaggactggcctggccatagccggctctggtctttcagggctggcctgggggttgccttgtggcctgagccctctgtcccaccctcccctagaacctggagacccagctgaaggcccacctgaccaggcctccccccgatgccgacggcccgcagacccacaggttccagacatgcctcaccatgcaggaggtcttcagccagcaccacggggcctgccccggcctcacctaccaccgcatccccgtcccagacttctgcgcccctcgcgaggaggtgagggccgagcggctgaggcctccgggg

SEQ ID NO: 32910 - DNA, 930 bp, Bovine  19866880480560
ccatggcaggctcgagcaccggccaccagctcccaccctggcctcaggcccctccgccctacaggagcagagctgctatgggtcagcaaggatgaatcggaatcccctccctaaccctgagaggactccagggaggcaggtgggcggacttggttctctgtggtttcctgccagcccactacccttggccctgcctgaaggccactagagaagcctgctaggggctgagggggtgctgggcaacaggctcagaggccagatctcgatcctacaccaatcacggctcttttctcccctaagccccaagagaagagaaaaaaagcctctcttttctccaaatacccccaagaacatgaccctgtgctcagaagagccagggaatcccaatcaggggctagaccgtggctgggagctggcaggccaggccgtgtgcctgggccccagatgactggccagaggaactggtggacatgccccagcctcggccctggaagcactgagctcctcttcacctccatggaccccctggatcatggagagaaagctgggtccacagatcgggcctcagcctccccacctgtaaaaggatgctgggagggacagaacaaaggcggcatcttcctctttctgggagtgaaagctaatctagaaacctcagaggggatggataggcaaggagggcagtgctggccatgggcagagtctggtgtgtgggtactctctgctcagagtcccggctgcagggtctgtgtgcccccacgctccagtgctggaggagcacccctcatcctgaggtcagggctgcgggacgtctgtgttcagccacctcgtccctcccccggaagcactcacccctggctgggcgcatgcgtgctggttgcagcgccggcggatgggcttgggcctcttcctgtggtcgcacaggtgccg

SEQ ID NO: 32911 - DNA, 1326 bp, Bovine  19866880583995
tttaacctgtcctgagacccccctggcaggctggggtacttctgcttctgttgtggcacacggactctctagttgcaatgtgggctccagagctcatgagctctgtggtttgcagcacacgggcttagtcgccctgcagcatgtgggatcttagtcccccaactaaagattgaacccatgtccctggcattggaaggcaaagtcttaaccactgggctaccaggaaaattcagagtgttgaaagaatcctgatgtaaaggtgggctaactgtagcttagagtggtcaagagcttgcagggtgcaaggacccgcagggtggcaggatttaaataggcattatacctgtttttttagacgaggaaactgaggagggaataagtgacctccctaaggccgcacacccggtggctgcagagtcaggtggatggcttggcccccaagtattctgaagcccagcccttctctctggctcctgcctcctgtggttcggagggtgggagcagctctgggagaaagtatgccacagtcctgccttccctctacctttctccctgtctgtctccaggtgggtgacggaggagtggggcacctgcagccggagctgtgggaagctcggggtgcagactcggggggtgcagtgcctgctgcccctcaccaacggtactcacaaggccatgccggccaaggcctgccccggggagcggcctgaggcccgtcggccctgcctgcgcgtgccctgtccactccagtggcggacaggagcctggtcccaggtgagctgttctcagagggtgcgaggggctgggctaataggcacttaccctggaagtccagaaagaggtgggtctgggaggggagctgccgagagttctggttgtccatgcaggcagagtttctggttgaatttctctccctgcatctgatttgatttttctcaaaactgagtccatcagctcccatgtatgctggaacatgggtttgttctcggcctttatattattcagtatctgctttgaccttcactgagagctaggaggcttgggctaatatccctgtgttttagatatgcgaattgaagcacattctttttagtatttatttttatttggctgtgctgagtctcaccaggatcctccatcttcactgtggcctgtgggatctagttccccgaccagggatagaagctgggccccctgcattgggagaacagaatcgtagccactggaccactagggaagtccctgaagcacacttcttgcattcaggaagtatttactgaagtgccagttacattgcaggcgcactgtgctaagaatgcctagaac

SEQ ID NO: 32912 - DNA, 2094 bp, Bovine  19866880660983
cagacgtaatcgagcctggatgggctggcaggaacgggtgcagacgtccagaggaggctgatgcgtttataatgatgctactttgcaagacaaatccggccttagtgggctgacagtgaggaggccagggtcggggtgggagggaagaggctgcagtggcatctaaacaagggccacttcatgccccaaaccctgggaaatcttgatcctagattgactggatgtctccattcatctgtctgaggcagcaggagtttggggggatgggaggcatctttacttttcatccttcatccgagaggctgtaggccatcaacgtttccctctttgttgtttcatttccagccggtggtcagtgatggataaaggaggatgcactggcggggggtagtcagtggacacttcagagagagtggaaggcagggtagtaccctcaaggatgcagtagacaagtttgaaagaaagccccagggcaggcagatgagctctaaaacacaaatctagacactgagctttgaaggcacactctcaggacagtgctcctgtcaatatgtgtctccccagaggccagaaagatctagtgatgtggcccctgaaaggtccttgaaagcagggaccgtgtctgccttgctcaccgtcgttcccagcagctagtacagtgcctggccataggaagtgctcaataagtacatgtcagtatgaataaggaaatgaatgccactcacccacctgtccactcgggctagttatttccctcagtggaccttggtgtcctcattcaggaagtggagctaatgattcccagatcacctcctaagggctccaatggcacctgtcagattagctgatggccatcatagcactttaaatatgtgggaccccctaacagaggtgacagaagccatcacacctggggcctgctctctctcctatctcctctgccaaattccacaggccatactgaccacctggaccagtgggaagaggagatctcagtagataagactatgatgaagctgctctaggcttggagaggccaaggactaacttgtgcttttctccttcagtccctctctccctcttgggctggtcttgatccccacacacccaggaaattgggtttctggcaccttgagtagtgatgcttccaataatttcaggaatgccttccatgaaagagaaagttctttgaggaagttcttcctgaatattagtagagagataatgccactcaggtgggggcttgttcaggggttagtttcaaatgccaagtagagatgttactataaaaggcatctgggctagtgcttcccatcgattgttagacaggcaggcaggagggacttggaagacaacctgcctgcatgggatctgatctaagactcagagtttgggtggggggagtggaggtagactgaagacttggggtctagagcaaggaggaagagaaggggcagacaaatcatcaaggcatccagtgctgggcaagaagttgcgaccgtaccctcccacccaccctcaacaggtgaggacagggatacagtgaagcatcatcttctcttctccccctctggaccacctgggacatttttaagaatctctgcccccagcttgctgcgtgaatttaattcctgggcttgagcatctccacttggacaatgagcgggctggactatattggtgctctgtccctcctaactttgacattcatctgccagtcacacaaagggggctatgggaggcactggctcttctggggatcaggatccctgtcactgcaccccagaacccacacatctcctcccttggggcccagcagtcactgtgacctacaatgactttgagggatgctgctctgtaccctgcccaatgggccatgtgccaacacctgccttctccccatgcgccatccgtcactgtctctgtgtgtcgctgggaagacagcttcattagctcctccagagccatccatcccctggtgcagagacaatgaagccctcccacccacatcaggctgggagggcccggaaccctaaaagcagtttctgcagggccatcctgctgtccctcctccctgtatagctgtcccgccag

SEQ ID NO: 32913 - DNA, 1096 bp, Bovine  19866880670905
ctgtgttctcggaaccctcactgtgaccctgtcccttgggttgtattcagggacccctcccctctgccaacagcagtgcctcccgccttcctgagaaggtttgctctgtgctggtgtggttggaaccacgtgggagcggtttagttacaaaggagtgggtccatttcatttcttcttggacagctcctttgttctgcacccacctccttgctcttcagctcactctccttggtgaagatggccacccgggaagccaggtccttcaactccttcttccaggcctctgggaggagggggcaagatctggccaactgatccccggggtctccctgtgcaccctccctttgggccgagtgtggaagggggataggtggaagagcctcctctcctccctgccctcccacccaggatcttaaagagaagggtattttcacagggcaggtggtgccctcgagggaaggagctggaatcacactattggttggtgggtgggagtgcttgctgctgacatttgtgtcccagcctgtgtcttagttgggaaatgctggagaatgtttggctacgtgtaccgagatgtttgtgatttagactcgctttgcctctttcaggaaaatgaagccagggtggagattcagttgataggctgtgccagtggctacaacactgagcgactcctggccaggttggtaaagagccctgcaggaagccttctgggcccctccgccccttctccaggatcctccctgctctttggggaaagagagaggcttggcccaagtggaggcctctgaaatgctgccccagcactccctatggctaactgttctgactggccggtgcctgagcacacaggttacaaaattcagtatttccaatactgttcctggctagagcctggaagtcacatgtctgttgtccagatatgtttgtcctctgctttttctgactcctcaaacacctcacagccaagcaagggtgcatttctgaggaccttggacccccacccacctaagagccatggccttttccttctcaggcacctgtccaagccaggcacccttggggccaggtatagccccaaggtatagggccctag

SEQ ID NO: 32914 - DNA, 673 bp, Bovine  19866880687113
ccttgagccccaaggaagtctgtgggtatgggaggttttgtcccagttttgagtcccatcccaggctcctgggagatgccagaggagctgccccaagggggagggagccccagggcccagagagcaattctgggtctgccttgggcccagcccccaaatcccagggctgtgggagaccagacgtggccctgcctttggcagctcagtgacagtgtcccctcagaggcagcactgtgctctctgggtggcctctgtccagtcacccctcgaggccttccctgctgctcgcatgtggagtgctggccagagtctgtcttaaacaggtgcatgtaggtccaggactcgggccaggctggtggctggcttacgtgatcctcggacctgggtttgatttagagtgtattcattcattcagtcaaccagtatttcttgaacacctgttgtgtgccaggctctcttctagaaatagggcttccgtggagaatgggacacaaaagcatgcaagacactatgtactgggagaaaacaaataatccaccatccagtgttcagcggtgacacacacctgtcacagccgcgcctcctggccttgtctgtccccagggcagagctgagggacacgctcccagcttgcctgtccccagccaaggcgtagagtgaaggccattttttg

SEQ ID NO: 32915 - DNA, 1982 bp, Bovine  19866880690913
actgcccagggcggtgggggtggaggattgggctcatctctcacctgggcctcctggatggttcccacggtccactcctccccggagcggcagaggtgcgcacaggactgcagctccctcaataaaatccccagagcccccgctgccttgggatcagatacaagctcctgaagcctgggtctcaggcccccttgccctcaacctgagctgccttcagccctctttgagttgctagaatctgatgagcctttgccctcaccatccgctctgccctaatgtcctttctcccactcttcctggcaaacaccgaatagccttcaagtctttgcttaaatataacctccttggagaaaccttcccctgccatcctatctaaaggtgacctcctcacacttcctcagagcgccctgtatttttccttcagggtgcttattgtcagttatggttacacctttacttggggggttgttggttcatgtctgcctctctcagaagactgaaagcaccaccaagggtgttgggtttaacatctgggttattctgcatccctgcgcttagcatggtgctagagaaataactgttgtgaagaaaagaggccagtgcggaggctgtcctgctgccatatttccagcaggtggcgttccagggccgaacttcatcagtcccctgactccaggagggctccccgccttccattctccaacctcctcccaccccctgcctcggagccctctgcactctgctcacgtctttgagtcttgaggttgcacatcatggttatgtttgccctcatctcctacagggggctagtggcaactctcctgcagagacctctcctgcagaggccagtcaaacccctttctttttccatggtgcctatgcagaactcagaaaactgaatgaccagtgggaaagacaatgactcagtctcatggagagagggggcccctggaggtgaacattaaggcttggagcctgactcgtgccgttccagattgcttcagttggccctgtgggctgtagcctgccaggctcctctgtccatgggattctccaggcaagaataatggggcaggttgtcgtgccttcctccaggggatcttcctgacttaggaaacgaacccacgtctcttatgcctcctgcactggcaggctggttctttaccactagtgccacctgggaagttaaggttttggcacctgatttctggattccagtgcttgctctactgcttactaatgtgagactttgggtggactacttaaccactttgtgccttattttcttcctctgtaaaaatgggactaggtcctgcctcatagggtgttttgagactagaatgaggaaatacatggcaagtatttaggatggtacctgtgtgtagtaaatgatcagtgaatgacagtttttactattgaacaattctttacccactatagaatccccattccagatgtgggagagactgcctgtgcttgtgcatagcgcgcacacacacacacatatatgcagggaaaaacacaacaacaccacacacctcttccagctgtgggctcaggcaggccacggagcctcctttgccaggacaggggagcccagcagatgccctgtcaccttcctggcactctgcctcctgcattcagtgccagtggcttggcaggacagttgccatggcagcaggtgaccaggcctgcagtcagggacagtggctgggccctggctgagctctctggctctttaaagggggtggcttcctgccaaagcacaggctctcctgctgctcatacgttcagctggcatgagcagccatggccacatccagagtccaccagtctgcttgccctgggaactggaagctaagccagtcgctcactctgggtcttccctcagaagccctggagggtcgtgccagcacctcattggcttctctctgtggggtgaaacaaaacacacaaaagtgaattccctctcaccaccttga

SEQ ID NO: 32916 - DNA, 1688 bp, Bovine  19866880752321
ctagcattattctcgcaccttaattgaggtgttaattgacaaaaaaaattgtgtatatttaaggtatgcaatttggtgttttgctatatggatacattgtgaaataaccatccacagttaagctatttaacatctccatcacctcacatagttttttcttttttcatggtaagcatacttaaaactaccctctagatctctaagcagatttcgggtatacagtgcagcgttgttcagtgtagtcacgtgactctacgttagatccccagaacttactcgtcttaataactggaagttggcaccccttgaccaacatctccccatttccctcattctccagctcctagcaaacaccattctattctttgcttctatgagtttgactgttttcaattccccatataattgaaatcatgcagtatttgtccttctatgtctggcttatttaacttagggcttccctggtggctcagagagtaaagtgtctgcccgcaatgtgggagatctctgttcgatctctgggttggcaagatcccatggagaaggaaatggcaacccactccagtattcttgcctggaaaatcccatgaacagaggagcctggtaggctacagtccacggggttgcaaagagttggacatgactgggcgacttcacttcacttatttaacttagcattgtgacctccaagttcatctacatggtctcaaatggtaggctttcttttttaagccagaataataagcctttagtaattatttttgtgccttgcatttatgtagaggaactttctagtttcagagccgcatttgagcctcatgataacctggggagagcatagaagcagttagtgttattgcatctcatagatgaggaaacatacttgactgaagttaagtagtttcctcaagctttcactgctaatgtggggccaggactcacgtttggctttcttgcctcttagcccactattctttaccatcacagtgattttgcggtttcatattatgcttgcagactgttttcccccggtgtttgtatttggccaccatggtggggcagtggtcatcctctgggctggagaggtgaagtgggtgtgctggtggagctgaacctttaggttggtagcctaggctgctcttggcagcataagagcagagtaactgtgatgtgacttctcattttcctttcaactttatcccctcaggcaatgcgcagagccatctctaggaatacggccatgctcgtctgttctgccccacagttccctcatggtgtgatagaccctatccctgaagtggccaaggtatgtgggagaaaggactagtaggcagacagatagagattttagagtagagtctaatggtgccttataggaaagaagaaagtgattttgagtttagattgtagcccagtggtggtgaataccggtcatccaccctgaggtaagctgcacagctttatggaagcctctgaaggtgactagctcgggctgtgggagagggataacacacatttaaactgtacattctgcagtggtactgacattttgattcagatcaggaaataatctgcatttaggggcatgcctaccagagggtgatcttcacccactgtgctgccccagagcacccctccctccttcccaaccctgcagttactagagcaggacaccacacaccttcaag

SEQ ID NO: 32917 - DNA, 2201 bp, Bovine  19866880814522
ggaactggggaaacggtaggatacatcctccggtctaaagaagattgaagtgttgtagtggaggagacaggcataaaaattattttgacaaagtggtaacagagaaagtataaatgtggttaaaagcactgactaaaaacacccaccagacccagtttgaaatcttagctttatctgtcacttctagctgtgtaatcttaggtaaataacctcactgaggctgtttccccatatgttaacgaggataatcccagtacacagctgatggggttctagccgtaagtaagataagacacacgtgaagcacacacacgcaaagcacttagtagagtgtgtggcacaactattttcagtgtgatagcagatctgtgtatgtacatgaaggtaaggggcctcaaagagggagtagcaaacattctgagtggtctggtggtgtctgttgagtggaaccttgagccgtgaataggaattcatcattaagaacaggtagcaagaacaagggaaaggaaaacaacaaaggagcaaggcactcagtaaacagaaaaggcagcggttagtgttcatgtgggaaaatctggctcacgaagggactggcatttttggttgcataagcagcttaggatttgtcctatagacaatgggagtcactgaaagattgttaagcacagaagtaaggtcagggtattatgtcaaaatacagctgagcaaaacatgtagtgtgtagtaagctgtgcacagtttcatagttctaataatcaaacacaaagaccttagaaagcaacagtccaatgccaattttgtatgacaaagtgagatttaaaaaataaatctgattagaaatggaagaagctaaagcaattctaaagtcaaccaaaaaatatgagaattatatgaattataactgagaccactgctcattctcagattctgtgatttgagactcaggaaatcatgaccaagtttccatcccttatctcttctgatccaacaaaatataccttatcattaataatcgcaaatgatggactaccttccctagcaatctgctttctacacaaggtgtctattaagcctggagacataaataacatcttacttttttacagactgaagatgtcttggacaatgttatgcatttttgtctgttgggtaagagacactgaacctctttagttttaacaataaactttgcttaagtaattttttttttaattacaagaataaagagaaaaagatgtgatcatctaaaccagcagagccgcacactccttccaaggactgagcacttgctcaccttcacgaggaggtcggtgagctccttctccccactatacactgctccggaggctttcccctcttgccacaagacatctgcagagaaaaggcagaccactgggtcagtaagcaggagcctctggggagacagattctaaagaagaaacagggagaaactcctctgtgtacaagagttggagcagaacctccaaggcgtccttacattaaatcaagaaaaagagcttcagtaaagagtgtcacagcaaaataaagatgaaaggtcaaccaccaccatcaacaacagtgtgaaaaaggtagcaacagcatctaggtacaatagagaacgtccactagtaacgtcgtcatccccagctggcctctaacagcagaaccacttcttctgtctacactcgttttcagttctctgtatggctccgcttgacctttttctgcagtggcttccaccttctctccctttctagccagtcaaagggagtgtggaaactgctatgggcacagttagcagaaagagtaaggcaaagtgcaaaatttcagcacagtatcaccagagctggagtcagggaactgaatctctgactggacaaaccatggtgagatgtgagccatcagcatcgtcctcagacaagcctggaaacccatacagagttagccacctgcttccagcaacatgtgctgcagcactcagcgtcagcagcacagccaacactgggagaaggaccagaggaaaggttcctgaccgggatgtgaggtccgaccttccactattctctgaggtcctcccccagaaacactccccaataccaatacaaatccgttcacgtgggggtctcgggtcctttaagacaacatgcctgtgccctactgaaagtgagtggtgagaattatagaagcactcaaactgaaaa

SEQ ID NO: 32918 - DNA, 1232 bp, Bovine  19866880826725
ccctagggagccgtggcctctgagatatccgggaacgcgcttgggtcccgtccctgtctgagaagtgaggggccatcagggccagcgcggcccttagtgttggcgagccagttgctggcgctggaggcccccaacttggtttttgttcggctcatcccctgcctctggccccaggtggtgatgaaggtggtgcagctgctgcccgatgggcaccgggtgaagagggaggtggacgcggcgctggacacggtcagcgagaccatgacgcccatgcactaccacctgcgggagatcatcatctgcaccttccgccaggtgagccccggcccacgtgccgtccccgcgtgcacagccccaggagggggctgacctgggtgtgaggcggctagggcgccccacaggaccctcaggggctctcagtcccttctatgcctcctggaagtcaaggtgatccctgccatggaagcacgcccagccctgactttccccggctggattctgcagtgcttggtggggtgtgcaggggtgaggttcagaggattcggcagctgctgtggccctgggacccatcaaggatgtgactgctcagatgaacaccctgtcctcgatccctgtggtgccaggcattcaccctccagtttctgggccacgggaggccctgggggtactgggcaggaggcaggtgggtggatgggtcctggggagcggctgtttaatatccggcaggaaagccatccagtgttttcacagctgatgctgcctgagggactaagcattcaattatacacatcagaagttttctataaaagtccagatttcatataaaaattcagaattttatccgatctagaaaaaacaagccctttagtcagccatggtcccaggcactctgttgcacgtggcccagctggtggagtcacataacccacgggggctgctctggccatcagactcgggggcctctggtctctgtgtggagcatcagttcagttcaattcagttcagtcgctcagttgtgtccgactttttgtgaccccatgaatcgcagcccgtcaggcctccctgtccatcaccaactcccggagttcactcagactcacatccatcaagtcagtgatgccatccagccatctcatcctctgtcgtccccttctcctcctgctcccaatccctcccagcatcagagtcttttccaatgagtcaactctttgcatgaggtggccaaagtactg

SEQ ID NO: 32919 - DNA, 1336 bp, Bovine  19866880894958
agcagtgcgtcaaatggcctgtggctcatgggtgctgtctgacactgccagctactgtcccagctggggcccacctctgcccacacctcctcttcctagaccataagccagagcttgtggatcagggattgttaacttaggagaccaggtcaggagagcctctgttgtcactgactggtgacagggaggccctggacatgctttgtttctggtgatactctcgctggtcagggaggtcctagaggacagggtctgaagccagtcggtgtcagtatattaattcaatccaacatgtgcttcctgttcatgctatatttactgcccactcgtacacctatggccagttgatttccaacaagaataccaagaatattcaatggggaaagaaggatctccgcaactaacaatgcttgcataatgggatatctacaggcagaagaatgaagttgaacccctgcctcacgccgtctaccaaaatcagctcacaatagatcaaagccccaagaacaagagctaaagccatagaactcttggagaaaatagagggataaatcatgaccttggattcctagatacgaaaccaaaagcatgagcaatgaaagaaaaaaaaaaagagagaaataaactggtcttcatggaaattgaaagcttttgtacatgaaaagacattttcaggaaagtgagaagattacctgaacagaatgggggaaagtatttgcaatcatatatctgataagaatctctgtcgtagaccatcttctagagacaggcagtgtgagtgctctcgtgagcaggacagaccagcagacatggttcctgcccttgttggaacttaggtgtgtgggagggagaatcactgatgggcacacaggctgttcaggccaggcacgcagtaggtgcttggcctgagttttcctgtggctatgggtctgaaagtcctccccaggccatactcggtgctacccgctcctggcttccactggttctgcttctgaccccacatcctccctggtgactcctcctctctggtctccctatgctgaccttgctccccgccctccagtcctgtgccacctcctccgtctcccctcaggtactccccccagctgaaagtggcccccgcagcagtctggcctacaagtacatcatccacgaggacctgctgccccttatcgggagcaacaatgtgctcctggaggagacagacacctacgagtgggcactcaagagctgggcgccctgcaccaaggcctgtggaggaggtaccagcctgcctgactgcagcccccttgtggggcagcccagggcctctcgggagaggacgcaggaggggtca

SEQ ID NO: 32920 - DNA, 1064 bp, Bovine  19866881009816
aaatagctgcccgtgtgcatatagtccgagacatgctaagacgggtaagttctgacccagagagacaagcactggctctcctgtctggaggggaatgtaaggggctgagggccgtggcttcaaacagccaagatactgataccccataaagtctccaagatgaaaacggaaaaggactgtttctggaatattgctgccaatacaataagcaccttacaccaggtgccttgatgcaaagcaggcactggctgagcgacagcctctggggtaaagcccatacatctagcaggaaatgtctgaactgggaagttgaggtctgagagatgcaaagagctggtaacccagacagcaaaaataaagaccatctattttgactccaccttaaaatcagaagtaaaaaaattcgtttgaaggtgctttaaagacaagttccttacttctagaagtaccttttcttcttttttttaaatagctgccttagcagcattgctttttattcaagtatactctaaagcaagcagggctatagataagaaaatgctgggaagtgtcagagtgtaaatctaaagaatttgcacccttaagatgtctgaaacccccaaaaacttggcatcggtgccagggacacagaacagacattcactaaaaatgtgctaaactgacgagcttcatcaaagcttctctcaagggtgaagacaggattggttctttttaagaacctgtttccattaggaagcccagggtgaggcaggtgtgcagagttaacttttactggatgtaaagatcaagcacagatagctcttattcccagaggtcccccccatttactgaggtggttttttgggtgggagacctgacccaagtctgctttagctggcgtggtttgagagagcaggtgccaagcatcaactgggggggacctggcttctggatactatcagctttgttactctggatctgaatggttagctattcttcagcccagtaacccaccacctaattcatgtttgctccctttgtttgacaaccccgacgatccattcgaaggctcaacgagaaggctc

SEQ ID NO: 32921 - DNA, 813 bp, Bovine  19866881049867
taggggggaaccccactgtgagggctgctgagctcagagtcttttggtcccttcaggcatatgccacctatttgagtgtttctgtgatcggaagaagacagaatgaaagaaacggggcaagagacggggtggagaggaggaagacaagagggaaagactaaccgctccagctgggctggaagagaaatcagtctgactcatctttgtgtattctttcacccgctacacaggcctgacgcacagtaggcccccaacacaggactccgctgctctcatttgcatccacttccatttaatatcaccataaactaaggagaggtaaaagagacttgggtttggagtcaaaagatctagctgaatctacgcccaagtcctgttatgccttaatttcccctttcaaggagggaccataacacctcttattttatctacctcctggtgtgtctgtgaagaataaattttaaaaaggtatccttaagcaatctgtactctcgtccccattaaattaaaaaggattcggttagattacaggtacaaagtattcaagtgaatggggctcctggaactctgtacagaggtgctgggagggttatatgggcttatgcacaggagtgctgagcaccccacctggcgcagagaaagcagtccgtaccccggagtaattagaacagaggccgtccttcattagcgcttaaactgtgctgggggagagtacacataatatttcatttaagcctcataaaataaaaatagttatttcagagcagttcaataaacaggagcttcaatcaagggaataactatgtgtcatga

SEQ ID NO: 32922 - DNA, 1437 bp, Bovine  19866881081154
taaagaacctgtctcccaacgcagcagacataagagatgtgagttcaatccctaggttgggcagatcccctggaagagggcatggcaacccactccactactattgcctggagaatcccatggacagtagagcctggcagcctacagtccatgggtcacaaagagtcagacacaaatgaagtgacttagcaagtacacacatgtaattgctgggttacactgggatatggtatgcaaatgttcaattttataagacattgccaattttccccctaaagtgtctgttcctgttatgcatcttcaacactcgtattaagagcaccagtctttactctgttagaggcaccccaatggctacagaagtgagggcccaattggcagagcgttcactgccgaggtaaggtccccagtgccctccctgctgaccgaggaggtggagggagctggggagggtagaatacaaaggaactcaacagattgagggtccaagtggaggtcaccttccctctggtatcagtcaggcgcccagtgggttctcaggcctgagttaacacaggtccaggcagggccctcctgggtcgggagagggtgtggtggctcagggcaggagcataaacattccaggggtttcagggggtgacttctaccgttagttgggggcaggggaggtcagctaacagtgatgttcagggaaggtttactttatttctttaagtcccagatcccctagaagcgaatcgaggatggaacaggaaactcaggggcctggtcatcgaaagcatcagagggccccggggcaaaatgccttgcttagcatatccagagtccatctacacacctccagagggcctcccttcagccagggccgcaagaaggggaagcagagagcgagcaggcaggtggtcccaccagacccctggaggagagcagctcacccctggatccttgctggacggactccacctattcctctgggggaaggcacagcatcctcaggagagggaaggggtgcgggtggaggacggagaacctgagacgcttgtctccagtgaagcgaagcgaagcgaagcaagagcttgaagcttccccacagcgacgcagcccagatagccagaccaacagttctgtggctcccaggggggccctcaggggaagaggactggctggcctagtctggctttggcatcagctcctggatgctgagtctgggccaaaactgctcctgagggcaagggggggttgggtgacagcctatagctggcttctcctggaccgccaactgtttggcttggggagaggcccatgctaggtcagccccctggccccggaggcacacaacgtgcctttgctccaacgcaggtgtctggacgaggaggtaggtctacggcttttccttctggcttcagaaatggtctctgagagaaaaccagggtcctg

SEQ ID NO: 32923 - DNA, 1692 bp, Bovine  19866881133955
tgtgaatactacaccactttacataaggggcctgagcatggaggatttggtatccactggggtcctgaaaccaatgctccatggatactaaggaacaactgtacctacatttctggagttttgatcccattctcgaaggctagttcccgataagctttgcaggccatcaaaatactttctgtccccccagaggtcacctgtaataaaaaagagagttggggtagctatcagcatgcactttctgccttgatcttgagggtatctgatgcagagacgttcaagctctgggatgcacactttagagcacctgctgctgtctttcagaaggaaaatttgactttattggctaagcccaatcttggctcaggagaagaataaaactactgaatgatcagaagctccacactgtatgtgtaaacaaataaatgcgtatctgcccagaccacctgtgcacaacacacttacatttctgttgttcatccaattgcagacaggacagggcattttatccccttccagaagcatcagggttactgactgatttaaatttttaatgcccactaaagaatgtgaaactgggaagttatagctctagtcaactatgcaatacattagaagaccaagaagagacactcaggcattccagagtaaacttgtgattttgacaagtttgaaagacagaaaagcaaggagcctctgcttagtttattaacttacttatctgaagtcaaaacaaaagtcctaatgttcttaaagaaaaatgtcttcctgaagctaggcctacctagcccctctgacacaggcaaattttacctgagttgatacaaaaatactcgaggtcatttccttcatcctgtttgcctcactggactacaacctcatgaaggtggcgaccagtctgttcatgacaatattcctgatacccagctagtaaagctgacacccatcagaccatcagttaacatttcctaatgcctgatttgactctcagtaaaccacaaccaatacaggtacgccatacccatctggctatcctttggtagcttctaagaatgaaatcatttcaaaacacacacaacacacaaaagagccatagcattgagctaggtgaatatttccttagatttgtcatctccaaagattcatacaatcttagaaaacttttccattttataggtaagaaaactgagccctgagagactgattcacccaaagtcatccatcttttgataaaaagtaaacctttctatattttcgtatttagtgtaacctgatgagatgaaatgagagcagatgatggctgaaatttcctaaagtaatatccacatataagacaaaaataccataggctacaaaatccaagcggtcaggagttacgtggcagattaaaaagtcagtcattttgtaactgaggaagccgtcgggaaacacatgaccgtcatccacacaggcaggtactgagctggggcataggacccttgtttgtaggctcctgcgtttctgcttacagctgaggtcagtgctgcagatcgcagtgtgtcctggggtccagcataaaacctcagaacaccacatgaggaaccaagacagctgtgaaggaagtcaggaaagcaccaagttctcagtgcactgttctctcactaaggttcagcaagacctaagcagaaatatttccaaatccctagtcactca

SEQ ID NO: 32924 - DNA, 1275 bp, Bovine  19866881190865
cagtaactaaatataggagcagctggtgcgcacggggtgttgcagcagctccttagcacagatctcggggcttcagataaggtagaattctcattgatgagggcaggagccctgtcggagggctgtggtcagtgtttaagcaaaaatcatctctcctagcatgatcttcctttcatggaactgaatgagaacgggcagccagagtggtggtgctgacacgaagattttggttgactcaaattgtttgtttagtcagaggcccctcacattctagggcagctctgcctaaggggcttcacacttagtgaagagtgggctcatacctctctccatcactcatgtgtaactcagacaattctctatttttctttaaaacaatttaaaaccaaaaagaaaagaagtgcaatttggtgtattccacccacagccccccaacccctggcccaagcccctttctctgtctgctcctgttatatgctcaataaattcttgctactttttggtcaaagaggtccagtgttgggttggtgctgaaaggagctgacagtgaagttgggcagccttgtaggatcgcttttgggggcacactctagactctcatcatctcaagtttgttcttccttcaattctggggccctcctatcccatcttgggcctcatatgcatgtggtcctgtcaccctccggtctcagccctgcctatgccaaagagtaacaggccttggtcacctgacttacaagggggactgtcagctggactttataaggaattctcccttggtggaggggtggttttgggtgaaggaagcgtggtttcctacccagagagtggagtggtgattttaggcagttggaacctcttgggagtctagggcatatctgtgctgtatgcagagcatcctctggaatgtaagggccctcttctagtcatttgctttgacagccagattttacaggctcttcctgttcctgctttgaggtccaatctctgacccatattataggatgtctgagcctgccaccacctggtgaggtttttaatttgactagtttttaatcaatgggttctgactctaaggcgctactgctcccacctggtggcagctgatagaaattacaggtatagtgcctgattgaaagtagtcagtagtcaacctagccagtcccaccaggattagcacagaccctgggtaaacttggagatttaccttccctttaccttcttttgtgaggccagggttgccttaatgatgttccttaaaaaagccttcctcat

SEQ ID NO: 32925 - DNA, 1436 bp, Bovine  19866881305649
aagcatggtgtattaactactggacccaccaaggaaatcccatcctcacccttttttaagcctcttctctccagtgatccagtcttctttctctcgttttcctgcccctactttcttttcccctggggtcttgccgataaactcagcatcagggtgacaattaggtctgtgactaaaactgtaaccttccctccttactgtctcatgggggagggaattcttagagaccacccactctccaaacggtgaggtctgacccagcagagattttgtgtccccatttcccggtcgcggaaggaggctggcaaaggtgattgaggagaactgggagctggagaagtggacagggctttgaggctgtgggatggagggacaggtgtctctccgtgcacctggctgcaccctgcctcctccccgctgccctgccagttcagtgagtcacaggccagcatacaccagagtcctcacacctgcctggacacgagttgaggtcttggcgaggtcacacatattaaccctccaaggaagttggttgggctgggctgatgggtggattagcggctctgcaggccgagcctgatgtcgcctgggctctgggcccctcaggaggaggtgagtggcctggggccctccctgtagacttcctgggtccccggggaaggcaggtcaagggtgggtccttggctgattgcggatgggcacttcatggccctgtgtcttcccaggcgcaggttcctttgtgagcagcagaccagcctggtggctggcgacagaatacccgcgtctgcatgctgaggaagatgggtgaggccgtggccagagttgcaaggaaggtcaatgagaccgtggagagtggctccgacaccctgggtgagtgagggcatggcttttccagctgcagggccctctctccgtggtttatttaatcaggctggaaatgagatagaaggggaaggtgaaagacaccgaatcagtatgcacccttcggcataaagggcagtgttccatggactttattgtagttgtgctcagtttgtatatatggggtcccagcataagacatgtttcttggtatgggtcataatcaaagaggtttggaatgccctgagtaggggtgtcatctgctgggagcctgtctgcttcctcagactattgacagctgcaaatatgtatgtgcccttggaccaggtgatggtagacaacgctccaagtagccccaggacgtgcacaggtgcctcatgagtgtgaccttgctgaatcttcacagcctccccgtgatggatgttacccaccaggcatgactagccacagatttcagatgaggagatggagggggggaaggacaagtgggctttttccaggtcacccagccaagaggccccttttcactccacttttttaattgaatcatgtcatatatttgttgaactggtcat

SEQ ID NO: 32926 - DNA, 926 bp, Bovine  19866881398856
ccccgcttcctttcaggatttcatgaagccagcaaaaagggtgtccctttgctcttccctcacggcgcctgcctgcctgtgaccatttctgatcctggtttccggggccaggggtggcctggcgggatcagagagaagagatatggttcccagggtggatgggaggggcagagccctttgtggaactcagaatgatctgatcaggtcccagtcactgcggctcttgggcttcttgcctctcaattttcttttgcgttaacctgaggatgtaccataaatattcatagagcttcagatgttgggcaacgactcctcagccttccctcacatgctgctgtgccctggatggacttggctttctctgtgcctcggtttacccatctgtgtagaggatgtttccttaaggcttcttaaatctcagggcaagggatcatgtgtctgactctttttgtgaccccatggattgtagtctaccaggctccttgatccatgggacttctcaggcaagagtactggagtggattgccatttccttctccggaggttcttcctgacccaaggatcaaacccttgtctcctgtattagccggtgaattctttaccactgagccacttgggaagctcccaatatattcactttttttcaggttcttttcctatatagattattacagagtatcgagtagagttccacgtgctatacagtaggtccttgttggttatctattttattatatagtaaagtatgtttgtttaattccaagtgcctaatttatcattccctagcaccccgatgtttcccctttggtaaccataaacttgttttcaaaatctgtgaagtctgttcgtattgtgccaataagttcatgtatatcatttttaatttgatttgacatgtgagtgatatcatgtgatattttctctgg

SEQ ID NO: 32927 - DNA, 745 bp, Bovine  19866881488239
ttactgggcatgaggcattgtaccaggcatttgatgaattagtataacacaaacagacccacataactaaccatcatgcagagcaaggcaatatgcttgatgatgaacaagatagaggtatcctctaaccttttggaactgacaggcttagagtaaagagatgtgaaattataagaattattgggtattcaaagagagtttgaggggagaacttgtggtggaagcagagaatgacatttaagttgaaaagagataggaaacttgttggattccatgaacttagatctttctggagagctcagacttattctctcttctctgatgtctgctcttctaagtcaaacttcctgaatgctgacttagaccagtctgtagctgccagctccagagctgtgagtcctgctcagatgacaggttaccaggcaactgaccatcataggggagacaggtggggtggctgagccatgtggggtcattagtcatgcctctttctttcctcctttcttctctaaaatatcatcaaacagctagtcacatggactttgggacaatagaagcacaggtaatgccatggtaggtaaacccaagagcctggtagagactcaattttcaagagcagttaagtttcatcaaagcacccagcgttactggccacaagtccagaatcccatgtatgaagcagaaaagacacaacaggtgagataaaaggcacgtcatcacaggattttctcctgtacactgatgg

SEQ ID NO: 32928 - DNA, 1890 bp, Bovine  19866881495162
acccttgctaatgcattttctgtaatggattctctgacacttagccttggttttgacttgttgtggttgtgaggttgtgtccagagatggcactgggcaatcccctctggactttttgctctcaactagagactttgtaagacttccccggagggatgtagcgagtgtcagaagcaggcctatagctataaacaacttgctttaaaggactgaaatgatttgtatatgatagggacttataagaatatttgaacgaaacgagtttttaattgggtctaagatgatgcaataacgagggattgtttcattaactgtttgggcagtcagtggaatggtttatacatttggaatgcttgacttacgtgagaagcggatagtcagagtaggtatttgagatatgtctgagtgagtggtttcctttgcagtgacccttgcaacatctgtccctaagtggcagatgatggtttgaacctcaaaactgagtgtcgcagtcccctcaagcagatccacaaggactagcttcaggctgctttgcccaccaggaggcgagtcagcagtggaccccagggtttctggagacttcggaaccctagtcactgctctgacactgggatgctcagaggggatgtaaggcaagtaggaatggctgtgtcatcctgcccttcccaggcgtccttttccaacctactgaagcatgggaatctaggtgtatgagtttgctaggactgctgtaacaaaggactataaacagggtagcttgaacggcagacatttgttgtctcactgttctgaagactagaaacctgaggtccaggtgttggcaggactggttccttccgggggcagtagtaacaaagaatgggccccaagcctctgccctaggcgggcagttttctggccgtccttcgtgttctttaacttgtaaaagcattgtccccatctctacctttgtctctgtgtggtgttctctctgtttgcatgtctgtgtccacacttcccctttttataagtccaccagttacattggatgaaggtctcatcctcctctagtttgacctcatcttaactaactacatgtgcagtgaccccttttccaaagaatgttccattctgtggtgctgacagtgaggacttcaacatatgaattattggggggcacaattcagcataccacacgagggtagatagaaatagctgcagcatgaatgtagctactctattggttactgctgaaacccactctgttttgtgggaagtgatcagatcagaaagaatcctgtggttaaggggggaggtacccatcctggtctgacaggttaaaggtatagccttctagacatgggttagtttgtcttgagctatgaacatgacttgtcccctggggctgttggcctgaggtcacacatggcaggatgctggtcagggcacagcgtggactgtagttctagggagctctttttagtctgtttatctcactttacaagagtcctaagctcgtgcccttgttcaaattctagaaccaactgtctttactctttgctgagataaatgcaaaagcctggtgcctagtctgccattcgattcttcttccagccaagtgatcacttgatgatcactctgcaactacaaatttctcttctgtatcttgggagagaaagatggaattaacaaagacgggtgattcagcaagtgacatcatggtcacaagatagattttgcaaatgacaacaggaacacaatgtggtcctacaatatttttgtgctttctcttgaaaaattatgctggcttgctgtttcctattgctaactaaggcaaaagagtcttcgcaaggttgcattcaccttatattctacttaaaacggcagcgtccatgaccacctgctcgtccc

SEQ ID NO: 32929 - DNA, 1311 bp, Bovine  19866880364407
cagtatacattataatgtatataagatgcatatatttaacatatacctatagaacatatacattataatatacacatatgcattttaatataacaaatatttcaaatacttacatttcaaggtatctctacaggctcaagccacttgtgactaaatgaccaaagatgctgggaaaacacttggcctgcactcagacaggagcttccccagattatattaatagaagcgcctgacaactcaggggctgcctgcactgctgttcccatggaaaccgacattagatctcagaagcccaaagcatgaggccttaaactaatcattgtggcaaaaaaataaaaaataacaacccattttcttctcacaatgtggaaatggtgattaggttaatagaccctgatcccttttcctggggctatgctttttataaaaaataaggacagaaatccaacctttgaaaactttttccacacctgttcattccaaactacatcaatacccttcccccgctaacacttccaaattcaataggacccccatccaacaatttagtaggaattagaatactaaaccacacagcctggatctggatctgtttcttttgatcactttactacaagcattgaaagaggaaaaaagagaatacaaaattaagcgaaaaactgagacctctctggattaagagtttaactgtgtgtattagtttcttactctgcagttctaaatggaatacactagagtttatggataaaatatgattcataagcaagattaactagctagcatctgtactacataaaatgcaagggtaggcattcatttccattaatgctacttgtataaggaataaaaccagtcatgatggccatctggctgaccccaatttcacagactaaacaagagagaaatcgtaaatgtgtatttccatcaaaggaacagaattccctggagaaaaagatactgcaaatctaagagtgaggttgcagcattctttttcagtaaattgtggaaaacagaccaacttctagcgtcttatgggcaggaagcgaagactgaacacaaagttgcttgaatttagatatgaacaaagctcacagggacttccctagtggtccagtagttaagacttggcactttcaatgcagcggtcacacgtacaaaccctcgtcagggaactaagatctcatatgccacgtcgtgcggccaaaaaaaaggaacccacctcatatatttactgtaacacttaccttatctctagttcaatcacacatgtcttaacccaccaaaccaccctgtcctttgcaaacagcaaca

SEQ ID NO: 32930 - DNA, 1850 bp, Bovine  19866880395518
cccgaaccccccctcccacttccttcacttggctcagcctcccaagcttccacgatttggacataaacttctccccatccccagcaattcccagtgcatggatgctctaacagaaggctggagacagaacccacagctgtgctcctcagcatcaatatttttcttttctatcaacatatggaagattagacaggaatcctgttccttttcaatcttgagttactcacagatagattccctctgttttgtaatttccgggacattgtgcacatacaatatgtgtgtataaagttttggctttacctactcaaaaaatggataattttgcatttctgcttcctttcttcagtcttttccttttctttcactttacaggtatcattctcagaatctccctgtctattaaagaaaagaatccaaggaaggatctcttctctgaactgaagtttgtctgtaattctagagactatagttttagtctccccaccacactcctgacaagtcacaaaagaaagattaaagtcagctccagaggccggcaagaaatgtcccttcataaggttcatattttgtacaacctctgtcatttcaaagtaagcaactcacggatacccctagtctgcacatgtgtctttctcagttttggaagagctgaagtgttccactcagacattttattactgtatgcatgggatcacagtggtaagggtcaagaaacaagaccatcatggttctaagccagtccctcaatacctggatatattacttatgtagtggtcaagagcaatgagcaggcagtgtaacgtaacacctgtgttacatgtgcattcgttcatacatttccttttgtcatgtcttagctgctaatccagcaccaaccaggagaaggcagtacaggctaaacaacagaagctttcagttttctttaaagtgaaacagaaataagctgatggatattctttataatataaacctccatccgtgctggggaacaaaggaaacttctccaacactgtcatcacctcctgcacatatcttaaccctccctcacctctgtcgttctattttctccttctaccatctcctccactcttcctagtaagttaaaatacacacaatatattaagtggaaaaacatctgaattgcaaagtttcctaatcctgccttaaaccctcaaatttctctctccagcattattacttaaggcaaggtttcctttttagatggcatttgtgaagggcccatgatgtttttctatgacaaggcatacttatcatgagtccccaaggccacttgcttcattgctcaaatacagaaaaatttcatgcattgaaaaaagagctatttttttttcctctgaatatggaattctcttccctaagaacactaagagtggctgaaggctgctcactaaaagccagaaggaggattctaaaggaccctcaacctctggcaccctgggaatccaatcactctaccagccatgtggggtgatggagggggaatcccctcttgtgttctgcagggccctggggagaaaggacaagtagccatctggacatttaggcgagtccgtttcttctactcagccaagaagcacaggcttcatcaatcattcagccacacttccaagcactcttgtttgggtgattgggttttctggggtggttattaccagaatgctccgcgcaaaagtatgaagttgccaaattgggcctctctgccttccatctacaattccttctttaatgtcacctttatcctttcccccaagggcacagcgtctccacaccaacccgcaccagccagggctctccttggaaccctcccactgagatgttccctgtgt

SEQ ID NO: 32931 - DNA, 1750 bp, Bovine  19866880413847
tttgtattatttctctgtcttcggtaaggttttttttttttttaataaatgctagatgttttagagtttggattcaattcagatagaaggcttttcccacagactcttgctcatccacttcctcccttgagaatggtgaaaaacagccctctctcccatcccctgatagggtgagggctactattatcttttctctcctaatagtcaatatattgagtatactgactccctcatctaaaccttgggtaaaggggaaagcagtgattgcttttaattggatgattgctaccctatgcttccctttggtgggatccccaaaaagacaaatgaccttttagactgctgctactgttgctaagtcgcttcagttgtgtctgactctgcgcaaccccagagacggcagcccaccaggctcccccgtccctgggattcttcaggcaagaacactggagtgggttgccatttccttctccaatgcatgaaagtgaaaagtgaaagtgaagtcgctcagtcgtgtccgactcctagcgaccccacggactgcagcccaccaggctcctccgtccatgggattttccaggcaagagtactggagtggggtgccgttgccttctctgcctttggactaaaggtcccaaagaaaaggactaaaaaagcctataatgaaggctttaacctttgataaccaatatatcataatacgacttttagccctgttacctgctaaacgtgtgatttgagcaagctgtttaactcatcagcaccttatattcctaacctatgaaattcctgtggtcagtgttatgataaataagagtaagtaggttattattttgttatgaaagtcacacgtaatatttgtcccaaagagcttagcatagtgttggcgcatattctgtacttaatacatattagctgaagaaataagcacaaaaatactcccaagagaatgttgtacttcaatttatgaaaaattatacttgttatgtctccagaattcttagtgcttttgcttttaccccataaagttgctgtagagaggaagtggtccctgttcctaccatagatatgagaggatgttctatcagtggagtctgaggttagcctgagtcctgtcatctgctcagttactttagtaaaagcttagatcgtcactgtactaattcctttatcgctctgagtggccacgcaccatcagtgtgtcatgtgaatgcccctgctctaaaagcaagtcccccaaacagggagtgatggccagaactgtcattctgagtcagggaaggcttcagaccagaagaaatgaagcattctatacctgcagctgaatgggtcatctgaaaaggtggacacctgaaaaggaaggtttgagtttctccctcatcttgccaactttttagggaaagtcttttggtaactcctttctcatccattcattcaagtttactagtcacgacacgtgctgcaaatcaccagttcctgggtctcaagttaaatgtgatttgtaaataatattggcatattccactgtgagaaacccttgatcttgtatcctttcagtgtttttcatttaacacattttatttagagagatttggaagtatacatttaaggcaagtgtctggtgcatttaatagatttatagagccagctgcctgacagtggtgtcaaaagaagaacccatactttggatgatgctagtagagaaccaagccaagtcgttgcatagttctgcttttcctttggagatcac

SEQ ID NO: 32932 - DNA, 3565 bp, Bovine  19866880460662
aaatggcaacccactctaatattcttgcctgggagatcccatgggcagaggagcctggcgggctactgcccatggggttgcaaaacagttggacacgatttagcaactaaacaacaacaaaaggttcgtaacatctcattttgtttcaaaatgatttatgatttgtcagggaaaacatgggttccctttcatctgtgttccatggttgtgctattaatagttctctctcccattccattctctgtcatccaccaggtcaagtaagcagatttcttccccaggctccttcattctgggaaatgggtggggaaggatgggagatgaataggactttcctcagagacattgcaatggcaccacactccaatattcttgcctggaaaatcccatggacggaggagcctggagggctgcagtccatggggtcgcaaagagtcggacacgactgagcgacttcactttcacacattggagaaggaaatggcaacccactctagcctggagaatcccagggacgggggagcctggtgggctgccgtctatagggttgcacagagtcggacacgactgaagcgacttagcagcagcagagacatttacacttgaccttgaatgatgaatgtgatttccccaggtggaaatggggtaggagaggggacactgcacatcaagacaacagaattatgagagtgctatgttccagaaaactcaactctctgggtgtgcctggagactgtgagtgggggatgagggaagatgtggtcagaatggttacctgagctcaaaatattgaggactcttttatgccatggcataatatttaatggcaaaatatttaattccttcttgtcttctcttttgaaaaaatgcctggctgagacttaagagaggaaataagaaaaacaaaactgggttcaaccattcccccattagaaactgttctgagcctcccaaggagcctggcctcagaacattcttgtgcactgagctcccagaatcgtgggtaccaatgcgccacggttaccatttcaggccctggaaaagggcaaaagctgtgttctgcttggtaccgtgttattgccatgaaacgtgcattctgtaaggaaaacgctttgctgtattcccctgccttgcggaccccatgctgagcttcagatgtttgtctttcttggatgttgggcttaaataaggacccctatggagagtgaagccacattcagtcctcagcgcaacaattacatattctatttattccaccagtacacggcccccaaagttgaaatccactcaccgatgctagtggctgctgttaggctctacctagtcaggcatagttgctgaatatgcagccgaggagagaagcaacggatgggggtgacaggaggactttaaaggggttcctgcccttcccctcctcccaacaggacagtgggcatccttccacgatactaaaaccctcttctgtttctgtttctagatccttcagccccaagagcaccccagcaaacacaggataggttttaagtgtctggcaaacctaagaaaacaatcgtaatgtaaagctgattttggcaaaacaattacatacaaaacacacatttaggaatgagcaagaagattcagaataaatactgacttgcctgtggcagcatagaatcactcagaaggcaggaaaagcaattttctgatacccaaatcgagacaggcaaccggaacttgagctatgggcatgctgtatacatcagggctgtcatggaaagaggaggtggaggagaggaagtaacacttagaaccagagacggagtctgcactggctctccctctggacagctgtctgtaggtgaaacagactgtcaaatatgtggactcccttagtactttatatatgcacatatgcagagacagtatcatttccactaaatctctttacagacaaatatctagttaactgttttgtaggataatatccttatattaccaagagagaaactggcaaccaagtggcaaaggaactccctacaattcaattaaaaaatgcatgatagaaatcacactaaaaacatgtttattgattctctacctaatgagccctagatatatcacatgcctatgtaatatgtaatatacgccctgaaaatgtatgctgctgtggcggccactgctgctaagtcgcttcagtcgtgtccaactttgtgcgaccccatagatggcagcctaccaggctcgcccattcctgggattctccaggcaagaacactggagtgggttgccatttccttctccaaggcatgaaagcgaaaagtggaagtgaagtcgcttggttgtgtccgactcttacccaccccatggactgcagcctaccaggctcctctacccatgggattttccaggcaagagtactggagtgggttgccattgccttctccggaaaatgtatgatgtactactaattattattaattaaatgcagttcacagtctgaaggttagtcaagtacaattaatactaggatattacatgaggcccaattctttaatatgaattatcatctaagcgtaagaatatacaatttgattgtgaccaatgtttgagtaaagtatttaccatcttagtgcctctttggaatatctaaatatgctggaaccctgatcaactctttacctgctaaagttaaaatatttgtctgtacaaccaaatagcaaggggctcttcttggtagccaaaagatctatgggctcctgcaacaagccactcatgttaaacttgatatttaaaaccatctatacacaccatgcctgcatcagagccactgaaaattgctaggttggtgaaagtatgtcaccataatcagatctcaagtggacagtcaaaactgtctaccacctgtggagaaccgtgagggacctgagaaattacccttcccttcttacagcgttaacctgtccctgtttcatggacgctgcctggagacgtgagattcaagatcagagaccaaggactttatatgataacaagagcaacagtcagttcatcagtatttgtgctggttccctgagctctagatctccaaggcaatgtggaagggccaggtggcatctggtacacacaggtaggtttcatttacaagacagaaaacatgcgttagggaacctgaatattttataacaggcagtaaaatctgttggacctttgccccagaaggtgatactctctttattgttctgaacagtaagtagacaggctttggaggaagacactatttctctctcccaaggaggtttactctacagccctgaagaaaagtcctgaaacaagggagttagcgattctgactctaagatgagcaaaaaggcaaaagacctgcagagacctgtcctcgtctcttcagtgtgatcctcactttcatggatgactgttcccaccttctctcccttcagtcacctgagctgccgctgccgcagcacacaccctctgctccttcgcttccttctagtttgggtttgctcctttttagtttcttttcctggcttctatttctctgctcatctgtaaatgttagagggat

SEQ ID NO: 32933 - DNA, 2501 bp, Bovine  19866880471594
ggcctggcggtgtcttaggttggggttggcttttcgcgtggtagatatcccacagtctggtttgctagcccaaattatttcgctcagatagcgctcagggtattcaggccagattcttactctgagcgatgcagcccgcgccgcgcctccctgcccagcccccgcttgctaatggcatgtgcaggcatctgcgctgcttctccgctgggggagttactgtagggctcgcaatctgcgagttttaattgtttattttttctccctgttatgttgccctctgtgcttccaaagctcggcacagattgggcagtgagaaggtttcctggtgtttggaaacttctctctttttaagactcccttcccgggacggaactccgtccctccctcttttgtctcttttttttgtcttttatattttttcctacctcctttcgaagacttgggttgcttttctgggtgcctgatgtcctctgccggcattcagaagttgttttgtggaatttacttcgatgtttaaatgctcttttgatgaatttgtgggggagaaagtgttctccccgtcctactcctccgccatcttggctcctcccatcgggatagatttaaagaaacaactaatttgtcttacagaagcattacagacattttcaccttcttgtctgaaacttgattattctctccccatgccttgatcaactgctatttgtaccttatgataagcttgtgcagaactgtttggtgccgaaatcagctaatgattagcttgatccagttcttcctcaggtcagccattttccatgggtattagttacatcctgaggttgcattaaatcatcctctcagtacatttgaccactgaggtcagtgttatccttaagatgtatttacatgaggtagctgagtcttaaccaacattaccactattacactgtgatggtatgatcctgacaccattcagttttgttccagaacaaatgtaagaatgatagagatgtttgcgttatgcatatgcaatatattattaaaaacacatagcagacttccctggtgctacagtggctaagaatccagctgccaatgcaggggacatgggttcgatccctggtctgggaagtttctacacgccatggagcagtgatgtctgtgcaccataagtatggatccctctagagccggcgagccgcaactactggagcccgtatgtctggggcctgtgctcctcgaagagagaaggcaccacaatgagaagcccccacacagcaacgaagagtagttcctgctcactgcagctggggaaagcccatgtgcagcaaccagcccagtgcaaccaaaaataactaaacaaataaagagaagaataatttaaaaagaacagatgccattacaattggccataactcatatatgtctggcttcccagttaactgaggacaaaataaatcaccccacctcatctcacaggcttgtgctaagactgctttccattttgtattgttacatagcagagctcacctccctcccatggggaggacacagggtatttaaaatagtttctattcctactaactatatcccaggatatgtttgattttgacctgttcctggggggcaggagcaatcatagcatattgatgtaaattatagtaatttccaagagaatttccatagacttggaagtctatgagtcccataggtgtgccccttgagccccagcagctaggattgaggaccactaccccatggccactccagcctacatttgtattataatagtcaagtgacctcattaggttaacatacaggcctctttcatgctgagttccagcattccccagcattatttgttgggtaatagcgttgattctcagagaaggcaatggcaacccactccagtactcttgcctggaaaatcccatggatggaggagcctggtaggctgcagtctatggggtcgctgagggttggacatgactcagcgacttcactttcacttctcactttgatgcattggagaaggaaatggcaacccactccagtgttcttgcctggagaatcccagggacgggggagcctggtgggctgccgtctatggggtcgcacagagtcggacacgactgaagtgacttagcagcagcagcagcgttgattctaatatcccttaaactcacatcactctccagctacttcccatttctctactcttcctcacagcaatagtcctaaaaatcgtgcttaaaatatatacttacagtcttcatttcctaatcttgcacttttttcttaacttagtatacccaggaaaacagccgttatcagtcagtgttagtcacgcagtcgtatccgactctctgtggccctgtggaccgcagcccgccagtccccggccgtcggtcacctgggccctggtgccatcctctgaatatcctccagtcttgctctcctgcatcctagtttctaaccagcagccagagaaagttttctaaagatagtcttatattact

SEQ ID NO: 32934 - DNA, 1848 bp, Bovine  19866880492771
agttacattaagtgaaggagaagaatattaatagaaggaaggtgaagtacaagtgagcaaaaatccatcttccaaattgcagagtgaactgtttaagtccagtcagtcaagaaattaccaaggtctctaccaaattgcctaaaataagaacataaccttaaaagatgcctctaggagtaagaatggaatggggagtatggagtagagcattctggtttctcatcggcagaattctggtgctacctggtgtgtgtattggcatgcaatacttttataatagtagttatgtgtgtaatacatttcatagtaagtactgactgcattcaatttttgtgtgtgcaacacatgaattgcattaggcactactacaaagtgggatccttgtttatttcatagactgcataacttttctatatagggacctatagaaatttatatatatatataaaacatatatattatattttttaatatatattatatatcctttacatgtagacatttctcttgagttatagttttcagtatctgaagtttcttctttttctatcaaatttcaccattagcaattcaatcatctggattaaatacagtccttccctatgtttattttttaatgcaaacatctataaaaggtataaatactgggaacctaaggatgaggtgatattcaccaagaaaaggataaatggttccaaaaggcagggtgaggaactataaagatattttgcttacttcgctacttcaataaggtctttcatcttcatagactcttagttttcgatgcagtaagtacttgtcttatacttacacagaaaaagtgaaaagttcagaaagactgaactgatacttaaccccatgacctagaggacagggcatgtttaccaaaccagtctcttgaagttggaaatttaagaaacaccgaggggccgagtgggaagtggttaaaatctctaaccatgaaacatctcagtcagtcagaatttgttttgacaaatccacaccctgtggccggtattaatgaactagcaattaaaccccaagcctagtcaggagctgaaggatgactttaggactaatgtttactgttccaggccatgtgcaaacctttgaacctttgtgaagtgcaaatatgcaggatttggtgtagagcatcaggccatttcccactgtagggctcaaaacaaaataaatatatgggcaaaggaaatcaataactgatcaagtacaatgtcattacacagatacagtttaagaactccagattatcttaatctctgcaatataaacacatcctttatttaaagatctactctcccaagtactaaatacttgtcatattggattaggaaaataaatcaatcagatttggtcatgggtcaaagataacatacaattattcaggttttggccatctttattttgaagaagttgacatctttgagggtgggtacatggacactatattggctgaccctcagtgtatatccagttgtttgaggagatagcagaagattatggagccatctcatgaatacttccagggggtatttgatgtcaatctattcatttatgctgaaaagtgtcagtaacgcctaacgcagctcccgaaaaagtaccctcaacccccaaatcatctcatattctctttataatcaccaaaaaaggaaagtctagtttttacttatttggcatttctttttttgattttttgaaaataagcctcaaactcattttaatttgtattaaatatcactgacaaagaacaatattattcccctggatctcacaatcccatttcttttgccattttggaaaatgtagcaaagaaatagaagtgtttttaag

SEQ ID NO: 32935 - DNA, 922 bp, Bovine  19866880534347
accccatcttgccctgtaggacaagagatgtgatgaaagttgcaaaatagtaatttatggagaaagcctgtgttccatgctttatgaaagtaaattgtagaaaattaatgttgtgacaagatgattctattttgatgaataaaatcattgaaaagctatcaagctccactgtttctctactgagggaatttctttctctttattctccatttgtattcttggctttcttcccaattagtctttagcaaagagtgataattagggggagagaatttttgacctaccttgtgaacaataaaaatacttaccacccatttttccatttgctaattctatgtgtactaatattctgtgctttcaggaagaaaactccatacctctgtgacctctgcttagtgaagggataatgaaatgcaaaaataaaaataaatgtaaaacaattgtatgagcacccaagaacaagctccaaaagaaggacagttgcttattgcacatctgatgactgggttcagaaacgtcttatatgctaaattcagtgtataatttcttatgtcatttcaaattccttagaataaaattaaatttttatctttgagtgctttgcataggcaatggtctcacatatttaaaaaatctgaaagagtaaatgagtatatactaatatatactagatgtataatatatataatatataaatatataatatatactgctgctgctaagtcgcttcagtagtgtccaactctgttcgaccccatagacggcagcccaccacgctcccccgtccctgggattctccaggcaagaacactgaagtggattgccatttccttctccaatgcatgaaagtgaaaagtgaaagtgaagtcgctcagtcgtgtccgactcttagcgaccccatggactgcagcctaccaggctc

SEQ ID NO: 32936 - DNA, 1863 bp, Bovine  19866880540327
tagtcttggaaagttcagatgggatgtaaatggacacagggtgcctctcccatggtgcatgtgtgcccctggtggacagagcaccacgtgcacggtgaagaagactaggcagtcattctctctttgagtttcaaaagaagccgtttacttgggacttccctggtggcccagtggttaagacttcgcttcctaatgcagggggtgccggttcgatccctggtcggggagctgagatcccacatgccttgcagcccaaaaaaccaaaacacaaagcagaagccatattgtaacaaattcaataaagacgttcaagaaggttcacatcaaaaaaagatctttaaaaaaaaaaagccagttactcttagcgactcaataccttcctctctgaatctgaagagcaagcatgatatttcccacctcagatggagactaagccagttgaccggccgggagtcaacagaaagggtacacaggatcttctttaggccagatttaccgtccgccttcaataagtggttcggcgtgcctgtgtgacatggtttccttcctgtaatggttcctgctggcaaatctgcgatgggtttccctatgcagaccactcatttcctctaattgcttccaatgagaggtgggaggcaggagggtgggtgcctcgctcagggctgctggtctccccatcagcctgaccatccctagaagcagccttcatgctcgacatggtatttgggggagaaagtcaggtcacacattctgcgattcaaggataaaggtggcttgatccctaaagatctgacctccttcctttgtttttgttttgagtttttttttttttttttttttttaatttgcccaaattaggcaagttaaagtttgaaagtgttagtcgcttacttgtgtccagctctttgggactccatagactgtagcctgccagcctcctctgttcatgggatttcccaggcgagaaaactggagtaagtagccattcccttcaccagggtatcttcctgtcccagggataaaacctgggtctcctgcattgctggcagattctttaccatctgagccaccaggaaagcaacttaggcaaactttagtttttcttaagattttttttatatggaccatttttaaagtctttattgaattcattacaatattgcttctgttttatgttttggttttttggccatgagacatgtggaatcttcgctccccaaccagggattgaaccacaccctctgcactggaagacaaagtcttaaccaccgaaccaccagggaagtccctttattatgagtttttaaggaattttctttctgatgataagaataatttatactcattatttcaaaagatgaaaaaatgcagaaaaggttacaaaaggaaattgaaagtaccctccaacctgttaatctagaaagaatcctattaaaaattttgtacctccctatgttacttttaaactgtcagttgagaaaatatcatatatacagatttgtatgttacttaactctgtttaacataaaatcaaaaaacctaatttttgaaagctgtctaaaataccattccctagttatatgttttggagtacatgtggtttttatcataaataatgtatcatgacatcctataccaatttctgtctttatttctgatatgattttaggtttgagtcctagaaaaaatactggactaaagggtctgtgaccttttaattttcctggaagattagtaaaacttattatacaaattttaaatgtgccacatgacacccttacttgcaatgaggattatcctcttggttaatatgataagtgaaaagtggcattttagttgttttaatttgcattgctttgatga

SEQ ID NO: 32937 - DNA, 1508 bp, Bovine  19866880642177
tgcatgggccccgcccccaccgagtctcaacactgtgctctgcagggcttagccttcctctggtccagggccgtcctgctggctctgggaagttgtctggtctctggtcaccactggcccaatgcttatatacacaccgtgcatggaaatgtttgttactttttgttctcagtctcatctgcttctatcttttttccctcaagtggattgccctgtagagctgggagtgaatctgtttttccctttatgactcctcattcacttcctgttacagatccctacacctggttactgctaaataactgctcataagctgaatgatcagcccgagatacaaaagtacgttgctacctggccgattagtttgatcaagttacagataacaatgagagtagcagctaatatttgcagagagtttacaatgtggcctgattaagggtttttcatgtagtagtatagctcatttagtcctctcaacagccctgaacatagctattatggatttcatttttccatggggcaacaattgcttttcaggggtttgttgttgtcattggtcagttgcgaagttgtgtccgactctttgtgaccccatggataaagcctagtttcactactgtaagagcagaaatgtgcagaagtcgttttgctgtgctttgaaatagctggggccgagaaaataggattctatctctgtgggttggaggttgatttagcagacatatgtaactgaagtattctgcttcttagcagaactgtatcagtatcttccacttaactctctctgttttagatcctgggaaaggccagggcctagagagtgtactctctactgaagaacgggagctgtattttgttgatactcttcaggaacattttagcagagcagagaacgtcagtgttgaattttccatctactctctgtttgatcttggcagatgacgaagatctctgaacctgaatttgctcatctgttgagtagggttcactgtaaccatttctcagggtcgtgatgaagtttaagtgagatgctgtgtgtgcaaaggacttggttagtgaggatggcttggagcccacactcaataaaacttggctgtaactatgttgctggcattacctaaataagccataggtttgaaatgagagtcaaaagtcttgaactggtgaagtattctgctagattgcagccttcccgctgcattacacagcagtgaaattgcttgttcagagacagcccagaacagtaaagaaaaaagaaaagaaaacaaacccaaaacacattctggaaaggctggcgttttatacaacgctgtaagacatttatagttattgagccaaaatttccactataatagaaaaagcagttgcttttaaactggctggtccaatttagcaattatgggtgagttaaaatgtgggccatttgaattggatttggaggataaagtaagattgtatccttcagtggggagtactcacagaggagggagctgacagagggaaacagc

SEQ ID NO: 32938 - DNA, 2613 bp, Bovine  19866880652503
ttcctggaggtcaaagtgtgccttcaaccaaatcgatacaggaaataacggcttctgtagttcccagtcttccagtgagtacacaattaagtgaacataaaaaaagggggctgatttgggtgtaggtgagagcacactgttgtctttttttctgcttagtggctgcgccatcattgggatagccagacctggtttaagaacattccctcttcctttctcttcctctccatcagcagtttttgatggctcatctaatgaaggatagatacgtaaagtcatatagtcagaggtaatgtcatgataagattcttcttttccccaatccctaccctgtaatgtgtagggttcttccaacctgagctcaagatatattttcctccacttggtggcgctgtgcacatatgtgcttgagggacagggtccagcctttgccagacactctccgccagctgttgagtactgagtgatttttccagtacagcattctgtctttatacagtgatgacttccccatgatggcaggatagtttttcgttagtgggcactgtgcacgcctatagcatagagggcgagaatatgacatgtttgtggtctcagtttcattgtcaaccagctgtgtgattcgcatcaaattattttgctgtgacagttggtgccaaggtagagtaggggagtcattcctgtttagtttatctctggagtttgctggaggacaaacataaaattagatgtgaaagtgctttgggaatttaaacaatggataacagaatgctacttgaattctatccattctcccaatatgcgggctgctagtgtccagtcttctctcaccttccaatccattttccgcgccataatcagaatgatccttctcagtttatatgtgatcatagccatccccttactaaaatgcatatgtctccctcccatagaatgaaagttgcaatgccttaaatgtcttataaagcccttggccataggcgctcttcgtctctggccggtctgtctgtctcctgatagattaaacagtgcattgaacactgaagcctctcttgctcttcagattccagtcacgtggttctcctggtctgaaagaggtttctccattcttctctaggcgaactcccactcattgttccagatttcacatcaggttagtgtcacagggagctcttccgtggtcctctattagaagcctctgattggtgctcctacaaatatgtattgtcctcagatgttttatctgattgcttttcctccacaaaggcacattcataagctggataactcagtactgtaagactctggcagctaacacgatctcaagcccatacaagatactcgagaaataatgtgttgaatggccaactggatggtagattagattcctaggacggccaaaacaaagtgctgcaaactgggtgtcttgcaagaagataaatatattttctcatagttgtggaggcctggcgtctggaatgaaggtatcagtagggccatgtccttctgtgcctctcgcgagcttctagtcgtggccagggagccttggtgtttatctcatagctgcatccctccagtctctgccttggccttcacatggtatacttcctcactgtctctgtcttcacatggcattttcctttttctataaaagcgtcaatcttgttaacttcaggccaaccctaatgacttcatctaaacttaattgtatctacaaagatcctgttttcaaattagatcaccttcttagatagcagaggttagacttgcctcatatcctttgaggggacataattcaagccataacgaatcagaaaccaattaattagtaattaattaatacaggttatagacagaaaaggcttcccctatgacaaatatatatatagatataattaatatgctggcttaaataatatgtgtataatggatatgtgtatttgtgtgtgtgtatacacacatgtgcattaaacattctatattccaaaaaaattctgcaaggctcattaccccaaataagaaatacggggtgatttatttaaggactttatagacatcagcttttttcagatgtaaatttttctggatgacaagaaatgatttctttgcctgcttttagaatcctcaattatgataatccatcaccttgtaaattctgtgttcttaccatttaaaaatttaagaacccaaagcttggtagtaattttagttatacagcaacagcctaccaggctcctccgtgcatgggattctccaggcaagagtactggagtggggtgccgtggccttctcccatcatttattcagatttccaaattaagggactttctgtggttagaggttctcctctttgtcactctccggttctgcagtcctgtcgtctgtcctttcctgtttccttacagatgattcgtggatatactaggtcttttccctaagcctcagattacgagaagcaaaattaaaccaaaaaagcaaatgatctgttaaattacgtcctaatttacaacatttggcagtgcaaaaatcaagaagaaaatttcacagatatcttggatgaagtgccttttttcagattaacattgggtaaaaggaagtgaaagatttcttttt

SEQ ID NO: 32939 - DNA, 1019 bp, Bovine  19866880691471
taaaaataagccttacaccccaactgcaattggagattcaataaatcacatccaaagattcatttcaagccaaagctttttccctgactaggagaccttggattgtataagatggatgtctctattaaggcattatcacagagacaactgtacagcaatgtgttaaggagaagagtaagagaataagacgtgccctgcgagaaagtatcaacagactaaaaatacagtcatcattgtcatccttttaaacagtatgatctgaacgtactcaggtcagaaacacctcctagctgtcactggtaagcatacagatggcctctgagtatatgcatcactaaagcaccgagtttgcatgcccatctcaaaacaacatagccatggggaactacgataaagctgaaattttcttatgggaggagaggcactctcagctactattctgagtcttccttcccacctggaaaatattccaaactgccaacatcaatctcagaagaaccagtccttttaacaggcagagaatgcccaaaattaagcctgacgcttgctccagatgtttctccttgtcattagcaggcaacgtttcacattttatgactattacagtaataaatcaattacttctcagaaatcctaaaattgtttcacatctgtcttaagaactgtttgaagctctatgacattctgaacagagctcaaagttctgtgctctgtaatttcccctgaaatccgaagctctttgagaataacaagcaaacgatatactatttttaaaatgaatctttgcagaggacagttgataggttttgactgtcttgtattcatgatacccaaatcatcacttcatgcatcccttctccacttagtgtttcaggggaagctgaactcaagttccagctgtgaaagatggaggtatctggggtggaagtcttgggcttagactaaccagattcagcccatcactaaccacagtcatccgttcatagacaggcatatgacctaaaatggcccaattagat

SEQ ID NO: 32940 - DNA, 1503 bp, Bovine  19866880743959
tagcttctttgaatgagcttgagtaagaagttgtccatcatgtttcttgagcctcagatacatttgttctagaacttctaaaaaatatatatactgtcaaaatcttatttcccagtataaggattaaatagttggggttctattttgttttgttttaaagaacgaggtcccttttttgtctgaaaaggttgtgatccacctgaaaagttgtctgtctttgagacaatttaaccctagaatcaaaccaaaaaaaaaagttcaatttattatgactttcaagaaaatcttgttgaatttcagaattcctttatttcctgatctctcccaattctttctaaaaataacatatctgctctaaaaacagaggacagataatatgaatattgagcaaaatgaaaaggaattttaacttctttatccttctagactgaggcagatgagctggccataaagcaaaagggagttcttttggttcatgtgccatgaattggagtgtggatattaagggtggaaacaggctattagatcatccattcactttactctccaagcagcaattaaatttgttttctttttctctgctcactccttgctcaaggaaaaagaaagaacagcattttagcttcttacagagaactcactgaacgtggaacacttttctgtccacatgtatggtggctgagtggaggaggcaggaaggaaaaagggtagtggggatcatagttaatctacaggatgattttggctattccctttggctaacgggaacagcttggcagtcagatgcagctctcaaagaaacaaccgacatctattatccatcctaagtatgtgctcctacttccagtttttggttgtttgttcttgttttttaatatttttttggcgtggaccatttttaaagtctttactgaatttgttacaatattgcttccgatttatgttttagttttttggccgcaagacatgtgggattttagttctctgaccacagattgaactagcgccccttgcaatggaaagggaaggcttaaacactggacccccagggaagtccccctactccttgttttaatgcacagtgtactctgagatgagagtgctgttatcacagtgctagtaacagatgcaccatgaattgctttccaggactcaagatgggaatgagaaaactaactgcccccacccgcccaaaaaatatatataaaaccaaaaacttagaaaaaaaggaacaaaacaaaccacactataactctagccttgagggatcatctcctgaaactggtgtatgaaatcgctcaactctttttctcagatagagaagacagatccactatagtcatgatttcctgcctttctttgagggatttctctctttgtcatgcacttaatcttttcccttatctgaatgttaactctgtgtgaaggtctccctattttccaagttctagagatggagcagaacatcacagagcttgatgagtttcctgttagagatgtttt

SEQ ID NO: 32941 - DNA, 1812 bp, Bovine  19866880793663
cggaaaggagatcattttgatagttatattctatataaatatttttacaaaactcagaatttgaaccatagtttccttcacttatgctgcatacatttatgtgaatacatttctttcaatttcacccttcagtggttcagttattcaaataattcatgcatgggtttcttaaagtaaacacatttttaataaggtctttttgtgtatttaattttcattcagactgtatttacattaacatactctcaaggggcgtttttgtgaattgtgtgatttttttttttttaactatttggtgtgtttttccttttcttcctgtttagccagttcctagtccattctgaaggagatcagccctgggatttctttggaaggaatgatgctaaagctgaaactccaatactttggccacctcatgcgaagagttgactcactggaaaagactctgatgctgcgaggggttgggggcaggaggagaaggggacgacagaggatgagatggctggatggcatcactgactcaatggacgtgagtctgagtgaactctgggagttggtgatggacagggaggcctggtgtgctgcgattcatggggttgcaaagagtcggacatgactgagcgactgaacagaactgaactgaacttggaatgtggaggaggaaggtccttggatagagaggaaagcaaagagtgactagagattttgattcacaggggtaagtctgcttatccagtgagctttccttctgcacctacagggacctatttctaacacttggccagacaaggcaactctctgtcatttagtcacccttcattttgcaataaattcactctcatcccactttcatcctcgtcattactgttcctcacctttttctccctctttctgtacccacggagatggtggccatagactacaattatcactctggcatttttttttaagtgctaaaccaaggtatttgtagtctttcttcaactctcagcccctctgaaatacctctttcctctgctgccatttacagaaaagtttatctaaaaatttaaaaattttctacataaacttttcaattttttcctcatattcattctgtttgtctaaaactttgtaatggtgtgaaatagtattcgaaaagaaaacatatttcactgaagaaaatatacaaatggctaattaacccatgacaagatgctcaatatccttagtacctggagaactgcaagtcaaaaaccacagtgaaataccacttcacatctactagaacagtcctaatcaaaatgacagataatagcgagtgtccacgaggacatggagaaattgaaatcttgctggtgggaatagaatgtgatgtagccactttgaaaaatagtctggcagtttctcagattaaatgtagaattaccaaatgtcctagcaattctagtcctaggtataggcccgatagaaataaaagtgtatgttcacacattgatgtacaaaacttgtacgtcaatgtgtacagcagccaaatagacaaaaaatggaaacaatcaaatgtctaccaagtgatgaatggaaaaataagtgatgaataaaaaaaatgtggtaaaaccatacactaaatattattcagtaataaagaaggatgaaatactgatacatattacaacatggatgaaatgttaacatattatgctaaatgaaaggaaccagacccaaagaccacatatttaatgtgctgtaaaggcgaatctagagaaagagaaaataaattatcggtttcacaggcctggagggtattaacgatgggggaaagtaagaacagtt

SEQ ID NO: 32942 - DNA, 1312 bp, Bovine  19866880796824
tgaaaatgatttgatcctcatctttaaattcaatccagcaaaagagatggatacgcgaatgaccaattccaatacattaccaattattattcattcaccagacatattgagagcttactctgtgtcaagctgtcaggctgttggcgaaacaaggttgaaaagaaatatgcttactcgcaaacagatcacaggataaaggttaacatatttgcaagcaattattgttaaaatacatggcccaggtctcacagatgtaagaaataactgcctcatataattctttcagaggccaaaaaaaaaaaaaaagaagcctcataaagtcagtttccatcctcaagaatattttgtggttggtctttttaacaaatgcaaggagacagaccattttttccagaatgaaacctagtacaatataaaggggaaattatgatcaagaaaagcaaaaggacctataaaatacaaggaaagaaatgtcaagaggataaaaggttagagtaaaagcacacttaaacttttaataaggtcgaacaggaaccaattaaaaacaataatactttctctattcagttccacagctaaagggctgatgggaccttgccaggtcacttggttcaattttctgcctctaggcgatactaaatttcaactatcctgtgatgttcccacctgcatcccttggcttctacacaatagctttattttcaccaattaaacaaattcattttttcaccttggcaaaaggaatcaacagaaccaacacttatttgttattcattgcttcttctagctcttctcacaggcagtatttaatacataattcagtaacatatttgcagcaagatatggactatccaaaacatattcctttaatcttcattataaaattgttgggaaggatagagtatgaaaaccagacacagggatatatcttagccaagttttgataccttggtgaagtgacacttcgcaaacgttagaatttgtttgtgctgagggtccaaattataaactgtgtgatattcaaggtcccactcagggtcgataacctatgaatctatatattctgacattttatttgaccttacaaggggaacccaaaatatcaattgtagtagatactgtggtgctctgcccagatcccacctcaatttttcaatagcaagagtctttcgtgcttgcgtaacagtcactccttgttacatttcttgaatgttcaacttattaaataattgccaataagatgtataaattgtttccttaactatttcaatctttattagaacttagctatatttccttaattaatttaaaa

SEQ ID NO: 32943 - DNA, 2350 bp, Bovine  19866880816709
tacacaattgaagagcaattgaagagttactaaattatttttccaagattcccaccacctcaccaccttctaaactacacatcctttttgtctaagaaaatacttcatgacttcagtcaacacaaagccttcaaggaagtcaccgggagtgatcaaagaggacagatgagctgagttaagctgtttcttgcgtcagtagtctcaatttccagtcattctccccacaacatgccatgcagaaatgctaaggagctgtaaaggatgtccgaattggttatcaggagctggaggggtgttttcctatctctgcttaattaacgggaggcaagctccttttgggtggatgcttccctcccaaatgtatatggactcaagacctctaaattgagattaatgaagattgaactcattaacttgaaggcttgagcagctggtactttgttagagattttatttttgtttcatgagaatcttagatcaggtaattgagtgatattcatgtcagtgggaggccccagagataatggtgcacattcgcttgttgaaatttatctgcgttctctgactgccactatcgatttgacttggctgcttcatctttctaatccctgcagcattttgccttgggcagagctgtagggcttgaagagaaaaagaaaataaaaattggaatacgttctcaggttagaaccaaaaaagaggaagacaggagtaggggagaggaagaaagagactggacctgagcccttggcatcatggaaagccccatgtgacgtgaggtcaagctgaatatcttggtctgtgtgatttacaaacatcagtatggttttgtagcaaagaatttccctgaagctagaatgtacattctacatccactattcacagatggggatggaaagtagtcttccctggcatccttaagacttcatggggttctttatttcctctcttaaaactggaaacctaactgtgctgccaaaaaaaaaaaaagaattataattctttcccaaacatttcatggtcataggaccttatttatcctgacagcttttcattgtaatttttctccccccatgtactcagtataaatttaaaaaaaagaaaaaagacattgaaatctttaaagcagtgaagcaggaatggcttttacttcaccaatattggtatcctttaatctcaatgatttactacataaaaaatagttttaaatcatagggaaaatcttttcatgcaattcattgtgggccagaatgaacattttttggtaagtattttatatgaattaaaatatataagaattttgtagtcatcttaaaaaattacccttccctctagaacaatggcaacccactccagtattcttgcctggaaaatcccatggacagtgatgcctagcaggccatagtccacggggtcacaaagagttggacatgtaggcttgcttgctaggacagcacaagggggaggagttcaagaagaaagtgtgtgttaggaagagggacacacacagagggggagagttagcttctagattatccacaccagcattcctgagagcctgctgaaggccaagttcaagaggcttatggattctctctcctctgactccagctctctgtatctttctgtttatgagtcttggtgctcatgtcatggttatttatcagagagtgtgcccacctccactgtctcctaatgactaaaacgtcctgatatttaacctctagctgatctttgatgtctgactttatacagaacacaattaggcaagatggaagtaaaagtttacacaaacagtagctaattcatgcttcttagcaggaagtctaatacattcaggataattagaataaattattgtgtaagtacattttttactgagagttatttataatctcccaacacattactcagaataagtgtctcgtgaacaagtaatattccattgtcaggttataaatagaaatatttatttgtttgctggtaatctttagaatatatttttatctaataagggaattcattttttttttccaattgtatgttcataaggtattaaagtactttgaagacttggttacaagtttacaactgtgacttcatgagcaattacgtatctatcaatgcagaataaaaggttcagacttggcccaggaagaccgatgaaagcacacctcttgttaaagttcaatgcttgtatactgtgccccttgtagaaatgaataaattaagtgcaagcccttctgttacttgtgatcggggtaaacttaccagaagctaattagggttttaattcattaattaaacaaaacactgattgagtgcctacagtatgtcagacactgtcttg

SEQ ID NO: 32944 - DNA, 1985 bp, Bovine  19866880924491
tttccaggcaagagtactggagtgggatgccattgccttctcctaaaatggtgctaccacatagcaaaggttcaacaaatgacagtgactctgtttcacagggggcatataaccacgacccatttcccaggtctactctgaggaaagctactttataatgaggatagttaacagaaccaaagcaaggatatgggtagatgggatcaagtagttttgagaactacactggttagaaaaaaatgagctcctctattgatgaatttccaagtcttaaatattctattgttaggattcctcttaagagaaagagtgtataaggcttcctaaacttgtcagacccacagcaccttttttcaagaagcatattgtaaagacaatgctctgtggacatgttttggggaaacaatttactggagaatgaatttcaaaaattctcaatgaaccagactaagattattctgaaagaacatcctacgcttataatatggcatgagtatgcagaagaacactaattcatatttaagtaaaagctatacttctatattcttcatactgtcttcaaaaataagtctagtgagtcactaaacagagtaaattttgagtccatcatgaatttcaaaaccaaatcgttattatagtatttcctgagtaaccacagtgttagagaaccaagaatcaaggaagaagaaggaaaaggaggcttggatacaatcatgactactttgattttgatggagagcatttctgatatctggatatagttttcgatccaaaccattccaggcagatgaattaataagcacatgtttggaaaaagaatgcctggaaagtaaattcaaaaacaacaaaaccacaagaggaaaagaagcatgaagtcaattatggctaacaaatcaagctgaccacaaattcctatattaataagaatgtcatgtgcatatcacgagggatctcccttagagacattctgatagctaaataatgcattttggtgatttcacagttatattaagtccatagggtttagctaggatcccatcttcaagagataagacaaatggcacttaaaacgtagaacaaattataaaatacagttctatgaacttggataaaattgatagactagcaagctagaagaacatgctttaattgtctttcccccctcccatttttatacaaatttgaggaaagagaggaggtatttaaagtaagattccctcctcaacatttgaagatgaatgtatgtttttatgagccagctgtagaagggaaagcaaagattctctctgacaggcacgtaagaataaacactaacagttgaataaaggtgagccaattaaaccacttactcatgcctaatatagttctggatggtccaagcacctggcttgggataaacatttactttctgcagcatgatatttaatcagctcatcagatggtggaaggttccatccagaagggcgattctctctgaccttactcttaattggaaacactgtttagggtcctgcttcccccagtacctcctcagtgtgtatcactctcatatatgaatcccattagaccctctaactcagcactcccttcagggcgagggtgacagactcagggatttccaagctttcctgggatttcctgccaggtgctgaaggaggaaaggcaattttaggatggagaggaggaaacgaacatagacagggacccagcggcaacactaggacccctcacttttaattcgggaggggatgagtggaaaattatccccgtttggacagtttggaaaagtagttaagtgatgtgtctgaaatagttgggggtaataaaatacattccatgaattaatatgatccctctgaacactataacatcaagaaacgtgaaaggtagcaactagaagggattttcaaagatccagagaaatgcctttattttatggttgagaagatgaccttacagaggggttgatttgcccaaccaatcag

SEQ ID NO: 32945 - DNA, 1145 bp, Bovine  19866881047072
tttcattagtagatataaaaaggaaatatctagaacacctttcctaaaaagaactctaaagatatctaatttagtacatgagtctttaggaaaacattagtataaaataaaccaaagtcagatattaacaagttactcaacataaaatctcactatacaatagtatctcttccttaaaacttcaaatattaacaaataggacagcactgcaaaatatcaagtgtcagatgcaactagaatccaaaatgttatgtttttagttttgaaatatcattattgctaaaatgagaattttataagaaaaactaccatcagtttaacaacatataatttatttgtaaaagtcaaccaagaaaaatctatgaattcaatcggctcaggaagcagattccatgccattttctccctcaatgctaaatgacacaagcagcaataaaatatgcagagaaaaaaacatgtcacagaagatgtgacaattttgataaatgatgataaattgtgatgtataataaccgtttgtaagctgctgttttcaaaaacatttattttaatgatgattttcaccaaacatcattttaaagagttattttgtgtaaaaccactgacaaactaaattggtaccttattaaaagttagaagagaaacaactgtattttaaattttaaacaaaattgtaattttactttgatttagaatagtttttagatccagtcacttccttaaaattttcaatgtagttatgtgatctagcaattctacacccaggcatacatgaagagaaattaaaacatattttcacacaacaacttgtacctggaagttcataaatgtagcattattaataaaagccaacaagtagaaacaatccaaatgtccatcaggtgatgaacagatacataaagcaaggtatatcaatggaatggaatactactcagcgataaaaaggaattgagtactcatacatgctataatactgatgaatcctgaaaacggtaagctggggaagacagtcaaaaaaggctacatatcctgtgattctatttataggaaatgtctaggacaagcagatccatagacacaagatgtagataggcagttgcctcgggatgacagcacaaaggggatggagaatagctgctgataga

SEQ ID NO: 32946 - DNA, 1457 bp, Bovine  19866881047618
atgggatcaacggttgaatgcttttggcatttagcaaaagctatgggggcagggccctggtaggagacagggaatcaagttctaaagggttattgaaaagaaggtactaaatgaataaaatagggagttaatgttgatgcaaattaacttcagaaacgaagagaggctcatcacagagcactgaaaaaggagaactggggaggagggaaaaatgaagactctcaggaacaaaagaacagatgattgagacctttggtgtctatgttctacaggttgctcctgatcggagatgaagtgtggaatggctggtacagccagatactttctccaaagttgcatatttcatcgatgaccccttcttaagtgaaataaacttatgttactatacacagggtccaaactaagtagcctgtgacctttggttttcccaaaggattcctgcctttgggggacctctttcttccctctccagactttcccctctgtgagcttctcttctgatgtacctttcaaaataaaccagcacaggaaggatatcgaggtgtttgagcaatcccatttccatccaaacaagttcaggcagttgaaggctacacacccaggtttgggggtgtgcatgacaatggtgtcccaggatcactcatcttatcaagttggggcagataagtacacaggggtacgacatgcgttacaacatgttgggagcttatgaaccatctaattacccactgcaggatgcagttgacagccaagtcccagaacttataaaagaggacaaagacaaagaaatgaatgaaatataactcctgtataaagttgattacaagaggttgataagaggagagatgtgtgtggggggaaactttcccgtaagtagtttggaatgtgattatataaactggaacaagagtaaaaacccacaggctttcgcatttgacagaaatgagagtttagggaaaagaaaagttagtgtatctttcctatttatatttccctttcctatttatatttctactgtagctattctacagaatagctactgttcagatagctattatttggtagtcctgtactggttggaaaaaaaaaaatcctatatatctgtttttcttaagggaggtaattacgtgcctctttttttaactgcaaaaagtcaaaacttttttctctttttggtggtttctacctggaaggtgagtcccaggtcagagtatctctgcgacccatattagggtttgggattggaatcagagggatctatcaaaactgtagtcctgagccctgtgtttgtttatttttattgtttattgtttactcttattgatctcaagtaaacaataagctgctgagctaacttacatttcattttgcactcctatactaaaattgttcgttctgagctttcttcattgaagaggtggtctgtggcagtagttatgaggcggagtctgaggcta

SEQ ID NO: 32947 - DNA, 1892 bp, Bovine  19866881054637
ataaggatctcttccaatgagtcggctctttgcatcaggtggccagagaacagcagcctgctgcatggtatgcccagtttctccaagaaagctcatccacctttgcctgatgcttctccctcagcctgtccagccctcccttggattttatcctcagagcagctgccttcccggcttccaaaccaaatgccgcctgtacctccatctgctcctctgcctacgctcccagagccatcctctttcctggctacccaccaactcacccacaactcctagatagtaaacagatctgcaccaaaaagtaaggtggtgcatctcaaattaaaaagctgacaaaaaaagagttatcaatgataaacacatcagcacattttatttcaaggtgtttataagttaacaaagcccttttccatccctgattccatttggacctgtgctaactcccaatacatttctaataaaaattaaatgctgttcactgagtgcctcttatgtgtcttaagccatgttattttaacttttatgacaagtctatcaggcaagtctagttttcaccattttcagatgaggaaattggagcttgggtgctttggtgatattcctgggtttgggcaactgggtaactaatggacctacaatccaagggtctgaattgtagttcgatgctctcactccttaactagaaagtaggaaatcatagatcaataagtgaaatctaaaataaatcctcagacatcaagacattaaggacagttgtttaacttgaattgccacccaatgtttaagtatggtctcacttcagttattctttgcatgttcttctcattatcaggggacacacaagaaatagcttcatcatttttccaaactcaactactcttgaaaaccaaaccaaagacttgggggtactgcttgagcccactggctgcattttgcttccaaggctgacaacctggatggatcttcagattcctcatgaaactgagcaaagtaaggcaaagagaattgcttcaaaaattactaatgacagtatttcatgatgatctttgaatgacgtgataattatcatgccagctctgttggtcagcctgcctaggctatactgactttctcagtatcatccaagccagtgacttactccttcctttctaagaaatcctttactcatggacagaagaaaccctcttctctgtgacaaccccacttcctctttcttcacctcccccatcactgactttcctccagttttactttttgtcctactgtaccatattttatctttaaaattagagttttctgaagtttgctcctggcagatcgtcttaaactgatgtatccatatatgcccagcatccaaaaatgtctaaacttttcctagaccgcctcttggaggtctggagaccactccagacttttatatacaaagaagaaagtataagtgttagtcactcagtcgtgtctgactctttgcaactccatggactatagtccaccaggctcctctgtccatggaattctccaggcaagaatactggagtgggttgccattcccttctcccaggcgtcaaaggacacttcaaatcttcttagacgtctcttgagcatctcaaatgtaacatcgctgtgttagaacccttgttaaaccctagtatcaacagtaatctattccttagcccatctttccatagtagtcaacggtgttggcacaagttttgccaatcctacttcaaaaacatgttttcgtttttatggtcttttctccccaaaagacacccccaagtccagttgcctcttaagtggtctcttttctgtcttttccacctatatcaaatagataatcttttaagattatgtcagaataactcatggccatgcttaaaccctttaatagg

SEQ ID NO: 32948 - DNA, 2585 bp, Bovine  19866881081285
ctgagagggttttctctatcagcatggcaccgaggtgaaaatgaaggtattagtcactcagtcgtgttcaactctttgtgaccccatggactgtggcccgccaggctcctctgtccatgggattctccaggcaagaatactggagtgggttgcaatttccttctccaggggatcttcccaacccagagatcaaatctggtctcccacattacaggcagattctttaccatctgagccaccagagaagcttcccctgaccctgaggtaggaaaactactgcctgcactggggacttaacaagattatttcaagggtttaaataaatttttttccttgcttggttttttagctttgccaaacaacttgcaaacaactgctacatttgctataattattttagatcattaactctgaaaattactgtttgtattatttcctacctcggccttgtgcccattgtgagctggcatctgataaacaggtggatggtactggccttggaggtttgcccttgtcaaacacttgacccagaccaaaaaaatgtcatagttgccttcataagagaagcctcatagacgtaagcctcagtaatgatgttctaatgatctaatatgccatgttgtcatctgtcgatttatgaaatcatgaagcaaatgcaaataggattgtcactgtctccttgaatgaagactaaagactggaattttaattttatgcaacatttactcaagacaactcctatacatttgacaatattgaggtctttccttctcctggtcttacctaaactcactttcatctagatcaggcaataatttgcaggttttggtcttcaatttcagtagcaagcaattagcccctcaaatccacagaaaacaaagagtttgtatcttacaattctataggatatgaagtatacaaagatttcatgttgttggtaaaaaataatgtagcatagacatgcatgtggaagtatgtaaaggaagaggggagatgtatgccttttattttgaatgtatcaccaagtggattaatggatggatagggtgattatattataaagcaagtatagtacaatgttcacagtagaattgagatgtgggaacatgggtatggattatacaattattttaacttcatggaatgtttgacatttttataatattggggggcggataaaatagcagagaccaaaattggtagaggtatttggataaacattaggtgactgaaaatgaagataaatttttctgacttactaaaacacagacataagtaaatagctgcatctctgagccgatataatctttcttcaccattagtatatgaatctgtcagataagaaaaaaagggcattttggggaaagtctagctcagtaagtgctcaatcttttgtccactcagcaatatataagtggatattttggagttattttgcattgtaaaatgcctgaagtcttcacaggtaaggcagtttatgccttctcagtcatttccacatatactgaatatttcatatactccaaccatggtgcttggcattggggcttctgagaggaagtgcttcagaaaggttagtatcaagaaatagataaagataataagtaatgcgataaagtgaatggaggtcttaaagtgctttgagttgctggacttaggaactctgtgatcttggggtcttgggcaggttacctaacttctttgtgccttggtgttttcatctgtaaaatttggcaaataaaaactgataacccattgtctgttaaatagcaagacttaatgaaaggtcactaatatcttttcacctagagaggaagaaaaaagtggcaaatcaaaaaataaattaacccatcaatagccataagatttgcttgacagagacccttggtgattcagttaaagaatccgcctgcaatgcaggtagaccctgggttagatccctgggtcaggaggatccccttgaaaagggaatgactattccacttcagtattcttgcctgaagaattccatggacagaggagcctggtgggctacagcccatggggtcccaaagagtcagacacgactgagaaactgacactttcactttttctacagtcataagatttgcttgacagctgcctttctctcttcctgccctctgcccctactgtggtcctagtacagttctagcatcactgtcttggagctgaaacagagcttgccacgaatttgggacagcttctccttctcacactttagagaagaggagactaagatggattgaaagcagtgacatagctagtccatggcaagtgaggaacacgtagggtaataaagcttcgactgcagagagaggtagaaggaaagacattccctgggaaatatgttagcatttctcaggaagtaagggagaaaatacttaggtatatgctcatgtggttagaagagaatgtgttaggggtacctaagtgctgcagtccatggggtcgcaaagagttgcacgtgactggccgactgaacagcaacaacaaaggtaatgcacgagaagattcccaagaagcacgtgatgcagaaggttgcatcacaccactcccgagttaca

SEQ ID NO: 32949 - DNA, 1338 bp, Bovine  19866881106702
gttcagcaatccttggccaaaactcagctccgtagtacatgattggaatagactggtgtcagttctgcccttatgaaagaatggctttctagaatacatgttcttttaattatgccagtgtatcctttcttgtctgccccttgggttgccatcattttctctagtaacgtcctgatttgcagatcagtgccccacgtggatgagttctgtttcggctacccatcctgtgtagtactttgattaatcttaaaattcttctatttttcagtggaaagaaataaaccacatttctggaaaatgaggaaagtatatgaaaaatgttgtgaaccctgtactgactttagattaaaggaagcgaatttgagccaatttgattgagatacctgtgtacttgtgtactttgaatttcttcagaaattgtcggtgtgttcaagatgccacatggcgggtggaggcttcctgtcttaccactcaagggttcatcatgctgagaactcagcagtcagtttatgcccctcatgggacctacatgaccttgtgatgtgcatgaatctctctgggtctgctttctggagaacacctgtcactgagttgtgtgtgagaaaagagaggtctttggtgtactttaccagttttggaaggtacttgatgaaagtagtcatcccttttgtctctcatcacttgattgcctgccattctaaatgattccttccaattattctttagatctcactaaaagaattctgctggtcgttcattctggttctgtctctgtatttaacacagacacagtcctcattactttcatcaaagtcatttgataatctctttaatgggaaatccctgattacagttgcattcttttggcaaccctcaggggttgaaattgctctaatttttttggttctgtgcattaggctgagatgaaatcccttgaggacaatctcttccttattgaattcttggggaagaaaagactatgtgtgagcaaggtggggaaatgtgcaacattaaatgtagtggaagctgtgccttttgcatcttttaatagaccattgtaaaaatgtaaatgttctttaattagttttacttgttaaattcatatttcttgcaaatgtaattcaaggctgagatcatccaaaagatggccagatttacactgattaccctggcagctcagatggcaaagaatctgcctgtaatgcaggagacttgagtttgatccttaggtcatgaagatcccctggagaaaggaatggcaacccactccagtattcttgcctggagaattccatggacacgggagtctggtgggttatagtccgggagtcacaaaga

SEQ ID NO: 32950 - DNA, 1271 bp, Bovine  19866881159443
aatgaccagcatgagctgagaatggaaaacccaaaacctacaaggacaagagaaggacaaggttgggaagggcaggaagtcaagaggtcaagagggtgcatgccatggagtgtatcagtctcagaagcctggacccaatatcaaggttaaatgatggacaggggccaaagatagccagtgcctgaaatcagaagtaaacattattattattattgtcatttacttttatcccagtgcttcttttcttgaccttgttgcttcttattcctgtgttagggaagactctctctgagtggattctacaaaactcaagtcatcagtgaaaaagaaattcaatatgctttgcaataaattgcccagccacagaagcaacataaatgctcactgatagatgaatggataaagaagatgaggtacacacatacaatgagatatagactatgaaaaagaataaaatattgctatttattatagccacatggatggacctagagactattatactaagtgaattaagtcagacaggaaaagacaaatattaaattgatatcacttatacacagaatctaaaacatcagtagaaatggaattatttacaaaacagactcacgttcatagaaaacaaacttttggtttaccaaaggggagagggggagaaagaataaattagaagtatggaattaacacaaactaccatatataaatttgggtgaataacaaggatttaccttgttaaatagcacaaggaactataggtaatatcttacaataacctataatggaaaagaatgaaaaatgtcatgtatatataaaacaaaccatttaccatacatcagaaactaatatattataagtcaattatactttgatttgaaaaatacacctggcatctatgttagccttttctggcttttcactttggcttctgctaaaggcactgcatctgtagcaacatatatcccagctctgatcttcctcagaaatgaggtaggtatacatcctggccagacttttccttgtctatatggtgggatcaaccgtctctttaagtgagtttcaagccagggttcatacaacacttgaaagcaacatgattcaaccctgtgccttctctgtaccctagaaaagctgccaaacattctacaaagaatgggcatatgaataggatatcagataaaacttgtgttgaaacaagttcttttttctctgcgttccattcacaacaacagaacccaaagtcaacccgtcatatattatctgaaaattattca

SEQ ID NO: 32951 - DNA, 1554 bp, Bovine  19866881180895
agtggaagtaaggaaaggagaaaaaggcaaagggaagacttgaacatcaatgcagaggcagctagtccttcagagaagggccgaagttggggaagcagccctctgcctgagggagctttccacggcgttcagggagtcagcccaccagcagtcagtgcttctgacaactgatgagaccagagccttggtcctgaagcaggctacctgggagctacactccagcattcattgcaggaagtaacagaatgcatagatgagtggcatagcattgagaattagctgggctggtttgaaactggtttctaccacactagacatcagatatgtcaccttgagcaaactacttaacttctctgctcctactcattggggataagaactctgcaggcatctcatggggttattgtggaaatggatggatgagttaacacacatgaagcatacagtggttcctggaatattgtgagccctttgcaattgtcagctattattatgagacgttgctataaaacaatgaaactatttttaaaactaacttacccgtatgaatatttgttcctgtataggtcagagggggctattaataaataaactccaacatctctagttgcttaaaataacaaggatttatttcttggccacgctacatcataggttggctctaggacccaagctgacggaggagccattagctggatcattgccagtgtggcaggaaaaaaagatagtattttaaatgctgactcttaaaacttccacctggaagtgatccatgtctattccactcatattttcactggtaaaaattaaacatgtgagtacacataactctaaaaggtgggaagggaggtataaccccacacttgtctggaaggaaaacctgaatgacttcataacagcactaatgaccatcaacagtttaattttttaaattacatggcactagatacacttattaatgataagacaacttttcttgaagacttactgcgtgccaggtactatgataaacagcagtactatgaaatagactcctattaatatcccggtattatacattaaaaaagtactgagccttttttagtgtcagccctaaaaacttagagaaacacaataaacagcatgaatctagttggtggctaatgtgaactcaaactcaggtctgtctgactgcaaagcccacatttatatctaacactctatgtcctcataagaagaacagtgacagcagcatagctcacaatatcttcaaaacacatgctctatttttttaaaggaattgctgttagaagctattatttagagggtcctaactcccaaagtgtatgaagtctcaaacactgtgggagatttttgcatgctcccatgatggtattccctgttggctcagctggtaaagaatctgcctgcaatgtgggagacctggggtttgatccctggactgagaagatctcctggagaaggcaaaggctacccactccagtattctggccagcagaattccatcgactgtatagtccatggtgtcgcaaagagtcagacatgactgagcca

SEQ ID NO: 32952 - DNA, 1243 bp, Bovine  19866881250561
cattagtctgctgctgctgctgctgctgctgctgctgctgctaagtcacttcagtcgtgtctgactctgtgcgaccccatagacggcagcccaccaggctcccccgtccctgggattctccaggcaagaacactggagtgggttgccatttccttctccagtgcatgaaagtgaaaagtgaaagggaagtcgctcagtcgtgtctgactcttagcgaccccatggactgcagcctaccaggctcctctgtccatgggattttccaggcaagagtactggagtggggtgccattgccttctcccattagtcttctacttactcctaatttccactagaaactcaaagggcaggatagaaaaataaagacaaatactttgggaaataagctgatggaatgcatagatacaagtaaaacaaattctctaagaaaatttaatttctatttcaatgtatattgcttgtccctatctctacaatttgacgaagatgcctacctactcacaaccaaattcaatttaatagaaacaaatttataaagaatctttatttccttagacagcaagaatatagtcatcttggaaaatttatcaaatgggtcctttttattgggaaattgtgtcattatttgttgctgtcacaatgataatctaatagaatgccatctgccatataaagaataattatcttccaaagaacagaggatttatagatatgtagctaatactagaaacttgctgtagaaactgcaaaattgtgaaataccaccttctgctctgcaaaaatcaatgaaacaaatgtttgcttttatcctggagcaaaactggaataatttatttccttgtctctactggacttgctgctgaaacagaacctgatttcacctttgtgggtggcctggtccattctggttcttggttagctactgcccagtgaatcccatttttaatccccatgggctagcagactctaggaccaccccctagccgaaacagagaatatccagaattgcaaatgtttcactctgtttcaatcaagcaggaaaacagagtctcacaggaaggtgctgcttagacctgtgaacccgattttaaaattcagtgattcttaatttttcctgaaaagttagctagtggaaggtgcgtcaagagatatggggtattactcagccattaaaaagaatacattgaatcagttctaatgagagatgaaactggagcctattatacagaggaagtaagccag

SEQ ID NO: 32953 - DNA, 1182 bp, Bovine  19866881258699
atggctgagataaaaatggccttggcattcatgataagagctggtgataaacgtctctgaaaggaagtcacctaccgcttggaattctacctgaacccagattcccctactgatcagtcccacagcatttctaagtacttgctatggacaagtctcttgcaacaatagcttgagaggtattattaattactctacatcccaaatcaggtagattaaatatatttttgttattatagaaacaaaaaagtgaaagtattagtctctcagtcctgtccaactctttgcgagcccatggactgttgcccaccaagctcctctgtccatgggattctccaggcaagaatgctggagtgggttgccattccttcctccagtgagtcttcccaactcagagattgaacctggttctcctgctccgcaggctgattctttaccatctgagctaccagagatggaatcacatcataattagagtaacacaaattgtcatgaaagatttcagtatgtatgatgatatctgaaaagaagacaaggccatttatgtttattataatatacactgaataaagcgttaggttatgttgcgacctcatccaggtgaggctggtaggagactgacgaatcatcttcttcttcacttcttttctccccatcccctatctattagtttttctaatacctagaaatagggcaataaagaaaagtacagtatacagtttttgctttcttttaaactagccattaatttcaggcaagagtagcacatacctgctatattttttttaaccttcacatgatttaacagagaagaatggtgactttatcatgtttttagtgtgatttcttattgcttaaaaatgtcaaccggtgaaattgaaataggtcattactttgttttctcctttatttcaatgacttggtccacccagcagtacccatcattgcattgtttccatctgatctgttttatttgaaaacccccttatcccttaacattgataatgctatagaaacgtttgacattaaatgtacctgatatcatcttcagaaagttacagttgacagagtaaaaggaatatgtgtggtgttttatttttcaaatcttagtaaaatgatgtcctacaatgttttagagggaagcatgatggaaattttttgcaaccagaagctgaatattcagtt

SEQ ID NO: 32954 - DNA, 1546 bp, Bovine  19866881339070
tgcatttagtgcactgagtagactgcgtttgactctcctgcagaatgcaacccagaattcattctcgggactctgctgacacttctcccaggaaaccaccttaggctacaaagcacaggtcattttgatacatccagcttcagtgatggttctgcttttgctactcatacttcccagagacgggggcttttttccaaatgaatttaaaatgaaataaactgatataattttaactggcttggctggatgccacagatacatttggaaatttaaaaagtcaagacattggacctcagtataggcagtgttttcttttctccagaaaacaaaatgattttaaagtaggatataaaactaagtatcttattaattacatattattttttagtgtttatgaagatataacaaatttgaactatgtcaccctccccaagtgattcacaggacaacctactgattctgagtgacattctgatcaaaataattgcctttgaaaggcatttgctgtgactcactcaccacggcagcctttcaaatctctttgagaacactgagtcatgcattttcacaatatgtcttgaggtaaatgggaagccaatattattattcctactctacctaaggggacaaccatgctctccaaagatgctgtctctatttgggatattctgtctctacagaatacttctttgtgctgacttcttaaggtcattctgtcgtcatgttttatccttttcacatcatagatttgaagagtggtaactggttcccaaaaatccgaggtatttcatcctcaggttagttttctaatcaagaccaatttggtggcttttttctctcttccaaaaaaagtagtatatatagtattatgcatttgttattgtttggtcgctaagtcatatccgactcttttgtgactccatggactgtagcccgccaggctcctctgtctataggatttcccaggcaagaatactggagtgggttgccatttcctcctccaggagatcttgctgacccagggataaaaccacatcgcctgtgttgcaggtggattctttactgctgagctgccaaggaaaccaagcattatgcttacatattacactatattgacattaatgacaggaaacccatggcctcttacttgccccatttctactgtgttttaactgttacaaagggcttcaagatgatggcctgaaatctgcttttcagctttcattttaccttccaggaaagcaaagaacaagactctcttcacctatttgaaggcatttgccattcctctactttagccaagttaaactttctcagaggattcaaccataactcacagggatggtttccagactctcaataaaccagttatcctttctgatcaggataccaagtgtcagagtctccttaaaacatgttatctaatattgaaaccagtctttaagacacagtctaagcataaaagagcagaaagagtctataactttccctagcagagacactctaagacccaagatactaaagcaatagacgtttttttccccct

SEQ ID NO: 32955 - DNA, 1414 bp, Bovine  19866881362602
atcaagacattctttcaaattccatccctaagtctccaagtaagagacttagagtttcaaatttagttagtcaaatcccagtctcatccgtttctaactttccctaaatatttgtggatgaatattctttaaattttagaaatgggggggaaaagtgttgggagcaggaagggcccaatgaaggaggaatcaggccattgcattgttttaaggcagtttgcaggttgccttcctagatgaaatatctaaattagagccctttaaaaggtggagttgctaaaaaacatttattaccaaagaaggtcagcaaataaatgagctaaatccttgtaccaggtacaaatcagacctttaatttccaaatacaattgctatcaaaagttaatgataaattccttgataaagttgttggtacctacaagtgtatttgatgggcatggttccccattatgaaatattaataccttgaaaaatcaaacatgcaagtgaaaaacgcacctgtgggcccattttcaatacaggtatacgtgtggctgagtccctttgctgtccacctgaagctatctcaacattgttcattggctatacttcaatataaaataaaatgttggaaaaaactatatacaaaaaaaaagtgtgaagaataagtataaaaactcttaaacaattggaaattagggctgtgtagaaatagactgcattactgtctgtgtatgttcaacttatgaaaaagcatcccttcttccacgattccttttatcaaccataaagggctttaggatagcaaattgcatatttatctccatgttgagtgaaatatccctaaagtctaatgcccaggggccattcaagagtgatgaaaagagcttcagagaaggatctcctgttttactgaacctctctctctagttgcatcaatttccatgttgatattatgcaaacctgtggcctattgtagttcatttcctctaaggctagtacactaatatgtgaaaagcatttagaatccccaagagaaaggtgtgacatgaaagatgtgtgctatttgtgttaatgcctttgttgttaattgctcttattgtcttaatcccatagctatgggagaactcaatgtaaatgttgataaagcacataatagcatcctgtgtgatagaaatatcataaaatggtaattatttccttccttttgcataattactgaggttgtctctagtcaggaacggtgaactctcaacttattttctgcagccatcttattaaaagagcttccagattttttttccccaggctagtaacaaagaaaccaagcaaggtcactgaaagggatactttatttaaagcatagttgttgttgttgttgtttaaagaataatcaactccacatgaaaataaataagattcaaataaaatcccc

SEQ ID NO: 32956 - DNA, 1082 bp, Bovine  19866881441965
ttatatcacacaaactctaaagggctcaggctctcattgaatcctctgctatcaccatcctgaaattcaaaatattgtttgaacagagtcctgcatgttcattttgcagtgggcctgtcaaccgtgagacccttctagcacacagcatggttattgcaactgtacagatgagaagaccatggctcaaagatttcattcagtttactgggggtttcggggcttccctggtggctcaaatggtaaagaatatgcctgcaatacagaagacctgggttcaacctctgggtcaggaagatccgctggagaagggaatggctacccactccagtattcttgcttggagaattccaaggacagaggagcctggtaagctacaatccatggggtcacaaagagttggacatgactgagcaacttacacacacacacactgggagttttataaaagtgagtaaagtgaaatttgaagccagcctcgtatatttgagaccaaagttcacactatttctagtaagccaaaggtcaattccatctcccagaacagtattagaaagtagagggcgaatcatgcaggtaaacctcttccagctcaggaaaggactcacattttctgccactgcaatccagaggataattcttgctattccctctggccaccacaattccaaataaacattaactcagcctttgggggcttgttaagagcagctgaaaagagtgtaaaagtagtgtaaataggatttatcctgtttctctgctgaagaagcagcgcaattcacaatggagaaattcagcattctttttttccttcaaaatttgccttataagagagatgtaaaggaaaaaatatatgcagacttgacttcagtggccaattcccttcccaacccttactaagaaatgaattgaaactgtaggtgccaacttttcttccaaatagcagccaactctctccccttattcctttgtcctctgtcaaaatttagacgttaggttttcccacaataaaatcttcttagcctcactttctgatgtgatccggtcttactaacagctacaccaggaattcagccaaacaaatt

SEQ ID NO: 32957 - DNA, 1703 bp, Bovine  19866880347393
atgtcaaactaaaaccacacaaggaggcatgatttattagagtagacaaccaaaaaatctgaagaccacccaccccaaaatatgctatatatatttctacctacagaacatttttaatattttaaatgtacttggctgcagtaggtcttagttgcagcactctgagatctttagttgtggcacaagaactctgagttgcagaatgtgaaatctagttccctgaccagggttcaaaccgggaacctctgcgttgagagtgcggaatcttagccactggaccaccagagcagtccctccacttacagtattttgtacactcattccttctgccctccagaccccatcttcaaaactcaaataaaatcctgatactccttctaaaaccatttttacgaccctgccatggagacctcttcctcttgggaactttgtacatcacttacctgtactacccatttggtacatgcacattcatccttggactattgtttgaaatcggtaattgtatctaaaccctaccttgaatataatgttaatgaaatcaaagactatattaactatcttaatattacccattgtttattacaaacactacactactcatagatacacagtcacctaggagttcatcaccattgttgttgttcagttgctaaatcatgtcctactgtttatgaactgcatgaactttgtgaactccatgaacttcaggcataccagacttctctgttctttactgtctcctagagtttgctcagagtcggacacgactgaagcgacttagcagcagcagcagagtttgctcaagttcatgtccattgagtcggtgatgctatctaaccatctcatctcctgctgccctcttcttttgtcttcaatatttcccagcatcagggtcttttccaatgagttgactctttgcatcattataagccaattcatgtcattgttcattaaatacaaagaggtacagggtcattgttaataagatacatgggagacaagttcacgacagaataaagtacttgaggtcttgtttaagaaacaaacacagatcacttatttccagtattctatgtatttatatctaaaccttagcaatattttttaaaatatttattgttcacatgtctgtgaatacagggatgggtgaaaagctgaagacaaaatttaatctcccatccagcataagatgtttaagaatgtaaactagatatatagagtttctttttttctctcttccttgttcaactgactaagtctactgtttggccctttactagaaatttagggccataagtacttttcatgaaaagtacttttggtggggcaaatagtgagaaggagttaattctaactatacaatcagccttgagaaagatattactaaatcatttccttaacttgcctttcattaagttgagctataatgttcatcttctttgtagattcaaagtttattaagaatgtgctgtttatataaagatgttgttgttaactaacccattggaaataggatacttttccaattatttttcttgcattagcaatgggtttactatccaaaccctttgacaaattgctcttgaaaccaacatccagatttgtaatccagctcattggactcagggatgtggtccagagcaatagcttttgcttagagttttgcttagagcatatttatgcttttgtgccaagctaca

SEQ ID NO: 32958 - DNA, 3161 bp, Bovine  19866880348567
catgaaagtgaaaagtgaaagtgaagtcgctcagtcgtgctcgactcttagcgacccacagactgcagcccaccaggctcctctgtccatgggattttccaggcaagagtactggagtggggtgccattgccttctccaatattagttgctagcagaactaaaacccaagtttccctgacagatagaaaactatgtgttttttttttccaccatgtaacctaaccctctttcttcccacattcccctcactacccacatcattcctcccacatcactacaaagcccataagtcaactccctaacttcaaagcataactaatcttagaaaatgaaactccttaagtagttatttattacccaaatatttgaattaagactgtagagagtagtgtaaatcagtaattaatatttaacaatcgatttcaaaatagcatgctttgttatatcaataatgatggtattcttcaataccattgatgttacatatttatgtatcaatactatatatctccattatgcttatatggggctatgggactatactgaaatagagataataggaataaacaaactaatcatagctacatgcttataaactctccagtttgaaaaacctcaccaagtcatatcagtcatatacagtcagattcttttacacatgaaagtcacaagcactcataaattaattaaatttatagttgttttcatttgaaggactctcatttaaattctcatgccaggagaattcacttgtatcacaaatattgcagcctcttggtatctgagattcttcagaagtgtttaagggaaatccccaacccatcttgcaaccattggaaaaaaaaaaattcaaaccagctgtaaatgatgtgctatacacaaggagttacttctgtgtgtgatctaagcataacaccacttctgtggagcgaacctactcttcggctcacctggtaaattggaactgccttgggttttaggtgcaggtgtaaaaacagccatctccaaatgctgccaaagaacacatgctttttatttcccaagcgatgacattccatccatgagaagttttcatgtttcttggcagaaagaaaattggctcattctagactagactgtctgtctctgtagtggtggagccaagtcaaaaattttgaaacatttcttccctagcagtcctttagtctgtggatcagcttcattgtaactttccaaatggatccagccaactgggcaatttgctgttccatagaacaaaacccttcaaactgggataatcttactgtggggtgcaaaaagacttttcgggggggggggtggcgataggtgagttttacaataacagtttccccaactattagttacttaacgaatgtaactaataataaatcttaaattccttacatacagatttttaactgataagcttgaagattcaggatcattcatttagttgtcaaatccattctcctgtctcacctcttcttttacaatctaactcccacttcctaaaagaagagtacatccctcacccatctcatatttccctatgagatagaaaaaccaagaaacaattccaaattttgtactcagttgtacttagactctaaggccttgtaaatcaagtggtctccaattctttttaccaacagcatttaaaggtcctaatcaattatcaggtaatggactataaaaataacagttaactaaagactagtctgtgttctttttttggcataaaactcagaagatcgagtaattgagtgacattgctatgacaaaattccttctattcttatctacttatttatgtgcataaagtttctcagcagttacatctataaaaatgaagagtagaaatgaagtcaacactgctatgttttttctagcagtaagtaatattctaacatgggtacagttcagttcagtcactcagtcatgtccaactctttgcgaccccatgaatcacagcacgccaggcctccctgtccctcaccaattcccggagttcactcagactcacgtccatcgagtcagtgatgccatccagccatctcatcctctgtcatccccttctcctcctgcccccaatccctcccagcatcagagtctcttccaatgagtcaactcttcgcatgaggtggccaaatagtaactaatcaactaattaaaaagaagccccattcatttcactgagagatgcttttccattaaaaattttatgtttattaaatattgctaaattttaatttgtttaaatgtactactaaaaatggtaactcaatccagagaatttattaaacacttaggccttatggtcaaagaatatttaatgtttttaaaacttcaattagtatcttttgagtacataaaagtgtgaaaaagtgatcaattaaaacttccatgcataaaaatccattacattagggttaaaattctatagcagaaatgaaatagaaatatagattaaagcataaaatggagtgggggaatatgggaactctattatctacttattttgccatgaacctaaaaatgctctaagaaataaagtttattttttaaaaaagaagaatcaaaaggaataccataaaacaaccagctgttaaagaaatataaacattgtcattacttaatacctgctatcactacagaatttatatgccatttgtttttaaaagaagcacaataattatattttaaagtgtaaatatttacagcatgctgggaaacgtatcctttagttcagttcagtcactcagtcgtgtccgaatctctgtgaccccctgtgctgcagcacaccagcttccctgtccatcaccaactcccagagcttgctcaaactcatgtccattgagtcagtgatgccatccagccatctcatcctccgtcgtccccttcttctcctgccttcaatctttcccagcatcagggtcttttccagtgagtcagttcttcacatcaggtggccaaagtattggagtttcagcctcagcatcagtctttccaatgaacacccaggactgatctcctttagaatggactggttggatctccttgcagtccaagggactctcaagagtcttctccaacaccacagttcaaaagcatcaattcttcagtgctcagctttctttagagtccaactcttgcatccata

SEQ ID NO: 32959 - DNA, 3307 bp, Bovine  19866880492084
gtgtctgtctctcaactagagaacttgctggaaacagatataggaggacctaacaatgcttcagaggatgactctctttaattggtctaagggatcttctttaaatgtcattgatacccatgtaatgtgtggcacaagggctgtcagaatagaatttgtcataaggtcattgctgattttagaacaatagtgaattattcccagaaagtttgaaggcacttggaagattatattaatacttcttgttttatctgtatactttatgtttctgggaataggggtgagagtggtggagatctccgacagaccagaggagggtaggaaggagctttaagagaaaggaaaaaactaatactaatcagaagtgatggggaacaaagggaagaaaatagattaaaatgctgataaagatgctttgtctcgcttcaggctgagccgttagtcattgatctgaaagaccttttccaagttatctataatacaaagaaaaaggaagaagaaaagaaaaaggcaagtactgtcccatacaggccttattaaacttgatacaatattcaagactgtgtctaacattatgtgaacatatgtcctctctggaaagttggcttctatgtggctcttcaacgtgtagaatgtaaggaaatgtatttctcttctttccaaagggcaatggatgggtgttatagttaggcctttctaatttccagtccctgactcttgtcttttatccttataagtttcacattgattccaaggactgtacatgagtaccaagtctaatagctctatttaaatccagtattgatatgaggaggggtggggaatgtagggtagaaatcaaatgcaagactctcttatgccttatgcctgtgaacccataggtatatttattctccttttgaactccctttgggcttccctgatagctcagttgataaagaatccacctgcagtgcaggagacccatgttcgattcctgagtctggaagatccgctggagaagggatagggtactcactgcagtattcttgggcttcccttttggctcagctggtaaagaatccgcctgcaatgcgggagacctgggttcgatccttgggatgggaagatcccttggagaagggacagactacccactccagtattctgatctggagaattccatggactgtatagtccacggggtcgcaaagagtcggacatgactgagcaactgtccctttcactttgaactcactttaccgataatttattaagatcattgaatttgtgtctctctttttagatggaagaagccaacaaaacagtagaggtaaaagagcatcttttgttcttgtgaattgcatgtgtcatatatataagccctgtttgccatctacccaagcagacttccctcctggcttattactgtgtgttcatgacccctcatcttagaagatgtacagttgaatgattagcaccaaaatcttaactgctaataagttaatacactaggaaattaaattgcatagagaaaactcgccaactgactctttaatatttgccatcttttcagaatgggagtgatgccctaatgaatcttgatgacccaccttgcaaactgaaattggtatgtatgtgaatttttatgattcttacttacctaaacacaggttttacttcctaaagatgttgctaataccgaatatgtatggaatctgtatgaagatccaattgtgacaactctttaaccatcagtataacatttatgtcagtatacaaagtaatctttttagtaaaaaacttctgaatctaatccaaatacttttttaaaagtatacatcaggtggatttgtctggggacctgtctacactacctgacctaactaacctaatatcaaatctatattggataagtgaaaatccaattgtgacaactattttcctaaactttagcttaggaaacaattacaacaatatacaaaataatcatttttaatagacacatctgaatctaatcaaaatacttttttaagggtgttgaccagatggatttgtttggggacatgtctacacctccctgacctaagtagtccaacagtaagtgtctgtttttaaatttgcaatgtaatagaaatggcatctataactcaaattggcaattcaccagaaatcttgagggtttcattgaaacttggaaggtgactattgatttttctgcataaagtgtaaatggctactagaacaaatttgtatcttaagtcaccataggagcctatcagcactacaacagatacattaatattgcttagaagttaaatctgagcaataggtcaggcaatgtagtccatcttggtattacttaggatcagaaggaggagctgaatattaatccttgatgtaagccaacttgaaggaaatatgtttgttaggtgactgattgtatagactcctggcctcttcttgttttctaattcttttgttgtaacttggcagcataagcgtggtataaagtgagaccaaacagttaagaggctcatttatgtttaaccaaagcttgtctttgtttaaaaaaatgctcattctttacaggatattatagtatatcgaatcttcttattattgatctgtaacaactctgagaatggagtgatattttcctttaaaaacaaggaaatggtgattaataaacctctcatctacccaagcagaggttcagtttcaatgcttaagcctaagtctcagaccttccaaaacaggcttcaagtgaaattacattgtaattttgaatgcttcttaaaacttttttgtttatttaacaatttcttgagtatcagctgtttgcagggcacagaaatgagattcataattcagtgacatcatggagtttaatgtctatcagggagatcaatgttaaaataatcacaaagcctaatagttgatgttacttacaaggattttatttagtttagaggttcagataatgcctctgagtaagtgagtttctggacttgaacataaattatgagaaagcacctagacataacttaagaaaaaaggtgtcggtctagaatgatgggaagaatgtttatctgggaacctcctgtagaactgtcaagcaaacctctgggatcaaaaaggtcataggaactagagcaacagcggattgagaagtggtgaatgtccttcttggtggagtacagtagagaatggcatgcttatgaaacttcacacaaatacctaggcccagtgagatgggaaggagcaggggctgcagatattcatctctacccccacctttatgagaatcaaaatgcataacatagca

SEQ ID NO: 32960 - DNA, 753 bp, Bovine  19866880617866
cctgttcgatcagttacatatttgttttctactttgaagctggggttttatttaagatgtctgacttcagaggcaaaggtttaaaaaagaaatcccaaaatgaaactccaaaatcataccaccaccactcaatgctgatgtagtaaagcacagctgatattttctttgaagggagatttgagcacctactatttgtaccattccaatttctgatcctttggtctacaagttaagttatatgtttcccatcaggattaacgttgtgtcccaaagacagactggttcagcaatcttcacaggactatgtgaaccctctgacaaatattcacacacatgtggcttatttctgctgcactaaatggtgacaaagagtgtgttagaatctgcactacatattatagaagattagaacaggtcttgttcccttaataggacacttaaaatatgaagaataagtgaggtcactgggtgaaatgtttatcaatagaacaaggagggcagttgcacccagcacagatccattaaggaagttattcttcactttccagttctttgggcatagattaatgttaacctcaggaggacgcaactgccctgcccagagaacatttgagaggtgccttaagagttaacatctgtatgcctggactggtctacgaagcgttgccacattttcttgcttgatcctcacgtttaatagtttcacggtatgtaagaaagatgggcttctcgtttgcagcccgaatccattca

SEQ ID NO: 32961 - DNA, 1441 bp, Bovine  19866880650147
agtcataatcccatggactttcacatatcagttaactttccagaaagagccacataaaacagacacaggaaagggagttaaggagaatcaaggacaaagcaacatcgacgtctttgctagtgtccagcactttggaagggtcagaagtgtgcttccttgtcctttggaaccttttgcttgtctcagctgagatcctgaactaggacatgtgaaatattaacctctagggcacatctgggggtccaagagggcagcaaacagccttcagcactatcttcaaagtagccttttgagaataagggaccttgccagaaatgatgcagccaagtttctgacatttggtgcaaaactagtctcccttaactgcttgaatccctatgcttttaggaaaactgattctactttgcaaagaccaagctgagtagacagtaagatttttgcagactatttaattggggaaatgagactatgttaacacacattgaaaaggagtccttaggagattttcttgtaaatgctgacactgctgtaggggcctcaggaacaaaatgtgcctgagttgaggaggtatgcactggttaggcatttacagagagcacatatcattgtctgtaacccgtgggaaggatgctgcagaaagataggacttagaaagctctgaactggaaaacttctcccagcctttgaaaccaagtcagaccagagttaaaagttccccagacagttaatttgggaaagaggccagatagtgtagcaggtcagagttcaggctaagaagtctttcacattttcactactttctagctctatggtttgagtcaatctatctaatattcatttcttcacctgtaaaatgggaatataatttgtagtgttgttataagaaatcagtaataactgatgtagagacctcagtgcctcgaatacagaaagctctcaacaagtggcaactatgattaaatcacatgtaggtttcatggacagttcagttcaattactcagtcatgtccaactctctgcaaccccatggactgtagcaagccgtggactatgtgtcaggtatgcagtcttgtgttgtagttgacattgcttttccacatcaaatgcttaaatgattttagaacaagtgggaccaataagtaaatcgctaataagtagaaacactgttaaaccacctcctgtccaactctggctttgtgactgtagaaggtaggttctgacaggaatgggcttccctggtggcttgatggtaaagaatttgcctgaaatgcaggagacctgggttcaatctctagatcggggaagatcccctggagaagggaattgatccactctggtattcttgctcggagaatcccatgggcagaggagcctggtgaattacagcccatggggtcacaaaaagtcggacatgactgagcgactaacacacacacatctg

SEQ ID NO: 32962 - DNA, 761 bp, Bovine  19866880693574
taatctgaatgcaagatgttctctgtagaacgttgtcactgcctttagtgataaactatttagagggaaggaaagagaagaggaactctctcttgactcagcaagaaactatgaatgaatgaaaattaagtttaagaagtaaacaaaaagaaaataaagtattaaaaactgaaaaaagagtaaagattagatcatgaaataaataattttattcatatgatctgggagagaaaaagagacgaagaaaggacatatgcttagaggttatggaaagactgaaggaggaaacaggttctggaagaaaccagaaaatttgtcagttcaagacatggggaaattggctccaaaagctgagacagagaaagagaaaagagataaaaaatgccttacattttattgcagagtatacttcccagagcatctggcaaaagctgtctttcttcattcctacttccaacactagattttcaaatgaacctatccccttccttactggaaaatgtctagaatctaaatataaatgacctcagtgatcccactgacctccagtcaggcattcagaaggccctctctggagaggattactgagaatgggggcaggagagcatcatggcctaggagtgtttccagagttggagctcagtgttaggcttgaaagaagggcaaagtcagggaggaggtggacattctggaagagtaaacaacataaacaaacactgagatggaaatatttcaatgtgcttacaagacagtgatggcgg

SEQ ID NO: 32963 - DNA, 2909 bp, Bovine  19866880718817
acttgtggtgccagagggtgggtcagggaagggctggactcggagtttgggactagaagatgcaaactattgtacatagaatggataaacagcaaggtcctcctgtatagggaactatactcgatatcctgcaaaaaactatagtggaaaaaacatataaaaaacggaatcgctttgctgtacaccagaaactaacacaacattctaagtcaactatacttcaacaacaatgaaaagaattttgtaagtggctgctgaagttcacagccgtacctcactccagggagtcaccctcaacccgaaggaacaatgttcccccgagatgcatttgagaatgagattgggagaggaggaagcctctggtagccaaagactgttgacaggggaacacaagcccagatcccttgcttcagcgagggatgagcgctgctccagcgcttccctgtggcatccagctgagcctgggctgcacctgtatccgtccatgtctttgcctgccttcttttcctgcactatcctgtttccttttcccttacagatttctcctgggagatctccctcaacagaaacctcacagaagaattccagtctcaagttctgtttccagaagacccaacttaagaaaccttcctagtaagtctaccttgatagccatgttaggaacaggagagattcttgtcttctttctcttctagacaaatgcacaaaaaactttatatgtccttgaacggtttggggttttggttttccagtcctgtatgtttatttagttcttggaggtcagtaaccggcatagcttagcatacctcttttacacctatgcatattaaagacgagaaaccaaaagaaaactttggtcccctgaggtgtccgggtggcaacagcatttcagtgcttttcttaatgcagcttctaccatttagggtgaaactccgacaggcatagcatattaaagtacaacaacatgactttcatcataactttaaagtttactttcaatagttctgctagcaatatgatggtgagggaagcttcagtagctcatggcatgtgtttgttaaatcataaatttgaaagggaagagagaatttacatgcctgaataaaattcatcaacttaaagttttggaaaaatattaacaatatttcaaagatctgtttccaagaactgagataagagggttgacattggtggtcatagaaagtatttctttgctcacctttgtttataagaatctgaccacaaatgaagaaaatagcttatattaacaattgaatatcattctcagctgggcaaaccccaaatcacaactttgactagatttccattccaggacgtggcatttgcagtatatcagaggctaaggaatttgtatgcggcagcattagtttttatgattgtattccaattagacctctcagtggcatttggtgttaaaatggaatctggctgtaacagacactaaataaatttagttcagcatttacacaaaaggactcattactggcaagttgggtagctctacagtggcctgtgttccgtcttgttgatttcccatcataaatggctgacattgcagatggaccacatgggtcaaatctggcccataataatttgggataataattagggttaatttgttaggtctgaatagtgcttttaagaaaacttgaatcaaaagtaaaaaaaaaaaaaaaaaaaaaaaccctaggaagtatataaaccttgacatcacttcttttgaaaaattgaagactgttgacaccagactcacaatccatgagatttgagtcatatatcaggagcgcccaggtgaggatcagatgttgctgttcagttgttcagtcatgtccgaatctttgttaccccatggactgcagcatgccaggctttgcggtccatcaccatctcctggagtttgctcaaactcatgtccattgagttggtgatgccatccaactatctcatcctctgttgtccccttctcctcctgccttcaatttatctgaccatcagggtttttttttccagtgagtcagctctttaaatcaggtggccaaagtattggagcttcaacttcagcatcagtccttccagttcagggttgatttcctttaggcttgactgttttgatcttgcagtccaagggactctcaagagtcttctccagcattacagttcaaaggcatcaattcttcagtgcttagccttttttattgtccaggtctcacatctgtacgtgactaatggaaaaacaataactttgactatacagacctttgtaggcaaagtaatatctctgctttttaatacactgtctagcttttcttccacggagcaagcatcttttaatttcatggctgcagtcactgtccacagtgattaaactcaaattgggaaattggaggaaaacaaaaaatggattgattacacatgagtggacagtgtgtgtatgtgggggaaccataaagcaaggagcagtaccctagaaccagtcatcttagggagtgactacagtcttggaggaaggagagggagaaacagtggagccagggaggcagcatggtggagaagcctgtctggcagagctgtgacttctcatgaaggacacaacgagcttgtggacaatgcctcagggaggaaaccacaggaataaatcgctaaagttcactctctttccctctgagtgtctgctagtgctcctcatgggctgaatgaagctacaagtcaagggagcagcccataaagggtagtcctgagggacacagagcagaatggagaagattggagcagggatctggatgtccaagtaggagatactcggtataattagcaactcacccctgtaaacaggggattcccctgtagctcagtcaggaaagaatctgcctgctattcaggagacccag

SEQ ID NO: 32964 - DNA, 1675 bp, Bovine  19866880739837
ttctggcaggaaagaaccctggcataagaatctgttgccccgtctttgaagtctaatatcatatttttctgtaggatattattgctgacaagaaaagtcttagctcattaaacatggcaaattttattcaaaagtgagtattttaaaggaatttgagaaatgccacaaagcattttgagggggcttgggagagggaatggtggtgtgtggtttagtcataaaaatgatacaagacataacaacattataactcaagaccaggcattaaatctggtgtcagcagacagctttcaaaatggaagaggtctacagtgagtggtgctgccatggttttatggcaaaaacttcttttgttagacactgaagttcaacattcatagcattagggttattttaaggtacttggtattctttgactatatcctttcacggtttggggatgagcagttacaaggagcaggggagaaaaaaaaataggtataaaacattcctttagcatcttagcatatttttttgaagaaaagccatgtgtctgttgggttgtaataggcaaaggcaagtctctattgcaggccatacaatttaaaagttatctgtgctccctgaaatgattggaaggtagattttgcccacaggctccaagactcaaagataaatctctttataaagaaacattaaaggtttaccgaaaaatttttagccaaagcgtacaaccagttatgtgtatgctgctgctgctactaactcgcttcagtcatgtccgactctgtgcgaccccatagttggaagcccaccaggctcccccgtccctgggattctccaggaaagaacactggagtgggttgccatttccttctccaatgcatgaaagtgaaaagtgaaagggaagtcactcagtcgtgtccgactcttcttgaccccatggactgcagcctaccaggctcctccatccatgggattttccaggcaagagtactggagtggggtgttatgtgtataagagagtgataaacactcacctttctccacagctttaaagagaaagtccctcatcacagatctcccaaatgcccaagttaccatttgacctgcgggagacagaggaagtcttgcttccaaactgaggtccctctgtacgaataatcaacttaaatccagtgtttaaaattcaaatgcatactccttccaacaatgttacagaattgtcaactgtgctcataaaacctctaatagattttataatgaattgatttttgggaaggctttgggcctgaaaaaggaagctgaggacgagaagaggccctaccattttctgtgactgctttcccaaattagggtattgtttaaaaaaaaaaaaaaggcatctattttaaagctctagtaaggtaaaaaagatttttaacttttatttttaaaggagaaccactgggtgtagtacaaccagcaaggatagtccttctgactgaggaccaaaagttaatcaggaaacatacacaaaggatgctatcataaaacatggattactaataaagtccaaaaacataatcaaaaagtcacatggactgccccactccccccactccatctaaacctagctggtttgttagtctagttcttaagaatgatctgtttacttctttagatgcccgagaagagaaataagacgatacatctg

SEQ ID NO: 32965 - DNA, 1397 bp, Bovine  19866880774324
ttttctcaaaaaacctttattttaccactgagggtaaattctacaggtgttatcagttatattttacagacaggaacctaaaaacagaaaattattctgcttattcaaagtttgacagttagtagcaaaactgggttaagaatttctgtctcgccactctttcttgctgttatttaattgctaagtcatgtccagctcttttgtgacccctgaactatagctccccaggctcctctgtctgtgaaattctccaggcaagaatactggagtgggttgccatttccttctccagaggatttttcccacccagggatcgaaccctggtctcctgcattggcaagtgtattctttgccactgagccaaagctacactttcgcttcctctcttatgctatcttttctccccatctcaaatcctctttgaaataatctaaagaatcatagcttagtccacagtttatggatgtaatagtctgatgattgttagacatttagagacacattaagttaataagggtatatttattttttaaatatagcagctctatgtgaaggtcagcaattaggcaatctagttcttgcctgaatgtatttttaaagcttatattcaggttagccatgaagttcacacccaaatgaactttttggccaacccaatatataaatgttgtcaaattaaacaaaactgaaaattactgaaaagtgtgtgaacacctgaatgttttgccttcattgcaccagatacctggatatttagaggcaaaataaaggtagggcttgagggaattattaggaggaaataacagattatgtaagaggaatgtgttattgaaatgaaagcactccataagtattaagaaagaaggtgagtaatcttggatagctccttttgtgcccagtaccccctccccagaccctttaactcactagacagacaatcttttgtagcacaaagactgtgtctgtacaaagtctaccacctgcctttcaccctgctgagctattaggctgagtggagaagtatttataatgcactttctggattcttagatgaaatgtgtttatcaagtaaagcctacttccaagtgtttcaatctcagcttgaaagtcatttcctagatcaaagagatgtacatcaacttggcagggggtctaaatctggaccagaaatgcagtaaatgaagagccactgaggtacacctggtcgcatctccctgccatgaagagaggtttccagcttcagaaaatgaaaacctcaggagagtagttcacacccaggacactttgtggtgggcccaggcaagaaaacgcctgctgtagcaaggaatccttttgtcaataaataagacaatgtggctcctttgaatgaagaatataaactaacacaggaatgcatt

SEQ ID NO: 32966 - DNA, 1812 bp, Bovine  19866880779658
aatgggcttaacagctgcagcacacaagctcagtaattggggagctggggctctagagcacaggctcagtagttgtgacacatgggcttagctgctctgtggcaggtggtatctttctggatcaggaattgaactgtatcccctacattggcaaccagattcgtatccactgtgctaccagggaagtcctagaattcatggattacaaagtgtttgttggttacttctttgttttccacttaacaatgatttattttttttagaactattcatagatatacatcaagaaccaaacaaaatctagacaaaatgtaaaagatcagaaaccttaataaagtgatggtgaaagcagtcagaatagcaattaaatttgtcccaagttaagtagtatagattactatatgtcctacatcgttcactgacaaaggttattgatggaagtgctgcttatctggaaatatatactattaatttgctcgcaaattgccaaaatatatatatttttttagcctaatcaagtatctaatattattgcaacctgccaaaactaaatttcagtagtggctcaatggtagggtattttcctcatggactgaacattttgctattcttctaaaaactactttctaaatattgtctgtcacttgattgtactcagccagaattggtttgggactaggttttgcaaaatcaggggttttgcccaacagtggctaatttgggttttggtttggcattgtggcctataagaacatggagggtttccactttccaagttttcttaactgactgatgacgcatcctgaaacaagaatcctatttttcttttcaataacttgttctcctttctgggagggtggcctgtgaaatgtagttaaaacttgttattttaacactactaaacaataagtcaacctaagctttacaacttactctatcatagatctaggtgactgtattgaggtaaggagctttatcaacctgtaacatatcttttttatttaggaaacccgcacaacttctctacactgctcccattcttcatctgtgactctgtttcctcttttctctctgagccaggaaatgttgatagctccaagttcttacagtcctcattcctcacgctccgtaagtccaccccaggactcccattctattccttcccagacttcatttacatgtcacatgtgtgtgtgctcagtctcttagtcgtgtccgactctttgcaaccccatggactgtagctcacctagcttctctgtccattgaatttcccaggcaagaatactggagtgggttgccatttccttctctaggggatcttcccaacccagggatagacctcttatctcctgctttgacaggcagattctttaccgtctgagccaccagggaagccccatacatgtcatacatacatatatttaacttatatgtgccatgattcatgaactctatgactccttgattggaatatgcaccattttatctaccactaaaaagatcaataatactaccaatttaaaaatctatccaagctatcaaatgtatgacatattccaacttcagaaatattaaaacatgaaaaaagttgtcttgggatcaatgaactatatatagtaatttaaggcaagataaaaaggaaataactttaaatgaccttataaaggcagaactactgtctttcattttgatttcctgattgtcttcagccctacctatctcttccttcatttgatttttacattactcaaacaaacaaacaaaaaagtgcctaccatatattgcatgtcctcagtacctacatactga

SEQ ID NO: 32967 - DNA, 909 bp, Bovine  19866880810572
ttgctgcctggcttccctgaaagttgactttggagtatctgctttagatgtccctctattttctcatattctgaagctataatattatctctgcatcaccaatgtttactccttctctgctcatagatgttatatttctggcttatattgatttttattttaaaaatgatgattgactcaaagcattcactatcctttcaacatatcaatcagttcatatgagacttttctaaaccttgagttctagtaggacttcctttactcctatataagtttaagtatattttttaaaaatgtttagcatttgaagaaaagaaattcaattattgtcttctggcccaatacactctatcttagaaacaagaaaggtactctgtaagtatcagcttctgacaaaaaacttttcctatacactgacttttttccttttaatataatattttgtagaaggaaatggcaacccactctagtattcttgcctgggaatttccatggacagaggagcctggtggactacagtccatgggatcacaaaagagttggacacgactgaaagactaacacgcacagtgccctacttgcaggacctcagctgcctgaccaggggtcaaacccagggcttggcagtaaaagccacaagtcttaacctctgaaccaccagggaaatcccttaacctttttaaaaaagaatgattcagaagtcagcaatcttcagtcaaattactgcctgatttgaatttcatgtcattttatgaactgaaaataaataaaaacatttaatgcttcatgattacatcaaattataaaaataactacataaattatgaatatccaacaaagttattgggggaagtgaatttttaagaattaaaaaagattcagagacattggaatggttaaaggttagat

SEQ ID NO: 32968 - DNA, 786 bp, Bovine  19866880905892
aattgaacccatgtcccctgtactggcaggcagattctttaccactgagccaccaaggaagccctcagcaagactctttcaaagcctagaatttaggaggaggtgaagggggcatcaggtttcctctgcttcaaagcaattgatagatttctttggaggcagcaatgtgcctttgtatttgagggacttaaatgtagatgttaacccaagaggataaatgtttattccaaaaaaaaaaaaaaaagctgcccttagccacactttgaaaaaaatccttgctacacagatgctggccagtgggcgtggatggagcaatgttcctctccagaggggacagtgagctcctctgggggtagctgtgctgccctcatgcgtggttgctggcagcactgcaagccatttggctaatgtacacatggcgccctgccacagcccagcaggtcagctgcccagttatgggggggaagtcattctcccacccactcccaatctaaaacagttatggttgttctgggccttgattctatccctttccctcagcaaaaaagagagaagtggagaaggatacagttagtaaaaaaaatacatctcaagctgagaagtgcatagatgattcaacagtcttccaaattctttctactgccttgctcaaagtaaagggcacagatttatttttcttctgttaaattcaagcgtgggttatatgactttctgggtgggcagtttattttttcgtccacattcagctttagttcataccttagtactggaatacatatgtgtgtt

SEQ ID NO: 32969 - DNA, 1662 bp, Bovine  19866880928757
ccccaaaggttccagcttggtttcagatttttgaaaaaaatctaggattccattgcatacaaatagtgaaaataactgtcactaggctacaattttgatgaattgcttacataatctgaatcatgagaagggatccagatgtgaccttgttaacttagaccagtaagtttcatttttcatactgaccattgatttctcaaactcttttcaaattctcactcctccatgaaacttttgtttccccctactctcttgttaactcatccaattggatctatacctgtcttatgcagaaattgcactctttcacgaactgcttcctgcttgttccagcccctgtctcagacatctgcaggcactgagagcgtgctcttgcagatattgtcccaccagctccaatgaagacctcgcctggcacgatttctgtttcttttcttctaatgaggacgtgtcttctgccctcagcctggcgtgaacagtctttggatgtctgcaggaacactgagttgagtcttcttgtttacccctccaagggcagtccagacgaaagacgtctggcctgggttgttggttctcacgccggtttccttccaggattgcagcctgcccctggagcctatttctcagccaaagccctgaccccttacacagtttcaaaccaccctttcttgcagtattgcttatcctgattcaaatgactctcttttctacttgttggccagtctctgcacttgatctcaggtggcctcagccttcagcagcctgaaatgggtctttggttcccggccagagattgaggctggattgaagtggtgaaagcaccagatcctagtcactagactagtcactagaccagtggtcagtgacaaggccctggcccttcagctttgcagaaaagaatttccacaaagacagaaagtagtgaaacaaagtatttattaggaggaaaaatagtatagtatgtgtggataaagaaaagggaaaagaaaagaagaaaggcaccaaaagacagatgaatatcttttggccagattcaaaggtgatgatgtgaaatacaaggccaagctaactggcattgatgatgtgccagttgcaagagaggataaaatgagccaagattctgtgatgaaactaaaggtaacagaggaaagcataatttatcactatgttaagcaaatctccaacagaggaagttaatattagaagtttgtatttacctatggctacctatggtagctcagtgataaagaatctgcctgccaatgcagaagactggggttcagtccctgggttgggaagatttgctggaggagagcatggcaacccactccagtattcttgcctggagaatccccatagactgaggaaccttgcaggctacagtccatggggttgcaaaagagtcagacacgacttagagactaagcatcatgtgtggatagacacaaggacagactcagggaggacccctgaattgtgctcgcgtggtaattcaaattacttttatggggcatttcttctgggtctccttggccaatcaatttgatttgcctggttcagaggccatatttggtatacatctggatcctcccatgtgtgcacacacatctcttagccaagatggattctactgaaaaggcctatgggtagagcatcccttag

SEQ ID NO: 32970 - DNA, 1132 bp, Bovine  19866880989528
tgaggcagccagagtatgatttgaggggaaaaaaaaataaaccaactagacattagaaatggaaggttataggagattcacacccatccacagagagatggatgatttttgaaacctcactttacagaatatgtggactccttcccccatacctctttcttctcaacccacttctgttccatttcttttgaacatggaagaaaatgcactcactatttcttaatcaggattaaataatataatcactccacagtcctgacttcacttgctttcctctcctggaagtcacagcagcaagactctgccatgaaatgagcaatttctctcacctttgttgtcatggggctctttgctgtcggttgcaccttttctcattaaaactgtgatgttctcaatttcaacctttccatggtgtatatcctgctcttaatacctagccactctcttttctcaggcgccctcaattttcaaggtgctgcatgacttcagctgctctgggttttcacataccactcattcatgcatttctttattttctccagagggtcctcgtgattccttgctaatgtgttagttctggtatgtggcactttgccactatctagttcaaattctgtgctttactaagattgcttattccagggtacaaatgatctcagtatttttctttgtttttgtatatacggcaaaaaacattctggagtttggtattttatactcattactaattctattattagaactaataatcacacttaaaaacaaaaattccacgtaaaatatctcatttgatactcccaaagcctggtaaattcttcttgttacagaaaggtatacggagttcaagcacatagtagaacagagatccaaacccagattttctaagtctcgtgttcttctcaatacatcattgaatcctgactttctttccttcttgtacagttagtatttggagtttagaatctcagctcacatacagaactttttgtttcttattctaatccaaaaaatttcccaccaaaccctagtaatttaccttcagttcaagaacccctcatcattgcagatgatgtgttaacatctgttctatcaataccctgacatggacacaggggatgtaggtctcggccag

SEQ ID NO: 32971 - DNA, 869 bp, Bovine  19866881264367
tatgtggtggcgttattttgattttaagaaaagaaatccatcttgtttttacccttcaaaggaaagtcaaggccagataactgaagatacaggattagaggggcacatccaaaatacagtttggatgaaattcataaacagtgttcaaagagataaaaaggaaggacatgcaatggtaaatagttttagaggaacccctggagtcaagaatcccaaaagaagacaaaaaacagtgaaaatgcacttcttgaagtttgctttaagagccacactttttcccccttgatgaactttggccttctgttaagtaaaaaaacagttttcattgttctctcatactggctaactgttctctttctaccattttcagtagaagtttctttctcccaagtaaagatgtcatagtgaaaatctgaatcctactgctaattcataaaatttatgaattttcagtagatgtaatctatcatgtgacatgctaaaatacaatgaattcacaacacagtttgatattaactacacttaagtttcttgatgtccacttaatgcaactatatgaaccaaatgtagtgtgttgaaaaagtgttttgttttaaactgctatacaagggagttagggatgacgtcactataactgtaatgactatagtgtagaacgctggtaccacagctctttaaaattcttctgatgtttttttaacatctggtgcatcgttctaagagttgcatgataaacaaaaatggtagatcaattaattcattcttacttaaagttgctccagaaagagcttcatagaacttgatatgtgggggataagagctgctgagggaaatgagggaaaggagaatgagaagcaggcgaaggcaag

SEQ ID NO: 32972 - DNA, 909 bp, Bovine  19866881632628
attttccttaagaatgtaaagaattggaggcaggtgagaatttaaaataataaacatattttaaaagaaagtagttgaagccaaggttatactgcattttaaattgtattgtttccccacctagtggtcaaaaagcagctagctccattttctattttattcagatgtttgtagaggaactgaaatgggtcagaagagctcgtttatcattttcagtgttcaaatcaacttctttagggtaccatatttcttggtgccactttaaaatattaattataattttaacaatgtaactgattattcatatgaatatagaaccaatagttgaatattttagtatacaaagcaaattacatggttgttaatagtaatgagacaggaaaagtgaagtaataagaaataagaaataatggaaattactatggttgaaaaaggaaagtttaaccagatcttactttgggatcattcttagtgtaagatttttctggctctaaaattagaggaaatgtaagaattcaccattgtaaccttttttattagttagaaatatttaacattttctggaatttgagacttgccatatcagtcatgcactcccagacagacttacctaagtccattggcttaaacaagtcatcataattgtataatttctcatgcgttaaatacaggaagacgtgttccagagaaaaattcactggatttcattttcagtgagggcaggcatgggacagagtgtcacttagatttcctctgtctttaagaatcaaactgacaaatgctaaagtcacagaataaaggtcatgaatggcaaataaggtataaaggtcaatagcttcccatctttaaaagtcaggatatagagctctaatagctttctgagcatgacagtcataacattaaattaat

SEQ ID NO: 32973 - DNA, 1419 bp, Bovine  19866881641117
cctagatgtggttatttcgcctgctttctgaaacttcctctctccttgccctgcttatcaaattcaatcaatgtttgctcaggttagctaacttttacatctatggagaattgaaaccatctacttttcatttgtgcagtagctacaggtggactttgcttagaaatcagaaggtacaacaaatccgccttcacagtctttcctttgtatgcttgataattaaggacagatagtttggaaactcacccctcccccaaccccatcccttagggaactaattattagacagtgtgtatctcagccttactgtgttgggatagctagttctgctattaaaaaaaaaaaaaaacagaatccacccaggcctgaaatgctgtctcatgcagttgtgagtacatgtgataaaattaggttctttcgggtgaatgtccttttgtgataaagtcaactcaactactttcaaagttataatgaataaaattgccagtagttcttttggagtatgcctgtacactgacaaaccaaaatgtattaatgtaagttaagcctcctaaacctcccattagagagtttttactagatttcacatgaattctttcaactaaatgtctgtcatagatcaaattcagcagatgtttatttcaacttcttttgatctctgccagtacttacataaggattcaatttattgttggcttatcagtttttgtagttaaaatctgactagaaactagcgattctgagctctggttttacagttccactagctggttttaaaaggtatatagtaaaattctgaaaaatgttaataaaattagtttttactgaattaatattttaaagagcatatagtagttttttggggaaattagtcatataaagtaaaagatcctaatatgaaaaaaaggagaaaaaaatttgaatgcttttaaaattcccattctcaaaacacttattttgactgaattttgttttgcaagttctttgtacattttacttatgagacagataatcgttttagaaaaattttgtatagcttttgttatgcaacaggcattactctattcatatgtaaaactacataagccttataacaaccttaataagtagtaggtagttattcatctctttttacacacagggaaacttaggcacagagaggataaactgatcaaaattgcatggctgaaaatgggcagcactgagattcaaatccaggaagtccaaccccaaaccacattcactttaaactctattcactaaaaatttaccatttttcacttagggttcctgttatactgggttagacttggtgtacatgatcatcaaaatgggttaagcagtaaacaaataactaaagcaaactttggatgtttgaatcttttgggggagcttacaagaaaaaagtacctagcccca

SEQ ID NO: 32974 - DNA, 1025 bp, Bovine  19866881951924
ttggcccctgatgcgaagagccactcttggaaaagaccctgatgctgggaaagactgagggcaggaggagaagggaatgacagaggatgagatgtttggatggcatcacggacagtggacacgaatttgagcaaactccaggagacaatgaaggacagggaagcctgacgttctgcagtccatggagttgcaaagaatcagacttagcaactgaaaaacaaaaacagcaaaaggatgagtggtagaatttagaacttattcctgggcctttagccagaaggaagtctctactcattgtccagcagtagaagtgctgccgactgcctccaagcatcagatgaggtagaaactttgaatatacatagtcactgaagctcgttttatcactctttcttttatatcaatatgatgaaacagatctgtaagaactgaataactgtctaaagtagattgggaaatagaatttttataatattaggttgctgctgctaagtcgcttcagtcgtgtctgactctgtgcgaccccattagatggcagcctaccaggctccctcatccctgggattctccaggcaagaacactggagtgggttgctatttccttctccagtgcagaaagtgaaaagtgaaagggaagtcgctcagtcatgtccgactcgtagcaaccccatggactgcagcctaccaggctcctccatccatgggattttccaggcaagagtactaggaaggggttatagctattgttcctcactccctatctggaatgctttccttccaagaagctttccctgccatagttgatgctacaggaaaaatgtcatattgcatgtggcatttttatactgccttgaattccaattacctgtgaatatgtcatctacacacatacatgtatatgaatttctggaaggaatcactgaattgtatttattctggaattccttgcatagtgccttgaatatactgtttgttaggtgtgttgaatggatgaataaaactatcaagtttcataaatttaagtt

SEQ ID NO: 32975 - DNA, 751 bp, Bovine  19866881970756
aaggaaggtcaatccagggtacaaaggggagtaagataaggaatgatctgagtacaaccacaccaaggaacagaatgaagagggaagggaattcaacttcttcttgtgtgaaagcctatggtaaatatataaaagctatttgcctcttaactgctttgcaatttactttcggtaaaatgattaaataatcttaattacaaccacctataacagagtctggaaaaactgtgaaaaatgaaacataaaaacctgagccccaaggcacacctcttaaactgttccaagcaataaaaataatgttacttttaaatatcaaatggaaactcttttagaactcttcatacttctaatttgcattctgtgctaggacatatgtctcctaagataaacatgaaagaaatgtaagccatgaaaagtcaaaaaaaaaaaaccaagaaatacagccaatgtcaactgatagattcgtattttccaagaggtctacctaaagtgtggcttgatttttctgttgaagacaatataaactgtcatccaggccacgaagagttgaaaacaacacctagagctaaaaagataagggaaaaagtaagtaatgtcatggaatgtgtatatgagaaagtgacaaagtacttgccaattgtcagttttaagctaacggggaatttcctataaacctagaatagtagattcctgacatcaagatatcctaagtattgttccactgctactatttttcttccctacttactat

SEQ ID NO: 32976 - DNA, 1334 bp, Bovine  19866880124880
ttaagtgaagttgctcagttgtgtccgactctttgcaaccccatggactgtagcctaccacgctcctccgtccatggaattttccaggcaagagtactggagtgggttgccatttccttcttttagacccttgagttgactcattggaaaagactctgatgctggaagggattgggggcaggaggagaaggggatgacagaggatgagaaggctggatggcatcactgacttgatggatgtgagtctgagtgaactccgggagttggtgatggacagggaggcctggcgtgtgcgattcatgggggtcgcaaagagtcagacacgactgagtgactgaactgaactgaactgagtaacattttaaagatttttttacctttcacatttttttttaagtttattcctgggtatatttttttgcacagatttctctgttactgtatcagggagggatgctttctgctacaggttcagaaaacccacaaaagtggctaaagttgataggagttaatttgtctcacataacaaaaatgcagaagtatgtggcaactggtatggttctacagctcaatgttgttggacctcgcatccctgcagttttgttttggccttttcttcaagtgctcattgtataaggggtgctgtacctctagccatcacattcacatacaaggtaagaaacgcagggagaaaggccaagattatttttctcatgttaaataaattttcatggagagctttcagggctcatgaacaggatcttgttggttgcttggaatgtgggaacatcccttcaactggatttttggttttgttttttaaatttctgcaggaacctcaggagtttcaccaactgggagcaatttttatgttaatgtagacctcagatttgaaatttttaatcacccagaatttaagaagagagacatgctaccttatcatctttcagtaatagtggacagaactttttctattctatatttccactaagaatggcatctcagttccattttcctgctttccacctgggcattacaatcaagagccagataaatggccagttggccttctcaaaggccagttggccacagcatcaatgcacagctttatctttcaagtttatcattctttcattttttcccactgcctggagttttctctttcttttttgtgaactaagctatgtattttagacaatacttttctattttagctttttgagtcatctagtctaccatattgcttagcacaaagtttagtacatagtatatattcaaatgtattcttctttccttcattcaggatgtggtagaagggattgatgtcaaataca

SEQ ID NO: 32977 - DNA, 3427 bp, Bovine  19866880159748
tggaaaaaccatagtcttgactagacagacctttgttgacaaagtaatgtctctgcttttgaatatgctgtctaggttgatcataactgtccttccaaggagtaagcgtcttttaatttcatggctgcagtcaccatctgcagtgattttggagcccaaaaaaataaagtctgacactgtttccactgtttccccatctatttgccatgaagtgatgggactggatgccatgatcttagttttctgaatgttgagctttaagccaactttttcactctcctctttcacttttatcaagaggctctttagttcttcttcactttctgccataagggtggtgttatctgcatatctgaggttattgatattttgcccggcaatcttgattccagcttgtccttcctccagcccagcgtttctcatgatgtactctgcatagaagttaaataagcagggtgacagtatacagccttgacgtactccttttcagtaataatattgcaaggtgagtttaaatcccagctctgtactcactaactatatgacctcagttacttactatttctgtaacttttttcattcatctatgagatgggaatatagtggtatttacagcatataattgctggcaagattaaatgagataattagataaagtgctttgattggtgtttggcacatacttgttgttctgttgcttggcacatacttgttgttctgttgcttggttgtgtctgactctttgtgcccctatgaactacaacactccaggctttcctgtccttcactatctcctggagtttgctcaaactcatgtccgttaagttggtgatgccatccaatcatctcatcctctgttgccctcttcttctgctctcagtctttcatctttcctagcatgagggtcttttccaattggagcttcagcttgagcatcagtcctccaatgaatattcattgtttatttcctttagaatcgactggtttgatctccttgctgtccaagggactcctgagagtcttctccaacaccacagttcaaaagcatcagttcttaggcgcccagccttctttttggtgcaactctcacattcgtactggaaaaaccatagctttgactatgtacataaacacatagtacgagattaataaatggtagcattgttactatcactttcattttgtaaatgagaagctgaatacagatttagcaacctgaatagattcacttgtaagaaccaaggatgtgtttcaatacaggtttgtgcaatgccattactctatctttttatcagactgcattttgtagttaatgttttatttgttggaatatgcattctgaagtgctatagagtgtttggaagtagtttgtgactcttagatatttaaaactatctttctgtgatgttttactaatagtttacataaactcagaactaaattggttagagaaagaactgtttggcctggttttcctgtgattagatgcaatttaagggcaaatatcctggggtcgtggtcagtggttagtaaaaagaacaatgtgtttttttcctgcctaaacaggttattgaggtgaagctgacagacagtaaactacacaaatttaatacagtttgctaagttttagcatgtgtaaacatctgtgaaaccatcactgcaattcaaatagtgagtatatcacacaaattgtgggaggaatcacctcccacaagtttcctggtaccccctatgcaatcccttcctcctgctctccctgatccgtcacccacacaaacattggtctgccttctattactttttacttctattattcttatagattaaacagtggttttgaagttgtagcaatcaggatttagatctcccattctgtcactgtgttagttgggtgactttggagaagtcattctctctctcagcctggtttattcacctgtaatctagggattctagcaccagcccaaaggaccacagggaagaggagaacagtgcctagaaagagccttgcatggttcctggctcacagctggtctttagtccctgaaaggcaccagaccagctttcagttggtggctcagagtacatttaggtgttcagagctccaaaatgcttttctgtcacctagtccttgtgttccctcttactgaatgagctttcttgaaataggaaagtttagattagacaacttgaggccctaaagggctctctggtatttcttccttccctcctgcatgcccagtgttccacatgctattaattataaacagatgttcttcataaataagcaaagaacttcaccacagatttctgagttctttatgcctatgtttaagtctgacgttgtgataaaactgcatgcgcaatgagtttgtagtcagagttctagattttggttcccatgctgccctgggcaaattgtaaaatctttttgagtctctgttttctcagatataaagttgaagagtatcataccacacaaatttgttgggaggattaaaggagaattttgaaaatgaattgtatgatgacatcatagtttatctgcattgtcctgtgactggcttgcagtgtagtatttaaacttgatattctagaattttttttgagtttattttattaggttttactaataggtagcgcaagaaagcaaaaaccaaaggttaaaagtgcttagaatttaaagtcagagaaactttaattcagatattaatttagtagttgtgtgaccttgggcaagttatatactttctctgagccttaataaggtatatctggtcttcctcagagggttgttgtgaggaatagaaataaaatgtgtacagtgatgggcaaatagcagatacttagtggtgctactttttcccttccattcccaaaattggtagatttgtggagttcagtgggctatcactgaagagattacttctgtcttccccattccataatacaatttggcccaggatagccattagatggtgtctcagatttcccatttaagtctgaaaatgcgattcgaggtttatgatgccaacagttattgtaaagggatttcccccccctaataataggaggaactgatgccatgtttttgtattttctcgttaattctcattgctgtagctggaggtactttgtactgtgggagccagggaaattgggggccatattgttttttctgtttgtgtttatttggattggagaattgtctaaaggattcttagtgaataaagtagatttgctaaattcaaattcttccttcctgggtgaacccaggaatgacctcctgagagaaaaacataggaaaatgtaggggtaactggtgagttctgcttgtgaagtcaggatctttgagttgggggcagtggagaagagttgattctccattctcctcttaccctccagagcgtttacagcccaacacaaa

SEQ ID NO: 32978 - DNA, 1473 bp, Bovine  19866880173004
ttccccatctatttcccatgaagtgatgggaccagatgccatgatcttagtttcctgaatgttggctttaagccaactttttcactctcctctttcactttcatcaagaggctctttagttcttcactttctgccataagggtggtgtcatctgcatatctaaggttattgatatttctcccttgctgtcctgtaaataaattcttcagtaccatttttatagattccgtatgtatgtgttagaatactatatttatctttctcattctgactcacttcactctgtataataggttctaggttcatccacctcatcagaactgactcaaatgtgttcctttttatggctgagtgaaactcctgtactttggccacctcatgagaagagttgactcattggaaaagactctgatactaggagggagtgggggcaggaggaaaaggggacaacagaggatgagatggctggatggcatcaccgactcgatggacctgagtttgagtgaactccgggagttggtgatggactgggaggcctggagtgctgcaattcacggggtcgcaaagagtcagacacgactgagcgactgaactgaactgaacagggtattttcctatctcatttctccttgctatgacttcctgttctccttccttgaacccctagaccccaacactctggccactaggccactcatttttattctatgttgctgtgtgtatgtgtttgctcatagggctcccacaggctggaaggtctatctttgctggaaaaaaatccttatccacaaggcccaggtccaccagatcttctcttcccaccctgacaatgacctcccttagcactgtttcttgttaatcttacagataaggacacgcaggctggatatggcccatagctgagttctggaggccccagaagataatccttgggtatcttgatcttctgccatccccggcctcttagcatcagagcatagacacacggttcttgatgtacacatgataggggtcactgcgcttgtccactttgcgggagcgggtgtatccgaggatgagactgcccacagtggcagcaaagaggaacatgacgaagaggatgtacatgtaggagttatcattgcggccaggcaggctggcccgcttctcctcagtcaggttgtctggccctggccggcagagcaagttgctgtgaagagtggcatttaaagcctttagcacagcgtgcaggctctcatgccaggtctcagccccactggtggtctccatagcaacagggaaggtgggggaagaattggaggatgttctggcagtgacagaaaagagagaagatggtttctgttacttaaagcttgaatgacccttccatttcttcagaccccagctaaaatcccagcctcacagtttattctaattacttgtttacctatcttctccactagaccgcaagcccgaggaagttagggactatgt

SEQ ID NO: 32979 - DNA, 1622 bp, Bovine  19866880359122
taaagtagagagttgccatttccttctctagtgcatgaaagtgaaagtgaagtccctcagtcatgtctgactcttagcaaccccatgtactgcagcccaccaggctcctctgtccatgggattttccaggcaagagtactggagtggggtaccattgccttctctgatgtatgtgtgtgtatatatatatatatatacatacatacatatacatatacatatatatatatggtatgaaacagcttgggaaattttaatatcgacagggtatataatggtaataataagttattcagggacttccctggtagaaaagtggttaagaatctgcctttcagtgcaggggatatgggtttgatccctggtcagggaactaagatcctataagccatgtggcacagccaaaaaataaaataaaatgactggtggaaatgagtcattcatttttaggtatgatagtgctctttctgttatctatttacaagtctgtatatcttgaacaaaattgttaatcttagaggtatttcttaatgaaacaatattgaggtctccagatttgcttcaaaataactgcaaggagatccaaccagtccatcctaaagaagatcggtcctgggtgttcattggaaggactgatgttgaagctgaaactccaatactttggccacctgatgtgaagagctgactcatttgaaaagactctgatgctgggaaagattgagggcggtagaaggggacgacggaagatgagatggttggatggcatcaccgactcgatgaacatgagtttgagcaagttccgggagttggtgatggacagggaagcctggcgtgctgcggtccatggggttgcaaagagtcggacacaactgagcaactgaactgaactgaactgaatggttattacaaactgaatagaatttgatagtgtgttcatttcttagctatccatgggaaacttgtaagaaattttgttaggatatttcagctgtaaataacaacaaaccttaactgttatgaccttagaggaatatactatttcccacaactagaagctctgcattgagaccacaacagcgttgattcattcattcagtggctcagaactctgccatcctcagtgtgtcactcctgtcctcatagttgtaagggactaattcatttccagtcgtcacatctgaatccaataatgtctaagagcaaaaaaggaccgtgtatatctttttattggcctgagaaaccttttccagaggtccttggcagctttctactcatatctaattgcccaaattagatacatgcctaatcagtccctggcaaggagaatgagaccacatgaatgctttggatcaccatccttcactcttggcataggcagaaactggagagcctggggcaggaagatggaatctactcaaaagtggaggtctgctggcatgagaaaaggaagaagtggcatatggaaaagcttcaacaatatctgctaaaggcaggaaaagtaacaacaaggagagagagacagagacataaaacagagagcaagaggcagaggctatacaatcctaagctcttgaatgcacagtaacatcagcattcagagaaggcaatggcaacccactcca

SEQ ID NO: 32980 - DNA, 1333 bp, Bovine  19866880456329
tccaattggtagagttcagatcagtggactagcccagctttctccaacccatcacatcgatggattttttaccattgtttcaccaacatctaagaaacttggagaactccaggtaaaaatatcataattgtctgctacatagagtaaaacttcaggggcacaaatatttgagtctgtctgtagaattggaaggtacgtgactcccaaataccgtgcaaatacccactccatgcctttgttcttacccaatgactgttttgtacttatttcccacttatctatatcctctcagttctttgctgcccatctcaagttccaggaatccttcacagctcctcctgcattcattcttctctgtgctctctattaattttataacatgaattacataatcattgttcagttataatcttacatagtctccaaaatcatatatctgtagtttccttttaatttcctttccttttagtttatagattccttgagaaacaggacagtattttctacttttctttgtttttcccacagctcctaaggtagtgccaagcagtagtagcttgtttgactcatttaagtggtatctttgatgttcattcattgattctgcctacattttttttttgatagtctgttatatgccattaacttaggatacggagataagagatcgtcctttcagttagttttccaaagtcaggtaggctgaaatagaagagagtatcaaatagaacacagtgtgatacatatatagtaaatatacgtactggatagtgggaaagaacatagaagggtccctttctgagggagactctgggagttcttcctggagaactctgaatattcaaatccttgagaaatttggtgagtttaatactttgtcaaatatattctaaaatatggatagaaatttaagcagatatttaagaaagcagttcaaaaaagaagaagaaagaacatataacattaccagatttaagaacttgttataaaaccacaagcacataattgtgtcaaaggaagagaataaagtccagaaatagatttaactaaatgaaagaacttgggcttccctggtggctcagtggtaaaaaatctgcctacaatgaaggagcctcagaagactcaggttcgatctctgggtcaggaagattctcctggagggaggccatggcaagccactctagtattcttgcctggagaatcccatggatagaggagcctggtgggctacagattgtaggatcacaaagagttagacacgactgaaaaaactgattttgcatgcatgcaagtgaaagaacttagcattttctatactctttatcatattttt

SEQ ID NO: 32981 - DNA, 3128 bp, Bovine  19866880508281
ttctacacccccaagggatcggaccgtgagtgctgaggggtgggtcaaggcaggatctaggctgtgggtcaggagatcagggtggtgcagactcagaggcagagctgaggcatgggaagctgaagcatgaggagactgagcctcatgtcgaggaggatttggaaccctggcctgggagaggtgggcatggggcaggggcagcccccagagaccggcatcaggcccgcagaggtgcggggtagtacaactctggcccgcttgctctcctcctctccagactccagcatcattacccggattttggcgggctgtaccacgggggccatggcagtgacctgtgcccagcccacagacgtggtgaagatccgctttcaggccagcatgcacactgggctgggaggcaacagaaagtacagtgggacaatggatgcctacaggaccatcgccagagaggaaaggggttcggggcctgtggaaaggtaggtctggactccaggcttgggggtcttgggcagcgtcttctccaccctagggctgggacagggaactgagcaagcagggagctcccatcacaagtattccagcagttctaaaggaacatcctaacatatcccaatggaccagctgactggccatactgccccaaattcagttcagtttaccaacctttcaccacgcgcagggctctgagggagacagaaatgaacagaggataccctcacggctcacagtcacagaggagagaggcatgtcaaggagcagccattccacagggcaggatgtgctgggttcacacagaggtgcaggccatgagggcttagggcgttcgggggcagaggtgatgtgaaagttgggccccaaagttccagtgagctcctgctgtgtggagagggaaggaaggggccccccccagcaatggcctgtgaggggtgactgatgcgcatggagaagaaacagaggccactgcggggagcagtcatgagaagggggcttccttgggaacaaaactttaaggttctctatgtgtttaagtggtgatgaccttgacaaataatgttgtctctaccacatgtggccagggctcacatgaatcttgcagaagaaaacaatgacccagtgatggttaaaggcaggacacctgagtcacagccttgcttgctgtgtgccttcctggagcccagccctcatctgtgaaaccagcgggtggtctcgcaggtcgcatggctgcaacctgtcactgtttcaaaagcccaccattcctctccgaggaaaggcttccttgtctggctctagccaggtctcagggaggcatattttaattttgatgggtattgcagtttatcctctgaaatgtggcccaaacacacacaagagggtctctctgctttttgtctctaatatggacatggataatctgagagcttttaacatcggaaaggaaagtgtggaatctgcccatccagggtggactcttctagaccactggaacgaggcaccatatcccccacctgggcctgtggccttgcagccagggggtccgcttcttctatttcccactcatcagccccacccgcttcctgacaggaattctgcccaacatcacgaggaatgccattgtcaactgtggtgagatggtgacctatgacatcatcaaggaaaagctgctagactaccacctgctcaccggtgaggccctgggctccaggcagatagccctcccagtctggaggggcctggggctccacagagtgggtgccacccacaagcaaccgggctttaaaaggagtggagggaggcagggtgcccagcatcattagggtgagtaaggaggaaccctagacgggaggccaaagacctgggctccagcccagcaccatttctccctgtgcaccttcaagcaagggtggccttctctgaccagtttcctctaatgaggtggttgggccggattagcttccaactctgggacagcccagttttgtgagtcctcatcaagagctccatcttggcactgcaagagatttggaaaacactatcctcatacttgggcttccctggtgactcagaccgtaaagaatccacgggcaatgcaggagatacaggttccatccctgggtcaggaagatcccctggaagaggaaatggaacccactccagtattcttgcctagggaaatcccatgggcagagggacctggtgggcgactgtccaggggcttgcaaagagtcagatttgacggagcacaagcactagactatactaacctcatgcccagggagttcagtttcattagggacaaacaatgaacacatgtgaaacagaaaacaagggccctcttcgtctcacagcccaatatctgctcttcccaccctgcgacagacaacttcccctgccactttgtctctgcctttggagctggcttctgtgccaccctggtggcctccccggtggacgtggtgaagacgcggtatatgaactcgcccccaggccagtaccacagccccttcgactgcatgctgaagatgctgacccaggagggccccacagccttctacaaggggtgagctcccctcctgccaccagcaccccctcctagagaaccaggcctccctccccgtctcccttcctcccctccatgtagagtgtgtctgccatgggatcacctagaaatacagtattgaacagcacagatgtaaatgccacaaaggaaaattacaatataaagacctaaggaaatgtttttttgaaagagaggaccaaatctgaattgaagatcagggaggcctatctgagaaaaaaaaaaggagtctatgcatagatccaagtgcatccccaaacacacaggaagaggaggaggagggaaaggtgcttggtaatcctgaggtttttccctgacccaccgacatcactgcgggtcaccactgccgacagcccgtatgcttcacacgttcctggcatttactattccctctgcatggaagccattcctgcgtcatccacatgctctccaacttactgtccttcaagactagttcaaataccaccttctccctaacactcgcagatacaaattttccccctctgtaacttcagcaatacttccctataccatttttacggacccacca

SEQ ID NO: 32982 - DNA, 1203 bp, Bovine  19866880519942
tgagatcagtataatgggctgcacaggtcacaaagaaatgaaggactgacagctgggaagatcaaggaaggttctcattcctcatttcacacatgaaggaaaccaagattattatcaaattagggagatgtaaaatactcagaaaaggaacggcagtggggttttaggagggatagaaaatctaggctccaatctcagcattaccacaaaatagactattgacctataagcaaggcattcattcatataggcatttggtaaagcatttgagaactattatgtatcaggtattgtaccagtaatttccatctctttatttgttgtgcctgccaagattatctcatagcgagataaaatgaaattatgaaaatgaaagcagttcattagctgcagaataatgttaacattcctatttgtatagttattcgcacaaaatactcttactgacattattttctataatttttataattccatatgatgggcattatcacttgcattttacatataaaaaactaaagcagagaggccaaattacctgcctaaggccacacagctagcaagaggtagaacacagctctgatgcaaatcccataaatgtaaagtattaactaacacttccagacaaatacaagactgcatacgattaagtgccaaaaataataccagctaagagttcaaaaaataaacaagcactttggctagaatggtctgaaaggttttaaggaaaagattagatctgagctgcgctttgaaaaatggagcatttggaggtggtgaaaaagtaagggcattctgagaaagctcctggagatcaaagattaggaattcagtattgggtaaataaagaggacactacctggtcaaaagcgacaggtcagaatagaagagggaaatcagtaacaaaggaatctagaagggagaagtgacatcagactcagaggggccctatataatcttataccttaaggtgatagcctatgacagatttccatgggttcttcaggagtatgtgtgttgtgtgctgtgcttagtcgctcagtcgtgtccaactctctgctaccccatggactgcagcccgccaggatcctctgtccatgggggcagaatggctaaaaacagtacaccttgaacaatgatcgctccctttcagcagcattcctcagattcaaagcttttagagtaggagcttaagtcaccaat

SEQ ID NO: 32983 - DNA, 2147 bp, Bovine  19866880602766
agagaagtcttctcacttttggtccacaatatcctggtcctttccctggaggcagtgtttggaatacttgctttagcagcaaataaaaagttttcaatattttcatgaattttgtttagtatgttcattagtttctatttatttttatagaagtaaatggtgactggcaaaaagctgatgctgtctggaataaaatgcaagaagaaaatattattcctcgtgagaagacattaaggttattagcagaaatccttaggaacaataatcaagacgttccatttgatgtacccgaggtaatttgtttttaactacaagcataatagattttgttgtcgatgtaaatttaggttatagattaacccagctttacattgaaaaggttgctgtatttaccactttttctttaactgaataattttatttttaagttgtggtatgaagaagaaaaagattccccaacttcattaccctcacctgtagaagttaatctccagaaagagctattgaatgcctgccgcacgaggagaaacaaaggtaaacacgtgccctggggtcttcgtttagatagcagcgtgggatctaagcccagcaagtcagtagtgatttaggaagagatggaattctctgtatatattagttattttctttcacttaacaaagacattttggtacaattgggaaaatttaaatgtcgactcagtagtaggtaattaaggagtcactctcatgtttatattagatagaataacagcttatgatttatagatgtcattgagtttggagatcagtagtgaagtattgagaaatgaaaaaactgaagatttctgtaattcattttaaaaatcttaagctgtaagccataaaatatttaagtcaggagctatgtgtttaaaggttaaacagatcaggaaacatgttgcttattagatgtaggcagtgggtatatggtgggggtcattatactattccttatatttttctgtacacttgaaatttttcataatgaaaactaaaatacatgttattttatcaaaattgcactttgaaaataacgtgatcgtgaattttttggcaaatgtatttgttacatgttttgattttatgtgaaagcaaaaaacgattaggactttacgcttcatacagtatctctgcttaacatctcaaggttgtaggctggatatgagacccgtttcttgctcttcttcccttttttcagtggtgatatttccagaaggtgtgcctacctctcttaaactactttaaaatttctgtgactatcttgaaccctctgatacaagcttgcctttcacattctagatgttttcattcagacttcatcatactcttcccagatcatacactacttccattttcttcacttaagttttctctgtagaatgcttctgttatctctaatttctccagtttttatctagatttccaagtatgctttatgataatttaaccattatgcagcagatttgttttcattctagtattgacagttttgagttctcttccatagaaagccatcagtttaggaatttatagaacctcttaacttttttttcttcccaagagggcattaaattttttattgattacacgtgataatagatgatacacaagcttcattcccatctataactttattggtaccataattcattttaaatatattgcataggatatgccaacaatcattaataaccaaaaaagaactccatgacttggcaagggtgacccttttaacggtgaactccaggtcacaacaaaataactgtcagttcaactacaccaaggttctgaagacaatagcttctccaccaaagcaggttgtaaataaatttcaaatggaacctgacgtcaccctgaaggaattctaacttcacactgttggagtagtttaccaaaatggcttcagagtagactaactttacacagcaccttaaaaaaaaaaaaagacatttattcagtatcatgaacagactattgcatttagcaatcaacagcatgggtgggaaaaaaaaaatctacattaaaaaccctttgttgaaatgctttatactttgcacagaacagaaactaaaataacctattacacaattagtcacaagtacagttctcaagttttttgcccatacaca

SEQ ID NO: 32984 - DNA, 1951 bp, Bovine  19866880626961
catgcttggtattggagattccctggtggctcagaggataaagcgtctgcctgcaatgcaggagacccaggttcgatccctgggttgggaagatcccctggagaaggaaatggcaacccactccagtattcttgcctggagaatcccacggacaaggagcctggcgggctacagtccacggggtctcaaagagtcggacatgactgagcgacttcacttcatttcatgcttggtataatctgctatcatcatcttgaaattctttcttcgttcattcatccatttatttggctacatcaggtcttagttgtggcatgtggggtcttcattagattatgtgagagcttttgctgtggttcaggctttctggttgtgccacatgcgctcaacagttgcagcgcacaagacaagctccagagcacacgggtttcaggagttgcagcatgaaggttcagctgcttctcggcatgtgggatcccagaccgaccagggatcaaacctgcatcccctgcattgcaagacagactcttaaccactggaccaccaggaagtcctttgaaattcttaataatttttaaacaaggggttttgcattttcattttgcactggatctcataaaataatgtagcaaattttgtagctttttctgtgtgcatgtatatatgtgtatgagacagagagattatatctctcatctttacctcagtctaatatatgtgtattagtatttgtaatatacagatatcagggcaaacattctataattctaagattcttttgttcttcaagctactactagatctatcttactgttcaaataacagaataactatattgatgccactcactgtctaagtgaatatctggctaaatgaattagtgaccaatggactagatgtctgtgaatgcttggctagatgaccgggaatgtgtgagtatagaagctagatagaagtggagtccaacaaatctgattctgccatttactaaccatgtgacctggggttgacccagttaagttttcttggtctcagcctacctcatcggtagagtgtgagggttaaatgtaatatcaggggtcctcaacctccaagatctaatgcctgataagctgaggtggaggtgatataataataatagaaataaagtgcataataaatgtaatgcaggaaagcccctttgcccctagttttgatgttctccaaaccattctccattctgccatgtagtgatttccatgggcatgattatgtcatgcccacaaaactccccgaatcctatttcttccaggataaaattttgtacatcttagatatcattcaaggacctcctgtcatacaatcagcaaaaacgaatagaggcaatatattcccaatcccttgggatgtgttttcacatttctacctaaactttttacctaagccttccttttcttttttgcaataacagtttctttttacctgttaaaatattttaaatcacagtttaaaatgcccatagaaaaacaagagtctaaaaaaaaagaaaagaaaaacagtctaaaagattgctctgtaaacattagtcccctgccatttcccctcttctcagaggttacaactttcactctcgattattttcacatattcctcatatctctaaatacaatgcttatgttactactcaattttaaaatttaaactttccagtcctgaagatgttgctctttcatacatacacacatactcacacgtctttcctgtgcacccatcttgccagtataccataactttgcacaaataagtgttcatgcaaatactaatccaatctgagacacgtggtatattataacaactttcccttttctgcttaatccccccatttccttaatttcctgtcagttttataaaactccttgcaccatattcagagacatcattaaaaaaaaataatttcatctccttctgctgt

SEQ ID NO: 32985 - DNA, 1142 bp, Bovine  19866880667772
cttttaagtatctcaagagatgtgataggaacacctccacatgtccaactgaacatgtttaagttcatgtccaattgaacatttgtttctatatgtacagtttgtcagagaaaaagcattaagttgtttttgtatgaatgcagaataggatttatgcaagaattaatagaaaactagtcgtcacaggccttgccttaaggaaaccttcagtttccattgcatccattctgctgagggttgtacagttattgtgtactttaaaaacaaaggccccgggggacagtcatttgtgtagcgtctgtttcttctgccaaatggagagcagagggattgtccatagctcacctcacgggtcctagaacccagcaggacctggactcagtgtttgctggactgaatgaactgaggatgggtcatggggtatcagggagctcctagcccaggacagctcttattcagaccatgactctggtcggaggtggatctggaagcccgatcccttagctgtagacatttcgagactggaaatcttaacaggaaagggtaaagactaagagagcttcttagaactttacaaattcttcagaacagaggcatttttcattttgttctgtgccttgttctgtggctagccctgggccacagagggttaaacccagtccctgcacttggggcgctcacagtccggagacagtataggtaggggactggtgaggcccacaggtaaggacggtgaagtattgagcagtgctataagaggggtatgtgtgaggcactgggaacagaaaagagagctgctaacccaacttggtgctacagcaggggcttggggtggggagcagagaaaaggcagagaaggctcttttcagaaagggacacctgagctgtgccttgaaaaataagtagtttactaagcagccaggaatgtgaaggacattcccagcagagagaagagtatggacaaaggagggaaggataaaaagggcatggtttcttgagagaagggttcactgtgcagctccaacaggccacttccctcacccctggccccagataaggtacaggacggacagggcttggcccagggtcactcactctgtctccacagccagccgcccctcaccagggccatttcctcaaaa

SEQ ID NO: 32986 - DNA, 840 bp, Bovine  19866880694491
atgcattggagaaggaaatggcaacccactccagtgttcttgcctggagaatcccagggataggggagcctggtgggctgctgtctatagggtcacacagagtcggacacgactgaagcgacttagcagcagcagcagtgataaagaatccacctgccaatgtaggagacaacaggagatgtgggtttgatcctcggatcaggaagatctcctggagaaggaaacagcaacccacgccagtattcttgcctgggaaatcccatgaacaaagaagcctggtgggcgacagtccacagggtcgcagttggacatgacttagcgactgagcatggatgagcacgcacacacactatatatatatttcttaaagtaaacaaaactactcaaagaaaagcatcttctacagctacatccttccctagtaaggcagaggggcaggcagggcctcttaccattaaaggggttatctcctccaaagaactcatggaaaactttttctgggttgccatggaagacgtaaccagttgtccatggggtctgcgatccaaactccagaggaattccgcccttcagaccctcctctccaaacttgtcatagatgcctcttttcacagctgtggatatgtgtcaccttgagaaggggccagcatgggggctaagagagctggagggctgggaagccagaggatatggggcagggaggaagaagcagggtgaagacagccttatttctaaagtgcctgctgtctggaagtctttggagagagacactagaagttagggatttaatttcaccctgggtggacctatgtaaggccccatagcccagaggaaagatga

SEQ ID NO: 32987 - DNA, 712 bp, Bovine  19866880739882
tcatggcaagagttatgaattgctgagagtgcaaaagagtgacctgcattgactatgaagccactaaacatttgtaaatgcagctgctgctgatacaggtgagaaaccgcctcctacattggagatgatgattttaaagtagtcagcgcattggaaagagtactgaggaagaaatagactcaggctctaatctgacctctgtgaactttgtaacaagttaggaattctttggagattcagtttactcacatgagaaatatggaaataataaaacaactgccctgcctgacacattcagtcctattgggaagatgaaataaattaagagacatgaaaatgctgaaaaagtggtaaagcagatataaagcattatgcttactgtgatgaaaggagtgggtctcttgcttactcccctacctggaaataggcgaaggccaggtgatccaaggcatcctcaagacttgcctcatcctctgtcttccattctccataagagcctcggaagagactgacggcctcctccagccatggaatggcatggtagtaatcccccatgtcataggccacctgcagggaacataagtaccatcactaaagttgagtccacaggtagagcaagaaaataacaatgcaaaaaatgtgaggggcctttgaaacccaggaaggcaagttttctttccaactcatttaagttaaatatgctaagcatcta

SEQ ID NO: 32988 - DNA, 1138 bp, Bovine  19866880769169
aaatgtgattttcaaattactgtattgccactattgttcatttgttccttccttactttcttatagctgaatcttgtgtgactgtagataatagagctaaatgtagagtgctattcctgaatgagtttgtttccaaaggctttgcactaaagaagaaatgtgtagaatgttttgctttatttgcttttaggaacgtagattgtcatttaggaaatggcctatattctacaaagtggtatgaacaatgctatatatatatatatatatatatgaaaaataatgtatgttctgttttagtatctgtgtttcagtgactgaagaacaaagtggagctaaaatgatacaacagctcattcataatcactaaagccatgcttgtcattctattataaagagaacagttttgaatgcaacaatataatgcaacaggagtcatcttaatcaaggtgaaaagtcattaaggcttggattcttatgtcaaaaatttaaatatccaaagttaaaatgttacaaatgttctcaaagagtatagattgagggaattatttgattctagccaagctcttgagcatgatatttaacaagagcttgacatagtgggtgtacacttgtctaacaaaataaattcagtagcacaagacaaccaagaaaaatagaagtactggccagtaggacccagccttaggatctacattatctttttctttatgtacagtatcatggaaatgaatgccctctcattaagtaagtgtgtagatcaaaactgatattttctagagctttgaggaaaagaaaagaaaagaattaatcaggcaagcttaaagcactagaaataaacagtagaaataaacaatagaaaagtcagtaaagtggcaaggaaaatgcttcatgtgaagagcaaacttaccacccgaaaagtaggaaatgaactggctgtgggcaagttgttgacttgttgttatgatgagcagatagtgatgcttttgtctccttttattagtgactgctaagaagcagccagggagacctttgaggtggtgagaaaaagtacccctcataggattcagttcctgttaggatgttgtgttttcagcatcatatgggaacggagaggggaggcatatagcataaataaaaa

SEQ ID NO: 32989 - DNA, 1374 bp, Bovine  19866880774465
ttgaatatgcaaaaaaaaaaaaaaaaaaggcaaagattgaatgcaatcatttagttgatagaaaaaagatccaagtactgagctttgggatacgctacagtatttagagcttgggaacgaaagcaatatccatcaaaataaactgaaaaggcacagttggtgagatagaaggaaagcaagagagtgttagctctctcttggaagaagaaatgatctttgtcaaatgctgctgagagatcaagtgaggtcaagactaagaaatgaccattaggattggcctgatgaaggtgaccttgacaaaggaaatctctgaaagtaagtaggagataaaaagctgatgtatgttggggatgttggttgaggaaaggacgtgaggtgacaaagtggagaaagtaagtaagataacttttttgagatagaagatcagagaagtaaggtagtatctagaagtgaatgtggggttgaaaatgtttttaaaagatgttttataatatccactagatgttttatgtaatatctactaaagggaaaaaatgacacagataagagacaggatgagtaaagggacaagatcttcatgaacaaaagaggattgaaccagtgcccaacgttgggcttgaatagaaacagagataacttcatatattcagtactcttcaaggtagagtatatatgattataatacaggtagatttgtagattcagttggtggtggaaaaatgaaatagtaattctgattgcttctttttatcattaaaataagaaacaaagtcattatctaaaggggtttacagtataaaattttatgtgatttttttttttaagctgaaaaatgagatttaaagaaatgtgttctgcctggcctggcttcaggcagtgttttcaggtcccctgggacaggcagtcatttttcttggcccttagtcaactccgagaagactattctatttaaagagtgagctcctaagcctctatatcatggcatgtaagaccctccagaagctaacccctgcctgtcctgctctgtcacactctcctgttatctcctctgttcctccttgctctcttccttctaagatcgtcatcctactgattttttcacatcacagtaccttcgttcacagtgtgccttctgcctgttttactctgactaccctcttttatcttccacttatcctaagtcctcagtttaggcaagactttgggaagttttctctgacttcattcaaaataaatgaggttcattggaaccttactctattaaaattatttgtttcatttctttctccccactaaattatgtgcttcttgagctcaggcatgggatatggtatcttcctcttggtaaatattgccaggacttaagtgatttca

SEQ ID NO: 32990 - DNA, 1383 bp, Bovine  19866880801570
ccaaatacataggttatttttgaggggaaccaatgcttgttattagaggacactgaaccctgtattataggaatgactattagaaacccatatattatgagtgtggcctaggaaaatcagttatatgactcagtcacaacttcagaaaagaaagtgctaagttgtgtcctacagactgtcagtgctatactgcggagggactaatataaactgaggtcagaaagcttcccaaggagatacaccctgaaagatgggtaggatctgatcagttttgtgtagactggtggtaggaaatgggagattttctcatgagataaatcacaggaacagaagtagaggtgagaaagggcctgatgagagagcagttctctctgagggtagggtaatactctacaaaatattccaatctgtcagagttataaagaagtgctttatgctttcagccagagccactaccttccagtaatttgccaaaatgaccaacacaaagagaaagaggaggggcaactgctacacgttctctaggcctttttgaaaacatggagttgttcctttggccacatacacgcaaatctactaagagggtgatactgtaaataacaaggggatgggtactgttcaaaaaggaatgccccacaaatgttaccagggcaaaactgggagtctacagtgttatccagcatgctattggcatcattgtaaacaaacaagggcaagattcttgccaagagaattaatgtgcgtatggagcaatcaggcactctaagagctaacagcttccctgaaatgtgtgaaggaaatgatcagaaaaagaaggaagtcgaagagaaagggacttgggttcagctgaagcaccagcctgctgcacccagagaagcacacttcatgaggaccaatggaaaggagcgtgaactcctggagcccattccctatgaattcatggcattttgggtataaaaataaagacctggattgtaaaaagaaaaaagaagtgttttatatcttatagttaatctaagtatctattataatagtatctttgtcccttaaatatctaatgatggacaaaaagaacaatgtcaccttcctttccccaccttacacactatcccatccttctaagaatactaactttcactcacctccatgtcatcttcctttttcctcttgtttactgactcacttccttcttcgtcttcttcttcttcctctatgattccttccactatagattttgagccttctggacttgtaattccttcacacctaggtattaaaaagaaaaaaaaagtgctatcacacacctctcttctacacacaaattaccttagagaagctatttatgggtttttataatcaaatactagttaaaatttaacaatg

SEQ ID NO: 32991 - DNA, 1742 bp, Bovine  19866880826631
tttaagcacttaactctaaaatcgtcatggaaacagcgtaagaaaaatttatcctttatttttctaaatttgttcttaaaaaacagtaatattgttttctttgtgaaagtggtctcatattaaaattgctgaaggaaatggtaatgacaaggtaatatttaaggttctacctcatttttcatctgatgattaattcattattttagtaaagtattcagtgtgtgggtgttacccttcttgctatattatgtaattttgcattactggaaaatgaaatagaactgaaacactccttgatctttctcttctaaaatcatcaatacttatcagaagaaaaagatttgtttgaaagagagaggaggactttttgggaaattaatgataactgatgggcatcagcactaacaactcagtgaaaacttgtgtgctgttcatagtggagttgcatgtgtatatgaaaaaaattgttttatatgtgctgagaagacatacttactttaagcattggtagggatggtgtctctgccacaccaccatatcccatgtccaccatagttcttgactcatagcagatcttaatcttgtaatttatcacataccttattccacaagtatcaagtgcctacagtgtattaccactgttggttcttcagagaatataaagttctcggcttcaaaacatttatagctgaggaaaagaatcacgttctcatgaaatctgtgtagtgaaaggtaggtagtatatgataaaagatgcaaatgctacatgatagtaagatattattgagatgtgaagtgaatagtgacacatgaataagatcatattcagataggatgatcaaggaagactttgtttataaatgccgcaaaagggacttcgttggtggtccagtagctaagactccatgctgccaacacagggctctcaagttcaatccctgtctggggactagatcctgtgtgccacaactaagacctggtgcagccaaataaataaataattattttaatgctgtgaaaaaagttaaatccttgagaagtatatttgagaacttcctgatggtccagtgattaagactctgcacttgcagtgcagtggacatggggttcagtccctggtcagggaactaagatcccacatgctgtatggctcagcccccccccaaaaaaaggaacatacttgatttagatacataaaagacagatgatactccaagaaagaagagcagttaacatacagtacaagactgcctagtacacattgtataaatacttgtcataaatcataaatactaagtttaaaacatttctttgttgtcttcttaccaagtactttacatacagtatataaatgcttagatttttgttgaatacaagaatgaatccatgtaacagtgctctaagtctgctgctattgttgtcctgattttagaagatctgagacacagaaattatacagttttttccaaattacccagctactatgtgttagaaccacttaatataccaagtgttgatctcacttattctcacagtatccctgtgaagtagataggtatatccatctcactgagaggaaaccaaagttttagagggtaagtgacttgcttaagattatagctgaagctagaatttgaacccaggtctattatctgtgctcttaaccctacaccattctgcttatttcatatttaaccttacccctaatttatccttttgtgctttatatccctaacacagta

SEQ ID NO: 32992 - DNA, 1846 bp, Bovine  19866880871321
gacccagtaggtagatttgaattgcctccatggtgggatctctcaggggctattagaatcataataaagacaccattgccaaatccaaggttgtaaaggttttgctatcttttcttttttcttctatgagttttatctttttatctgtctcatttaggtctttgatttggggtgctactcttaaccttgtcccttacttactttgtgacctcagactgttcatttgccatttttcagcctcacttttttcatcttgttacaataaaagttgatatttgagtatacaaaacaacaacagaaaacagattagaggttgccacagttaggatttatggggagggtgttgaccccaaagatagagaacttttggggatggtgaaaatactttgtatcctaattgtgatggtgtttctacaactatatacatttttcagagctcatagaactgtatacctaaaaggagtaagttttactacatgtaaattgtacctcaataaacctagctctaaaacaatacctacaacaactcttcaaagaatgtgttattctttcccattttgagtctagagggaactgaggctcaggaaagttagtggacttgcctgtggtcccacgtttggtatgtggcagttccagaatttgaacctaaatctgcctgataatagagcttgtgatcttcctactcatttttagcctgtccctgaaactattaatgtgtggattctgttgtaaaaggctgaccttcacttgaaagccaggaactctatctgcctatcgtattcttattccacattttgaacccctggcagatctcatttctgccagtcattagttgaggttggagtccacgctgttgtggagtgctgctcaggcatggtctccttctgaggctgtggttctcatttttgagcagcaggagaccagtttcaaaactgatgagtttctttggttatgaagagcaatttcagacttcatccaatcagcaacacagagtagcctctcagtaggagagtgctcagatatttataggacccgttgtgctgcttagcagtcttccttaccctggcttatttaacagagaacccgttgggtagaagagcgatccaaggctattaccatcattatttacatctgcattccactttgtagtttgcaatgtattttaatatctgtgaattctcttagcaccttgctaggagagtgcttatattaagagagagaatgtacttgactgtggacttcccagatggtgcagtggtaaagaatctgcttgctgatacaggcgatgtggatttgatttctgggttgggaaaatcccctggagaaggaaatggcaacccactccaacattcttacctggtaaatgccatggacagagaagcctggtggtctgcagtctgtatcacaaagtcggacacaactgagcacacacgcacgttcttggcagtgttcttggataactctggctgcgagtatgtttttttcttaatttgtgccggaatgtgtatatttcctataactttcatcaggttgttcactttcattttgtcaactgatgatagtttaatctagcctgttgccctggggtgatttgccagggctgcacattgggtacatttcaagaagttctgtcatctgaatttgaccaatggcattttcttttttacctgtttgccccaccttcctctctttgggaacccatctttcctccacctttcattccagaaccctggacaggctaattaatctcaaagcaattgtcatcaagccagctgttgactttaactgcttgtcttcagcatttgacttgtttcctttcctgaggtgctgtggaagaagttaatga

SEQ ID NO: 32993 - DNA, 1693 bp, Bovine  19866880886969
ttgagctgggatttgaacctgagtctgactgattgcaaaacctatttttactatttctgatgcttacaaaacaatttactgctacttttctaaaattttaagccctacaaaacaaaaactgttttcagctaaaagagcttgagactcagcacatacttaaaaaaattcaactactggagccctgctgttttattctttcctttacctgctctggcaaggaaaaataaaaagaacaaaccaaaagaaaaataactgaggactaagaagacctaagatgtggcctcatctctgggtgagacaggctgtctcattcagctttgtccattatctttcttgccaggctcctgtccagtccctctcccttctctggtcagtgaggctccattgtatgggcagggactttaggacctcagtggagagttttgcagagcttcctgcaagaaatgttcctgtagttagccatgacctcctggcagcagttgtattcatcattaggcttcaactttcccatcccccttttgaggttccattgaatctgccagtcacagagcagcttccattgaatccagtagcctgtttctggttacattaggcattatctgtattgcattttttggctcacctcattaataagctagttctgtgcttattttctacagaatatataagctgacagagcccttaaaagcccctaacccaaggaattccctggcaagtgaaggatgctggagaatagaggttggggctaggttttaaaaagcttaaaatttagatgtgaagattttacttttatttccattaatagcatggtttatgtttacttcttctttgaagatgcgttgtgggaaccctggatggcagctgagtaatgaactctctgcctttttacactgtacagattggaactttgttttaaacgtttcactttgacgaacttaccatatgtagctctagctgttcttgagtggcctcagaggtccatgacatgtcatcatttcccactttcctgaggtgagcgtttgaaaagtatttgatgaggcagtggtggcatttctaaatttgaggattcttaagccatctctggggatttgttcacaaatgatatggtttttaatatattcccttcccacatactttatactcaagtccacagttggcctatcctgggttctgatcgtacagctattccctgacttgtctgtatgaccactgataagtctctttctcttagttcttgtatccataataacaatgatgctgactgcataatctcttaagactcttgtggttctgatattttaggactccgtatatgggatgcagatcagccttttctttgacattcttcgtgtacacagatcataatgtgttaaaacgtatttgtaccacggtgactacacacatattggcttattcatcacatgcttataaaacagatcccattgatgatcatgctactgttttttgagtatttttttggtgtcctatcctttttatgttttcttctgccttcatgttctggctgcaccttctgtcatcctgtggagaaggccaggcccagataccactgtgttccagcagtatcagaaaagcatacaacagagaaacacaaccagcttacttcaatttaaactgaccttcctgctagctacagattatcaactcctgcacaagcagcctgtagggctggaag

SEQ ID NO: 32994 - DNA, 1950 bp, Bovine  19866880953313
acacggccgctgctcaaccccgacaagaccgggcatcgaacaggtgactggcctgagtctgacgttcttcggtatttgggatcagtcccagcctgaatccataaaaagagatctccatgctatttgctgcttcccccaaagtattgggtgccccatacacacacacacacacacacattacacccttcgctgtaactaccagggctcgtgtcttggctttgagtgagaatcacatcacctctggtggaaacctagggtaatctccctcagaagctgcaattggctgttggtgacatcatagggattgctggcatccaagaatgaaaactgatgcgtcctgccagaacaaaggttgggagggagaggagagctggccttgctgggtagaggaaggagtcacaagacgtgccacacccccttcctcagggccgcctggagctgtgggtggacatgtttcccatggacatgccgtcccccgggacacctctggacatctcccctcggaagcccaagaagtgagctgctcggggccagcgcccttccctcccggctccccaacgcatcctttctgtaggagcctccaggcccaggtcaccttagtcagtcccatgtggccttgttgggggaacagagcaccccacgaagagggctgtggggcctgccctgggggaggtccccttgctgaggcaaggggtcgcacccccactgtgtggccagcaagggccatgagttcacactgacaccctccccgaagcctctgtcctcacagacccactcctccacgggcacgcactctcaggcagcatcctccctgggttcccccacacacatccacaagacgcagaaccgctgagagctgctctgcccccctgataaaagtggttcccactcgaggctgtcattcagctctgccaagttttatttaaaactgatgagatgtgcaggggtgagtgcccagaatgggcgggagggtgggagagtaagcagaacgctggatcatgagccaagccatctgtctctgttagttgacactggccaggtcactttttcctccatggtcctcagttttcccatctgtaaagtggctggaccaagccactgccagcactggactcggtgcctgcaatcagggccccacatttccatttcacactggaccccaccaatcatatagcccattctgcctggtgggctttctcaggtggcacagtgataaagaatctgcctgccaacgcagaagatgtgggttcgatccctgcatcgggaagatcccctggagaaggaaatagctacccactccagtattcttgcctgggaaatcccatggacaggggagcctgatgggctacagtccagggtcagatacgactgagtgactgagtgatcccatggaggaggaaatggctacccactccagtattcttgcctgggaaatcccatggacaggggagcctgacaggctacagtccagggtcagatacgactgagtgactaacctttcactttctgtcttcacagcttcactagaacttgtccctcaaaggtcaccagtgaactcctaatcactaaatttgtttcctgcacagaaacctccactgactctttgttttccaccaagaccagatccctgaacccagggtcctcagcttacacaacatgccccgagcctgctcttctagcctaatttcctgtcacttctctcatagaccagacgctttcacattgatatatattatgtcaccccaccacatctgcacttacgctgtttcttcagcctgaaatacccctatgttttttctatctattgaaattttatgcacccttcaaaatttggcctacatgtccatcttactgccatgccagtcaaaattaacatctccttcctctgtgctcctgaggactttaaaggctggttctcatttttctacttcaatttatactcgttgtatt

SEQ ID NO: 32995 - DNA, 1790 bp, Bovine  19866880953568
taagaaataatttaaatgaaggttatctctcttgaagagatggggactgggaaagtggtcagaaggacatacaatgtgcttttaactttatatgaaaaataatgttcagttccatgttgctgaacgttgttctgtttttgccaaataaatcctctacctcaaagtactgtctgaattctttattaaaactctgcttccggcttttgttttggactctgttacttgtgtagccacctcctgctcagtgtcctctgaagcttctacttcttttccgctgttccctgacacctcggttgtcctcacgctttcccttgaagcctcaattgccttccctctgtcctcagaagttgtaatatccttcccatggtccttccagctctggttgctccatggccacagaaagctgccagcaccatgaatcatgccacttttcctgtacttcagttactgatgcagtagggatatcaaagcaaataccctgctttcctttgagaaagaccattcccttcactttggaatcaatatcctcacccagttgctctttaagttctttacaagcataactaatgtttggcagttccattaagcactgcaagatcatggtcacaaagcccacatctcagttaaggagcactggtctaccgatatagcactgaaatgtgggccaagactgctgccagggcttccatggctcccttctcctcagcttctcagctgactgcttgaagtgactaatcacggtgggaggaacagagtcaaagtcctataaccctaacacttctgtgaaattacactgattggattcctaaaagagattttagttagatttgaaagagaggtgggtggtatcaaggcatgaattggtgaaatggctctagttggatggtatgacatgtgcttatgtgtctggttctccttacagtggtgaaattccagcagagatctgtgtttccagtacagtttggtggcccaatgatcagacactggtggaattccaatcttactttccaaatttacacaaagaaaaccccacagaaaaaggtacttaagtaattatgacttttgccttaccactttagtcacaccagggatttggaccatacttaaaattatgttcatatcttaaactagaaatttttccaggctcaaacaacagtaatacttatgaattattgtctattataattttaaatttatgtttagtatttatcataaggtagatattatgctaaagactctgcatggatactatcaaatttaatcattaaaacaagtctgtgagttaggtacctgttatcttcaatttgggcttcccttgtggctcagctggtaaagaatccgcttgcaatgtgggagacctgggttcaatccctgggttgggaagatcccctggagaagggaaaggctacccactccagtattctggcctggagaattccatggactatatatatatagtccatggggtcgcaatgagtcagacacgactgagcgactttcatcatcatctttagtgatataacttaggtctaaggttgccctaatgataaagctaataaaagacaaagccaggactctatcccaagtctttatagatcctaagttcttaagctctttgctgtgttacctgctatggagagttgactatttggattgatacagaaaagcagccttaatttgaggctctactttcttttttcagacagaatatataaggtatccaacccatatccaaaataatatattgtgggtagcagttttatcagctaattgcagctttataaaatcca

SEQ ID NO: 32996 - DNA, 841 bp, Bovine  19866880955882
ctatcatttaatatctgagctaatctgaaataggaattacttcaggattatgactccaaaatatcattaacgctcagtattagctctgaaatatatctgatagtttttgaagtcttctacttttgaccaaagtaaaagaaatggggatctgacttctgagcagtggcttctggataactggtctaatattctgaggagtactgttgctgatggtctgtattcattagtgagaagagccatagaaacaagcattgagtaatttcgtttggagctctgctgcatggatttcccaggtggtccagtggttaagaatgcaggggacacaggttcaattcctggtctgggaagatcccacatgctgcggagcaactgagcccctgtgctacaactactgaagcccacacacctagagcccatgctctgccacaagagaagtcacgcaatgagaagcccgaaacagagacccagtgcagcccaaaatagattaataaaattttaactaaaaaaaaagaactctgatataagtcacagggtccaaatcaagaaggctttcggactttttaagacattcagaagaaaaccataattgatttttctgactgtagttgtgtgactatattgttattatgatgcagagacagtgtgatgtttctcagcgtggttgcttgattaaaatacctctgcaagtttgcacttcttcttcatcatcagtattttgaaatccagtattttttaatcctgtaaggaagctgtccatagacttatgcgaaagtctgtcaacttttggtacaagatgtctcatcattacaaaggaaagtgtgagtcaaatacgaaagcagta

SEQ ID NO: 32997 - DNA, 795 bp, Bovine  19866880962483
ccaggtaatactttgtttaagaaatgcttggctactaaaattaaaatagaaatctagcaaaaaaaaaaaaatcgaaagtaacaaatactgagcactcatgtgcaaattatagtgatgtataatacactccgtgctcttacaaagattatattcataatggaaaaatttttgtatgttaacggagctgattaggatggcttgcggaatggaatttcttcttgcttataaaatacttagttacttttataataaaggtaagaactggtagcaacagtgattttactttgagatctccaatttacccctttaaatgaactatcttaaattatagcccaaagtattcaacttgaaagtttctgtggagagccaatactcagcttgtcatcatccccaaagctaattcctgtagctgtcactgcaatttaaaatgtctatttccccctaaaaattacaagtaaaataccatacacctggaggtccaagtggaattgataccatttttccaggaaaagaaaatgtcctaataagcgtcctggcaaggatgccccaaaatgtctgtagaaagtggattcttggaacttacctggtggtgcagtggttaagatgccatgcttccaatgcagggggtgtgggttcgatctctggtcggggaactaaggcccaacatgccacatggtgcagccaaaaaataaaaacaaaaaagttaaagaaagaaagaaagtggatactcagtaaatacaagtgagaggattttttaaaaatattaccaacagtaccgaccccatatttagtcaa

SEQ ID NO: 32998 - DNA, 1081 bp, Bovine  19866881047074
tctgtgaagtcataggcagttgatgtctttggatatcaaccaaagaacaggacgtccaggggccacaatctctctgttctttatccccctagtgtcttctgcagctgactccctgattacagaggcctggttaccatggtaagggtagcacagatgcaggagtccagcagttttaagtggcaaatgcaagagtgtgtctgtgtttggattttaagcctctgatacacagtggaatggcatgcgtttggatttggagtcagttggcctgattcagattctgccacttaacatgtggcctcagcacaaatcacagttctctgagcttgttttcttgctctgcacctcctcacagggctgtcagcaggacctgatgaagtcaggtgaggggatctctctctgtgaagtttcatacagtatgtttttattgttcaatcctagaaagcaagtataggactccaggaagggactgtgggacctaggaagtgctagcttattcccagttctttcatcttcagattagggttaagaccatcataaacatttctgaagacaagagataagttttgtggagaatataagaataatattatagggggaaaataatctttaagaagtagaggattgagttgacatcaggttagtgattttctactcagactggatataagatcagtcccagtacaaagcagtggaaggtttacagagggaagatttccctgccctccaccaagctcacaatcgatgccctgctctggagcctcacagcacactgatccaattctcttttcaatctgttgtttaagtccttccaccccattgtgctatgataccacaggtagtgtgcaagagtgccatacagtggttaccagcagggtctttgtagtcagcattggctcagctccagtcctggattggagttatgtgacctttcgtaaactactcagtctctctgagacttggcttccttatccctagactgtgaataacaacaatcctaattaaggatgatatatttgttgtgaggaataaggatttagtatgatgcctaacatacggtcattgctcaataagtgtcaactat

SEQ ID NO: 32999 - DNA, 1381 bp, Bovine  19866881051335
ttttaagcaaaatacagcccgtgttttttttaaagtggtgaatgaatttccttttaaattattgtgtcatggaaaacacacccatgaagcacctttacagaggttgtctagtccagtttcattgtgtagagacccaaagaagtggaaattatcaatggtggtggatagaacctgaatcagaacttgaatctgccacctagttcaatacagtttttataatggcttaatcgctaaatcgtgtctgactcttgtgacccccatggaccccatggaccccatgtgaccctgccagactcctttgtccatggaattctccaagcaagaatactagagtgggttgctatttccttctccattttttttttaataatactagtctatattacactttttgttaacctttttctaatactttacataatttggcatttgatcaatgaagaatacttatcaccttgttaattttggaaaatattagtggttattacttgaatttatttgtgtagtgtttcaaaccttgatgatctaaataatttgatattcacagcaaccctgtatggtaggcaggttaggtgtagttatccccacttttactactaaagaaacttagtttcagacaggggaagatgacctgctcaaggacatatggcttttaagtggcaaacttggaactaaacctaacgatatctgatctttactctagctttcttatcactgtactagactctgtaactggagtgtttaatagatgttagtgacatcataaaccaagtttcaaggacctcattaaaaacattttattggtttttgtaaaagctgaagtaggctataatattctgcagaataaattgccatggaatttttttttaaagagctgaatttgctacttaacagttgctttggtttccttggcaacaacattctccctctgtccaagacatttagtatgtagaaataagggtttggagatatatatacacatatatatatgtaatatatatgtatgtatgtatgtgtatgtatatgtggtgtgtatatatatacacaaacacacatacacacatttatttgttgcttttgtatatttccaaatttcttacatttgctctttagtttctacaattttatttttaaatttatttttatttatttcaaagaaatacatgcttatgtttttttaaaaaatagtaaaaagagattgtaatggaaagcagtgttcctacttacctcttctcatcctcagtttgctccttagaacccatttttgacttgttagttactgtcatgaccataaaagctagtaccactattccttgatttattttacatattatcggtcagatgcatgctgtgaaaaatgagagcgcactcaccctgttct

SEQ ID NO: 33000 - DNA, 830 bp, Bovine  19866881187284
atgaaatggaataattaacacctccccagtaatttctgtctgcaccaccgtgaggagaatcagatactgcttcgccttgaagcaaaaaaaggagaggtgagatgtgaaaaattccaagtaaaacgatcatgacatagcatctggcagagattggaaaggcatgaacactgccgaaaggatcgtcagggatgaacgtcaagagaagaaaacgaggttttccaacgggccacagcctaacccaaggggcaaaaatcgccactgccgccgccactccctcactcaccaaccactccatcctcaagtcccctccaattcagatatatatcctccaaaaccccggccaattccccacccaggtgaaaacaatccaataatttcctaggaccccccccccccctacttcccaccttcggtaagacccgcacttctcgcggctaaacctctggggaaaacaacgcccagatcccaccctcatagcgctaggctgaagagggccggtcacccaccgtggggcttcccgggtgggcctcacagagcagaccaactgggataagagcaaggaacaagggtggggctcaagggagggagctggggtaggcgagacgacggagaacggaggaagaaagggatggacaggaggctggggctgggcggggtgaggagtggggagggcagatcgacccgagagggccgggctgcggggaacggagccggtggagtcggggactgaagggtcaaaatccgagcgacggatcatgggaagaggaacgggtggcgaagaggggtcggcgaaccgaatacgagcaggggctgcggggggtagaaccgag

SEQ ID NO: 33001 - DNA, 779 bp, Bovine  19866881320477
cagcattactccacctgatgctggagacagatctaagaatccatcagcatgagactgataaacagcttgtggtgtattcaaacaacagaatactattcagcaacagaaaggaatgaactactgataaatgctgcagtccatggcgtcgcaaagagttggacatgactgagcgactgaactgaactgataaatgcagcaacatggataaaatgtcacagatacaaggtgctaagtgactcaagagcacttactatttggttcaggacagtggtcgcttggtacctgggcaaggggagaatagaaagggttggggtggtgagaaggaaaaggagtgggtgtttggctatctttacattcttttttaaaaatctggaaaaaaaatctgaaacaaatacagcaaaatttgaacatatatttcatctcaattatagataaaattgcttatattatgtgtacttttcttatatttgaaatgttttatttttcaaaataagtaaatacagaaatgatgattgtcagtgagactttcaggaaatgacttaactgaattttcaacatatggttttagtctcagaaaagcctcactaaggaagcatatattggtaccatacatggaactgttttaactgacttcattttaaattagccatgaacatgatgattgagcttgattctattaggatctcagaagaggaaaagttatatatggagaggcttagggcaacccactctgtgttaatttgggaggatgtagtctcaaaacttggatttagacacaa

SEQ ID NO: 33002 - DNA, 2581 bp, Bovine  19866881353570
tgctgtgtttggggtaaatgcagtaacgtttagtacttctactttgtcttacgctgaggtggaaaccaagtgtactgttactaaatgtttgtctactaaaaggaaaaatactaatattaaaataatttcttataactgtgaatcactcatttatttttccaataattgatattgtacattcctagtgctattaggtatgtatgtaacttttgtagtttttcacctgattgttgtaagtatttcatttgatcagggctctttaatctcatttgctttgttcagattaactgtagttatttatttctgtattaacaagctaagcctatggtgatgacatgtacactaataaagcattgaatgtttgtagttggtagtgaaccttgttgttggtgaatttaaaacttaaaatatgggagtgatttgctgctatatttcctttgagggataatagaggaagaaatggaccctagtaatgatcatgaattttagggaaagtacaaaaaaaagcatgtggtcacctctggtttctcatgtgaatgaggaaagagtctacttccagctgaagacctcttatacttttaaagatggggaatctgcatttttagagctgttagcaaagtgtgaaagccactttatgctttactttgtggatttgggttttgttttattcatacattagctcatatcgagatgcattgcttaaatcttatgtgttgatcctattcaacaaaaaatgtaaaatatagaatttattatttgccaaagaaaatttatgaaagaatttttatccagtttttctgcagacatttaaatttcatttggctttgtgctccctcccctcttttttgtccttaatgtagcttaaaccattggcaaacttcagaaaccaagagaaaaaaagaaacataaaaaaaagacacagaatttagtatggtacaatttcacctttcacataggtctgaagaaatgtaactttatgttgttaagatcatcttacttccttgactcctttttttcttttaaaattgtaatcagatgcttctgggtttttttttttttttttccaggaatagtgctttcttttacttgtttccacttttctctgccatttgtgattctcttttatgttcagtgtttcaaatacagtttgtatttaaagattttaaaataccaaaactgtaactgagtacaggggatttttttctggtatgatgttaatattatacaatgaaatgtataaagtgttgtcaatttgattattgacactataatatgtttacaaataaactgtggtgttgatcaagttgctgtgaaaatgtgtataatcttctgttaagtccctttcataatttaaaatacaggcatgctttcagtgctgagacttctatacttgaaaagaaaaaaacaaaagcaacaacaacaaactaattttacaataatttcaaattagcagaaaaattgcaaggtcatctggagatattccctgtacccttccacaggcttcccctaatgttaacaccttatataaactatgacgcatttgtcaaaactcagaaattaacattggtaccgtactatttactaaaatacagattatgtttgattttcaccgattttccctctgatgttctcttctgttccaggaccgtgtccaaggtaccatggtgcatttctttagtcgtcactgcctccgtctcctccagtctgttgacagtttctcagtctttcctgaccttgaggctgtgaagagcactagtttgttctttggtgggctggccctcacagtgggctcatcttggtgttttatcagattggaggcttgtagttcactggggagggtgggcgcagatgccatggcccttccacagtgcctcagattgggggtcgcatagtcaacagacgttaccagtgccatctcttcgctggttacagtgatgctgtctgccggttttttcactttccatactctttttttttttttttttttggaagtgagttattcaacctaggccacactcaaagggaaggagcagtttacaaattttcttttaaagacttgttccatatacacacaatggagtattactcagccattaaaaagaaaacatttgaatcagttctaatgaggtggatgaaactggagccaattatacagagtgaagtaagccagaaagaaaaacaccaatacagtatactaatgcatatatatgaaatttagaaagatggtaatgataaccctatatgcgagacagcaaaagagacacagatgtatagaacaggcttttggactctgtgggagagggcgagggtgggatgatttgggagaatggcattgaaacatgtataatatcatatgtgaaacaaatcgccagtccaggttcaatgcagggtacaggatgctcgcggttggtgcactgggatgacccagaaggatgatatggggagggaggtgggaggggttcaggatggggaacatgtgtacccctgtggcggattcatgttgatgtatggcaaaaccaatacaatattgtaaaataattagcctccaatttaaatttatactaaaaaaaaagatttgttc

SEQ ID NO: 33003 - DNA, 1443 bp, Bovine  19866881442980
tattcttgtaaaaatgtaatttaaatgtcagacttttaaattaaaaattcacagctccgttcttagttccagtatttttctttacttagaggctgtgctgacacaattctaacactgaagatccttagctagttactactgagcctgtttttatcaagatttttacttacattcataagatttttaaatcaacaatctattttaaatagaggagaagtacctatatagtttggaagactttaactgtctgcaaattaactgattaaattatactccatggaagaacactatttcaattcaaaccatgccttgagaaggcactgagaaagaaccacgccactgggagtgttgccaccaattgttttatgttcgataaatgttagacttttaaataaatacaataaatttacactgcaccaagaacacctgaaacagaggtgctgaaaccacaaattgtaacacctgttctaacctagaaatgctaaatatcctatttcaaatactctaatttgtaagttaatatctgcaatgcaacaatgacacttttccacagtattctgggagcagcgccactctcttgccaatcttatggattcatttccttaactaactctacaattatacaacacttatcttcctttaagaaaaactgtgctatacacaatcacaagaatatataactaagcttaatcacactttaataagaaaactcacatttgtagtttgtttctgttgaaggaagaatgacgtgttaccataatacttctaatgtaatgacttctgttcaggattatgaaaaaatttgaatcatttcttcccagccatttcatttcaatatttatagtttgtttagctagccaaccaaaaagaaagaaaataaaggaaaaagatacttggccagatgacacacagagagaatgctaacatgagttcaatgcatggagttcttggttgctctgttccatggaccggggcaaagcaacgatgttctggtgaaggctaaacagaacgccagggtcagtccatttttactgggctcaagaaaattctcaatcaaagcatcaatcagtttcttcaattcctcttctagtaaggcagtgtcactgaggaaaaaggttaacagttttgaaattctgtatttccatagccttaaaatgtgcttaaattgttgtaactttaagagtgcatatactttatgggatgattaaataactggtaaacaagacagaaattcactcgtgtaaaacaaaacaaggccacaagtgggaagaggggaatcacactcacagaaaacaccattctcacaaactgaaattgaactgcattaaaaggaggttaatatctgcggtgtaacaatgacacatgaaacatggatgagttagagtaaatctaaagactgctcctaaagcaggcaatttaaaggctcagaacaccaataccagg

SEQ ID NO: 33004 - DNA, 882 bp, Bovine  19866881458848
ccaatgtcagagccattaggaagagttaggatttaaatgttgcccttatcccataccacatgttcttaattactattctgtactgcctttcacacatgcagcttccgcaaaaggtgaacatacagagaaattagaaatgttttcaaaacagctttccaagaatcagtgtgacccagggttgccccagtgttcaaaggtcttaaaggaaccacttgccggctgcctgctctgcagtcccaagcactgaagtttcttatcttctcgggccaacagcagcattttcgactctgttccaacctctcgttcacctgcatgacagatgagctatgtcaataatgggctaggatgatcagctggcagtactcagaaagcatagctattgacagctctttactgaattactccgctagtcactcacttaatagtttcaaaaaacatttattatgttctatatcttgacatggtattgtttatatgactgtacatatttgtcaaaactcacagaactgtgtgattaaaaaaaaggacttttactatatgtaaaatatacctcaataaacccaattttaaaatattatgattatcaagtcctttgtaatatggaaagataccatacttggaacaatgtacagagtacaatgctaaacaaagtagggccaaacatatgtaacaatataaaaggaggctgctggaggagaggagggacacagaagagtgatatagctcaatttacatttttaagtaatttcacttatttttggctgtgctgcgtctttgttgctgcatgggctttttctctagttttggcaagcagggccatcatctagttggtggtatgcgggcttctcacggtggtggctttgtcttgctgtggagcacagg

SEQ ID NO: 33005 - DNA, 1412 bp, Bovine  19866881710430
ttactttacaacctttggaatataagcccatttttaaattggagaatacactgacatttttttccactgaatattgggaaattactttttaattgacaattagaaggtttgtacttttgcctattccctatccaagtcattgtttaataaaaatagtacttccaatttttatagcatttgatttaacaaaattttctcaccagatataatctttgtgaatccttctctcacctggttccatccccataagtgtcctgaacaagcttgaatgttccatctgtgagctctcatgggtaccctaggcttatttctgtcatagctgtagtatacagtgactgtttccttgcctatctccctccaaacattaggtctttgaggtcaagaaccaagttttcattgatgaaaatttcaggcctgctggtttccctcatgcccagaaagtgtatcagggcctgccatacaaggcatacccaaaggtctctttaattgaaattaagttagctgcttaaataagcaagttgtgactggaaaaaaaatcccttaaataattgccctaaagatatttgctgtttgtcctttatcctggatcgtcatggcatttagatgtgtctggggaaggggttatagaaccattggttctgaaatattagggttttctgtaaggattttattggcctttaagctctgacctcaaaactctttcttcctattgtgatatgcctaagcagaatggtagcttacttgtattttgatgactaagaatggccatgcatcagtgatgagagtgaacaactccagttgatttgtagaatctcataaagtgttctattgtctgcttttttggtttcattactgatgtctcagtgattgcgtttttgtttgaggccagatcactttatatccttttttctatttacttttagtgctttcgaaaatgttactacttatgctgttcttatattgggtgagtggtagaaataaaatttagaaaaatttctaacttgggtaaagcacagttctttattatcagaagtataagattagagttgttcttgtgctgcagcagttgtctttatccatccatttaaaacaaagcaggtttttgtgtgatctgactcagcaggttggaagttaccatagactaagtatcttatctgaaagtggttttaagtaaggtaaggtttcattcatacaaccatgtcgtatattgggccataaatatcctttcttgtctaatacaggacgttgtgtaaaatcctcctatttccatttttggattctgtgatgcccagttaataaggaacattttcatcactggccaacgcagagaagtattaggagtaggatgtagaattttcaagcacctggtaaatcagtgttttgtaagttggaactcttttaaaaggtttccc

SEQ ID NO: 33006 - DNA, 748 bp, Bovine  19866881810032
cgttttacagcaatcaccagcatacagcctacaaagcattttcataagcatcatctgtcatgatcatgtctctgtaatagatattatcacctctgtttgatagattaaggcatttcctgtcctccctgcctgccttccttctggcagatgacatcatttgatcattcacagttagtcatttctggcatcagatcactaatgcttcaacttgtggtgtgttttagtgcctggctgaaggacactgttgacccagtgctggtgacccttgaccatcgcattgctgccctcacgggccttgatgtccagcctccctacgcagagtatctccaggtggtgaactatggaattggagggcactatgagcctcactttgaccatgctacggtaactatggggtcagtgaccatctcctgggggtagggaaagggggtattatttatttctctgaggcagagctctaatagggccctcaggggacactgaaatcttggaacaaaggttcatgttctaggtagatctgaaagtcttagtttcaagctgatagctgctgactcatctttttactaaaactcattgaaaaacactcttacaatgactggattttatgacatgtaaattatatcagttaaactcttctgtaacaaaagaatatgtctctttggcaaataattaggaattccagtcttaggacttggcatgtttacagaataattatctgtaacattttatatatatttctctaacaacc

SEQ ID NO: 33007 - DNA, 797 bp, Bovine  19866882025530
cccatagtaagtacttaataatatttatggaaagaagagaaggatagaataaggaaacgtgtagtattgacatatctgtaatgaggagcatacaagttttggtagctgtgcaaataaaatgtgcatatctaactgtactgaacatgccttctccctctttttaggttcagaacttcaggagagaatcctgtctattctgcaggtaagcagttatttcctgatgtggtctagttgatttaagtgaccctctagcactagtataattttgtctgaaaagttgccaaatatatctttgggaagattggctgagaccaagtcctacccctcacatggaattggacaatgggcaagaacataaattgtgggttaagagcaagagttctgtagtaggtttagattccagctctaacacatactgttctgtgacctttaactacttttctatgacttggttttctcactttaaaaaatgaggggaatttatagtacaaactacagtgaattatttgaagattcagtgaggtaaaacatataaagtgctcaaaaatgttcactattgttattattatttttgctactattccagacctgtctttcatgtccattatctaccaggctaaggctttttctacaggattttatccaaaataaatccatttaatctggttaactcagtgaatttcaatgtttcaatcctattgcttgccatttttactttattatgtgacagatttcaaagcagccattagataatgacatctgttatagactaaagagtatcagaaacagggaattcc

SEQ ID NO: 33008 - DNA, 1951 bp, Bovine  19866880442717
aaataataaaattcacttgaaagcatgttttccaataagacaataagaattccaaaaaaatttgagtttcaattactcattaattcacaagaccagtaatttttcctatatattaactattgtttcgataacactgcattttgaaaaacattatatacagagaaagcaatggcacccactctagtactcttgcctggaaaatcccatggacggaggagtctggtaggctgcagtccatggggtttctgggagtcggacaccactgagcgactccactttcactttatactttcatccattgaagaaggaaatggcaacccactccagtgttcttgcctggagaatcccagggatgggggagcttggtgggctaccatttatcggtcgcataggtcggacaggactgaagtgacttagcagcagcaggagtatactatcttactttctttagcaattctaagcagtacactgaaacttaaatatttttttcagaaaaaatcaaagtcagtttccaacagagaaaatagtagatttgggttaaggaagcaaatggacatttttgatctttaaatttttccctgcaggtaattacagttcaaaccatggtctaagcctctggaaactatattaaagtgaggattctcatttcagctgctaaagtgaatattttgcataacatacattgccccaggtatcaatactatttttgtgaaaagaaagtgttgatacttttgctgtctgaaccaagttctctccaaacaggaattttcaaatgaacaaaaaagtttactttgatataaggaaagtttcttaaatgtacaaataaatgaagaacgctttctatgaaggttcatgtaaaaaacttcatcaaattattgggccacaactcccaaagaggatgacttgtcacagaatcttgcccaatgttaaatcatgttggctagtgacagaatgaaacgaattggaaactgcttccctggcattcctagcctagtttcattttaattatagacttttaaacatttgtgttgtgtttgataatgttctttgtgctttcacagacctcatctcctttgattctctcatttgatctgtttcattccaggcatttcaaaactagttctgaatcaaagccatgatcatttattttgctgcattgatttatcctgatgaagggtcaagtcagtgtccaggcagatcaaagtctcttcattgctgtgctttgttgagtatatttgcttcctaaaatctcccttattagcctatttaattctttgaaaattcctcactaaaagaaaaaaaaaaaaacaaacaacaaaaaaagtcacacatgcactcaatctccaaatatttactcaagtctagtttgacacaattcactccatttctggtcatggactagctaaggtattcagtccaactcttagtacttgtcactatagaacatgttgtgggttccctttttctctgcaagcaaaagtaacaaacccaaacccatctttttcttaaacaagaaaatacattactcaagcaaaaagagatttattataccagaaatactgtacccctcagcaaaaattaattccgatttttgcagattatcaatgttgcaactaaactcccatttttctgtttgctgcataattatcaagaatgtagcatccaatagccaaaaaggcaagaaatgggatagtaagcctgaagtatctttgacttgtaatttctatgataactatttctttgattaggggaaactttcacacagagttgaaaagctgttattcaagtaattcaaactattaattaggtgttcatacagatgctacaatggctcttccagttgctattaaacatagaaggaaggacaaagttatttattgctaggacttcatcctggaggaaaagacttgagttacctggggccatgtggagcactgttaggcaaaacaag

SEQ ID NO: 33009 - DNA, 3970 bp, Bovine  19866880449055
cacctttacctgcatattgtccactatctcagtcagtgacagatggaaagggtttgagccctaatttcatctttaagcttaagaaagcccctgatcttcacctccaacctcaactctgatttaaagccagaagtcaaaaaaaaaggaaagaaaacactgctgctgctgctgctgctgctgctaagtcgcttcagtcgtgtccgactctgtgcgaccccagagacggcagcccaccaggcttccccgtccctgggattctccaggcaagaacactggagtgggttgccatttccttctccaagaaaacactaacctcagctaaaaaccacttaacagtccagtccattcaggatattccatgacttcatgtccctattaaacttctctcaggtaatatgatgtaataagagatgtagccttgactctacaatttaatgcaaaaatgtaagggccctattcattggtcagattaagttagaggaagcggcaggaaatgcaataatcatatccaaatttggaagtactgatagttcagttatccaacctagaccacaaagttaaacagccaaatggaaactggcctatgtaggactttgaactgggccttaaggagaatacatcaacaagctgtgcagagaaaatctcagtttcttcaagttttataatttaagatactataaaactttatatttgaaaataaagatgtgtgcttcactttttaaatcttgtaattcataattaattactaacaatcaaggaaaacacagcctgtaatgtttaaatttcatgcctataaattttattccctgaatttagtaaacagaaagacattctaaaactattaaatattgcttattggttaccctccccatcactccccatgaatcaatgactattaagaaagtaggttaggctaggagcaatgctgaacataatggatactggaaataataatgttaagaagcaagatgtggagcaaatcaataaatcaggaagggaatcacctacccttaactgataacaaagacaaggtcaataataacatctcacctctaataagttttaggcattgtgataaattctttatatatattagctcatataattttcacaacaaacctacaaggtagaaattattattacacccaatttgtaactgaaaaaaaaaaaaaagaggtttaaagagcttatgccacttttccagaattattcagaaagtgacagtttgaattcagttattcaggtctctatgctccctagcctgtgaacacaggcaagatgctacccagccttccatcgaacctcgcaaaattgctattatccttagatactgtgacaggcctgtttttaggagccagcaaatcctataatattatatttataaacagtagcaatgctttaccttcccaggagccatttcctcacaacagcaattacagtttgggtattcatcaggtagaattagatttgtcttcagagaacagaataccttgtccccaaataatagtagtttaagtaatgctgctgctgctaagttgcttccgtcgtgtccgactctgggcagccccatagatggcagcccaccaggctcccccatccctgggattccccaggcaagaacactggagtgggttgccatttccttctccaatgcatgaaagtgaaaagtgaaagggaagtcactcagtcatgtccgactctagcgactccatgaactgcagcctaccaggctcctccatccacgggattttccaggcaaaagtactggagtgggttgccattgccttctccgagtttaagtaatagaagatgtttatttttctttatattagggaaagttcagatgtacagagtccagagcttatatgacaattacacaggcacttgggatccaagcttagcctgtcttttatacacattaatctttagagctgacttccattgacaacattgcctcatggtccaagataaccgcttaagtgttagccatctagtttgagacaggaagaaggaagaggagaaaaatgaaaaggggtataccctcccaaatgagtccacatgttattagaagaaaaaaaaaattagaaacaccagcactacatcttgcactcacatcttactggctactcataattctaagaatgtatgagaaatgtagtccaactgggcaggcttctgttagtaaagtggatggggtaatagatactatatcaacatctagtagtttctaccactgacagtgagaaataatcatcatttaggctttttactatcatcttaagaaactgtttccaagtcaaagctactaaataaaagttggcatctggtagcaggaatgtttattgactccctcagaaacacataaaaggatgcaaatctcatcatcagaattctattgcttatttaataaacaaacattcttctaatcatttatagtaatttcaagtttgctaattcaatatgaaatacaaatgtgacacaagtaataaaggactaataacaaaaatcctaagctactaggtaatacacatctgtctaatttactctacttcatttggctctattccctggaaggatttcatgaacttatgacaaactctggtccaatgatcatgcccataattaagattcccaatctcatgctctgtgttttctttattaacttacgttatcttagatgtagcatcctctgctccacttctattaacctaaacagatcaaactataacctcaaagtatatttaatctaatttttaatcaaatacccttttttctctgctacttcactgagagaaaatcacacagtccctacctctgcttcctcttctaaaatcttactatgtcttcttcactttaagtaactatacatgtatttttcttccttcaaatatacttataaataattatgatctgtaataaaatgtgctaaagtaaacaatgtggcttcatagtagagaaggagagcttactgatagaaatgataagagacaagtttaggtaatgattcctaacctttatggatgccccataggggataagaccatctcaagggagagaccataagcaccataaatggtcaagcaaaggctagatgctaactagcaagaaatccaaaaatgaattgttatattgagtagaagtcaactgatttcttaacatcctttcccactaaacaatttggtaaaaatttttaaaataaattgagttgcaatacaaccctccaaatgatcactaatgaaatgtcatagtttcttggatattagcctagttcatgaaattacactgaaccctctttgggagtccctgtgtaaaatatttaatgctaattagacagtaaatttcagatctagcattgacataggaaggagaagcaaagaggattattaaatagaggtgataattacactgatttttattgcttttaggagaacttaaaaacttaatcagttcttcaagtgtttcattatttacattgatgacaaaggactaaatattgagagaaaattcaaagagttctaaagaaagctaagtgaaaatctattatcaccattaactattaataatagttaagtaatgttagaagacaaggtaaaggtctataaaaatatgctaaataacttaatggttcagtattattgagcaagttaatataatgctattgtaaactatgccaaggtaaaacttttgtattttaaacaaaaatgataatttttgtttcttaatttaatgatttttttcaattttagtaatgtcattaaatagatacggttttcctgagactgggctgttgaatttcaataacttcacttctataaaaccattcatacaaagaaataatgttaaaaagccattttgagttagtattccacagagttgttgctttagtcgctaagtcaggtctgagtcttttgcaccccagtggactgtagcccatcaggctcctctgtccatgggattttccaggcaagaa

SEQ ID NO: 33010 - DNA, 3625 bp, Bovine  19866880523384
aaaacacattacccacactatcaaagataccatgactgagctgctgacaagcatatacttaattgcaggatttaaaatgatgtgtctgcttttgattttcatggtgacaactctttactaaaataataaaagcagtactacctaaaattagcagatacaatatcctattacttcatagaggtatccatagaaaaaataagtagaaaccctaaagatgctcagtctaaagtatgaatcactgtatgctgtcatttttgtaagtttaccttactctgaaacattcaacttgacataaatatcttaaacctgtttacacaaggataaaactctcattttttcctagaaagataaaatataatctaaatcattacagactgaatgtataagatattttaatagatgttatatttttccaatccagttcaactgggatattccaaattaaaaggtattctgtaaaaattatgtatgtcaaacatggagagagagggagaaacgatatatcatggtgtgaaagcaagagtaacccatcttgaaagatctttgtgagaattaagaattgtttgcaataattaagaattattttcaaattactttgcaaataacacattgcaaagtacctacttccaaaaagcattgtattatttatcagcttcataggtaagaacaaaatataaaaagtaaagatcctgaggtttataatattttatggaaacaggttagggtgggagaaataaagaaggatagagtaagacagagagaatgagggagagatgaagagctgtgtggtgcagaggataagaaggctggattgaggcagtgggaacctgcctcagtggaagctgtttgagctcctctgaatgttttcatcccagggatgtcttagtgtttgcgacaatgatgcctatcagacctttcagacagtgatcagaatagaactctttgtcaaagaaattgaataagccgttacaggatctcaggtggactgatatattcagtgtgccatacatattagaattctgggcatcctaaatgaattctgactatggaagcccacattgcatgaattctgattaggtggtgggcaggaacagagaacgttcatcaactcctgtacttacattgtacattggaccctcagaagatggagatattggtctgattctggagtttgagtggtcctgctgagaacacagcagataagcatagccaaaatttccagactgcccttttcttgtacagacataaacctctcaggatcatttaaattccatgaggctcatcacaataaagccaatccattcagtgcagtagctattatccagctggacatgccagttacaccatggcccaaatccatttctattagtacttaataaggtattaaataaggagatcaaaccagtcaatcctaaaggaaatcaatcctgaatattctttggaaggaccgatgctgaagctgaagttgcaatacttcagccatctgatgtgaagagctgactcattggaaaagaccctgatgctgggaaagattgagggcaggaggagaagggggagccacagaataacatggttggatggcatcactggctcaattcacatgagtctgaccaaactcagggagatagtgaaggacagggaagcctgacatgctgcagttcatggggtcacagagagtcagacacgacttgatgactgaacaacaaaacaagatagtgaatatgttgtttatatatatggttgtaagaacaaagttctggtatgcaccagacaggtatcctttaagcaacatacagaattaaatgacccatcatcttccacactgatatcatcctagacccctaaagaaaccaatagttcacattggctagccctatggatttactggaaatgtccattctttctttatggatatcagtgatggctaggtaactggcaattttttcccaagtaataaacattaagcaaagagtctaaaaatatgacctaatggatatttggacttctgtcagaggagttggagaattttaccatgtgtttttttcatcatctagtctactttcagagtcaactgtgtactcacacaatttgtccccaaaatcagggtgttactcttatgcttcaaacacatactagtcaagttttcctccattatcttctcttatttctagtgaaaaaaaaaaaaaaatccttgttcatgaggttgacactgtataacatgtcatttcatcagatccaaatgcaagaagtacaaaagactccaagtgagaaacctcaaaataagagaaaattgagagactcctttatgagtaaaaggagtatatactccctttcagtatactgagagaagatttatacatatggagaagaatttacagttaaattagtgataagtacagaagcaaagataatgcttaaaatccttaaagctaagcttccacagtatgtgaacaaagaacttctagatgtacaagctgaatttagaaaaggcagaggaaccagagatcaaactgcccaacatccattggatcatagaaaatgcaagagaattccagaaaaacatctacttttgcttcattgattatgctaaagccttcaactgtgtgatcacaacaaactatggaaaattcttaaagagtcttaaagagatcagaataccagaccagcttacctgcctcctgagaaatctgcattcaggtcaagaagcaacagttaggtccttccaggcggacttcacaggactgtggacgacagaagggaagcacacagggactgtcccctctgcttcgatgccctcccgttctccttagggatcagggacctcccgagcattgcctggggtcatactgtgaactgtggctttggacgcatgtttgcctacaccaaccagtataagaccgtcttggatttcacaaggatcagacttgtgcagagaagagtccatcgtggaagctttaattgatgggatctggctggctgccagagaacaagagaagcatgggaggtattaccactgaaagacttagcagagatcaagccctgagcctttgcagtgggagcactgactccaagaccctagactatcagagaactaaccccagggagtatcaaatagtgagaactcgcacaaaggaaaccactgtaataaaaggcccagcatcccccaaccaccaatagcaccctgtgcaggacacctcatctaaacaacaaacaaaacaaaaatacaaacccagtcatcagcagacaggagtaccacttcactcagccttgcccatcagagcaaaaacaaacaaacaaacaaacaaaaacttagcacaaatctcaccctatatgaagcttacacaaaccactggaccaaatttagagggaagaaaccaaaaggaagaaagaattcaagcttgaagcttgggacaggagacctcaaacacaataagtttaaaaaataataataatgaaaaggcagagaaatattacacaaatgaaggaacaaactagaaacacagaagtccaaataaatgaaaaggaaatgagcaaactacctgaaaaagaattcagaataatgattgtaaagatgatcaaaaacctggaaagcaaaatggagaaaatgcaagaatcaactaacaaa

SEQ ID NO: 33011 - DNA, 1279 bp, Bovine  19866880558220
accttgtggggggtggtccctgaggcagcaacaagcaaccccagaatctttcttttttttttttttccccagaatctttcttattgtgatgcagtaacaaacaaattgaacacactgggctgagtttatttagaaggtccctgtctataagtttggagttttcagaagacgtatttatgttgctgctaagctgttaagtcgcttcagtcgtgtccgactctgtgcgaccccatagagggcagcccaccaggctgccccccatcttgggattctccaggcaagaacaccggagtgggttgcaatttccttctccagtgcatgaaagtgaaaagtgaaagtgaagtctctcagtcgtgtccgaccctcagcgaccccatggtactgcagcctaccaggctcctccgtccatgggattttccaggcaagagtactggagtggggtgccattgcctgcactacaatcagagcatgtaatctatatgacaccaagtctttaaaacatgctgaaacttattttatggcctactatgtgatcagttttttaaaatgtttcttgaatttgaacataatattctctaattattggatagatggatagatagatatagaaagaaacttatatatagatctatagatatagatcagagaaggcaatggcaccccactccggtactcttgcctggcaaatcccatggatggaggagcctggaaggctgcagtccatggggtccctgagagccagacacgactgagcgacttcactttcactttttactttcctgcattggagaaggaaatggcaacccattccagtgttcttgcctggagaatcccagggatgggggagcctggtgggctcccgtctatgggctcgcacagagtctgacacaactgaagtgacttatcagcagcagcagcagtagcagtagtcccctacatgcttaactcatgtgctgaggtaaaggtcaggaagatcagccttcacagagataagataaatattgctattcaaatcacagctgtgtacatgatttcagtaaaacatgcttacttctgctaaaaaatatgataaggaaagattgttatgctgttaccataattatttcaccaggaattgataacctaaaagagtctatttataactgtgctgaggaattctgtgtatcaaattaagtcatttttcaatgagatcattactagaggcaaatatatgactttcagaatgttatttttagaaatttaaagtcctttgaaatgtcaacttaaaaaaaatactgga

SEQ ID NO: 33012 - DNA, 613 bp, Bovine  19866880601351
ttagagtgagaaccctgaaggctttaagataacacacacacacacacacacgcactaaaccatagtttgggctaaatggattagggccaggtttcaaagaagcagtatttgtaatgattaaaaggtgaaggctgccaccttgattctcggcatttttcatctttgtgcaataaaaatattgttggcaaaggacttctatgtgtctaacctcattaaaatctttcagaaacattaggaggaattactcttaaagcaaagggtgtgttttggttgacttgagcagagtttaaagaatttactgtcagggcttaatctctgcacagtgacttcaatttctctgtagtcaaccatctgaaaggcgtcatttcacaatatatgaaccaaatgaatggttaaatatgtcctatttggtttttctcccccagttggccttgatgactctaggaataaatgctatgattcctcaggctttcagaaggaaagcagatttttaagcactttgcatcacagaagaaatttacatgactattgaagaaaattaatcagagaagactgccacccaccacctatcaggaattaagagacttagatatgcaagagcaagcaggggaca

SEQ ID NO: 33013 - DNA, 1562 bp, Bovine  19866880617836
ttcccaagagtcaaaaacaatttaaagacctaattgacaaatgacaacatccatgggtgaaaaataaagtagctaggctacaagggtaaaagatcatttcttttgaaagtctacagcctgcacacacagataaatgattagtcttccttgatttgtatgcagctggtagcttgtctgaacccttcaggttatgaccatgacactgggatacttttgattttcttcttaattgaaaatcacatggtaacgatggccaagttctgtgtaacacaatctcatcatctctcaggggcaatcaatgacttcaaagctgtctggcactaatagaagtgcactcaaacagctttaagaacacaatcactgtcttttcttttctaatttttcagcacaatttagagcaatcgaggaaaaaagtatttgactagaagagaagatgtgtttttatcttggttttatttctttactagtttaccttgggtaagtcacttaacctctctgagcctcaattatcttacatgtaaaatttggagataatcacacttgatctgccaatatcacagggtagttatgggagaatcatttggcataaggtggatatcaaatgttatgtaaatataaagggcaggcaagtaaatctggagattttcaatcaagtgccttatttttacttttctattcaaattttttaaatttaacattctataatgtaggagaatgaaaaattttgcaagcttttccacaaggtttttatttttctcaaagggttataagtttttggtctatttttatctaagacggttttttcattttatgttatacatgctcttgaataaattttttggaataatatataacatagtgggggaaattacccatgacaaatttcacagacattttaatttattcatttctatgccatttctttgcacacatttataaataaatgcatactgttaatataaaattaggatcattgtttagagatttattttttcacttatcaagagcttcatgcagattttaggtctgtggaaatgagatctttacatacaaaaccactactttatgaataaatgtaacatttaatttttgaacatactgaggtttctttcaaatttatactatcatcaataattatatgataattatatttatatgtaaattgtcgactatttttgagtattgttttatgatttgcacctaaaagtgggatttccagtttaaacattttgaacattttttaaacttttgctacagattgaaaaatggccttcataaatggtgttactgtgcactcccacaaggcatgaataaaaccttatcttaagtcaccaccaagaatcaaaatcctatcacacactcacactcagagatcaacacacatattgtacacacaaaacaatgcatagcatctttagagacgatgaatacacatttgtttgtattcaaatctcatattggtaataaacacttttatgagcctgagacacatccaataacctgctttgatactacttaagagactgaggatatgcatcttttagtcactgattatttactta

SEQ ID NO: 33014 - DNA, 1464 bp, Bovine  19866880644168
gtcggacacgacttaagtgacttagcagcagcagcattcattgtctagtagaatattggattattttcttcaaggcttcctgttcaaaaatcaatgttctgctaaactgagtggactgacagtagtgtgaggcttgctagaccaacagacaactggattgcccttagatttgaaatccaaggctgctcctgattatggtgaagggtaaataaagaaggaaaaaatacaattatatatgtttcatttacagtcatgaggactttcatgaaattttttgtgaaagaagaaatatagctcaagctcaataggatattaattcaaataaagggattaaattatctcttaattacttttagggatggatgaacttggccatatttggggtgtattgagtatctcaaatgttttcccaaatgtctggagtttaaaaaaaaacatcttcctcagctacctttgttttaaagatcttgcataatttatggtaaacccaaatgaaaatattttaatttcatttgcaactaagaaaacatttgctttttatgctttttcttattaatgtttgaaatttagtttcagtcaagggctaagacttctagatgttttacatgtaatagaaaaacatttatattcaggaaataattataaactttgctacatgaatatcacacttattatcaatgaggaggaaggaaattttaaaagactatacgttatgcagggccatgttgatattattttagacagcctattactttgaataagagcctttctagtactagaatttacaacataaaacattttaaataaaagtttaactaaattaatttcacttttctgtcaatatttttgcaaagattcatttttatcacacttttatagtgtaaacaaaaataatatttttaaattacatatttggtaccaatttatgtctatttggaattgaaaatattggaaaatttcttatttaaaacataaacataattgataattttatatgtatagatatgggtatatatattgtgaatgtgtatgtatatattcactatatatatatacatattctagatacatacacaacatagtgattgtatatatgtatatattcactatatatacacacaaatatacatattttttcactcacacaaacatacacattctaagagcaatatcacaagagtgaccaaaaaggctactttttgtcctatactcagacctcttgtaaaaaactatttcttctcaatcaacctttttttgtcattgttctttactttgagaacttatctgcaatcctattagagtacctaccacatagtgaacaaaatactctctctgttgatgcaataatattcttctgtaaaaagagtcatcctacctgtgaataaagcaattcagttcatgttttctattgctgtggctttccataaaatggcaaataccattttctacaagagatacatgtta

SEQ ID NO: 33015 - DNA, 1912 bp, Bovine  19866880650001
tggattttaaagcagagtaaaactcacttttcatctaaatagcagtgagtttattatgaatggacccatcttaagataagaggatcctttatgatacatatcatccagatttgctttatttttccctattaacatgctctgcagttatctattactttggatcaaaaagttgtagctctaagcatgaattagttagtggtaatgttgagttaaatatttatacatacccatggcaggaaaagtcaaggaaatgtattctaaagtcctttattaacctgatatgctgaaggttaaagaagtttttatggaagaaatgtttcatttttaaaaaataatattgaagcagaacaaaaaatacatcaaaaggtaataagttgagggactgtcctctcttgaaacatagacctgaatgaaaaatcatttatcaaaaattgtcccccacctctgacttccagaagcaagcaccagaatatgaaatactcttcttctggcagcaagggctaacgcgatgaaaaccagtatggttggcagggctcctactgaaagcctactcctgcacttcagtgtcctcagtgatttccgttttctccagcccctcatatctgtttcgtctattctcacacgccctgggaccctaaaggccaatccatgatggtcaagcgaaacagaactccttttaacctcatcaaatctttctgcatcagcattttccagactaaggcatcctgtccttagtatgaagggtagaaaaagaaatgacagcatcatttaccattccactcactcagcccacatttatgcacttcagtttcaaaagtctgaatatcatgaagtctcaattcaatcagccccatgtaggctatgttaaaaatcctactaaaaaactgtaagttttcatcagcgcttagactaagcctggggccattccaagatactggtgaaaagtttaaattatggattgttaataaaatggagtttcactacttttcttcatgttcaatatctgaaattaggtcaactcagtcctaccttgtagatagataccttactacaaaaaaatgtaattaatattaattatattaatttgctcaacaaaactgtattcagtggctactatatcttgggtattgtgaggggcacttaagaatactactataaaaatgtggttaagtatctaatgttatatgtaaatgatgttttcagaatatttgatatccctagaaaatagtatacattgtttaaaacacttgagattcaaacactaattattagggcaatttttattattttatctctagatgagtagataagacatgtagagtcaagttatttacattctggtgaaagacaaaagcatacacagtttacaaatgcagtaaacttgggcagcaggagtatggagcaccataaatcattgagcatagaactagtcatagaacctagaattactgtggtctgaatgcttgtgtcctctcaaaattcatatgttaaaacataaagctctatatgataatatttagagatgggaggctttgggtgattagattataccatggaacacacaagaatggaattaatgcctttacaaaagaggatctagagtgatccatgggctttgtatgccatatgaggataaaatgaagtctgagacctgaggaggacccttacacacccagactggcacacttatctcagacttccagcatccagaacagtgaaaaataaattcctgttgtttacaagccatctagcttgtggtatttgtgttatagcagcccacatgggccaagtcaaagtttcacatagactgcagccattggagaaagcaatggcaacccactccagtgttcttgcctggagaatcccagggacagaggagcctggtgggctgctgtctatggggttgcacgga

SEQ ID NO: 33016 - DNA, 2318 bp, Bovine  19866880657350
catattgttttctgtataactctatcaatatttatggcattgtgctgagatcatgaattttattatttgtatcttttagtagatgtgagctcctttagcaaaaagactttgtctggctcatctaacatcggactaccatatgcctgtaatagaggttgccaaattgagtaaatgagtgaattaacaaatgaagaaacccgggctataacttttggtgactcctatacaaattgccatataacttagctgaactccaaagaatgtatacatgtaacctaaaaaggaaatccctaagcaattaatctggtctatcaactcaaactcaattgttgctattactgccattacatcacagacaaatcattttagctattttaaaggtcaaatcagtgaacactggagtacatgtgtctctttcagttacagtttcctcaggttatatgcccagttgtgggattgttgggtcgtatggtagttctattcctagttttttaaagaatctcagcactattctctatagtggctgtatcaatatacactcccaccaacagtgcatgatggttccctttactccacatcctcaacagcatttactgtttttagattttttattgatggccattctgattggtgtgaggtgatgattcattgtagtttatatttacatttccctaataatgaaccatgttgagcatctgttcacgtgtttgttggctatctgtatatttcctttggggaaatccatcagcagaaaaatggatacagaaactgtggtacatatatacaatggaatgttactcagctataaaaaggaatgcatttgagtcagtcctaatgaggtggatgaacctagagcctattatgcagagagaatgaagtcagaaagagaaagacaaatattgtatattgacacatgagtatagaatctagaaagatgctattgatgaacccacttacagggcaacagtggagatgcagacatagagaacagacttgtggaaacagaagaggaaagagaggttggtctgaattgagagaatagtatggaaacatacattactgtatgtaaaatggatagcaagtgggaatttgctgtgtgacacagggagctcaacccagtgctctgtgacaactagaggggtgtgatgaggtgtgagatgggaggcgagttcaggagggaggggacatatatatacctgtggctgattcctattgatgtatggcagaaaccaatgcaatattgtaaagcaactaactttcaataaaaagaaaaaaaaatttttaaggtcaaatcaggttaatcactcaattcagttactacatattccagccccttttctggggtcaaaactggccaggaaacttggagtttccccttaagagctgaaattaactctggataaggcacagattaatctgaccattaaaaaatcatttgtgaattggcagagcagttgacctcttagcagcaagatgtgatgtaaagaatgtaagtttcagagtcagacagatatggcttcagtttcagaaaactctaccttcaaaatatgtgacaccgagtaagatatcttagccctgctttcatttatttatttttatttttgaaagttgaatactaatatctaccttatgagtgaggatggaggaatggcaggaagccagttagtcaaaagatgaaaaaatgctttgttccatatctgactcatggtaatcaataaatattagtttattactttaactgtcactttttctttctaacactcttcattgatctttacttcacctggcaaatgttctgaatgttggtgctatttgatggagaaccatagataccatcaaagactttctactgcttagactgcagcagaaggtgaactaagagtactgagcatataattattccctgcctctctctctcttccattccttttctttctctcattttctccttctccctcctgttcttcctcttccttttctctctatgaatctaagaaaattttaaaatttacaaaggcacttttaggctaaaatttaatctttataaggctttttatcaagtatttgctctcatttcctctaaaggtagtcaatcacctctaatctttatttctgtatagattatcttacagactcatttttttttttgcaggtttataataaagtgtttaaaattcaccacaagctgattaaagcatgttttgttctcttttcatcaaagatgtactgatactattttacaagcctatttttttttaattcaagttagtaaagaaaatagtattaggtaatttgtttaatcttatggggaaaaaaac

SEQ ID NO: 33017 - DNA, 1328 bp, Bovine  19866880694798
ttcaaatgggaaaatagcaatattagcacagttattaagagaaaaattgcttgctcatattattgcaaaatgctctaagaaataaattgttatgatatataataataaaactgtctatgctgagaggctttggtgatattttaaattaattgatttctaaaatgttatctttactgtaatagatcagtttgttatagaaatctctgcatgatgtcttaaaagaagtgtgttgcaattatacatacaataaaccaaaccagtaaaagttcatagtctagacttgtagacactgtatgatgggaagacagcattgaatagtggaaagaacattaagttcaggtatgaactttggtgtaacctgattgtgaaattatcaaggtgatgaacctctcaacatttcagtaaactgacatggaaaattaagatattaagtctagttacatccaaaaaaatgcatgaaatacagcagatacttgacacttgagaatcatatgtccctcctcccgtccactacttccaacaccaacataatatttcagtcctcttgcaagcaagaggcaaccacttggttgaccatttcttaagaaatacattgagaaatacccaatcagatggttatgagaaaaagcatttaataattttctctcccaagatgctgttaaaataatattaaagttattttacaaaaatatacacacatatgaatgcatagtatatttctgataaagagaaaactactgagtgaggaagtggggtgaaggaagccacagtctaatgtccatgaagagtataatgtaggaggaagctaacttcaacctgaatctagagagacagatgaatgcagtgtcatatctgatattgtacctgatgctgaagatgctggaactataaactgaagtgaagaatgactttaataagtccattcctagattggacatacctgaggggagaatttatgagcttaaagatatgttaatagaaacttccaaaagtgaatcgcagagataaaaaggaatgaaacacacatgcacaccaaacaaaaactcagaacatcagaaactatgctgttgtttggttgctaaatcatgtctgacttttgtgaccccatggacttcagcccactagtctcctctgtccatgggatttcccaggcaagaatactggaattggttgcatttcctactccaagggattttctcaaccaagtgattgaacctgcatctcttgcatctcatgcattggtaggtagagtctttaccactagcaccacctggaaagtccaaaaatgattccagttcaattcggttcagttcacttactctgctgtg

SEQ ID NO: 33018 - DNA, 1069 bp, Bovine  19866880728373
tttgcctgaaacttaatctgcaaatcattaaaggtcaggctctcccttttcccttcctccttccctttcacactcaaccagctttccacatgacaaaaagaagtcacagccttcttatggctcattgcctcccaaggtataaatcttccatggcagcataggaacaactttactgttgctttaatcaaggcatcataatcaattctctcatccatccgtatactttcacattttacatttaatagtgatatgtaaaagtttatacaatgtttatactgttttagtcaattgtatgttaatgtttataatgataactcaaggcaggtaaaaagtttaatacttaaagactttggttatatgaaaaaatcattccaatttataaatgatctttgttgcagagaagtatgatagggtgatcaataaaagtctttcaagcataaaagtatattacattagtataaaattttttgcagaaagtggaatggaagtacaagctcaaggagaaaaagagcaatgtaaaaattctgatgattgtatcatattccaaagattatatcttatatatataatacatatatacatatacaaattatatacatatatattttaatagatatggttatcaaactacttatgttttgtattgcttagaatacatttaaaagagtgatgaaatttaagattttgtaatgtgaatatttataatatactggtaattatatactctcaaaaagttttcgattatgaaaaatgatgaatgtctattttaaaatgtgtgatgggtacattttctacatttttttttcaaagagatatgcaggcaaaagtgagaccacaggcttaaggctaaaaggaagtggtttgagactactggctaccaccctacttctagactagaaaaaaatgagaagaaaaagaaacaaaaacagctactgttgtatacacatatacatacaccctccttccctcactattcctaacccccatcctttgcctgcctcttccatcagctccacctcagacatatttggtggtaaagcaaagggtttcattgtttgggaagcaccga

SEQ ID NO: 33019 - DNA, 1691 bp, Bovine  19866880761692
attaatctttattcattatcccttttctttttaatgttcaagattttagccactaaataatatcgttggttgtatacttaaactgatagcttcctctttctcccaaatctgtatttccctcaaagggacaaaggtagatttgtccttgggaggaaaaaaggaaaacagagcagggggagtcaaagtgtgattcttgacattgcacaacactcatgattgtctctagggatgggagccctggtggttcagacagtaaagtgtctgtctacaatgcaggagacctgggttcgatccctgggtagggaagttccctggagaaggaaaaggcaacccactcccagtactcttggctagaaaatcccatggacggaggagcctggtgtccatggggtcacagagagtcagacacgactgaacgacttcacttgcactttgtttaggactgtgtatacggcaagatcttgcttccatgaactgtgttgtgaaaagcacgtgtatatctatgtatgaccttattttttgcttatctaaaagaacattgttctttcatccatgtgaatgtaacagaataaaagtgtggcacatgtagaattgttttggaaaatatactaatttagtagatttgagtcttgctcaaacttcttgataaagcatacttttcccaatgtttttctctttctgtataaatttgattaggtttaactttctaactccaaggggaaatgaagtgaacagtctgacatggagcacactatgctgcattttttgtctgtgtctgagtctgtgcattttagaatccaaaaagtttgagatttttcatagtttaacacccaataaggttataaaccacccctttattataaaatgatttttaaacgtattctacttaactatggtagtatttactccatatttttttttgcaatttttatcatttaattaaggatatttttctaaatttataatctggcttgggcaagataggattaaaactgctatttttaaaaaaaagagatttacaggtaatcatacagtatattatgtctatatatttatagataatcatacagtatattatgtttctacatattcattcacaattaattcaataaccatacttatctctgctaagaagaggattgataaaattatatagttgatttggtccagagaagaatttgcatattggtttaaattagattctcctgaaaatatgagtctgaatttctgtttgccttggcctgtctgttgtcagaatgagtgagtagatagatagaggtttctgacttgcctgaaacctacaaattaataggatttaagagaaaatatggacataattgaaaattggtaagggtggaggggccttaaaggccagacctgttagaaggagagaggagggacttcagattagattcactgcatgtttatgttgagtgagagacttattttcattccatcaggtattttatgaaattgttttataaaaatttttcccataaaaattataggtcaatgttgctgttgctgctgctaagtcacttcagtcgtgtctgactctgtatgaccccagagacggcagcccaccagggtcctctgtccctgggattctccaggcaagaacactggagtgggttgccatttccttccttgggttacactgatcttaattgtatagaattttataataatct

SEQ ID NO: 33020 - DNA, 496 bp, Bovine  19866880773322
taaaaaatagagcttagttccttaaaatcacgttcttgatattttttcatttaaaaaattaatattttatgtgactcattatatgactcatttatttatgttgagaggtcaattaaggctaaattagatatatctgaatatctatgaataaagtgatttaaatttttaagtcttcactgcaaccagaaaaacctcctgaacaattaacctagattcatgtaatttgcaggtttttgctttttctaatgttggcctttttgctcaaccaataaaaatgtgcttattattcttttatatttctatttcagttcattgttcttttgttctcaggtggggaccagttcacatccaaatacttaatgcaggcataatacctttcaggtatcataagaaagcaaaattaattaacattaacaattttacttatattttaattttacaaccccttgaggcaggcactatcttcattttacagaggaagtaacgaggtctaaag

SEQ ID NO: 33021 - DNA, 2534 bp, Bovine  19866880784682
ctgctgggcgccggccggctggagggcaggtcgagtctctagccgctgaggtcagcgactgcggtttaaaactactgcagctgcttcctgtccttgactgtcattgaagagcagaagttagaaactagtaaatgacttaaagatggctgtagtcttgttaatatgatctggaaacagttcctggtcgtcgcttaagtgttcagggcttccgtggtggctccaatgcggaagacaggttcgatccctggaacaggaagattccctgaagcaggaaatggcaacccactccaggtattcttgcctggagattcccacggacagaggagcctggctacaaagacctttgcgacactgccactctctcctttgcctgggtctgaaactgcattctaaaaatatgtttctatcggtcttgtcactacaaataattttttccggtatcccaatactggaattctcatttacctgttttttctttttcttttttttaacccagaagtcttcccaggcattcaagaacactctgaaccccaacctcatatgtagcttaaagcattaatcaaatgatcacaccagtaattggacctggaaagaaagtctcctccaaaaaagtaatgggagacctgaaggagaagacattaaccaaacgaaatggaggtagatgtatagacagaggtaatagttgtgactgtcagaaactaaagagactttttaagaagggaggtctggtttggttggaacttgaatagtagaggaagcgggtggtggggggatcagatctgttgcaccagtggtcatttacacagcatgggttttatgctgagagcgttagggagttaggcaaaagcaagatgtgactttaagttattgctttgtctatgaaaattgaattactggagataaacatgaaaaaggggggaatggttaaagggccattgcaatagtccatgttagaaaatggtagcttctactagtgtaggaaatgtgatgatgaagaagagattgcagagatatttaggaggtagcaccaagacactgtgattggtcaaacatgggagtaggaagaagagggaatccaggatagtttcagaggttccattctaactctggattttgataccaattattgagattatgagaattggaccgtaaagaaggctgagctctggagaattgatgctttcaaattgtggtgctggagaagaggtggtgattattaaaatgacatgaagcttatgaagactggtatctttttcattcattcagtaaatctttattaagtacctactctgaatctggcactgttttaactatggcagctgaaagaaaaacttgttcctcactaatggcgtttacagactggttgggaagacaaacaggagggaagaggggcagggcacaacctttaaaagaatggtatagcctgaagacatgacataaattgattagaatcaaataggtccaagatggcagactagtggacttccactagaatttgagcctcagtatatgctgattgtaacacatcagcaagctgaaagacacatccaccggcaccaagatggttcaaaggctgacaataaaagatcaaaaaatgagcagcagcccaattcctggaattctccaccctttccctaaaatagttgaagtaatcctcctattcaagcccatgaaattactcagcctgtagaagctaaccacatcacattttgcgactgctcttgccttctgagatggcccacactctgtctatggagtgtgtttctctctaaataaatcccacctcttacttatcactttgtcactcattgaattctttctgtgatgaaatatcaagaacctgagcttcatctgagtcactccagataatgagtgcagccatgaaattaaaagacgctgactccatggaagaaaagttatgaccaacctagacagcatattaaaaagcagagattttactttgccaacaaaggtctgtctagtcaaggctatggtttttccagcagtcatatatagatgtgagagttggactataaagaaagctgagcacagaagaattgatgcttttgaactgtggtgttggagaagactcttcagagtcccttggactgcaaagagatccaaccagtccatcctaaaggacatcagtcctgggtgttccttggaaggactgatgaagctgaaactccagtactttggccacctgatgcgaagagctgactcatttgaaaagaccctgatgctgggaaagattgaaggcgggaggagaaggggacgacagaggatgagatggttggatggcatcactgactcaatgggcataagtttgactaaactccaggagttggtgatggacagggaggcctggcatgctgcagtccatggggttgcaaagagtcggtcggacatgactgagcaactgaactgactgactgactgagcttcattaggtcctaaaaacaggtgtgtgatctcagttggaagctgtgggtcttggccgggtttaattcttgcacatgggttcaaagcctaat

SEQ ID NO: 33022 - DNA, 943 bp, Bovine  19866880872026
tatccttgaacatattgagcctattaaagttcttggtattgtaaagaacaatcattgccaaatggatttctttgaatgctttttttagtactgtgtatttagttcttaaattaataattcatttgaataatttaagttatttttttaagaataatggagactcgctgtggtcttttcaccatggaaatagttttatttgtgaaggaaggtttttaaagaatagatattttttgtggtacttattttaaaggtttataaagagccaaattcgttatataggttgtgtggacacattattttagaaagtaatacatactgatatgtattatgccatgctagctttgaagatgcttcttttgtgaaaagggtgtatgtggcatatagtataatgaataacataagaggtgaggatgagtagttatgtatgcacagttgacctttgtttctattgataggctgttggtgaatatttggaagattatagtgttttatgttttatatttagtgaaattaatattgaatacaagcctattagtttatttggcaagctagcattatcttttggccagatttgcaagtttgtctcataagaatctatttagtataagttatgaaagagcattttaatttattaaatcacttgaaacagaagcacatgcatttctgtgtgcaaatgtaaaatacacaggagaagtagaattcgtttgtaccacttgcaggacactttttttccggttggttgaactgatgcgggcccactgggccactgagaaatgactttgatagatggttgctgtctgagaagctagtatactacagattagtagaaacccaaagagaatctaattcgctttgtgaagagtttggtccaataagataatttttctaattaacctttggagcaccagtgtagctgtggtgtttaagaaaataaacggcctca

SEQ ID NO: 33023 - DNA, 739 bp, Bovine  19866880878241
tatgagacaatcaatctctgttgtttaaaatcactaagtttggggttgcttgttatagcagctataggaaactaatacaataatcatcaatatgattgagatcatgtcaataaaaataataagcatacattgcttacataacaaaagacttccctataaaaatgatgatatattttctctatagacatgtttctttagggatatgcaaatgcttccctaaactggggaaatagaaaattcatcaccaagagaaaaccttctacctcaaactcatgttaaatagcaggtttatggattagtagatgtttggtcttttccacataagaaagaattttgaagaatattcatttaattgatattaatgaacatgaattgtataatttaacatagagtataaataaagatttatgaaatgagaccataaatgtttttgaaaataatcttaaagacatggaaagctaaatagaaagaatgaaaaattaaattaaaatatactctacaaatgttcatgttaatgaggtttttatatatctagatatcatccaaggagagttatgagtttagaaattagaatgaaagtacatttttagatggtattaaagagattataactatgtccagctttattttcatgctgtgactgcaagctccagcaggggaagatgataatatgcataagaccaaggcttactttctcattttccatgggcaacatgataattactgtaaagacaaacat

SEQ ID NO: 33024 - DNA, 1773 bp, Bovine  19866880899620
tctaactgttgcttcttgactccaggtttctcaggagacagatattcccatctctttaagaattttccacagtttgtggtgaatcacacagtcaaaggctttagcataatcaatgaagtcagaagtagataattttctggaattcccttgctttctctatgatccaacgaatgttgacaatttgatctctggttcctctgccttttctaagactagcttgtacatgtggaatttctcagttcacatactgctgaagcctagcttgaaggattttgagcataatcttactagcatgtgaaatgagtgcaattgtatggcagtttgagcattctttggcattgcctttctttgagattgtaatgaaaactgaccttttccagtcctgtggccactgctgagttttacaaatttgctgacatattgagtgcagcactttcacagcatcatcttttaggatttgaaatagctcagctggaattccatcacctccactggtcttgtgcataataatgcttcctatggcccacttgacttcagacttcaggatgtcattctctagttgagtgaccacagcattgtgatgatctgggtcattaaaacttttttgtatagtttttctgtgtattcttgtattcttctatgtattctaattcctctagtgaatggtttaagactggtatattttctggttataaatatcattttaaaataaagcattaaaatatgaatagagcaattgtttaaaatgtcccatattgccagcagaatttggctgtaggcttccataggactggggaaaacagagaccccacttttgggaggcacacacaaaatcttgtgtacactaggacctggggaaaaatgccccttatttattgaattttctttctcataatctgaaaattatcagaaagagtagaaattcaagttagagttaggtagagaaaagggaatactatagctgataatgatgtaaggtaagtaaatctcttcctcatttggatatttcatttgaatttactttctcatttttttaaaatctcagttttatttatttatttatttttttactttacaatattgtattggttttgccatacattgacatgaatccgccatgggtgtacatgtgttccccatcctgaacccacctcccaccttcctcagtgatagaaagtcttagaggcagatgaatagaaaatttttagaaaaattccagatgatatgggattaatagagatgaggaaaataacctctttaaaatttctactgagtagcaataaaaattggtgaggatattttttaacctgggcttccttggtggttcagctggtaaagaatctgcctgcaatgcaggagacctgggctccatccctgggttgggaagatcccctggagaagaaagaggctaccaactccagtattctggcctggagaattccatggactttatagtccatggggtcgcatgtatagtcacgggacatgagtgagtgactttcactttaacctatgggtggtgaaaatatagagaaacttgttcatatcttgtcaacttttttagtgagttgtaaaatttagatggcatgactagccatatttattgaatcttttttattttagaagtttatgttggagttataatgtgatgagttgagttatatgagacatctgcaagtaactttctgcctaggaaatctgcatgtctcttagttcttgtgattaggataatgggccctgtacatttttccagacaagaaaagaacatcacca

SEQ ID NO: 33025 - DNA, 2900 bp, Bovine  19866880937616
ttaaaaatttggcattgttttactacagcaaatactgttatcttaccaaatatctggtttcttctgtttctaaacatacagtaagcaaaattaagtaaaaatacgcattttctgagtagaactagacagctctcagtttgaagtataattccttcaagtaatagttctatgatcttacaaaagttatttcaccttctcgactataatcaaataataacaaatttctgaggccttaactaattagaatacaaggactaagacttcatgtcccttttttagaaaagatcatactttatattaacagtcattgtttagtcactaagtcatgtccaactctttgtgatcccatggactattgcccaccaggcttctctggccatgggattctccaggcaagaatactgcagtgggtaaagccattcctgtctctaggagatcttcctgatccagggatcaaacccatgtctcctgcagtggcacatagattctttacctctgagccaccagggaagcccatattaacagttaacacctattaaatttaactaatcaggctcttcatgcacaaatattttgacattagaaatactgacccaaacaattgaaaaagccataagaaccttagactccacataagcaattcagtcatgctagcagacattatgttcctacattttatgttttaaaacatatattctctgtacctataggtattgtatatctgctacgataaataaaaacagatgtttcattaaatacctggaaggaataaaaatatccattagcaaaacacagaaagtgggaattacctcttcagtactatccccaagacacgtcaaaaatagataatattcagttcctgagctaggaaatccgcacatacacttaaaatgactattttgaaatgaaattttcatttcatgtatagagagggttggtttttttttcctttggcaaatcaacatttagtctgtaaaacacgatgctcactcataatgtcatgcatctcactcacaataattctttcttattaactgcttgggcacaatttattttcctctcaggctatgaaggtgcgtgcaagtgcagcagactctggctggagctgataagccagcccatagcagcagcactgctggcctgatgagatttgtaagaagacaatattccattggctcggaaaactatgctgtatatcaaacctatcaaaaataatatctacaaacaatgccttgatgcatttgccaactctcacagagagctctctggtgttctgaaaatatagtttgatttttttttttctgttgtagtgaagaaatacagaccacatattttttttaaagatccttgcttttgtttacatttttttcactaagcgtggtagtctaaaagaatatttttaaatcctggctttcaaacagtcattgctatagttcccgaagaggatagattatctatcctttgagttaagactatttatttcataggagagttaaaaaaagaaaatcaagaaatgatcaaaagagaagtatgtcataatctcacaaactaaaatctcattataagttctccaaagctttttagataaaacacttatgaggaaggcaaacactcctgctaaaaatgagattttcattctgtttagaatatttattttagttccacacaatttctcaaaagcacataccatattttaatctagtatatttttgagatctttgtttccaacaaaaatatgctcctaagaaaaaaatattaccttaaagacaaaccactgaggaatcaaaacaaatgacacactagatatattcactttatgtatgtattgcataaaggaaaataagctacagaaaatgttatcatatttagataatactttataatttacaacgtaccgacatgtattttccacaacactatgaggtgaacatgggtagaactagaattagcttcaaatgcaaattgactgacatttttctgtttcctgtatactctacatacaatacctcatttaatcctcagaacaaccaaatgacattttcttagaaggcaatattccactggctcagaaaaaaatttctgctgtacatcacacgtattcaaaaatatctaaaacatgctctgatgaattttccagctttcacacacacacacacacacatacacacacacaatctgtgtgcctatctaaaacaaatgtgatttatttttttcaatttttaaaaaagaataaggaacttgaagtataggtgggattgattacttacctaaaaccagaagcaagagacaactatatgctttgagtaccaactaaagatgtactgaggggtttatagacacacatacaatcacacgatctcagttaatattaccaactgctccttaagcttgatattgttatacctctttttttcctgtctctcagggacactggcttcctttttgctccagtggctccttgtgcttccattgtcataaaagagaagattttaacatggccaatagatgtctccaaaatcctgcagtaactaggatactggcactttgtggtattttctcatcctttatggtgccctggaaacaacggtgtaaccacctgtgattttaccttttgctgtgaaatcaaagctgtttcatggtagagccaaattagactataaaaaggctctaggaagattctctggtaagtcccatccttcagaatgaaaaagaagtaaacactgagaactcagaagaatataattcgcttgtgttcttaaacaatgtgtcctttgttacaagtcaacccggattcttaacattttcttattgatctttacaggaaagagaaataatccacaaaccgtaactacttcatttctacatgaaacattcttctgaatctatgtagttttactcta

SEQ ID NO: 33026 - DNA, 2760 bp, Bovine  19866880954131
ttgagttttatcacctgtagaaattagagtaatttgaaatcttaagtacctattactatttcattgaacatttccctcaaaatcttaggtaactcaatttcaatataaagtattaattagcaatttataccttcttaatgccaaaagtgacctttattcagaggttgttgaggtaattctgtgatgtaaccaaattaaatttcaaccttagatacaagcaattatttccaatcaggtcctttactgctgctgctactgctaagtcaattcagtcgtgtccgactctgagaccccatagatggcagcccacaaggccccccaaccctgggattctccaggcaagaacactggagtgggttgccatttccttctccaatgcatgaaagtgaaaagtgaaagtgaagtcactcagtcgtgtccgagtcttagcgaccccaaggactgcagcctaccaggctcctccgcccatgggattttctagacaagagtactggagtggggtgccattgccttctccgatcaggtcctttaacaatggctaaataggcacttgtgttacttacattgtagcttatttccccacagagagttaacaactgttgtttctctatgtaaccatcacatctaagagttttctgcaaagccaagtcaaatgtatgttcattttgtaacagagaatggaggaataactgcctgctcccacagaataacaccttaattctgtttttaaaaaatagctctcatttgtcacagtgagatgcttcacgtgtgcatgcatactcagtcacttcagtcatgtctcactctttcggagtctgtggaccatagcccgccaggctcctctgcccatgggattctccaggcaagaacagtggagtgggttgccatttccttctccaatgcatgaaagtcagaagtgaaagtgaagtggctcagtcgtgtccgactctagcgaccccatggactgcagcccaccaggcttctccatccatgggattttccaggcaagagtactggagtggggtgccattgccttctccaaatactcgcaggaatccccatatagtcagagtgacttttcatttttcatgtttatttcattttatctaaagatgttgattttaaagtcctgtttctgaatgtcttgatttcttccctgagtcttttgattttgatttttgaccaaatttaaaaacactataaagaaaactagccaagtttatacaatcttggacaaacaaggtaaagcatgcctttcaaagcacaggaaaatttgttttgtctttattcaatgtctattaaacaatttggttacaaactgttaagaaatcttgaatttcaaatactgaattctgaaattgatgtattgctaaatattttgtagggattctatttcaatatactattttatctagatatttactcacatcagaattgtttccacaaacagattgtaaatgttttaaagataagtgactgcatccttttgaatgccccacaatagtgcctccaataacatatgcaacataaaatacttgttaaataagtacacgttaagccaaatttaattacaaaaccagctgctgtcagttgcattgtctcacacgtgttaaaatttccttgggcttcctgagaaaccaataaccatatttttagtttcattttcacaaaatagttcactcttctggctgtcaaagttcatgccacgaacagcccaccttcttcaaatgtattctgaaaaatgctttttaccatttctcttccgtgcttctctggaacttcttattttgttttactttcttatgcttagtaaagcatcaccgaacaaaggacaaaataagggcaacaaaacaattgtgtgatgccttttatttcacagctctgctcatctgcggcacaaatagcagaacccatggttaatcaccacacacttctggttccctgggcactcgtggagctttccatatggtctgttcaaaacggggactcatatatatatcaaatacaaattatgcaaagaaatgtgatcatatagtggaaccaagtcataagagaaaaatacctgttcaacaaaagcagaaacctactttcaaaactctccaatttctggttcccaaggcaaagcaataataagtacattagataaatcttcatcctaacactaactaggatcatctctcagacatactcaactggaagctttcattttcattcgtatccaagcgaaagaaaaaagtttaatggattacttccattttctttaatgttttaggcttttcaaatcttgctgtttactctgagtgacttagtccctctatggtgaagtctttaagtatttttttttcccataatttcatctttaagctttattccgtctctttttctactggcttagacaacttttagccttagattaggtaaccgcatagtttatgactcctaccagggcgcttttgaaatgaaaggaagtacaaagaagaaaaaaggatagtgcaacaacaaatgaaacagagattttgctgggaagactgagagatacagtcacctagccttagggtttgctttttggtcaacagagactttctcctatagtttttagggttaatcagaagagttacttacataaccaaaaactgtttgactgtaagttggatcctattttccatgtatatcacatttctaatggcagtcaactgagaagggcaattagaaaaataccaaagttttcatgagatactagaaactagaaatcactagtaa

SEQ ID NO: 33027 - DNA, 986 bp, Bovine  19866881042006
atatagaataaagcaagtgagatcaaaactaaaaaaccctcaaaagcaactgattaagattgactatgatttctctttttctttctttcatcagttcaatatagagattacaatatatgttgtacttaattttataaaaatacctcaaaatgttctgaaaaattaatagcttcattcttttataaacaatgaggaaaacaactgctctaaaaatacttagtgaaaactcattaagcagcttaggattcaaacataggaagtgtttatactttattaatgaaaaagtgaataaaacagtggggagaaagaatgaaaaactaagactaaagaaaagagaacaaaagaagttataaaataaaaaagaaaattatatgtaagataagatctgagaatgatttaaaaataaagcagttaatttcttttacctatgtcaaaggattattttcattctattcttgcttttcttgctaacagaacaaaattctattacactttggcaacatcaatgctactttcatttgacataaaatctatacccattggagctttgtaagcactagacacaagtttctgtggacaatatcttaaaatatgtggaggaaacgatgactcacacacaaagaacttgctggattctttcaatagacattgatctcacagacagttttcaatgtggtattttaggtgattgaaatatttatgtgtcctgctccaaatcgtttttcaactgggaatataatactttttgataaactactgttccttttttttttttttccagtccatattttcttcaaagagccactgttgaaaatgaaggcttttcttcaataccagggtatagaaaagcacggctagctcaggataaaatgccttgaaaagacatattttctcaagctgtgcaaaattctaggacgcaatcaacagaaagacagaaatactttgcacttacatacaactctttaccaaaggctatcaaagcattt

SEQ ID NO: 33028 - DNA, 1754 bp, Bovine  19866881056938
aagaaaccaaaataaaggaataccaagagtggcaaaccttaaaagttttggaggattgaaacaaacagatggggactagcgggaatcaccaagggtaagccaaaagccacaggtgaccaggttacgcattcgaaggagagagtagaggtgaagctgtggtaaggtctcaagtgcctggatcagggaagcaagacatctgaacggaactgggggtgtcagagggctatgaccacatgccatcatccgagcagaccctccactgaagagcccacaggcgagggcagcagctgagcaaatgttaaggcataacaatctcaagaggttatctcctgagagataacatgttaataagatggtttctaatttatggtagtagaaagaacattgggcaggaattgagatctggatttaagatctagccatcaactagttgtaggactataaaaaagtgtcttacatttctttggcttctgggttatcatggacaaattggggggttggattggatgaattctatgatacctaaggtacttgaaattctagggatgaactgattggtcaccaaagccatcacccagttgcactgtgtaggtaggctgagatgacagtccagcattcatcttcccgtagtctacacactgtcctcacgcagctagccagacggttacagtcccaccgtttttcatttgtacttctgtgaagatagaagccagactacttgatgtttcatactgtgtacttgtgaaaaagaaagaaggaccaagctttcccaggatttgatgatcctgtttcaaatacagtggtgtgtgtctttgggaaatcttaaaaacaaaacaaactgcaaaagaaagcacataaactcactgttgcagttcagactatagttgctgatactttgtgtttgagttagggcgacttttaggatctttaagatattttagacttttctaatcagagcttatattttgaattctaaagtactagaaaatgataagcccattgtcaaaatgttcatcatttccttaactatcactgtaggattacaaacaacatttttagttttaaatctcttaaatttatttgtaatcttatttaaaatgggcattattgctgtttgaactttatacctttatggaagaatttagtaagtagataattctcaagaggctggtttatagttgttagactataagcatttttgaaaacatactcttgagaatggacatggaagaatgtggacatttaaaatcttcaaacaactttaagtctgctttaaataaaatttgacctgctttttcatctaatttatataaagaattaaaaaatattaaaagtgatgcatagttgtattgatttttgaagcaggcagatatcatagacattgtctggaacaagtggttcttgaccttttcactgctaaaggctcttttaattaatttttctccagtgattcaacattttgaaatattttgtctatttttcctcaccaagagcactccttaaatgataattaggtttttcattttaaattaatctgaacacataactactgatctctttagcatgagttcagcaatgacaccatcctgagataatgaaattctaccatgtaaaaaaattctagtatttagtgcagacttactgtgaaaaaatacattaattctattatagttttgaaattttgaaaatagtttcagaactctggggaactacttcttttccctacctctcccagtttacagatatgtaactca

SEQ ID NO: 33029 - DNA, 1835 bp, Bovine  19866881098108
ataagtttgttctctaagtctgtgagtctctttctgttttgaaagtaagttcatttgtatcatttctttttagattcctcatataagggatgccatatgatatctctccttctcaggcagaggttatttcacaagaggtggatacagtggtggctctcaaacaattttcaagggatgtatttgcagaagccacattctaaagaccactgtttagtagtatgggcagccaagatgatggcagagagggacagcaacagcagcagttgcctgccctctgcctcagaagcacaatgacataaatttaaaaccacctgtcctctggtgcttctctaacttcactctgccaatccccgtgctcattttgtaagcactgaattcaccgtgctaagtccttctctggttgggatgcccggggggtgtttcatgcagcccacctgcatgctggctgatacaactagtgcgttgtccttatcacatgctagaagctgaagcagactcagtactcccacctgtgtattgccatctgaagaaaggaagggaaggagagggaaagcagtttcctctaaagggcacaacctctaagtagcacacatcacttcctctaagaaacacgaaacagtccaatggctcatcaagctacaaggcagaccagaagggtaaatgccagcaggacaaacactggatcagctaaaacctagaaaagttaatcggtgaaaagaaaaagaggagaactggatactggggccaattagcagtttccaccacagatgtccccaatataccacctactttcagcaataaagtcattgtcattttaattaaggaaacacactgaaaaaaattaacagagtgaaaaaaaagaaaagaccatgccaagttgccaagtgtcaccatttcagtagtagccaccaaggcaagaaacaggaaaaggttattttgtcataaatgtaattctaccaataaaagttgttattgaattcctttcttctactcccggtccaccgagatctaccacagccttcttcacacacactcacacacatgcattcagtaaagcagtgcatttcagctttcttcattatgttagaccagcttcctttatgtccccagagcactaactcaccaaggtctttgtaatttgagtcacaaatgtggtaccacacacattcagatattttattttcttaagagagttttattatgacccttagtcatgacctttagtagttcctttttgtggcctctcttttcaaattattctgttcaagaaagtcagtccccaattaggaaacatttctttttgcttcagagaaggtggtggcattttcaaagctcttgacttggtgccgtaaagagtttggacagagagcagcacttgaatcctgtaattatacggcatttggagcacagattatgacaggtgtgctagcagcatccagtaatgagagagttggcaaaacagctgacttgtcacataattcgttggtcaaaaaataatcgttaaaagtaataacaacaggtctttaggcaaactagaatttcagttctggctcaaaataattttcccagtcagaatttcaaacatgttttctatgcgagttgcagtgttttatccaatcttttggctttcagttcacccagaacatatatcgtataattctgtcctgtgtcttaccacagaaagaatgatattgtagaactgtaaagatcactttgctcagcctcgctttcaagaaagggttttacctctagtgactgttgtcccacatttctcaccaagaccaccccccacccctagaatggtgcctcggctgccagtaaaacggaatcacaaa

SEQ ID NO: 33030 - DNA, 917 bp, Bovine  19866881166896
actgaattattgtcttacatgtagatgtacctgttacatcacatgaaagaactataatgattgtctgtcattccattaatatgttgatggtcatgaaaattcacttctttaacaagcacttagtttttgttttttcatgttattgaagtagattaaactggtagaaagattttccttttgtgctttatttgttcttttacatttcttctgtttacaagttttacataacagtgattttctattttaagtttcatttgaaaatttgatgtttaaccaaaataatatgtagcagattaggaggtgttaaatgtcagcagagatgaagcagtagttgatgttttagattataacattggttaacttctaggttgcccattttcctaagaataatgttgcctggttccagtgctttcctaattcctatctttaggtaaaggaaaatcgtcatttggaatatagtatactattcataatgatgtagcaagacagtctgtatttccagtttaaggaaacagaagtatggaaaatccagttgttcgtaattgatttaagcatgtatccaatttattttatagcactttatgctaatctgtatctcctgactaagtttacctttggcagtatcactttcttcatttttcttagcataacaatcacacaagaggctggctagtgataggggcagtatgaattggatttatgctaaggtgtgagggaatgtctagaaatttgccatgtaaaatctatgtaaattattcagttgttaataatctgtactacataacaaattgcttgagagattgtagactgtattttttgatacatataaaggtgacgtgctgtttaatttttttctactaaacagaagagattttggtaaataatggggctttatttaggttaacagtccctaagga

SEQ ID NO: 33031 - DNA, 649 bp, Bovine  19866881187878
gtttaaggattaggatatgttcagatcttttaggggatatcattcagcccattacacttattaaatgtaaaatgcatccttcccatagcagccaccctttatatcctccccagtgatgctggtcattcctagaaactctgctccactctctcaaatcccaatcctggaaaaattcctaacacagaactcatgtagttcttttttgactttctagccaaactttttctcttaaagagatacatattttatctttttgtcttcttgtttcattttctcttcacttcaaccctcacccagattttgcctgacaaaataaactcaggagctgaccccaaatgtaagaagttttgcctctgagaagctggggagacctgaggggtttttgagttgtgaccgtttaagaaatttttgctctgtaacagcttaaccatgacttttgggcccccacacacaattaaataaaatgatttctgtcaggactcagatcctccttgaccaaccgaagtttattcgcgtctcctctttactatctccactttgaaaaaatacaggaaagtcaggcatgactcaacaaaagtgaaatctggaggcaatgttggggcatccctttctctagcatgctctagcactagcatgaagtgctagcatg

SEQ ID NO: 33032 - DNA, 1369 bp, Bovine  19866881189491
aattcaattctttgttgctctacttgaaagtactcttagaagtactctacatttttatgcagatatggatacaactaagttgaaaggaaggtgatcttgttttcataacccactcagaaccatttagcagtccaaaaaactctaccatttcccaagggtatggacataaaaatatttctttaagtatagactgagctccttgagaacggtgattatgagctccttgaggacggtgacaaataggagatactcaataaaagtgggctgaccaaatgaataaatgttacagttagggtgctcattcactcccatagctaagaacaggctttcaaggaagccacttaataaaatgggtagaacggtttaaagaagaattcccttttccccagacagacagatatcataaaaattgggttgatctacctcattactcttgctctgagatagtgtcaggctatcattggtcagttcctcatcatcagcactgtttctgctaagaactttactcttcttcttcttgcagcccccttcactggcaggactgctatgctcttcatcgttgccttcatcgttctcgtcctcatcactcccgcttccctcatcttcatcatcctcattgtccccatcacttccttccttctgagatgcagatcgtccctttctttttactacagtgggtcgccaatcattgtcatcttcactgtcatagtcatccatgtcattcagctcttccatggatacgaaatccaaaagtggtcggttccgacgaaggttccacttttttggctcgctgacctgctcctctgcagctgtggccgcggggcctgaaggacacgtgtgagcagcaggagggcttgtggctggcgtggtggaggcagcagcagccacattatcagatactgttgctttctctttctccttctctctctccttctctttctctttctctctctccttctctttttcctttttcttcctaggtctttctccattctcttcttcctctttcttttccaccttaattaactgtttttctgatgacagtacttcttcctctgcagaatttttaagttgttcttcttttactttaacgtcttcattcagttcttcctctaaaatattttcttcagaatcactacaggaaccttctccactgtcctttgaaggatcttcacttccattaccactcccttcagaatctgttgaaaatatgagaaaaaaaaaccacacatatgtatatacatacacacacacacacacaacgctgacacaaatgaaaccaccaaaatttgtgaataactcgcaaaacaatataaacaaatttaagtcaaagaaggtagacattcccaaccgattaaataataaatca

SEQ ID NO: 33033 - DNA, 1156 bp, Bovine  19866881279338
atgtttgacagaaaccacaaaattctgtaaagcaattttcttcaatttaaaaataaataatctttttaaaaagtaaaaataaaaaaactttttgagctgcaatcagttactatttccatatgattatcaatcttgtaatcgatgcttttgaactgtggtgtgggagaagactcttgagagtcccttggactgcaaggagatcaaacgagacaatcaaggaaatcaatcctgaatattcattagaaggactgatgttgggactgaagttccaatactttggccacctgattcaaagagctgactcattagaaaagaccctgatgctgggaaagattgaaggcaggaggagaaggggatgacagaggataagatggttggatgacatcactgatttaatggacatgagcaagctccaagagatggtgaaggacagggaggcctggtgtgctgcagtctatggggtcacaaagagtcagacacaactgagagactgaacagcaacaacaatcaatctcattggctacagaatcattatcaagggttcagggcatcagtataagttattaaaatctctaaactgtttacatttatggaatttctctacctatcttctctctttatttaaattcttgcagaagtctaaagactcatgaagcttttggacaaaaatcacaaattgtttattatgggaggggtgattaaaatatgtcctgtggaatgtttatctccccttctagataatgatgttaagtaaaacctagttctttgcaattggcactgtgatattatctaactggaagtttctggcttaaacattccaagactacaactatgaaagtaaaaacctgtgtcatgtgttaaacagtaggccatattcttgttgctcagaatatagcgtacaagtcagtgggtcctggtagtttatttacttcttccagtttggatgcattttatttatttttgttgtctggcttccaatactatattaaatagaagtggctacttcaattttttttttaaaaattagttgggtcattaggacagaagctagtttcctgacttctgtttctgcttctcccaatctacccatataaatccattcttcagtcattatcagtgtcttctcctccatgaagctttccctgaattctccagt

SEQ ID NO: 33034 - DNA, 782 bp, Bovine  19866881287091
acacacttgtagtacaataaaaagaaggactcagaaagtaattgatcagtttgcaagctataatgttagagaatgtagcatctagaaagtcagagaaaaaaggaggggagatttgcttccatgcagatgatatagcatggaaaaggcagaaggaaggaaagttcacaaagtgcataacgtgcagaaggaattgaaatgaattcagtgtggtgggagcttaggtttcctaaggaggagttattggaaatgaagcggaaaagattaacagatttttgagaagttgagatttggaactttatcttttagacggtaaagatttgtaagttttatatataaatgggataaaacaatggcaggatactattaatatattaataaagctgtttttcattaaaaccattccactctgagacatgtgtcctctagatttcctgttcctttgttctgtttaattttgtgaacaattttaaaataccaaaatattattcaaattaaatgcaagttgttcagtgaataattataggcagtatatcaatagcataccccaaaagtatttcttttgcatggtttctctgaagattcaagcccagaaaattctggaaagtatagtaattatgtgttgttattaaatgtgtgacagtaaagaaatagcttctttagagaagaataatttgataagtgaaccatggagtacgactatattaatgcaaattgaaagaagaatcttatattttttactctggttgcatttagcatttaattatttttctagcagataaatt

SEQ ID NO: 33035 - DNA, 782 bp, Bovine  19866881344510
tgggcctggggaataattatgccaccatttggtgaattttcatctcagatgacatcaatctgagaattcaacctcaaggggcttttaataaagggtagtcatctccagttgctatgacagttagctgtagaaattttattaaaacagattagagtccaatgtaaactggttggaatatcagaaatttctggatttagcattgactgaggagttataaagcaatgtcatgtgaatatcagttatacaaacatgccatatttactttattactattgaggtttagaagacacactaaataaatatatttttccttgacccatgtaagacctattgtgtgataagcacaggaataagcagctagataccaaactatttttatttaaaaaaaaaaatttacagtataaacaagcacaaaattaaagggaataacactataaacctatgtactaggtcatccaacttcaacattcatcaattcttggcctcattggtttcattcatatacttctatatattttcctaccctcaactggattattttgaagcaaatcacagacttaaatatcacttcacccataaatatttaagtatatatcaataaaataaaagaagtatttataacaaaccataaagtcatcagggatttctctggtggctcagacagtaaagaatctgcctgtaatacaggagacctggattcaatccctgggtcaggaagatcgcctggagaagggaatggcaaaccattccaatattcttgcctagagaattccaggacagag

SEQ ID NO: 33036 - DNA, 1122 bp, Bovine  19866881376931
atagagtgaaacttaacgctttgaaattgtaacaaatagaaatgaaacttcactattcatcttctgtggatatcttctaatctagatacaacatctgacaccatcctattctgataacttctctttgatggttttccttctttcccaaacagtttgttacaatttgggatagctcataatatggatttagagatgcatcttcaccttcttcccagagagtattgttatcttttagcaactctttttgttggatacagcagaaggcaacttgccctatttttattttgaggtgaatccatttacaacagcctactagctatttgtagctgaaaagaataaaatcgaaggaacacacttataaaagaatttttccgtccccaagaaaaagaatcttacacctttactgtgtataacgccttctgggattgtgatacaacatcatttatatagacataggtgggtattctgtttctcttaagtctgtgtttatatagtatagacatgtacttctttcttctgtgaaggtagagaagggttgatacaatgcattggaataattctgatagttcaattggaatatttttgatagtttcggaatattaggagctgtagaaagaacttcggagaaggcaatggcaccccactccagtactcttgcctggaaaatcccatggacagaggagcctggtaggctgcagtccatggggtcgctaagactcggacacgactgagcgacttcactttcacttttcactttcatgcattggagaaggaaatggcaacccactccagtgttcttgcctggagaatcccagggtcggcagagcctggtgggctgccatctgtagggttgcacagagttggacacgactgaagcgacttagtggtagtaatagaaagaacttgaactatgtatgttagttgttctaaaaatcaccaggtagaaaacagggctaatcaaggggatcctcagagaatggttgatgcctgagatttgattcccaatctgcctcaagatttagttctaattaaactaacatgaacaataggacattatgaagtgaatagtatttgatcagggattaatggacaaagtacatgaaaagaaggggagaagtgaag

SEQ ID NO: 33037 - DNA, 1381 bp, Bovine  19866881423276
aactattaccgtgctactttgttatattcaggaggatttattccagttgctgtggttgttatttttaatacaaatagataatatccgacgtttgctttagaaaacaaatgattctaaatgctgttactatttaccaaactatgacccagaagcaaaagcaaaactaggttgaatttgcttcttattgactaacttacaaaatgttagcctttctttctgagctccttgaaagcaaaatgggtaccacacaaataggtgtaaagattgtcctgactgaaggcttgtaattaggctgtgaataaaaactaagtgagcacctttcctgggaaaatatgataagggtggcactgaaaatctggcatccttacagtaccattatcaggctctgaaaaatcttggctgaattgaagctgaaaaataatttaccacatcaccagttgaaacaggatgttcagctcatccaaagtctacttactctccatttgactctctccaagaggcttggaaatcactcacagtgagataactagtgatccaaagataggctgacaagcacaatgtagggaaggtagatgcctgtgccgattaagctccaggctatcatggttgagctgcacaaacctgaagagactaagaagataggaatgagctatatggaccaaaacttagtttatagtttagaagagagagagttcaaggtatgaaaaatcctaattaaagatattctctccatatatctcacatgctcacatctctttgacagttttgagatggaaatatcttttctcctaaaattcaatatgttaaaaaacatctgtagcacatttcccttggctgttgattattagaaatatctgttcatgattttttatgaatttcaaaacgttttatatctgtgttggacgatggacttaatactaacagaagtgaaagaatgttggagattaagtgttgaaacaagaagaaatagaattgaaacatttggtctttccttgaaaggctttctgaagaggttgatcaatggaaagatattcaaaatatggaaatcaatccagctgtcaggaaagtttcacccttgtcctttagaaaaggttaataagaatttattattaataggcctgaacttagagttccaaatgaaatgtgagtaatagtggcgagccaggtatatcatttgagaagtaaagtaatggcatgaggttatttccagggcagtaaatgactattacttcatcccaatgcaacacagaagtggaaaacacttccctcatgatgtataagacagtttctcaaacacagccctgaaacacccagcctctttgcattaccagtgagcatctagactcctaaagagcaatttaaccagcatcgaagacactcc

SEQ ID NO: 33038 - DNA, 1333 bp, Bovine  19866881470141
atactgcgtatgtgctgtacaataggattttgtttcttgttcagtttgcatctactaatccagaccctcagtccattcctcccccgtttttccttccccttggcgacctcgtctgttctctgtatctgagtctactccccatcagaatatcactcagttcattttccccagatttggaggtattcagagacaacttacagtttggcttttgagggataagactaagtccttcactataaaatacctgccactctgctccagatcctcatcttttttccccctctaggctgctgttttttgaggttcatggcattagattgcctagttgctgctcctgaatttttcctgggttttgctatttttatttcactgaattgaatgttgggaaaggaaattctgtgcatcagttttattacaccatcttagctcagaagtccccaatgatttttattaaccgcaaaaatatttctattcattgtgcagatatggaaatttgtaaatagaagattaggtgggatgtattaccatgtgaacaagtacttaattacattagagatgcaaatgttttttgagattatacttttgtaaacaagctgatcttgttataatggaggatttgtggtaactgcaatgtaaaggagcctcagaggaaaaattagcaaaactgagtatgcgaactatttattgcccgtgtgagtagtatgcataaaatccaatgaataccaaagaccgtgtgcaaaatcacaacacagtgcattctattacacagtctcattctcttcttttaaatatctagattgcttttcatttcttgtaagtgaactgaagaaatgtgtctcagactgacacacttctgaatgttttaaatctctaacgatcacaaacacacttggcagagaactaatttcacacctcaggcattaaaatccagagtctgtattcattgtttattttacataatgtaaaacagcatgaagcatgatatattacacaatgggtgaatgggaattttagaaagtagggcatcattttacatttacacctggtagatgacattttatatattagaaaatgtcctgatatatcaaacaaaatgttttttttttcaatcaactgaattttgtgttactgtatacattaaagaataaaagatttctattatttggttatattttcttagaatataatggtaattttatgagttactgtgacgtcagtgttaatacccaatagaccaggctttgttttgtagttttattgatagatttgcttatttttcagctgcgcagggtcttgttgatgtgtgggcttttctccagctgcaggagaggag

SEQ ID NO: 33039 - DNA, 928 bp, Bovine  19866881604076
atctgtctccttgaaaattcctcctgattgggacacagttcacagctaggggaaacaccacatttacaggcatcacaaaaccaaggttcagtggagttttcagaagctgaactcataatagagtcactctctccatcaactccataacaacctaaaaaaaaaaaaagacgtatgattagagtttactttttaaactcacatttataaagttacaaaagaaaaaggtaaaggaagcagagaataattctgaaaattaacggtttagaagaatgatattaaagtcaaaacacagaactgaaatcattttataaaaatgttttcaccatttcatagtgtatgcaatgacataactctttacaacaagtttaggtctactggaaagcattacagaaggggaaaattttacagttctttagaatttttttacaaaaaacacattaaaatatgagttttcactatacagaaatcagaactattgagtctaggaactattaattagtaaatattttcaagctaccctttgtactgagcatttaaatatatctaaaagaccatgatcatgtaaaacatacaaacaaaaacctatgatttaattttgtatgaatttggttaaaacacaaattcatacaaccataaatgcaaagtaagtactagtaaaaggaaaataataggcatacacatacataaattaaggctactgagcaatctgaatagtttagagataaacaagcgagttccattcacaattgagccagtctagagctatacaaggtagctgatctatttaacatttataattctactatcttctggaaaaatgtatccagaactgaaataatgaaaagaagggtagcataatccttcacattttagagtaggacatcaatccttattgggcttataataaacagtacttcccggttaatta

SEQ ID NO: 33040 - DNA, 880 bp, Bovine  19866880187012
aaacgagctatggattatttaaatgttgtcaatgaactcaactacatgactcagattgttatcatgctctatgaggaccctaacaaggtaacagagttcttgatttgcatgtgttgttcagtcgccaagtcgtctccgacgttttgaaacgccatgaactgcagaacaccagggcttcccctgtccttcactatctccctgagtttgctcaaacttgtgtccattgagtcggtgacgccatccaaccatctcatcttctgtcgtccccttctcctcctgccctcgatctttcccagcatcagggtcttttccactgagtcagtgcttcacatcaggtggccaaagtattggagcttcagcagcagtccttcctgtgattgttcagagttgatttcctttatgattaactggtttgatctcctttctgtccaagggactctcaagagtcctttccagcacaacagttcaaaagtgtccattattccatgctcagccttatttatggtccagctctcacatccatacatgactactggaaaaaccatagctttgagtatatagactttgtcggcaatgtggtatctctgctttttaatacaccatctaggtttgtcatagctattcttccaaggagcaagcatctttttaatttcacggctgcagtcactgtatgtgttgattttggagcacaagaaaatgaaatgacactgtttctactttttccccatccatttgccatgaagtgagagaaccgaatgtcatgatctttgttttttgaatgttgagttttaagacagcttttttactctcctcttctaccttcatcgagaggttctttagttcctcttcagtttcttccatctgcatgtctgaggttgtt

SEQ ID NO: 33041 - DNA, 5135 bp, Bovine  19866880428166
aaactaccccacgggcactcctgtgagtgaccctggcttgcagacggcagactgtgagacctctcagcctccataaacgtcagtcagttccttacttcacacacacacacacacacacacaccacacttattagttctattctgtggagaaccctagtacaagagtcaataataaacaaaattgtttgatttctcacaaatacgttaagttttcttgaccaaaagatgttcattctcatcagaatcgcttcttttcatctgattttccacatcacttccccattttagaccacactgttgtaatcttcccatcccttttgtttcaggctgcatttctacagtgcgcctcagtgctcttaaggctcttctggaaattccagtttattcatgctgctgctgctgctgctaagtcgcttcagttgtgtctgactctgtgtgaccccatagacggcagcccaccaggctcccccgtctctgggattctctaggcaagaacactggagtgggatgccatttccttctccactgcatgcaagtgaaaagtgaaaagtgaaagtgaagttgctcagtcatgtccgactcttagcgaccccatggactgcagcctaccaggctcctccatccatgggatttcccaggcaagagtaccggagtgggttgccattgccttctccgagtttattcatcagatcagatcagtcacttagtcgtgtccgactctttgtgaccccatgaatcgcagcacgccaggcctccctgtccatcaccaactcccagagttcactcagactcatgtccattgtgtcagtgatgccatccagccatctcatcctctgtcgtccccttctcctcctgcccccaatccctcccagcatcagagtcttttccaatgagtcaactctttgcatgagtactggaactccagtactccaaagtactggagtttcagctttagcatcattccttccaaagaaatcccagggctgatctccttcagaatggactggttggatctccttgcagtccaagggactctcaagagccttctccaataccacagttcaaaagcatcaattctttggtgctcagccttcttcacacccatccttaaaggaatgtcctctagagaagggtcaaggaacagaaagtttgacttaatcactttaaaaatgggtcgtatgtctaaaactcttaagagttcctgcacattttaaattaagagattttgagatgattaaagatagaatatagattccataaaaactttatatatttgatttattcatccatttgttgagtgtcagatcctagctaggtacttggagaaaacggagaagattaaatggttacacatgtaatccaagttcttacagtttaatgacatagacaaatataaacattatgatatatgatgtcattgttgttcagttccttttggcccaattctttgcgacttcatgggttgtagccagattctggtcctccactatctcccagagtttgcgtcagattcatgacacaagatacagtgggtctaataagcaagctatagaggagagctgttttctggttagtaggacttgggaaagcttaatggaagtgacttttgagtaaaggttgaattaagaatcgtaggacagtgggaaagaattacaggccgatgctgtggcaaagcacagatggtagggagggggggtgggtattgtggtctgatttaaccaaagcatagggtattgtgagaatttactgacagagtgcctgctatgtgcgtgtattgctgctaatgtgcaaacactattagacaggcatcaccattcccttaacagatggaaagatcttcatctcagagaagttacgtaactgtccatggttacgtagctgaaggtggtgatgttgggagtcacatgcaggtctagatgactcaagagcctgtgttctttctgctctactgctactgtccttaagtgtgtgtgtaggggagaaaaagtggaactgtatttcattcatgaggtaatagaggggcggcataggcgaggaaaagaaaatgctctggttgaagaggccttcttgatagcatatttttctggtaaggcatgctcatatatagatgatattataaaaatggtggtgatgacaacatgtaggtgtcatttgctgaatgccaaaaataggccccaaattatatcatcagtgatgctcagaactataggtatcacggtcgtgtgatttgttacctgacgtagtggaaagagcggaggtacagagcccaaaagaactcggttccagttctgcttttattcttttctagttattgaattccaggcagattatttattatttatgaaccttgatatcctcatctgtaaagtaagtatatatgcatatatcatggagttgtgaatgttagaaaaaatttttttaaattctagagcattttataacagaagcagaagagttagataacaaaagtaaaaattctgctgtagaagcaagagtatctctgagcatgtctaaatgaaaaacataatagtatgacaaaaatatggatagtcatagcaccaaaatttaatctaccttaataaaggctgctcttttaattacaaaaagaattatttactggagtaggcaactaaggatatgactatgaatttaagtatattccgaaaactgagaggatttacattcatgcatatgacagcaaaatacacctaaacattattgttgtagaacctcatgagaaatacaactcattcttactaggttgaaatatgcttttacatccattgtattcatgcttctctgtctagattttttaatgacagtttttaattcttttcaagaagaaattcagtacatcagaaataggtcatgctgtgcatgggtttcttttcctagcttgatgtgtgctcacatagtagactgagaattgaatcttctcagaatgaaaaatggatgcttctgacattcatatcaagcatcagaaaattataaacatttattgaatgtattgctgcaattgttttgaatgtaatagtcttgcaaaaaatgcctgtctagaaggctttgtttttgttaatggactcttctaattgagactcttgtctggaaacctcccaaaaggaaatcctataattggagaaagcagggagagcatatacagcattccagataatttaaccttcttgaaaccttagtgcctggtgttttaattgatatcttaccccatgtcagaacactggtccttgattaatgtatctaaagaaatatttggaacaacttttaagcatatacaattagtagagtctttaggatgtatttatgttccttttgtaaagtgtaactattactggaaaatattgtgaaggaccccattgaactatcaatagtcgtacaatagtctatcaatagtctagatttgtaagcagaaaaaataatccccaactgggaaaatattttctccaatgggttcttttcagggtactgaggcagagtgctgaaaaataagtcatcctgcaaaatattttgtcaatatttgcctagagtaagctgtgtacaaggtatagttttaaaagtggagtaaatgcttgcaatgaactgattagtctatccacgccttgcaatctaaattggagtaatatacttcaacatagaaatatgaaaacactataataccaggtattcccaagtcttaacaaaatctatgcatcataacttaagaatttacattactttagacatttgtcctgtgcaagtggccataaatttaaatgcataaaatgtgcaaaatggctgctatgacattataagaataatgctttcatgaaatcctaataatagcagagtgctcaaaagtattagactagactcagaagttggaataatatgcagccattaaaaatggagtttttgaagaatagttaaagatattagaaaattcttggaatttgatgtaagaattataattacaattatgtttataatatctatccagatataaaaatatcaacatatcaagcattaaaattattggaaggaaatacatcaaatataactgatttttgggggcattgggattttgagtgatttgttttcttccttgttaattgattcatgtcacaggcctttgttaaaacctaatgtgtggtaggcactatactagagagctgttcattcaacagtgagcaaacataaaatagcctctgtcatcattatgcttctaacgtagtggagaagacatattaatttttaaaaaacatgaataagtataaaactacaactgggataagtgctaagaaggaaggagactgagagcccccatgacagggagccctagcataatgtggggtttaattcatggaagaattgacaagtgcatgaaagcctgatgcgtgggtaggagattttagcaggtgcgtggggaggaggacccgggagcatccttcacagagaaacagcacttcagaagccctgtcgtaggatggagcagttgaagacgggggatgagtgtggtgttatgggaagaggggttagggaacatagtatagtatttgtgttttaaaattttcatcctcttctgcagtgcagaaaagagattagaaggaggagaagcacagtcagagaacctagccagggcattatggcagtagaataggtcagtggtgatggtactttggattaaggagatgaaggtggagacatagcatcaaagggatggaatcaaaacatatttagggggtaaccatgaaacggacttgatgatggcttatacatggagatgaaggagcagggaagactgaagaggactcctaggtttccagtctgagcaactatttggaaggtggtgccagtcatttcagcgagtgaccccgaggtcctgaggaattctgtaggtggtcggtggagctcatttcaagttgctgctatgaatccatggtgacgttcctcggccctgacggcggactttttccaaaagccgggctcggtcactcacggaagggagagagaaaacccccagaggtgggatttggctccaccagtgagaagcaagtgaatttagaacatgggcgggaatttttcagtgatgatggaccgagaaactgatgctgaatgcatatattaaaaaagagagagagaga

SEQ ID NO: 33042 - DNA, 1409 bp, Bovine  19866880454812
cagaatgggtcccatggcaggaagagatttattaaagatagcataaaaggttcaacaacacactgtataaagaaagcaatatagtaatattttatgtctagaatcattttgacatttccatcctgtcttagtcaactcaggttgctctaacaaaacaccataaactgggcagcttaaataatagacatttatttcttaaagttttggaggctgataaatcaaaaatcaagttgctgacaaatttgattcgtggtgagaactctcttgctaacttgtagaaggttgccttttcacttagttctcacaaggcaaagagaaagagctctggtctctttaggacactaatgccactgtgaggatcacaccctcatgacctcatctaaatataattacttcccaaaggccccacctccaaatacaatcacattaagggctaaggcatcaacacataagttctgaggggagataaacagttagtctgtaacattcttctagccctaagccagaactgcattattttataacataaatttaactccatacaacttaagtgtgcatgtaacacttatatatttgtaagaatatacatggaaaacaatatttggatttaaaagcaattcgttattttagataatttaaatactcaggactttgaaataaaacttcttttgtcaaaggaatgtcaatgtcaacagatgtttacaacatttgtaagttcaccctgccccttcctccaccaaaaaaagtaagctcctgagcagggctatgcatccacaacacattttattctccagttctcatcagtgtagtctgaaaactttcagcaagaatatacagaagtctaaatttttaatgtatcacattaggggagaataaagtaaccaagatccagataattttggactttatagtctacagtcaacaccttaaatttcatctggaaccagaccagattacagaacactgacgcaatatccaatggaaacattatcacagcttgattatggaataatatgctgcatttctcatgttgctttcattaaaataccatcatatccacaaaacttttgaacagaacatctctggggagaacagtccaaaattatcatcttattaaaatataacttctacttttgttgctttttcttgttttctttcaagttttaaactatgtcgaatggccaggggaatacagattatgcctgatatagaacaggcctggcccttgctgttacacacagggccaggagtgtattttctacacttcttcaaaacagaaactcttcatccagtacctggtccaccctaataccagggcatcagcttcccagttagggtggagacaaacatttcacattttaggcctacccacctcattcactgtaagtctgctttttttttaatcttct

SEQ ID NO: 33043 - DNA, 1725 bp, Bovine  19866880468390
ataatataaatcatgcctaatagtttataaaacatgttttcttcttcctcaattcatatgggttattatgtatttcatactcttttctattattcggaaggaaatgtttaggtacaccattgcaaaacttttataaaccaagatggttccagcaaaagaacatttcctttttggtactggttctgacaatttttagcaagcctctgctaataaaaagcaagctctgaaatggactatttgctgtacagaaacacgtcagtgttgacttttccagcaatgtcacggagcacttatttcctctccatagcaacagtaatgacatcagcaagggaagggaaaaaaaaaagaaaaatcttttccaaacagggatgtggtttctctaagctctgaaaatggagagcccctgagagaccacaggaatggtcatgggaagctctgtttatgctttgaaaataatttggcttttcaccctccgaatctgatacctgtcagggtaaatgcgtctcccatgaaatataagcaaacggtgacgtgcaatcccaaacagacacctgtttcctgcacgtatcttcatgtgtcaaaacaccattgctaagaattatattttagcagcttaggagttggtcagaaaattatgtgctataaaaggaagggctggagccaaagtaataaggtggagcctctcactatagtatctgccctcccccattcaaaatgaggaaaagggtatatagactaagacagagaaatgaggggaaaggaatttaagatgtggccctggttcagaaaaccctgaaatcatggtgcagagcaggaaagtgaaatgaaaccttcccaaattagggaaaggaaaaaactgcatagatgtatataataataaatgaaacttgaaattaacccatggaaggatccttctatattttgtcctcttgggaatgtcatgcccatgttcatctctaaacacgtgtgattttgtgaaaccgcctcatccgttcaccaaatatagctcatttgaggcactgactctatgatacagtattgagctgattaaataagaatcatcacaaagaaaatttcattgaacagctgaaggaaaagaaaagccatactttctttccatcaataattgaacttgtagtcaaaggaactttgagctccaatccgagaaactataatatcttaaacatgttaggattcaaatgatccttagtatcagccaacacagtttgcctatattattcaatattcatcttttttctactcaaaagatctgactttaaaccaagttgctttctacgttcctaaggaagaattgtaacacatccaccttcttttccatagagaataacatatgcaattcgactctgtcaacctcctcctcctccacggtggaggaggaccgtgttctgactgctcctctggccccaccaaatggccctttcaacagtccttatcgccactgttgattccctgaatgatgacggctggtatcaccctagatccccaaactacagggctacttttctctcctcttcatgcataataaggtgcgtacatgacaattacttcttttacaccagctagctttaattctgacagcgtgtggttagcctgaaaatagtaggtcctcagtaagtatctgttgaatgaagaataagtcatttgtcttaacagatgcctataatttattacagggtggcataacctgttaccccatacattata

SEQ ID NO: 33044 - DNA, 1908 bp, Bovine  19866880533843
tggtctggtattcccatctctttagaattttcccagtttattgtgatccacacagtcaaaggctttggcatagtcaagaaagcagaaatagatgtttttctggaactctcttgctttttccgtgatccggcggatgttggcaatttgatatctggttccgctgccttttctaaaaccagcttgaacatcaggaagttcacggttcacatattgctgaagcctggcttggagaattttgagcattactttactagcatgtgagatgagtacagttgtgcggtagtttgagcattctttggcattgcctttctttgggattggaatgaaaactgaccttttccagtcctgtggccactgctgagttttccaaatttgctggcattttgcgtgcagcactttcacagcatcacctttcaggatttgaaatagctcaactggaattccatcacctccactagctttgtttgtagtgatgctttctaaggcccacttgacttcacattccaggattaaattaaagaattaactttaattaattaaattaaattaaattccaggattaaagaatgaactatgatgactacaacagcatgtgtgcatctaaaatgcatttcattaatgaaagaactcagacacagaagacatatgtacaatttcttttatatgatatttttgtaaatacaaacctatagagacagaaaataaatcagtggttgccagggactggggttgggtaaattttcagttacagaggagatacaggaatttaagggatgagagtgctagaactatttccatatcttgactgtggtgacatttacaagatttatgcatttcttaaaatccaaaggactttacactaaaatggttaaattttttctatgtacattatatctaagaaatttttggaaaaagaaaagataaagatggcttaggaaataaaggaaagataaacattgaataggtaaaatactgaatatgttgtcctaaaaagccaacccaagatatagatcacacaagtccctaaaataaaaaaaacaaaccaagagactggaacaaatctaaaaactaatattcaagaaaacttccttgaattacagatttgaaactgcatttaaaacagcacatatgtacttgacaatttaaactaagaactactatctaaagcacactctagtaaaattaccaaactttaaaggaaaaaaccctttgtgcagtttttttttaaaggaaaacattcattttatatgaaaaataaaattagattatcatcaggctttgatggcaatgctttatgccagaagaaaatggaataatatatttgagaatctcagtgacataatatgtgaatcaaggatttcatatccagcaaaactgactttcaaatataaacagtgtaagacaaactattatcaacattaaagaattcaggaatgttctcatgagcacttccttaagaatctaccaggcaaagaatactgacaatcaaaatgagaaacagcaacataagcactgacagtgagcattaagtttataattacatttagaaccaaaaaaaatggattactaagttaaaaggaaaatatagtatgtaattgttatatactcagaccttgtaattcaactaccagaaaatgagcaaggaatgaggatggcatatgcaaaaatcacacataaatgtgacccataagcatattgatagtcattatattagtattgtcattctaagactactatatgtataatttcttaataaagaaaacaagaaattatagcataaatctaattctgcaaacccctatgttcttgaggaagggttaagtaaaatcctgccatacttaaactgatttgaaaatatcagtataaatccctaagatacattatcttggatatgtatacatttaacat

SEQ ID NO: 33045 - DNA, 1293 bp, Bovine  19866880553800
gaccagttactagggaagaaaggagaataatttgtggggaaagagaaatacaacaaaactttccagtttccgtggagcactggggcccactgccatgatgtggaagcattttgtgaatctgcaaagatcttcaagactaactgcagtttaccatgtttttcttaatgattttcaaaacaattttgaattgttttgaaatttcaaatgcttgaggcttagcttagcatgcatttctggacttttaaaattaggtctgtatatatcagtctaatgggttgatggaacttttatgacttgttttaagatttaggcaaaggaaaaagtactttatccttttatttggtagtcattttcttgatggagaatgaggtgaatacaagggaaatgtttactgctagggtattttgaatatttttgaacttctttgtaatactgggctttgaagacttagattccactgtaagagttagatcttgacattttctttatccagtgtaaaaataaacttcatgaaataaagaaaagttaagattttatgttgttttagaagaaatgtatgcatttttcacttaattttatctgctgataatttggttactaagaggtccataaattctccttttataaactggaaaattatattgccagtgagtcttctctgtggaagtcttgggcatttattctctagaagttcttggtgatctggtatattcatttgaatatatgaatatatatgaaatatattaaaattataggatgatttactgagggaaatatatgtggaacaacatccaaaggttttataatctctacctcttcagtgagaaatatggtttaacatcctgcacctggataattttgtttcctgtatcaatcagacatgtctcatcttgtttccactctcattgttttttgttttttttcaaagttttgagcttttaatgcaactgagaaacatttcatagaatttttaacttaatatgccttaacacatcaccactttcattgttttcctctgggatgcatctaaaccctccctgacttgtctcttcacctgtgttctcaaatgccacacccagctcactgctcatttcaggagaaggccagctgcgctttggtgaagacttggccctgagtctggtttttgcaaataacattgtgattatggtgaattactttgctaatagtctctacatgtctcagagagtttgtgatggggagaggagataagaataccctgaggtgcttttcaggataaagtaccatgtagaagtcaaagcatgatttctgaag

SEQ ID NO: 33046 - DNA, 1128 bp, Bovine  19866880566817
attacaagtgccaagctaaacagtgcgtgcaaagagattttaaagtcattctagcagaattaccctaatcaacaaaagccaactacagctcaatcaaagtcttgagaagaaaagcttgtgtgggagttaaataaattacagcggtaaggtcaggcttttataagatgctctagattctatcaccttgctctaattcttgcctatttcagcagtcacttttgtgtgtgtgtgtgactgctgaaataacaagtcatttaaaaaaatcccaggatggttacaaaagtactgttaacaacactgtgcatccacatatagcccatagcactgaggacattggaataaacttggaactctgcaattgaaaagttatttttaaatctaaaccaggcgataattttaaaaaagggtgggagggggtaagtgtaactgaagcaacttagatttgttttctgtttccatattgtttgccttgctcctttcctttctgacactaccagtgtcatatgggtttgaacaaatctagaccaattattggagaaggcaatggcaccccactccagtactcttgcctggaaaatcccatggacggaggagcctggtaggctgcagtccatgaggtcgctggaagtcagacacgactgagcgacttcactttcacttttcactctcatgcattggagaaggaaatggcaaccccctccagtgttcttgcctggagaatcccagggacgggggagtctgggtgggcttccgtctatggggtcgcacaagagtcggacaatgactgaaagcgacttagcagcagcagcagcagccttagaatatagtttaaaatcaggaattgtgaaacctccaactgtgtcctttctcagaattcctttggctatttaggaacttttatggttcataagaattttaggattgatttttttctatgcctattcaaatataattatcagttcagtcactcagtagtgtctgactttttgtgaccccatggaccacagcatgccaggcctccctgttcatcactaactcctggtgcgtatccaaactcatgtccattgagttggtgatgccgtccaaccatctcattctccatcgtccccttcttctcctgccttcaat

SEQ ID NO: 33047 - DNA, 3712 bp, Bovine  19866880629318
aatcatcatagtatttcattgaattcttgacaaaactgaagccattgacatcacacacaaaggagtgaccattggcacggaggagatcaaaaccacaaactgtttgctgcaaggggaagaagggaagatgagaacaagagggccacgcttccttctcagcttcaccccaccaacctctccctcatgccacagcccctcccctgcacccctcctgctcctgcacaacctcccctaccaaggggcctcccttcaccttaaaagctacgcagactttcctggccaccagcttttccatggcggtcagcatgactggatatcgaatctcttttccctcactgtctcgttcaaccttcccatccaaagctggagattttctggcttcagcatgggcatagtctggccccactgtgtacacctgcaggtacatagcatcactgagtatgcccacagctcaccctgtatatgagaaggcaatatgagcgtcatgtctgtaggctagtttcccaggaaacataaacaaaacaaacaaatcccctgagtattaagaacaagaagactgacttttttttttttttaactgagatggaacttcagtatcattatgaaagtttctccatgggactctaaaactattgcctagtccttactaagaaataacttaccaacgttattccatttttcacattacccttgccctcactctgatagtgacaatataaatacctacttccccaatccttgtcttcacctgcatatgaaagccaatcccattcacactttattttctataactgcttccctacacttctacttgcttcacaagcaccccaccccactcagacatttataacctcttaaatccccatatccaccataaccttgacatctgtgccatctgttggcataaactcctcatagatgtatgagcctgtctttcggacgctgctctctggagagtaaacactgcttcggctgccaatcttcaggagaaaaaggaaggggaaggaaaaaaaaaaggttgcctctaacttgtccccaagtcttccagcttcccttcccacaacttcattcttgctcatctacttttctgcctccccggatatctcccacaccttacggaagaggcgctggcttcctcctccagctgagctggggtagtagatgtaaacgttgtggtcctctgcactcacgggcttctccacaaagggcttggggaagacggctccatttacctccacctggtcttcaccctctatcaggttgcactctgaaaggtcggtgtgtggtcattcctagggcccaagaatgcttccaactcccaacttctctgagttttaatctccatcaccctcaaatttctatgaccatactttaataatagatatggtaactaacatctgtatacgaggtctcagattctgtccaaagacccatggctctagctctacccgtagtccagtaaccaaagcctcacagagacaggcggcacatagctgtctcaagaatggagaactgggctcagtcacagaaagcggggcagcgtaggactggacaaggccaggtactcaccctcaggccgggcagggtcacggttgagcacagcgtatcgaggcaggtcaataccctcctcctgcaggatccggtacacctccctcctgttacccccgaataaattagctgagagaggtgggggcaggtgacaaggggagaggctagggatttcattcactcaggaattgggagacacccgtgtatagaactcaagagggtttggtataacaattcggcatgtttgtttgactctgcccctcccagagtgggttctctaaaacaggcgtgatctcggggctgcccatccccccagtcaacagaaagctgtacctatcctggatgtaatactgcatagccaggtcattgataagaaaagggtttcgaagcttggagtaagcaacagctttgtccaggggaaagcctgggatggagagaggaaatagagaggtggaagaaagaaggagagaaccagtgagaaaacagcaagagaaacagagaaatgtgttaaagctattcgttgccactgagctccacaacccgtccaacccagcactcatcctcctgcccaacttcgcaagtctagaaaatccatcaggaaaaaagcaaaacagaaactacttgtagggtccttccagagaccgattttgtcagagatccgaagaaacttacagagctttcctgaggtttgaatatgggctttacactaaccccagcaacttctccaagatgtaggaaaagcaaatccctttgcactgttctctagtgtcgggaagagaggacgacttctttactatttgacagtaagagcctcatttcccagtccagcattcccaacaccactccttcccattttccttcacagacaccaacctttggagtggaaggagatgaggcagtggcaggatggccagttttccacaggttcattgaggatcacgtcttctcccaggatgataacagtcaggtagtcaaacctgcagagtcgctctaggatctgggtcattggcttggacttggatttcttggtcatggcacagatgccaacaatgatctgaggttcaggaggctaccaggaggaagtgccatcaggaacttaggaacttctcacctgaaccgcctttagcagggaacactgcctcatcatctccttagggcagagtttcttgtcaggactttggacttagggggtcaaggttgtctcctaactcaggcctagactggggttcctgcagggattcctcctgccacagtgcaatacgtatactcaggcagaagagtcagagaaccaataatcatgagacaacaggaggcggacacaagcagaggggcttcagggagcggcagtctaaccagtctccactgcccttccctttcatcaagagggcctgtttgtgacagggagtctaagcatttgggaagattgggaggaggtgtcttaatcctatggaatctccactatggcgggggtcccaacaccaagtgacatcatgccccctaatcttaccacttcatcctcctcatcctcaaggagctcgctgtcactctcttctggcctcatgccgagtccacgggtgcccagcccctcatctccagctccgaggaagaagtgggctgtggcactctcgccctcactggccggcagtgaccacatccccgccggagcacccactcatcccgccctgaaatggaggggatcccctttagctcagaatccaagtcccacagtagagggtgggggtgggggatggggaatgagaaaataagagggaactacaaggggaaacaggaaacaaagctacagtgacaaggatcaacagggaaggaggcacatgggctgtgactggcaatgactaaagatccccaagagaaaatcaaggtttccctttttttccctgctcaccccacccccaaccaggagcctgggatgagaattactggattaacccttaccgtgctggcatgtccctgattctgccagcaagaaaaatcattaactccagcagcaaatgcgaaaggcagttcttcatggagggccactgttgattcctaccataagaaaagaaggttagaatgacatttcaagttcagattcactcgaaatcttcccagccctcctctacctcccaacggcaaaaagcagagacatcgcttgcccacaaag

SEQ ID NO: 33048 - DNA, 945 bp, Bovine  19866880680304
tgggtagacatggagatgatgacgagccagaaccccacctacagcacaatctgggcttcctccccacatccctaaagtagatgctgacattgaaaggaatctatgcaagtgagggccctgaaacttaagctttgtgggcttcatcttaaattcactttttaaatcaggtactacatatattttaagaattaaagtttaaatggttgcttaaattagtttgagatataggattacaaataacacatgataaatattatttccaagttagggctttgtaaaatttgaatcacatgcattcagtctaagaagatatgattagatttggcattaaccagtgaaatctactacagaaataattaagatcacttcccttactaataaataaccaagggcaaatgttataccatgacacgtaggaatttgcatatatgctttaaatacggcactagttttatttaacactgaataaacatcaatcagaatgcctgtgtacaaaacaaggaaatgcccatttgcaaataaccttttccctctttcaaaaaaaatgacctatgtaccataaatgtgatcacacagtaagaaaataaggattaagaataacaaaatagcatctaaagtactgtcttaccgtagttcacttaagcatgtaaggtgcacaatgcagttcctaagaataaactagtagaataaaatctgttttatgctttaaaaaaaaaaatggcattccaagatacagctgcatagactatatgatgaatattcaacatatgagaaactgacaaatttatcttcactccatcattaagcatttttgtgacaagctgggtattcatcgcattaggggtcttttttgtgtgtattctttttgtttaatgcttgctcatgccctttcctgacatcctgcaagactagtcttttcttttcttttccaaatttctgattgct

SEQ ID NO: 33049 - DNA, 1408 bp, Bovine  19866880694854
tgatatattcaagcaaaatcataaatacaaggaatctgttttcggggcttcccctcccttttccaaccattgccacttttcaaaccttttggagtgccacaagcacagcacagtccctactcagtcaacagagctccactccatcaagccctttcagtaaacgttaataaccctatggtccaccaaatcatttactatcagaccagagtgcaaaatggcatcatctttccaagcacatcctgacagtcactgctaagtcccttcagtcgtgtccaactctgtgcgaccccatagacgacagcccaccagggctccccccgtccctgggattctccaggcaagaacactggagtgggttgccatttccttctccaatgcatgaaagtgaaaagtgaaagtgaagtcgctcagtcatgtctgactcctagcgaccccatggactgcagcctaccaggctcctccgtccgtgggattttgccaggcaagagtactggagtggggtgccattgccttcaccgtgacagtcactaaactagtcttttcccagaagccaagaattcatatacatataaattgttctttggagttattcaaggtactatttgcccttttatttcactgagctataattttcataagcttactttctagcatggaatggcgactcctcgtttgttttcttcactagttaaaaacagaaaaggaactctccaaaactcaccatgaaacctcattagtatttgcaaactttattcacacatcatttaatttagtcatatattttgttggagcataaaatgcttccaaaggcttttggtattttggtcacattatattaggtgtctgttgccatacaacaaactgcccaaagcttaatatcttaaaacaacaataatttagtatttctaatgatcctctggttggatgagcagtccttgtctgctttgcctggcctcactcgtgtgagtttgtcacactctaaaggtggccaggctggaggatccacatggccttacatgtctgggagtggttgctgaccatcaaggggtcttgattctccccagcatgacctctccttctccagtagacaagattggctagactcctttcatgccagtctcaatagagaggataaaagcagatgcatcaaggccagaatttgcaaaatttcacatccacttcattttattcactgaaaggagtcacaaggccacctctagtggtatagctcctcttgatcaagagactttataaactaaaagaaaaaagttacctgtctgtccagattcaaatcagcagagaaacagactccaactttgaatgggaggaatacatataccaggttgaaaagaatttgcaatcatctgaaaacattctgcaatccaccccacatgttgactcactcgta

SEQ ID NO: 33050 - DNA, 1486 bp, Bovine  19866880735821
gtatattgtaatttaaatctagctattttaaattcgtcttataggggaaaagtttccccagccagagcttaaaattcaggacaaggtaggaaaggagcccagaaaaatgaagctttactggagtaatttttagttctttggggtttgtaatttacttgtctcctttctagttattattatgtaatatttgcattaaagaaaataaaaactcttgttttcttttgagcacaaaaataaaaggaagggagacaccccacccttctatgtttccagtttccctcacaggtcagtttgactttcagatgaagccttattacacaaaaggagaaaattagcgtcagcctctgggcatcagccttaggttagctgttctcctcattgtagagaatggatccgaagcagctgggcagcacccaggggcaattcccaccggacttgagagcttgaacttgcaactccgccgtgggtttcctgaccacctctgagcgtttggcagtcacgttcctttctgccttctgtagtcctctgacctgcctgccactacacagcatcctcttctgactcagtctgtacactagaacagacatggctgatgggatttaactgagagaagctgtctggacaatattaagaattgtgaggccaaagttgtgaaacacctccagtagcctgtcctgcactacagtgaagaaaagaccatgggtgaaaactggttgcattaagtcattgtcttacaatgaacagtattcttggtttttagtgtttctttttcctctgttcttcattatttctctcttgatgaaaatctagaagcatggtgatcttgctattgaagaagggaaatcaagaaatatccaaattctggactagtatgtgttttttatttagaaacacttaggcaatgtgtataaaatgccaagatttggaaaaagagcagcaaaagagattaaaatggtatgccctttcccttccccaaactgaggaagaactattacttctttcaccaatagagaagctaatggcaaagaaaatttagtgattattagaaaggaaggtcaccaggcccttgttttgttttcttagctgtgtcatattgtttttttcctctttcttttttggaagttcaggattggtatcatgtaggatgctatttgtcaaattcttaagttgtatttggacttccctggtagctcagatggtgaagcgtctgcctacaatgtgggagacctgggttcaatccctgggtcaggaaggtctcctggagaagaaatggcaacccactgcaggattcctgcctggaaaatcccatggacagaggagcctggtaggctacagtccatggggttgcaaagagtcggacacgactgagcgacttcacttttcacttcacttaagttgtatttatttatataattcaccccttactttattagcaaggctcaattatacaaataagtagaataccaaaaatggctcttgtaaacag

SEQ ID NO: 33051 - DNA, 1501 bp, Bovine  19866880760593
aagttaacacagcagaactaaggctgctatcctgtgaaagtcctgcttacaaagttggcccttggctgatgactaggaacctggattctgtgagggtttctaccattccctaacggattaaggatggctcatggtgcctaaactgttttacaaagaaggtggtttatgctgaaaacttctttagagactctagaattttgggtgccaatgtgatcggcttccatttaaaatcccaggcaccaagtctgtaataagcttcccaagtagacaacaatttacatgtgttgctacaactcttcactgggagaattaaccatgtcctgtgagactccactgggagagaatgtcttacaagtttgttcctggttttcccctggacttatccccatgagccttttctctgttaatcttgctttgtatcctttaattatataaatcttaggcatgagtatgtccatctgcagagtcctcctagtgaattattaatataaaacctggagatcaccttaggaaccccctgacccaagccctaactatttaataagtataactttaggtatttcttctggattgagatatcaaaggtgctgtgaacttagtctggttatttataccagtcttttgtcaattgtaaaaatttaataatatacctctaaatatagtagtatattcctttgttagattttttgtatatattactgtctgcttattctttaaggttaactttaatttggataaaaaggccagggcaagggaaaatgcttcctcctatttaatgctgattagaaatccattaatcatataaattaattttgattttagaaaaattgatattataatattgaatattctcattcatgaaatgatgtataatacttctccatttagtcaattctccctctacatgtcaatcacagaatttttaagctagtagcaaaaaaagactatttggtcccatctcattttagtttgaagaaaactaaagataagtttcaattatttagtggcatagtaagtactgatactaaaatactggtctcttaatttccagttcaactacttttgtactatacaatattaaacctttatacctgtaggaatttatctaaacttattaagcatcatataataagctgtgttgtacactgaaaagtgagtaaaatatgctcctagatctaagtagtttatttgtcttacctgatgaatgaattcatctctttggtccattattattttctgaggaggcccatataagaaaaatatgttgataatagctttagaaatttctgatgctgaaacatcacaaagaggcaaaatcacaacccattttgtgaacaaatctgtcatgattatagcatatacatgacttctgttgcttgtatgaaatgggcccatcagatcaacagtaactatactccatggattctccactttgagaaggtgctgtttaggtgctagaataactgtattttttgccacttggcaatgctgacaagcatat

SEQ ID NO: 33052 - DNA, 1870 bp, Bovine  19866880782991
caagggactctccaagagtcttctcccaacaccacagttcaaaagcatcaattcttcagcgctcagctttcttcacagtgcaactctcatatccatgcatgaccactggaaaaaccatggccatagccttctagtcaaggacctttgttggcaatgtaatatctctgctttttaatatgctgtctaggttggtcataactttccttccaaggagtaagcatcttttaatttcatggctgcaatcacccatctacagtgattttggagccccccaaaataaagtctgacactgtttccactgtttttccatctatttgccatgaagtgatgggaccagatgccatgatcttcgctttctgaatgttgagctttaagccaactttttcactctcctttttcactttcatcaagaggcattttagttcctttgtgctttataggtcataaaaaacttttttgttactatgataacagtggcaagtatgtaaagatagcaaaaatatacaaatttgattagatgtcaaccttctttttttaaccaaaagttaagcactgagcaaatccttcatttaaaaatattcttcctttctgtgaggagattttccagtgaaggttgtcaatttcctctgacaatcccctcaagttagtaatttgtctcgcttggactttgttagggacaagctgctggaatgttggagatgagaggtgaagaataagagaggtgatctggcttgttatttgttttatcccttggccatattagaattaatgtgtatgtgtttgtaggggtggagatgaaagtgtcccaggaaaagtggggaaaggatagatctttagaacttaattgggaaaattttgcaaattttttcatttgatctttctgacagttcagagtatttaatagccatcatatcatttgtgtgtttggtgggacatgatattctcttatttcattaaaagaatctaatctgatatagaagtgttccaccattcccaaaagataataaagatggagggaagagtcagattcattaaatggaacattttctacaagctcaggctatatttcttgtatgtggctctttcagttcctgtagttgtgtaataaaacatcctgaaaattaatagcacaaaacatcatttattatattcacagttttatgggcttgtctctgctccacagtgtccatggcctaagctagaaagtttgaaggctggggctggattatttgaagggttctttgggtgcctccctctgcctctgtggtctctctatgtgaacttgccaaatttggggcaagaccctggtgtaactgatgtcttataaattggcagagggccgctcccaaggctcatgcccagaaacagacggaaagccagtgaaagccacactgcctctttagacctagtcttagaagtcacgcagcatctcttctcgtgttgtcctccaaggtgatcacagtgtcccacccagtttctggaggagtgaaaatagaccacaccttttggtgggagagaggcaaggatctgggaagctaagtgggaccagaaattttatcatgaccattttttggaaaatcctaccagtgcctgtcctaaaatttcaacttaaactctgatttaggaataatattttacttaaattgcagtgctaagtcatgggttgagaatctaagtctatttcagatattactattctagctttattgttactttttgagggaactggaatttaaaaattttttccttggtgagttgccccaggattgctcatatgcttgagagcaagaaacaaaattaaatggacattcttaaacaagtatatgctcctggaataatttccccagaagtaatgaccattttgaaataa

SEQ ID NO: 33053 - DNA, 1593 bp, Bovine  19866880851938
gaattgaaatacaattacgttgctgtcctcatgtttccctgtttgtcctttaaagaaaaatatgcatttcagcacacactgttccacaaacagagacagtatatcctttgcctaaaaggtttcagacctaaggctgtctttacaaatggagtccaaattctcataaagagatatgacatccttctaaacactgttgacccatttttcagccattgactccctcaccccattccatgccacccctccccgtaaagtagcagtacatagaccacagttctgagctgactcactggattgacccatgatctccacttccacagggccacactgaataatgaccataagctgttgaatgcttagagctcgtgggccaccctcttagaatgccttcacattttgaccctcaaactgggtgatatgcttacaaattgtcaactgtgttaattcccccaggaacttatattgtgacgatgatgatgatgaattttgctcatttcactgttaaattgtaaccctacttttaatacattatttctattcctctgactaaccgtccgattagcttaaatatatgaatcttgtaacttctggggaagccagatgtgacctgcggcagtagtgagctgttttagaaaacttagagaactaaggtaattaagttagacgatacatctattttttttgagattccgttaggaaaaaaactggcagaaatatgaaaaactcaacttgtcatacacaagaaaaatatagtttattgacttgtgctgtgagttttctgttccctttcctgtttccaaccccaaggctctgtcaggttgctgttgaagatgcattcccccactccgagtgaaactagtaagataaaagaataatcaattaccttttgaattcttggtttgaagttgcgcagaggcaaaaagttctatttccagactgaggcacacagttaaacacaaatggttttcccaagctgctatcaatgccaacttctgcaccttctaattttattacctctagaggcgagcattttccttcatcctgtaattgataaggaagaggttcagcgcgggcactgcagctaagcagataagggagaaaatgagagtggaaaggaggactaaagttatttttctgaattgattgttctgaaatgaaaataaaaccaaaatgagcttttgtagattatgctgtctgtgatatattacatcaaactccaaatttcccacatcctttttgaatcgcctctattaatatgcatttcatttatgccaacttgggagagtatcattaatcattcatatctatttttccccatcagaaaaaagaatataaaaagaaattgatattacaaaatatatgtatttggtagtatctagttagtgtctatacttagcctatattccatacttattgtgtgttatgccctcttctaatatctttacatctattaatttattaatagatttattgtcacaaatgctcatcattacttttattatcttttttttttttttttttaacaagtcaggaaacttgcaaagtttaaagagaacttgcagcatagagtgaataaagaatacttttctaaaa

SEQ ID NO: 33054 - DNA, 706 bp, Bovine  19866880863932
aaaaaagcatttaaaaaattcctgatacggtgtttttaagcattatttatttatttattctttttttggctgtgctgggtctctagctgtgagcatgggctactctgcctgtggtgtgtgagcttctcattgcggtggcttctcttgtggagcgcaggctcccgggcacgcgggcttcagtagttgcggctcacaggctctagagctcaggctcagcagttgcggtgcatgcttttagttgctccatggcatgtgggatcttctcggaccagggattgaacccatgtcccctgtattggccagtgaatttttaacccccagactgccaagggtgtcctgttacagtgctttgatctctagcatttatttttaattcttccttaaaattctgcctctctacatgttgtgtattattttattaaaatccttactaatcatagtttaaaaaatactggtctcataattccaacattactattgtatcacactcttggttctgttgtttatttagtctcttcaaactgtatttcttgccttttagtataccttgtaatttattgttgaaatatagatatgacatggtaggtagaaggaactgcagttaacagtcctttactgatggggcgtggagggaaggggatcgttctatagcgctacgagtgggtctcagccttttggtgagtctgtgcccctggactgtgaaatt

SEQ ID NO: 33055 - DNA, 919 bp, Bovine  19866880922068
ctgaagagtccctccctcatggggttgttatttaaattaaagggggaaaatgcatataaattgactagcccagtgccaggcagaaaactagctcttgccaagccgtcttatgtatgagaagcaccctctagtacactctggaagatataaagaagataaaggataatgaatactccctattagttcacaatctaggagaaagtatggaaaatatattgacattagttcataataaattttgtcatagtgagatacacgatttaatcagaagttaaaggtcataaaagggcatttcatcatgatctattgtaaaaaaaatataaataaatctccaggcacaattacaagaacaaagactgtcgtggacatttggtgaccatttagccttctgtagaactcaaatcctggtattagtcagctttataactttgatgaacttcccaaacaggaagccacaaaatgctccatcagtgctatatttggtactggtttagcccttacttagagaactctattccatattgatcctcttacctcagaaatgacataactacccttggggaagtgaaaatatacagagctattcaagctaggcttagctctgggatttatgtctgcaagatacaaaacactaaataggcaagggagctcaagaacacactttcatcaaaaaggcatagagacttgtaatccctgctgttcaaataactctctagcaaccattctggaaatatgaccacaaaatagaggcaacatattacagttgttaattaaaaatatagacatacttgacccaaagcccatcaaaacttgctacaagcttcactggacacagcagaaatcagtacataggaaattactaaggttaagacattcctgtcatctcaaaccaactaccataatttcatttttaacaata

SEQ ID NO: 33056 - DNA, 1707 bp, Bovine  19866880999987
aaaaatgaataagacagttctcagatttcagtcttgcaagatttaggctcttctcttaaagtaatatttattctacaaaacattcacttggcatacatcttatgctaccctgcccttcctctcccagtaacaggcatgtctttggagggaaaaatccactggaatcccttttgtccccagaatgcctgcatgttctcagtagggaccttgtgggtgaattctgctcttgttagaagactgggttccaaatggtctcctcagaaacattcagattatttttaaattcgcactataacccatcgcagagcgtgtggtgtacaaacaggttttatctccacaataatgttgaaattcactagcagctgcctaaagtgctaagaaaagtacggaggccacatctggactgagagagagaatgtatactgaaactcaagggttagtgacgtctgccgcatgcacagatgagaaacatggtggtatgcatgctcagtattcgccatctcgactctaaatcctgagccaaggtctgaattccacgaagttcaagtatttcttactgcctaagttcctttccctaactgaagcatcagaccacggacagataattcgaggttcttctaaatatacatttccatgtataatccttttatgtaaaagtttggtgaagaatattcttccgagtgaattagacttaaggtcaatcacagacccaatgttctcttcctctttgaactagcacacagtaagaaccctttcccaagagtatctgtagcaacttttaaacttttccaaaaaagcaaaagcatcaaagccacttaaagatgccactgtctgtgcagcgactcttttcttccagtagatgctgcgatcttctgtttaaagagttcccttttctcatcctgtgctctcccataaatcggtaacatcccagacaaccccaaatcggggtgacatttggcagacttggtttcagactcttcctctgaaaccatttaacaaaacctggcacaaagtccttttatgatggcgagaatacaaattcaacatccagccccactcctaaagtgactgagggggtccagcaaactcaaaataagaaaccaaaccccttcttcttttggtttgtttctagggagtgttcttcctcagctagaaaattcctgaatgtttctctaaagtatcaggagatccatttcataattctaaaagcacactacaaaacagaagggtgcggtccgtaacggctgacaacctccactcgtagctttataatcatatttattatatttccaaggcaatcttcctcatcaatgtccactcccctaatcaaatcacattgtttaaaaaggcaaattcacttattacttgctgccctctctccattacagtagcacacgcctttgctgtctctccgccccacctcttctagagcatttatgcctgacagtcacctcctccttcctgccacagaccacttaggccagagtcatttcaaagttcccttaaaaaaacttgatgcttataatggaagaaaagccttctcaagacagaattctgttagaatgagaaaataagtaaaaacaggttgcttttctcaagatctcaagtaatattctttctttagtgaaaggtcaacttgccttttaaagttaagcttagaatcttccaaaagttcccaacacccccagtacgaaatcacttccagca

SEQ ID NO: 33057 - DNA, 1112 bp, Bovine  19866881042559
aggcaccccttggattatttgcacttcccaaatttgcctcagactgactgacgtggtgctgggtggcatcaaaaacttgcaaagaacaactttttaataaaccttatttgtgacaaaattaatctttttaaccatcgactaaaaagccctgcaacaactcaaacccctaattcagactaaagcacaacatccccctttggacacataaaaatattccttccttagagggggagatagcccaattttttgttatctggtacgtatgcaaggtgaccctgcttcagcaattgcaatagccagagaaaaattattgcttctttgattctgtagttgcgttttgtcctctggaggtgtatccccaaaaaatcaatgtcaactggctttagaggaaatgtttttaatggacatgctgctgccaggtctccctgggatacttaatcactgtctccacgccagggatagaagcactgggactccaggagcctggttctgagcagaccgtctcgggggctcacatgcttacagaggtcagacaggcattataaacccgtggagcagtcaggtctacaacgccagggaatatgagggaccgtgtgaaacgggagtatatctcagagaaggcagacagtcgctacctgttccgttcagttgtcaccctgagggatacgggacccactgtgtcgtgggaacagctcttgcagtttctctctatatctgaaagagactaaattggggtcacacacagttagacctgtgaacgggtcaccctgaggaaaaggattagagaatccgctgatattaaaacctctcatggaggaccaaattagtttcctaagctaccataacaaaatgccacaaattggctggcttaaccagcagaagttcatttttttttttttgcagtcctgaggactggaagttcaagatcaaggggtttgcaatttggttccttttgaggcctctttccttaacttgcacatggccaccatgtctcactgtgtcctgacattatctttttctctgtgctcaagcattcctagagctcaaacttctgtctgtgtgtccccagatttcttcttcttgtaaggacaccatcaggtggattaggactc

SEQ ID NO: 33058 - DNA, 1874 bp, Bovine  19866881078220
cttatttttgggggctccaaaatcctgcagatggggactgcagccatgaaattaaaaaatgtgtgctctttgcaagaaaagctgtgaccaacctactataacgtattaaaaagcagagacattactttgcttgacaaaggtccatttagtcaaagctgtggtttttccagtagtcacgtatatatgtgagagttggactataaagaaagctgagcaccgaataattgatgcttttgaactgtggtgttggagaaaactcttgagagtctcttggactgcaaggagatcaaaccagtccatcctaaaggaaatcagtcctgaatattcattggaaggactgatgctgaagctgaaactccaatactttggccacttgatgcgaagaactgactcattggaaaagaccctgatgctagaaaatatagaaggcaggtggaggcagggacgacagaggatgagatggttggagggcatgaatttgaagtggctccaggctttgatgatggacagggaagcctgatgtgctgcagtccatgggatcccaaagatttgggcaccactgagtgactgaactgactgaatatcttgaaaattgaataaaggcatagatcaagaagatagagaaatgtttaacaaggacctagaggaactaaagtacaaataatcagtgatgaacaacacaataaactgaaattaaaatgcagttgaagaaatcaattgcagaataactgaggcagaaaaaacaggaaagtgagctggaagattgagtgtttaaaattactgctgtggtgcagaataaagaaaaaaaatacaaagaaattagcacagtctcagatacttgtgagacaactttaaacaagctgaaatttgaattataggggtcatagaagaagacaatagaaaggatctgagatatatttgatatatatttgagaaatatttgaataatatttcatattattctcctaatatgaaaaacagagaaggcaatggcaccccactccagtacttttgcctggaaaatcccatggacggaggagcctggtgggctacagtccatggggtcgccaagagtcggacacaactgaacgacttcactttcacttttcactttcatgcattggagaaggaaatggcaacccactccagtgttcttgcctggagaatcccagggacgggggagcctggtgggctgccgtctatggggtcgcacagagtcagacacgactgaagcgacttagcagcagcagcagcattatacatgagaatatgagatgcatattttgtatgcatttgaaaacaggactagacctatgtatattaaaaagatgaggcagaaacaataaagtggtcatagtccagtgttggagcaataaatgatttgctgcttgtttgtgttcttcagtacattttttataacagtattttttacttgtagaatgaaaaagactcttgactcttcctacattcatctttattccaactttggaattattagtctattttggaataggttcctaagacagttattattttaatagcttcagaatctttcacaatattgagaaggttctctatatacacatacacacgcatatatgtacatacacactcacacttctttccaaatgcttctctcagcatgcaagtttgccgactttagagattagcctgcttacagattctctaagacatatgcattttattgtaactgaggtccttaccggctactggtcggggttttttggtaagacatctgggactgtcttcaggattcccatcatcccctcggaaaacccatgcagcctgaatggaagttctctgtgtagaatcctttttcttcgatactgactcgaaagccaaggtccacagag

SEQ ID NO: 33059 - DNA, 1158 bp, Bovine  19866881083056
attagaattattgaaatgcaactaaatgactgaagtatgtccagatataccagaaatagtgatcagatcaaaggtttatggtttgagagactgaaatctagaatacaaaacatcaaaagcatatcaggccagttggttctcattaagtttcatatttaattcccatgcccccaaaaaggatatggccatctccaaggcaattatgaacaatcactctctcttacacaggatggtcataatgaacttcacccaatcaagtaacccagtgaattaaaagtttgccacagtttccatacatactttctaaagtaatgcccatgcacacacacacacgtgtctatttcttacttgtaagaagaaggcattgcctaaaatatctcaagtaaaggctgttctttgttacataatcctatctcataaaagtaacttcactaatgtgtaaactccagaatagatttttttccttctgccaagaaaactaaaaggatcagagttgtgtcaccattatctcagaatgagatgacattctacattattccaaccttggacgagaaagaatttcctaatatgtagtgatttatttttgatgttgaacaagctagttgtggaaatatataagctgatttaatgtatatttcaaagcattatgttgctattaggaaacagaatcccttatcagaactaaagacttaagagcaataaataaattccctttaataaaacattagtcagaaatagaaaacacagtatttttcatacttttcacttaaaagagattacaatatgattcttaaaggatttcaatataaaagaattttcatgctatttttttagcactaacatactgctgatttccaacataagaagataatagaatcacatattgagaagttcagttctttaaagatgaatctgtgaaacttcctagataatatatcttcgtaataaattcatataagtccagaggtttagactgatcaaagtggcaaagaagaatcagtaattaaacttctactccatggacagatttttcgcccagggaaatctctacacagagtcaccaccacctggctgcttcagaaggcaggaggtcattacaattaatctcatactctcctgacatttaactctggaattccaaataccctaccaaaatac

SEQ ID NO: 33060 - DNA, 898 bp, Bovine  19866881148730
atcatggctttaattactaagaaaaagtatataaagtgaacgaagcctgattcaccattttcatgtttagggaatatcaaaagaaacatattattctgactcttttaaaatattaatatccttaaatgtactatttcaaaattaagtttataaaatatattttccaaaagacttcaaggttgggggaaaaaattcaaataaaaatgtatgtgaaagtgaaaacagccattttgagataaataattgctgtcgtattttttttgtttgtttttttttgctaaaattattacttgaaaggcatcatatagagtaaacgtgtaatgaactatctagattccattggtaaattatttattccatgtgggctggccttgattttttcactgtagcaagggactgacactagatcgttgacagaactcctctgtgctctaaaatttcataattctatgaatataaattgcatgcaaatactgagtcagattggaaaggcatcattgtcaggagttggagacgtgactgagttgtaccagttgactcatctcaagcaggctggccactgcgttttgccattgagttgcatcactgagtgattagaattcttaaccacattatacccacatggtttcaaatggacttttaaaatctgtcttgcagcccatattccctgtgaacctctaggttagttataattgactttctaaccatatacaatggacaataattgatgcttttagctagctcaaagtgttcatctagcatttaaaagtagaatttttttttcacttcataaatgtaggatctgttcaatatgcaagctagggaaatgtacactaagtaaaactgtttagtgactctggctttcacagtctagccttattctccatttaaaaatgag

SEQ ID NO: 33061 - DNA, 712 bp, Bovine  19866881158915
acattaaacttattaccagttggaaaaatactttttatttacaaatatactttcaaagaatctaaaaacccatgtcatcactcttataatgcaatcacgtatgtagtctgaaacacatggctcatatttcataaatgttgaaaaacacactatgaaattgccaagtgaatactactaacacctcttcttgtatgcactcttccacaacaacaatcacgggcaactggaatctgctttacaagcatgtctatctttgtaaaaactgcacatgctttgttagtgggcattgcacttgcgtcagacaaaagtctgataatttaattgtatattcaaagatacaaaacaattaaatccactagcatcaacaaccatccaggaaaccaataatgagggttctttgaaagtagagtaacccagaggtcctaaagtacttaacataaaattccaggcccttcaatatcagccacaggatactacatttcttcagcattacatgttttcacatttcagtgattacactcttagctccctttatcagaaataatttcctttcttaaagctctaattctaaagatacctacacctcaatgttcataccagcactatttacaacgaccaagacatgacagcaacctaaatgtgcatcaactgatgaatggataaagaagatgtgatacatatacacaatggagtattactcagccacaataaa

SEQ ID NO: 33062 - DNA, 1442 bp, Bovine  19866881176686
ggtagaactggcatctcataagtctcctacattggccaggagagttctttaccattagtgccctctgggaagcccaatctctaaatggctcctgtagtggttaatacgtcaagtggttatatgtcaagtcagctaggctgtagtgccaagatatttggtcaagcattagcccagacgttgttataaaggtatttgtgaagatgtaattaatatttaaaccactgactttgggtaaagcagattatggtccaaaatgtggattagtgtcttaagagaaaagactgaggtcctcggaagaggaaggaattatgcctttggacccaagattgcaacatcagttcctgccaggatttcctgccttccatcctgccttgaatattttagacttgccagatctcacaactgtgtgggccaatcccttaaggtacatttcagtttctctttctctttcattctctctctcatacattctattggttcactttctctggaggaccctgaacgatacagctcccaatgacccacagctctgacatccttgccctcgttcaatcgtcttcccttgatgcaggctggaccaagtaacctgacccagtaatttgttatctctaacaaatagaatatagcaacaataatttttcttttgcacattggattcagagtaggaagacctgtggtcaccactttcttgacctattcgacacacattcgtaacttctgagatgaggatacagaagtgctctggcttccaccttggacaccctcttgcattctcccttgctgacggtgatgggcagacagcagcagccatgttgggagctgccctgtttacagcccacatgaggaggaaacgaggcgtcctccagcccatggccagcaaggaaccgaatcctgtcaacagtcgcgtgagagagcctgcaagcgaatccgccccggtcgagtctccagatggctgagaccctggccgatattctcaccgtggcctttgtgtcagacaaccagcacccagctaagctgtgcccaaattccttagccacaggcaacccggacaataaatgcttgctgttttaagccactacatttagaataatttgttatacagcagtagataactagcatagtgcatttcccacttttaagctcttgaagatcttaaaagctgtcactcagctaggataaccgaggtacttacggcaggcgtgtgaggtgtaaggaaacaccagagcagtccttgtgattatctgaaaatacacacaaaaaatacacatcttaaatatgaataatgaatttcaaactaaaaatgttaattaataactcaatactaaatttaaaaaccctatatatttcgcttgtatggtgttttacagtttacagagtactttcatactcataaaatccatttaattccaatgtatcacagagcaacaagagaactatcattt

SEQ ID NO: 33063 - DNA, 1011 bp, Bovine  19866881201097
atcttctgtttgttttcttaagaaaaaaacttagatctctaactagatttttctctgtctagccaacactgatcattaattcacattctcacatagttcatcttattcagtttgaaatgactcaaactgattcctttggtgtctgcctccattatctttaaagaacgtctgtatattgtgcttcattttaagacattatttaattgacttttcatgagtaaaggtaaggatttagtttattttacctatcacacatgcttgttatcattcctccatgttcctcgatattatggtataaatttaggcattttctctcattttttcctttttttgatttattattcctagaatattaatataaacattctcacactggacaataaggggaaaaaaaatctcagaacatttacaaatgcagctgcccctctatataactctggttgtttaatattcacctaaccttacatttttaccctggatatatatatattttacatgtttagatctactgtatttttggagtagcattaaaagaaaaggtgagttggtttcaagatagctcaggcaaagctaagaaatctggtataattcttctagcataaagaaacaagttgcgaaaatgataattgccaacaactcaagaggaaaaaatagtttagatcttaaacataacaaccatagtatgcagaaatcagtaataacatattatttttgaaatgagattttacttaatgaatgtcaacaagaatttaatccctatatttcactgaaaaatttttcatccatttgaatacataagtacgtttttttcttaatttgtggctttaaaaagattttgcaggcattagaacagctgccaatgttttaaattatgatgtacactaagtagaattgcactgaatatttaaaaggaaagaaaaaagaaatacacatacacctttattaaactgttcataaaaaagcattcttcttgttacccccaaatacatgtaaaatttcaaaaatgctgca

SEQ ID NO: 33064 - DNA, 1058 bp, Bovine  19866881203743
tttgtctgcttctttgcaggtaggctttctccgccttgggatgcacatgacccaaatatgttacccctgaaaaccctatttttctatcccctcatccagtaagaatgaactaaagcctctaagacccaattttaaatttttaagtggaaaaacgaatgacagcttaggtcaagtgtcccagatgtctgttgcctttgacttttccaaaagactaatttctaggactccagatatgatactgcattttgatgttctacccagatcacacaatggtaaagaatccacctgccagtgtaggaggtacaagagatgtgagtttgatccctgggtcaggaaaatcccctggagagggaaatggcaacctgctcccgtattcttgcccggacagttaagggggtcacaaagagtcagacacaaatgatcgtgcacacaacacaaatgcacacaactataaaaatgcttcagtacctacagagcactttgattcatccagtagccaagtgaacttacagaaatatgatgtgagaatattcagttccaaattcttaaattagcaaatcaatattgttgcttttcatcccatccaacaagaagcacatgcatttcttttttaagtgaagagtttcaagatatttttaggatattcggtttatactctttttttttcccccacaggaggtaaactcatccttacttactggaaaaatcagtctgtgcaactgttctcatcatcaaagtgggagtctttatctggaaggctaagcatttattgactgctaagactgtggcaacacgcagacagcataaaccaccatttcttaccccagatgctttgtttcagagactcggagctgctcttggtaacaaatgccggaaggccctgaagtaccaattactcactgtttaagacaatgccctctccagaacggaataaagctcacagtcacaaaaaagttgattctgctgcggggagccaagtagatccacgctctctctagcaagcctttataatctgtactaatcacaagtttctttgggaattcttgtctagggataag

SEQ ID NO: 33065 - DNA, 1026 bp, Bovine  19866881335673
acagaaaggaaatggaagaaattttgccccattttgctgttccattagttctgcaacagagctaagattaaaacagatttcaagcttttatagtgatagctcgttgccttggagaactttttaataggaagagacaggaggtttgaaagtagaatatttttaatttaaaaatctcattggcttattttcacggcactgcagctgctgattttcatatacataatatgttattttttatgctgtctctctttgtaagccaaaaacacttcttaagaaaaggctattagtctccattttaaaatatatatatatatattgaagaagttacagtttgtgacagattttgttcatgaattcatgaggccagtcagagctgggaacagttcctcctaactagcgtatctcaggtttgctttatgactgagcaaaaaattctggggttgtccagcttcacatgaggatatcttacctggctactctgaggcctaacaaagctcatcatccacctttacactacatcctcactcaaacagggagaatccccttccaaggattgtgatttggtgccaaacgggcgacacctgggttctagccccattctccttccacacatacatccttctctccctccccatgatgccacccaaacagaacccaaattcagtccttagaactttaaaaacaaataagaaacactcatctcccttaccatccagctatctacccattcagtaaatatttactcagtacctattacgagacagacgctgttctaggtactaggactcagcagtcaacaaagaaagaatcctgactcagtgaacatacagcgtgtcaggcgtcgatgagggctgagggaaaaaaaaaaagtggcggggagcccaggggtatccagagtgatggaggaggctcctttatacaggctggtcggtatggaaaacccattcagccacgtacaagtcagatatccttcatgaaagctgtttcaagggcatcaggtgagctcaaagacaaacgggaacaaag

SEQ ID NO: 33066 - DNA, 978 bp, Bovine  19866881363388
agaaagggagcttgcttgtagcttacataactaattgcccacacccagctggcacttgcatgaacattttctatgaaggcccaaatgtttgtgagatctgttgtcataaacaaaagaaacagatgttccaactctgataccaagcaaagttgaaaaggaaatgatacatttagggatgggcagaccacatacgaaattatggacaggcccatctttcgggaagctctagagtttaaaatgctactgttatagtaaaaattttttaaatgaaaaggacaaaccccttttttaattataagttttcagactctacattatatgtaaatattcataaaaggatgaagtagctcagcatttaactctttataatcaatacagaactatgtcgtcaagtaccctatcggggaaaccaacttagaaaagtgtgggcttgttttcttaacactttgatccttcctgtccaatgtaggatacttccattctgctcccaagagcagcctcaagtagggcaactgtctgtgtggtatattagagtcaccttgaaacacctccctcctccaagagatcatcatgcctcaaactgtcaccataattagtagataaagggaaaatttgtaagttgcattcaaattagtggaacacagtcaataccctctataattaaagctgaaagctatcacataagctatcaggaagagtaacactacagaagtaattcctctacaaacaagaataattttcactcataatgcaaagataaataacacagtttttaaatgagcaaaggatttgagtagatctttctccaaagaagataaacaaatagccaaataagcacataaaaaaatactccacatcagtagtcatcaaggaaaacaaatgaaaaccacaacaaaataccatcccatacccactaggatggctatatgtaaaaaatatcaaatatggcaagaaagggagaagctgagaacacttata

SEQ ID NO: 33067 - DNA, 1482 bp, Bovine  19866881384306
tgtgtgtcgtggtttggacctttgttttagtttcagctatacttcacaaatggagaaggcaatggcaccccactccagtcctcttgcctagaaaatcccatgggcagaggagcctggtgggctgcagtccatggggtcgctaagagtcagacacgactgagcgaattcactttcacttttcactttcatgcattggagacggaaatggcaacccactccagtgttcttgcctggaaaatcccagggacaggggagcctggtgggctgccatctatggggtcgcacagagttggacacgactgaagcgacttagcagcagcagcatacttcacaaatgcatgctgtacccagtgttttcaaaatgtacactgtgcgcattttcctagtaaataaagtgtttccttgtctgactgactgactgactgaaagtctctcagttgtgtccaactctttgtgaccccatggatagtccatggaattcttgaggccagaatactggagttggtagcctttcctttctctaggggaatctccccaacccagggatccaacccaggtctccttcattacaggtggattctttaccagctgagccactagagaagcccaagaatactggagtgagtagcctatctcttctccaggggatctgctcgacccaggaattgagccggagtcgcctgcattgcaggcggattgtttagcaactgaaatatcagggaagcccggtttccttgtctagcgttgtctagttttgaatctcatatatttcattttttaaaattaatttatatttttattgaaggataattgctttacagaattttgttgttttatgtgaaatctcaacatgaaatcagtcatatttcaaagaaacagagtggggcctgtgaacattgccgggtcttctgtatgctgtataaatatacttcagtgcctctgttactgattggattgtgagggaatttgctattgaagaccttaggtgtcattttaaaatttgttgttgttcccggtacttgtttatgaaactcggttttaaaagtcttgttcacctacacgttgacttttttacgcatattgcattttctgttcgactctattccacagaatattgctgcttatggtatcataacagcactttctgttttctgtttgcggtttttatttttgctttaaactacatgtgaaaggcattaatggaagctgttaagggtctctgttgttggtctctgatttgtagtgctctgcggttccaaagttagccttgggtctggtttctgggttcacatgtattcttactgatgcagtgggcgtggtgcctggtccgcacccctgcagtatttacagagtgtgctttgtgattgtttatcttggcagtatgttttttggatacaaagtttatcttagaatataacagaatgctttgtcatgaatattgttaataacaacaaacccataaacagagctttcactgcagtt

SEQ ID NO: 33068 - DNA, 1682 bp, Bovine  19866881399228
caccccatccctcagggttgtcccagagcaccagcttggagtgccctgcttcatgcatcgaatttgcactggtcatctattttacatatggtaatatacatggtggcggtggtttagttgctaagtcatgtccgactcttgcaaccccatggattgtagcctgccaggctcctctgtccatgggattttccaggcaagaacactggagtaggttgccatttcccttctgcaggggatcttcctgactcaggaatcaaacccaggtttcctgcattccaggcagatgatttactgactgaagcccggtaatatacatgtttcagtgctattctctcaaatcatcccatcctcgccttctcccacagagttcaaaagtctgttctttacatctgtgtctcttttgctgccttgcatataggatcgtattattgtctttctaaattccatatatacatgttaatgaaacaaaaattattacataactatattggagtgagaatgaaaagaaaaagggtgtaaaagatagttaaatgctcatcagcctgaatcaagaaatcaataatgtctaaacttgatatatcaaggaataaatacggcatatgtgttatacaatcactcacatggcccccactgtctcctttctgaaggcgctgcctataccctgggctgatccaccaccccactgatcacttttgccaagctccccagctggctggagttaaggtgaagtctagcacttggatggcccacacaagccctcgtcccgtactgagcctgtccatgcaatgcaacgcaacaccacagagtgtgggataagcttctaggaggtcacccccagatggcatgattctgaactatggaagagttagctccccatagagtgaactcagactaaagagaaaaagtagatcagagcaagccaagcagaggaacttctgtccaagaagtatttgaaggcggggctactgatcacgttccatggtgacaaaaccacatgcccggttgatgtgcttgctaagcatccgtcgtgtaatgtattacgtggccctgctttgcagctttccctgcctcacttctcttttttcttaccttcatctacttgggcttataccatccaaataaagtatcaaaacattaatccctgagtttaatctgtttttagagaatctaggccaagatagcatattatttttaaatatagagatgggtatgtactgttgctggagaatatgattatatgattacagtattgcaagaatgagaagaaagattacttaatttcttttatatattttctgatattaccgactttaaaaactactctccatatattacttttataaatgaaaattaatttaggaagaaaatatgtgatgattaccattacatgcattttaaattgcttgcaaaagtttatattgcttttgtaagttttccccatagaccaaagaaacaagctaacaattattttagtagtagtataataatgttgtaacttaaatctctgtagtcatacacatattatagatttttctaaaaaaaaaaaaaaacccttttatgaaaaacgaaggaagatgtcaccttaagatcaatactttcttgtatcctgcttaaagtgctatattcttgaaatgacagcaagtgctttatggcagagtagcaataagtcaatctatactcat

SEQ ID NO: 33069 - DNA, 1096 bp, Bovine  19866881400039
atatgatattgctgatgcctctttactgctgctgttggaaactatccaggaaaagcacattttcctgacaaaagacggtagtgtagtagaaatgaaaaagaaggaaaacacttattactaaagaactcccattatattctattattacccatcttaagccaagaagtctcatgtagacgatagagatcagtacactttgcttacgacatttaagaaccaaatgttctttattttgatttagtcatttgtgagacagagatgcagtgaattctacagaacaagtagttaataaaattgactccttatgtaaattaatatgggacagacaaaaccacctgtatactactgcacatgaaaactattcacataaaatcagtaatttttgttttgggaaaccagaggtaccattcagattcgagtgttgagcacaatcatttgatcctgtttggataatatcctcacatgccttttattgttcaggcttaaagaatccctgcagactacctttctaaaggagactatgcattgtgatgatacaaacagatgtagaaacagacaacaagacggagctttacctgaatatggcccttctgcttgtatctgtggctatttgcaagttggttgttctctgttagtgggccttagaaatgttatactgtgaactaggtgtctggtaactttcctcaggtatcctttgaaacgataaccaaagcagggcaaccatctcatggtggcaacagtgactctctgccttagagtgattactcacagagtaggtagtatccctcctaactcagaccatgcacagtttaaatctgattgagataagccacataggacccattaagccctacattcttacatagtacctattagcattcaaatagcttgaattctgcaaagtagtagagaaaacctcaggggctgacaccagagctgccagaccaagaagagtaaagtacagaaagtgatcaggcctgttagacaagaattttagttacgagagaaagagaaagcaattggaaaatacttttcaaagcctctttttaattgatccagacagataatagaatcaaactgctattttctaaagcaa

SEQ ID NO: 33070 - DNA, 1437 bp, Bovine  19866881599442
tcgcctgcccgcctggcccgttcggcggtctgagggggcgcgaggtggcgaggccgcccgggagccgggacggcggggggtgcacgcggcagacggcgctgggcatcgctgccctcgccccacctgtcgcctttgggcccggcggaaagcggagggaagggcttcccgggcgggcggcggtcagacctggaggaggcgggccccattgtgaagctgccaaactctctagtggtggaatctgcgcgtctctgccagagaggagatggggagcgcggcggggacgagggccgccggcccggccccttgcaggtgttccgcatcctcagggtctcggtgctgctccagccgcgccggttggcacccgggtagtttaccgattggtttctgtcgagccgagatgctcgagttgtgtctgtggtccgactggggcgctcaggtagaactggggctgggaactttctcatcattcgaggaaagaggaagaaatgcaggcattttatcgtgtgcttgctactcgtagccgaaagagcagtttcttgcacaacgtgtctgacgtttctagacccttcattttgtattgtttttctcagatagccacactgcagtttagagttgtaagttgccttatttatttatttttttaaccctgtggagcagattggacgctagggaaatagaaatgacctcttccccaagtttattttcccagtcgtttcaaaatacagtattggttattatggtgaagctttttggtactttcttaattcaagatcgtaatttatgcttacgcaattacacttaatgaatatttgacagatttctcagtgttttcattatgtaactgtgtatgcattataaactcaataaaatgaccagggcataatacaaggattaacaagcccaaagacctcttgctttgataagaactgctgtttagaatatgcttctgcctgcgttttaggttatttaagtgtaaatgagactgttaagtagtaactgttccaagatgtaagctagaaggtgtttattgaccttatataatggtcagtgattttgtttactttctgtgtatcattttgtatactttgaagagctagtgggcacattaacccttaaaagtatttagtgtcgtgggagtaacacaacgttacatacgggatttttttttttttttttccttcctgatttatattctctggggggaaatcggcttttcctccagagaaagctctgatttcctcacattcctatcaaaataagttcttggttttaagcttttatttggaacgtcaggcagttccacagtgtacacctgtcccaattcagttgtgtttcctgaaggggaaatttcttgtaaagactgcatgtagacctatgggttcggttactgtcagtcatatttgtagtgaaacaattctaaaagtagaaagatgattt

SEQ ID NO: 33071 - DNA, 1441 bp, Bovine  19866881761559
aatagcaagagaaacagcattctctcactaaaggtacacgtctacttcctcatttcagaaatgttaaaacaagaagaaaatggtttcttataataaaacagattactcttacctttttgcactataggtatttttgtaagccaactcaaattcttagaaataggatccattgcaaaactatagtaaagagcccgatagtgagttatttcagtttctgaagagaacagtcgtcttggcaggcagtcgtgtcttcaaggaggtaatttaccaagttgggattccttagtgggtcataaagagctgattattctaacaatatcttttctataaaagcatttagtgaccacgttgccgtggtcaagcaacagggtgtatattccgaaaataagaaggagaggacgggggtgagcttcagcaagccgtggcctttgctctggttctggagaacaaggcactggcctactcaccggacccttcggtgacgttgctggcgagcgaacttcctcccgcagagctggcccttttgccgtctcggaactgctgcctcctcctggcccactgctccagggcttcctcctgggagccgtcgctggccctttttccttttggagccagttcctgggataactttcgaagactgctggtttccaaattcccatctacattaaaccacatgaagtttgaaagtgagacagcacttcaaaacagaatttcaaatgttccagtctttgaaacagaaccactgaagactagaactagaatgatttcactcagttccttcctgatgcactttctcaacttgcattactaaaacagagagagtgagagaggaagagcaggaggaagaaacaggagagtaagaaggagaaaaaagagctgtatagactgaagagagatttacgtaggaaacgggaatcatcatgcatttcctcagtaggattcaattcaatagatattccttgggcagcagcagtatgcctgatacattgtattagtttgtgttagtttattagctgttttggaggcgcacaatgtaaatcaattgttaattacatctactgaaattactgtacaagatattattattattatctgaattagttcaggtatggtctttgaaaacaagtttactattgaactctcagttcagttcagttcagaaggacacagatttcatacttttcttgctgtatgtgttggttcaaaatgagaaggataaaagccaaattacatgaaggctttgatatttttatatttgaataaataacaacttgaaatactttatttacttccaaactgctgctttctgtcagcacaagctatgagactatacgttaattagaagtaagaaaattacagttaaactaattacaatacaagcaaactttaagaaaataattatcaagtgaaaaacaaactcatatagcagaatacataataa

SEQ ID NO: 33072 - DNA, 1388 bp, Bovine  19866881789380
ataaactataaatctttatatttaaatcattcttggtatgccccttttcaatgttttcatttccattagagtttgttggtataggaagcagatccccaattactttaaactgagattttacagttactcttaagcagatacattaagtctgaaggaaggatgccaatttcagatggcaatattttttaagtaccaagtaagaaagcaataaaaaagagttcgctttaggtaaaattattccaaacatttggtccaaaagaaaggtgactgcagctgcaactaaaattttaatgctggaaatattttttttaatttattctggtcattaggtattttgaaaatgcatcttctttctaatggaaaaaaatggcccagagagaaaaattaggtcacgggatcaataataaacacaaatatgttcatatgagtatgaaaaaagtttagaaatataagcattatggtcaaagttacaaaagttcagtaattagaaacactgtttctaaattatccaaggttattttagggtcccaaaagtacagggctttctctctcatactcaagtagttattcttaaaatcaaccaagtaaatttttctcaagaaacatagtattaaacatattgctgaagactgaaataaagctaggctaatcctatccatactttctggtgtacaaaacttttcatttctggagtgatcaaatgaaaagcaaaagaaaaaatgaaaaatattaattatttttataaaaagacaaagcaacactgatccactatgaaagaaatctgcaatttcttcatattttaattttgtttaaaaaaagagtaagggaaatatagcacattccaattctagtaatattttatttgtgcatcatggaatttaatcaaaaattaatttaaatgggcctccaaaaaatattataatatataataaaatacattttgaggactactaaaaaaaggaaagaataataaaaataagaggctactgtgccctccgctcctgggcatcacccagcatcagtcccagccttcccgggacacccttcccagccactccagcagggcctttgcctcaagccctggacacagattgaccgacacccagcggccagtgaaggtttaagtgctcaatgaggaccagcagtgggacagccagggcagcgggcatgtcatccaactatgctgagtggctgaagggcatgtccctgctagttagggcctgacaaaacatggccaactggacaagggaatggcaaacagcttcagtagtcttgccttgagaatctcattaactggatagaaaggtaaaaagacatgacagtgaaaggtgaacccctgaggtcgtaggtgcctaatattctactggagtagagccgagagatagcta

SEQ ID NO: 33073 - DNA, 812 bp, Bovine  19866881820346
ttttaattaatgaattttaagatatccaactattggttttggttttgtttttgttttttcccctcaggttttgaattgtattcgatggtgccatctatttgtcctctagaaactcttcataatgccctgtccttaaagcaggtggatgaatttcttgcttccattgcttctccatcaagtgaagttccacggaagacccctgaaacttgtaggaaaagtattattattatttgatttttagacagtagattttatctgaatatgaaataattatgaaaatataaattcaagtagtgatagtaagtagaattttaggggagaaaggggtatacaagaacattgtttgaaattctttggtataatgtgcagtgtaccacttgtcttgactctttccccaaattttttctcttaccaaaaggaggaagaaatctaagacccagaagtagaaatcagcaatatataatacaaaatcatagtcttattttctactgtcattgtatataataagctttttttaaaagacgggatattagtctgcattaatgcccacgtgttcatccattcaatacttttgactcagagctcttaactcagagcaaattagggcaacagtttttcaaattgtgttctgtaggaaatattctgaagaggttaattcctttgtgtaaagtaaagggattcgtggctaagccagttttggaaactttattataaggaaaactccatacccacattttccaaaacttatttgttgagaaaacattttggtaacacatttaaatattgtataaaattattctcaggaacttcag

SEQ ID NO: 33074 - DNA, 760 bp, Bovine  19866881853689
ctacactgtagacctgaagattttttttttttttaaaaggttgaaccttgtggatcaaagatgaggcaggagatataagatggattaaagttaaaatgaagataaattcctgaaggcaaacaaaggcatgagaagatgcagagagctttcaaggttaaatagagtgataatctcaaaagccaaatgaatttagagttctattctactttatcacaacctttcacaaataagaccctaaagagatacctgggtgaatatgatgagctgctgcagtagctcaccacagaaattccatatctatcatctaattgcctctttcttacaatttttctcttatgttaaaaaaaagactcattttgagattattttaatgaatcattgatatttgggtcatccaatataatgtgtatattgtttttcagctcacatcattggctcttaattgtaggcaccattttttaattagagaaagaatatttaagttgtctgaaagtggttaatgccctgatatagaattctgtgccaaagtagctggattttgagtttaaagtctctgtagaacagctagtttcactgtggtgttagctgaagattttcctcctctttcattaatcttttcctgtatacttgctgaatgcctttagatcactcatgacctggtcactgaggaacttgccagctagcagttgaccagtatgtgtcctttgttttgtattctggatgatctgatgggtcgtcaggtcaatgcccaactgtatta

SEQ ID NO: 33075 - DNA, 1142 bp, Bovine  19866881854000
ttgagttttccttccgtaaaaccgtgctaatcctacaaggagaaaagcattttccaagatgggcactcagtcgacattcctggcttgcgaaaaacaatgatttcatgtaagaggctgccaggtatgccgttgggctttatattaatttgtgagacattcctttcattatgttccctgttcaaaaattatacacatttgaatcaaagcccaatgacagtgtctagtaactggaaaatatttatttctccttggaaatcttacctgcttaattacccaatcttttgggaacacagccaaagcctggagtgagtcttttgttgtaggaagaaaagaggagaataatttggtgccgaggggaagcaggtcccttacagctctcgtgggccctcttgtcatgtttggagttcccttgcaaggcggcccgttgtcatgtggttctgtgtcattagagttcacatcagaggataatccccagataaatcccctgtactaccctacttttttttcttctgctcgcagatattcatctccaacttgttctgacttgttcatattctgggagtaatggggtgaagttaatataagacagttaactctctcaattactcagaggctaattatccaggctattgattgcacagtccagcctctgcttttcctgccttttaaagggtggttgactgccccttagcactgaaaccagacaagagtagggggtggagaggtaaagtcataaaattcaaatctatctattttgcagcttattagcactagctaagagcttaggtgattggcaaaagtgtggtttggagacacctgtatatttaatttagccttacttttccttgtcatctcttaccatggataattgagttggctgcattatcttatgttcatatggttaattctcagaagttgggtttttattgctttggagcagtgacttaattggtacttaagacatctgaaggaggtagggttagctatacaaatttcattttttttttttaaataaagaaaccgagactaagtattcaaactgaaaaatggcaggtggaattgtgggctagaggtggaattgtgggctaaagtgctttttcactcttggtctgagttcaggatacacagataggaagaatcac

SEQ ID NO: 33076 - DNA, 768 bp, Bovine  19866882148560
tttaaaaagtacttgatagctgctacactggaagttaaacatttaaccttctgagattatttcatagaattttaatagctatcattttgtaccttttaatgactctttctcttcttattgccagcaaaacataccctgtgaatgttacaaggaaatcacttcagcttcaacaatacaatagagaatttttaagtaatttttcaaaacagcgataccagtaaaattttctaacaatacctttttaaaaatctttgccatctaacaatattctgaaaataatgctgtcactttataattgtgcagtagaaagatattgttcatatttcctgtttacatttttcctcattcttctgtgaattatgagtcaaaacccagtttaaaaaaaaaatctataaaatccaatgtaaagctctaaaatatgataggttttgactgatatataatagcaatcatggtaattttcctgaaccttattgccagttctacatagaacaaataaacatttatgaaaaatataagtctaagaaatctgcagtggaatggatactatgatgtaaatcctaaaaggtctagtggtgatatattttacttgtggataaaattatagcttatgcatttgtgtaaaaaaaacagtaaagtgcctagaattttttcaaagtgaaatcagagactattagagtgtattaaacacagggaatgacatgatttaatttgtatattttaaaaatctggctgctatgtaaattcaaagaacataaatttagaagt

SEQ ID NO: 33077 - DNA, 1340 bp, Bovine  19866880598003
ttgaggtttgacagaaaacaacaaaattctataaagcaattatccttcaataaaaaaataaattaaaaagaaaaaataaataaatcagaaaagtggactttgacctgatttggcccatgagctgcagtttgtcatcccctgttccagacttgtgatgaactatccacagaaacacaggcctcacacagccacccaaccttgtaacacacaatctaaccgcaaggtaaaatattagaaagggatctgtaggtagtttttcctcaacatggctggatattaatattcttgtggcagaaccagtgctctcattggcattgttttactctacaaagtgaataattcaagtcaaactcaataaagttcttcttgtttcaaataaggggaaacagtggtggcccatcacattttaaattttcctgaatttactctcattaaaaaaaaaaaatctactggtcacttctctagacctctctctgtcttctctaagccaaccagcatatctcaggtcttatcccacatggggccctgccaggtgactgcttagtccattttgatggcttccacctcccagaaagttacagtccaaagcccacttttaaggaagcagcaccaaatggcctgtcttttctgggatctgcacaagtttgttggcatagttttccagctctaagtacatagaacagttcagctcacatgagtgatccttagaccttggtggacctctcagacacgctgttgcaatgagcatacatgaaaggtggtttttgtttatgaaaacattagatatattttttaaagcatagaaaatgtaatgaacaccctatttactcaccacctagcttaataaacaaaatattatagatctattcaaagccctttgtatacactttctggatctcattttcttccctttcttcccccaaataatctttatcttgaagatgatgtgttctttgtactttcactacatatgaatgtatttttatgaacatattcctaaacaatatataacattgctttgcatgttgatatcctttgtatcaaagatataatatgataatttttttcaagttgaatccatagttgacacatgtactgcaagttcattcatttgctctatttatattcttccattgggtttctctggtgactcagagggtaaagaatctgcccgcaatgcgggagacccggattcaatccctgggttggggaagatcccctgaagaagggaatggctaccctctccagtattctgccctagagaattccatggacagaggagcctgtcgggctatagtccatgaggttgcaaagagtcagacacagttgagcaactaaca

SEQ ID NO: 33078 - DNA, 1466 bp, Bovine  19866880694998
ctaaaaataaaatagaaaaattataatgatatactgtaataaaatttatgtgaatgtggtctttctctcaatataaaacctatgcattctttatttctagaattttctgttaaatattttcagaacatagtccaccataggtaagtgaaatcttagacaactcagacaatgaacctgtataaatatggtgcttgtaatttaacacctagcagttagttagctagctagcttctttatctatttaaccaatgtttggaggactttgtatgcaagggcaccccagaatcatttattaaatccttgtgttactgtcctagatacggcataagtttttttaaaaagcaccaattaacctctctatggaaacttctgtgacattcccagtatattttgatattgcaagtcagagttggacaaaatattacttttgtatttttcatactctgagaaaagtccttagaactccatcacttgatgaagcttgccaggagcagaagaatcactaagatgtggatccaaagcctgacatgctgagcttggagctgctggtattattcaggataggcaagatgctgctgctctacctaacaacccccagatgttagagcaacagaagtttatctctcatgggacagacccatctcttcatcctcttcctctgaaaaatctggctttaccatctagaaagtcagtcaccactgccaaagaaagggagaagatggagcaccgcatactggatcttcaacacccttgacattccttctcacgtttcattggtcagagtcagtcccatgggcacatctcacttcaagggagtggagaagtacagtcctgctggtggtctggaggagccgagctgagtacttggtgagcagaaatcatatccacactcatcttcctctgggtttcttattatgtgacaccatagctctccttatcattttagccaatttcaggcagtgttgtctgttatctatggccaaaaccatgataactgaatgctgctgctgctgctgctaagtcactcagtcatgtccgactctgtgtgaccccatggactgcagcccaccaggctcctccgtccatgggattttccaggcaagaacactggagtggggtgccattgccttctccgaactgagtgctagaacacccaaatctcaaaccagaaaaaaatcccctatataaattctatatccagcaaaacatccttcagatatgaaggagagatttaagacattctcagataaataaaaagtgagagaattggtcactagcagatctgccctaccagaaattctaaaggtggtctttcaagctaaaatgaaataacatggactataactgaaatcaacatgaaaaaatagagtactggtaaaggtcacgacataggtaaacataaaagacagtttaaaatagttctctagttgtaactctcccatcttgttggttgtaacaactgcatg

SEQ ID NO: 33079 - DNA, 739 bp, Bovine  19866880798576
tcacttaaacaactatacatatgaaaaataaaagtatctgggcattttagttaactgtgggctaaaaataaatcaataatatgacatggttgcttaaaaagtctaatgcaattttagggactataacagactttcattatccagatctagaaaactgattgttccactttactatgtgctatctaaagcataccttgagtattatgttaacttcatttctgcatgacatgaattaggagagatagttaccaatgtaagggagactatcagggagatacagaaaaactatgaagtagctgagacagatttgtttcaaaaaggaagacttaagggaaataagaaatttatcttcaaataggtaaaggcaagagcagttagaattaatttatatcctttcaaacagcactaccaggacctccacagtcacaagggctaagagaaacaagtttcagctcattataaaaatgttctaacaattcagttgtggagtaggagcagagtagaaggcaattaatatttactgtctataacatgccaaacccattacctacttcacagcaatcctgcaaggaagatattattgttcatttttcagaggagaaaatggaatctcagaaatgttggataacttcacctaagattctacagcaagtagaagcagagcaaggaataagaatccagcttacaataggctcctaacttgatttccatacatccagtacgttcatccaataccagt

SEQ ID NO: 33080 - DNA, 2022 bp, Bovine  19866881219130
aactctgaacgcactgcatgtagtagacataaattctctgattagatccatctgacagctgaggaaacatgttcaaagaagatgaatgacttgttcaacataatatagcactcagtggcagaacagatactcattaaaatctcctgattcaggaactcaaaccagggttctgtgacaacctaaagggataggatggggtgggaggggggagagaggttcaagagggaggggacatatgtatacttgtggctgattcatgttgatgtatggaagaaatcaacacagtattgtaaagcaattatcctttgattaaaaataaattaaaaaaaaatctcctgattcttaagtactcattacctaaggaaacactacctcaaaacaattccattttgttcatatatgataaaaaataatttaagcattttaggagccaaaataggttctatgaaagagaaaactctttctacattgttcttttgaattaagtctgtaagctaccaaaatatgaacttcaacctgaaccaagcacttatatgaacttcaacctggaccaagcacttaattttccaaactctattattttttcctgaactatgacatgtaaaaatgactatttattttctttttaaaaacttaaaaaaaataaaagtcacacattaacctattataataagtctactaatccttaaaatttgttaggccagacaacagtccctattcttcttccctcgctccatctttccttcctattaggaaaacatttcagttcttttcactgattcttttcctgcaaatcttaatatctctaaatttatatgcttgtattgctaactcatgaaatttcagtttcaggcatatctatctaagtgactatttggaagatgaaaatttggtattcttttccctacctaccacaaataacaggtgccctccatctttccaaattcccaagataattacatttagtccagatcggggtttacattattataacaataaagtaatctttattatttttcctttgctatttaactttttattttctctgaaattaatcatcggggttcgcttactccttggaaggaaagttatgaccaacctagacagcatattaaaaaacagagacactactttgccaaaaaaggtccgtctggtaaaggctatggtttttccagtggtcatgtatggatgtgagagttggactgtgaagaaagctgagagctgaagaattgatgcttttgaactgtggtgctgaagaagactcttgggagtcccttagtttgcaaggagatcaaaccagtaaattctaaagaaaatcaacactgactattcattggaaggacttaggctgaagctgaagttccaatactttggccacatggtgtgaagagctgactcattggaaaagaccctgatgctgagaaagattgaaggcaggaagagaaggggacgacagaggatgagatggttggatggcatcactgactcaatggtcatgaatttgagaaaactgcaggagatgggggtgaaggacagggaagcctgctgtgctgcagtccatggagtcacaaagggtcagactcaacttagcaactgaacaacaatgtacgaaatatagggacttcccaagagacagtggcttgcaatccaaaatttgttttctttttatgttttatgttttctttccttttttctttttatggttcatatggctactcactgaaaatatttgaggcagcaaagtttatttgtcaatcatctctctggaattgtctttttttggttgtattaggtctttgttgctgctcacaggctttcttagttgcggtgctcaggcttctcattgcaatggcttctctccttgttgtgcacaggtttagttgctcctcagcacatgcaaccttcctggaccaggaatctaacccatgtcccctgtatcggcaggtggattcttatccactgtaccaccagggaagtcctgggaaacattttcttgtagaaataatggcatgtgtgtattga

SEQ ID NO: 33081 - DNA, 767 bp, Bovine  19866881264321
aaattcaaggccaaggtgaatagaatcagccagcagatcagaagcataaaactctgagtactaacccctcttttttgctcctttaagcataaagtgattgtaatgaaattgagagagataagtcaagccatccatgtttatatttactggggcagtgatgttgaccctacttgcctgcagtagagattcaaaatcagatttttctggagttcaaaatagagctcatcaacctggcttctctacagccactcatttgctctggcagtggcagaggaaaaggaggggtgaaaacaggtgggtgggtgggattcaaaggatgactcatggcttgcagcctttgtcccaagtgcagcctgtggaaatcacaaatgctgccaggtggatcactagttctggagctgactgtaaccatagagacagcacttctatatttcaatcaaagacccagaggcttccagtccctagaatatatggtggtaatgatggacacactgcagtggaggaccccaggaaagtcaactattacatcaacccaggttaggtttccagacatactggtttctcttttccacggctatgtcctatttgtgcagggctaatgacccaacagaaggaacaaaaggataagtatatacaaggctatactctggcccttaagttccagaaggttaagagtttattggttaccaatgttcatcgcagcactgtttataatagccaggacaggaagcaacctagatgcccataagcagagaaggataagaaag

SEQ ID NO: 33082 - DNA, 1861 bp, Bovine  19866881295080
ctgaaaatatttggatatttctggaaatatccagatagtaaatatttaggttttacaagtcatgtggtctccattataaccactcaactctgctcttggctgaaaactaccatagacaatacggaaacagatgagcatggctgtgttccaataaaactttatttaccaaaaccttgagtggctggatttggcctgtagactggaatattcaatatctccagttttaggggaatgaaaagatgttttgatttgctttattttgctttctctttttctatgtggctatcaaaccagtacaatatgtattgtcatcattcagcagttcctaacctgggataattggatttgggaatgtccttaagcttttctcattattaaagtttgatgaaaacaatctatttatctagcatgaacagtcttaactgaaatgtaagtctcatgttttccctagactttccccagtttctaagactacagtgtatagaagaatactattggaaggactgatgttgaagctgaaactccaatactttggccacctgctgcgaagagctgactcattggaaaagaccctgatgctgggaacgattgagggcaggaggaaaagggcacaacagaggatgaggtggttggatggcatcaccgactcagtggacatgggtttgggtggactctgggagttggtgattgacagggaggcctggagtgctgcagttcatggggtcacaaagagtcggacaggactgagcgactgaactgaattaatgtcaaaaattctttaagagtgaaaatagttggaaacaattttcttaattaggtagaaccttcctggtaaaatgtgagagcagactccttattcctttccttcacccagaactattttacaaacattattatgagcattgtgctaaaggtttgatgcaaacattagttcatatacagaatttttactctcagaggcttacaagacagtgggaagactcagggaccagtggttaagaatttgtagactggagcctgagtgccttcttcaaacacaggccccaactttcaatagacatataatcttgagtgagttactcaataagttacacatattattatttgtgcctccattctctcatctgtaaggggtaaataacaatgctatctatctatctctatatatatatatatattcaatgctatatatatatatatattcataaaactattgggaggattaaattatcactgtgggctggcactgtcatccagataactatttgtactgggggctgtcccatgttttgcaatatgtttatagcagccctggcctcaatctgctagcccaaccgtttctatccttcccaacctgaatcctttctatctttcccaacaatgaaagtctccagatattgccaaatgtcccctgggagtaaaatcacacagctgattgagaaccactgatctagcacatattaagtgttcaacatgtactagctgttactgtatttaatcataagctaattttgaaggataagagaagagatttctcataggaggtaactcttgcactttgatttattacaaaatcccacatataaaaagcatgcaatacaatgttttgctgacattaaaccagtcaacggtaacttctctttttcctccccaatctttaatattgccttgaagtgcagtccctctcagaatacctttttaactttattgccaaggacttcatttttaatttcatttttatttttccctttctagcctattagccaactctttcaaccctcagttaatcttattgcaggtcatttacttggagggaacggtttcttgcatggaataatgtaaaaaatagaataaatccact

SEQ ID NO: 33083 - DNA, 978 bp, Bovine  19866881302080
ccctttacctcaccccaaacagtgcttccgatccccaaggccaaaaagggaaaacaagccctcctttcacagacaggaaccttaaaggatttaacaggaagccaatggccatctccttgttacatgttctgcaagattaacaatcatttgactgtttctctacttttccttaatgacctaagcagttcagttattaagtgataaatcctctgggtattcatgagcagccagtttaattcaggagcccaaactgaaacaatcaggataattgaggtatctcggaaacatgaaggaagtcagccactgtgcagagcagaaaacaaactcaaccagtagcaggagccttgtcccccagaaagaaatgctgaagcacaaagccaaatgggatggaagggtgcaaactttaggaagggaaagtggaagacaaaaacaaggaaaagaaattccagttcctcctcgtcaccctcccactccacttttggcttgtatccaggcaaccagctgaaaccagctgccggatatactcctagagcctcatccgaggtcccaatcagctgcaggaggcgggcagaggaaggatgtgtgacaatctggaagatcaccctccaactcttgtcccttcactcactgtccaccccaactgacatctgttttctgaaaagaaatacaggagggaaagaaggagaaaatttgcgtgttggcattcagctttttcttttgtagactctggatgctgagtgggcttgattggacaagcagatgatgtttggatgatggacttctgagtctccatcacttgctgggcctattgtacaaccagatgcccactcacttgctacagaagattgtaccaagctcaatgccttcgttgtaggctgcagacctgtaaaggtgtttccattatttttctagagaatttgttgttgttgttcagtcgctcagtcatgtctgactctttggaccccaggactgccgcag

SEQ ID NO: 33084 - DNA, 886 bp, Bovine  19866881787573
tccattgtggagtgggacgaaaagattagaaattctatttatgatcttttacataaaatataagaaagtactgacactccattcatatttaatgtatgcattgaccctggtgctcccatttggtctatgtcagtgggtcattgtcgcatactctaaattgagggatcttgaggaaagtctgagaaccacgatttgctgggagttgatggtggcacactacttctttcagtcacttttgcagtatgttgcagcgtatttcagtttacgagcctggttaagtagatgcgtggttcttagtattatcttcaatttgtggtttctttgcaggaaccttcttaagccatttgactattatgcataggttggctatagctagttaaagccactcagggtagacaaatggcttaagaacattcctgcaaaggaacagtggagtgatgataatagtcataatataagcacaaagcaaggacaagaaaaaggtggagctagctgccacttctgcaagtcaccttgtaaattggttggccaagtcatcaagtgaaaatgaatataatctaattggacctgacaagatgtcagccccccaaagaaggaaattatcaagaacattatttgaaatatgtatttatacccactatgttcaacagcaaacttattctaagtctgtactgtgctttggatatattcactgtacgtgactgtgatacatactttgtaaataaatatacatattgaggatgtatgctcagacttcttttactgataagaatgctcaatcaaaacagtttggagaccactgggtgagatgaggaaagcatggagcttctcatctctcatcctgtgtctgctgcttagagagtgtttacatttttttcctaaggat

SEQ ID NO: 33085 - DNA, 2429 bp, Bovine  19866880365186
atttggcccactggcaaggaaccagtctcaaaggcaggccccagacccccgtcctctctaggcactgaggcaactgagaccaagattccaaggggggaggcctgggctcgccctgggcccatgtgtggcacttgggccaggcctgagctgcgggctttagcccccactggtcttgttgttgcttcccccagagagtggtgactccaaagagcaggtcacgctccaggatacctgcttagccatgaaaggcctgttggctcttcctgggcacacttcacatccggtggggagcccaagtcgagaacagcctgctccccactgccaagccaagggtgggcctgcctgtgacacctcccccacgtctggagtccgagtctggcccttgcgggtctgacagcacataggccacgtgggctgcaactcacaggaatggcctgcacattccttccccaaagaaggaaaagccattcacatgtgaggtcatttggttttcctggcacgaggctgagagccacgggccactcaattccatagagaacttccccacatgacaaggctcaagccctgcttggtattcataaaatatgggaatctgtggtctggccacctcaagcatctaacctgactcctctgtgtggttgagctgtgactctcaactttacagcctgaagccttgatagtcgcatccatgaaatgggaataatcaatccaccccgtcctagagttgtgataagaattaaagagcacagtactggactgatggtgggggctcaaaaagtaaaatgcagtacagttagcgacccctctctcgccagggtcatttctaatgagtgtgctagctttgcttactgggaacaaagattctgcccgggctccaagcccctcaagggggagcctctggagatgccaaaccacttattacaaatttgcagaaaagaaagagacactgcttggatcaaaaaatttcccaagtctcttctctgtgtccctgaataacccgctggactggagcttctgttctggcctgtcccacagttcacccctgggacccctgccctctcaaggcatctcctttggcacagggtcaggaactctgacctccagaggcttggagctggaggcagcgggggcatcagctctgcccaatgctttcagggacttgggaggggttcccgagaccccagacccaatatagatagccactgaacctcttccagtgagcaggaaaccaccgaagagaggccaaggcccaaagtctgagcttacaccgatcggctcaatgacacaagagcagggcagcaaacaaacggaaaaatgtggagcagagtagctccatgcagtgttctcaaacttgaacatgcattagaatcacctggagggctcgctagagcagatttacgcatccctccagacttctgcttccatagttaacggacaggtggagaaactgcatttcccataacaatccacctggcgctgctgctgctggcctggagaccacactagggaccatgggcttcatgcttaagaggatgcgttcgggggcagaagacttggatttggtctgggtctgccacttactaacgctgagacctgagcaaattcttgccctttttgagcctcagtctttctccctgggctgttaaggggtttccatgagctaacatttgcaaaaagcttgtgtgagtgcactcagtcactcagtcgtgtctgtctctttgcgaccctatagactgtagcccaccaggctcctctgtccatgggattctccaggcaagaatactggagtgagttgccaggccctccctccatgggatcttcccaacccagggactgaacccgtatctcttgtgccttctacactggcaggcaggttctttaccactgtgcacttgggaagcccttgcaaaaagcctagcacatgctaagttgttaataatatctagagttccctatttaaatacaagaactaaaatacagatactcacagaaaggagtgagataatagaaaatgctcagggtccatggaattgcctatgtgttctagatggtcacctggaccatccaagggttacagaggttgcccgggtgcccggtgtgtgcctgagtctgggccagcacgcaccagccagcactgtgccccagtaatccctggccctgggctccctgacccaatcaaggacatatgatcagtaagacaacctcagcccacaaacccacacctccctcccaagggactaccacatgccctcacaccgaatgtaagtagaaacaacctcccaaaagaaagttcaaagctccagggaacccagagccttcagggtaccagagatgccctaagcagaaagcaggtggcagggggcacaagctgagaacccagcagctgcacaagcattgcaagccacaaggaaccacgccagtgatgtgca

SEQ ID NO: 33086 - DNA, 2136 bp, Bovine  19866880384854
catatttagagacttgcaaagtggtaggttatttcccagtgatagaactggaagcacggtggttaagtgattgcctatgctccccaggtaaactgatagcagatcattggcacaataggagtgcgtagtcacttctagaatcagaaatgaaagagtagagccctatcctgctaagtcatctcttgctcttctgaggattgggtgggataagccccagggccagtgtatttctttcatttaccctgtcctgtgttgctttgtgcacggtggggtggaccatccgggcagcaggattgggtcctcccgagtcctccttgaacagcctcaggaatgggtcgtagttttctataggcttgctttggaagtttgcactgttttggcctacttcatgaatttcgtctttctcttcctcctctttctcatcctcgattttgggggcatattaaatgtctggttaatcagctgaacaccagtgtgggccaacatagagcagcttacgcccctcacacagcttccttttcccagtcccgtgctaagtagacaatcattggctgccatgttggagtctggacatgactgggccaccgcagtgcatggcccagtcccagggtatgaacagggtgtcgaggccttgctggatgaaagggctggagccccacgttgtgattctgggcacctctcatttcccccttctccgtttctgccgtttcattgccagcaggagtctgtttgaggcttctagagcttgtctttgtttcacctgggaaagtcccttcagggagagcgaagatctccccagaggaatggctggaggcctgacctctgtcacctgaattgtttagatgaagaagcccccagaggggttaggagggtgatcaattggaaacttaaggagcaaagacctctctctccctctcctccctctgctcattgtgctcagaagggcagcggggtcagcggtagcaaactgaagggccaactagccgcgccttgaaaggcgctcgttttgtgtttcagtaatgagcgctctctttctccccttggatgcactcagatttcacgagttacagggaacctgtcaactgctgttttcattgtatgggactcacagggaacttgggtatagggcaagctcgtttcaaagagagcagggggaggaaaagtcctgaatagatgcaaagtgctgtcatatgcagatcacagccccagttgctatgggacacctctgcccgcctaaaggacgagacgctgaagtcctgtgttgaggtggctgcttccttggagatgggaatgccactgccgaaagggcacagccagcaagcctgcactgcctcaggctcccgggtttgccacggagcccggcttaacacggcttggatcccagcagcctctgccccagactggctctgcagtcaggagcctctcactgaggcctgagggaacaggcccattaaccctggaggagtggagacaggcaagtagaaagggggtctctttaagggccaccaggtctctgctcccagatgagccaccagagcccatggacccgaactgggacctgatgtgaaaggcaggttttcaccttctttgtttgccatgccctctgagaacacttggcagtaacactgctttcctgatgggttcattttgtagctggcagacattgttttctttcccctgtttacctagagtgacccagggtaacaggacaggccgtgcctaaaagagggaaaagcgggcctgccttggctccccacacccaggtccttctgccctgcatccacctatggggacagggacgagcccggggactgtcctgcctggagtagagaccagagcaggacctacagaggagtccaacactatagaagtgcccagaattaagactctctctataagactctctctaaggcgtccttcacctggaggtccttggagtgaaagcatctggtagagctcatggtaggacctaaaagaaaccaggggagagtcctaagggaaatgttgccagcaactgtttactgaacaccttactctgtctacaattaaagggccaaggaatggccctgtctctgggggagtctgagtctgagagctgtggctaagccaggagttaggggccagtgcccttggcaa

SEQ ID NO: 33087 - DNA, 750 bp, Bovine  19866880437219
aaaccccatttaaattttatactctagtatctgcccttcatttctggcattctttgaatctggtcctaataaaggtgattcatatccatagtcatcttttgagagggtccatgtcttaactgtctctatatcccatcaccacccctgtcaccaaccgttggtgttaggatggtgccttctacaagtttattggagagaactgaactcagcagagacactgttaataagactgagttagagacaccatgttgcctggtcacactgctgcccagtaccatcctactgaagatgttactgaagctgtcctgcagttctgctgaactttttttaaaaagaagtcaaacagatgcaattttcaccttctaataccccagtatctaagaaagagaatgacaacaagccaactgcttaaagaggagcatgacagtaagggtgttctgtgggcttgatgtatgaaggtggagggagtgagatccctggggcagccatcacttcccctttgctaaatcaaggaaaccgtctatcttcacttaattctatttacttaacacaagcctaaagaaaacttgttttactttatccttctgtctcatggttgccacgatataattttcaaatgaaatttctaaatgcagaccacacacgatattccagtggacctaacattgatttatgctaaactggggtgggggaggggagatactctgaagaaagatgcttagcccagcagttttctgactgccagccttt

SEQ ID NO: 33088 - DNA, 2833 bp, Bovine  19866880441533
cctaaaggaaatcctaaaggaaatcaagcctgaatattcactggaaggactgatgctgaagctgaagctccaatactttggccaccagatgcaaagagccgactcataggaaaagaccttgatgtgggagagacagaaggcaaaaggagaagagggcggcagaggattagatggttagatagcatcaccgactcatcggacttgaacttgagccaactccaggagacagtggaggacaggaaagcctggtgtgctgcagtccacggggtcaaaaagagtcagacacgacttagaaactgaataccaaccaaatgctggatggagagggaagacagaagaggcacttgtggtaactcattcacttcaaggggctctaacatcagtctttactgttcctctgtgtgctcccaatgccgcctctccttttgcagtatgcttggcacacagcacagaaaccttgtattcctgctaattgctccacgtgcatctgtctcttccatgcctttgtggacattgggaggtaggctctgatttaattcctaccctccctaacactggcagatttgtcaagccattcccctcaataaacttggagaataacagttggaacagcatcacaatatgctttgtggcttggcttttgctctttcacatgtgattgctgatgtcttttatcatggctgccagggaggttacaactgcatggatggaagcaagcccccacaaaagtgtgagcccgcaggactccccaggctcacctatggacttgtatggacgccagggtccatggtggagaggcagggctgcttctgtagaacttggtgcttattcagggtgcctcctcattatacctcaatcttctaacgagacctgggaagttctggtgcttcacaatctgagttcgagccccagctttatctcttattggctgtgtgatcttgttcgagttgcctaacctctctgaacctcgagttcctcatcagtatagtaagaatagtaatattcttcatctgtgggttgcctggggattctatgagatcctgctagcaaagtaagcattctgctccatggctggtgcctgcgggtgctcaaggaattgttggctcctactgtatgcacttccctcaaggcatgggtaggctgtggatgtgcagttatctgcaaggtcctgactgatgtagcaggagtggtttttacttagaaaaatcaacaggaatgatggggctagaggagggagactcacctgggaatgaaattgcccagggtgatggatgttccagtcatctgctgcttgggagatcaagcaggacccatacgacactgacttgattttcctggccgaggtgctcacatgtgccccaccacccagaactgccccagcattccatgagtttcacatggccctgggagccttggctcctcttcctgaagccagggatagacttgcccccactaatccccccagggtcattcgcagggaattgcctggcccaggtgccatagagtatttggagctggcgcgggagggaattgagcttgggggggccctagagcctcgggaagcattttggttccatcccttgatcgaatttcaggctccagcctgtggacacgtcaggagcactaggcgagctgtgacttgcagtctctgctccttccttatctttcctctcagtgtccccagcccatagtttgtttttcaacctccaggaagatggggcagatagacagctaccaaaggagaccatgttggaaggcatttctgagagggggcagcagcgcctgcccaggattataagttagccttggccaaacgtgcctgcggtgtagagcggcgcgtgagggacatcagcgccctgtcctcagggtccatcaagtgtttgctggggtcacagtgcctttcccaagcagtgcatcgtgttaggccacctttcagaaggtcctgtcagggaatcgttctcagtatggagtgcgttctctggtgagaagcctggccttccacagggagggtcgttttcctgagaaaatgccggctttacctcatctttcaggggcctacttcctgaccaacaggctctagatacgtgaagctagagccctgtgtctgggaaagattccaaaactctggtgttttcaacggttatacttactgtaaatctttactctccttaaagtagtttaacagaaagaagacattcgatcctcctttagtacatctcaatagttcattttctctgtcatctgaactcaggacatagagaaataaaaccttactggacctagtggtttatccatcatattctattaccttctaagaaggctgccctatttgcatatctgatcagttgaggaacacctggttaaactatttaggtgatgacaaggttaggattggcttatttcctttctcagatgcaattctttgggctctccacccagggtcactgctcatccacatggcacctatttgcaaattagaacaagccaccccttcccctgtgtggatgtagctatgccagggggcacagcttggcaagcagagtgagggctggattttagcccctgctttgtgcagtgaacagcctgtgcaactgtgcatggtggccctgcctgcgcatgttgtcactagttcagtttcttttcttggagaggtgtttgctggagagggagagggaagagaatgcctattgctgtatgttagagacaggttcctggaggcccaagagcagcacttgaatgcaggcatgttttgagagtttcagggcattttccagtagggtgtacttttcctgggacagagaacccagtctttgaagttaagacagacctgggg

SEQ ID NO: 33089 - DNA, 955 bp, Bovine  19866880456433
tcccttacacccctgctgattgagctcagctggctggctctcattcagaatctcttgcagttagaatcaaatggcggctcctgttagagtcatctgaaggctctactgagctagacagccacgtgatcctcactcacaagctggcagtgatgtgaatgctggtggagagctcagctagggttcttgacaagagcacctacctctggcctttcagtgtagcctggacttcttacaggatggtgactggcttctagaggtagtgtgtcaggagtgaaggttctaacagacgcagcagagatcacaaggttctcatgaccaagtcttaacagttccaggatgtcactcccaccatattctgttggtcaagcaagtctctatggtctgcccagattcaagaggtgagaagcagcacaccaaccctagcccaaaaatggttgagggctgccattttggaaactgtctaccacaacgtactgtagataaagataaaattcttttattgagctgggagagggagaggaaatgagctctgggctaaggaagtcgagaggaaagagactgtgtccctgtgtccagaagaaggtacttggccaagtccctccccacactgttctcttacctcacatcccaaggtacattcttaaactgtcctagactcagaacgtgaaggagagtggaaaaaaaccactgacatcatcctaactaagcagccttcatcgagaatgagtctgctacgtgactgttgccacaaaaccgttttatctgcccttgctgcagcgtggcctttaagggacacgatctggtgccagtgacatcccagtggtggttgccctggagacccagaggtcaaggatgatgagggagagtgttgccaagatgacctcacatagaaatctttttgctttcttgtgaccacctggtaactgagctacaaaggaaagagaaaaagccataa

SEQ ID NO: 33090 - DNA, 1185 bp, Bovine  19866880461648
agctgggactatccccaaaaggaaggctcagtaactgctggggccctctgccctgctcattctagaaagctataggagccagcagccacccctgtgcctggcctattcgcccaacaggcagccagtttcatcctttgtgggtcaccaggttttggagaatgagatgttaagacctttgcaggaaggctgaggatgcataaacataaaatccttgttcaaaggcaagtctctttggcatccttctcatgctgccgggtgatgaggaatgagtcttactttagggacacagacactaaagctgtgggcatgactagccctgagggatgcagggaaacattctcaggcaatgatccaggccttggtacttgggagcttctagtgtgggagatatcttcgcctcttaacaagtaggtcactattgctcctctgaactctattgttggattgagctgtgttggaggcaagatctggtttggactttgattcagggcaggagcatgatgtgaggtcagcgaggggtcagagatgggcctgagcttgatctctgcctcttcattcagaatcattgttctttactgtgctcttttctgaactcaccacggcctcagtacagcagatcccagcatgcagatatttcaagagcaagagaagacagttaattttatcttatttagaaacaagcctggatgaaggagaaataaacagggccattctctttgtggtttgctgagattccctggaaagcaagcttaggaggccagagcctatgtcagagcaggagagaccaacgccctctgcaagatatgtgcaaacagaaagggcttcagaactggctggaagtcatggagagggaagcaaaatttccagtttgggtccaagtcttttcaggccttgacctttaacctaaaagccagagaaccaaactgatctccatgatgaccatggctccagaggagacccatgggccaggagatgggggaaatgctagctttgcatggccagggtcacaggaacccaaggaactgccctcccctttgcaggataactaaagcaaagctcctggttcctcctcatcccaagaccttatcgtgcccttgtctgtgactttaatcattttgaaaatgaagtcccaaaaaggattaactaaggatgaatcctgtcacctctactctagatattccacag

SEQ ID NO: 33091 - DNA, 2067 bp, Bovine  19866880566038
gcgctgaaactctctgaaaagaaggaatcacagaaccgggccagatgcgagggacaggctccgactggcttctggctgcctgtgcatcacgtgttctcctgcctgagtttttctgagcaatgcctcggccacagactcatgagtaagaggtgcccatgagcctgtaaatgctttccatctggcctcttctctcagaggagaccagcaaggcgccttcatgagggagacacccagcccacccggacccaggatactctagcctggctgggaagcgttttactgttgttgtctgacaggggttctgttctgctgccactctctgctcatgctgggcatcagtggacgtggacacttgggtccacagacctgggcattaacccctatctgccataaactagcctcagtgcagtctctgactttgcagggttttgattccctcgcctgtaaacagggctgatacctcctaccttgttgttgggatgaaataagattcaggatgtgtaacagccagcatggtagctgcaagagagacagggaaacacgaccgtggctgtttcagagggtgggagcctggagccccctgcagacacaggagcagcccaaccctgacatagccctgctccagggcagcccgcaaaggcagccagcaccttgcaccccgagaaaggcaaagaaagccatccctctggcgaagcctacctcccaaggccaatctcaggagtggccagtgcctggggtgccactgcagggcaggagggagagacaacagacgaggagaagaaaagagggaggcagagagaagcatgggaggggttcataaaaagcccccatctgggctgagctgccccacctccactgctgcctcagcgctgggacctgcagggaccagagacagtcacttcctggctcctcaggaatgcacaggaatgtgtgtgtcaggagagaggtatttggggcctagggagggtggagacccagctccttctctagcgaggggttccccttctccaatcaggccgacttgccatcaagcagcatgccctggcagagaggaaaggagatggtcaaagtggtggttaggactgcaggctgtggctgggcaactctggcttcacaggccagaatgccacgcaagaacttgggtgtgcatgctgtgtgctcagtcatgtctgcttctttaagaccccatgaactgtagcccgccaagcccctctctgtctatggcttgggcagattatttaatctcaataatgcttaagtgcttctgtaaagtggagatgaaaatgtattagcacctagatcttacgggtggttatgccaattcagtgctaagtgctaacatcaggaccactagcatcaccagcactggtccctctgaccatttctggctccctcctcaactgcaaaatcagaagccggtgccaggaacatctgagcgtaagggcagccatgcaaagggcccacctgtctatccatcaccacctccacccagtagagtacagctgtcagcatgtgtgaaattcacctgaacttgaccaccacccacacagatccccagcagccccacctgccttcagagcacagaggctcacctcgtctatctgtcggcaggtgttctggagcccactggcaaggatgacttcagttgttgatttatatgtccccagaataatttttttacttaaaccagccccacaaggaatgaactcaaagcagtgtgtccttggacaagacagatcaccaccatggacctcagtctctttatctgatgtgcagaagctcaggtgacagcacgggttcccttctggttgggcctcctgtgatttgatttcttcagactgctaccagggaaaggatagagctgggttctgggagtaaacaaagtgaaacacaaggctgcccattgacaccagtcccttgggcagattccaggctgaaacccttgttccctggctccggcaggagtttggagtttcttctacccacagaacccacgggcaggccgcctccctcccaccaggccgtgggtcagccaagccacacaaagggctgattatgagtggccca

SEQ ID NO: 33092 - DNA, 805 bp, Bovine  19866880575427
tacatttcattctggaaacaatcccatatatatatatcaagagtcataaaaatgtctaacttttggtcccatcaccccactctaggcacttatctcaggaaaagacctctcaggatgcccttctttcctagaaagggccaagctcattcccacacaagtccttgcccttgttattttctctgtctggaagccggtccctccagacttgctcacggttggaagcccttcaagtctccgcttcatgtcaacgcctctgacaggttgctggtggtcactctctagactggctccatcactccgcagaatcaagtggcacagagtaggaacgtacatttcgagttgagaggagaaatgtgcagtcgtgaagccaccaccagactacttagatagggagtattacctgactcactttggaacccaggaagccacttctgcaaagaaactctccttgcagggggtttcaagactcttaagatactggcagtgtgggaagcaccagccaggggccatccggtcctttcttccagcatctgaaaggctgcctttcagatgtagatagtgcatggtgggctatctgccctccctctcaatcctgttctttcttggcttctaaaacaaacaagtggtaaagaatatctgcagggtgagagtctctgtcaaaacaacacctagtcctacttaattacgatgaataatttgaacactctcaaatcagacaatggaaacattaagagtttccacaaaaacagaaagttggccaagtgggagggagccccagaagcctccacagcattctgagttgggg

SEQ ID NO: 33093 - DNA, 626 bp, Bovine  19866880614663
tggttttctgtgagttgggtggggaggatgcagttaaacttcatttcagatgcatcataaaatttggagaggcaggcctatggcctctgtgagcaagtggggtacggttggctgctgcagcggctcctctgcggggtggtgtcaatttggagaggtttccaagaattccgtcactcctagtagacaggcagcagagggacacagtcctgtcccacctttcctcggcctggtctctccaattagcattgtgaatttctcctttttttaaggatacttaaactccatggcatagtttatcataaacatgcaatactctgaaaatatccttctaatggtttttaaaaatttctttactgtaggctttcatatcatgccatctaactgaagaataatttatagcccacatcctgcattccatggaccaaccagaccatagccctcccagagtttccagtctggactaaacaagccattcacaataggaaaaatacaaacaggcgatatacacacaaaagatgctcgacctctctaggagctgaagtaaagcaagtacaatcagcaacgagatatcattttcatatgacagtcacaaagacgaaagaaaatacaatcccccagtgtaggca

SEQ ID NO: 33094 - DNA, 2757 bp, Bovine  19866880625905
ccacaaatcccagggctgtgtggcaaatggaattccagtgtgtgtgtgtgtgtgggtgtgttgcagccttgatggtgctgtttgaaatcctccccatgcctggaatttgacaagcaacagagtagagaagggtcaaaaaacccaaaataaaggggatgggaaaacaaagagctttcccaaagccatggttcaagttgtgggtagaatatcttcctgtttctcatgcagagcccctgccttcaggccccaggggctggctgggctggtttggccagttcaaggccagagctgaactcctgattccaacccctgctgcccccaccaggcttccctgggtgcagggcctacgtgctctggggagggaagcatgcagtgggggagacgaggaggctgttagggtttcagacactttctaggtgcctcgggggacctacatatttcctatgtaaagttcagtctgtttgcaattaggcctgtcttctttgcttatttccggagagattaaaaatagcgaaatcagcttaatctgggactctctgagatcaacaaggccactgtttccaacagtatgaaaataccaagcagccccaccctcattcacggatcacatggcgtggtaggcagggtaggctttttgtaatgtaggaacttgaagttgcacgaattctcaacagataagactctgtgttttgatcctagcaaggatgtcttcaactgaagtagaaagggttccatacagtttagggtctgaaattctctctttcctcctaactgagctcaaagctgtgaaagccttttcagaaaaaacctactgtggttcaattacttcactaatttgtgcctttccttagggatttgggacagagcagatcctgagcaactgtagacacaaagatgctgctcctgacctgccaccatcagcacagcagatgtccaagtctgtttcatcagagattgagagagatgcggggaataccctccatctgtgagatggctcactgaggtgaggagggccatgggtcagaggaacactccttcttacgctctgcattagtcagtacaggaaagactgggctacagtaacaaatacacccccacatctcagttgtcacaccatctgaaacttgggacatcaggattgccgtagtcagggaaggtaggacaggaggattgctgagatgctgttaaggccctgtaaaattggctaataccatttctgcccatgtctctttggctggaacacagtcacctggctttgccctaacaagggacctaacaatttcccagcaagggaagctgggaaatatcagatttgggatgagtaggcatcactggaggctttgacctggtgtcatcagccatggcatggaagcctaaagaacatcctcagaaaaacttaatgaagctgtagcagtgcagtcctatggactgacagggcctgctatcaccaccactgtcccctcctggcatagatgcctgaaggaaggtagctgcttcaaggagacatcctggggcataaagcagggctagaagccaagatgggacctagaacaggtagccaaagagaataaaaaaaagtacctggcttatagtgtaagtagacatatctcagatcttcagaaggcaggaccaaaatccttcagttgaaagcacatggaactgtagtaacttgtgcttaccgccgtgagaggtggctcagtgggtaaagaaactgcctgcaatgcaggagatgtaggttcgatccctggcttgggaagatcctctggaggaggtcatggcaacccactctggtattcttgcctggggaattccatggacagaggagcctggtgggctatatagtccataggtcacagcagttggacataagtgactgagcacacacacgtgcttatggggaccaaaggtcaacttctctactagactcaggccaggtgaaatgtcttctttgtgtctgtttcacttcaggctctcctacaggcagaactcatgggacaaatgctttctcctgctcgaggtgcttcatcccaacatcccagggctcctttgttgccttcaactaggatacagtggtcacatctgtggggcagggctcaagtgcttttctgggatggtagttaagaagggaaattctgcaaatagtgaaaactaaaccaagggagatttaataaatgagagctgatttacatacttcaacagcaacagaaatagtgaagcaaatcatccaaactgaactgagtgatcattatgaattttcctctatgctgggaactaatagaactttgacaagaggatgtcatttgtatagagtcctccttggtattggcttgagaatccggagctgaaccctcactaatatgtggatgagctgatgggactattggttacaactgggtgtgatggttaattttatttgtcaacttatataggctgtggtgccaggttatctggtcaaacactagtctagatgtttctgtgaaggtattttttagacgtgattaacatttgcaatctgttgattttgaagtaaagtagatgaccttccataatgtggggtgggtcttatccaatcagttgaaggcctttaggacaaaggatgaggtttcccaaagaagaaggaattctgcctccaaattgcaacatgaaaattttgcctgagtgtctaacctttggattcaatactgtaacatcaactcttatctgaatccaggctgcctgctgccaattagggaaaaaatctctcaacctctctcttgg

SEQ ID NO: 33095 - DNA, 1687 bp, Bovine  19866880629840
tggagtgtgcctctgtctcctgccggatgctgatggatgcactcctgttctgaatcatgttgcccaaagccttagacaacagtgttcaggtgtgtgggaggttgtgtaggtgctggtgagaacattatagtggttaagtgcacagaatctatggtctaaccaactggagttgaattttatctccaccattttctcattttgtggctatttcacttcgtgaacctctgctttctcttctgcaaaatgggaacaggggcttccctgatagctcagttggtaaagaatccccctgcaatgcaggagaccctggtttgattcctgggtcaggatgatccactggagaagggataggctacccactccagtattcttgggcttctcttgtagctcagctggtaaagaatccacatgcaatgtgggagacctgggtttgatccctgtgttgggaagatcccctggagaaggaaaagtgtacccactccagtattctggcctggagaatttcatggactgtatagtccatggggttgcaaagagtcagacacgagtgagcgaccttcactttcactttcaatcccttctcacaagctcattgcaaggactcaatgagattatagtagtaaaacactgagtttagcatcaagttataatgcatcactctataaatgagagttatcatagattattattaaaagaaaatccaaccattgagggtgttgctttggcaataggatcagctatcagtatgcttctagattttgctagatttcttatagctaccggggaatttggacctcaggttatctgtccacatgctacaggagaaagaaaacaaacataattgttgttattttaataggtaaagaaactgtcaattctattattaatactcagtttcaagagaagttttaacagagaatactctagaagactattttttatatttgatctaaactttcctaccccttcttggcatgatcttaaagtcccccaatcacaaagcatgattcctacaagtttaaactccagaaatgtgatgccctttcgcctgcccttgcagagctccccccaccatcccatccttccccaaatgatgttcttaaccaaaataaggctcagaagagagtctcttaactctgtccaaaagctaaaaccaagagaggacaaaggttctctggttagtcacatttcacccaactatttttagctggcatagggtgaaacaaggttccccaaagatctgggtcctgtgaaagttggaagctctgccaagatggaggaatacagctccccccgttggaagagagagaacaattccctccttcatcacttgctgccaaggagtcttccacctgctctgtcttgcttacatttgatcccattgggttggtctgcttgttcactgtttcagccccaacttttgctactgagctgtcaatttgtcaattcattctgtggaccatctcatgccacattatcctccagctcttgtgttggaagcttggtgggtttctgaatctctatcctaatggaaatgcatgacaaagcgtcctggattctcaacctggacacacttctttttcctggtttatctctcctaagagccccaagctctgccatacccttctcctttcagccctttccttctcctactcacatggatgcatcaaggacaagtatcttcctg

SEQ ID NO: 33096 - DNA, 1614 bp, Bovine  19866880635177
atttctctttttttaagattaaaaaaagttttttttgatgtggaccatttctaatgtatttattaaatttgtcatgatattgcttctgttgtttatgtcttgttttctgggcatgacgcatgtgggattttaacttcctgaccaaggattgaacctgtaaagtcctgaactggaaggtgaagtcttaaccattggatcaccagggaagtccccctcatctagagtatttctaatgcatttgctccttgtctaataaaaaccaaataagctcctttgtgagagccttcaggatagctgtctctccgagtaattaaatcaggaatttgggctagagatgccagttgtcaagaagacgttattaaaagctggctcaggatgtggaattcctgctctccttgcacctgcccttgcagaagtggttctggttgctctcctccccgtcgtgagaacaaggggtgcatcattacaggaccttatctttcttgactgcctcctcctccaattccctgtcttcccaatggtcttggtgtcttctgtgatgactagatgtctttaagaatcagagtctcaggcacaggtttggcatgaggtttgtgtgagttcctttctgacttttttttttttaaacaaaggaggaagaatatgaacacaaataagtggaaagtattttttctttgaattttatatatgacatttcataggtggtcttctagcttcttctagcagtaaacaatccacctgcaattggaagaccggggtttgatcttgtgtcaggaagatttcctggagaagggaatggcaacccactccagtattcttacttggagaattccatggacagaggagcctggtgggcttacagtttgtggggtcgcaaagagtcagatgtgactgagtgactaacacatacacttctagcttcttacaatgtagtaaaaccaatttgaaattatggagtttctcagcatcgggtctggcaagtgtcagtgaggagaagaggctcaaaaccatctgtgcccaccataacaatggagacttgtgcccttgcccctctctccaacactacaatgggcagaagtttggggagctgaaggcaggggcctgctcttctacagaacatgcagacactgaccatgataacttgtctctgatgggaacattcttacacaaagattgctgtggatctgaagtggcctttgagatgccacccccgagtgctggaatggaaagaggaccccactgatccccagacacagacagcaacagggctcttcatggccatagtggcctcaaaaggcactggaagacacagattcataaaattcctctttatagagaataaattaaaaacataataaatatgaagggaaagcaaaaagttatgaaaagtaactttataagaattttaaatcttgtttactgaaccataagataggaaaaaaatagtattaaaagtgtataaaaccagaaaaaaaagtgttatagtggggacttccccagtgggtgaagtggataagaattctcatgacaatggaggggacacagtttcaatttctggtctggggaagatttcacatgcagcagagcaactgagctcgttccccacaacaaatg

SEQ ID NO: 33097 - DNA, 638 bp, Bovine  19866880645502
atttctaatagtctttctttgaagctttctaacccctaccaatttactgtggtttcagtttctactttccctaaacaacttcctctttcccgtcaaaatcatgatcttagcaatgagagtcagagaggcaactctgtgaatctcgcttccacaatattatcccaaagttatccaattaagaccaggctttcaactgttgtttaccaaaatgcccagtgatcaagatataggcaccatatcaaggctctcctacaaactatctgggcagaatgggctctttccctcctgaaattaccttataatcttgcatagaacatcttgaaatcttcgtctaaatctgctatttgctggagttctaatcttttaaagcaaggctctaaatatgaaaagccgaagggcataccgcacagggtaaacccaagtccagctctctgattgcttattacttatacacccttagagagtccgtaacaaagaggcctgctgtttgctttgcttaatctggtcttaaaatctctgcttctttgtcagaaaacaatatttgcaattgtaaaaaaaaatatttaccaaggaacttggatagcataagtcaaaggctaagagccaaaggtcaggagttcttactccaaatttccttg

SEQ ID NO: 33098 - DNA, 1482 bp, Bovine  19866880695197
tgagggaccatgctgagtttctgcctgaccccagatcaccactgagggcaatgctatgggaaggttgcctccccataggcctaggggctatctcattgggatgacaccattggagactcaatatccactcttctgttccttcagtcttcaggcaggatactgggcagatggaaactgagtttcaagttaaaggagtgggtagaactccatacagtgatttatggtctaggccagggctttcaaaactgtataaagagctattcctggccaagttccttattagtcatatgtgtgaaatggaaacatcactttgtcagaaatatactcccccacctcctccccaactgtgtctataatcaggttctggaaatagagctgggtgttgggaaaaggacttaagggaagaacactttactaatagaccttgcattaccctggcagcggcatttgcaccaaacactgatggaaagagatcctggggcaggcgaaaaaaggataaaccaacttcacgttggcattgcccccagaggtgcttttccgtaaatgaatagattgtgaatgtttcagctttctcatttgtcattttatctattcagcactcatctactcgtctggtacccatgccccattttcctcttggggaatcccaccgtgtcctctgttctcagtccatgagattccaggtcagctcaagacgaagcacatgatccaggcttaagccaatcagtgcagtccattctcctggggatagaggttagtttaagaactggcagctgatcaatcaaattcaattagataccttgaggttttctctaggatttctgggaaaaagattcactctttctcttaaacctcaaatctgggagatgtagggcctggaactcggctattttttgatcatgtgaaaactgagtctgaagccagcagagctgagagatggaaagtaatcacgtcctgacaatggtcctgaatccagttgtgtctgatgctagttctcattctagatcttttggttgcagggaccattagatttcccttttgcgaaagcagtttgagacagattttctgtccctggcctttgttaacagttgtttaaaagaatacataaggcttaaatggaactaaaagaaaagcaggagggccagcacgaggcctgtaatgtgcaagcacaatctgtggctcaggtgcacagactgaggttcatcacacactttaatgtgagcaaagcacaccaggacgtacccagacaggaagatgaagagccccagacaggaagttcccccagcaaacaccaccttttagagatgaaattgctaagacactagaccatttctattgagttcagtctgtgttacatcccactttatatatttaatgcaatagtaaatactactactttagtaaaactccctcatttataccatttcaacttataattccctataatttattccttttccttagaattcataaaaaaaaaat

SEQ ID NO: 33099 - DNA, 811 bp, Bovine  19866880817752
aaggagactgagccaagagaactccttttctcatgccattcaagaagcactgcacaaaatgtttgccctctaagacagcccagtccaggaacccaactctcaggactggagaatcatggcagacagaggagccctctggggaacagaaccaatggagatgatttagggtctcatatccatgtgctaaccaaagagctaatgtagatcatggcagtcaaggtccatcagaaaaatgggactcaccccaggtagtttaagagagagagtttaatgttgagaactaattacaaatgtgttggaagagcttgaaaggagaataaggaacagtgaagcaacatagagactaacaagagtaagaagccaccgtcacccctagggctggattaacaaaggaaggggtgctgttgttagggctcagacgatagagctgcccatctccagctcttcacagagctgggtccacaaagggattgtgctcagttgctcagtcatgtccagctctttgcgaccctacagactgcagccctccaggctcctctgtccatgggattctccaggcaagaatactggagtgggttgctccagagaatcttcctgacccagggattgaacccatgtctctcacatctcctgcatggatgggttttctacctctagcaccatctagaagcccatacaaagggatcacggaggaggaattggggtcattggagacatcactggaaaaagagagagggaggcagaaatgtgtggcttctcccatatttttcatttctccctccagggccccaaactaagcagaatcaatgga

SEQ ID NO: 33100 - DNA, 2680 bp, Bovine  19866880839574
tgacttatgagatgtaaaaatgacagaaaggcacgtttggtgctgattttgagatttctattagattgacccatataaaattgtcattgttgtaggttgaaaatgcttcaatgtcagcggttccttaaaagttaaccctaacaatttagataattacttgaatggtgataataactgagaaacggaatccgtgaaacaagaggaagtatttgtgcaggtgagaagaactaaaatcttagttttagatctgctgcatttaaactacttttggaacacaaggtagatatccagtggggaaatctgcagcgcagaagagaaagtgttagtcgcttaatcatgtccgactccttgtgatcccatggactgtagcccatcaggttcctctgtccatgtaattctccaggcaagaatactggagtggattgccagtccctcctccaggggatcttcccaacccagggactgaacccaggtctcctacactgcaggaagattctttactgtctgagctaccatggaagcagaagagaggtcaggcctagaaatgtagtggtcagacaggagtgtgattgatggatgccatcaagaggctggcttgactgcaagccattccagttataccccaacataacatgttttcaaaaaagagccactaatgggtcataataccaactggaatcaaaacctttaaaatctttaaaaacagaatagaaaaaaaaaaaaatcagagtgagtcacacatagtaaagttaagtactctttctaatatgtatctgtgtaccagactgcaatgtgaagttttctaccaaaaaagatagaaagaaacaagagcaaaggagagaaaggacagacagacattagtctgatatgtgtatctaaactgctatcatacagagaagacaagctatgggaaaccaatatttccacaactcagtgggctaaaagaaaggaaatttggagtaattttagcactcctttatctgaaatcccagccacagtcaatttcccaaggggaaatctcccttctgctcacctccagagaatactttggtgttcccactgttgaaagccaggcaaaaaatgttggaatgatgctctcctttcagctgtatgggcttaactctggagtggatagcttgttccatgtgccatagtagaacccgacgatcatctcctccttgagaggggagcaagaatctagggttaaaacagctggcatttcaaggctgatatttcatttttccagcctgaatcccatacttttcaaaactgcatctccccacctccatgagactctgatgcacataaacccaggactctatccccttaatcttcagtggacatgtggcctctaagtcactcactcttccccaggaattacatcttgaacagacacacagaaattcctgaattttcagagacccagtcatttacacatttcttcatttgctacctaaaattcttccactaaagtttccccactttttttctggtctaacagaacctgagttgctttctactgcttgcaaagaactctaaagaaattatccccgaatttaaagcataatagttttccaaagcactctccttgatgagatctcattgactatgggacactagacaaaggataactgaggaactgcctgtcacagcagcaggatcaagacagaacttggctctcaagaagctcggtccagctctttcctctgcacaactctctatagtctgagtagaatgagcaatattctactgcatgcgccagctcctagagaatgagaagatacatgttctacatattctttatttttgcaaatgcattatacatgtctggaaggatgaacaatggactgttaaaagggtttactacttccagggagtaggattaaaaaagagttagaacacatgttagaaagtttttacttttatagatttggcatggcttgactctttataataagcctatattatattcctaataaaaatgtaactttcaacagggcagaaaaatagtaagttctatacttcagcctccccttctccattcaatataatagctacaaattgtatcacaatcatacaaaagcgtaccactagatgcaaccactaaatcaataagtctataagaattaacacagaaagatgaccacaggtctttgtcaggggaaaaacatgaagtgtaaaatagtatgcataccaacatccttttgtgtaaaacaaatttttaagaagctccatgacagcaggaaccttgtcagttttgttcactgcagactttctagcacctaagtgaatgccccaaggagtagacactgaattaacatgcttatgtttgcatgtctatgcttgtatttgcatatctagatggctgtaaaaggagttgttttcagtggacaccacttctaggctagggctactgggagacttttcactgtgataaaatttatgtaacagccaatgcagcattttaatcatttatgaatgtacaattcagggcattaagtatatttgcagtgatgtgcaaacatcaccattatccatctccagaacttgtacatctcctcaaacttttagtttgagtactgtacccaatatttattctgtacccaatacacggtctctctccccagtgctcagtaaccattattttactttctgcctctagaattgatactctaggtac

SEQ ID NO: 33101 - DNA, 1734 bp, Bovine  19866880868831
ctgtaactttctaggttgctttactggcctggattgcgcttcctgacaaattcctatacctctgctatgcccatacaatatcaacacagaaaggttgagtggtgatgtaatgtctgaggccaagccaggtatacaaggctattttgttggcttcacagggtacaagtcaggagatgagatatggtgatttaattatcatgattttaggggttctgccatctatcaagttcaaaagaaagacctgtgtaaatgataccaatgttcaggcactcaagggctcagccctttcaagaaaactttattccctctcctactttcagcaagatgtagtgactattaggccaggtgttaaatgagactaaagcaaaagaagaattttaaattaccacagtctatctccaagccacacaaacccattagcctgagctcctctgctggacttgagcaatctagcacaagagccatttaaggaattgtgaaagaaaaggaacaaaagccgagtgctgtcttaaaagtgagtgccagaaaagctagcaggtggaaaactggccttcttttttaaccctgttaagagactgactcactaagtatacagaggggaatatgaagcttgggagacagaatgtacctagtcaggcttcagggagaaaagcaaaaacaaacaaacaaaaatccaagtatgacacacaagcaaggaggagaatcctttagatttaggcagcctccagaggaaggaatgctatttgctgttttactgaaagattcctcattataccgcaagactggaaggcaggctgccttaaaaaaaaaagttaaggctttatttggggctaattgtttctgttgatacccaaccaatctgatgtcacttatgtcaccttatctgatgacagacgttatcaaatttgaataagattgtgcttaatcactcagttgtgtccaactctttgcaaccccatggactgtagcccaccaggctcttctgtccatggggattctccaggaaagaataccggagcaggtagccatgccctccttcaggggatcttcccaacccagggactgaaaccaggtctcccgcactgcaggcagattctttaccatctgagccaccagagaagccctatattattattattattatatgtatcaataaataaactgtgtatctgtagccaaaagtgggggtgacagagtgtatacaaggctttgaatcaaagtctcaaagaggatacaaactggcagtcatgtaaatgtgtctaccacagcatgtggcacacagtagatgctcagtaaatatctgtcttcttattttataagatggaagggggaaagggcatgaagttaggacaggttcagtaggaaacaggaaaaatggatgttttcctgctgaagcagaggtttgaaacttgtggctctagaacagaacagatgcacctgttcatttaattcatacaatgaagtatgaatttgctgcaatacttaaaattcaagaaacttcattatcagttagtcagtcagttcagtcactcagtcgtgtccgactctgagatcccatggattgcagcacgccagaccgccctatctatcactaactccaggagtttactccaactcatgtccgttgagtcggtgatgccatccaaccatctcatcctctgttgtcaccttctcctcccgccttcaatctttcccagcatcagggtcttttcccagagtcagttcttcacatca

SEQ ID NO: 33102 - DNA, 1607 bp, Bovine  19866880870843
tccccccactcccgttaagaatttatgggttatttagatgctcctgaactgagagcctgtaggaggctgcgtggaggctgctctcctacaagtcctgtctggggagtgtggttccacacgtctgttccacacagagccaccagggggcacacgcctcctcttcagggcttgtgttgaggctgggccgttccctgcccctaaccctgcctctcactgctgtccagctcagggtccaaactgacctctgtggcattttccaatggagtataatttcagaaggtcctcatttggggataaggggctaagaagaccaaggaaccccgcatagaaaggccaaggagggcagtactggtttctgtccccttaaagatttccttggctcagggggttcacacaggcgggtgggcacaggggagggaagcaagctgttgaaccgttttctgtgcaccctgaccccacccttcatagccctgttacctccttggacctcagatctccccccatcccctactcccccagcccttggcaatgaccccttggtgagctacttccatgccagcttgtacccaatccctctggcaaacaggcctgggcactgaccccggggcccggtggctgcagggcagagctgctgtcctggccaggcctacctccctgcaggaggcagcagcaaggccctctcggccaccacccccacctccacctcgggaagggccaatggatctcttgttcctcttttcctcccagcaggggttggcacggcaacgcctggcctggggtcctcttacacaatcaagcaatggccggtcgatgactgaccaggccggcccggtacttggtcatggagcgtgtgtaccttggcgggcagggccccttgttctggagacttgctgtctcaggagggaggtctacagggtattcttcacggttagctagcactagatgggccacccagcttcccagaaacctcggtccttcttgtcctccagaggccattcgatggagcagtggttgcttttcccttctgagccctttagctgtcctactatttggatcttagtctacttgcctacctgtccacttgctcaatggctcggtggctgtggaagtggagatacttctgccctcactcatgctgcccactgcccactgcccacttgtccactccctggtcctctcaccctctcatccagagggagtctgaacagctcagttgccggtcttggcactgaacccagccattagggaagctctaagtgaccgagggcaaagcttttggggtcagagagaccagatgtgaatcctgactgtactgtttccaggccacgtggcaatgggaacatttgtcaaatctccgagcctcagtctcctcatctgtaaaatggggaccctcttcctcccacagtgggcataaagattggattcggaattaattagggtgctttaaccagagcccagggaacgccggctgtggtcactgggcctctcagtggccatgtccccggctgtggggactccacttggcctgtttcccatggcttccctgtgcctcaggttacacccgggaccggcaggggctcatccctgcttcttgaccaggctgtcct

SEQ ID NO: 33103 - DNA, 1574 bp, Bovine  19866880881127
gagttggaagcgggaatggtggcttggagggcagcagctctccccttcccgtaacatctgccactgacatgaacggagcctccaggacggctgggacacttgtagtgctgactcctgtggtgaggagggagacagtataggccgttttgtttagatgaggagccgctaaaaaagctacacggtgttagttgctcagtcatgtccgactcttcgtgaccccctccggactgtagcccaccaggctcctctgtccacgggattctccaggcaagaatactggaaccggttgccatttcctcctccaggggatctcccccaacccaggggtcgaacccaggtctcctgccttacaggcagattctttaccatctgagccactagggaaaaccaaatctgtggcagaaatggtgcgcgctaaggtctgtctctcttcatcagtagacttctccacgctccagctgttccctcctgagaactcacttcttacccccttcatccactctctgggcactccttcctctgtgtgagaccctgccctaggaactagatacaccaagccagattgtctcagcccctcagttttgttctctccatttcccttccttatccttccatgaaagaagcaggggtcacggctcttccagctccttcccatgtcactgtgacagcaggtttttaaaactctgagggatgggatgctgtaaaaagtgctgggagaagagatgattcactctcccatttgaaaacccatggagcagctgttgaggtttgtaattgtcctctgtaagcccctgtatacatattaaaagatcccttggagaagctcattcctgattagggggaaaaaaaaaaagatttgggtacaattaattcccagtgtcagatggaaatgaaatctttccaaagctgttgctgtcgttactgtcagtgactaattcaccttggcactgttcaggacatcagctactccagcccccctgctccagggtctgtggtgggaaagcctgaggcatctgaatctccaaaatcaaatgcagaatagacatgggataagaaacaggaaacacatctgtggatccctgagataataattttttaaatacaattctttcccccctgatttggaataatatgtattcatgggagaaaatttgaaaaacagagacaaatccaagaaagaaaataaaagtcaagccaaatcttaatacccagagacagcactgttaacatttttgtatgtattcttccagttaaaaaatgtacacaatatttttttcttgcacaactgctacattctatgcatactgccttataatccactttttccttaatgatatgttgtgaatattttcccatgagattaagcctgcttctagcccataattctatcgactgtcttccatcatatagatggtcattcaactaatacctcgtgggtgaatatttaggttgtgcctaatattttttgctattgtagataacagtttgtacccactcacgagactaactcaggctgcctcattgtcctagacgtatatcacttagttcttcctcagcagccatcagtcatgtgt

SEQ ID NO: 33104 - DNA, 2411 bp, Bovine  19866880893751
cagccttttctgtctcctgcttctagaatccagtctgtcccctcatcctttcaggaataggggtattagtggagccctactgtaattaaccctggcagacctgcacaagcccctgttcattccactaagagtactccttttatcattaaagtctccgaatgattctaatgaaagccatctcttgatgggatcttggctgatacaacatgtaatatattcagctgaagaaaaagtaattcagttgtagaaaaagttctaatcgcaacctgtgcctcgtttcatttctagtcctcacatttactactatttttatgagagctgaatgcaggccaagccaaggcataaggaggtttatgaccaaaaaagccttcagtcctctaccctctatctagacatagataccaagcgtggagcaaggactgctcggctttcagcatgttgacatgaccctgccttctcctccccactgtcctcaaaatccccacctcatctttcagcttgtcactctttccttccactgggtagtggtggggcaaacagcactgcctgtaatagtgtccaggacagtactaagcacacagtcagttcactcagggagatgagtcttacttactcatgagctataaaattattcaattagtgtttaataaaagattaaaggcaactgttagaaccccaagtacctccatagcagaaaccatgtccgactcacaggtctgggtccccagacctagctcagcgcctgacactctataggggcccattaaaacatttatcgagatgaactggagtgtctgttcatggggacaggagggtggcaagtgccgtgggaagccacacttgtgtgtcctgagtgtacatttccaccgtgtgcacaacggtgcactttctgactttcctcactcttcttatcagaatatcaccaacgtctcccgcagtggtattaaaacctattttgggtcatggacttccccctttgagaatctgatgaaaacaatatacctgctctgacaccaatagataaatataggtcaaagactacaggtagaggaaaaaaatactctgagtcaagatggtccatatgaccctgaagcagacatgttccctgtgtagaaaaaaggcaggatacaaggtactccatgagggatctaagaagatgcatcctagtccagacttcacagaacataacctaggtctgtggtccccaactttgtggcaccagggactggttttgtggaagaaaatttttccatggactagcgggggggtggttttggggtgattcaagtgtattacacttattgtgcactttatttctattatatcagctttacctgagatcatcgtgtgttagatcccagaggttggggacccctgacttagaggaattagctttctttattcaaaccccggcagctgataatgaatttgggccctgggctaagtgtggtacttatctgaactcttaagttagcccttaccttcatcacctaagtactactgttgtcttcattttaaagatgaagaagttgagatccagggaggtttggcagacttctcaaagtcataaatgtagctagtgatgaggccaagattagaacccaggcagtcccactcaaatgcttgtactcttaactagtctgctcctgctccctcaccaatgagctaatacctgctcctaactaccttgtctcactaatggaatttatttgcacccatttattgagcatctactagagtgaaaggcattgtgctagttgctatgggaagcacagagatgcacgcaagagagttttctctggacccataaatggcaagaaagagaatgggtaatgccccattgacattaataaggccatacagcacaggcaaggaagaactggggcagagtgtgaaggacaggtagataaagcactgagcagatgggtcaaaagcaacctgagaggtgatataaacttcacaagagtcatccctgcccagacatgcagactgggggaagatgatctgttcaggccacctgggctcagattctatgcttgcagtatccaagtggactttagaacataaaacaagaggttaatttgaaaaccaaccaagaggactgtaagtaaactgcacagtttgctatgctgagcacttatcaaatgaacgacagtatgttcaagtgaagatatggtgctatttatggccctgaaagaggtttggcgattgcaggtatctgtgctgcctccttttctcagcttcttctcctgctcctcctggctggctgtgtagcttcagaagactcacaatggcataccctggctggaagggtctctgaactccttctgcaagttctccgagtatctgaataccacagtacaaagtcaggtctgaattctcagaaaaatgttgcggctccggctgctgct

SEQ ID NO: 33105 - DNA, 1004 bp, Bovine  19866880909448
ttcaggagcatacatggattaagcactactctgtgcagacgctactggaggcctctggctcccgttcttgagtcccggagctctcagaggagcccaccagggtgtgagcccactggggagatccgccacttactaggacaggcgtagagcaggcaggctccacgaacttaaaggtgtttcttcgctcttgccctccttcctccaataacaataaggctttgtatgtcaggcataaggttaccgggttggcttgtggagctctgagaacccgaaaagtccccgttttaagctcatcttcgggaaattcagtttctccgtcgggtcaggggtgtgtattgagggggcgtggagtaggtagattgctcagagctattagggtgctgcccaggtgcgtataaggatagctcggccctgccagcccgcgggaacccgcagcggaacccgggaagctgggcgacttagaccctgagcccaagggagggcggcaaaggagcctggggcgaggcgggaaagctgtgtggcttcggaggccgatggctggttagaaacctggctccggcagggcaggggtccgccgggtcgcgccgcgcggggcggggccgggggcggaatcaggaaattcccaggaaattccttaacattccggcactccccgccccccttccccgggtgccgatctctccggaccctgggaaacagaaaatgaaatgcttttcgggtttcttcgcgtcggtcctccagcccctggcagttgtgggctctggagcgcgtgggagcgcaggacgccgcagcaacggagtaccgggccttcctgcgggctgggagcgtgtccaatgccccggcggttcctcctggggctcccgagcgcgcggccgctcggtccccgagctcggggaggcgtccgccggcttcggtcccgttcagcttaagctggtgtcacatgagccgcgcgggggagtgggaacccggggagtgggcgggggcgtgtgcgccgggagggggcc

SEQ ID NO: 33106 - DNA, 1131 bp, Bovine  19866880942267
ttaaacctggtatattacatcatgaacgcctttgggcctcattctcagcttacagtgatgctcaggtatctgaattaagttcagaaatcacagcttattgaaggacacagattattaagtcacttcacttcattggactgaagctgtggacattgcttgtttggagaagctgagcactgagtgatctcttaattcctgtggacctgggctagctggagctatttaatgaagggtgtggccatcagatgtcatgaagcccatagaggctaacaggaaggagggaagggacaatgatgtactggagctagcttacattgactgattgttaaatttttaggaatttcgcgagctgcttgttcaacacagccattacagtaaattaaattttataaacttaaattaatattaaaaacaaaggtaatcaatactaaagacagatcacaccctaattattttgctgccctttgctattatccatgctctggagttatttgcctttacatggatgtagtggaaatactacatggtgctatgtccctgtgcctctcttcccaaattcatgtttagtggcatcacattggatagttgggaatcagatatagggagactatttgtaccacagaaactggcacacactacgaacgggggcttgatatattggtttgttgcttgtccagacttaagaaagtgatagagaaaatgcttagaaggcagaataagcataaaagtatgctatctctgtagcaatgacatggtgaaagacccaacgaatcaaggcaatttttttccagtattcaaaaacaactatccagttcagcaaagaaatcactcctgacattgacaaatgagtgaagttctcggatgcatccttgttgtttcacttttgacttactgatgcttgtaagtgtgattatcaaccaacattcaatgtcagttctccatgtaggaaaccgatggtgaaacaatggctgtcagttcagttcagtcagttcagtctctcagtcgtgtccagctctttgcgacttcatgaaccgccacacgccaggcctccctgaccatcaccaattgccggagtctacccaaatccatgtccatgagtcggtgatgccattcaaccgtcccatcctctgc

SEQ ID NO: 33107 - DNA, 1373 bp, Bovine  19866880997397
tgagctggaagataccttaaagatcctctcggaaacccctcaatttcccgtagggaacgttgaaaatcagaggtgaaatgacttatccaaaccagttaggaccacccccgtggggcttctccagtcgactcttgtcctacttcctccagcagttctgtggacctgttgattacaacactgcccacggccagaaaatcctgccccatcagcggggggggtttccaggctgacataggacatgtcccgttagaagacggctgagttttagttccagttctgcccctgctttgttggctcaaatgagtcacttcttcctttgtctatttcccctattggtaaggagaagataatgaacctttccacctatcaggctcacttgagtgttgtaaagaataatgaggtgatatttgtaaagtgctttgagcggctgggaaagaggagggggtgggctcagtagaaagcattattagctgcaagcacttatcaattgagctgtttaacaatagcagagagtaagaataccccagaaatgaattccagggactcaccctgctttgaatttaggaggaggattaagtggggacctaataggtattccacttctccagtttctttagagtaccgtcaaactaggaaaggtaattacattcttctatggcggcttcagcctggagtttcaattgggatgtcaaagcgtacttgtcttctattctcctcctgaggctgtgttctgttgtaattgttaaagccttgggcatcttctatccccaggggtaaattcacttaggagctatacaaagtcatttctgtgtagtggctgggctgctgtttataaggttgattagtggagctttctaaatctaaagcgcctggggagcaatttggatgaagctgggaaataaaaaggcaaagtcttcatcatggttgatctttttttattacactgctccatgggaattttctcagtaactcagtatgtgcacagtgcagtatggctggatagccattgccacatcctctttcctggggaaacggagacctagcccaggttaagatgactgtgccaggtcactaaatatatttagagccaccttttaacttctcttactcccactgagggctttctggtggttcagtgtaaagagtccatctgccaatgcaggagacacgggttcaatccctgggtcgggaagatccccttggaggaagaaatggcagcccactccaggattcttgcttgggaaatcttacagacagaggagcctggtgggctacagtccatggagttgcaaagagtcggacactgtgactaaacaacaactcccactggaggttagatgagaggtatttgtgggggtcttagatgtgtagga

SEQ ID NO: 33108 - DNA, 2019 bp, Bovine  19866881022465
gtgggtgtggtgggcttaatggtgcccccacaaaggtatgtccacacctcaatccttggaacctgtgaatgtgaccttctctggaagatgggtctttgcagatgtaattaagttagggatcttgagatgagatcatcctggattaccctggtgggctaaatccaatgacaactgtccctgtaacagaaggccacatgaccatggcagactagagtgatgcccacaggccaaggagcatctggagccacctgaagctggcagagccaggacatatcctcccctggggagaaacacgaccctgccaacaccttgactttggacttctggcttccagaactgtggaagaataaagttctgttgtttaagccaaaaggcttgtggtcacttgctgcagctaatacagggcagatgcacggagagaattagggactgcagagcggaagggtctggaaaaccaagttcagtcctggatctgctgctgctgactgaggtgaactttatgcttcaggttcatttcctctctgttcctcacatgcctggccctcacagctgggcgcggggctcacatctcacttgaagaagttactcaaaatctaaggaggtcaggtgagatactccctacctgtttggaacagtggtaacaggaataaccacactcgtagaatgttgaatacatactagatacgtttacacacattatcttgtgtaatcctcaaaatattcccacgagattagcattcacatccccatcttctaggtgaggagactgaggttccgagaggtcctatagcctgttcaaggtcattcaccgagcgagcccatgtctacctgtgctcgatccacaacattacaaaaggctcaagctccacaaagacagtgggtccagattcccacaacatcccacagcactcacagcactcagctggatgacggaagggggtttgtttattttctgaatattagcagcactggcactacagctcggtggcggatgacagagtaagtttgctgagagaacctgtttggactctgctaacagagtggactctgctagcatggtgcatgcatgtgtactcagtcgtgcccaactcttcacgacccccatggactgtagcctgtcaggctcctctgtccatgggatactccaggcaagagtactggagcgggttgccatgtcctcctccaagggatcttccccaaaccagagatggaacttgcgtctcttatgcctcctgcattggcaggtgggttctttaccactagcatcacctgcgaagccctgctaacagtagagggttagcaaaatatccacattagggagaaatatagtctcaactaagacccatcttggtcctcttggccccaagtctccgaggctttcttctctctcaccttgctggagaaagagatgaaacccctagccaaggggcttctgccaggtgagagtctggatggacagtcacacacacagagagaacatatcccacatcactccctccccagccaagacgaagaagagaaggaaccaactgagaggctctagagaagccctgtcctgagcagcccgacacatctggggccccctcttgtctggctggagtccctgtgcctttcccagagtccccgtcagaggtttaggtgatctataccgatcccctgctggctgtggtttaggcagggccatggctaacatggcagctgcttccctgttcttccagcgcttagggttggagagagagctggagcccagagatgacccaaggacctgccagatttcctcccaggcagacctctgtgcgagataaagtcaggcaaggctgagccgcaggacagcagcataataaattcccctggcctcctcccaggctcattgttctattgctggagttgttttgagtaggatcaaaaggaaggaagagctctgtgctatcaggctggggaagaaggatgctctcctgaccgctcctgttgcccttggccaccctcgtgttaaatatgaggaaatcgaagggcagtgtg

SEQ ID NO: 33109 - DNA, 1908 bp, Bovine  19866881024614
aaaacatgctagttgcttggctttagaatttagtgcaactcagtcagtgatctacctcttccataaactcctcctgttctttaaacgggtgccacatccttcattttccctcccaagtcattatacattatttctggctgctagattccattccagagcatactaaatttaagtaatagatggaataatctcaatgactaactcagtacaagttgcagaattggaaactgcagcctagtcatctctctgggtcacacagaagtcacttaggacaaaaagtgctgtatacaacatatatttttaaaaacgatctttcttctactttgtgctgcaaaaacaaactttgaggggatggttctcccacaggatatggaaatggccttggagcacatccagggttagtgacacagctgctgtttcctgctagggacatcccacagccagaaagggaaaaagacaaagttaaatatatagcaggaagttaatgactgaacctattaacaagaatgaaaggatcagcctgttacacagtctgtttataataatatacagccattggccaaacttaacagtttatgtttagaagacatatttaaaactctttaccagagggcaactgatgcaataatagccgtagcatcaacaacattgtctgcttatggtagccaataattttaaagttcctttgggtacttaggtctatattcacaacaacctggtgaagctggtaagttgggtagagaggttggtggcttagatggtaaagaatccgcctgcaatatgggaacctgggttcgatccctgggttgggaagatgccctggcgaagggaatggctactcactccagtatcctggcctggagaattccatggactatattgtccatggggtcacaaagagttggacatgactgaccgactttcactttcatttctttcagggtgtgtaagcaaggaaaggagtttggatttcattttaagaatgatgtaaatttttaagcaaggccattgcatggcatgtcttacattttagaaagatcgttcaacttgctctatggaacatggactatagggtgccagagcagaagatgagggactagtcaggaaacatgacactaattcaggtgaaaaatgatatggtttggactgggtagtggtggtgaaggggtggttaggtagattttgaagaaactacttaaaagtaaatgttgctcagtcgtgtccgactctttgcgaccccatggactgtagcctaccaggttcctccgtccatgggattttctacttgcaagatctacaaatagattggaggtaatgtgtgaattttttaaaattaagaatatctaaatttggaagcctagataacttagaattctggggtgtttttctcccccctatgaagttctgtgatgttatttaggccccaagatctaggaatgctgaaggaaagagcagatttgtgtggagaagagtagggtagggatttctatcctggaaatgttgagtttgaaatgattgttaaacatgcaagtggagatatcacataggcagctgaatataggagcctagaactcttgggaatgggctgaactggggatggggagaggcctaaggactgatctcagaggtacagcagcatttggagacagagaagtctgggagggaagggataataagctgggggaatccctgagagtatgatttttctggaagtcaaaggaagcaagtactttgagaaggaaggggctaaacccagtgctgagaagtcaagtaagatgatgactgagaattgacccttggatttgacaggatacagtcaatgttgaacttgataataatggtgccagtagagtgttggggacttaagcctgcctggagtaggtttaagggagaatcagagataaagaa

SEQ ID NO: 33110 - DNA, 1301 bp, Bovine  19866881025060
ttttttaaaaaatgtgcaaccaacctatttcatgtactgcatttttttcatgtccttgtgaatatgcatgtgagtgtaacagatgcagatgtgtgtgcatctgaaggtgtctgtgggtgggtgtataaacatgaatatgtatgagtgtgtgtctaagtgtgggtgcatggaggttgggtgtaggtgtgtgtgtgtgtatatgtgtgcgtgtatatgaatatgtgagcgtttgaatgtaagtgtacgagttcctgactgtatagtgtgtgtgagtgttggggtgggagggggctggaggaagactagatccactacgcagtgatgagtcatagtgagaggtgaccacctttccctgcccccgacaacgagcctcgatcaccaggaaacaggcagggcagagaaaaggcatgtgggccaccagcgcctccaactgcttcctgcttattatccacaggctctcagaggaggcagggtggggtgggggtggggtgggaaagtctccttctcagccaagggagcacctggatacagctggcatcctggtaaccatcaccagggactggtggtacatctgggaaccgcaggagccagcaggcgggggcagtcctctgctgctatatttacaggtctggatttagcacaggaccttgaggcggggggccgagctcctaagttttcaatatgctcgtctccttggcaaccttgtgcagtggagattttgtagcagctcagagaggttagataaattgcttaaggtcacaccgctagaatattcagaaccagagcaggaaccagggccagggttaaagctcaggcggtaccgaatcccccatatcccccccagccattcccggcacatgagaacctgcataaaattgccaagatttcaccgtggctgttatcatatgggtcaaccctgcggtcttagctaaatggatttttttttttttgcacgggaattccgtgccaaacccctcagccaggaaacagctggtgtcttgtgtacggaaagcccatgagcaggctgacactccatacaggaactggcacgcaagggcagtgatcaaacagaactgcagggtcttggaggtgggggagggcctctggggagggacaggggcagccagagcattgagggtgtttggggacctcagggctgtggctacttaccaaacaacatagaagcatctcagtatttaaataattttggcacattctggctgcacgtcagccttgtacaaaggatcccagtgttttcagtcttcttagaagtagaaggtaaggaagctcctctctctgtc

SEQ ID NO: 33111 - DNA, 892 bp, Bovine  19866881032604
atcccagattaggggagcagagagaggaagtcagtagtcagacggagctgctcactggactcagttgacctcacaaggaagacacacagcaccccgaatcaataggagccaagcctagggcatcctctccagtctctctgtagaaggacactctgggagagttgtaggatttggacactggcctgagcagaaggacaaacttgcctttgtgtcagctcttgcccccatggtcagccagacatgaacgaggcagggtctctgccagctcttccatctgttggggctgccctgctgtccccagtcaggctaaactaggtggcacctgctcatggaatgccaacccaggcaggtgcttgcagagcaaagtgttggagttttctttgagcagggaagtttaaaactgagataaagatgaagagatctgaactgtaagctgcttctcacagctagtttaggaaaaagatcttaccaggaccccacagccaagatgagtacagagatttggacagtcttctttggtctccaactgggtagattccatttgaaatgtgttccttcctcttctggtccttgggtgctcgtaactggaaagttcttctctcattcttcagtgccagcatacctaaaacctaatgagcttacacaaaaaatctacaaacaataaatgctggagagggtgtagagaaaagggagacttcttgcactggagatgcctttaaaaactaggaataaaactaccatatgacccaacaatcccacataggcatgtaccctgagaaagtcataattgaaaaaagttacatgtaccccaatgtttaccgcagcactagttacaatagctagggcatggaagcaacctagatgtccattgacaggtgaatgggtaaagaag

SEQ ID NO: 33112 - DNA, 1299 bp, Bovine  19866881098947
gtcaagataacctgtgaacagacaaggagaaggtggagggaagggaaaagagagaccaaattaattattagagctatcaaaaggcagactgtggtttaggggaagactgctaaatacacaggtaggaaaaccccagctctgactttcatcaattttatcttgaggccagaatatctggccaagtctccaggtcattcaaatcatagaaaacccaggaaacagactaactttttttttccagcttaaactatttatcaattatttctaaatgctgagcaaattgcgacagagaggtattggcgtatcagctgaataatattaacacaaggccaaccagagaatgaaaatgcacatgtacacattttatcatttttaagattatatccacaacatacaatatcagtgctgaagagaggcaatgatttaacatctgaatgcctggggcttcttcccttgtcaacgtgaaaatcagaattttctttccaaatctgtgaaattggaataaaactcatctctaaaggactagcactcttctcttaaacaagttgaattctaacaaaagaaattcgaagtctcactacgtatttaaaacacaaatgaatagaatctgacctatacaaaataaagtccataacatttaaaattcctagaaagaactctgaaattacttaattcacatggtttatttccacacaatattttaatatgtggttctatcaagaaattattcttttccttaaaaatcctcatttgtaaaatttactctattgtttataaagctaaagaacaaaacacagattctcttttggaaaactgcagcccgactaatgccacgatcagtttcccagatttgggtgttcccatcatggacacattggtgagccattttggtccctcttctgaaaaaccaggcatttggtgcctggaatacgcatctggccagactgtcttggtctgtcccaagggtcagctatggttttgttgccatcctgactggagtagaaatggaaatcgtctccattcttaattgtccagcttttcagctgcacctctgttgctgtctcttgaatggaccaatgacacgttataaatcctatgccaatggcagcttaattgggggcggagagggcagcaggatggcagggtcaggtaaagaaatgaagtactctattagcaaagacagcctgtccaagctctttgtgtgtcaacaaggctcgtgtgagtccccagtttctctgcagcgatgatctgcagatatctgccagatattgtatctgccataatatgtataaaacataa

SEQ ID NO: 33113 - DNA, 1692 bp, Bovine  19866881113346
cagctgtgggccaggcctcactgcccagtgcctgcaccttgccaatcacagagcaacacgcagttttgccctctcttttgtggaaggggatgaggtattagaattaatttccttacaggaatccactctttgtttaaaaggtttgtgggaagcaaacccaagtggatgttggctcaggggatcaggggtccttggccattgtctcttctcatggtcttgttgggtgtcccccaaatctactgttgtcaggagggaaaaatgagatactctttcgatgtgagagtcttaactgagagtagctcaccacgggggccaggttactgtctcctggcctgggagcaggaaaggtaaggagtctgtctgttatctgctcagtctccaagcctgtaaatgactacatcttttaggatccttaaagacagggcttatttatctttgtatgtcctgcctctaagcctggggcaaaaaaaaaacttcatagaatttatagcattaaaataaaaacctagaaggtgctgcttagattgaatttagtggggtatctcttaattttgattttgaagctgctgtttgtttttttatgaaaaaataccaagttatggcatcatgaacttgatttgtgagttagtggatccttctagtagcagtttgtaaacctttgtcaggttggttaatttctgttgcctgcactgacttcccaggtgggtgggtgggtggctgttgtgagagctgtgcttgcccagaggtcctccgctctggaggtgccaggacatttgcgatggcgtagaagtcctttccctcttctctgttaggcttgtggacactgcccaggttcaagatgcccccttctctgttgcctttcctgttgtacccagttgaactgaccacactctcctggtcccccaggacacccccaaatagacttccctcctggcacctgcgatatatgattgtgctgactttttgacttccctctagaagtggaatgtgtggcctttgacttcctaagtggtgcacagagtgatgtgagcactcaggaaatgtgacctttgtccctgctgagacccatcctaacgtgtcctgctgctgtttctgtagaaatcgtggatgggaatgtgaaaatgaccctgggcatgatctggaccatcatcctccgctttgccatccaggacatctctgtggaaggtaggtcttctgctctgctccatgctgtccccaggcttccacctctcccatgccttcaccatcacatcttcctccctgatccatggggcaagaggtccttcatcgcaagctgcatcctgggccgcttgtctatcgatggcatcctcgctctctcctagtctacagacaagtaaaaactggagtgctggcccctagagttgcgttggcctcctcactttgagaaagcccgagatggctgtggggaagtgtactggaaccactgctctggggttgtcaaatcccagagtaggggaatagcagtcaggagagagccatgagagagatagggcctccactttgctcccatagcaccctctggtggccaccttgcacgtccgcaaggggccaccatggtctggggccgtggtctctctaaacttttggtttcacactcccgcagtttttgacctttatgtctgataggtgtgtatttatttttcagcaaattatattcatgtatttctatat

SEQ ID NO: 33114 - DNA, 1800 bp, Bovine  19866881116953
taggaccaggtacaacaataaagaaggaagaaaaaaatgtggaggctactatgaaccaatcttgtctgttttcttaggtagctagatagattccatgtgctcctccagatccagcctccacccttcgccctaactggtaccccagatgatgaacctgtccatatggcatccatgctgctcctgtgacctctggtctctagtcatacccaggcaaagggaggtaacagcaggaagttggaagattatttatccccctagttccttcgctgccaatcaccgtggattagtgtctccaccaaaggtcacaagtcaggtcaggcagccttctccttacaggtcctctctctgggttctagtaatgattccttcttcttgacacttcgaacttagagatggtaatacttcctccaagttattaaatctgaagtatcacaccatcctttgtcagttccttaagccctgcccataccttgctaaataatcccttcactaaactccctctattttccccaccaggcccctaactgatactatggagtgcttgatgcccctaaatgtgaacaatctactgtccactaattgtgtgacctctggcagatcccttgactgacttcatccatcctcagtttgccctaattcaggagactacaccacagcagcagccctggaataaacagtggccccactatgtcccttagctgttttttctgtcccctactcccaacgctgcaattcctggcttagctgctctgcttcacagggtcattcaagtccctccctccagatcttagaaatggatacaacctgctgaaggcgaagctagctggccaaataaagaacacttacatagagatgaccatcaagcggggatcatagtcaaggtcaagttcatacaagccactcaatttttagcctgaactagtagggctcaacaaataggagcctctttcccctcctgacacatgcttcctggaaaaacatttatttttagtttttaactagaaagacagatgaatagcataaataaagaaaaatgttgaaagttcaagattttaaataataaagaagggaaagtcatgagtttttaagggtttgtgttatataaaggtagtcagtccataatgcaaaaaaaaaagaaaggtcaataaagcaaatcagacagagctggtactgcagcccccctccacctcgcaggctgaagcagatttagaaatggatgccaaaggtatggtggaaggaatcgacaagcaagaggagtcagagttggtggcaacctatcctcaaagaccttcaggacctgtgaagaccctacatgtgaacacatgactacccggacaggcatccaccagcttcctgtcctgtgagaaggatgatgaagtggccttctgcccttctctgaaaacccactaaacccccttgccttcctggggaggttatttctgcatagtgcaccttttgtgtcttccccttgatcaaaagaacatgtaaggcccctctgaggcatctaacatgaccagtctattcactctccagggttgacattttcccagagtttcactcgacccttgcccaaatacaatgtgccttttctcagcccaccttggaacgcagcgccaaagcctccagggccttgctcctgggcccgtccttctctcccttgctcactcttcctcctacagctccttccaagatttttcaggtaaggtttacacttctttgggaatgagccctcctcatccctattcttacacagtcttaaacagacattgcatctctttttagagaaaccgccattctttt

SEQ ID NO: 33115 - DNA, 1146 bp, Bovine  19866881188989
cggcttgtgaaggcgccggtagtcccggaagtcctccaggcttctgctgcatggcgtgcatggtgttctcgggtgcccggttctccagccatgggatggtgcggcggatccactccagcagctgtggagggagaaggggaggacgctgggaggggggccgcatctctcctgagggcacactctttcccaaccatcaccccaggccgttcccaggccacagggccaggctgcctctgagaatcaaaggctccatgacgcctggccactaggatatatcaaaccacagccagcatcactcaacctccctgctccccaaggggaaacctgggggcaagatggctcaactcagcaggagacccaagctctagttcttcatctactacctggctgggcctcaatttccctatcttaccatggaggggtgaatggttgctggccagaggccctgccatctgacctttgaggattctagaatgtgggtccttgactcaaaagagaaaaggttgcagaggacagcctgaattttgtttcttcaatgaggtgatggggggtggaggagtggaaacgatgagaggaaactcgtgatcccctgcaactggatcacgtggcccagactaactcatctgaataatgatgacgagctaagtcatcacgggattaagtgctgtgaccgtccccgccagtggcggaggacataaccaaagcatggtgagcttctgtgacttgccaaggtgaccgaagtagggcagggattaaatccaggcactgggaccccagaacctgggctcttactatgctgggggacagtaagtccaccaagaggccgggctaagctgttcaggggctgaattaaggaaggagcaagtggtgctctaacccaaatgcagtcagtggcagaacagcaaacccatcctgtcccccccgtcctctgggtgggcccagccgctaagctagcctgagccagcctgatttatccctggttcacatcctctcagaactgcacgctccttttaagttcaaacgaaactcccagagtaacagtacactgggcccaaaaggcctctgaggtctcttggcacagctttcatttgtcaagtgaaaaaaaatcaagagcagaagaggtgatagaaaaagcgcggaactcag

SEQ ID NO: 33116 - DNA, 688 bp, Bovine  19866881246359
cccctggaagtcattattttttcctttagcaattgctgagttaagcagtaaaaatatggtttccatcttgcgcacacacacacacacacacacacactcacacatacacattcacacagccgatctgctggacatatgttgagaagaaagcagggatgtgggggtgggagaagattcacatgtcgtgagtcaagagcttgaacatttgaaaagaaaaagtgggagagggtggggagtttgcagccctggaaagggactatccaaaggatttattgcctttgagcatctcacaaggcattttttttttataaaaatctgtaacttatggcttttttttttcctgtatagggtagtaaacaagagctctgaaaggggaaggaaaccaggagaaagccagctccattagtcacgcagctgcatatcctgtcacaaaggaccccagttgagtaatcgcccaaaatatgcctgttatttttttttctgtcagaaaaaaaaatggggcctgccaaaatgtactgtaaaaaaaaaagaaaaaaatctggtctctcagccccagagggggaaaagaaaagaaagaagaaacaggcgtaacttctcagcactcctctaaccctctccccaacttatctttaaaagaaaaagccttcagattctccacaacgatggagccggcttgaaaagagctggg

SEQ ID NO: 33117 - DNA, 1502 bp, Bovine  19866881271363
ggctggacagtgtgtcctgatccttcccaatacaagttctaattctatactccattctgttcacatggctgtgagtattacatttaggaatattccagtgtcggtctctcccttgacctttgacactgtccttaggatggaaatgtgataggactttagaggtaattcactccagtccccttgggctccaaatgaggaaacagaccctgagagatgaattgactcacccgaggtcacacagatagtaagtggccgagctagatctagagctcagctcactagctcaggattctttcttctctcccaggaaagtccccagtgatggccttgctttccaaccctaaccctcctggtctttatctgcagccactcatgacatccaggttggcgcctcccatcctcccaccagcacacatctttgggatttctctgggaacaatgctggtcccaagggctgtctgaaatatgaggcacaggagggtgcctggaatttgcagtgaatcctagattccctggtggctcagatggtaaagaatccacctgctacatgggagacccaggttcgacccctgggctggaacgatcccttggagaagtgaatggcaacccactccagtattcttgcctggagaattccatggacaagggagccttgcggggctatggttcatggggtcccaaagagtcggacatgactgagaaactaacaccagattcaaggatgggcggcatcgccgctcccacacttgctcttgtctgcaacatcagccctctgaatcacggctctcgcttgagtgctgaaagcacttagcgcatgtgggaatattttccgatgacagtgacttcttctgtgtcacagataacatctgtgttaggtaaacgctttcacctaccctgcttgcccctgtcttccagcatgtcgtcacatgactgacctcagagccctcccctggtcagtctagtgctggcgtcttgggcaaacctcggtccatggccttctgcctctcatcgggtgtcttctggagcctcctggaccagccacatgatctcgcttcacttctccttacgtggtgtccacacgtgaagctctcggtgcaaatgtggacagatggccagaggtgcaaatgatcgactctttaagtttctattttgatgttgatttggtgttttttgtttgtttgtttttcaacttttttctctcttgggtccagggagcaggggtctttgacttggtagcctccctggaccgtttccttgggtgtgatcacacagatctcacaaatgctgctgctgctggggtgacactattggaaaattctccccatttcttctggagtacagctggcctgatcctctccattccttaggggcttgccgtgaaggcagtacagctctggtttacagaaaggcaggaagggaggtgggaaagatcctgatgcagtgggggcaagaaattgccaattgtgctggtaaaatgagtcccccgtggccagaaggtgaca

SEQ ID NO: 33118 - DNA, 1263 bp, Bovine  19866881275507
tgattctcctaatcaccatgtcaaaatgtatgtaactacaaagcttctgtcagaaagctggccatatttctcctgattaactaacccctggaccaagatattcattctaattaaacatgtgagaagtttattaataaagtcagaattcatttaactggctaaagccaaacactttacctacaggtaatatgttcttacaagagttaatttacagaaaactgattccataaaatgaaatatagggacttcgtcagtagtccagtggttagactgcgtgcttccactgcagggaccgtgggtttaatccctggtcagggaagatctaagattcctcatacctcaaggtgaagacaaaaaaattaatttaattaaaaataaataaataaagcttaattacataaacttagtggcccaacccaccccccacccccgcaaaagaaatacagctggtgactgggcaacaggaaatgatcatcagttaacaggttccaattaagcatatagttattatcacagctattatttgatgcttaaaattatgctgtgccaatagtatggggttaagcttattcataaagcgtttctaatagttcccctcactgagatcattcttaatttttcacactgttctgtgccatctgcaataaatgttagatgttgaggtgtcactctcttaaaagcttttttgtgaggttcaagttaaacaacaacagtaacaacaactgcagcaggagcagcaaccagagcaacagtatggtctagatccttgttagaaaaactttacaagtattatttcattcaacacttatcacaaccccgtgagatgtatcactgtccttattgtatgaacacgggaacacaaaggatgagtgacttgtcaaaggtaacccagtaagcaagcagtttagttgattttcatcccgaggcactctcaatccagaatttatgctcttaacctctatgtgtaactgtggatacttataatgataagtgaagtcggagacccacagaaaacagaaataggactaaatagtgagtccaattataaatattatgaccaagtaattaagtgcctctccccattcacagctcctacttaattaacactttgaaatagtgtagttgctgatggtatctgaaaaggttctgaaggtgctttttctacattggggtcataagggttaaaaaagagatcataatctctcaccataactcaaaacttctcactatgggctattaatctgctggtgctacaagttccaa

SEQ ID NO: 33119 - DNA, 1171 bp, Bovine  19866881381967
acaaactcccggagttcactcagactccgtccatcgagtcagtgatgccatccagccatctcatcctctgttgtccccttctccttctgcccccaatccctcccagcatcagagtcttttccaatgagtcaactcttcgcatgaggtggccaaactaccgagtgtcagcttcagcatcattccctccaaagaaatcccagggttgatctccttcagaatggactggttggatctccttgcagtccaagggactctcaagagtcttctccaacaccacagttcaaaagcatcaattcttcagtgctcagccttcttcacagtccaactctcacatccaatacatgaccacagggaaaaaccatagccttgactaggcgaacctttgttggcaaagtaatgtctctgcttttgaatatgctatctaggttggtcataactttccctaccaaggagtaagggtcttttaatttcatggctgcagtcaccatctgcagtgattttggagcccagaaaaatactgttttggagcccagaaacactgtttccccatctatttcccatgaagtgatgggaccagatgccatgattttcgttttctgaatgttgagcttgaagccaactttttcactgtccactttcactttcatcaagaggctttttagttcctcttcactttctgccataagggtggtgtcatctgcataaatgcattaaatttgtaaaatacataaagccagtaatattgtaataatattttcagttctactgtgttttaaatgtgatctcagatatatatatatatatataaatcatctaaatgctaatactattgcaactttggtttagaactctgcataatttttgctttctgcataatttaagagattaaagtttaaaagaattattagtttatgttttgtaacacataatgtataaagacataatattgtgacatcaataaccaaagaagtgtggacagagctgtaaaggagtaatgtttttgtatgttattgaggttaagatgctaattattcaaattagtgtgttataaacttagaaggttagatgtaatctccatggaaacccacaaaatagctgtaaaatatatacaaaagaaataaaaaggaatttaaatattttcttacaaaaaaatagttaaacccccttccag

SEQ ID NO: 33120 - DNA, 1908 bp, Bovine  19866881400041
ccctgtaataagttcttacagcaggattgcctaggccttgtgaactcttggaaagtgtaatggaggttttgctggagatatcacatttaggtcacaggggttcagctggtctttggctgctatgccgagcagttttatgggaatagttgtataatgctaacatctgtaggctgagagcttgacgaagacatcacccagattgcctcggaaagctgcttactttgggagctcattctttatgggttaaatatatgcccctcctctttcccccttgcctctacacagtcacccaaccttcccatttccatctgcaatggtggaagagctctgtgcgtatttgcttgtcaccttgcactatgcatttttggcaatttaggaggccaagcaaaggcccttggcttttgaacttttctgctttcttagtgtttccccatgagataagatgttaaagggctagaggatttctctttaaagatttctggtgaggagatagggaactgactgatactcacatgcctgctgcctcagcaacttcaagtccatatttctcctttcccatgaagcctctcttgcccgttttgtttaaaatcacagcctgttccaacaccttatactaaatcccctttactctggtttgtctccccgagaaatgattactcctggacatgcagtattctttaccacttactgtgttcatcgtctgcctccattgtctgccgtaacatagactcctcaagggcaaggatttctagctgttttattcactgtgtatccgaagagcctagaatgctgcctggtgtgtagttaagtcttgacacagagtccttgtaagaatgagctaacagcccagcaaaaggagagatgatgtagtgtcatggtgaaaagcttgagctttggagtcaaatgatcctggatttgaaccccagctttgcgacttaccagctctatgtcttcagaaagtgatttaaactctctgagtctcaattttctcatctgtaaagtaagaattgtagcactaaccttggaggtttgttgtaaagatcagaagggagaaagaggcaacatgacttgatggttatgaggcaaggctttgcattcctgtagatctggagtctgggctttaccttcaagttctggctctcccagtaccttgtgcaatttttatacaaactctctaagcccgccttcttcacatgtcaaatggatataataccctggcctatctcataggatactggtaagaagctaattcatatgaagctcatagcaagggatccattaacttgagcgggttggaggaaggtgataatgatgtttgtaaagttagcctcattacttgcacaaagtaactactcaataaatggtaggtttgagaaaagagcatgcttgtagaaccttggaactctcctaaattgatatggccattttctttgcattccccttcttcagggagagtaaagcaaatgcttattatctttgtaatgtacttgtttcaacttaaaatggaacagcgaacattttttatgtaccatagccccttctttgatctgtaatcaattctatttggatatcaggggttatttttgaattttccttttgagttgccacaggggctctgctccacccagtgaccttcagggggacttcatataacttggggtgttgagtcagcacattcgcagccaatggaattggctccagcagccatgggtttgggagattgtgctgtttccagggttccatcagcttccgcctgcttttatgagagatgcttcctcccacctctaatcctcacttgcagtatgagtctcagcaagacacttcacatcatccaaaccctttaactgtatggttcctatggaaatccatgctttgtcttgccatgtgaccctggccagattattcaac

SEQ ID NO: 33121 - DNA, 906 bp, Bovine  19866881417529
caaaagcccttagggatgtttcagagtcgtagtctatatgctgggctaaatctcactccccccagttaaaaatggaaaatgttactaaccatgttatataatgtgaagataaatccttatgtacttcccagaaactcagaatttaacagaagaacaaaacgttcatggtgagatgcttgctggcccaactatccaacgagcctgggtttagtctactgcccagccccctgcatcttcacttcaggaatgaaaatcacaacactgaaagctggcatttatatgcgctctggaatgtattaagctgaggtagacttcattcctgaagcctggagtaatggaacaaaatgctggatcagaaggcaagaggcttgagtgtgggttcccacacagctctcgtttgctcagctccccatccaaacagtgaaattagacgggtctcatgcaacccgaagattcagagcaaaacaaaagatccatcccagatggccagtctccagtcctcaagggacctatagcacagagctgtgggagaggcagaacaggtagggacctgagcctcctcactcacatggcccagagcaaatgacttcgcccttgaaggctctttcctcagttgtagacatgagaaggatgaaatgatgcaacatataccaaagtaccaataactgtagtgcttcctccttcatttggcaaacgagtaccttaactagaggtttgagactcatcctcaaacagacttttgaacaccagaggcactgaccatcccaattatgttagtcctcatccttaaaacatcaatttcaaacatttgtgaaattatctttttaatactgaaagtcaacaactcagaagtgaagcaatgaaagcacagcttcctgttgcatgtaactgggctagacatccctc

SEQ ID NO: 33122 - DNA, 1851 bp, Bovine  19866881515340
ctgaagtggattcagccaagtggctgtttatggatgacctttgtcttttaaggggcagtagcaggaggagatatagattcctctagaatgtctgatcatgtctcgtcacaattagaattataaaccatgggccttgtgagtgcattcatctgagacagagatggaccaggtatccaaagactcgggactgagctctgtctttaaatatctccacatatgtgaaggtagccctgtaccactgtgcatcttttccctcttccttctgtcttccccatgagcttttctaatcttcaaaggcacattgcatctgtaatttacacagtattcactttttcatctttttctattcctgctctgcatttagtagggatgtgataatgacttgacaatagagtgagaacatatcctgccttggatgaactggaattctttgaaagtgttgccagctagaaatattctgcttcagggccatcactactgttaagaatatgctggaacagtgtgatcagataccgtatcctcccaggtctcactctctggtccccctgagaagatggggctatgagagtactcccctggctccagtctatacccttaatgggtctttctcctattgtgctgtgtttctgagaccctgtattgaagtccgtacacctctctcaattcttagcatcctgaagagtcttagtggatacttttcttcctttctcctttcctttctttctatctccctctgtccctttctttcaaacaagagggagtgaactcatgaatatctgaagtagatttcatagaacgtaaaatttcacaagggggatacagaggtggagttttaattcctcagaatcatcacactttaaaacataaaccagatcatgtcagtcccctactttaaacccactcgtggcctcccactacctttaaattcaaacccacagtctttgtactggcctacaagacgctgtctgagtctaccttgtccacctctctcactaaccttcagccacgtgggtcttctttggcttctcagagcaccccaagttggtttctgtttcaggaccttagcacccatcttttgcctgggactctctgccctgaactctgtgctgccccagagcccctcagatctctgcccaagtgccctctctcagacaggcctgccctgaccatcccatcaataacccccacacagtactgtttccttcatgtcactcatcatatctgaaatgtccaacccatctccattttcttgtatgttgctagaccctggctagcgtgggtactccctccacagggcagatggaggctttattagtcctgttctgttatctcccagtggggctccatgaacatataacatgttactcagtgagggattgaatctgaatttatttccgtctctcttggcttttccttcacttgctctctcatttcttttgcagaaactaaatcatgaacagcagtgtgatctgatgctggagcacaggtcctggatcagggccctgggttttgctgctcagttgatcgtacacagctgccaattaaaacagctgttctcaaacgactctctttttttccattgatcaacaaggaaatcaaaagtaggaataagtttcaaatagtctgtaagactttactagcgttaagtctggtaataacctttcagtcttaacttccatgaccaaactgctgcttcacttcccctactttgtgagttactctgtgatctaacccaatagaggagataatgtaggatatatactgctgtatccttggggcttttcaggtggcactagtgataacccgcctgccaatgtaggcagacataaaaaacatgggttcaatccctgg

SEQ ID NO: 33123 - DNA, 736 bp, Bovine  19866881565420
ttgtcggggcggaggctgaggccgtttggagacatttcgagtactgaataagatgttagaagctttcagaatccaaggagaatggatgtcaggaagtaagagagagttgttcactttgtgttttaatgtcctttaccacttctcatctgccttgtctgtatgttacttatctcaaattaaaggtgtatctctggaggttgaatactgggaaaaacatgaaatatagagtctgaagacctttgaactcaacctttacggtggaatatgtttaccacaggctttggtgtgaaataaatgggataatctaggtcaagtggattggacagaacagtggccaagtgaccagatgtcttgggatgagtgggatagtcttggatttcagcttcctattctgtatcaagttcactttactgatagagcttcctgttaccctgatatgtggaatgaataaatctttatgaactagataccagtggtaacttttatcagtgattagaacagaattcttaagctggatttatatgtttaagtagcattataatggcagagtactgtgtctttgggacagtgatttggccttagtaaaatttggtctgttaagattcatcactcacttatggctaaagtgttagtcgctcagttgtgtccaactctttgcgaccccatggactgtagtctgccagcctcctcagtccatggaattctccaggcaagaatactggagaggattgccatt

SEQ ID NO: 33124 - DNA, 941 bp, Bovine  19866881687449
aatcattacctaagagggctttgtagattgtcacagttggcagccctccaggcttgagctaatcctggaaattctttaacttcccagaaagaaggttccacaaggtcaggctgaggtcctcagagacagcagatggaataaagcttgcggctagtcacttttgcagctggatatgaagataaataaaattatacccattttttttttttttttgcatcatcaagtctttgactttcatttgttctttactcttttttccctgtatgtggaggggggggaaaaaaaaagaatgtgctgcaatcagtgaaataaaagcaagcaaacttgttgactcagttcccatggtgaatgcaaggaaggccaggccaatagaaacaactgagatattacaaaaatgtgtttctttctggcggctacacagtcagtcctttatatccagtcattgtaatcagcccatcacccaagactctttccaaggtcattattctggttgcgggggctgcttctcctgcaaacaaatgttgattttactaaaagtcctgtctctccaaccctctttgtgacaaagagtatcaaagcatcattcttgaaaagaaagtataaaagatcagagagataaaatacttcgggttttctaaatgcttagacatatctggctcaagcaacacaaattataaactatgaagccacctgtaaaatcctgttttaattaacttgaaggcacactaatgttatttcattaaaatgaaattctctttaaatggaaaaccaccactgcagggtacattgagggcattgttcacatggcttttagggttggcaagtgaaccctgtatttagaaaaactaaagcaaatgctatttccttggagccttcttaaactttgaacgacttgtcatagttttcttggaatgtaaggagtatccctcggtaagccctgg

SEQ ID NO: 33125 - DNA, 1329 bp, Bovine  19866880436423
ccaggggttgaacccaggccccctacattggcagcatggagtcttagccactggtccaccagggaagtctcttattttgattttctattgctgttttccttgtgcctatatttctacttatgtttttttgttcttcccaggagcagtttgctgtgtccctgatataagccatttttttgttgttgttaaaagagatagggtaaaaacaaacagacaaaccaaattctagctttcttttttttttttaagccattgaagacgtatcaaggcctccctgccactattgagcaaattctttcccaggctggtctgagttgcacccagactttacattaggctttgttccaagggggtggaggtgccagaggggagactgcagcctgaaagacatccaaggaaaaaggcttcatttacaagcacccgcatcacacggttggcagtgctgagctgagctgtctcccagcttccaggggaaaatgagagacatttccccagagcttccctttcaagctctcacagctggaagggtcgcacagccaagttccaccctcttcaatgcaggttgtcacttggatgccggggtctgctgatctattagtcaaatacctaatgtgagaaaaagagccatcacacatctttctgcttatccatcattcaatgctccatttagcacaaaagaacctctctcccctttttctcttctgctgcagctaaaaggcccctcccaagagataaaaattacaaaggaaataaaagaaaaaaacacgatttctgagccgatgctcattcgtaattccgtacctgaggctgtttgtttccttgaatctgagaacaggaagggggcttggggaccctctcatgtaaccccttattttacagatggagaagcagttgcctggtgaggtcaagtgactcaccccaacaccatacaactagcaagggcacgggcagcatcagacccacatcacctgatcctaagctagactttacccgctgcaccactgatgatttcttatgaccacagtcacagactcttgtaagatttcatgattcaactagatgccgcccttgcagaaggacaacatgagaggcagcccggtggcttctagcctattttaaaccaacaacccaaacagtcaaatttaagaacccagcttatttttcttgtcatgcggaatcaaatggtttcaggcagactttccctaactcacaaataagctgtgttctaacagtgtgtttggaatttgctatttaggacgcaggatgtgttttcttcccaggaaatcatgtgatctgatgtggtgagaaccccaggccaggtcacaaagg

SEQ ID NO: 33126 - DNA, 844 bp, Bovine  19866880601558
tgaatgaccttcaactgctagtgatcagttaaagcatcaaattaagacccttctcctgtccctccctccccacccccaaaatacacacacacacagaagtcacaccagggccccaagcgacagtcaaatggtcactaccacagctccatggtctccggtctctggcaggtggtagcctatttgggcctccttctccaaggatgggaaaggacaggctgcccggctccccacagcaggaaggatcccaggccaggggagcaagcccacatgttgcagccaagagatgtagggaccccggaggccttgcacaggcacagggggactcgcggccctctgtaggctgcctgctccctacccccgcatctgctgctcctctccaagctccgggttcgctcgctctctctccctctgtgtctcttgtctttgtgcttttctgtgtgctcggaaggcgcgattcagagtggccaggccagctgggggggcgtgggggggacggtggctgttcacccccattctctccgagtgacaggcatttgtggctgaactgctatttatcaccgcatacacttgctgggatcccggaggctgccatgtgggtggcaggatgcgtctggctgtgcgcgtctacgtgtgcattgtccagtccttcgtgtccatggagggttctccctctgtttttgacagattgctggatgaggaagcaggaaaagatctcaggctggccccgggcacctcccgggcatcaccgcgctccacttgccacaccctggtccccatgccccaacggagccgcgccctcaagcgcagccgcactcctccacgatcatgttgggcacgtcccgct

SEQ ID NO: 33127 - DNA, 1416 bp, Bovine  19866880660630
catgttgctgagattcctccagtaaagggctgacatttcacaatactcctctgatgctggggattacagcttaagatgatgaaaacgtggtttattcaaaacagattggggcggaagaaaacaaaggcaggcccccaagaggcccaacactctgtgctcccgctcccgggagaggggagcagcactgtcccccacctccccagcataggaagccccagtgctcagggggcctggattccagggctgggggagaactgggtcagacagagccattggccacctcagggagtaataatggccattgttcctgggggcatgcctaagtgccatgcagaacagggtgcagcacccgccatgcccagcacccgccattagcatcgctctacccattccgaaaagggagacctgagtctaagtaacttgcccaatgcacagagcggagtcaggattaagaacccagatttccatccaaggatcttatttttaaccacaggcccaaggcagaagaggcccagacacagggcagctgactgctatgtgaccctgcgtgagtaactttacctctctaggcctcagtttcctcacctggaagatgaaggtgataaccaggtcttccctgacagcctcaaaggtatggtctccagatggtccagtcggggctggcaagggagcagagagaggcgtctgggctcctctccctgtgatgtccctgagaggagctgtggtagtcaggctggctcatctctcctttgcagcggccctgagcaggtgacttgggcctctggacctccgtttcatgctctgtgtggtgagggatgagggctcggccagcttcaaggaggccctgaaggagcctggatgtagcttgggtttggcacagacccaggtcctaaccaaccctgctgctgaggatggcggactctttctcccttcaagcctgaacccccaagaccactgtgacagaaaagtgttctgtccagggtgggatccagatacaagggagcccctcccagcccccatcctgaggcaggggtctctgctccccttctcattagatgttgcatagggaccaccctcaggcccagagagcggaatcctccccagggagtgtgtgtttgccccctcacctggggctcaggggcacaggtgccaccttgtatcccctcctccccaggccaacatgctttggacgacagtaagcacctgactacccctggctcatgttttctaggcagtttttgtatctccacgaaattttcaaatctgctcctcacccaccccctaatcccctcacacacccacatgttatttggtccttgagctgatggcagaggggaagggtggtgggcagggaaagctgggccatggggcccaggtcacagtgaccacagaaggcagtgaccttggtgagcagtg

SEQ ID NO: 33128 - DNA, 2400 bp, Bovine  19866880664603
gattatttgattgagtggtcatgttgggcatcatctgttcaagttttgtctgtttatgatatgaactttgataattgataggatttttctctttttctcttgctctcagtttgtttacctgaaatctaatgagtttctgttggtgatctcaaggtttgggtcagctttctgtgcaaccagctcttccttcatggtggtgggtcaacagtggttggtgattattttcagtctttgctatgtaattgtttttcactgttattttggcttaactaacagcaaggtgctttgctcttgatgattgggcatatttttgcttcagttccaaataacttgataagtttctaagatcaaggggtttttgccctcgtgttttccgatgaccctcccccgccctttctacttgagaatatgataagggtactttgtgtgtgtgtgtgcatgtgggcacacacttaaaggataaacagcaaggcttctacatgtcaaattttagtctttatttttttaagccattaaaaacagtttctgtggtttcttactgaaaacacagctccagtaagaggctgtgttttgtctctctgttaccgccaagtctttggcaaagaaacatagtactgagatttcaactaaaaaagagctcatttaatacatgcttacattttatgttaatatggaatgagagtctggtttgtttgtatctgtataatgtttaaatctttagcttctcaattttaattggtacatatttaaatctatttgatttgttaggcattactcagttcctttgatgcagcattaaaaaagagaatgctgattctctgagtattgaatttcaagaaaaataaatttggagctgtatgtccttctttatataactgtattgtgactgcttttgtggaaatggagcacagtggtggccctcaggcccagcatgcctcagtgtgtgtcagcaagacctgggactaagcatagagctggcctgtcttggagctgatgggttccccagccttaagatgaatctacattttaatttctatttctgcatgttctgattctaatactttcacatgaatctaaaacagtcctcctttagaaagtgatgttaataaaatttggaaatgctccctgggtttggacggttgggtggaataatggactattctatttctggtagataacttttaaccagtttaatctaaatgtactctttgttcagttctgtagctttttatggctgatatcttctaaatgacaccattatttgagtgaatgatttggtatgtcagtatagaattacccaatatttaaactatcttttgagaatttatgtatttaaagcccattatctacttataaacaaaactgaatactatgtggaaaatcttgcatatgtaggggagaatataaaccaaattttctaaatttttagagaccctagattgcgggctgtgagttttctgggttagatctgatgaacagcttgtattgcagttgaaggaaagatgataattttattgtttaaaaaaaaaaaacgaaaaaggcttccaaatttgttctgaaaatccttttagctaatttattttcagtttccttaaggaagaaaggtgaagatgcatgccttagttgaatagaatgtctgtccttagacatttttataattgaggtgattttttccctttgtagttaccttaaatgtgtgctgcccttttggtcatgcacaaaactctggcaaatgtgttctttctactggaggactttgatcatttctaatcagaaactgcttctttgcatgtttcactctcttactttcatatgttgtttatagcaattgtgataaaaggcattaacactttcttggaggggctttttctcatcacattatctgtacctgttgaatttcattcactgtagaagaaacagtgtttctccattgttaattggaaacattgatgtccaattacacagcctctgtgagggcagattttttttttaatgttctttctgaattttgtttcctggacttcagttttatgccacttgatttgtgaaataagttttcacaattgccctttgctgtatgtggctttgtccttatgtaaaattgtcctttctgatacttgaatgaaatagattataagcattttttcttctcattaggacctcaggcaacttttctgcctttgattttgataacgatatcagggacagatacaaagtgtcttggtctctgtgaatttccttctttatttaattcacctgattctgattacttgtgcatatttccatattgccattttctactacatgtaactttgtggatttccccatttgttggtcttgggatgttctcattgcatggagtagatgctggtaactgctcgtagcagtggtgcatgctgg

SEQ ID NO: 33129 - DNA, 682 bp, Bovine  19866880696426
atctgtctgaggagaaaattatttgaactgggacttacgggacatgaaggagcccacacaggtctgtggccgaagtaaaccagaaacaaggaccaggggatgcaaatgccctggatgagagcctgcccggcgtagtggagtgacagcggtcgccactgcggctgtactgcagtgagaaagacgagagggaggtagaggccagtggaagccttgcagatcatggccacgcgtgcgaagggctagggaaggacttggtctcaagtctgttttaaggacattcctctgctaagtgcaaaagggactggatcagaatgagactcaatcaggaacatcagttgagctcttgaaacaatctaggatttagtcttgaaaggtagtaaaagaattagggagaaggagagaattatgtttggagatggaattgtttgagcttgccctagaggaaaagagatgaataataagtcattatacgtgttctcttggttgtaattcattttgattgagaaatagttgttcaggttcaaacatgaaaagactctagctgtgactttgaattgttcagttgcaaaataaagaggtgctttagtaatttaataaaaggatgactctaggttttttggtttgaacaactgggtaggtagcttggtagtgttacttaggagcttgggaatactggggaagg

SEQ ID NO: 33130 - DNA, 1618 bp, Bovine  19866880810612
aagaaaaggaacagagaggcaaggaccacagatgcacaggaaggaagccgggtgaccccactggagaagaagccccagccctgctgtctgtcctcacgagaacaggaggagccacctgccatcccccagggggcctgaccccacagaggcacacacaggccagctcagggcagcagggcacccctcaggtgcatgccagccactggcctgccacttcaagtcctgggaatttcctgggctcctgtgggacccacgggccaccctgtgacccaggagggtgcctggggatgctcagcatctgaagagcagaaacacgctggtgactcacatgccgccccctcttggaggctgcaacaaaaattcctgggccagggccagggtaggggctaggctgagggcttagaccaccacagagccacaggcagctggatggtaacctctacaccctaacgtgcccaggccagtcctgtcttcgtgaaattttgttcttagcccccactaattttcataccatctctatatttcacagggtaacaaatccacccctcagacaaacgcctggcagggcagtagctctcttgaacgagagaaggatggaaaaagacagaggccagaggctgcctcctgccaccagctgaccatgtggattgaggtgggcctctccagtttccccattgttgcttaatggggttagatataaccccttaaggtcccactactcaaatgccctgaggtttctgggaagaccccatgtgaccccccccaagctacaagttgcagcccctctgaccccagagggcctctgatgaaggcaaggtcttagccccaaagtcctcccacggaaacaagaagaccagccatggcacgtggactccagtgcccagggtgcctgtcctggctgtgtgacctcaggtaagccctgaaactctctgagcctcagattccaaaccctaggaaacaaagatgaaatcatttcccgcaaaggtatgatacaagggttgcctgataacaccatccagtgggtatctccaggaatcccatcaactgtagttgggcatgtgttactaccaccaccacccaatctaccacctgctaaaatccccacagcaaaaggacaactggcatcctcaggatagatggaagccttgcttctggcttccattccaagatattaacctcttcccagttgcagtcatctctattaataaacagagatgggcatggggtcaggtgggcttcaacctctcaggtttcacatttcctcccagggacaggggcttcactggcactttcaaatggtaatacactcggccctggtgcaacataattagtcttgggactagaagggtaaacaaatgtgtaattcatgaatttgctaattgtccttcattttgatctcctgccatttttcctagactctgcctgacatccgagcttgtggcaaggactcaaaagagtgccgggtgcggcccagggaggcactggcttcaaagtcggacacctggactcaccctccccccagctgccccctccagcctggagcccaccaccccagatatcacacaaggcagggagcccgtggcactccatcttttattttcttcaactgtacacaaat

SEQ ID NO: 33131 - DNA, 1615 bp, Bovine  19866880811341
tatattaatataaagcagttactttgttgatgtggtcgtttacatacagaagttgtggcacaatttatctttctcttgtattattaaaaggtatttgttctaacaaatattttccttaatgtaaatgacttaaatgcaaattgatcagaactacaaaataattactacaaaataaaagaggtgtaaacatatcccacattattgtggtataaataatttttatgaattcaaactactttggcaaccttaccatcagaatatctttaaatattcaaaacacagatattacacagaacattgttaaaaatccttatttccttcttccttcctgatttaagattataaaacaaatataaatgctttaattctacatgttcacattatgaacataaattatttaagtggacatacattcgaaatcttcgttctatgtttcaagtgcttttaaaaaatcagtcttctaatttgctttttcaaatgttttcacactgcatgtacatcagcccaaatacttgacaaaagctattgtttagtcagggaagcatgacaagcagacagagtggagccctaattagattgctttttaaagcctacttgttttctaaattaagtaaaaatactgcctgagtataattcttgagctgaaatagactataaacttcacaagaatttatgatattcacaagttacctatagtaatagaaggtgagccttgataaaatctttcaagtttctttcagctctcaggttgtggtacatctagtggagacgggagacttttgttcaaatagctgattagacctggctaatcacctgccaagagattataaacaactcccatagttaacataatcctttacccctgtttgtatcagccttggtgaaatacacaaatgcataatcgcataaaacatctctatgtgtatatactagtacttgaaatcttcaagcagctgtcataatggcttaaaatatttttatacactcgaagtcagtttttatatataaattttctctttactcttaatcaacatggtcaaccctttccgccctcctacttgtgccagcaggctgtacaaaggaagtgaattcttacgctatttactctgcctttattttgaattatgcactgatttaataaatactaagtgttcttcttatgaatgcagtctattccagaatattcctcaacctgtgtacacagtgctgacacaagtcagatggtcaacacaacaccttcaaagaacgtggtaaaaccatcctgaatcagaggcaaggttttttacaaacattcttagcatttacaaaagtcctttgattcaccaggacctatttccagttgtgagaataccaacattgatttcttgcacgtgtgggttgtttgggggaggcagggttggctgctggagaggggagtagtttagatacaaggaatttggcatttttgtcacacattattacattgatatgaatggaacctagaactactaagtgtacaaaaactgcgattattcctagaactctacttagatttatgaacagatcaaaaacattcccaggcagggagtcccctggaagtccagtggttaggaattggctctttcactgccatgca

SEQ ID NO: 33132 - DNA, 1171 bp, Bovine  19866880830075
tcctctgataaaacataatggaaaaagaatatatatatatatatatacacacacacacacacacacacacatatacatacataactgaatcactgtgctgtacagcagaaactaacacaatcaattagaaatcaattataaattgatttataaaaccaattatacttttaaatcaattatacttcaataaaataaaacttaaagaataaacaaaaattaaaaattgaggtttttaaccagaaactgtcacacgacagaagaaactctggcgggggctgctgtccccacttcgcagttgaggacactgcggcaccaaggctgaaagagctcctcccggatcccatatccgtggtggagctggagccagtgctctggtgtctgacttcctgtcttgtttgacaaggggagcgagggggcaaggaacccacccagggacccaccctgaggatcagcatgcagacaggggcgtggacagcaaagtgaagtcactcaggcgtgtcctactctttgcgaccccatgaactgtagcctaccaggctcctccattcatgagattttccaggcaagagtactggagtgggttgccatttccttctctagggcatcttcccaacccagggatggaacctgggcctccagggttgctggcagacactttaccatctgagccaccagggaagcccttggacagcaaagggggaaaaaaaatggagaccaagaggagaaagcagagtgtgggaaggaggtgcctgtatagggtgccgataatctcaaattgatgcctgacttgtggacatgttggaaaaaaaacactctgtgaaaaggtaagcaagttaaaaattattaaaaatctcttggtaagaggatttctagaaaattgcttatatgcttaaaaaataagcatataaagagctgctgacaattagaatccaaataaagaaaagttactcacttctttcaggtcgtgtaaaatccgtttggggtgaacttctgtcttgcgtcgctggaattcctcatacaaaataggatctcctctatctagctggggttttcaatcattgaaaatattaaaattgaatacagatgcacacaactacaactgttatttctctttaaaatgggtagaaacacattaagcaattggtctaatccatccatgatgttccctctg

SEQ ID NO: 33133 - DNA, 4552 bp, Bovine  19866880882873
cctctggcccctccaaagggctcccagcctctcagcacttggaagcctttgtgcccacattaagtcttgcagcaagaagctccaaacactgccatcatactaacaacattttatttcttaaaagaaaaaactgtaagtttaaaatatgtacatcatctatatttcagtcttttctctaaaactttaattccccaaatggccggaacataagcagacacagaggaccatggtgacctgcagaaaggaagtgagaggcactggtctcctggtggttttcattctaggatcaggtaggagctgagcgctttgctccgcaggttcttcatctcctcgagcaccttctctcctgccttctccgttggctgtgcttggtctttcacctctctaaatatatacatatatatatagaacacaaacccgatgaggacacatcagggcacctcttaaaacttcagttcacccatcaccaccctgcttctgggcccagtgtcaccagtgatgcctcatgaagatgggaggagctgtttatacacaaacacagtataaaccatactttgtgatcatttagttaccagtgaaaacacctggctgaaggtgattccaacctgatttcctgtctcagttgcactaggttcttagcagagccaagtgacctaaactctcagcctccgtttccagaggtacacgtggtgggaattcccatctctgaggattgttgcaaagagaaatgagaacttatgcatggacatcccggcatgatgggttctaaatgctcagtgggcaggagctgattctttatgtttatgagtaaagtggacacacagtatctctgactctgacaatggctctggaacaggggactcaagaaggaggattctgcgcctgggtggaggagtgcctgatgtggagcctggatgttgctggcatggtgaagggtagaactttccaaatacctgggaggacaggattagtgtatttggttgaaagcacagatgtctaaggatggtgagctcagctatatgatctgtccagttagaaaaattcaagacaaaattaagtgcttctcctctgtgttcacagcagcactattgacaatagcaaagacatggaagccacctaagtgtccatgaacagaggaatggataaagaagatgtggtacgtatacacactggaatattactcagccataaaaagtatgaaataatgccatttgcagcaacatggatggacctggagattattatactaagtgaagtcaggagagaaagacaaataccatatgatatcactcacatgtggaacataaaaaattaatacaaatgaacttatttacaaaatagaaacagactcacagatctgcggttgccaaggggtagggggtgggggggatggaccgggaatttggggttagtagatgcaaacattatgtagagaatggacaaacaaggtccttctgtacagcacgggaactatactcaatgtcctatgataacccataatagaaaagaatatgaaaaagaatatatgtataactgaatcactttgctgtacagcagaaattaacacaaccattgtaactcaactatacttcaaaaaaataaaattaagtgcttgtgaaatatttcctaaggagagtgaaacttcctaaagttttggcaaatgcctgaaagttttgaaaaaggagaagtatctcaaaatgagaaaattaaaacttccctaatgcatataattaaaaaaattaattggcaccactttatgaaatccatctaaaaatacatagttcatgtcagcccttaaatatgttaatggctgagtgatattgtgataatctaaggggagctgaatgatgtgtcaacaactaaagtcactcacacagtttcttgggtattttgcaatataattctccttagtaggtcttgagagggtgagatcaccatcaagatagcaaggaagctcttgggttgattacaaccttcaagaaagagcagatgattctttgcatccatgaaaataagtattttccagaaaccaaattgacagcagtcttcatggggacattaagtatcactgatgtgttttttatttctgtccgtctgtccaagctctcatgtgtgtctgtctgacactctgtctgcttccagctgaagctgaaggaggtgaaaaaaggcacaagtaaggactgaaaagacagaactgagcatcgggtcatgcttggtatacatggagagaatttcagaactgaatctcttgtaataacctataagggaaaagaatctgaaaaaaacagatacacacacatacgtgagaatcccatggacagaggagcctggtgggctgcagtccatagggtccgacagagttggacatgactggagcgacttagcacacacagtggtggtggttgaaattgataagttgtgtctgactctttggacccccatgaactgtaacccaccaggcttctctgttcatgggattttccaggtaagaatactggggtgggctgccatttccttccccatatttcatatttatatatatacatatacacacatcactgtgctgtacaccttaaactaataaacattgtaaatcaactatactccaataaaactttgaaaaaaatcatctgtgagatatcattggaatactatacagccaataaactgataattatattgataattttggcacatgaaaaaatgtacaaaaataatttaaactgcaaaataggtgaattcaaaatgccatggatctatttattgaaaatgtgtgaaatgtatgtgtattttgaaaaaaaaataacttggtgtgcagaaaatgcttagagttattgttgttttttctgttttttttttttttttggtaaagtagctgaaatacattaaaaaagaagagggaatttttttctttgggtgaagatatataaagtaataagttctatttcatttaatactcatttgataatcaaatggcatttgagactactttctgtagtcaaaatggcgaaaaaaccaggtgaaacagcaaggtaaacaatgaggtattgggtattaccctgctcatggggcaaactgttctaagtccaggggtagtttttcaaactgaaaaaaaaggttttatttaaaactcttagccatatgtttgaaacctgaaacaaaatgcaaagtgcatctctttgttgaggcgtcagatgtactatgtagtatagcatattttgttgctaaatagctgattaaaacagatgctcactgaaattctattaaaatttttttcccctaaattttgttttagaagctgctaatctactttctgagaagtgctggtttgctataggtttctgttactattacaaatgaaccaaaggaaccccttgctcctctaagatatgtgggcattcctttctgaaaaggcagggcctcctccaaacaccctgaacaaagaagacaagctaaaaaatgtacagcacacacaaggaagggtaattatccttaatatatgaggcattcttataaataagaataagataaagactttctgcaatataggcaaaagagccccagataaaagaagaaaaatatttggtaagtgtaggaaaatttttaccatcactcataaacgaagaagttaaaattaaaacaataatgtggtcattaaaaacctatcatattggaaaagaagaaaaaaacgtctgataatatccacgttgttcagggcatttgattgtgggcatcctgacctctgctggtaggatgtttgttgatattttcctggatggcgcaaagcactatgtattaaaaccttaaaatgaacatggatttagtgtttatgtttcaaagtttatcctaaggagacagtttgataagtttgcaaggaattatggcactaggaaatttgctgaagccctactggcgagagcaagacactgaagagctgacatgatcatcagtagaaagatcggttagcacatgatgggatatctaccagtaagatataaagacggatatctatatttataaacatatgataatatgctaaatgaaagtctagaagataaaacaatacgaacaatatgatagaattcacttaaacacatacagttggccctttgtgtccataggtccagcattttcagactcaaccaacccccaggtgggaaaaaatatgagaaagttccaaaaagcaaaacttgaatttgctgcatgctgaaaattatttaaaaatcatttacactggatgaggtattataagtaatgcagagatgatttaaagtataggaggatgtgtataggttataggcaaattctacgccattttacataaaggacttgagcatccacagattttagtacccaggctgaggggtgtcctggaaccaatcccccatggatactgtgggacgattgtatatacagtttaacaaaatacagtaggtgtttgtgagttatttaaataattaaagtattaatacttggaagaccacataccaaaatgtacaaggtactgaccctgggtgggaaggaataattgggttttatttcattcctttat

SEQ ID NO: 33134 - DNA, 850 bp, Bovine  19866881075428
aaattaagtcagagccagaaagataaacatcgtatactaacacatatatatgaaatctagaaagatggtaccgattaatttatttctgaagaaagagatatagagaccagatttatggacacggggagtggattagaagagggtgagatgtatggagagagaaacatggaaacttacattaccatatgtaaaatagatagccaatgggaacttgctgtatgactcatggatctcaaacaggggctctgtatcaacctagaggggtgggatggggagagagatgggagggaggttcgagagggaggggacatatgtataatacttacagctgattcatgttgaggtttgacagaaaacaacaaaattctgtaaagcaattatccttcaattaagaaacaaatcaactttttaaaaaagtcctcatcacaggtacaaagtaaagttgatcctcattaattatggattcaagaacaaacctcaaagtttagatcagcccctcttattataaacgacaaaggtataattaaaaaaaaaaacttacatttatataatttgcattgatatagtcttcattaccctttaaaatgacccgtgtagcatcatctgaaaaaatttaaaagaaagaatattttaataaagttatgttaagaagattaaacttaacacacaaagagaatagatacttacaaggcgaaatatctctgtatctatttttggaaatgttctgaggtaatttggcacaacacattgtcattccaggctttttccgatatagttgctaaaaaaagaaagtacaagacaggttcacaaagccatcgagagtttttacttttttaaacttgattctatg

SEQ ID NO: 33135 - DNA, 1186 bp, Bovine  19866881082589
tatctttttttctttaactttagtatagttgatttacactgttgtgttcatttccggggtttagcacagtgattcagttatacatatattacacactgaggcccactgccctccagccacagcctccacttcaagaggctctctccctgtattagggacccactgacctcacaagctggtcccacaaaggggccctgccatctttgggaacaatgtcgcctgtttatctgacagagcgtctgctttcttttcatcttggaggaaaagagctcctgctgggagccgctaagcccagagtaaacggatgacctcgtggtgcctttctgcccgaggtggggtgaccagcttgtgccccaactgtgcaaacagacctgaggctcgggccgcaggggccgggctgcccggctgggaggggcctgccctctcccaacccctcctcttccctttgtggtttcgggttgaatggggagaagctcaaaggcagggcagggaaggtcaaagccaatttgcagggccaagcgtgggggaggaaagcggggcagaaaccacgtgtttctggaggcctgaccttcacctggaaactaccccggcctcccctccccgcgcttctgccggcagcgcccaggcagggccggctggtgtccctgctactgagcctcagtttcctcatcctcaaggcaggggtgaagacagcatctactaggcctgagcccttctccagggatagtgatttatgatgagggagctgctgctgctgctaactcacttcagtcttgtcccactctgtgccaccccatagatggtagcccaccagcctccgaagtccctgggattctccaggcaagaacactggagtgggttgccatttccttctccaatgcatgaaagtgaaaagtgaaagtgaagtcgctcagtcacgtccgactcttagcgaccccatgggctgcagcttaccaggctcctccgtccatgggattttccaggcaagagtctggggtggggtgccattgccgtctccaatgatgagagagggagagctccaactgtgggagctggagccaggtgcctgtggagcaggcaaggtgtccccaggggaaggccagacaaagccgtcagctggggctgactagcacctgccagggacacagtgaagacacccactcgctctctgcaacaacataatccc

SEQ ID NO: 33136 - DNA, 874 bp, Bovine  19866881723181
tctacaatttaatgatcttatacttaaaaacagtatacacacattttttgtgaaaatttctattctagagctaacacaaagcaaagtgaaaaagaaggtatttgaaatattgaaatatgcttcaataatgatcattgtttataaataaagtgacattttcttctaaaattgcattttgtataatgaaatgggaaacactctttccttttcaattccttgctaacttttttttaaaacaaagcgtatccttacccttaagatcaagtcttaattctagtaacatttgaaagatacattcatttctttacagcatgaaagacatacaaatattattttttttcctttttaaagaacaaagcaaaagaagttaacagtttcaatcttttgtccatagaaaaatattttctatatcatttacacaacaataggtaggaaaattctacagtgtttaactgaaactttctatgagcaaaacaaggctttcaaacattttcattcttgtactggttttaggaacacattagaacctcttcctaaaactatagtcttaaacttgcaatattgctaatacctttcactttgtaaattaaaaaaacaaaacaaacaaaaactggtttacttatttattcactgaaccctgcctagtcagcattgatggactgtaccccagtacccctggctgcccaatcagcttagattacgacaataaagataacaataaccaccaaacttttgaaatcaacaataaactgtagaaaaagcatacaaataagtagcagcaaatttagatatgggaacaaaaataactatttggtgtctacccacaacaatttcacccagattataaaaataaaatgtgtcatttctcactgaa

SEQ ID NO: 33137 - DNA, 722 bp, Bovine  19866881734467
taaaatttgcatcttccactcgtggccatgagggtctccctccccgccccctcaccaagtcgccttggtacagggttggtcagaacagatgtcagcatctgggtggggtgaatggtccagggtcttggtggaacttccctcccacccaccaagcacatacactgcatttgcaaaaacaattccctatttggcagagggcagtgtttgccctgggataggaccttgcagccctgtgccaggccctgtttattctggcatggaccacagtgatgtccaagcactccaagtgtgttgaacttcctggatttcttatcacgcagtcaaccccgctggggagcaggtgaaacgctgctgtgtgcccagaagaggatattaagaagttccacaaacacgactcctgccgcccaaaggggcaggtagcacaggggcagggcccctgagggcaagcgggaggaggtagcaggaacagctcagatgcagagataaagcctttcctctcctccactccacctggacctcctttcccatcaccgagtccccactcccgaatcctctgttctggtcaggctggtctcctcactttacctggaacacagcttgccctgtctgacccctgaacctctgcgtgggcctgcccaccatctggaattcgcttcctgtcatctctcccattgaaatcctacttgatgggtagaagaaatgcatgactggaccatttggtg

SEQ ID NO: 33138 - DNA, 1639 bp, Bovine  19866881923245
caattgccaatattcattggagaaagcaagggaatgccagaaaaatatctgcttcattgactatgctaaagcctatgactttgtgcaccacagcagactgtggaaaattcttaaagagatgggagtaccagaccaccttccctgtctcctgagaaacctgtatctgggtcaagaaacagcaattagaaccagacatgaaacaactggttcaaaattgggaaaggagtatgataaggctgtatattgtcaccctgcttatttaactcctattcagagaacatcatgcaaaattccaggctggataaatcacaagctgaaatcaagattaccaggagaaatatcaacaacctcagatatgcagatgataccactctaatgggagaaaattaagaggaataaaagagcctcttgaggagggtgaaagaggaaaatgaaaaaatctggtttgaaacgcagtattaaaaaaattgagatcatggcatctgatcccatcacttcatggtaaatagaaggggaaaaactggaagcagtgacaggttttattttcttgagctccaaaatcgctgtggacggtgactgtagctgtgaaattaaaagacgcttgcttcttggaaggaaagctatgacaaacctagaccgtgtattgaaaagcagagacatcactttgccagcaaaggtctgtatagtcaaagctgtggtttttcccagtagtcatgtatggctgtgagagttggaccataaagaaggctgagcaccaaagaattgatgctttcgaactgtggttctagagaacgcttcagagttccttggacaggaaatcagaccagtcaatcctaaagaaaagcaaccctgaatatccattggaaggactgatgacgaagctgaagctccaatactttggccacctgatgcaaagagccgactcattggaaaagaccctgacactgggaaagattgaggacaggaggagaagggggtgacagaggatgagatggttggatggcatcatcaactcaatggatatgagtttgagcaaactccaggagatagtgaaggtcagggaagcctgttctgctgcagtccatagggtcacaaagagtcggacatgacttagccactgaacaacaacaactataacaacaaaccccatttttaaactgcttgttattctctgcttataaataaccattcctactgttgtttttaatagaaagctatttatcagtcttatactttctttaatgtagacccaagaagtataggtgtgattaatgttgaaggaatcatgtaacttttaaatgattgcagtacttttctattttcttcctttcagtgagctctgtgaacagagtatggacattatgctgactccagaaatgatcgaagcggaattcccaatgctggattacagggacaccaagaaagagaagtaagtgaatgctttatgccttaggaagaggtagcccaggataaaatttgtcctacatgacatacagaactgtttgaatctaaaaacatgtccaaagagacacgtttccagtgctttaggtatttagacatgtatcctatttaccacccatgccacctccagcctcgttgcttatcttcagtcactgggcctcagtctccccattcagaa

SEQ ID NO: 33139 - DNA, 2108 bp, Bovine  19866880498178
tggggcgctggcctctggagcaactgaaggcgtttcatagcaacctaaatcttaacggctgaaataggaaacagagcaaagaacgtggaaactaggtcaaggaggaaactctggtaaacctcctgaaatggctgacgtttcaaacgttacaattcctcttatcagtcattttcaaaaggaaagtatgtattcccaaagggtatcctttccagaccaaaacaagacatgtaagcagacaggtatggagaaatagagaaacaaaacccaagtcagccacgcacgcctcacctctgtactgcccagccttctatgtctgtctctcctgagctgcactgcctcctggacatgtggtgtcaggaaagtgggatccacttgacctgagatgagaagtatcagtaaggaaacaaattcattcacagcttgaggtcattatctttaatccattttagatggattgcttggctgatctgatggactggctagatggtggcaagtgtccaggcaggcataagctccagccagtctcctgttcaatatccactcacataccaaggagcaaaatgcaaccagaaatcaaaagaaagattagatgaggtatcacctacactttctaaaatgccattggcattctcttcctgtaatggtgttcctttgtgaataaagaaaagatcttacctagtctacctgaatattcccttcaaaggactatcacaaaataaacaaacaatcattcttatgtcagattaaaacatgtgggacaagacatgggtgtttcagtggaaaagagtgttcatggcagtcattgtgtgagaccttccagtcccacacaatgtgggagaaaaaatgccccagtgaggaaaaggggccctcaggcagtaattccagtagggttggcaatgttcaagtcacatgacctgttccagcacaaaaggtaccagttcgcaggtgggcctgggacctgtgatgtggccttgcacaaagagctctatgcaaagagagatgatgataattgggtggccagccagacctttcctcaggattgggagtggaaagtgtggcgtgaatcagcagtgaggaaacactgagaagacacaaagacaagcagaagctaagaccagcagagccgcagaaaggcagagcactgggagaagagaccctggggcccccgctggagtgcctgaaggtgtgtgtgagggggttactgccatcccgacctctcctggctttgtgaggccaggctttccagccccttgctctctctctggaggctgatgagtcaattcttcctacgtttccataagatccagctatcagctaaggttcccattggcggcacatgagtcaccaccccaatccatggtaaccaaagagaccaaatgtttaaccaattagaacttagaaagacagggagactggagagagaaaagatagaaaacagacaggaatgtaggccttgaaaggaaaatttgagtagttccagtaatttgttcatgagtagaagtcctaccaacatctctgtcaggcaagacactttcatttcagagacttctcactaaaaatgaacagcagctactgaaaaccaagagtaaaaagatatgggatattattagctttttaaatcattccaaaatatttttatcatattttaaataattttcatcattagtttcaaggtatccaaaatcattctttggccttctcagtttcccttttttaaactcacagatcaactttactcattttgctatgttttaatattcagaaagaaggaaaaatttctcagataaaaaacaccaccttcatctttactttcttatcctctctggttttgagaaacagaaaaagaaagaaagactcatttagtttcatgcctcaaccctcttctccactcaaaccatccccaaagaggcagattttttttcagaaactcagagatatgactacagtgaagacagaaagaaaggatagaaagctctctcaagccccagggttattgctagtttagaaaaaaaagttctttataaaattccttttttggcgggggtcactccataacagctcctcctgtcattcaaagcctttaatgcatcatctgaattgcattaaat

SEQ ID NO: 33140 - DNA, 1470 bp, Bovine  19866880503742
cccatggactgtagcctgccaggatcctctgtccatgaaattctccaggccaagaatactggagtggggtgccattcccatctccagcagagtctttctgacccagggataaaacctgggtctcccccccttaaaagcagattcataattaaaagttgaatgatataaacctacaattaaataagttatattaacgataagggcgatcagtactaaaagcttgtccctttctaattgttttactacattttaccagtatctatgtttttgaggttattcatgcttatgctatctatgtggagtaaatataatggtgtattacagcacattgatcccagttccatgttcattgacatcagcttgatatcagctatgtcaacagtctttaccctgaatgaaaaagtgaaagaaagaaattgaaagtcacttagtcgtgtccaactctttaccaccccgtggactttacagtccatggaattctccaggccagaatactggggtgggtagcctttcccttctctagaggatcttcccaacccagggatcaaatctatgtctcccacattgtgagcagattctttaccagctgaaccacaagggaagcccaagaatattggaatgggaagcctatcccttctccagcagatcttcccaacccaggaatcaaaccagggtctcctgcattgcaggcagattctttaccaactgaggtatcagggaagctttaccctgaaggaaactggaaaatgcaacaaattagacatttttccctcctgagagtcagtggttcaatatgtcctggcatagtgcaggaaggatattcctgagaaccagtgaagacgcacatcctctgctcacagaatttctaactaaatcaggctacatttggttctttgggttctgaaatggcaaccttattcaggagaaagtttccagtctttgaaaaagtggtatttcaaaaatatggcatagaggttacccccaggttctgattcagtgggttggtgagggctgcacagtatgagcacaaggtcctatgtgtcattgggaaatgagatcacatttgcaagcaaacacccatcagaggatgtctcagtcaccctctgcttcattttgatagaaaagaaagtagatgaaaaaattattaccacttcaaataagtcatcgactttctaaataaagactgggataattagacctgaaaatacctgtagttttaaaatgagaagaacaataggactctgtttctgccttgcagtggctgcattataaaaacccaacagttatctgctttcaattgttatccctcatgaaagaggagataaagaagatgaagagggaaaaacaggaggggcaaagagaatcactttcagaaagtcagtaatagttaagagcaaagacatcaaagtctgctgttaagtcataattatgatgtttaggtgataataaaaagaattaggaggttcccag

SEQ ID NO: 33141 - DNA, 860 bp, Bovine  19866880613631
cacccactcttcagcttgacctgtgtacccaacctccctgagatgccatctagcttctgaatctacaggcagcctcaaggttgctcttgttgagacatgcgacaggctaagacactaaactgtcatgggacatcgttatcctatggtgtctgttcttggcacatttggacctgctatatttgagtacattcttaatatacaggagcatatatgttccagatgatagatgtcatgcgatcacccaaagagacagttgatttttaaataggtggccacattgttttggcaatgctgagttgcctcctcttaaaacatccagtaactagtaggggagcatgaacaaggcagaatattctgcagtaataggctctgcggcatgaagaagactcattagaaatagaaatgtgggggagtgcctccttgtcctcactgtccctcactgtcctgcccagcaggtgccacctcctactcagttgcaaacaagaagctcccactagttctccagcagcaactctgttgtcataatcaccaagcaaggtttgaagccaagcagcccaaatgccattctaagtttgtaaaatacgcaaagatacatcaatacagcaggtggagggtaagcctgcagaatgcaacacacaggctctgtaaacagggaggaagctctcggcataactcttaaaaaaggattgtgcagagtcccttaaagataatgagaagcaaattgatgtcatcatttgggagaagaaagggtgatgatcctgagcagatctagccatcctttccctcaggtcacaaggccccaccacatgcttcacactatccctagactccatgtgtcattactgtttgcagttcatacg

SEQ ID NO: 33142 - DNA, 3615 bp, Bovine  19866880649221
ctatcctagttttcccctggagcttcgaatagggcttttgggagaaaacaaaaagctcccatcattacggctgcctccctttgagcccgttagtatttgctgctctgcctagtagtgttaatactacgaacagttcactttttagtattccattaaaaagaaaagaacagtgaacatgaaaaagaaacaaagaacagtttcttcttctagtgagtctggaatgctgtgttactgccaagatcttcaccaggagagtctctggaccatagcttagaaggccaacagaatgtactagaaagcaaaagtaggttgttggagtcaggaacaagccgttaggttttaaacttaaaagaagtgttttgtattttacacatattttcaacagtttacattttttgtagttaaagttttaaaatcttggatttggttactatagcactgatttgagcttatcccatgtctaattgcatgaaacagatttgggccaaaaacctctctataaaactcatataaaacagaatggttattagatacatatattttctattaaagctaaggcatgccccaagtaaatttgctagcagtactacatagaacaaacgagaaatttgaaagcagagcattgacatcgtggatattttctggctatacactttaggacttaattcaataaaatagtattcataatatgaggtttcaatgctaggatccctagcaaatgcaaaattgagaaaagattattctgggaaaaggtctttgtcacttgtccaaattcattttgactcttgttattctttgcaattgacaaaactagccatggtcagcttttagaagtatctggtttgttttccagttacaaatggagtcatcctaataagtcatgagcaccatatacagttctcagtagtgtaaaaatgttaggttcttggttacagtgtaaaataatccatagtttaaccgagtactaattgtgagattatagctgttcaattgcagtgagatagataaacatctagacatttcagattaaaatattagaaagtggttctttctctacttgtgtaaccatcagaaaaaaagaaggtattatcctagaatattttgcaagctgtctagaaatgaaaatgaagacataaagatgtatttactaaagatgatagatatgaaaaaaatagaagcgccctcaagcatgattttgtttgaacatatgtctcttaaggtcacttttcacatgaatatcctacaattctgagataattaactcttgagtgagaagaaataaatttaataaagaaaatccaccagattttatccttgattctacctgtaactcctcccattacagttaataacaaaataacaattcaggcttgaacgttgggtttactttgacccatcttttccattatccagtcatcttgttggacactggttactaccgactccaccgccacggtgtcattcatatccactccatcttttctaggtttacaatcaaggttctagggtccaggtgttcacagcctctcacccagccttttgaagcagcctgtgattgtgctatttaatttttccctcttgtccctacacgttgcccctcagttaatattcctataaaatggtttcgatcttgccatgcatgtgacctaaatacctgatggttttagcagtgtccaaactccagagcccagtaaactaggctgcctgcaatatgaccactgccttggacagcttcctttacatgtctttaatacattctgtctttcaggcacattagagtaacattccatcaaaagaagacatactgtacagtcccatctctgaatctcaagtcttatgcttttggttcctttgaagcagcaactgaaaatcttaaaaaccattctcaccccttatctcatcatcctaataggtagcactggttaatataatcatgttgcttgcttgtttagatcatctgtgctgctcagaatctttctaaacttttgtccagacaactattttgacttgacctggtactcgtgatgaaattacttgcctcctatcacttaatactctaacggaactttgaattaaaataggtggtggatgtagactagaaatcattgtgtttgggaggaaggaaagaaattaaagtcgaagacatttttccagcttacagagaactgaatctgtttctcatacagcagcaagaatctacgtggacacaagcataatcaaatctaaaacgtaaaatgtagaacaagaaagatgaattacactctgatcagagagaagaagaagaaatgttgacttgtttgaatattcttgcacaactttctttggtagctcaatatgttctgggaaagaaccctgatgatgaatccagaaaccgaggttctggttctagctctgtaactgagttaatatgggacttccagaacaccttctctgtgtactttgtctttttatgaaacagatggaccagttctctgagtccctaccaccctgatcaactgtattagaattcatggagtctataaaaactgcacctcccttttatacaaacacaatgaatactgtgtaagacaaaaagaatggttacattctttctgtttgtgttaaaatatctgataggaattctccttgatgctctctctcataatactgagcttcagcaaccatcaaatgcttgagttattatggaattgaacagcagattgacagtttcttcccaggccctcccctcctcccctttctcaggccaatcagaatcttctcctacccttagtcatgaagatcacaaccctcttaaacaccagtgtatctgacaaggaaaatggttttagcttgcagtctctaaaatctaatgttgcttaggtgcaatattcaccacatattttagcaaatgggagataattcaagaggcagatttttctcagaaacagaatttatgtgccttaaaaccaatggatttgataatacctttagtcaaaggaagcttaaaacattgggttcccagcaagctattattacttactctgtttccattttgctctcaagagtctaattgatataattggtataagaggaaaacaacaggaatacttaggaccgaaaccattcactcaacagtggagattatttaataatttcacttagcaaaccccttgcactttccacagtagcagtatgtattctcactgtcattaacagtacctttcatccactgatttcccagaagtgttaatgacacagtctgtaagtaattgctacacttatctaattttctttcaggtaatgcagcatgtttgtcagtttaactgaataggctcatgaataactttattttcttccaacttctaaaatgtgaaaaggagaaggagaaaacatctatctgcggacatcctaactatcaagtgattcctaatccactgacgggtgattgctccctagcttcagtgtttgcactttggggcaggtttgaatctcttttctggaagatggtcgttgactccacctgtaggtatgctgtgactcagctcctacgggggacgttctgtgctctatttagataaaaacatttcaggttccttaatttccaaaaagaacaacaacactgctgctttactgttt

SEQ ID NO: 33143 - DNA, 1575 bp, Bovine  19866880696441
tcaattgaaatattacaaaatatcccctaactctgtagtgaatgaattagcaaacatgtcaatttgtttgacctgttaaaatatattcaacagttgagctgaggaaacatagtaacagtaactctacactgcttgaatgggtttgaaggcacatctgtgacctaataagcaaataaggtgtggtgggaaccaaaagggaaaatcaggatcccaaggcaccaccctcacagcatgttctctgtaatgggacacactaagccaatctcagccagaaagcattaaaaactaggagagactaaccctgactaagaagaatgtgaatgtctcaccacagagtcagaagcagaaaatgaggagtcctgttctctgactccacgtggaaaagagagccatttctttttgctcctttgaacacaagacatcctgtacatctgtcacgagtgcatttggcttcaagccacagaaactccaagtaagcaatggattaaacaatttaagggattttccttctccttgtgtccaactgcccatgatggagtagctccataatgttgtcaggtacggggctgcttctactctccgattcagtcattttagtcggtggcccttaccctcatgcttgttacactgtggtgacaagacggtgctgtccaagcagaaagggcatagagaaataagagaaaagcaaaaattcatgctaaggaagctgtcaccttaaaaatctttcttgcccaggaacttccactcatgtctcattggccaggatgatgctcatgaccacttcttgcagcatgggaggctggaaatacacttttttacctgagcacattatttccccttgctgaataataagaagaagtgtgggaaatggacaggcggcaatcactgtcttccacactctggtaccaacagtctgtggcatccactaccaaaagctgacagtttgtatgggccaagagatggcctcaggtctatataaccaattccccacaagctctcttgatggaggttgctacatctattacctttacaacttcatagtacaagagcataaaatctccagctgcaaacttggaaagcgagggagaaaagaataagtcaaaagaatatttctatcctcaatcacagtcgctgttagttctacccatgatcccctcccttctttcttgctcataagtgaatctccctttggcttgtcagcaatgtgccaagttgcatggtaggggctggtaaattatagcctcccatcaaatcagttctgctgccagttttataaataaagttttattggaacacaaacaagcccattcatttacacattgtctatgggccacttttatactgtggaagccacacaactgagcagctgctacagagaccatctggattgcaaaacttaaattacctactatgtggccctttaaagaaaaagtttcaaacccctgtcctagataattacccatggttggactgacccagctaagacatggttcttcattcttccaccctctcagacacctggggtgaccatagaaccatataactggacaactgccgggacgcttctgggggaag

SEQ ID NO: 33144 - DNA, 711 bp, Bovine  19866880713367
ttaactcccatatgcagtgttggaatttaataccatggttcatcaatgtttggaattcaattgaatataatagatcttgcccctggaattagctttataatacaattatatgtaaagcaaaattgattttaatgattgaggtacaataacttcactaccaagttaaggtgaaaataataaatttactgcaatatctcggctctgaaatactgactgattagatattttaacccaaccatgcaagttagaacaaattctctttttttaggcctgtagcaaattagttagtactgcaagaaaccaggcagcacacctacaggagataaaatcatcactgcctttctttggtaccatttcggaatcaatggcagcagaatgacctttaaagttgggatcacgtagaacacaccataaaaaattttaaactgaattaaaaaatatttttgcaaatggactatacatgcattcataaatggcagtgagaccaaactgagttgaatgtgaatatgaaagctaatacgttttccaagtcttcgtgtgtaagaaattacatgttttctttgaggttaactgtaagttatattttttgtttatgatacaaaacttgtgacaaaaagccagtttctcaaataagaaacatttgtagtaaaacaaaaccaaaattgaacaaattataaacatatatgatgtaataggaaaagtttgggaatt

SEQ ID NO: 33145 - DNA, 1458 bp, Bovine  19866880728557
ttagtagataatgcttgaaatgggttgtggttacatggagaattaattacaccattgtctctactttttttacatgttggaaattttccatattttcctacatggattgtatttattatatacataaacataagcatgtattttaatgaatatatgtatgttgatccagattctaagtatttataaattcatatatatatatatatatatatatacacacacacacacataagtaaatatgcctcgtaagaacaataaaaatgtatagatttttgattaacccagttgccctatccttcaatttattggcatcgaattagtgttgccttttgtgtaattatcccctttcccgtgggcagcaatatcaatcatagtcatcaaacaaagcacactcaccttccctttggaacacttacctacacatatgggaattccataggaaaacaatagaaattccagcaattcccagttttctagttaacttctcagccccaaccactccagatttcctgaggcccaacatgatgtagatgcggaaattacagtactgagtagattgtgggtgttctcttgctgaatttgtgcaacaagtttgaaatgtgtcaccactgacaccaatttcttcgccaggcaatgccagatgcctcgtaggtttgatctaattagatgttgtatcttcttacgttaatcttttacttactggttttcacatcagtgctaaagttcaaccacgctaaagcgtgacgatgaatcagataaatcacctcttctgtcctcggaaggaatgagtaaggatctggagaaggaacctgggtagggggtgactctggtgaaagcccttctgtggcagacatcagccagaaatatagaggctccactctaaaacttctgtgaacttctcacctcttctcttcagtgccaacatgtcagctattaccgtgtctcctttctcaccttcaaatcacactcttatttttagatatatgtatgaccaacctagatagcatattcaaaagcagagacattactttgccaacaaaggttcgtctagtcaaggctatggtttttcctgtggtcatgtatggatgtgagagttggactgtgaagaaggctgaggctatggcttttcctgtggtcatgtatggatgtgagagttggactgtgaagaaggctgagcgccgaagaattgatgcttttcaactgtggtgttggagaagactcttgagagtcccttggactgcaaggagatccaaccagtccattctgaaggagatcagccctgggatttctttggaaggactgatgctaaagctgaaactccagtactttggccacctcatgcgaagagttgattcattggaaaagaccctgatgctgggagggattgggggcaggaggagaaggggacgacagaggatgagatggctggatggcatcgctgactcaatggacgtgagt

SEQ ID NO: 33146 - DNA, 1754 bp, Bovine  19866880775941
tgattcagctaatgcagtttttcaatcattcagttaaaatttactgagcacattctgtgtatcagcagttctgcagttagagacacagtgatgaacaggcatgcatagtccctgtcctcaaggagtttacattacagagtactgaaggtgagttagccaattgacacacatcacaattgctgatggtgaagagtttctcagagtaaaacaagtcctagtggagatacaatgggttgaggaatgggagtcagggatggctttctaaggacagcctgcacatttaaaactaagacatgaatttagactggctgatgggtaggatgtgaggctgagagggagagacaagagacatgagaggccttaggaatttgggcctgaacaactgagtatgtgcttgtgacatttctctgactggaaacgctatgggaagagcaagtttggggaatgtcaggattcattctgggacagactatatgtgccttgcctgtgatcacagaggagacatggagaaggccattgcatttaaggttagaactcggtctccagtgtagaatgtataggttgaattggtttattggtaagacccttccaattccaatattctgtgatgctatgaactaaagtcaaagcagctgaaagaagctgtaaactaaagaataaaagagtaggaaagagaaccaaatcaattttcaatggagatgaacaaaagcattcatttagaaaagagacaaaagtaatttgccaaaatgggaggtgaaactacagtggaataagaatagaatagttcctatctgatatgtacaacttaggtttccgtgaaagctaaaacaaaagttttcaaagtgaatgcttggtagtaaatttcttattatcaaatgacattgaagttaataatctcctgctcatgaatgacttttccaagtgctttaatttatatagagggtttgttgaatgaactattcccaagacagctgtaaatcccagaagtaagtagttcaacaaatatataccagttaggtatttttgtgcggtttttcaacattttcatggaaatcacaacctgaaactgatctctgaatatgacacctttcccttagtaatcccaaggcagcctggatacattaataattcataaaacaccaatattttctatttaaagaatgaggcaggaagttgacaaaataaaagaataatcacaaaaatttccattttaaatttcaaagtgtgtttcagtatatcagtgaccaagaaactgacaggtatgggtaatacgaaagatgactccaagtgaataaacttatatttctgccttctatagtttccatggctacaggcccatctgaattgcattagtcacacacagcaccaagaacgaacaaaagaaaatggaagaaataaatggcatcagaatgtcatagaaagggaaaagtaatcacagattattttttaaaggaacacaatttttcttatcaagaactatctgctttagagtccacctccttcagaaggaaatgtttccagtcaggtctggaacttttttatgaaattgataaataattactctgtgtttttaaaaataaatcaatttattggtggctactcggggagttggtgatggacagggaggcctggcatgctgtgtgattcatggggtcacaaagagtcggacacaactgagcaactgaactgaactgaactgatgtggtaattagagcattcagaacattctgacatattcacagaaatgcaactta

SEQ ID NO: 33147 - DNA, 915 bp, Bovine  19866880814895
actgagcacttaactaccaccttctcagccttttatttaatgcatttaaaatactcttataggcaatgacttattcccatgcatcaatggctatgccatggtgtgaaatactatttgtttccgtaagatattctggggaattgttttcttttttcacccctaggaaaaacctcaacaccatttggggcactatgactatttccaacttcagtttgagagaaaaaaaaattgcaactgttctttcattccataaaaatcatagtgcagtaaatccttttcatctcccattgttaaaaatctgtgatctgtccataggtttctatttccaaactcctaaatgagaagactttctgtttccagattctagttgcggtttcagtgtcttccccttcctgtggaatggaatgaaccagagcagcaaggaaaggtcattctgttgccaggtgggtgacatttgggccagaacttgagactgctgagcagcaggccaagctacgatattagctcgttccctgctgggccccagcttggagacagactttagaggaattgatgaggattttgacccacttacctgaagaaggctccacagaaagcagaccaaagctggagaataggagttcagccaaagggttcgttttactaaaacaaaaggtcaagtatgctagcccttagccaggcctaactggacgttagcttttctcctgttttattagtatgctgaaactgtgcaaggatcattctgtgcctttgacaaatcccgctcaatgcagaggttccctcctggtccttctctccccagacattagcttaacacacttcatatgtgggaaaggctcagcacaacaacagagagggaaagaagtatctgagtttgctgatgtagcagctgcccatgccatggttcatcattct

SEQ ID NO: 33148 - DNA, 1026 bp, Bovine  19866880824485
aaaaaacccagtgcagccaaaaacaaataaataatttaaaaaaaaaagacaagaaccaagagaaaatgtgtccaacaaacttgagtttggggcaaacacagtatttttcaacaagattgtggtcatcagaccaacaatgttttggtacttagtgtgttcatggattgttctaattcttaccaaagacctctgaaatgtggccacaacgattctcattgagagtcaaagatgagagtacagaggtttaactatgttacataatgtgaccaaggtaaaacagacagaaatttgtagggatgggtcttaaagacaggtctaacctgcatgaagctctcagagacccaaagcctagttttgttaggctgtcttcttctctgaagatactggatgggaggcagcatgccataacaacatgagtataggctttggatttggacattcttggattcaaatctttcctccatatgctagtttctgacttctgtgatcatcaacttccttattccttaaactgttataaatgatgcatgcaatgcctgccacaatgctcaatgtaatgcttaatatgtgttgtgtgtgtgtgcgcaaagtcatgtcagactctttgtgaccaccatggactgtagcctgccgggctctgtccatggaattttccaggcaagaatactagagtgggttgccatttcctattccaggggatcttctagatccagggatcaaacctgtgtctcttgcgtcagcagacagattctttacctctgagccacctgggaagcccctaatatgtgttaggtattattatttatatgctagagtagacaaggctcggagaaggcaatggcaccccactccagtactcttgcctggaaaatcctatggatggaggagcctggtgggctgcagtccatggggtcgctaagagtcaagacacgactgagcgacttcactttcatgcattggagaaggaaacggcaacccactccagtgttcttgcctggagaatcccagggacgggggagcctggtg

SEQ ID NO: 33149 - DNA, 1511 bp, Bovine  19866881170393
cttccattgtgtagtgcgtctagcccggcttcctgcgtgagaccttaacctcacttggagcaggagcgattactgagaatttcggaaccttgagttgcaatggagctgtacggaaaggtaagcagaagggagctcctccgccggctccgcgtgaaatctcgctttcatggactttgtgtgtgtgagtgtgtgtgtgtgtgtgtgagtacactcgcgcgcgtgggcgccttctcagtgcaactgtgtgagtaaaccgctttctttatgtgtgtaccattcattgtcgttctcccccgcgtttgctgaatgagattgtaaaaccaccctactctgcctatggaaatgtacaaactttcccgattgggaatggggacgtgtagggcggagagttccagaacacagtgcaggtttcgtttagattgtaaattagcacaaggtagtgcgtttcctaaccaggaaaatcacaatgtagcttcggaagccgataggtagcaaagaaaaatctccagctgagatgaatgaactgaggtcactttcgcctgcaccttgcgaggaaatagctcgggaggctgagagcactaacaaccaggagcgagtccaaaagagaagggaggctccgcggccgagtcctactggagaagcagcccgtttaaatgctggcttgccgggaaatgtagtttactgctccccggtttgcggggaagctcagctaggctagactacaactcccaggagcactcggggctccgggccagtacgcgtgtgcggcgccaggaagggacagctccagtgctgatgttggagccggttagcgaaccccgagtgcagagtggagcgtgaagcgcgcgggctgtgcacgcttgaccgggcgcccgagccagcactgtgttagccagggagaaaggacactttgcgaacaatgagacacgaagctcccatgcaggtgggtctatatagaaagtgtggcctcgggaggaattgagagagacgctttctccctcgctccaagtacaaactgcgcccgatctaagggaaggtcttaggcagccatccgccgggacgcggttcagacttggtcctggggacagaaccccgctccgcggggctgtgattggggctgttttgaggagggataggagtatacattatcttcccgggctccacaaggaggataagagtgtctagaacgtcaacccgggcaaacaaaagtcagaggaacatgccatctcgtattggtattgattgttcctcctgtcttgcctggttcgtgatcacggggcagacacaccaggtctggtgttgcgagctgtctactggagtcggtatagagcaaattccgcttaattaagagctctctaagaaaggagaaaccaatgttagagtccccaaagtctctttcttcaattagggttctagtaataatgagcaaacacttcagggcttcactcttcccagaagtatgcaagccctttatctgtgtccacacggtttactcttgcgtttcagagact

SEQ ID NO: 33150 - DNA, 741 bp, Bovine  19866881209203
ttatagttctgtgtatttctagccccagttagatgcctgttttatgggaggaccctgagccagtgggctgagaagcagcttcatccaacccacaaccccctacaccttgtgccaaacactgtctccagaaacaaagcaggatgcaaacccaggaccagaaagtattcccacaggactcccccacatcgcctggggtcttctacataagccctatcttggcccacgggcctgctttacagcaacggcagcttccctctttgcttcacactacttgcttgtccaagtctgagcttggcagactacctcacctacggcaggggtatctgagggacagcccacggatgagctcatctgtgcactttccacagatttcaagaacgcttttgtctggtcttctgcaaccacatgagcacaaagtacatgaatgtctgaaaaatatgggtgcatctgtgcccctctgggcaggcacagatttgggacactttatactagaaaatgctctgatctaagaaaggatatgttactgcatggctaataaaatgcatcatctgtgtgcattaaagagccctttcaatccttaattattatcattatacccaaacagttagtgctctggaatttcatactgggatgggctttgcaaactagcacctcaatttccccaatggctggctgagggcagcagggagcaggcccactgagatttggacataccacagacaattcctttagaggaatgtt

SEQ ID NO: 33151 - DNA, 3580 bp, Bovine  19866881252439
tgcccatttgttttccgttccgattcctgtttaagtccgttcttatgtttgcttcctttgactccctgcaaaggtgcctctgcctaagcatcgtgcttaagttctgtttttaagtaaagatgagtgatgctttctcgtttgtatgtacaatcagttattactaaccatcagcctgtgttcattatcaaggagagtgatcccattgcgtaacagaaaggcactttatgaatgaattgagagggaatggaacacaccgtttggaacgtgttgtctctcttgagaacccacccctgctgccaaatccagcaatataaatgtttgactttaatttgaattcaaaggttttccaactgtttttcctcaaaaaatcaagggctttaaacgtatgcgtcaatttacttttcctttatggtgtgggttatgtatggcttctcaggtggctctagtggtaaagaacgagtctgccaatgcaggagatgtaagagacgcgggtttgatccctgagtcgggaagatcccatggagaagggtatggcaacccactctaatattcattcatgggttatgtatattaagagatgttgactgttaagtgaaaaaaatttaactgtttgttgaagcattatattaatgaaagctctcaaattgccttatgagttactgaaaacttgatttgttccagagaacagttgccctgctgtgtatcttctaatacctgtctttgtgacttagtttttcattatagacctgatgtgaaaagaatctggacagacaataaaggtacaggctgttgtaatcaagatgtattggcttatgataatttcccattactggagttactgccaagagccaactggctacattaatcatatttgattacaagtaaacattgacagtagactttaaaagtagattgttagtattcaacattaaccccatatatgcactgaagtctttatgttaaaataaattactaacaaattgatcacagtgcatcttgatttttattttcttacagtatttattttcttacaggtattgcttagactgttcagaagggtcatcaaaatattacagaactacatgaaattagtgccctaagaaatatttaaaatcaattcatatcaactttgtagtaggcactgcaattctaaaatttagtcagaactttaatgaataattagtataaaaacgggtaacaaaattaatttgcttctgcagttattttcatatttgggatgtattttattcattgacttggtttttttaatttaaaaattttaatgcccaaatgctgtattgaataacatgtacatttaaaaaaataaaaaacttttttctgtagtatatttaaagcacatttattgattcagtttaccaagtaaattgttgtggtggccaactctcaattactgtcaggttttcaaaaatatataatgataggaagaaataaaaactataaacatgctttatatatatggcagatattgccttagcacttgcacttgtgaatcataatcacattccagatgactttgatatatgaaaatataatcagatgaataattgacattttttccatttaaagaccaaaccatatcatttaaaatgctaatttactttttatattttcttaagtcaaagaaccctttaaaattgttcaatatattttaaaaaagtatttattgtgcctttgtacatagcttggtgctctgttcagtatagctgtctttgatatatgcaaattttctgaagaatatttctctttgagttgatgcaaaatgcaggataatagcagtaatagtctttgctgtctgtatttccaactaaataaccaggaatagcatttggtaagtgttccaaatgatggattacaattttaatgcaggagatggtcattttgtgttttttcctttagtgcctccataaatcccgaggaccaaatgaaatggggaatagcagtgctcatgacttaagggcaacactttcatgagcaaattatcatttgattcaggagcctgattgaacaaattccagtttatctagtgctttgtctgtgccaagcactgtgctttgcagtcagatctatgtgtgtgcgtgtgtgtgcgtgtgtgtgtgtgtgagaaatataaaacagtcctagaggtcaccattaccttaattacaggcagataactagagctttatatgattaaacaacttgaccaacacggtaaattcaaaattctgctagatctctaggaagcccatgttgtttccgctattattttgggttccttaagaagacacaaaaaggtgatataaagaatgagtgccatgttgattttcatttggatcagaaaaaggaaaattgtctcttctgtttataaaattatcttatataaactaaatcaaatatttgagaagggtcagtgttttaaaaatggctagctctttgtcttcctggtttaaatttcttatagctttacttacactctccaaggaccaaagtggagttcattgtctgtgtttaaatgcttcatcttcagttttgttatccacaagctttcttcatgtaggtgtgaaagtacagagagccctctaactacttcagttcagttcagttcagttcattcactcagtcgtgtccgactctttgcgaccccatgaatcacgcacgccaggcctccctgtccatcaccagctcccggagttcactcagactcacatccatcgagtcagtgatgccatccagccatctcatcctctgtcgtccccttctcctcctgcccccaatccctcccagctacttaggaaaccaaagaaaaacaactactcaaagcgtggagcggtgtgccaaaaaaggttgtttggctaaaaatgaggaagattgaagaaagagtatgctgaaagtgtagaaagtgtaggctgaaaatgaagttgaggtggaaagcacaatagatattaaatacagccatgctgtataacagcaacaaaaaaacttagaaacaagacctaagtaacgttgtttcatttgtctgtgagaagtccacaggcaatcttgcattttattactgttgaatttctaccacatccaacttcaaattatgatccctttatctttacataacaaatggaagtttagtcctcatcccttacagagacggagaaaagccatagttaacattggagaaacaagaacttctttcttgctcgatttgagcaaattcctcaagtatccacctttcttctgtaagggaaagtggagggtagagagggaaattgccataaaagcaaatttctatggtgtaagaatgattttccgttttcagtttaaagagttgtgggatcattacatggcataaccacaatttccccctgccattttaagcttatattggaactgcaaattcctttcttgaccatcatattccatatgctaaaaattgagttttcctgggaatttatgaggagttgcaccgcctaaaaaagatgtattggttaaaggtcatccaacagttttctacatttatcattcactaataagttccagagcttctagggcagtcctcttaatagatcatagatttttaccatgcata

SEQ ID NO: 33152 - DNA, 939 bp, Bovine  19866881255484
ttatgtgaggacttgccatcaatcttgcactgttcatcagtaaaatacatatgaatcatataatctgctgtctagagtgtgaaactcaaaacataggccagatatttttaaaaaatacattctccccccctttttttgctacatttttctatttaaaaaaaaaaaaaaacagaacaaaaatctactgaaaagctttgtgaaacaaagcacatcaaggacatttccacttaactactgattgaaaagcataaaggaagatactgtatcaaaagaaatacatcgtcatccttgcaccagtaacccctgtaatggtctcagtagtagtcttgaaatttgctgagtctccaggaatttcaaattgatttcatcaattaacctcatgtgtttccaggaatctaaagaagccggcctttgggttacatatgtataagcatattctccgatgaacttcccagattgaagctgatcaaatgactcattaacagaaaaccacgtgagataccaacacatcacaagagcttcttaacaacgacgaaccattaatacctagtaagtcattaatagtgaatctaaatagcaactcccctcctgatggcattgtaagctctttgtcaatactttggaatattatggtgttcgcctacatattcattacagtttataattaaaacctaagcttaataggccacaaggctagtaaatgaaaaatccagaatttaaaaccagtgttgaatgaatataaaattagttttatttctagtatgtatatctccatgaaaagattaatagctatatatttcctagaccattttccttgcctccatcatgggggtcagtatattagtaatgatggagggaagactaactatgactaataagctaactacttatgattgggaaataattctaccttaacttttgagggttggaaaaacaaaa

SEQ ID NO: 33153 - DNA, 1988 bp, Bovine  19866881330481
catcctcaaggctgtgagcagtcttacagtaagcaaaaaaacccaaccaaatatgagagaaaaactgcttaactttttaaaattatagtagccaacattctgtgagcacttaggaattctaaaccttcatacgctccacagtaaatcctgaagacaccttgatgggagaggactctatttgtcctctcttacagaggagggaatgaaggaagagcggagagctaatcactccctctgtgcgggctggcagtctccctccaccacctgtgtgctaacgccaggattcgagctgtctcgctaggccgaaccacaagttttcatcacataacgcttatttaacagcacctctcagaggacaactctttggaatatcaatataggaaatgctgaattagacagacatgatgataaagtaatggaaattttgccttttaagtaaagtggtttaaaagaagatttagttactgaaataccaatcggacatttgaagaacaagacggtcagtattgactggacattgacattgtgccagggattatgctaagcaatgtgggtgcaatagggaacacaatcccttgcagcacctaaagcctagtgaaaaggcgtatctgcagatctcttcagatcaagacagtaggagctaagagagacactgctacacacaggcagtggggacaaggaaaagagacattcagctcaaaactgccagggaaaggaagacatgagcaaggcctcacagaacatgaaggacataatcaaaggcagaacagcagtgttctaggcaatgatcccagagcgcaggaggtataaagttgtgaagctttaaatgtcagttcagtctttagggctgtattttacctttagccgccctgccacgtaataatacaaacagaaacacacacacacacacgcacacaatctgcaagtaacgtaacaaagataatatttatgtaaaattacacggtctactctagaactcaggacaactggatatccatctggatttcatcttttgaacttatggaaagttgttttaccatttatccctttagttttttgaaagataaataaaatgaagggatactgcctggctttttctccagagaggatttttaaataatagatacaaccattctttgaatctataaaaaaagatgctatatacatattttgtcaaaatagaattattgtagaatcatttgtatgaatcagatattacgcccttgagtttctgttttcctactttcctatcttttgcctagcaggacgtattttattctcttcttacagttacctttgtagatgtggttgggtgcattcagggtggtatgtctgtagacaacagttccctttttaatcacagtggttatggttaggttttcttttcctgcttttctgtctatcatgtggtttgggtggcagagggcctggtaagtaatttgttctctagtgtaacttggactaaatagtttatccaaataaattttcttctattacttgatgattaacaaccaataaactgtgatttaacttcctagccatttctttggtgtagttaatatctacttattttaaccatgtgctttttcaggtgcttaaactgagtagtatcagtgacaacagacatggacaaacgtttatgtacgtggatcttatttgaagacatgcttgactaaaaaacattttcctggacattctctgtaaggagcccttgaactccatgctactggttaaaggcattatggaaacatacattttagcataaggcattatgttgcatgggaatggtaataatacacttattagctagcaaattcattaatactgattggtttatgggattagccacaaagcaactagaactttaatggaatgagtcaactcataaagtttcactgtggggaccaaggagttaagaaaactttaaaatgaggaagtcgagcagttgaaggtaaggagagaagtcatgaataagaggaagtcaaaat

SEQ ID NO: 33154 - DNA, 1476 bp, Bovine  19866881375070
agatgactggtgaagacggcagctgatagagagctctagggtccccatggatccaggactctgtgtcagattgctcagtctcctcgtacatacatcctgaggtcttgacagtgggcacctgccctggcttccctgccaacacttgttaatccaataaattctaaacctgactgatccagagaatcacatggggagctttaacaatttagatcccggccccaccttgactattctaattttgcagaattcaggaggagtttcccaggtttggaaatcttggatgtagtgaagattcagttttgtattcctaagtaaaaacatatccagctctacagagcaggtatgtgtgtgtgtgtgttactctgttgtgtctgactctttgcagccccacggactgtagcccaccaggcttctctattaatgggattctccaggcaagaatactggagtgggttgccgtttcttaactctagggcatcttcccaacctcttacctcctgcattcgcaggtgggttctttaccgcctgagctatcaaggaagcccgagagcaggtatatgagaacacaatgtctgctatttcttgctaccaagaaatgatgagaaggcatatatattttatccatatctatgagaaagttttaaaggattttttacattttgttgctaagagaaaggctctttcatttttataaattgacatctacatttaggaagtgtgaatgtcaagaatgtttgatgacttttttatattttagacttaattttgttttaaaagagctgtatatggagaaagatgttgctaggctttgcaggatcctggattttcaaccagtccttctgattgcaccacctagaaacatctagtgtgatctaccatcccagcttgcagattttaacactgaaagttctgctgtgtaccatgaaacacctcagttttgggcaaacaagaaagttggtgactctagctacaccctaggaacaagacacttggtgtcttcaatcctaaggccattccagacttgcctgggctctggtggacttccctagcaggcctaaggttcccctttctctagtcatgcacttccagatcccaaacttttgttgacgtttctgtgctacttctctttgtctatctggaattttacttttgtggataccctttgcattattttagaaaggtgttagcaaatgatggaaataaccatcctgtatgcaagatattgtttatttattgtgggctttgaaatttttgtttctgttgagatagaattgaaatatattgataacattgtatagctttaagatgtacaccaatttgacttgatatgcttgtgtattacagtatagtcaccacgatcgtgttagctaatacctctacgtatcgtataattatcatttcttgtacatagtgggaacaataagttctagtctcctagagacttttgaagtttatcatgcagtattggtggctata

SEQ ID NO: 33155 - DNA, 2112 bp, Bovine  19866881591777
cctttaaaatcccatgggcggaggagcctggtgggctgcagtccatggggtcgctaggagtcggacaggactgagcgacttcactttcagttttcactttcatgcattggagaaggaaatggcaacccactccaatgttcttgcctggagaatcccagggatggggagcctggtgggctgccgtctatggggttgcacagagtcggacacgactgaagagacttagcagcagcagcagcatacctggatgataataaaaatattaaactacttactagtaggatacacaaccaagtgaccacagtgctgaaacaacgtctgtgatagtcagtgtagctagtctgactataaaatagtccccagttatgcaaacactaatttaggtgttgctatgaatgtgttttgcagaggtaattaacattcatgatcagttgattttgagtaaaggagatattctatacaatcttagtgagtttgattcaatcagccaaaaggccttaagagcagaactgaagcttttcgaaagaaaagttctgctatggactgcagcttcagttcattccgacccttctagtttgcccttcctgccctacagatttgtggcttatctggccaaaccccacaagtgtataacacagatcctcgctataaatcccttattatacgtctcctgctggctttgtttctctggttgaatcctgaccaatgtagggtttacaggcctcgcatagagtcaggcattacgtctttaggagtgtggagatctagggcattccaggaaaggggcaggatggatgaatgtgggagtgggtagggacatggggtactatcacttcccaagagggtagcaaggtatttccctgctttcatgaccaatgcaagtgtatgagagtatgctggttgaatatcagctatttcaaaaagagggaaaagaatgtatttgaccctgaagacagaaagtagctggaatattcagagaaactaaaaggagggcagagaggctggatattgtaagcaagagagagtggaaggaaatgaaggaagacagggccaggtggtacagggctgagaagtacaatggcttttatctcaaagctcagtggagcattgcaaacaattgagaggctgcttcctgggtaataaattagcttggggctagagtgaagccaggtgcaggaggacatagagtgcctaggcaagagtttatagtggtttaggtaaacgtgacaacagcgaagatgcagagaaatggatggtttcaagatacatttgggagataacaatgcgagtcatgtgagtgcttgctgataaacaaaaaaaaaaccaaaacagtggagggagcagatgagcccccgtttctatagggggtgataaagagatgagtatctgtgaatgtcaagggaaggctttgcaagtcccagttggtaatccactaagtgtaggttgaggagtggtgttgtttagggttgggggtgtgacacaagagcctcctgcactgtgaccaggcatcttgtgattatgggatggagatttcacctccccttcagatttccactcattcttgcccacacccagtctttgctcctctaacccatttccttctgccttgcgtgtaaagtgctcgtttccccacggtgatttccatgttgttgtgaaggagtgtgttgtatgcttgattgctggacttgtttcatgctatggaatttttgaaataccaaggttgtttctatatgactgccagaaatattggaccaggcccaggaaatgtgttttgtcttcatgcaaaatgagtgagggaatctttgacatcctccagaagaatgttttgtgctgaggctttaaatacaccttaactaatcctcgaaaaagattagaagcacagggttagttgacatggacctgcttaagaaaaacatcagtgaggccaatagagtgatgttttttaagggtctgtggctactattgtgatttatactcaaatattaagcgttatgtgctgaattacgttactctaaaaaaaaaatagatgtgttggagttccaactctcagtacctaagaatgtaatcttatatggtgataagatttttttagaggttattacattaaaacaa

SEQ ID NO: 33156 - DNA, 724 bp, Bovine  19866881760578
tattcgattttacaaagttcttaggctgggcctttagccaaaaatgtatttccctttatcttttgaatgaggtacatcttagtggaaatttaatgtggatgttttaggcttattaagtatttttcctcagctatatctagtgtttatatgagatgccaggtaattttgacaaataggaaaccaagtacctttttttttcttgataactgagataccttggtgcctcagaaacatctttaataaactggattcagggacattatgtctttgtccacgacccactcaaattatatattcaactggatacctacggggtgactgcatggcagagatagaaacccagtggccagtgtttctcctacaaacagactcaaattagtgttccagtttctcacttattcttgggaagaaacaaagagcttagagggagaggagtagagatcaaatatctagaggtcaaatatcagaaccatagcttgatgtgagccttctctgagccaagtactacaccatgagtgttatatacactccatttaaatgcccacaacaaacctgccagataaatattattgtctccctttttgttggaaggatgaaagtatttgaattattgccaaataaatggtacagaaaacacagactacagaaattcagaagataaggaaaaaattgctgaaatagggtttcccaggacagtctcatggtagagcttgaaatctgtgta

SEQ ID NO: 33157 - DNA, 1662 bp, Bovine  19866881762251
atgctggccccagatagctgaggtgtacatccaaaggagtgattttaatgagcccagactcttgcaccctcctatacatagaaacgtgctaaattccttaactggagatatctggttttctttaattaacagtaaacttttgatattccgtccatcctggtctttgttacaaaaactgtatatcctggctgtgcccctcgcctctttggagtggtccttcagagttatctgagatgctgcatctcgggtttaagtcctaagttttgcccgccaagtaaaacataacactcatttttataattgtgcatttttttttttcagttgacaggactgatgaaaatgcctcttaaaacgcaaacatggcaagaagaaggagtaagacggaagtctattttacccacacaattcatcactgaagattggtttacctggctagcttagttaagtgatcagaccaaggggtaaaggacaggtctggtgtatttggacaagagaggtggagcctgagagacctgggaagaccgggatggaggaagctatgtgagtgagtgggcgctgggaacagtcaggaatggaagagctaagagctccaataagcaaataaatataattaattataatacatagtttcagggatttcctgatggtccaatggttaagaatccatgcttccactgcagggggctttcagctgttcagaaaaaaagaaaaaattaagaagaggactaaaattgaagctgagagaagcattaagggattaaaaaaggcattgtttgtagagtctaaggagaaaggaaatatttgttaaaaattaaaatgaaaactgttatagcacagtcccagttcaggaatacttcatggcaaaaatagaggccagagagggctggaggagagcagaggtgcttccaaagcgcggctgtgtgaacccgtctccttatgacagttgtctgtgtctgatgacaaaggcgtaacgtgatgttctgtccttctagaggaggttgatgctggctgcctcagctaagcagatggcccacgtgattgttgacacaggtatttctttctactcatcaggtctggaagagcatttagcagatgtcttccatcaatgtgctctgtagaattccatcttataacctattgaaagaggaaaaaggaaaatttcttcaaaaaagacacatgggcactatctttataacctagagatggtggtgttttagttactaagttatgtctgactcttgtaaccccatgggctgtagcctgccaggctcctctgtccctgcgatttcccaggcaagaatactggagtgtgttgccatttccttctccaggggatcttcctgacccagggattgaacccgggtctcctgcactgcaggtggattctttaccaacctagccactagggaagcccataatctcaggataagaaagaaaatatctaaaaatatagaaatcacaaaccatagatgaaaagaataatgattggctccattaaaattagtaacatttgtaaaataaaagaatcatacaactcactgtgacttttattatttgctttggcagaagacagcattgtaaaacactgctctgcaaaactatcttggtgtcttgaatttacagacaaacttggattgaatcaatacaaacttaattactatg

SEQ ID NO: 33158 - DNA, 827 bp, Bovine  19866880716712
aaatgtagggatatgtcccatgattgtggcagtgagaaagtcctttaaaggagattgtctttaaagaagtcctttatctcattagagaattgtctgtgctggaaagatggtgatatgtgtgtcccatagtggtaaggagatttagttgttgcttctgtatagaagctgttcttgagcatgtgtttgtattaagttttccttcattaggccagtataaaactattttgagcaaacatcagctcacagtagaaacgggggaagtaagagggtgtggagtaaaagtgacacagtattggatggaaaggaaaagcagctactctgaatttgaaaatttgccgtcgagaatcagaggagaatattcccatgcatacttagttgtccattcactttatcaccatcattcctttcctccttaactataaaaaatattgggctgacttacaaaagacattgaaagtttaccctgttgacttcagttcccacatactagaagcttcaaagagtgtgatgtctagggttcctgggggagcaaagctgagaagagaagttgagaggcactattcctcatcacttactggccttttctcaagaccagcagggagaaggaagtggccagttaacttgaacaagccagtactgttttaggttatgttcagcttccagctcaggtgccatctcttctattaattgagctaaaacataaatgtctttatgtccaagcttccctccttctcccaccattccatcaggtttatgaaagagcagtaattttggtgtttctctgttgttgaagatgttattcatgtattactttcaaatcctccacg

SEQ ID NO: 33159 - DNA, 1215 bp, Bovine  19866880829923
aacacgaatggctcccacacctggtgctacagagaacccaggagccgcagcttaccagagcaggagaaatgagtagtgccccggtggtctgcatttttttcagtctgcagagggggggaaaaaaaaatccattgacagcctggttgtttgcttacagttgcgaccttcggtcgtccccttcaccccgcccgtcctccctggaccacgctcttcctcgaaccatgccccagccgagaagaacattagaggtcagagggacagcgcaaactcccgttccacctctttcagcgcgacaggtctgtaaagaaaggtcatggagattggaagtaaaagaagaaggcccgagcccagcagggaaatgatgttcaacgaggatgatctccgggatagactggggaggtaggaactagacagatgccgttcagggtcctgcccatttcaaacagcactccaccgcccgcctcagctgggacagttaatcgctcattaccgttggtaattaagattaattgttaaggttacagatacccatcgcttttccccgccctacggacaaatgcccctccatacaacccagccatatccttgccgattgctggctttcggtttcaagtcacctgtactcccactgccctgctgcccctgctcagaccacagcgctcgcccggctcaaggtgactgactcacgtcccggctttagctctaggactcggcacactgctcccggacccacgtgtcccggggttccccaactctcattggccgcaatccccccgcgccttcattggttaacaccctctagtcctcctttcttattggtcttgcggaacttctttctctctctccacaggagcttcgtggcagttcccgcctccatgagggcaaaggcggggttttcctttgagatctggcttccgattggccggtttctgaagtgctcgaccatagagtctgctggactaagaggtttcataaccttccccacaaaatggcggccaaggtgcaaagctgaagaaaaaggcatgggagcgaggccggacggcttacgcagacaaacacatgaccttggaccttagccttcattcgagcgctcgggccctgaggcgcgttgtcttttgggatttgtagtcgcttcagaggccccaaaggtggttgagatcccgcgagactcccaggctgggcgagccaacgcctttgcagcaattcccgccctca

SEQ ID NO: 33160 - DNA, 1844 bp, Bovine  19866880964895
ctcaaataagcttgttagacagattcaactagattgtagtgtctttccgaacagaaaacttgtttctctttatatgctagcccttctgctttaaagttcttttgcatcctggggttgcttctctctgcccctttatagagaccctcaggataccctccccattttggtctgccgtttttgtccctcacctcttccaaagcacactcctgtaagacatcattaacttgggctttgctcacatcttgacactcaggtcccacagcccttctgtcttcagtttggaagatgatgtcccttatattcatgtccttacattgcttttgggggtgtttatcccattttcccaacagattaggagacccctgcaaccagaggctctctcccccggcagggcagaagaaggaatgtcttcattaatcttgcagatccctgagggaagaacttatcttctgttttttaaaaggaaatcctggccctatattagctctgcacactgtgggtgctcaataaatgtcgactgactgggtaaataatagacttagtcccctggagtgtcatattctttctttccacagggagaaagtaataacattcagcagagcaggcttggtctcttaatatgattacctgggatttgtgggctggtgactctttctcccagctttattgggtacattcatctccacagagtagatattcccggagaccactaatgctactggccaaacaatgggctaccattaattggcctaaccctgctcatcacgggcttcccccgtggcttggaggtaaagaatctggctgcaatgcaggagccacaggagactcgggttcaatccctgcgtcaggaagatcccctggaagagggcatggtaacccactccagtattcttgcctggagaatccccatggacagagaagcctggtgagctacaggccataggggttgcaaagagtcggacatgactgaagtgacttagcacgcatgcacgtacgcactgctcatcgtacatgaggcactgcctccagcccgagactccaacactgctgaagcaggggttgtactgacaagtgtgctttaaccaaggtcaactgtgttgaacttgttgtgtatctgtatttaagacatcctagagacttccctggcagtctggtggttaagactctgctccctatgcaggaggcatgggttctagctctggtcagggaactaagatccttcatgccacatgatgtggcaaaaaaaaaaaaaaaagacatcctactatgagccttatatgctatatatgaccttaccattttttaaccttttaaaaacataccaacttgagatataaacaatacggaatacatatcatctattttgagtctgtaattcagtggttttagtatagtcacagaattgtgcaaccacttccataatacactttagaacattttctgtactctcaagagaaactccatacctattagcagtcattctccatttctcccaacactcagccctatgaaaagggctgttgtttttgttttagttgctgagtcgtgttttgtaaccccgtggactgtagcctgccaagctccctctgtccttggaattctccaggcaagaatctagagtgggttgccatttccttctccatgggatcttctagacccaaggatcgaacctgtgtctcctgcattagcagggggattctttaaccacggagccaccagggaagctccaggaaaagggctaatctattttgtttccatagaatattttcttactttggatatttcgtataaatggaatcttgcaatatgtggtcttttgtgacgagcttctttcaattaccaag

SEQ ID NO: 33161 - DNA, 1339 bp, Bovine  19866881003610
gaaaggaaagctgctgcctgaaagccaagcaggaaaacagcttcagaaaatgagttcaatagagtcaaatactagcaggtaaattaggtgcaaaagaatcattaacaaaggaaaagaaaaacatatggaaagatgtacaagtgaagcagaaggtgaaggatgcctaacgtagtcagttttagctacatcagcggggctagaaacaaacctttgacatcaggaactaaacattgacaggcagatgtgcttctttcgtctcgttttaaaagccagtgttttctcattaaagagcatttgaaatatacgaaatagaaaattacagttccatcaaacaatcactgttaacatttccatctagttctttctatgcataggttacctttaaaaaaaaaaaaaaagaccatttaattgttcatctgtgtgcatatgtgtgtgcacagctgcctgccttgatttcaaacataagcatccttctctaaatcctcctggaggatctgtccccaagcagggagcctgagttctggaccttggtgaggttcccccagggtgagctacagagtgtgggcctccaacccagagcatcttcctgtacctcctcccatggaaactgctgcactggtttggcctggacaaacaccaggcactttcccctgggtcaatatttcacatccgttgtcagaggctagtccctcctcaacatctgctccctgggctgttgttctctgcccgcccgcaatacacacacacacacctctgaccccctcctggtctctctatgagccccagcagcagaggtgctttctccacctcactgcttcttgctgtttaccttttccacctttttaaatccactagcctttccctgagccaataatctcccacaaatgacaggaaggagccccgtcaacctgaaaaccttccccgattactgaacacacaggcgcctggtagacgcctgttaccttgggttgaattcaggggttcctgcctagtctgcaggcagcacagtctagccccagccatgccctctgtgcttttgtggtggaagggtcgatgccccaagtcaattccccggaatctgccagggcgcccagaacacattctgatcaaatgtccaacgccgcttgtgcttcctgctgccagcctgtgggagccctggggacgcaattttatttgaatagacagggaagggaaaaccaatgcaacaatgtgacacaatttactgcaaagagcaactagaaattctctccaacattttgtgttttgctccccatcacaggctggaaaaggtattttccaattgcatttcttttgatttatgcctggcttggtcctctaa

SEQ ID NO: 33162 - DNA, 1014 bp, Bovine  19866881056904
agaggatcacaagctgcttgttactcagaatgcattatgtgagattcattttacaagggcaaactgtatttcacacatgagtcaccttgaataacccaataattaattaaaaccacgttctgcagtggagaaatttattacattcgccggctttttatgagctaggtgtagtttggaaatgaaaaatgttgaggactcttcagtatgtctgtgctacattctgcattggctcacggtgactccctgtctccgggtcccagaaagcagagtcagtcgggggtgtgggacctcagttgggaagggtagaacccagttattgcagctgagttggactctcttcagtttttgtaaccagggcctggggcagtgtttcctggacttcctcttggagatgagttggggctttggggtgcttgagggatccctggaaagaggaaagtggtgtagccaatagagaaggggcaatgggaagagggaagagacaaaatcctgacttgtgccacgctgcttggcaattcctgggaaagaggagtgggcattgtggtattcttcatgacaaggaggtcatagcttctttggctgggtaccaccaagtccagatctcttcttagtttgggggaggtgctttttgtgtacccagccaaagaagctatgtgtggaggtgcttttccatagacataggaccagaacaagcttgtaggttggtttctcttcccctagtagaaatcccacattcatcttaggcactgccaactcagagctacaacttgttggttatacgtatgttgtaatctttatacagcaacttcacttccctctttattgtctccaagcagcactgtacagaaggctgggcagagacaatcactcccactttacagatggcgagacagagggctggagagagatggccagatctctcaggacatgcagctagcaacatgtgtcagagcagggagagaaattccagctccccatgtcaataatgcccaaagggcaggaaggaataagaga

SEQ ID NO: 33163 - DNA, 901 bp, Bovine  19866881157842
atcatttcagagctgctaacctggctggtccagagacaacaagtggtacttgttaagagcacaaacttagctcccagtatctgtgtgcccttgggcaagttaagttctctaaaccttggtttcctcatttgaaaaaagagaataacagtggtacttaccacaaagagttgctttgaggattgagatactgtaggcaaaacttttaatacaccccaaacaagtgtccagtctgtgttgggctcaacaccatcagcacagtatcgttaccaccatcatcactgtagctacatttatcgaggaggttgccaagcaccctgcattagcaagctttaaatcatccttaagtgctacaaaagggactatttatcccctaaagctcaactgttagcagatctgaagccctgacctcagtggcctcactgcgaaagtggatcccaaggaaggatgatgaggttatagagatttaagcagaaaaatggaggaatttgtcagggctcccttcctcacatgagtcaggatgggatctaagttcatggcggactggtaaagaggaagaaacaccgaaacccaccactgtgtgacattgggcaaatcagttaatgttcccaaaccttgattctcttcctctgcaaattgaggataagggaataattcagtcttgccaacctcacagcattgacctgaggcttacatgagagacagtaggtaaacgtgatgtgtggaaggtattgttattatacctacagagaaagttcatgatctgtagtctgaacatctgctctgcgctttccttctctaattcaagcattatgcagaagccctattctcatacccatcctgctccatttgtaaaccaactcgtgacaggcattctgctgcatataattagacttttcccagt

SEQ ID NO: 33164 - DNA, 1232 bp, Bovine  19866881169775
ttgggaagggtcactcacatattcctgaggacaggaaaggggttctaattgtgttctttgcatctcccagtccaatgaactatttgagaaggttgggtatctcattccaagaaaatacgagttttgatctcagtggtgtgtacttccactatctatagttcctgttgatggttattgggggatctgttgaagagctggcagcgatggctgcaatcaatggctcttttttggagcacaagttacaaactggcagtccatgggcgaaagatgacctgcagacctactttgactgcagagcagagtgtcattattttcactttgaatttgggtgctttaggctggtcctgactctttgggtcactacaggcacttcttcctttccaggtccttgaaggtatttgaatttgtgttggagtcagctcccagttattaatagggaccaggaaagaaggatgtgtgtggttttgaaatacactgtgtagttttcttctgtcaatttaccttactaattaagcttggttttggctgatgttaaggattagtttatattccctgaatactcagtgctagtgtttggaggaaagccaaggcctgcttcctggcaagggtgggtgaaacactgacctcagaaaaccttttgtggtgatcgctgggcacaggccatgctctccaatagcttttgactctctgtgttcctttctcggcaatggcatgtccagatggggcaagatggcttccggtcccaaggagcccactagtctggcttccgtgtatagtctgggagcacctagaaacgtaacctccccctctcgtgcttcttccccactttcccccttgggtctttcttcctctccctcctggcagtgcgtagggccgcccaacagtatggccttcgagagggaggagaaaatgacgactggactctctactggactgacttctcagtgtcactggaacgggtgatggaaatgaaaagttaccaggtatctgggtcagagctggtcctcggtgtaagcgtggcatcgaccctgtggggccccactcttatgactaccccaaaggggagctcctgggtgctcctctgggccccattgttcaccacttcggcttcctttgcagaaaatcaatcacttcccagggatgagtgaaatctgccgcaaggacttgctggccaggaatatgagccgcatgttgaagatgttcccgaaagatttccactttttcccgaggac

SEQ ID NO: 33165 - DNA, 1195 bp, Bovine  19866881172870
cgttttcccctagggttaagtcccaaagaattttcctcaagcctagaagggttttccttcaggaaggtgagaaataacgcctagaagtgaaagaaaaaggagataggttatttgctgctgctgctgctgctgctaagtcgtttcagtcatgtccgactctgtgtgaccccacagacggcagcccaccaggctcccctgtccctgggattctccaggcaagaacactggagtgggttgccatttccttctccaatgcatgaaagtgaaagtgaagtagctcagtcgtttccgactcttagcgaccccatggactgcagcctaccaggctcctctgcccatgggattttccaggcaagagtactggagtgggttgccattgccttctccgaggttatttgcagagggctggaaaggaggtaggttatttgcagagggctggaaaggaggtaggttgtttgcagggggctgcgctgccacgagaaacagagtgtctttctgtaaggattcttcagacaaaggaagaaaggtggtcaggagaaggatccgaggatgaggaatgaggaaagggacagagttgtgcgattcccagggatctctggtatctcagggacagctccctggggtcaacgatttggggaaatcgagggagggcaggaagtgagggtgcgcacagagggcgacccaggtttgggaggaaaggtaggttaggaaagagtgaggagctgggaaaagaatggctggtgtgtgagaaaggtactggcatggggtcctgaggatgagaaaagggagtgagaatatttcagcaatgaactgagtatggggcgtggaagagggcaagcgatacctagacctgctgagaagaggtgggctacaggagaaccgagagaaagcaggggcgtgcgggaggcttttgccacagaatgccaccagggaagggcagaggggtagccttgggaaactgggcaccgtgggggacaagggggacatgtagaacccggttttcactggcgaggcactaggaggccgcagcctgggggcagcagcgggctttggggcgctcttacccacaattcctattcccccgtctcgcccccgcttgccgcccgtatagttcgcaaccacactcgtgggtcccctcctcggagacacgttccctctggctgccagacaacccctaaccccaaccctagccgct

SEQ ID NO: 33166 - DNA, 1610 bp, Bovine  19866881204714
agccctaagacatcttcttccttctctttaaaccccagggcccatgggagggtgcattgaggatgtgggaggctgcgcttccttctgaccccacagacttgtgtctctttccccagaacgatatctgcatgcacctgactaattattccattaataagcacagtgccaatttccttcaagatgctcactctggcagcaagaggtaagggaagcggttccccttctcttttctttccctgctgggctcagagtggctctctgtgattctactcaaaccccgtcagaccccatcagtgtttccatctcagatcatgtggtctcaaaaaatatttcttttcctctaaacccagaacagacgccttagtctctgccttctggctgttaatcattaaaagaaggtcacatcataaaccctagggggttgggaggaggagagataaacatgaactgtttccctagcaggatacacacacacaccaaaacatactcatattacagttggcccttctgacattttcagaccaacagctatttatcgattgctggtctgccactggagaaggaccttccaggcctggggttccctggggtgttgctccgacagagattctcaaatgatgtggcatggtgtcctggtgtgacatgacctgtggctagctggctagaagtttccccagaagaatggggggaaatgggaggaatgcatgagtggcttttacattttccccagtggcttttacatttctattatcatctaatcctgtctcactgagttttaagatgactaggctaaagggagaaggaaatggcaacccactcccgtgttcttgcctggagaatcccatggatggagaagcctggtaggctgcagtccatggggtcgcacagagtcagacacgactgaagtgacttggcagcagcagcgggctaaagggagagggcaaggaaggcctgtgtgtcagggcccatgttggtgctttgtgtgcatgtttttttcattgaatttttgcaacaccatggcagaggtgccatcacctcccctttgtaggtggacagctatgagttaggcaccacctccattttatagatgaggagactgggcctctgagaggttaaataagctgccgaaaattacaggctataaatgctcgagctggacacaaatgtcagtctgtcagattccaaggcgcatgatctttctcttgtatcaggcttaaaggactgataaatagagtctgtttggcttcagataatcagagaagcataggaaatttcacaactccctcggtagcagaattccacgaagcaaaaggaaaatcagtaggttaagcctcctggaaggggaacgtgtcgggtggatagaaggcgatctcccccttgtccgagagtgccgaccacccatcttgcctacagctccctgacctcctctttgcccacctggtccttggggacccactggcattctgcattgttccatgttgaacatcggggctcggtgaggcccagcttctagtccctgctctgactcttgctggctgagtcgtctggagcaagtcccttcacctctgtgagcctctgtttcttggtatgtaggatgagagcagtgagat

SEQ ID NO: 33167 - DNA, 1106 bp, Bovine  19866881891111
cttggtgaaaaaacagttgaggtgttaatgatcctttttgctggatgtaaaacaaagcatcttttaaccactgttcattatccccagctgctcttaccaaggctttgaaggggaaattatgctccaggcagttactagtggtaaaggaaacagtcatttttagataatccagtcatcacccctttgataaaatgaagatgaaaactagaagatcaccccagcctttctcctctatagttcttgcacccacagactttaaagctataaaatgcctctgaacaatagcaggtggtaggagtaaaatggtgtctacatctaaattgggttttggaatctttgtacttattaaggcaacaagttatccttcttaggttcattttctcttttttaatattaaaatgcttttgcattaccttagcacatgtacttgctaagcagtgggaaaaacaaaagtcaccctggcatacatgagtgtgagtggtaaagaaaagcaaacctaaaatcagagaagggggagttggcaagatctttggtaaagcaaggtccctaagaacacctgtagcttcagcccttttcccttgacttgctaaaaattgggatgaaatggaactgccttgatgtttaaatatcctatgattctggtgattttctacattggcttgtggattgcactgagctaagcattctctaacctggtctcctagcaacaaatgctaatgagatgataggctgtggctaaaagatacagtccattgcctaggagaaaaagcaaaatggactcaacgtaaggtagagatcaaacccgaagagatagcatctaattcccctgagctaaccaacaataggccacaagctcagggaaattacactggcccaacactccttaattgatctcatataaatattaaaatgatgtctttacatgcatgtagtgctttatagtttagaatggatttcatattttccatatgtactttcagtaatcctttgaaacagacggctgccaagtcccatttttatagattaataagatgaaatgtggagaaataacctgctaaaagtgaaaacaacccaaatgtccatcaacttatgaatgggtaaatatg

SEQ ID NO: 33168 - DNA, 1294 bp, Bovine  19866880345615
catacgcatcataaaccctactatgtagatgaagaaactggcttgaggatggtggcttgtaaggggcacgggctaatacgacccatctcggtcctcatctgcagccatccggtggccctcctcctctggccctgagccctagaagcctttctcagatccctggttgtacctcacccgtggctcaatgcactctcagccatttaagataactgacccttctcacccatccctggctgaacaggtttccccaatcttgtcccagggaattggtgcccctgggctgctatatttacatccctttggagtaaggacaagtgagggtctgaaagacaatcacacaccttttactttcacatgcaaatggccctgggctagtttgacctcttaaatcccccaatttcccacagatttgtgagatttcagatgagcttctttgacctcctccaaagaaagacttttgtgcagcaaaaatttgcaaggagatttgcaaaggtgattcgctactgctctgctggattaaaaaataccatggaaaaaagaaaaaccccaagtttctactcatgtatttataaaaaaagaaatttggctgattacaacttgttagatctgctgcttctctagttccatttaggaaaaaaaaaatgtgactttatattcccacccactgatttccaactaaaacagaacttagttgcctgctgatcctgctggctttttaaatgaaaaacttattccttttaaactactggaaaattatatctaaaaatcagcataattccattgcctattctttctggatttcttgaacaatacaacgttggtttctggaactctacatattcggatgtaccaatttggttaccaacatattaatgcatgttaactggtaatgtgtatcactgcacagaatccatttctacatattagttaatataacccaagttaagactttttgctctctaatttaattatatctcttgtaggtggggctttagtaaacttaaagaggttttgtaacagtgctatgtgtgtgtgtatgctcagtcactcagtcgtgtctgcctgtttgcagccacatggaccatagcctgcaagactcctctgtccacggacatttccaggcaagaatactggagtgggttgccgtttccttctccaggggatctttctgacccagggattggacctgcatcttctgcgttgcaggtggattctttaccactacgccaccaggggaagattatatataatatcatggtggaatatattctttatatactccaaattcttgacc

SEQ ID NO: 33169 - DNA, 981 bp, Bovine  19866880425404
tgccccctgggcctctctgcagacccaaaagcagctgggagatccttgggaaggcaaggaacctgccagggaccacacggagtcaggaggtctaagtggtaccagcacagacaggtgaggaccacggatggaccatacacactcccctctgtgaaccccttaggatgcagactcacccgcagggcaagaggtcaccctaaattaactgggttacatttctatcatttggaatcaagtccagtcataaagccttcaatggggtccctggcacacccctaggtagtggcctgagatttgcagagatagacctccaagttctatctcgaaacgacccctgtgtattcagcaacatgagaaatgtagtcacctctgtaaaggccaatggccatgggggaaggatttccagcagcagtggaaaaagctaggtcaagatttaaaactaaccagcaaaaccaactggaaacagcaggggaattcgctgtgagcgttggttttcagtgcaccccgtccataatcactcgttgcaaaagtcacaaatctcctgccaaaatagggcctgccttcactgacgaagccccgttcacaccactctctctttgctctgcaagaaatgaattcactcaaaaaagaaattagaaaaataattgatataataagcataaccttgaaaatgcttctgtcagaatttaagagcagaagtgaaaggaggcccaaaataaaagcatcgtgctagaaattgaaaacctaaattagttctaagcatcggctgcacccacttctccaccagctccctgaaggtgaacgggagcaatccctgctgcatggcccagacagcaggaccaactctgcttcagagagcacggtcctccaatctcgaaaggaccagctggtcctgcttgtttgtacagatggggaaactaaggcttgtaggtgttaacagtgctctttccaggacacaataaacagaaggtcctcaccaat

SEQ ID NO: 33170 - DNA, 2869 bp, Bovine  19866880464256
tctaatgaattgatttgttgcatcaggtggccaaagtattggagcttcagcatcggtccttccaatgaatattcagggttgatttcctttagggttgagtggtttgatgggcttgcagtccaaggaactctcaagagtcttctgggagcctgggctctgcctcaaggctattctagtgtttcttggctgctcctcccttgtctgggcattccctccctttcgtgattagcaattctttctttaaaaggccttgatgcccaaaagtcttgcagggtcctgcccagtttctgaattctcaacttaatggactattgggaattcctatttacatggctatcaaacccttgaaacccaacatgtataaagttaagcttggtagtggtgatgccaatatcatgtgatatcatggttgtaaataacacgactttacaactctagttgtctgagtttgaatcatgaccacacactggctgtgagatagtgggcaagttatttaactcctttgttattgagtgttcaaatgtgtgagttacatgtaaacatagaccaaaaaggaggctgagcactgaagaactgatgctttcaaattatggtgctggagaagactcttgaaaatcccgtagagggcaaggaaatcaaaccaatcagttctaaaagaaatcaactctgaatattcattggaaggactgatactgaagctgaagctccaaaactctggccaccttatgtaaagagcctactcattgggaaaaaccctgatgctgggaaagattaaaggccaaaggagaagggcggcagaggatgagactggctagatagcatcaccaactcaatagacatgaatttgagcaaactccaggagctagcaaaagatgggggagcctggcgcgatgcagtccatggggtcacaaagagtcagacctgggttagtgactgaacgacagcaaaggaagttagcacaagggagtgtttagaaacaatcctggcatagaatgagtacctacttaacctgtttagagttggctgctaaagttctttctatccacttgaagagaggaaatccatacaaagagaagcatttgaaaatcaattcattgggaacttcagggttgcaccttttgtttgaagttttgtcctgttctttaaagagtgtgggacacaccctcatcttattcacctctgaaccgtgaatgataaagctcatggagttgtttggaagtttagaaataataatacagaaaaggtggtacaagagtacctactcaatgtgggtgaactctcttctccttgagttcccctaaagattgaatggcaacaatgtgcatttcttgccagaggaaccaagagataagaactggatcactgatccaacttgcgaaagggcagccaggtcaaggaagaaatcacaaacccccatcagagacttaaatggggaagaacaggaatgggctagtgagagccgtggacagacccgcacagagggaagactcacaaattcttgtggtgaaaagttatgaaaggcagaacgcaggagttcagggtgttgacggaggctgctcttgctggaccacagagagggtcctccagaaagctccatggtgggctcagaagcaagaccagagactcaggcgcgccatgtgcctggcagagtcagcaggagccggcgcctggcacattttctgttccagaaagcactccaagccaagagagagtggattaggaggatttaaagtacaaaaagtaaaacaagctgggtttttttagacaatcattctcaaagacagtgagtgaaatttgtgtcactttaaataagggatatgtcagcaggaaaaataaagaggaagaagaaagattctccgtgcttctctttgtagtacagcaagacaacaaacagagcggcttgccaactacagcctcacccaaccctcctttggccataagctatgattcctgcatttttttctgtgactcactcccactgcctgacgtcaatcacccatttcctcaagacttctctagttttcttcctcccttggaggaagccagcaactccctgtcaatgactcctctctattaccgcaaagttcactgattatctcctatggggctcaagaggaaagtgtaacattctatataaaggtaaatagctacttttattctagaagaaagtctcacttctgagatgaaaaagacaaaaagcactggacaatgcattggaatataaaataacaccatggggaagtttgtaaaacacctctttttttatattaatttttattggagtctagagaaggcaatggcaccccactccagtactcttgcctggaaaatcccatggacggaggagcctagtaggctgccgtccatggggtcgctaagcgtcggacacgactgagcaacttccctttcacatttcactttcatgcattggagaaggaaatggcaacccgctccagtgttcttgcctggagaatcccagggacgggggagcctggtaggctgccgtttatggggttgcacagagttgaacacggctgaagcgacttagtagcggcagcagcagtttatctataacgttgcgttaacttctactgcagagcaaagtgaatcagctatgtgtgtatatatatctatatctataaaatatatatgtatgtatgtatataatatatatgtatatgtataatgtatgtataatgtatatgtatatgtataatgtatatgtatatatgtatataatatacatatatattgtgtatatatataatatatatgtatataatatatgtgtgtatatatgtatataatatatgtgtatgtatatataatatatatgtatatattatatatatatataaatacacatata

SEQ ID NO: 33171 - DNA, 2127 bp, Bovine  19866880504944
tccacatattctgcgggggacactttctctattcttttgttgggctagaatcctacttccccttctggatctattttgaacattatctgccagcttttctgccccaacttggtgagctgtctcctgtggtgagaggccacccttgactctcaggcaggtttctgccactgcaaatttcaaacagcatttaacagaaattactgacatttgtcttgatgcatttttttttccatcagggattaggaagagcaatcatctcctgcctctcatcaattactttcccccgtatcttttgcattttcctgcagaaccattttgcaggtacaacagagcgatctttagagataatctggtgattattacaaattcagcgtcttacgctacaggcattaagagatgaaaattgcctgcagtccactgttgtacacccaatctgtacctctggactcctgtcccgaggtgaaaatgcaaacagaggagatatttagaatcattttgacagttcataaaattaagcagggattagggattcactttttcttaaataatgccagagggtgcacacagtggtaatcgtatcatcccgcaacaggtccagtcaaagttgagcggactatctaggaagagagagggaaaatgtcaggttattaaatctgccatgtatcagctgttgaaaacccattttttaaactttaaatgaactgtctgcctaatggagacgctatccccagctcccaacaccaatccgtccttctctggcgtctgttttgttcagacaatacatgatttagctccaatgtctgtgcacatgactacatctagtcagaggggatgattgtataaatatgcatgtagtacaaatagtttaattttaattggggtagagtagctgatgttgaaactatttgcataattttgaatattgaatgtgatatcaagcatgtgactggctctattaaatataaaaaaagtactcattttaattgcattgtgggacaggagcttaagtaccaaatcatgtgcttctggtccttcttctaagtgttaaataattgtgaccagtagattctcttcccagggtattactttctcttaataccattgtaggatttttagactaaaatgtctttaaagtgctgtttttgaaagatcagtgatcaaattctccttcatgggccaaaaaagagctcttggttcttagtgtattagtcagtaaaatctaagataggctgcagtaacaaacactcccaaatcttgatgtcataccgtaatgactggtatgttttgatcaagctctgtgtcctgtgcagctcattacgggatttcatccaggtgacctgtacttaacacatagtccatcaatttgtcactgttttgtctaaatatagcatcttttcatttgcatggtagggacagaaattgctgaaaggttacacgtggagtcttctacattttttctagaagtttcaaatgtcaattctatgcataagccctgtaaccacgtggctctgactaattgcaaggcggctgtgatgtacagtgaagcaagtggaatgtttcctgatcaacattgcatctgccataaggtcataaactattctcttctctttgataaaagaagatgaaagtaacaagttaaaatagagtggagtgaggtttgaatggcccccaaatatacaagtttacatttaaaaagggatgaaatagtgggtggtcttcattgtttaatattctgactaaacttcccacccagcccccaatgaagtgactgaatcattgttgcatcactgaaattcagatacccagaggggatgatggaaatcaccagaacacctactctctttggtgttgaaacctggttgtgagaaatatcatttgaaagaagtcaaatggggttgctggcattattgcttagaataaaaaggtaaaagctcgcagattttagaaacctgcccaaaatcttgaagttctttctcttctcaagctggggccacattcccaacacccagaatcttcactcgcaccatatgcagtccttggtgaaatctcaagagtgccaatgtccaaaggaaaatctagaagcacaaaattaaggtaggagagaaggacattagagtttcagtgtga

SEQ ID NO: 33172 - DNA, 1141 bp, Bovine  19866880543805
aatcagctgtttatccagactgatttcttttattagaggatgatacctagaaaccaaaatctgggttctaagaatgttcattgctactgagcatctctatttctaggcccttttggtagacagtacatacactgacttatttgatcttctcaacaagcttctggtaaagaattaattgtggtcatcttatcagacaatgaaaatgagagcatttggcgtgtgttgaggtctcacaactcaatgtggaagaattagaaatcaaactcatgtgttggcttgaaaaggcaatatccttcgtaccatgtggtgctaactcctggagggtgagggcaggcctctcctttctagttggcatggctgacccatgctccttcatgcctcctccctggatatttcctcaatatttttttctaggtgaccagactgcatcattctactgaggccaacataatctacttttgagggtctcactttggagtctcaagcattctttgattacccaccagttcctttctttactgattattcctgttcatctatctagttctttattcctccaggaaaccctccatgataacaacatgtgcacaacatccatcagaatcctgatcttatttgtagccaatcagttgattaattacatgactatttgcttaatgcataacatctctgctaaaatttaacatctgggagagccggaatagtggttggtacattacttgacttacaacaggtacttaagcgatatttgttaactggaccaacagaggaagttggccactcctcactctacttcccaaaggattacaccagtggattctgagaaagtgctcttgtctcccccaggctccaaggaaatatttatcttctcttgcctgtctttccccaacagtagaaaggccattcctctgtgatcagcaggaactccattttgctcttaattacttaattgtttcattaagtctaattgcttaattggattaatcccaacttccctcaaggggcatcagcagtggacaagctctccacccactggggagaggatctgctgcaagaccatctgagcacagtctactggtcccctctacatagatcctctggatggagggtaaaagtctctgcagattagcagggctttgag

SEQ ID NO: 33173 - DNA, 1119 bp, Bovine  19866880603159
gtcggcagcccccgagagaagcgcccccagggggacacgtggggcgttggacaggagcagagtcctcgccaggtgggactttccaggctcgtctctgagggaagttgacagataaccaggccatgcaccgcgggcaaggtgcccagagccgcgaattgctgcatcaccctttgctcccgcgattcgcctgcaggctgctgggctgggcgtcggaggaactggtggttagtttgtggtcacccagcagttttatgaaggcccttgaggtgcttcaagtaccaggtggccccagcgtggtttaactgtctgggggcccgagctctctcagtggccagctaagcagcacagacaatcttgctgtgagaactgttcagttgactgtgacaattacataatgcacccgaggagtcagtttcaccatagctggagaggaatatattataaatgcatatattaggaattaatgaattagtcagcacccctgccacatttcaccgtcaataaagcactcagggtagggggaggcatggtctcattgagggagttattggtgtctcattggtcccatttcacagatgtgggtagtgaaggtcatcagggtcaaggacccgtcctatgtattgaacagaaaactggctaagagactatcccagctgaaattacattatttgtcaatgacccctcaaggctgagagtattcccacgttgcagacaatgacacccccagcctccagccagtcctcttccccggccagcgcctccttctccctggaacgtctctgagccgcagcggcttacagctcctcagcaggtaggaacaaggtggctatattttcttttggtcttattcccagatgctctgacagggagaaattctgagaacaaatgcagaatacaaaataactcatacttcttcaggagcacgcaggaagctttggggtgacattttaactgtcttgtctctcatctaggcccttgctttcctttccttaagcatctgtcatagtgagtgccaaggatatggctgggtgtggaccaggagccctgggaatgcaggagatggaagacatgtacaagcacacagatacctgcacacacacacacacacacacacacaca

SEQ ID NO: 33174 - DNA, 824 bp, Bovine  19866880647127
atttccaccatctatccccaagatttctgaacccatctcttaacgtgtctttctgcagcagccttgcctcctgccagtccattttctacaatgaagcaagagtaatcttcttaagatataaccagatgatgtcactcagtagcttaaaacccatcgggcccttcccatggcctcgaggacagcgtccaaagtcagtcacggagcttacgaggccatagcaacccaacctctaccttctgattttgcttacctccagtcaccccacccagacccaacacacattctccagtgagactgagccttcagttaatgaaaaccccattgctctccagggcctccaggctgttatgatcatggctttctccacctggaatatttctccccttctgattgctgggctgggtgtgaatgtcacctcatcatccctcaccagtcaaacttgtcgggcaacccagggacagagtcacctcctcacagtccctgtggccccacggatgccctgagggtcatgaggtggcctccctgggcctgctatagcccgagtgtccccgagatccccagcgggagctcctgctgcacctcattaacatcgtccctgtaaataacagcagccccgacaccagtctgcaaaaccaacacatgcatatttgatctgtataaacagtgcatataatatgacatttcctttcaaaactccctcaccactcggaaattcaaatgagagcctgtattacccttggactagagactaatgagggcatcataaatatttgatgaaaaccaggccaaattctcagggttttgccacacaacatttttcagga

SEQ ID NO: 33175 - DNA, 1453 bp, Bovine  19866880651628
cgcaccccactgcccccccccacagcgtctccactgcccacactggacacaccagccgacatgtctttccaattaggccagtcctgagcggcagagaaacaggaaaccgcttgcaagctcagacccatccagacgcaggaaaccggggcagagacagcagcagccccagccgcggcgtcagccccaggccccggcaccaagcaggagcctgccagacactgcccggcctccctcggagcccagggagaatggcaggagcagagacaggagagaaagaatgcaccccaccatgctgcagctgtgacatcttgagcagacttctctccaagaaagactcctgcaactatcctggggcccctcccttaaaagcccagggtggagacacgcatcacaagatgaagtttgcgaatctcagcccaatgcctgacatgaagtcagggccccttcagggccaagagaggacagtctcctgacccaagccttccccagggtgcctggcagctgagctgggaggatcagatttggttcccattttgcaggtagaaacactaagtcagggtctgtgtaaactgcagtggaggagcatgaggttcagaatcagaggcttagagtttcaaatctcagccctgccagctgctgcctttggaccaactgctgtgactgtttaccttccaatctgtatagtcaaagctatggtttttctagcgttcatgtaccgaatgtgagagttggcccgtaaagaagactgagtgctgaagaattgatgcattcaaactgtggttctggaaaggactcttgaaagtcccttggactgcaaggagatcaaaccagtcaatcttaaaggaagtcaatcctgaatattcactgcaaagactggtgctgaagctgaaggtccagtgctttgtccacctgatgcaaagagccaactcattggaaaagaccctgatgcgggggaagattgtgggcaggagaaggggggaacagaggataagatggttggaaggcatcactgactcaatggacgtgagtttgagtaaactctgggggatagtgaaggacagggaagcctgatgtactacagtccatggggttgtgaagatgtggacatgacttagcgactgaacaatcaccaccactctgaacacaccatctctaattcctactcttcacaccctgatggggaccttggctccctgtataatggagatatctaagaactggagagcttatgtagtgcacacctggttccatctcagaggggcggagctaacgatcaacctttttagattttcaagcctcttcttcccatgtagtatacctaatagcccctctgtacagggtctggcaaagagctcacagtacttatactccagaacattcatgcagaaaaaaacccaacacgctggaatagcttggggtctgcactgggtggcactgaattaacaatttccag

SEQ ID NO: 33176 - DNA, 2139 bp, Bovine  19866880690059
ctgtataatgggtatgataatgtaccctcccagagtgagacaaagaatctcaagtgcttggcacagtgcttgatatacagcaagcacccaatggatagagatttccttcctcttcctcatggtccacatcacgttcctctttccaaatggccaggggggaagtgttgacttcctggtgctcttccagccccagggataggcattggcaggtggcctcctaggacctgccttgctcctctctggatgcccttgcatttctgggctctggaccgaacctctcagagctgaaaggtggcattgtgtatgtgggctgacgcctttggcctcccagggctctgcagacgctggctcactggggccgggacaaagccctattatgaagggtgctcacacacacaggtctgaagtgcatgaacctgctgccccggcccgccccggcccacggagggctggcatcgctctgcccagccatgattcccacagcaccagggaggtcacccagggtggtgctgcccaggggcacctttgtggggtgtggaccctgcgcctgccttcactgagatgggaccagctgctctgcacctctgctgtgctcctggtcacaggctgtggctctggtgggaaggaggcgtctggaaggaatgatgcccagatcctgttcagcatcggtgtgggaagccaggtcccaggttccctgtaaaccggagtaggtgttacccggaggatgctgcatgtgttggcggcagaaaagaggaccacatttgttcttttagtcaatcagtgtttgtcaacagcccacaatgggtcaggctctgtggatgcacaaaaacaggtatatacacatatacacactcacagaggcagaaactcatggcagagttgattgaaacctaggtctgctgattctcaaacttcttttcttccccccgtagattcacattttttcatccacggttgtggctgcataaaccagaggagaagctgcgaagccaagacccagagaaggtactagccactgtcacacagcagagtttggcacccgaatagggttgagagccccagcctggacttgccaagcctgccagttcttgcgtcctgagatttgggttctttgagtctgcaaagggccttgtggtcacatggaagacgggaatggaaggatggttagtaggtaatgagacagcacctggtccgtctcctgcaggaaggcggtgcggattcagccaggtgaggacaggtaatttcaacaggggtgaaactgcaaaatccatgttgccattttgactagtgaactgatttaactccggggcctgtcttactgcggacagttgggcaaggtgagaagggccctttgcaggtgccgtaattccccatcccaccgctcttgggggcagggagggaccattacttgaaagaaacttcagctggaaaagaagtttaccctcctcagctttgcctggggtgcatttcttatctgtgagtaataggtttttcacaatccaccttttatgttcatttcaataatgcacccggctaagccaaggttctcttaaaggagaaggccctgcttatttcccaagtggtacaacccagctaagaggcgcagcaaaccttgggagcctcgtcttccaagtcaccttcttgtcaatgaaaaattaaactgagaaggcgtatttctgtaacatttagaccagaaaaccaaacagaatgaaaacctccaagtcccaaagatttcaaagcaaacacagctttaggggcttttgaaggggaacgtgaaagctccagatggtaaatatactgtatgtcttgcaagccacacctgctggccagtggtcctgcgacagcaggtcactgtgccgggctggtgtgagggacccttcttcttgccggggcaggccacagcaccgatctgtcttttgcattcgtgaaccgtgagtgtctgtctacatcctcgttcacatgggtgggacatttcctaatcctctgcacaagcttaaagtacccgtcaagcaaggtggaattaacctctgtttaggcactctacgagggcttcccagccctatgaaagtttgcttctttccctttcacagggcctccctggtggctcagtggtaaagaatctgcctgccaatgcaggag

SEQ ID NO: 33177 - DNA, 1528 bp, Bovine  19866880697988
aaatgctaggtctgagggtagatgcaattcctaggtagattgtgcttcaaattaccctatggtctggatgggagagaagagacagggtagattgctgctgattaaagaatgtttctctttatcatggacctttgcctctcaagatgaagactttcaatgcatgttctgggagcgagttgctgccgctaatagccgtaagtcttaatgctttatggccaggcatgagaatgttaagtaacaccagaagaaccattatggaatttaatgtgctttaatattctcaaccatgtaaatctgtctgagttccaattactaaagggttgtacttgccagaggatctcaaagcaccttataattactggaatattattttgttctctattatgggaaccatcaaaaacatctttcagaggaaaattgcagctagaaaaaggttatgaattaataataataatattaataatagcaataataactaaaaagatttggtgataagtccatataagcaatcatcaccactttcatacccactttccacttgggttgtaggacaaccctatcggttaagaatattgttcacattttacaaaagcaattaagatgcttagagaaattgtagtaaaaggaagcctgagtcttgaaagatgcttgcctctgatacagcttgcttaggcagagagaaggaccatcttgcccttaaaaacagtctcaaaatgttagagatacacctcccaacaccaactccctccaaaatatccattttcaaacactatcgtttatgtgctgctgtgtgctgatgagtctattgacctgtgagcataatttagagatctttgaatttataaaccaactctccatggctgtcatctcctctttgatagcagaaagctgagggattttctctcccagtagttccaacttccttggggattttcacaggtatcagtgaagcagactttgtctttgttcaccagctgctgtggctttatagagcaatttgctgttgttcagtcactgagttatattcaaccctttaggaacccatggactgcagcatgacagacttctctgtccttcgctatctcctgaagtttgctcagattcacatccactgggttggtaatgctatctagccatctcatcctctgccacccctttctccttttgccttcaatctttcctagcatcagggtcttttccagtgagtcagctcttcacatcaggaggccaaactactggagcttcagcttcagcaccagtccttccaatgaatattcagggttgatttgctttaggatggacttgctgtccaagggactctcaggagtcttctctagcaccacagtgggtccctcaaatccatgtggcatgtgcaccctactgtatttaaaatagatactcatcaatttcctgctgtatagcacagggaactctggtcaatgttatgtgacagcgtggatgaggagaggggcgtctggggaagaatggatacatgtatatataaacggctgagtccctttactgacca

SEQ ID NO: 33178 - DNA, 1520 bp, Bovine  19866880729237
ctactcactgttttcagggactcctcagggagattaacagtgtgcacagcagaatctgagaaagggtggtcaacagaataaatcagaaaaaaatagcttgggactgagacttacagaccacccatgattcaaagccttcttacctcgccagacccagataagtcaaagcagctagtaaaatattctacatgcagtgaatagatttcaccttttaataatcaagcccttaattaaaaataagtaattcataagagtgattaatattaggtggctaagtaggtttgttcaatgctcttggcatttaaatagaggataaagattagaattcctttcttatcccccaaaaaatatttctttaagaaatgagtcttgagcaaatgcatttttttttacttaatttgaagagaaatataatccccacactggatgatactgtaatgctaggctactggcaaacacatccttggatagagcacttttaggatttacttatcagccaacaaatatttatttatagtctattaagcacgaggataatacaagttgtactgtggaaaagaaaagccacggagcttatccaccaccctcaagaatcttacattctaaatggccagacactcacatataagtaagcagggagtttagtgaaaatataagacagggtgatctaacagagttagtggggaggctgactaggaaggcctcccagaggaggtgttctttaagaggagcctgcagaatgagaattgggaactttacagcctgggaaaggggtccaagcctagaaacagttcagttggctagaatatttggaaacaaagaggtaagtagcacagcatgaagttgggagaagtatgtaagtggagaccaatttctatatagtgtattgtgtatcataatgagagctttgaattttaattttactttagtgggaagctgttggggtgttgtcttttttaattttttaagatttaaaatttcagatttaaaattttaaaacagatttaaaatttcatgctggtacttccatggtggtccaaaggttaagaatctgccttgtgatgcagagaacaccagtttgattcctggctggggtaactaagatcccacatgccttagagcaactaagcttacacactgcaactactgagctcacctgctacaactcaggagtccaggagccacagcaaaaaaccccacatgacccagtgatgatctcaagtgctacaactaagacctggggcagtcagatgagtaaataaatgaataaaaaaaaaaaaaaaaaaacttcactctggttctctgatgggccaatcaggaagtcatgagttggtagactagtgtaataagtattgcaataggtgatggtagctggaccaccagccagtatgatgacattggagttggggctagtgggggaatcagggatgtgagtctggttctgaaccctcaggagttggactggggtgggtggctgagagaaaagaaacagcacaagattcctaccactgactctaaca

SEQ ID NO: 33179 - DNA, 910 bp, Bovine  19866880775633
cctggttgaagggcttggcaaacaacttaggcgtttccaggaaaaaacagagcccagcttggggccatggaaagcgcggtccccaaagttgagtcagccttgagtcatgagctaaaagcatgcttttgccaattacagctctcagcagctgtaattaatgcagggctgatgaaaactgcatttttcactcaacagaggagagtatttcaggtaattagacataacctcatgtactggtaactcgcctttacacatgagctctagccgccttgtccaggccctacctccaaaaataacttacaccaacattaaccaacaagttgggtctgatttcaaaagattaccctttctccataagtattttgaatgcaaaacgctaaacacacaaaggcccttaatggggtttgttctaatccaccgacctgagcctctgagagatggcctctgcatctgggccaggtggccaccctgtctttaaagacgaccctcctctgagctgacccccgtgccaagcattctgtgggctggaaagaagcagggggaggtgtgctttgatccataggcccttaatcattaattcattggctcatatcagtgctactgggacacaccgtgctccattctctgggccgaataaggaaccaagagcccaatgtggtggtactggttgagtcaccaagtcatgcccaactcttgcaacgctatggactgtagcctggcaggctcctctgtccatggaattctccaggcaagaatactggagtgttgccatttccttctccaaagagcccaatatagaggaatttaagcttgatgtgggtattagaggacgaggtgcattgcctcctttataaacaggaaccctgaggtccagacttgcccaggatcatccagcaagtggatggtggag

SEQ ID NO: 33180 - DNA, 768 bp, Bovine  19866880791819
gacactgggtaatgttcattgtgcatgcacaataaattactatttacctggcagcgcctttgataagcccgtcttctctccctctttctgtccacgcagcacggagcagtgaaacccctttgcctataattcttattaaggtgataccttttctgaataagaaagtacacacttccaaagcctggcgctctccggggtttttgagggacattgtttttattggttcccttttatttctccctccctgctgtgttttaatgctatagtgacttctgtgtatacaactctcatattgaaatgtcggcggctgcagatatatgcaatattaaagagcgcttatgaatttttgacatctaattagtcgctacccagttaacatgtcaggactcagagggattagggaggcagccctttctgaataagttacagcgaggcccctgtccttttcatgtattattctttaatgtaggtggtgattatttggctgtgattaattgatgaagctcattggtctggcaagtggtacggaatccaccattcttcacttttatttctcacagtagggctctgccacttactcggaaggactcacttccttccaggcagcctgtgctctcagcccagtgctcctggtcgggggctggggtggggggtggcggctgttccctgggcctggccttgacttctcccacctcttgactcacacatcggccatggcttttgcatcctgccttctctcgaaggctccctctggtggtccaggccccc

SEQ ID NO: 33181 - DNA, 661 bp, Bovine  19866880846547
ctgtacttcctgcaatggcacatgtcattgcacccccatccttatgtccccaacacaccccaaaccatccctgtgtattgggtggtgcccctgcactaccagggcttcccaggtggtccaaagataaagaatccacttgtcagtgcaggagatgcagaatggatccctgggttgggaagatcccctggaagaggaaatggcaaccctctccaggattctggcctggagaattccacggaccaaggagcctggcaggctacagtccgcaaagagtcagacacagctgagcaccacacagacggacagacctcctctgccaacgcaggcccctgagaaccccctatcacatcagggttggggaaaagtggcccccacatggaaccacaaacaccctatgggcagaaaatgagatgcaaaatcctcttggtccttccgacagttaaagtaaaattttatgtgagcaatatactcttgctctgattaccatgcagtataattttattctggtttttctgggcccgctgaacccccggctcttttaagtgttcaaatgctctgcttgccaagataaatgattataattgacagggcattgtcaatctatcgcaaagctgatttcattaagcatgccaagggccagctctgggggcaggtagccgag

SEQ ID NO: 33182 - DNA, 1426 bp, Bovine  19866880892393
tgaaaagtgaaagtgaagtcgctcagtcgggtccgactcttagcaaccccatggactataccccacctggctcctctgtccatggaattctccaggcaagaatactggagtgggttgtcatgccctcctccaggggatcttcccaacccagggactgaacccgcatctcttatatctcctgcactggcatgtggatactttaccactagcaccacccaggaagctcaggctcactactaggtaacccataatttttctgagcctcggttcccttatctataaaacaggcataataacagcttctggagagggttcttttgaggaactgagcagaagaaatgcgggaaggtgcaccataaattgggcttccctgtggtaacgaatctgcctgccaatgcaggagacacaggagatgtgggttcaatccctgagtcagggagatcccctggagaaggaaatggcaacccagtccagtattctgcctggagaatcccatggacagagggccctggtgagctacagtccgtggggtcacaagagaaatggacatgactgagtgagtgagcgcacaggcagcacgcatgcacatcatgaattatgaagcactgctgagatgcaacttggcatgattatttataagggcccaagggttgtcccaggacgtcttttctgcatctcaattctcccctctcttctttgggacacctcatctccccctaaatgcctttctttcttgagatacagcctcccctgctggtctctaaattggcacatcttcttaccactccccctgagattttcagttcctttaatccaatgaaataaaaagttcaggccatcatcttcaaagaataagaatgaaatttggggaccaaaattatacccattgggattgcttctgtggaaatactttggaattccttttcatgccctattaaataatttaaatgtttcttttctgcattcaatgttagttatttaaactctagtcctaagctccattagcaaccttattagcacaaaactttctttgcctgttggattagttttatagatttttgcatagaagtcatgcacacaggcaaattcaagtgcatggctgtggttattgtccttcggtcataggaaacagggtaaatttaacctgacacaattaatctcactccacctaatagcttcttggagtaattaatgctttccatttgtattaagagctgttagcacatcaaactcatttttgtggactctagcagatgtaagtggtaccctaccctaagattccatccttgactggaactgaggatggatactcaatgttaccaagttggtatttcataattaggcgtaagaacacagtcataaaatgttaggatggaaagagatttggagtcatcacatagataaagctaaaagatccaagtgataa

SEQ ID NO: 33183 - DNA, 1832 bp, Bovine  19866881025418
tagaagagttgggaagaatgtttcgttgccccagctgtatgcatgggttggcgtgcatttgagcattagatatgaaatattccatctagctgactcagacagacatagaccttgtgatggaagtgtaatcttcccttgtgttcctctcaaaatcttgtgtcagttacccaggaccctgatgttgggaaagattgaaggcaggaggagaaaggggcaacagaggatgagatggttagatggcatcactgactcaatgaacatgaacttgagcaaactcagggagatagtgaagggaagcttggtgtgctacagttcatgggggcacagagttggacacgactgaacaactgaacaactggatacttacctctctcctttcagacttttacctaggagacactggctctagcaaccctagtaacatgtgagaactctcccaaaatgagtcaaatcatctgaagatttgactttgagcgttgagtaaggcctgctgaataaaaccttgtgaacccaacttacctgcctgaccaggttcatgtgctcacacctgtttgaatagcatccttagggtctggtactgtggcccacagagtcccctcactcccaatcttagactacactcaaccctgtcccacgacacccacttagtgatgctatcacagcataaagattacagacctgtttgtctcagaggtcagaggaaaatgtcctttcccttaaaatatagtactgttctcaggttccaagaggttcaacctcagcatgaaattataaatctggaagcatctttaaaagtcaggcatgggaatgtctgttatgttttactttagttgaatgacttcagctactttcttcctctgatatctggagttcagccaaccacaggacacttgttttctgttcatttgtaaattaatataactggaagtgaagattgtctctgaaaagagcaaattcactttcctcctgatataatgaaattatgtttgggaaagcctctgttgatgtccaagaatctttatgagccttttaaagccattggtttccttctcacaaatgagaacttgctgatgccaaggagtaatgaactggaaaaccacatggccacttggttcttaagctggcctgctgggggaggacacgtacgacttccttaattctggctttccctctctctgctgttttccctcttttatctgcccctccccaccttattccttatgcaataaataaagctttggaatagactgatttgggtacaaatttccttctgccactggttgtgtggtcagttagtactactgtgtggacatgatacttaatctcactaagtctcagttttctgcatatagagattatacattcattcctcactctctgtttcctaagagaatctatcttccattcagacatctcactccatcctctgtaactcttgcaactcacaggggtgggcaagacccccagatccagcgatgagattcaaaatgtcacagttaatattggtctttaattcctctggagagcaagggttttgggaggccaggctgccccctatcagagcttgggatcactgatagattagctatgatgtacggaagcagccttcttaatctgccccctggaagcatgctgacttggagattttatccatcagatgacttggagaagataccctgcggatgaagctgtcacaccaaaaggagacaaaagaataggagagaactgaagtttggtccctgatatatctctactggatctgcacttcccaaatgtgagataaaatcctttatcctcaaactagtgtgtgtgcatgtgtgcgtgtggtggtg

SEQ ID NO: 33184 - DNA, 1084 bp, Bovine  19866881132893
atgtttcccagttggagagatgaatgtaaaagaataacagagaattgattcaagtgcaccagtgctgggggtgatcgcaagagcatggcacctgaacataattttacatattttaaggactattgtattatttctacatttgcaagcagccccaggaaaattgtgcatgaaaaatcagtgaagacataatgcttcaagtgggaaagcttatgataatatggggtaatcatttcatacagggtagaattattctgagagagttttgtagttttatatctatcatctatctacctgcctatccagcagctatctatctgtgtatgtgcttaatcacttcagttgtgtccaactctttgaaaccctatggactgtagcccacctctgtccatgggattctctaggcaagactgtcctcctccaggggattttcccaacccagggatctaacccacatctcctgtgcctcctgcattgcaggcagattctttaccatcaagccagtaggtaactggggaagcccagttacctatctgctgctgctgctgctgctgctaagtcgcttcagtcgtgtccgactctgtgcgaccccatagacggcagcccaccaggctcccccatccctgggattctccaggcaagaacactggagtgggttgccatttccttctccaatgcatgaaagtgaaaaagtgaaagtgaagtcgctcagtcgtgtccgactcttcatgaccccatggactgcagcctcccaggctcctccgtccatgggattttccaggcaagagtactggagtggggtgccattgccctctccaagttacctatctattagatgtctaatcttactgatctatgtatgtattgcttttattgggaactattgcaagcattcagaaaaacacaaagaatattctaacagctgcgattttcttttaaaatatcaaacaatcataagtgagttctagtagatgctaagatacagtatgaatactttggaattctggaggtaaattctctgtctggcatctatttttcaaagcctagactcacagcgggtacagaaataaattgtcattacccaata

SEQ ID NO: 33185 - DNA, 721 bp, Bovine  19866881139236
aatcctgctgatggttaaaattatattttggtgttttaataactctgtaagggacatgtagataaacctcagagatatgtaccggtgtggattcttgttaaacaccaataaatattggtattaattcaaacatgtgcttattgttttgtgaacgttaatggaatttatgcccgagatgggtcaggatgtcacaataacgtctgtgtctctttggaacctgcattcagggatcttttgatctttgtgggctctgagtttggggtatgcgtcttcagagtgcatggtggctgggaaaccaaggaggaggtttggggtggttatgacatgctcctgtcaaattccttctgggccattccaaggatcagagtgaaatcaaactttgaacccttctagaatctgtttattagaccacagacctgtatgcactgagttggtaggattttcaagtcacttttttgacccactctctccctgagatgctgagtgggtgggtagggtgggcccagtggggttttctgggggagtctggggaaatatcagggacattttatctcctccctctgcacttccacatactcaaacttcctcccactcaagggtctgaagaagtgtccccaagaagtgagcattagttgggggaattgacatattcctgtcctctctagggcatgggttccaatgtcaccaatagccccctgggccatccctgccctcctatttc

SEQ ID NO: 33186 - DNA, 802 bp, Bovine  19866881254383
agtgggcccaaactttatgaggaatgtggttttcagaatcttttggacttgggtattgctgatcagagattgtggatcttcagtagtttgtcgtaaggctcatatgttaaaagcaattataaataatgaatgacttgaccctcacgattaagggctcttcagtttcctacacaattagcttaggtctaaaaataaacaactattatctgctggactgagttttgtaaccctcttctctgatctccctaaatagctgcaaggaaccctcatctgacacatctctgattgtgttttctttgctgggttctggttcaaggtcaagttcaagtgtgctctctgttcccccaccccactcattggcaccccacagtgttaggattctggcagggttttcttatttcatgacccatacttctgagttcttagtccttacatctgcaaatactcaaaactaaatttaaatttaacttgttctgcttccttccaatatgcttggcagaacactagctgcctgtttaactctttaacttacaagtggcttcaattccatgcctcatctgacaggtttccctataacctgcatgtgtgcctctgcctatagcctctgttgtcatcaacagcttctggttgctgtggtgataaagggggcatcaaaagtctctttcagagtaagagtcacttttctgcctggggtccagactgagtccgcattccctgttacacactgtgctgatacttcctgtgtaacatcatcaaaaatccccagcagcgcagaacacaattgaatcacttcctgtttatt

SEQ ID NO: 33187 - DNA, 1208 bp, Bovine  19866881356016
gtggagatctgttatcggctccatttgacagatgagcaaagtgaggctgtggggaggtgaaagcagactgaaaaaatgatttcagtccaagcagacccagctccatccaggctggcctggggcccgtttgccttagactatcgggcagagaaactgctctccttcccagggggccggagggcttggcagggaggcggcccactgctcggttggttgaagagataatcattcttggggtctgtttatcagccatctttgaatggcaggcctggatttcctaattaactaacatccgtgggccggtaactcttctaagagcccagtcgtatcagatcactgatattctccatggttctatctctcccccaaacctgtgctcaatgactgataactagaagtttctgcagtggataatgaatgattgggggttaggggaggaaggggcaggctttctggatggccccaaatccccagggctcccaagaattaaagttgattttttctgccaaaaggaggcctgtgtggacaacatgccatgaggaaagggccaaggatgctcagctgttctgaatttacccaggaacgcaggggccgcggtccctggccacctggcacccagctgttcgtagcattaaagcccctgaatcctgccctggtggggcccccagagaccagctcacagccttcattgttcctcccttgccgggtgtgcccagccccttagcaacagacgcaggacagagacccaggtcatcctggcgggggcgggggattgccgtctttcaagtcgtattccctgccccagagctccagccagagctgacactactgtgcatcctttcagacaggtcacagtcctgctcacaaagtcagttcagttcagtggctcagtcgtgtccaactctttgcaaccccatggactgcagcacactaggcttccctgtccatcaccaactctcggacttgctcacaccatcccttccacccaaacccttcttccttcttttctcctttgggagaatctcaagtcaaagatccagtttcagcccaagcttcctggctcagagaagctttccataactcactgcctcttggtgctgagtcaggcaccttcctctacgcagccagcctggattcattgcctctttcacaatactttctggctgccttaaagttgtgtgagtctgaggtacacattaaaccctgag

SEQ ID NO: 33188 - DNA, 1090 bp, Bovine  19866881370957
atgtctttatattaagacataatgtatggaggtgtcattgccatcttgaagggtagatgaaatgtgaaaccaaccagctgaggatggcacagcagaaccacagaacaaatgggttcttgctggcatccttaagtcactgagttgatcaactgtgttgacctccctttggacttatgtgagttaataaaactgttctgatcattcaagccactcttagggtcttctcttacaggatctaaaggaatcccagctatatgatccatctcacagtatgggcaaccggatacttctccagttatgtctggtcctatgttgtgagatcttagatatattatcacacataaccctcacaaccaatgtggtgaaagatatggtactattcccacttgacagattaggtacccgaagcatagagtatgcatactaattatatgaagtcacacagataaaatctcaaccagtactcagaccataatcaaagtctgtcctctatcaattataaccttcactaggtttaatatcccaagtctgtatttcccattataccaaataaaaacatctcagagtgcttttcaagcactacgataatctttcaaatttaataatcaaatacaattgagctttgtttgtttttaattttcagttttgcttcataattacccaggcagttagtgcttccttgttgcactcgcaaaattatttttataattcacataactttttctcactctgtactgtaagtatatcttgttctacctgtattcccagtggactgtgaattccagcacagggcttgacatataataggggtttcataacagcgagtgcagtgacaaaagttcacagggtattggactaggtgtgagtgttctcagttgctcagtcgtgaacgactgtagcccaccaaggctcctccatccatgggatttttcaggcaagaatagtggactgggttgccgtttcttcctccaggggattgtcctgacccagggatcgaacctgtgtgttctgcgtttcttgcattgcaggcagtttcttttctgctgagccacaggagcaggaggccagactaggcagttcatataaatca

SEQ ID NO: 33189 - DNA, 580 bp, Bovine  19866881710619
tgctactctgcttccccctaatgaagctgaagggcaagacttgaaagaatcaaactgtttccaagtaacttaaccacatcccagaacaaggctcaaaaaatttatgggaatataaaatatccatctctcaacaaggtaaaattcatgtctggcatcaaataaaaaaccaccaggcattcaaagaagcaggaaaatatgacccataagaaggaaaagaaccaactgacagaactaacccagaaaagatagaattacgaggcaaggaaattaaagctatcgtaactgcattgcctacgttccagaagctacaagaaagaaatgaatgtgttaggaagatgcatggaagacatatattaatatataaaataaggaaaacttctagagatgaaaaccatatcacactagatgagagtaactgaaaggatgaatggacgtgaagaaacagcaatagaaactacccaagatggaattcagaggaaaaaacagactcaaaagagggaggaagagatagagaaaagatgagcgagaatgaagcatcagaagagtcataaggaaacttcaagtgtcctaatatctacat

SEQ ID NO: 33190 - DNA, 879 bp, Bovine  19866881727885
gtgaagctcaggaattattagttgaatggaatggctccagattaattttgttaacattaacatcataaggccttttgctcaatggatatgctaataaaagtgttacttataatgagattttgcatctactatagagtatttatttatagctctcacagtcacatatattttaggattgtataaataaaaccttattttatctagaagattctcatatcactaaaaaaaggacttcagagacattctaataattgccgtatgttcagtgagagaggctcttttcatcatacaaaaatgaagttagttaattgaatggttatgatggctgcagaaggggtttataaaagtcacaattaagaggaacccactgtaagaaaaaggcaaaatgtattttctttaggctcccataagctgcattttcaatgcacagatttaagaaaattccctttccaaatcctcttttgtcccacatgaaaggaatgatgactttaacgcggccgacccgggttttaaaaaaaataaaataaaaggactgtttattctaagtagaacatcatgggcttcatcacagccgtttcatgacagtttccctccagctggttttatttatctcttgacttccaataaaacttatgttttatttcaaggggcaatccataattaacttttcaactggtggcagtggtttcttttggtgccaccaacagtgttgaactcagccttaaaaaaagaaaaaaaaagtaaatattaaagacctggtgcagatcctttcactggtcccagggaggtttgcttgctggagagtttgacaatgacaagatgcattatggggcttggcttggacacacagggagaagcagaagggtcgtgtcacaaagg

SEQ ID NO: 33191 - DNA, 725 bp, Bovine  19866881749183
cgcgtccacagtggctggctttataatttacagtgtgaggccaactaaccaactctattattcaaacatgtgaagcaaacccaaggagaggagtgctttaatcttttgctcagaagtgacatttgcagctcttttcacttacttttcattatttcaccacaggggaaccgtttccaggaattattatgttaagcattatattaaaaaatgagtcttggtattttttgcaataaataacagctcacatttactttgagaacaggaatgctcaccagaacttatgaacattgtctgcttccagaagtgcagacatgttagaaatgataaagtcgtgtttaagaacatagtgtgtgagtgctctgagtcatgttctagtctttgtgatcccttggactgtagcccaccaggattccctgcccgtggaatttttctggcaagagtactggggtggattgccatttccttcttcaagggatcttcctgacctaggtattgaactcacatctcctaggtctcctgcattgcaggcagattctttaccaccaagccactagtgtgactccttaagaacattaacaacccaaaccatttgatgagcacttgctatgtgccagctcctgtgcaaaactcaggagatacaaaaacgagtaaggtatagatcttgtggggaggcatgaccacagaggataaaaagcaataactttggaatcagagagagatgaatt

SEQ ID NO: 33192 - DNA, 1926 bp, Bovine  19866880265731
gaagtgaaagtcgctcagttgtgtccgactctttgtgaccccgtggactatacagtccatggaattctccaggccagaatactggagcgggtagcctttcccttctccaggggatcttcccaacccagggatcgaacccaggtctcccacattgcaggcggattctttaccagctgagggcaatcacaaagcaaatgtacaacttagcaaattcttataaggtgagatatcattgaaaccccccatctgtgttctccatccgagacacagccccctcctccttttaaaagtaagcattcacctgacttttatggccataactcgcatttctttaatgttgtcacctcagtgtgcactccctactgctacaatttagacttggagtgtcattctttaaggaattgttgtggtttagtcactaagtcatgtctgactctttgtgaccccatggactgcagtgcaccaggcttccctgtccttcaccatctcctggagttttctcagactcatgtctattgagttggtgatgctacccaaccatctcatcctctgtcgtctccttctcctcctgccctcaatctttcccagcatcagggtcttttctgatgagttggctcctctcatcaggtggccagagtattggagcttcaggttcagcatcagtccttccaatgaatattcagggttgatttcctttaggattgatttcctaaaggttgatttcctttaggatttaggatcacctaagtgtgtaccccctgccactacaatttagacttggagtgccattctttcaggaatatgagggtgtaatgttgttagaaaggatgcttattttaagcatcctttaaaacaagcccctgcagtggatccttctgatgtttaggctcctggataaatcattttccaccactggcaggtgaaggtggagccagaataacattctagtgcccaccacctagcagctgtcccctgagggtttgatgagtggctacacaagccaccagagtttgcggtctttaggggagggggtgacccagtcctgtaccagggtgatgacggctggaatgactaacgttgtggaggggaggagctggtgaactgttctgagtgaggagtcatccatcagtctttccttgacttgtcatttgtaacatattttctcttctgagcatttggggaattaatctcctcacacctgctgcagcaggtgaacccgagtttgctgttggggtgtccggggtgcgcaggtgtgtgtctttgagaccattcttcattaaaattaatggcaagggggcttttcctgctgtgtcaggctcctcaacactccctccaaggagggactctcaggcaggtggtcacacgtctggcttggtttgagttcccaagagtcataacttgcagaactgtgttgagttctagaatttacaggcatgagttctatgggattgggctaaggtgatttaaaaataatggttaattaaacagtgggcttccctggtagctcagctggtaaagaatccacctgcaatgcaggagaccccagtttgattcctgggtcaggaagatctgctggagaagggataggctgcccactccagtattcttgggcttccctggtggctcagctggtatagaatctgcctgcaatgcgggagacctgggttcgatccctgggttggacagatcccctgcagaaaggaatggctacccacttcagtattctggcctggagaatactgaagtcacaaagagtcagacacgactgagcacctttgactcactcactcagcctttgatgtgggccatgcagtcctcagcatgtagggcttcctcatgtcctagaaacttacctcaagcaggtggatgacaaagccatcctcgaccaggagctggagctgttcacttcacagacacttgcggagc

SEQ ID NO: 33193 - DNA, 1310 bp, Bovine  19866880361278
gacgactgaggctcgaagttagggggatcttgctcaaagttacagagctgagctaagatttgatgtctgaacactttgtggtgggaacacagacagtgaacagttcctaactgaactccagacgacacagcctttttgaacgctcaacttcagaaaaaattagagaggggaatttgttcaaatagcaacagcaaaaaatgtgctccctgtgggttaatttcactgctccctgcccctaccctcagctacccccctttcctggggattgggaccaaggagtgtttcctcagcccttttggaaaggcagaccctccctttctggcaaaggtgaaatgctgctgtgtaaaaagccgggtggaaagttaattacaccctggtttgttcagctgtggccagagtgacctgtgggccctaattacaggactggggctgcggtgggaggctggccacctttgccagcctccttcctgtccaccggctggccagagcttgcctttgtgtgccggctcaggccctttcttgctccaacagcatgcgtggggcccctccctgccttagtgctcgcggcaccccttgcactggttccatttgggcaaaacggagtgggcgcaggccagccgctgggcgatgcagtgccaagtacacaggtgcagggcgcgggtttcttctgcccgtgggggtgtgcacagcgcctcggtgtcagccggcatcacgcagagcaaaaggcctggggcctggagcacaaagaatacccccacctgaagagctttcctgcacgcgaacagcatccggtcacaaaacacagagcaagaaagagtccggtttacgctagccacagaatgtatagggccaggaacgaacccacagggcatctcattcaagtgttcggagcgagcaaacagaatcagcgactgggggacacagaagagtcttaattaagtgaaaaggcagaccttgttcttgaatggaaggatttgatatcataaatacatcaatttctgtgaaattagtctattaatgttagccagtgaaagtaacaaaaagctttgtttagacatggacaagctgattctaaagttcatgaggtggaacttccttggcggtccagtcattaagacatcgtacttccactgcaggggacacaggtttgatccctggtccaggaactaagatcctgcatgtcgtgcggtcaaaaaatagaaaaacaaatgggcatgcaaggataggaaagacagttttgacaaagaggcctaacaggaggggctggtaactagatatgattttaaaacatgttctgaagcggtaggatt

SEQ ID NO: 33194 - DNA, 1317 bp, Bovine  19866880397448
taggctagagtcaattcacgagactgagcaatgcaccaggagaccactccagtgggtcttcgattggtacttgctttcacccttggtgtgctgaaggccctcctccctcccagtgccttagtgggcctggctggggttctagcttcctcagggggagctcagcccacctgctggactggactcttcgagatactctcttattctctggggtcccatcacagtgaactagccaggccaagctgcggctggaggtatgaccatgcaacaatggcgttgcaacccacccatgggtgcccatcagatcccaaacatggggacactttggcgagtttgggtggggtgcagatgctctccagatagcactcgctccaccccagtctccctcctggaaaagggctcagctgttgggctctgactccaggccagctgcccctcctgtggagaaacctgcctttaatttagatgttctatttctttctccgtggaaaagtctttgtggtaccaattaaggaacactttcatcccctcctgtgtgagcagtgaggaatttggggacagcctatgaatggctcctttccacactaattccaaaggcagagtgactttttctggggaaggatacctggccagaggctctgggtgggtccttcccagtggtgtggaggttggcacccatggagggcttgctctgtgccgggcactgtgcccagcgcacctgtagggaccacctcactgcatcttcccagccaccctaaggaaggtctattgtcatccatggtttacagatgaggaaactgaggctcagggaggtcagtgtcctgttcaaggctaggcgagtggtggatggtggagcacaaatatgaacccagcttggtccgattacagggtcatgatggcctaaagtggttcatgatgtcaagaaagtatgttatttggtgtctttattataggacatcagatccagaaaaatgcatgacctgggccagatgtggccacatttcgcacaatttagtgtttattcttctacatggagtctcctgtgtgtctgtgtgaagtccctggatcgggtctgcagctcccggaagatcccaggttgacttggatctcgaacttctatttgggtgttttaggctctgcccagtctgttcctttcgtgctacccagcctcagtccccactgtatttctcacaccttctgttctgtgtgagtctgtagtcgctcagtcatatgtgatcctttggactatagccagataggctcctctgtccatggggttcttcaggcaagaatactggagtgggttgccatttccttctc

SEQ ID NO: 33195 - DNA, 847 bp, Bovine  19866880449835
tcatctaagtactacactggaatctatagccttgaaatcaggagtgactgggctttccccggagatcacgaaggttgccactgggtccagtgtagacacatcggtgtggctgggcctctctgaggtggacgtgcttctactcttgcaacatacaaattactgtttgcctccagcagagaaatcccaattgggagtttaaaaagtaattggttaccatttatgtatttttctttcactgtgctcagataagaataatattaagttttgaatttctgacattcagatcatagtgtattataactgaccataaaaatcacttactttttataaattcattttccaattaccaagtcatttgttcacaggtgtcattttgctttatgacaagacaagtatttttcctaacactgaccttctctatgggtcagggacaggcttcatatctctacgaaggtggcctcactgatgctagtgaagttttctggtttccttaagaaaatctcctaacagaaaagatcattaaccactgtatacattgtgtacatgtatagaggtatgctttgagacagtacatgaaacgactaggggttattctatatactgaatatttatagatctgtaacatttgtttcaaaatgttatatttcatttttataaagtaccagtgtttctcttttgtttagcttttcatagattaaatcagcaatctggaaaacctgactgtcctggagtgttttgaatttaaatcttttcttggtctttgggaactatttagctaaatagattgaaagttttaagagttggttgctgccgaattatatttagagacaaactctaaaaagactga

SEQ ID NO: 33196 - DNA, 1286 bp, Bovine  19866880516582
aacatgtctgtataattctaattaactgctcgcataaagcctcagaaagttacacggggaaagctcatttgccagactgttgcctaaaagccaaggaaaatattatgttcttccaacaaacggactattcatgtaggccgttcccaagataaacaggagatatttgaggacaagtgagatttgaattgaagcagggatggccgagcctcttgtaagtggtgttcagcagtgttggcagggtgggtggcttgattgagtgataaatgctcttcaagaaaaatgcctcggacttggaatgtggggtcaggaccctggagatgggccatcttgtggtactcttgttaaagtctgtgggcaggaggccactctgaattagtgaaaagtctgaatcagagaagagtcaagctctttcggtagtttgtgcttaggttactaagaaagtgtgggcaaaagagagccttggggctgctttaataagggggtcgggatgacttaaagtcaacctcattcattccttctttcattcactcctccagtcgattattgctgggcatctgggcacctgacccagagccacagtggggctctgggtgtgacagccgacaaaatgtcaacatctgtgccctcctgatcccatgtctggttgttggtggtggcgggggggtagtgaacatggtaagtgagcacccattgtgtggtgtgttagtgatcagggctctgggagagagtgaagggggagagggctgggagcccaacttggtgggtgtggttttcggttgagtcaaggaaggtctgcctccctgaggaggtgactgtgagtgaaaacatgaaggaggtgcagactttccgggtagtgggaacagcatgtgcaaaagccctgtgcagaagagtgcttgggtgtctgagaaaggtgagaaggcccaggtgcctggggctgagcaggtgatggggagaagtgggtgatgacgtcggacagctgattgaggggcagggaaatgtaatccagtcttttgttatatgcaagaagacactttttaaaaaaactttttggctgcacctcttggcacgtgcaatcttagttcccagaccagggatcgaacctgctccccctgaattggatggcagagtttaaccgttggaccattccagggaagtcccagaagaagatacttctgaactgcttttcctttacttcataagatgaaaaagacttcaacattttgccacacttgctctattgcagatggtgtgaataatacacaaaaatatagagaagaaaataaaat

SEQ ID NO: 33197 - DNA, 1545 bp, Bovine  19866880535760
ccgcctggccctccaccacccgcctgacccagacccagctgccctgggctccagggaacctcatggggagctaaatgttggtggaaaggagccgtgagatgctgggggtctccctgcagctaagggctagttccccaactcccagtgtcttcacagggggagcaggaagcagatggaggcctggagtcagaccctatgttaaccagctcctctgccactgcaaaggctcagtctccaaagaaacagagtcccctgcccgtcctcaggatgaccctgagctctgagctccggaggctctctgctactcggagtcccagtggggcccagagggagggatgtaaacacactgctgagtggtccaggtaagccttctgcaccctttcagcctcaatttctcatctggaaagtggggacaatgtgttccccaccatgccttggggagcaggaagggtccgtcgtggggacaagcccccgggccctggacctgcctgtgttacctacttgatggcctcacacatgtccagccccatcttcacacagttacgggcgtggttgggcagggacacaggcaagccggacacgcagtagtagcagtcgcccaggatcttaatccgcatgcactcgttggcctgcaagtcaagggagaggcctggtccacagatggcccaagggccagggagcaggcctgtcagccacctccccacaccctccagagtcagccaggctcttttccggccagaggctttttcccctggggcaccaaacaccagcagctgcttctgggcctggcaaaaggactggggacacaggagctctgtaggaggaaccctaagcaggtgtcaaggatgaaaccaagtgttatgaagggcggccacctgagtgcctctagggagccactacctttggtttcattcacccatgcactgagcttctactgagacccctgccctgccccagacactgggacccagcagtgagcaaaacagaaaacaaccctgcggccagaggcagggctggacactaaactagataaataaaatcgatagacacccatgatgataagtgctatggagaaaaacgaggggggaaaaatgaggaatgagaaggaagaagaagcttcctgaggccagagaaggcctcccagtgaaagtaatttcgagaaaagtcctaaaggagccaatggagcaagccctgtagggagctggaggaagagcatccccggcagagggaagcagactgtgcaaaggccctgaggccatgaagctgttggagacacagcacagcagtctgtgcagatgaagtgggggagtgaaaacagagaggcaataggagccataagcttcagggtcagtcagtcaggtcagttcagttgctcagttgtgtttgactctttgcaaccccatgaattgcagcacgccaggcctccctgtccatcaccaactcctggagttcactcaaactcacgtccatcgagtcggtgatgccgtctagccatctcatcctttgtcatccccttctcctcctgcccctaatccctcccagcat

SEQ ID NO: 33198 - DNA, 1816 bp, Bovine  19866880641575
ttgtcttaaagctggccggctccgtgcaatagatactttgatctggaatgagacagggaccacagaccttggtgagtgccatttgacagggaagtagatgtccgagaagagctcctttggccccagtggaaaggagaccacgcgccattccatcattgtagcagtggaagggggcttggagatggaggcatgcttttaggaatggagatggctagaaacacaacctggattttttttttctgccccattttattggaccacatttctagctggagtctgtcatagttccttattttccatcaacagccatggttatttctgacctcttagaggtatctctcagaatacaaggttaagttggatcctggaaagctgcctacactgcttggactacctacaagcagtcaaacttgcctatggtttctttctttctttttttgactgcaccactcaacttgtggggtcttaattccccgaccaggggtcaaacctgggcccccagcagtggaagcgcaaagtcctaagcactggaccaccggggaagtccctgtgatttcattttgaactagtggatgcattccaccagggaaataggagaggtcagatttgaggaaatggcattcaagcaagctagtgtgtgctgtttttctaataactttaacttatataaattgttgaatttgcaggggttttttttaatttttgaatttggaaattaaaaaaaaattttttttttaaagtgcctgaaaaatggtccagtaatctttctttcctgagtgcccgtgagccctatctatatcatttctggttattatagctcttaacactttagttgcatagtttatgtttaaattatgtttacacatgtatatgttttattatcttaacatatatatgctttattttcctgactatacctgagcttgatgtgggcttcttgaggggaggttcatagcagtgttgcagtaactagatggatggatggatggatggatatgcagacagaaaacagtttatctttagacagcaggactggatttaatcatttagtcagctctgtcagtggttaatctgtcatgtgtgtatgtggtatgtctagaggaatatgcttctctggaaccatgaataaaattgttatcagtaactgtttaccctatatttagcatatatgtcaattaatagcattgattacattcattctgattcttgtattagaagatactataatttcaaaaatattttttgtaacagtttctctgtcgaagattgtagaatgttattattataacagtctagatggaataattaaaacttagttttactttctttaaatgtgtgctttttatatgataaaaatagaggcctttaatccttactttaatttattattactgtgatatagtggaaagacaggtagactggatccagggactcaccactaacaaaatgtttgatcattagacagatcactttacctttgggggtctgggtttccttgttcacaaaaagaggaattgaagcaaatgatttctaagatcttttccatctttaacctcctgtaaggaagctggcatgtagataaagagattggctaatatattgtactgtaatgggaataaacattcagatagccagctgtattcatgcacagtgactatgaatgggcattaatttcttcatctgtaaaaatggggggggggtgtgactacaattctggttcttttataaagcctaattattttttcatgaatttctgtggttgatttcttaatgttaaaatgtgaatagtaaaactcttttttccccccttcaattt

SEQ ID NO: 33199 - DNA, 799 bp, Bovine  19866880654055
ctttggagccctgtaaaaataaaaagttaaaagaccctcaagtttgaacaggaaaaccaaatacatgaaaccaagctgtttccatgtgggggccatggactgtgaacacccaagtttgaaacttcctctcatcggaatttatggaagccttggaaacttttccttttccctttaaacatcagaattggctcagggcattctttaaaagcataaccccggtgctgctcacagcttgatttaatacagcttgaatacaatagtaacttctgaacccgctctcttcagagagagctggaaagttgtttcatgacaccagtaagtaggtttttttttttcttctctcttttagccaaaaagtatattctaagatttattagattctctcctgccctccccctagtaacccagattttcactcgaagtaaaggaaacttgcttagaacaagttctctaactaagggctggaagatacagagcccagtcctctagggcagtgttggcactgaaagattcaccagtgcccagaggctggtgttgttgtaggcggtggttcatcagtatctgcttggtggaccagaaccgcacagggtctgggctccagaaacatcagcaggagagtaattgtatttgggggagaggaggttaagtaggggcagggatgtgaatgaggaaattcaattttcctgctgaggaatctgttctgggggtgggtttgtctgcctgtgttcctgggagagagtgtttgcaaagcctgtgaggtggtgacaatattcccccagaaataactcagattccttgt

SEQ ID NO: 33200 - DNA, 1785 bp, Bovine  19866880665953
tagactatacagtccatgcaattctccaggccagaatactggagtgggtagcctttcccttctccaggggatcttcctaacccagggatcgaacccgggtctcccgcactgcaggtggattctttgcaagcagagccaccagggaagcccaagaatacgagactgggtagcctattctttctccaggggatcttcctgacccaggaatcgaaccaaggtctcctgcactgcaggcagattctttaccaactgagctatcagggaagccctgttttgaataatatgcacacagttcccaatagtgtatcctgtccctgagtagtcctaagaactgggggaaataactcctcacatctctcttccatgttcgggggacttgcccaggctgggtcatgcctttactgggtggtaatgaatttctcagggatgctattaggcgaggttgtttcctgtactctttcaaggaatctctgactcctgtccaatgctccagggtttgggggtattcctggttcccatgtcccagtggaggtcgttagtggggtcctgccaggaagcaggcagaggagctggtggataaagatgcatcgataaagatggctggagaccctgcaaatggggctgccgtgatttcagccaaagtctgaggctgtgaagaaaagaggctgccactgggaagacagtcctgcccaggaccaaaggacagatagctaccatttaaaatttccaatacagactaccacgcagagccccaaagcctcccaatctcccttctccacctagaagcaccaccattctcaaaagggtggtaacagacgaaagaatctccttgatgctgaagagctgtagtgccaggaatggcacctcattccaagagctacagacacccatcaaagcatcactccacagtggaactgagaagccctgctttaacaacagcacaggagcagtgtgataggacataaagagaacagcttttaagtagaagatcgattgactgtttttaaaatatgcaccaatagttcactctcttatagttaagatttcacttcagtttgtagctaatcaagaactacaccagcatcgactgttttctcaaggagaatgagagtctgtagcccacaaggctgaggaggtcctgattccatcaccaaactgctatgtgacccgggttaagtaatcacctttctgtctccctcaatatttccccccaggaaataagacgactggaaaagccaaccgcataaatcccttctgagcatctaagttggccatctcctctgccaatgatgggaatattaacaaattccaaaatgactggggtttggtttgctgattcccaaacagttcaaaactttgagtctttctgggtccattgtttttgatatcgattccctttagaggttgagaatgaggacttggctcatccagggctgtgtgggtacagatgtcactagaggaaaagtcatagcaaagttccccaaacacttggctatcaaacttccaagacagcctcacaggtagaggaaataagactttgagtcccagcctatctcctaccagcaaatttccctccccaaacagatgtcagggcctcttttgagtattggttggagatttaggtcctatttccacaaaccggcacccaaggggctgcatcaacagtcacaatacaaggaagtgtctcaggatagctatgtaaggaatacggatgctctgacctccttgctcaaagtctggaacgatgtcaaccctaatgggatagcatggctgccacactccagg

SEQ ID NO: 33201 - DNA, 1530 bp, Bovine  19866880700292
tattaacatttaacaatgctttgttttgaatttttctaaaaactcactcttcttaggaaaagacaaatttatgtttcacttttgtgttttagattttgctaagcacgttgactttttagaagccataagtagtgccttgagagcccttttgcaaacaatggcctccaagaacattcctcaggtaagattttaaagttttttatatgaaactagcaaagcttctgtataatggaggcaaagtttaataattttttgaagcatttctattagaagagtaatgcttgttccttgtaaagtgaaaacaaaagtacttgaagcataaaaatgaaatctccttgtcgccactctgccaccagagcatagttttatccatttgttttgcttttggctgcctcaggcctcagttgcgggtgtggaataattttccttgcggcacaggggcttctctctagctgtggtgctcgggctcagtagttgccccttggcacgagggagcttagttccccaaccaaggattgaacctcatcccctgcctcattataaggtagattcttaaccctggaccaccaggggagtcccctatacaattttctttttattgctataatgtatttgacatatgtatgttgtattttctctgaaagccatttgtctgtttttgaaatactgcagtacagaaattttcaagcatgtcctccaggtactccacagtgacttgtctgcgcctctctgataggtgccttttcgcttttatttttttactttccgtgaaggaaattttcaaacatcacgaaaagcagagatgatagtagttacctgcaagcattccacgtagtgtcagcaagtcagtctttgttttctttctttttggccgcgctgggcttcacggctgtgcacaggctttctcgacttgcggcaggtgagggccattctgtagttggggttcacgggcctcttcgcattgcgttggcacttcttgttgcggagcccgagttctagggcgcgtgggcttcactggttgcagcgcgtgagctctgtagctgtggcgcacgggcttggttgcccgtgacacataaagcttcccagactagtgatcgaagccacgtcccctgccttggcaggcagattcctagccattggaccaccagggaagtcccgtcttgactttcttgtttcattcactttccctacattttcgtttttgcttcttggaatagttaaggcaaatcatgttatttcacccatgaatgttctattgtgtgcttcattatgttgtctgtgacagaaaatgaacttaaaaaacttaaccacattaccattatctcaaacctccaaattaacagatgttttaaaattatcatttaataggcagtctgagttcagttttccctaattgctttaaaaatgtctctcttttttaatggtttgttcaaatcagcatctaagcagtatccacatattgttcttagttgatattttggtctcttaaatacatatttttttaaattcacataccatacagttctcaca

SEQ ID NO: 33202 - DNA, 1440 bp, Bovine  19866880720927
ccccccaggcagccttcctctgagctcaggaagcccagtgccttccccagcatgcactgacacactctggacagggtcctggctcagcctccactccaaccgtggggaagcatttgctgactggatgctgaaattcaacccaggcctccctgtgtctgtctccaaacagcactggacacaggacaccccgtaggtgcagcaggaggtgttcctgactttgctactggaagaacggaagcagcacgctcaccttggctatctggtcaaacttgccgaagagctcattcagcaccaccaccagctctttgggggagcagtcactggccagtcgcgtgaagcccacgatgtcagcgtagaggatgctgggggtggggtgggagaagggtcaggaccaaaacccccgaatatctgccagccctgcactcagtcacccctgcaagccctccacctccacagggatgggagagaagctcctgctcataaagacaaattaaagttccagaagctttacaccagagccaaatggagcaagccccagtctgcaaggccctctggaacccctggcccctttagagcccttaccatagatgactcaactatactctcatgggtggattcttgggcccctgggaacttctccaacctcccccacacctgatttcaccagatgtcggaactaaagccttggtaagatgcaacaactcttgagagtcccttggagagcaaggagattaaactagtcagtcctaaaggaaatcgacactaaatagtcattggaaggactgatgctgaagctgaagcttcagtactttggtcacctgatgcaaagagctgactcattggaaaagaccctgatgctgggaaagactgagggcaggaggagaaggggatgacagaggatgagatggttggacggcattgctgactcaatggacgtgagtttgcacaagctccggaagatagtgaaggacaggtaagcctggagtactgcagtccatggagtctcaaagagtcagacacgactgagcgactgaacaacaacaaagaagtggctggatgctccctccaggcgagctccacacccagtgccctcacacctctcatcttcacactgcccctgtagaacccccattctgcggatgagcaaactgaggcccagggaggtgcagatgcgctgggaagccagagctgcatttggcaccagatctcccggctcccgagactgtggttctggaccatctgcagcccagacagcagccatgggcagcctcaggggtaaggctgagctacaggcagagggccggagtggagctcacggcacccgcatctacacttcactcagggcagcgccatcgagtaagattctgcaggcccttcaagtctgtcaaaatcagtgtcacgactgggggggccactaagtcacctggggcggggggggga

SEQ ID NO: 33203 - DNA, 905 bp, Bovine  19866880748493
tctttgatagcttagaaattcctttttacttgctattttaatgttgaggatactgtaaaaggctcacatttgaacttaggtagaagcaagatactcttagtcctagattcaaatactacattgtcctcaaagggattaaggagaggaatttccatttccagaggaattgctgtttaaaaacggattgtaaacctgtcttaaaactgcttatcgattcatcattcttttgccttctcctttagaggatgtcagcagttaaatttttaaaattttattaagtgggacctaagtgtttttgtaagagtgtctgagtgcttaaaaattcttgttgtgatttatgggcccatatttcttaacttttaggaaagtcttgctgtttttaatacaggtatttaaaaaaatctgaattcagaatgcacctcaatgttgcgctattctgacattaggtatagtaaaactattgagagttcttgggatgtgactgacagttagctaataggttaaaaaattgttgtggtccttggcccctgaactggcacgaccatctaggtagggagaggaagaaaaagcgcatgaacagtggcctggaacctggggcagctggatacccactctgtcccacatctgtgatctatctgtgttctgttttgccacagcaggttgacactccctgaacactccaagatgcagttcaaaatcctgagttcattgctcatgttcttgatttttttgtactttctctaaaatcttgcagtgcttgttttgtgctcttggcatagttgcttatgtttaattttccttttatatatatgttttatccactaggttgctagttaagatgaaacttctttcttcctttctttttttagttgaggtaagatggaaatttcttaaatgtagagtaa

SEQ ID NO: 33204 - DNA, 1500 bp, Bovine  19866880795189
ccagtgatgtcagatccaccaattcagggtgaaaagtggcctcatggaagtatccccagggttggggaggggcactgatggtggcagagggagtcagggaaggcttccgggagtcagtgtcttggaggagtacctgctgggcatgccttggtagcagtacgggcttctgaaggtgttgctcacttacctccccacaatgcagaaagaacagccttccccctttcagagcctccgctccagatgccacacgctctcttcactgaagttggcagaggagatgcccaaatacttctcaggagcttcgaggacttgcagactatagctccgacatctgcagctaaaacttaggaacgggaagaatgctatccaaataaacttaatcctaatcaaaggattattttcttacagaaaagcctcacctatacttaatagttttaaattgttccgggtaccaattagacttttaattttgctgttccctccggcggctggaggatgtgtgtggtttgcgtttaatcagagttgattttttttttttttttgctggttctgggagaggggaggagatgagaagactggttcggggtttccttctggtcctaccagggcccggtctaggggagagttgctgggaccctcgagtttggggctgtctgctggggcagtgtggacatctccagggagcaaaccagagtccccttgtgcctgcttagaggcagctgggagtttctgcctctgcatttctgcctggagaacacaacgctaagttaaatgtatggattatccaaaaatttctgcagcaatagggtgagttattattgattcacagagcacgacaaaacatcgctgcatgaattagcaaacagctgtttctaatttgagtttagaacggtacacagaggaacttgtttctctgttcactcctttcatttataatgaattttaatcaccgctacaggtgagaaaaatgtagaaacaagcttgtatcttgtggaagaaacaaaggagagacagatgctaacagatttccagtctgtgataaaagggatgttttggtacactttacatgtaattagagcgcagctgtttccagtcccaggtccacgaacacggccgaatgtgggctccgccgatctccaaagggagtaaagaaaaacagtgattcaaccctgaaagcatttcgctttctcttgagttgaacagagagcccttcgctccggcccctggcactgttgttctgtaaagcctgatgggaggtgacttcagaggtgctgcctctgcgcctgtgaccgtgggaagccggtgggctgagcttgggggtgtgcagggagccctggccagggggctgatgggaaagccctccagagcccctctgctagctgcaagtgccccatctttggggagcctctggtgggggaatatcaggccctcctttcctggcaggagttgatggtgacactcctccacattagctagtttgatcatcgccagctctcgggg

SEQ ID NO: 33205 - DNA, 1645 bp, Bovine  19866880887244
agaagcagggcccactaccctgagaaacggtggtctagtcacccctcacatcgtccactcccatgtctgtggtggagagagccggtgacaggccacggtcacacagccattgcaggcaaagccagtctgggctgcggccatccatctaggccttggggccagaggggtctgtctcttggaggtccagccctggcctcagctttctctccccctccctatcccctcccttaggggccggccagggcccgctgtcctaaccctcatgtgatgacatggacaagagccgcttgctttgccctgtgtctgtgtttggatgaacaggcagaaagatccagaaggacccactccccatggtccatattgctagtcccagagctttgggctgagaggacttggaggtaaagagagactgttccatccattttcttcaggcatcttgttctttgtctcttaggcatgcatcactttcagagtgtggttttggtgtatttctttttaatctaacaaaataaatttaattgctcttcccccgctcacttttactttcactgagaaaagtaaagtgtacttgtaaatgtgcagctacaaccttgaagagaaatgtggacacctgagagtctgtgggtcacggcagtctaggtggaccgagccaaatgaccaccaccacagtcgtaacagcagcttcttgtcaggctgagacaagtcagtgaccttgtccaggaggccccacacctggccatccaaagcctcccctaccgccagtccagatcatgtccaccctcgccctggccaggcctgcctggtggggaggggtgctgcccaggggccccaggcttctaggacagatggcgccccatcccctctgccctctttacctggctttcctccagggccccccaacagctgggccagggtcagggcccgctcagaggtgaccgtcgcctgcccctccttggccagcgtccagactcacacacgtgaaggctccttccaccggctacctaatgagaatgactcacatctggacccacaacttcctgctctggcggcgggagcagcagaaaggctaacgttgagccctcagctcagcgcctctcggggcatgcaggcgggggcccctctcccagctacagcaagagccctcgacaggagtggggggagccgtcaggccaggctcccggctccaatgacctcatggaaattggaagcttcaaactggaacaattttcataaagtaaaaataaaacaagaacccaaagcctgcattagaagcccggtgacgctggctggaggcagggggtgagcagcgccttaacgagcaattaagaggcaacagaagccttccagggagcctcttcctggctccacctttcacacagggccctgagcctcagtttctccacccacacagcgagggggcctcatccgtctctgagaggtcaaagtctccagcctggcttgccgcctctccatctcacagctgccccctgccccatgctggggccagaccaggggccgaggttaaggccccgggttgaaatccctattccaaagagcccccagagaaccccagcacccctgcgtccctggaagccactcatcgagctccagtttccctttccaatgtcaggcctcagcttccctt

SEQ ID NO: 33206 - DNA, 1687 bp, Bovine  19866880915123
ctaagtttgttgagtgggtgcaaaagctgagagacagagatgaatcgttctggacaacagaatttttggagagggcagagagaagaggtggctgactgtcggagagaaaatacaggtgcacagatctcatggggaatttcacaaagtgtctgcactgtggtgtgagatcttaatagcaaaacttcattaaaatcacctcatttaccatctcagttctgctcgcttccatgtcagctccattcttataggttctgccctccacggctggcaagacagtggctgcaacaactcctagagccacagcagcccttaatcacagccaacaggtgtcttggtttgggctcccccagaaacagaccctgagacaaggatttgaatatgagtggtttattgggaagcgatcacaggaaacagtggtcggagaatggggaagtgagccagggaaggaaaagaagccaataaagggtgtgttactgagccagttatctccacagacggccagagcctaatctcactggggagctgtgagaaacagggtagagtatgcacccagaaggaaattgcagcatttatcaaccagcccctatcagccattggttgagggctgctccagggctgggcctaggactccttacattttgcacatgaggcatgctactcttctcatcccagccccagccgctccctggtgacactgattctattactcaggcttacagcacaatggactcaggcagagttccacgaactggcagttggaagttcagccagtgttcatggaaatgacagatgccaaggggctctggtaggggcacagatagtagctaccccagcaaaagtctcactgttatcgcaaaggttctgactgggtcatatgttaacctctgaaccaatcactgaggccagacagctgctctatgctaattaccttaggcacaggaacagggagatgagagggtaggaggcgtgagaaggtggtgagaaggtgttccttctgtatttcattgaaatgggtgagggtggaccacagcagatctcagaaaataaggtgaatggatgctaggtggccagagaaacaaaaaatgcacgggaccattcctcaagactaaattggaaggtaagaaggttgtgtttggcttctcaaaagtgattctgaccgagcctctgagctggtcacttgcccttatcaaaggataagacattaattgaggaagacttccctggtggtccagaggttaacattccaccttgcaggggacacaggttcgatccctggtcagggaactaagattctacatgccacagagcaactaagcccggtgccacgactggagggtctgtgtgctgcaacaaaagatcccacgtgctgcaactaagaccagacacaaccaaataaataagagaaatgtttaaaaagcattaattgaatactgatttgtgccagacactctgccagattctgagggtgcacacatgaaaaggtgttactcgcggtctctgagagcttctgggtaagggtagcagtcgggggtgaggggtgggaagttacagtgaccactgtttcaactaccatctcttcatatctgtgcatgacatgcccctgattgcagcacacacagtttttatgacccattaagcaaaacttaaaaccaccagttatattatgttataccatgggttgtaattt

SEQ ID NO: 33207 - DNA, 1532 bp, Bovine  19866880946041
cccctgcaccccttcatccacccagtctttgagaaggagggtcaacctgccccagcaccacagccccctgaggttcatcacggggctgcccagctggctttatttttctgtaaacaagtctcaaaactacagcaaagcacattattttgggagcaacaaactgagcaactgctgagattataatcatctgaattgaaataaggctccttaaactgaaaaggcccaatcaggggaaatgggcatgttgacaaataaaagacccaactcagattgccctgttcaaagccttttactctcacaacatttaaccttggctgctgccatccgtcccatccctccagatgcattttgtgtgaggggcacttagcttactgttctaggagcaggctggagagagggccagggccagcgcactcaggatggatgcgtaggggaggggtcggcagaagggggtccttacagcagccaggctcccctcgtgctgttagtcatcacacaaatggaaccagtgcagcacatgcccttgggcagactacagaaagggaaggggtgcagagacggggtgaaggcaatcccgagacccccttcagcttgaacgtttcagaactcagggagaaggtagattcaaggaaagaccagctgtaccagccaccttttcatttccaagtcagtgctttgatagattctactatgtgccaggcattcctttaactcattcagtcctctcaatagcccaacaagataggcactactcttattatttccctgttcatgagaaaactgacgcacagagaggctgagtaacttacctaaagccacacagcttgcaggcaggacagccagggttcaaacctagttagttggttctgagtcggtgctttcacccaccaggctgtgtgtgtgtgctcagtcactcggttgtgtccgactcttttgatccaccatgctacccctgcttctatcttttgggagagggtatggtcacagcggaagatcaagagggaaacccagtgactaatatcagatcctcggcttccccttttcacctagagtaagtacagctaaagaaacagaacaaaaatgagtataaaaatcactttcaaaaaggaaattgcagtcatttaaaaatgactaaccctcaaaaagggctgataggaaatgggttatatgggtcttctgctgtcggctgcaggaagagaacaaaaataagcataaaagtggggagaaacttcgataaaaactgaattaggtagtaaaaagaacattaactgggcttcaggatatatcagcggaagaagaggcgggcgaccccaagctcacgtggccacactgggtcaattctgcgggctgagtctgcagccttgacaacatggcctcagacacacctggactgggtggagtcaagtggccaccacccaggatagctgggacccgcagctccatgcgcttcctgtcacagagaataaaggtcggagctgcagaagaagtctgggatgccagagagaagagcagcccacgagagttacagaaag

SEQ ID NO: 33208 - DNA, 1597 bp, Bovine  19866880953295
ccctgtggccttggtgaagcatcatcatctcccagagtcccagtttcgtcagctggaagatggggctgtgatggtgcccagttcatagggcaccaggtcggctggtaatgctcgctgctgtgggtggacccctgggcagaaagatggtggtgtgtgcacaagaaaacaccccgcttgtgagctagccgaggtgcagtgtgtgcccggcaggtcgggaactctggcaatggagggaaaggcagcctgcatggtgccgattctgttttctgtcccaagctcatggccctgggagagggccctgttggaaattgtgtagtttaggccttccttggttgtcccctagagaacttggatgaggctgcagggaaaggcccagcggcccatttttgggaagtccttctcagctccgggtggggatgggcagagaaatgagctgtactgaccttgctttgggggccctgggggttgcagggacctggggtcaactatagtttaggctcaaggtttccacgatggaaacccgaggcagcccttggggtgggggcttgggagggctgatggcggctgctgggccctgcgtcccctgtgagctctcagtgaggaccctcaggggcctctggctggatgagggagggacatgggccagcagggctgcccccgaggagccagggccgggtcaggggaacagggcaggtccgctcctgatggccccaggggctctctgagcagctgctgagggtgggcctggaaagaagagacccagagtgtgccccaggggcactggcagcctcagcactctcgtctcctggccttgggcgtctggggtccaggcctggagaagggcgcgtgacaccacgtcagaacttgtaggttcagtctcttatgtggctctgggtggcctctcagagcctcagttttctgaggaaagctggaaaaataacaccatttttcccgattatgaggctcagaggctgggtcacacgagattgccttacagagtaaaccttcgagcaggatggagggcttcctgctctcaaggtcttgattctgttgacgcagcagaggggcccccggggactgggtctccagggaagtcctgcttctaacagttcttcaggctgtgtatgaggtccccatgtcgctcacctcccgtctcctgtcccttcccatgcagccaccttgccttcccatttaggacacagcggcggggaggtgacagttccttaaaacagatttatactcttggatgactttatgggtttttgccttataaaaacccacgagttgacattctgatttatctgctcctgagtcaacaggatgtaccagatttaaagagatcaaatgcattgtaatgtttgtggttccagttgtggattagatgagctattatggaaagtgctgccaagtaaatatggcaaaaaaaatataacaaggggataatttaaatatgtctattaaactgtgtgttaagtaaagtagcaccggcatgctgctgaatgtaacttattatctggagacttggtgtagtagataaagtgggaattatggttctttttttcccccttcagaacatttttttctgttaaaggaagag

SEQ ID NO: 33209 - DNA, 1374 bp, Bovine  19866880968575
tttaccgttttaataacttgagaatcacactctccactggaaaaatttgcatcagcctgtaagaaacagtcattttggagagggaagacgaacccctagtttccccccaggaagtaagttcactcctctgttgttggtttattcaaccatcatttattcattgaatgcctactgtgtgcccaaactgaggataagacagtgaacaagaaggaccacagtctctccctgctgggtcttgttctatgatgcggaggctgactttttactaaatggccacataaataattatttaattaccattttgaacaatcctgagaaggaaaactatagtgcaaatgaggccaaaaatcagagggtcccagtggtggtctggccaagagtctggaggaggaggaagaagtcagggaaaaggacagagaacagagttcctgatggggtgaacagtgcgttaagggccagatgtggaaaggaacggggtgattccaagggaaagttgtcacggttcagagctaagggcccaaggaaacaggggttgccaggcttaggaaccaatctgatccagcttctggtccagtctcattacctccagggagacctcgagaagggaccctgtgcctccattttctcatgtgaaaaatgggactatagagaatgtgaatctcatggggttgtcccgaagatttcttgttggttaagtgttgctggtctggccatcgtgaccaagggaaggtcacgaggcttctttcctttcccttcctgtctctcccctttaccagtcctcaagttcaaaaatatttctagagagagaagccaattacacaaattctctccttgcaccgacaagtgcctccttccctgggctgctggtttctagaagttttctagcatctttaggtctgcggagaaggctctgtgttcaagagaatttgattgttcctttgtctcttttgcatttttgtttcatgataatgacccactacttgtggaacccaggttttcctgggcactcctgtcctggggatacccaggaagcaatgactatgccccatggttgaatctgtcaggattgtcagattgaatctgtcactttgactatgaactggccactacccactagtcaggtgttcctgcctccacagctggctttgcaacattgaggagtccttggtctggaaggaccaacgcttggtctggaagcttctgagacttcagaacagagtaagtcaaaatagaaagagtccctttctctgctcttagttctcagcctggagttttggggagggaaatccctacagatgctcctgaaattccccaagggtccccagtgtcccccgcccagaccacaattcaaagggccagcggcaggcccagaca

SEQ ID NO: 33210 - DNA, 1048 bp, Bovine  19866880969459
aaatgtcattctgcaggaatactttgtaaaaataaacaggctgaaaaaacccaaaacttgattaatggaaatccactcagttggcctctgtcttgagctgcaaaatgcatttgttcatatggctaaatcggatcattttcattgggctttaaataaataaggagatcaaaaactagaaatggtggggggaagaaagggaagtttgtacttctgtttttaaagggccctaactgcagcgccccctccccccacccagcgctggcctttcctaggggacagtagcttcaattctaacctaaccaacagatgaaaagaaatgcggaggagaaagccccctgctcagcagtgacagtgtaggaggggatgggggagcttcctctagatgcaggggttatatcatacatgcacaagtcaactatccacaggctcacctcctgcaactgactacactcagtccaggttccacgaccctaacacacagacatacacacacacacacacacactcatctcaaaactccactggcccctccccagcctatgaacaagaccaaaggactaaccagacctgaaactgagtctgttcccctctaagtttaagaaaaaaaattaaatgtcacatcaaaaagttgattcatcctttgatccttggcttgctcgagttccacgcagaccatctgaaagccctgtgcagagttccagggcccataggacatctgtgaacaccagtcccaggccaggagctgcggctggactcactcactcccctgtcacatctattgctcccctaggaacaaatccagccacagggactcactgggttaaggctggggtgggccagactagagcacaatgaggccctctctctccttgtgcaccaagccaaggggtctcccagatctcagtaccccccaagttctgcccccacccagatcactgcctgctctactgggactccaaggcagttggcactgatgaatgccacagacacttggaacacattcggagggcagcacagtcctgcctttcacccagacacccccaaccgc

SEQ ID NO: 33211 - DNA, 4102 bp, Bovine  19866881016193
ctgaggaaataagatacccaagtaatgtgaattattccacactagaggaatgcttataaattataaaccattcatttaagggaatattgcacaacccattgaaaagacaatttttaatagaaacttttgagattgggaatcatccagacaaccaaaaatatacatcattttttcgcatgtgcactactttggaatagcagtatagctatttcgcttttcataggtgacttgagaattaaggtcatacaaatttatgcaacccattttgagactgttaattgatgttaggttcacattatttatttcctcaagaaaaagtctccctttttcttcagtcttaaaggaatgctttattgcagtcttcagagaaagccagaatgcagcaaacccgtctgctccttagccaagctctgttggtcacataagggcctgttagtaattctggttagtgcagacttttccgagaagacatctaagcatctaaaggcaggtttgttgtgtataagtgcctggcgtctataacgaacccttgttttaatctttgtatgctgagctacttcttaacacagtacatcaagtttcagggtgaattcagttcagaattcctgaatatttatctgttctccccagctaactaagcagcacttagagaagccgtgcggagagatgggaacccagtgaacagtggtgtggctcacagtgccgcgcggaatcgtaatgcctgcgtgtccttcagcccgttaggactcttcttctgctcacccacccctgccaccaggtcccctgttccaagtgcaaataccatttagtgggctttaactaaagaaagccacctgaaaatagttttctaaaccttggggtgagcgttggtcgtttgccttttttttctttttttttttagcccaccgacaaggagctgagagagaccatagcattgctgacagctcagcagacagctctggaaatcattgtgaacatgtgctgcagtgaaggtgtgttatcagttcccatttagatatcctccccagcactgggcgggcgcttccatgcagattatcttaaacagtccagttctctgtgatctgcactcttcccagatcccacagacgacgaatgggaagagctttctagcagtgatgaaagcgacgcgtttatggagaatgccctcagtgaatgcggtgggcagctgctctctcccctctgcctctcccatgaggttcacactgctctcacccaccacctcctcccaaagaaggtaatcggttttcagtctgggctcactctagagcatcgagaaggtttcagaaagccattctttctgtgcacagaggaagtgtgttaatcccctccaggtgtgggcgatgggtgagatacggaaagtgagacagtgaacagcactggaggtgggctgaagcttatcaagcctaaccatctcacttagaagttgggattttataaaggaatcatgtgttcagaaaaaaacctttccttgtaacgtttgccttactgtctttcttaaatttagatttttgacaaaactgcctttccaaacagcgttgcagttgacgtgtgctctaggagccccacttggaaacctttgattagaaagtaagaacatttctccttccaaaaccatttgtcattatgttattatcggaaatgatggaccattaaacagaagatgccgactccccccgcattcgagagttctagtcctgtatcttgtgtgtgttccctagagaagtgagcgcatatgtgccctaagggaggagaatgctcatagcagtgtggctcacagttgccccaacttggaagcaacctcagtgtccatcggaggcagaatggataagtcagtgccgacatgctcatacaatagaatacatacagcagtaaaaagcatccgaactggaaccactcacaaaatagtgagtagttcgttgagaggtgcatacatagatggttcctgggcttcccttgtggctcagctggtaaggaatccgcctgcaatgtgggagacctgggttcgatccctgggttgggaaggtcccctggagaagtgaatggctacccactgcagtattctggcctggagaattccatggactgtgtagttcatggggtcacaaagggtcagaccccctcgctttgggggtcagggaggtgggtgtgacagggaggggatgggtggctgtgagcgtgcgagaagcatttctttttttcctcctcctagtgaagtagggttggtttccagtgttgtgttagcttcaggtataagcagagcgattcagttatatatatgtattctttttcagatttcccgcttctaggttattacaaaatattgaatagagatccctgggctatacagtatgtccttattggatatctgttttatatggagtagtgtgtatatgttaatcccaaacttctaatttacccttcctcgcctttccctgttggttaccataagtttgttttctatgtctgtgagtctatttctgttttgtaaataagttcatttgtatcttttttttttaggagttcacctagaagcaatataatacatttgtctttttctggcgtacttcacttagtaagatagtctcctggcccacccatgttgctgcagatggcattatttcattcttttttgtggctgagtaagattccattggataagtacgccacatcttctttatccattcatctgctgatggacattgaggttgcttccgtgtcttgagtattgtgaatagcgctaacattcttatccaggtgcaccagtgtttgctttgtaaactatcaaactctatatattcctgagcgctttatgtgggtcatatttcacatttaaaaataggctttaaagatgctggcacacacagaaatttttctcaagcagattccatacgactcatcagtttactgtgcctccaaggccttgagtgctcaagcagtttgatctggtcagattcacagttcaccttaagcgttcttgccagctgcccgagacctccttctgcttatagatggtccccatcagaaccggatgcctgggttcaacgtcagtgctgagctctgtcaggtcaccgtgagaggcccagacagcattctctttcttcctttccagaatgaacactatacagtgcagagccctcgtgtgtctccagagcctcgtctcccttctggatgtggaccatctgggaggacctgctgcccttcagacgcttgcacagcacctgtcacaactgcttttttctcagccaggtaaatgtgctgtatttttttcttttttaattttactggagtagtgtgtttgtctctgccatacagcaaagtgaatcagctgtgcatatatatatatccactcttttttagattgttttctcatataggccattatagagtgtttagaattccctgtgctatacagtaggtccttattagttatctgttttataaatagtagtgtatatatgtcagtcccaatttcccaatttatccctcccctctcatccccctggtaacataagtttgttttctacacctgtgactctttgtacatctgaggaaatagagtattttacatagtaaaggaaaattctccatgttactttaccctgcatgtatgtctggagtgagggttaatatgggagatacgaatctgctctaattctttgcaaaactgttttaacatttccccttcttagaacactgaatccaagagctgaaattcttagaagatcaaaataaggtcacttttgactaaatacaagtttctgtataaacagtccttcaaaagttgttcccagattctttcctttttttttggctttgctgggtctttgctgccatgcaggcttttctctagttgcggtgcacaggcctctcactgccgtggcttctcttgtttcagagcagcatggccttcatggggcttcagtagctgtggctcccagggtttagagcacagactcagtagcgtggtgcatgagtttagttgctctgaggcatgtgggatcttcccggatcagggatcgaacccgtgtctcctgcattggcaggcagattcttaccactgagccactagggaagccggatc

SEQ ID NO: 33212 - DNA, 1577 bp, Bovine  19866881132423
gagctgtgctgcttggaaagtccgaaagtcctggttgggtcctggctggctcaggtttgggcactgtcgtgtctgcaggtgcctggtccttggtggcaggggccccctccagggcaggggccaggtatgaagccagggtggggtggtgctcaggttctcaggaggagagccctgggttagggcaggccttgggggctacactttaggcaggatagggggaggtgctggatggcccgtgccctgtctctttctgtgcggtcgagatgcattccccacagtcggaggaacacagcgaggttgtgaaactccatatctcatccaggtgtcctgacggatgtgggggtgcacatgctcaggcttgcagggtctgatgagggcccccgctgtgctccaaaaccccacaccagaaaagcgcccagcctggtcatgtccgtataagggcctccctcccagctgtgttcccagtggtgcgagcggcgacgaggacagaccaggacagcagcagcatgtgggagggcgccgacggtgtggtgggcatggagctctgtgcagggggtgtcagggcccgggtgtatctcctgtagaaagcaggggtgatgccgagggctgtgtgcgggcctggggtccacaatgctctgatgctacagtgggaccgccagccttagggccttcgggcactctcaggagtggtgaaggtcgtgcagtttgcaagtttccagtcaagagctgagcgcaccctacatgcacaggcaggaggaggtgctcaactcctcatgagtccctccggccctcaggggactggtgcctgtcagctttccatcatccgctcggaggtgggaaagggagggccaagcatcctgggcattggataatccacagccgggcaatggattgttctgtttcctttggcctgattctgattatttctttttgacagtgcatgtacgtgatagattttccttcccaatcctgttggactcgggctattaaagtcagcttgtattccctgagcacgagacttgtgagatggcacaagtccctggtggtaggatgaggctggtggcagagacagtcctggacgtggggcctggcgtttggtgagcacatacttggtctgtgccaggacacagagcaaacgtgttttaccccccagggtctccctgagccatcatgacaaccctgggagctgggtggtatttccagcagcaagtccacagtttctccatgggctggttcggggctgccatctggtagaggacggggccaaaggcctggctgaagctgctttagaataacgcttctcgttaagctgagaaaatgtcacttggctgcatcagagaatgggggcaggtgccaaagaagattatgggggagcaaagcctccccaagccacccttggcaccatcactgagaactgctgtcctcatttggtggatgagggaaggaggcttggaacggtgcagtcgcagatccgccgtccccagccaggttgctgtggagcaaggactcgaacctgagtcctcctgccaccagagcctgggggtgtaacctccatgctgcccgccactggggaggta

SEQ ID NO: 33213 - DNA, 597 bp, Bovine  19866881251202
cctcaagtgagattaaagaattaataatgtaattttacagttaatgtcattttattgtggtgtcttgggtaccctcttcaataaaattaaaaataaaagcaacagctttgcgacaagcaggagttaggtggaggaaccctgtccttgctccccgaaactgccgtctgtggcccgtgacccataagtgggtgggtctgcaccctggatttctggaaggccttttggaaacccagcaattaagaggttattagtgcaaagttaagcagcttaagtgtggaaagctgcgtgaaggagtgaactctgaggcagggctaacgatgggatgaggagaatttcagaagccaagaagtacgcctgcagaaagggacccagttctgcctctgcacttggcctctgcttccctgggtaggagaagggtggctgggagcagtttttgctaggcctgacgatggccctgtgttctgttaccagctgcctcagagaaggtggacaaggccacagtttctaggagcgatttaagacttcacgagtcaagtgtgtccgtgtgtctgggatatatggggtgtgaggggtaggggaatggggacatgtgtattc

SEQ ID NO: 33214 - DNA, 3075 bp, Bovine  19866881264224
ggcaggttgggtttggagaagagggcagcttagggtctgggaagagccccaggagtctcaaggaaagagaccctggctccaccctgctccaagacggcaggcaggctgaaaggatgctttccagtcccttatgtgttcctgcgtgtcacctttagatcccaaggtctgagcatggactcatggggcagcaaggcccagacagaagcctggagctctccccgggactcaggtctgctcatagctcctggacagagagccctgttttactgatgtttgtagagagtgctgcctttggagactgtggggtcagagcctccatggggatgagcggcagctggggagataggagacctagattccagtcattgctcccctcatgagctttgtgaccttgagcaagtaatgtccccttccaggaaccgtactctgaccattgtatgactaaagcgagcacggagtaaatgagcatgccactccgttaaccagacttccttcctgttaaaactttcagagttttaacatgatgatggttccagtgatgatagtgatcatagacagttctatagcacttacttaagtgccaggtcctgttttaagcactttatatcaactgttccacttaattctcacatcagcccccagaaggattcactgagtgcaggaactcctcagcactcaggtctgcagggcgtggttgggcaggttgtacactgcacgaagttttaacaggaacaccatccacatgtctgccagtccctgtcagtgacagggatccagaactttggggcagagaggcccttctattctctcattttatagatgggaaaatcaagaggcgaggtagcctgcctggggctactctgactcaaccagcaagagtcagagccaggttaggacccaagtgatctggctacagactccatgtgctcaagcgccatgccaaattgtacccttgcagtcatggagtcccctttttaatggagcatctgtctacaggggagcagtgttccctggaacacactttccagatgcattccgtgggcacttccggctaccagctctggaccgtcaaactcctgggggaatctccaatggagattttattccagtctccgaatctccaccagtgtggactcctgcagtgttgcatagattaatagtcatccgttcttcttctttccatccttcctttataaaaacgccgtatcagagaaatttgccaatggtgtgtccacgcaaggacctcctcaccaaggcagctgcacgttaaggggaaattcgcaaaatgaagtttggaagccgccagcccggccggagccccttctgagcgatgatgatttatttcggcaatgtggtagtcattagtatctttggtcttggagcccacgagctcgggcctgggtctgtggccgagggagccttcggggccattacgcactaacggctccgtgtgggcaaaggaggcccgctgtcaatctcgctgccggcgggtaataaacgtcggccggctgccttcctgctcctggagaaggggtggcgggggcctcggcacacggtggcccgctgggcctctccgagaggcctggccttgtctctacggctgtggagcaatcacgtcttatcttggctcagagaccggaggtgagaagttgcccagaattttgtctgactcacccagattttagaaacctgaggttggtttggggactcttggttctgctggtttggttttgggtggctgtcttcctgcagggtgtccacgtcctcttggagagggtatgggtgacgtagggccggtgcagaaaccaccccaagggaaggcgctctgctgtctctgccccttgggatgacctctccatgttgccccccttagaatggaggcctcatttatacacagtcaagggcgtggacatactgagtgtcgctcatgccctttacatgtgcccgcccagcctgcatgcacatcagcaagtagcccccttccttgcccccagcagttccccagggcagtcgctcctctgacttctaccacctgtgggtggttggacctgcctcaacggaaccctccagggtgtggttttgggggtctggcttctatagctcactgttaacaatacatttgtgaggttcatcttgtttgcgtattggtggtgtgtgcctttttgttgccgtgttcaagcccctgtatgaacatgttccaggtgcctatgcgttgcggtgttcagttgttcctggatgggggtgctgctgtgaataagcgctgcggaggggttcgctgtggtcatacgcatgcgcgtctttgctttcatagctggtgggttcctgagctgctggctggtgggcggggaaatgttcagctggagttgacacagccagttttccagggggcttgtgcgggtctacctgcccaccctctgcccgcaaggtcctgtgtaccccacgacctctgcccccacaccctctgctcccacctcctgctcacaccactctggccgcacctgactgtcctgttctcggacagcctgtgcctctctgtggaatgttcctctccagctccctacaccactgccacgctcacatccaggtgtcacctctcggggctgagccccactgcgacgttgtccctctaatctaccctctgtcttgtttccttcatagtgcttctcttaatctgtaggcatctcacttactcatgtgtttgtctgcgtggtatttgtctttccaggtggaccagggaccttgtctatgtcgttttggcctgtatgttcagtgcctgggccagagtccagcacatagtaggtatggataaggagaagaatgaatggacttgaacttttcaaacccagatgccacgtgtatcttgtcttgccatcgtagtcaccttcctacgaggaggatgaggtcaggtcatggtctccatctgacagtggaggcagtgaggtatgaagagtgagtgatgagccccgacggggaccccagttccaggcctgagcctggcgtgttgtttgtgagctgggctctgaggtcttgggatcggcttcagatcggctctgccacccattgcgatcttgtgcg

SEQ ID NO: 33215 - DNA, 1856 bp, Bovine  19866881276969
tcagacacaactgagtgcctaactttcactttcctgggcacccggagatggggtggatacacaaggctccttggtgccggtggtcagatttaggggaatagctgcttgttgttctacggcttgaggatgggaaaataatctcaaattgcagaaccaggaggctgctgacgtgatcaaaggaactgagtgctccagtatgccttaatgtggatgcagaaatggagtgagacttagggaccccctgaggtgacgcaggtgtttagtgttgatggaaggtagacacgaggccgttagatgactgggtgtcagattgcaacctgagcagccctggctttgcatgcaggtgtgtcctgggtgcgagaggctagaggtgggacatgggcattgagagcaactctgctctgttcctctgtgtaagctggtgttttgtgtaaggtttcactgggaaaatcagaggctctatccctctgtgggtcactgcgtcttcagaccttgctccaggactggaattaggagagctgtatgtcgggcctggcctggtgggtgattctgggtggttctgcagacctctgtgaacctcaggctcatcatcttctagatggggtggatgctctgtccaggttgtcggcagatctgatgtcagtggcaactgacgtttcaagtctgggctgagggtcagtggtgggggacttgggtgcccagtcagtgggttgctgaagcggccccgactcctgctttcattctctgacctgctttttgttacttaccctctgccgaaaaccagattttcttgcagctcagatgtcagtataatatgaaaaaacccaagggccttcagtctcagatgggttccttgctatcaaaagcttctccctgtattagggcacaagcctttaaggttttcagcacccgtgtgcccttgcccatcaccagggcacctctggccctggccttgctcgtggcaggcctcagaggcaaggcccacatttggactatttgtgggatgaggaaggacaagaggctggatatttccttacttttttgtatcagttactcaggaatgaatctgccggataattgctcttcctttctctctatgtccacacgttggtatggccctggtgctctccaacattaagggaggaccagctctagctctgtaacttgtgcaaaatgaaaattcagagccccgaattttctcaaaaaaagtttaaaattcattttctaaaaatgaagaatctcaagatgacaacctcaggatatcaaacctcggcaactgtaccggtcacgtgcccatgaaaccagcgctgtataggagcaagatgctttgaatggcaggaaccccacaggactcaggctggaagggtatgctcatgcaggttgtatactgcacaactctggggaataccattcacactgtggcccacatggcggccttgccagaggtcaccccaaccagcccttgacagtggccatgacccacagctctgggacagagaggccgcctgaagatgggctggggtcctcacgcccagattctcccctccagccagggttctggaagctccttcttcgctcctcccattctccttggcatttcagagacacgtttctccgcgaagctgaggtgcccgggctccacgtgggcgctgctggggaagcttccgctcctccgtgcggatcgcccgccggcggctctgctgttaacctttggggtttgctcataaaatagaaactctctttgtaggtcagtttgtcagtaattttggcagccgcggggccaccgagggaatgaggcttggttcccacttgtctctcgtgctcggtttggagacttttgcggagcccttccccgg

SEQ ID NO: 33216 - DNA, 2662 bp, Bovine  19866881311375
aacagtcaattcctgcgtcctgcaggggtggtctgggtgtgattggatgtccttatacaatagaatggtctttatttaatcctgccagttgatgtctgtgaccctgcgtagacccattaggagaccctctgtggcctgcaattgtggtcattgtgtgtgtatgctcagatgctcagctgtgtccaactctttgcgaccccatggaatatagctcgccaggctcctctgtccataggattctcaaggcaagaatactagaaagggttgccatttccttctccaggggatcttcctgacccagggattgaacccatgtctcttaagtctcctgaattggcaggcggattctttatcactagcgccacctggtgggtgggaagcaaacgctgcatggcctccctgtggcgggtgcaggtcagaatccctctaagcctgttttctgttctaaaaaaaaatgagcaccttcctttgtagcccacagggcttgagctgaggatgactgtgtggagtgcttagccctgcgggctgctgcttcagccatagagccggatcctaccccaaggctcctgctctttctgcacctcccgtctgtccccataagctcatctcttgggggaggtttcagaggtctgctaataggacctatcccttgaaagcagaaatgggatttttcttcccaaatccgttccttaggggaagtcttcaaagagagttcttgtaatttcccgttataaaattttatgtgcaattacaaacaatgaactgtgagcattaattgagcagactgggagattttctgtttttaaatcaggactattttaaaacctctcagaccacgagaaaatggcctgaggaaataaagttccagagggtggcccaagcagcatcccactcttgtggcccctctcgttgcctctgggaccttgcaggaaaggtggcgactgcacccagcagagccagaggggcctgctgcagcaggacaaagcaagaggctgcccagttctcccggcgggcagggctacgtgaataatggctttcacccactccagctgcctggtgtgtaactgatctgtatccatccatccatccatccatccacccatccacccatctactcgtccacccatccaaccaaacactattagctaagtgcctgccaggtgccaggctctgagcacataggtctgtgagcaaaagacaagcattcctgcccaacttgagctgacattttaacaagggagacagagataatgaacacagtaaataagaacactatacagtatattagaaggtaataagtgctttggagaaaaactaaattggggatgagacaggaaggagagggtgggggcaggcctccttgagaccgtgacatttgagcaaagattagaaggaggctgggaagcaagccatgtgactatctgggtggaagtgttccaggtagaagaaaaaaaagtgtgttcaagggtcctgggggatgcccaggaggaaggggctctgtgcagtcctgctcacccttctgaggacattgagttggctctgaaagaagtgggagccattatggggttgcaaacagaggagtaatgtgtgcttactttgtaaagttttttttttttaattaattaatatttatttatttatttgttttggcatgctgggtcttcactgctgcgcacagcctttctctagttgcagagagtggagactaccctccagttgaggtgtgcgggctcctcactgcagtggcttctcttgatgcagagcacaggttctagtgggctcagcagttggggaacacaggcttagttgttccgtggccatgtgcgatcttcccaggccagggatcaaatctgtgtcccctgcactggcaggcagactcttaaccactggaccagggagtccctgcactggcttactttttaaaggactgccctggctgctgtgttgagattagcactgctgtccaccactgaagctactggacacaaggctgtcaagtgcttgacatatggcccatctgattctggatggtgaagacttaccatgcaagagagaaactgtctcattaactctttgaacacattgattatacgttgaaatgataatattttgaatatatcagcctaaaatatgtattattacaatttattccatttcaccttttaaactgtggctactagaaaaggtaaaattccatacatggctcatattctgtttctactggacagcgctgctgtagacagtatgggtcaagggcagaagctgggagacacttgggaggcacagccgtaattcatgtgagaggcgatggcagccgagccagggcacagcgtggtgggaagtggtggaattctagatggattgcgaagcgatgtttgtgactggactgcagggcgttgcttcacagatgtgtgaggaatgactcacacatgggctctgcccgtcacactgtggtggggaggtgtgtggaaagggagaggggatccagagagtcagaattctctcctggaacccgagtctggaacaacaccccgggagagactgttggtggtcgaagtcagagaactggctgtccgcatgggggcagtgtaggaccgggtctcttgtaacaggtggttgtgagaatccaggtcttgatttccccatctgtaaaatgggggca

SEQ ID NO: 33217 - DNA, 914 bp, Bovine  19866881347728
ctgccctcttctccttcctccacatcccctcccatggcactcaacccatttctctggttgatctgaagatctcactctgcaaaccttagctttggtcattgagtcctgttctacctctcaatcaactctgattctgccaatgctcagttattattatttgaatggctctgaatttccaggccacaatactctcccaacctaggtgctccaggcttcctgtataggactagagatgctcaaccttactccctagaggcctcaagtaataggtagagaggtcacagtccagttcatcactgcctctcccaggaagccctccctgacttctccaggctgcctgtttcattttaccttgaacaccactctctctgacaaccagttctgccagcctgcactttccctaaccacgctcatccctgtcccaccactgggcccttgaaggcagggtctgatgaagacttgttcatcttttccctcccttccatcagggagtatgggaggttatcgcaacggaagatgcccagaagagcctcagcaacccaggctgaggttgggggcgggggtgtcagagcagttgtacagaaccaggtgggccagctggcaggccaccatgccatcctgcagaccacggcgagctcagtgaggctcgggtgggtgccattctcagcagacccttccacttcatctaacatgcgggcagaagcagaacccagcagccccacccaagtggcccctgcccaggaagacagggccccaaggagaagactccgcaggctggggttggaccaaattccttctcagcggccgtacatttccagcatacaggaatcgttcctgccgattcaaaaccaggtcagagaaaaccgtctctcgtttccggcaggggtgagcgttcctcccggggaagggctccg

SEQ ID NO: 33218 - DNA, 783 bp, Bovine  19866881377187
atctagcagttttcttactggaaacagtttggtgctgtgggccgacattcataattcttgatcttcttgtgttggaaactgttctccaaagtagattaatgtcgagaaaagtttttgttactttgtttcaaaactctcaatcagtagaaattccaaaatacactgcatgagtttaaatgctaaatatgcaacataagatatctagacagccaagtctactctggtatggcgtgttcagaatactcagtgtttaaagtcttcctgagaaggtcaggatctcagctctggtaaccttccgtcctccgacttgtcatttaacttgtttgacgtatttaagttttacctttcttttctttctaggtacctattattaaattaacagattcttttaccgaagtgaaagttgatatcagctttaatgtacagaatggcgtcagagcagctgacctcatcaaagattttaccaaggtcagagaattcatagtgtttattcaatgagactattagaaaatggagttatgttttgaaactctgttgtggtggtgttttggtatacttggctaaactatttttatatgtgtattgctgacaaatgcttcttttctgtgcggtggtttttactttccttgaatctgcttgtcataatcagtaatttatagtgtggcctcaggtaagaattaagggttgaggaagcctttgaagagcttctctgccctagatccttcctcttagggagattcgggctgagtcatgcgacgcagttcactcctgtctgctttcagt

SEQ ID NO: 33219 - DNA, 615 bp, Bovine  19866881608471
gagctctctgctccggcaggcatctgagaggcctcaggcccctggtgtcagacagagcaggcctggggactcccatcaagtctgtgttatctgtttccagaccgaggaggtgccaagccgatctcgggggcatctgtccctcgagggccactgctggcgccactggcagggaggtgggctttgggaaaggaccacccgccaggggtgcccctggaagacagggatgtttgtaaaggtgttcactgcgggatcagacgggggcctgggactctgggattttgctgggggtgggagtagtggggagagagtgagagagaaggagggctggagaggctgaagggggaatctgcagtgggccccttaaggagtctcctgtccagcttccctgcccagcgagctgcagggtctgaactcactgtgtcaacccttcacctacactatgccacgggtcccccacaacaattctatgacattgagacaattattattcccattttacagaagagcacttggcaaatgagacccagggtgatacatgccatgtgccgctggaaaggagatggcatgcactgggatctgaactcggagcttactgcgatcatcagatgtgcttaa

SEQ ID NO: 33220 - DNA, 2967 bp, Bovine  19866880385495
tgaagaatttggaatttataaagtcctttaattatttccctccgaaaatagcaaatgttaatttctgtacaattaacacatgaaggtaatgataatgcccccatctccacaaagatcttagctatgaaggagggaggtagagttgtcttctgagagttaaactgtaaaacaaaagaataacagaagagttagcgatattaaaaaaagaaacaaacaaaaaagatgactttaaggaggatagactgtcttccagaccagaaccagggcacggctgttaccaagtccaagctcatgctgctagctgcatgacaggccaacaaatcaagagatgagatgttatggctaggaagagtgactttattctggaagccagaagaccaagaagatgatgaactagtatgccaaagagtcaccttacagagttagacttcttttacattagaaggggaaggatgtgtggctggtttgttgtcctttttgtgttggccagatcccagagaggaggtgataatctttagttctttcagctccatgggtttggtcacctgttcctataaacctccaacaaggcaaatgctattctctgttctgcaattttgtaataaccatatgaatgaaaagtgctatacctttaaacatcaaagcagggaagcagagccttgagagtgggctctcctgtatatttcagactctaggcagctcttttacaaaaggtgcagagctagcatggctaagcacaggggaacagagcacaaaggttagaaccgagggaacagatacaatatgaaatcatgtttgtttttctcctttgcaagacctcatttgaaaaaggaggggcaacaaggcattgggcagtcatggaaactcagtagatgagattacagaggtgcatatacacgggggttccaggatgtgacttagctaatcccaagattaagttactctttggggctatcatggttccttgctaccaaacatctgagttacaaacaaaccccatgtcttctgattccatggattccaagacctgttctcatgaagacatggcttgcctctcagatgttgtcagaaaagaacccactaacagagctgctagaggtgcttatagatatcgtaaaataatgttagcactgtattgatacactcacccctttagggtagggtctgtgaatttgagtatgcttctgaaaggaggctcgcccacaattttctgtgactgcaaacttgagggctacaatccagattgtgataaagtcattaagggaaatgttagcacagtgctttcctaaggtgcctttttgattttttaaaatttcaacatgaaaataaatatttttttattcattagagccttacctacttccatataagactaaaggtcatataaggccattataacaaatttaaaatgctttcaactatcttaagtatctttttggggaaaaaaaaaaaaaaaaaacttccagaaatgagttaaaatgaggaaagggaatcccagagagattaaatgatttactcaatgccattcaattaattagtgtcagagtcagaagtagacttcatatcactttcccatgcaaggctttcatattctccggtggaaaactactttaagtattttcaaataccagtggatttcagttgagtatttgcatttcactcacaattgcctgtcatttgaagcataataattgggacttccctggtggtctagtggttaagactctgagctcccaatgcagggggcacagattcaacagctgatcagggaactaagatcccgtgtggcatagccaaaaaaaaaaaattaaagcataattatcatctatcctactttattccttcccatttccccattttttaaaaatatcttcatccttctcctgtagtcccaactttaagtgagaaaagacccatgctgtagaaatactcagaggctttatgtttttaatataaaattattgagatagtttacagtatttttctcacaccaagtcttcagaatcttgtacatgtttcaccctggcaccacatctctacttggatatcaaagctagtggccaagtattaggcagtacagatttggaaggctatctgtggaggctggagtggaggcaggaagagtacactgtcccagggcagagttgtggcgggcttccccctcacacaccagttcaagcaagacacacagaagggacttggaataaccagtcacagcttgcacagaaggcagcactgggaatgtcgagtgagtgggtcacaaagctgcagaaatacccagaacctttcatatggtcatgttagttataaatccccaaggaggattataggctgcattatccacaagctcatttgacagatctttgtgcagagcatttcattatcctgtgaacacgattttcagaaatgctgcatctgaatgtcaaactgcatgtgcttttttcttctgacattagatactcttagtctcaggaagcccatggggtgggggccatggagagagttgaaagataacaagagtggtgagtggagaaagttagcagagtcatttaacacgcctgcctgtaaaaccaaccaactcaagtgctatagtatttcttcacacaggtccagagaggattcattaattagcgtttgaaaaacagatcattggggaaggtaccatgtgaatgtggtaatcatcaacaccactcacaatcacgtcaatagcatgtggtgatggcatgttgactctgatcgtgaacagttgttggtgttgataaagctgtgaactttgaatcattaaatgtgcttgctttgtggttttaaaaccccaaggcagatgttatgtagtagagttaagttatatcttgaatatgtgcctggagtccaaagctaagaaagaaaaccatcaaagagcccggagcacatgacaaacgggttttgacaaaggctctcccaggagagtcttcacggagaagtgatgtg

SEQ ID NO: 33221 - DNA, 1641 bp, Bovine  19866880401321
gcttttagtctaaagacagggacattcagatctaataaagcctcagaaaaaggacaaagattcctaaatgtatgcctacactggcaaaaagttgggaaagtttttcttctaaggctgcaaactgaaataaatgaacaaacgtaaaatccagaatgaccaactctattctagttgggtgggcatagactttctcattcttctctaagatccctggcacctggcacagcctggcatttcataagcatgctgtaaatgtctatgaaatgaatgaaaggtgcctctagtgacaggaaggtaggagttccttactgtgcacacactgcctggtgtggctacagaatagttccagctaggctttaaatgtaacaccttcttaaggtggcttggcaagaggcagcaaggtacagggggtggatgtcaccctcaatttcccaaagattcttcctggcttttatctgaccccaggaacccttctcacaaagggtggcaggctgacttcagcttgatgggagtgtacccttttcagtgggtattgtcaagaacaaaactccaaaaccgatgatgatggactctgctctttttcttcttgtgagtgtctagccattcagaaaatcccaaagctcgtactttgagcatgagctgtgcccaggtgcagccttgtctttcatccccattaaaacccacaaaggagactcataatgtgccgcagaaggactgtagatgtaaggtggaatttatacaactggatggcttttaatgaatagggagtaaatgggtggttacctggcaaccctgggtaagtgcaaattaatccatctttatttgatgtcagcatggtggcccaagtcttccactgggctgggacaggagtgtaaagctgctgatgctctagtggagttgggagagtctgtttatttttcattttgccctcatctctatacttggccatcatgctcccagcacaaaattgcactggtgactccacggtgggcctttatttggaacggtcattctaacacatgaatccttacagaatggtcatcaggttggagagccaagctggttcccagtttgaagcttgtgaagattaaggagttcagggtcgggttacccttttggtgttggtcttggaggagggcagaattatctggctggtaacttgctttatggctccctttaattgtgccctgtcctcccaggctgtagccagtcttatggtgtcctggtcttgatctggagatactttatcccaatatgttccccatacaatgatacttgtttgaattcagtgaaaaggttttttttgttgttgttgttgttaactatcattgttacaatgagtttttgttacaaaggagaaaaatgatagttccacttgatttgcaaggaagacatgatagttacagatagaggtaacatttttgctgaattaatttttattgaaaaaggatattgttaacacaattttgttgaatttttttcagtttattttttaattggaatataattgctttacaatattgtattataatagtttctgctgtacaacaacctgagtcagctatgtgtatacatatatacctcccttttcagcctctctcacacctcatccccaacccgcccctctaggtcatcacagag

SEQ ID NO: 33222 - DNA, 1501 bp, Bovine  19866880444048
ggtgtttgctatgaccaatgtgttctcttgacaaaactctgttagcctttgccctgcttcattttgtacttcaagggccaaacttgcctgttactccagatatctcttgacttcctacttttgcattctagtctcctatgatgaaaaggacatctgtttttggtgttaattctagaaggtcttgtaggtcttcaaagaattggttaacctcagctgctttggcattaatggttggggcatgaacatggaagtataggcattttaaattaagaaataattgcgagtctgattatttagtgaaaaagtttccctcaaaaaatgtatttcttactgtaggtttcaaaataaatgttttaaatcatgtatctattgtgttatattgtatgtttttttgattgtatatattttaaaattatatctttaatggttaatttatgttaatgcatataattattcattcttttttgaatattttacagctatgactggttccaaacagactctttagtcaccatcgtcatatatactaaacagaaggtaaacaagtttttaacatcagaaaaaaataaaaagctacatgcaggcacatttctgagcactcatcttgtattaacttacagcaattctatgagatagatcctttcattatccctattttacaagtgaggaaacagagattaggtagtttagcagagtcacacagtaaatgggagatctaacattttgatcccagacaggctggctccatagtatatgctcttaacaaacatgccatagcatctcaggaaaaaaaacagaaagtagtgggttggccaagaagttcgatccagtttttccataacatcgtacaaaaacctgaagaaaactttcagccaacccattattttatatgctcttctgtgattttgtttgtttttatgcatggataacagcagtggactgttacccttggactgcaaggagatcaaaccagtcaattctaaaggaaatcagtcctgaatattcattggaaggactgatgctgaagctgaaatcccaatactttggccacctgatgcgaagaactgactcattggaaaagaccctgatgctgggaaagattgaaggcaggaggagaaggggatgacagaggaagagatggttggatggcatcaccaactcaatggacatgagtttgagcaagttctgggaattgataatgggacggggaagcctggcatgctgcggtccatcaggtcggaaagagtcgtacacgagtgaacaaatgaactgaactgaacagcagtgagagttcgcagtttaacttcaccatatgaactgatttcctgcacttgaattggaattcaagagacaggagagaggattgctgtgtcttagtacgcttaagctgctaaccagctttagatgtcctctggaaactaaaattagggaattaactcattcattatttattgaacactgcttcattctggacactgctgtagaattcagaaatctacag

SEQ ID NO: 33223 - DNA, 1733 bp, Bovine  19866880464123
ctatacaacaatacaaaagaaaacaaaacaaaaaggagcttgggatgaacacacacacacactactatgtataagataaataaacaaaaaggacctacagtatagcacagggaactctactcagtattctgtgataatctatatgagaaaagcatctgaaaaataatgagtatatgtatatgtaaaagtgaatcactttgctgtacacctgagactaacacagcattgtagatcaactatactccaataaaaataaaaaaataagaagaaagtaaaaaaaaaaccaaggaactgctctctattctgctatagtgggttggtgcaactgggtctgtttgaaagattattcatttatccttgggcctctgagcagctggacaggtagtaggaaggatgtgaggtttatgagaactccagggcacataggtccccaagctcttccacagcattaaaatcaaggttctgcttgtaccccttcccccaatttgaacaagaattgcaagttacttatggctcatgtggtagcataatcaaataattccacttgaagcaaacaaacatttcagtaaccaaaaagcaaaccaactcatggtcactgtaaaagataagacatttttggtcaagaaatgcagaattgtatgttggttggtatttttaatataactgctggagattattctattaattcttgataaagtagaatttactcctctgttataaatatggtgaaattacaggcatggaagaaattgtgaaaattttctagtggtttataccaattgttttctttggcttcagatttttgtttttaacaggtagggtgctatatttattaaaatagtatgtggaccacaaaaaaggttatttcaaaaactatcagccaagcatatttattgagtactcaatagctctgacccctaaacataaaaataaagaaataagtcaataatgtgaaccaccaaccaagccacacttcaggcttttatttttgtccttaaatttgttggcatctaggtcagcacaccccaagatttgtacttgtggtttcatttccaaatacctcatacttacatatatgaggtgttccaggaaaaatgaaaaacaaaaagaaataaaccaaaaacaaaaaaaaagaaacaaaactgttccagcagcagaaagatgtgggttccggaattttctaattcagttggttggggagtgggggtctgaaatcaagtattttaaaaaatgcttcaagtgtttcacatacataccatcctggaaaccatgaataattttagagagctccagcgcaatcagcacctgggtctcagaaagatgtggctgctttaccacaagactttctgacagctgtttcacaacagaactgcttgtcggcagccccacaatacggcaggtgacgccctctcgagaccttccaatctgtacctgccctgtaggagaggtcacttcaagctgtgcctgctaggactcaggtttgcatccttggcccttatatttggtggccgtatgatcttgggctgatatttaattctcagctccacttgccttgactgatgaaggagcgaattcagtctactcgacagcactagagagaatattcagaggaaaacacccttcagtccctggaataatcacagatgctgtttccatttaacgtagagcaaaagccagaaaaggcccttcttagcttgtgtccctgcttccattttctcatttattattttccc

SEQ ID NO: 33224 - DNA, 829 bp, Bovine  19866880468732
cactagcatcaactgggaagcccaaggtagacactggagatgaagaaataagtaaagacaaagagaagaaatggcagttctcaaactttactgtatgggaaaatctgggaagctcacttaaaatgcagcttcctggattctgctctccaaaattctgatacagtaagtttgggggcaatgccaaagaagccacatttccaagaagcatcacatgtaattctgactcactttgaaaaataccttgtgttgttaaaagtccctcacatagcaccatctcctctgcttgcccccctttcacccagatcttcccaatgaccacatttacacatctttcctggcactcaagtgaacaggtattttgtaaatttcttctgaaaagacactttcttttaaaaagttataaaccttttggaaccatgatatattgatgactaaggctctgccagcactcctctctgtctttgctgacttttcctgtccttgaggagcagggtccagacaccaggctctgtggagcccagatctaagctgctccctgagtaacatggatgcttaatcagcaggatagcaaatgtgacctttatcccagggagtccagttctcagctcatatcccctcttccccaagtaccttctgtgacccttctggagcatgtggaaatctctcagtacacaaagtagggtagcatcctggctttgactgaaaattggacccatggaaggcatagtgtgaggcagtagcttgccctagcaaggttagaccctaaagtattatttatagtgatggcactctcttctgtagtttacagacctctttcccgaccagggag

SEQ ID NO: 33225 - DNA, 2178 bp, Bovine  19866880477426
ctacccaacccgtagcacccccaggaggccagagatatttgttttgtgactatttctcaatttctaagcacactaataatgtcttgcagactgtaggtgttcagtaaatgttttttgaatgaattattgtgagcaatagtaaaccatcattgtgctgtttctggagtgggagcatcactagaccagataaatcctgggccaggcctaagtctagctctgctttcagattgtcctgggttttgaaactttgggtattctttgaatggacaaaagcaccacatcgtctgtgcaaagtccccagccttctaaagcatattcagaaacgggatgattcagaattgttcaaggcaccacttccttccatgtctctctacctagaatcaccccttacgaccaagatggtacttggtctgtacgaggaaaggaaaaccaggaaatgtttaacagtacaaattcaggggcatcctaggacatctgtggagaaggcaatggcaacccactccagtactcttgcctggaaaatcccatggatggaggagcctggtaggctgcagtccatgggatcccgaagagtcggacacgactaagcgacttcactttcacttttcactttcatgcattgcagaaggaaatggcaacccactccagagttcttgcctggagaatcccagggatgggggagcctggtgggttgccgtctatggggtcgtacagagtcggacacgactgaagcgacttagcagcagcagtaggacatctgtttgatgatgtttgctgagcaatgtgatgtgattgataatcttgatgcacagctctcactggtaagatttctgttgttttccccaaaattcaccctcgtgaactttcccagcttcctaggcccctgtctcccctcatgccctctttgtgttacagacacagatatagacagacacacatgacttcttgacctttgctatgctcagagaaagtctcttcctctgaaaaagagggataatcagagaatcaccccatcttctcatcacctctacctgcaccactaaaaacaaaaactgtttccaaatgtagttaaaagaaagctgggaattatcatttaccatagaaatatcaattttgtggggaaaaaagtgtcagttttaccagatgcttctggtcttggctgcctaatccatttgctgtctcagcagctgcaagtcctttgtcagccccacactccctccctcccacgtgctgtttctatcagttggaatccaattggttcctgccgcaggcactaaacttgaggcaaataaaatagcaggggtgaatatgaacaagaccagtaaaaataaccttccttgatgcctctaaattatagtatgacaatgacagtcctaagcactcaaaaacctgagtcagtgagttggagggtgatttgttttcaattgaagagtccaaggatattcctgaaaaagtcagatgacattattgatggaaggtatattgctcacaaattgtgccatgaaaacttagattaattgtattttatttaatcctcacacctgtgagcattagagcccctgttctacaggtgaaaaaactgaggctcagagatgttaacctcgttacccaaagttacgtatctgataaatgtaacttctgataaatgataaattctagatctgtgcctaggtctggctgatgatgaagtttgcatcctcctggcttattatacagttctgctccttgcctggcctaagacttttttaaaattattttttattggagtatagttgttttacgatgttgtattagttcctgctgtacagaagagtcagctatgcatatacatatatgccctctgttttggattttctttctgtttaggtcaccacagaacactgagtagagttctctgccctatacagtcgcttctcaatagttatctatcttatacatagagtgtatatgtgtcaatcccaatctccctacccatcctacctccacttccgcccttggtttccatacatttattctctacatctggcctaagacttgaggcacttaacaagcatgcttgccagtgccagaatccctcattctcttgaatatttccaagcaccctgaattacaatatctgagtaagtaccctaattgaaagtagccattaggaagctatacctataagagcgtttgcat

SEQ ID NO: 33226 - DNA, 4373 bp, Bovine  19866880503553
cactctttaaaaaatattaatctcactgtagcatgtagaattttacacacagtttcagaatgggtctggcactgcacatccttataaagtaaaaggacttggaatagattcaagattcaaatgctgaagtttgtatctgcacctttgacttattgttttttttttttaaatgcatatagcatatgcttacattgtatcatataacacaatcacatctttgataacatcagtaagttggtgttgctttttcattgcattttccacagtggacatttttataggtctgtcatgtggaggacagcaaatcagtatatatttccttttgtccagccaaagtttttgtagccctaaaaatgacaaaagttaatagcattgtgttttttaaaatctaaatgtcacctttagactggttaatttgtcttcagtatagtgtcctggttaagaagagctatgctatgctatgctaagtcacttcagtcgtgtccgattctgtgtgaccccatagaccccatagaccccatacctcatagggcagcccaccaggctcccccgtccctgggattctccaggcaagaatactggagtgggttgccatttccttctccaatgcatgaaagtgaaaagtgaaggtgaagtcgctcagtcgtgtccgactcttagcgaccccatggactgcagcctatcaggctcctccatccacgggattttccaggcaagagtactggagtggggtgccattgtcttctccaagaagagctaaggctgcttcatttcaagagccagctctgtctatttctagctgtgtgaccttgaatgcattatttaaccttcctgtgcagaggttttcttcatgtctacaacaaggatcataataacatttatttcataggatcttatgagctagtatttgtaaagtgtgttagacagtgcttggcagaaaagaaagttgcaagttcttgttgtttcttattgtctttagatacatgtggaaatctggagagataaagataatctatattctgtagggtaaaaaacaatcaaagaacagcttggcagaaaaaggagaataatacagttgcattggttacacaagtcacttcattatttgtaaacaatttaaaatctttatggtctggcattttctaaacaatatttcgatcaagaatattctattataaggcaataggagagtgaacattagtgggaatggtgtagaaaggacctccaaagagttgttccattatacaagcaaggaaaacattgccaaaaatcatcaaaaataaatttttcagaactctggaaattaaccaaagatttgcagtaagtcatggagatttttcaaaaatctgaatctggattaaaaacagcaggttttgtaatgtgtgaacttgcccttctcccatcaccctctcctcaactctaggatagccttggaaactagctgtctcacaaacatgattgcaatgaaaaacagtggcctagtagggactggaggagacagagcagctttggagctcctcagaagcatcagcttcagagaactgtcactatttgagctgtctgatgattcctgaaaactcccactcaaagtgtttgtccttactccgtgtgaacagtctttttcctgggagaattgtcaaaacaaccagcgacaactgttaacattgccattacccgagagagtgatattaatgataattagagaaaaaaacaatctgatcaaaaaacttataaggaaaagttggagaataagatgtctccagcgttctttaaacaagtctaacttttctgggcatctaaaaaaccatatgcatgtgtgtgtgaatgtgtgtgtgggagtctctcagtcgtgtccaactctttgcgaccccatgggactacacagtccatggaatgctccagatcaaaatactggagtgggtagcctatcccttctccagcagatcttcccaacccaggaatcaaactgaagtctcctgcattgcaggcggattctttaccagctgagccaccagggaagtgtttttctttatcaagttgggatagtgattctccttaggttacgtgtatgtgctcagttgtgtccaactctttgcgacctcatggacagtagcctgccaggttcctctctccatggaattttccaggcaagaatactgaattaggttgccatttcctttatcaggggatcttcctgacccagtgattgactccacatctccagcattggcaggtggattctttataactgtgccacctaggaagcctcttagttatatatgtttcaaaaatattcttctagtctgtgccttaacttttcattttctttatggtaatttttttcttttcacagtggttcaaaatatgatgcagtaaaatacttctttatccttcccagcctgatgatataacatattcttcaaaaggttttatagacttgcttttcgtgtgtgttttcttttcagacttaattttttaagaacaggtataggtttacaaaaaattgagaggaagatacagagatttccaatataccctctgcctccacatgtgcatagcaccccagctccattattgacagcactcaccaaatggtacacttttaccaaccgtgaacttatgttgacacaccataatcacccaagtgtatagtttaccttaaggttcactcttggtggtgtacattctatgggtttgaacaaattgatgacatatatccatcattatagtgtcatgcagagtattttcactgccctaaaaatcctctgtgttctttctattcatgtccagctctcctccgatatctaagaatcatgggtatttttattgtatgcctttttgagaatgccgtatagttggaattatacagtatgtagccttctcagattggcttctttctcttagtaatatgcatttatggttcctccctatttcttcatggcttgatagttcatttgtttttcttgttcattccctaagttgtgtctgtctctttgcaaccccattggagactacagtacaccaggctttcctgtccattactgtctcccagagtttgctcagactcatgtccattgagtcattggtgatgccatccaactatctcatcctctgtcatccccttcttctcctgctctcaatctttcctagcatcagggtcttttccaatgaagtcagttctttgcatctgtggtcaaagtattggagcttcatcttcagcatcagtccttccaatgaatattcacgattgacttcctttaggattgactgttttgatctccttgctgtccaagggactctcaagagccttctccaacaccatagttcaaaagcatcaattggtcagtgcgcattctgctttatggtccaactctcacatccatacatgactactggaaaaaccatagctttgactagatggcctttgtcagcaaaggaatgtctctgctttttaagtatgctgtctaggttggtcataaattttcttccaggaagcaagcatctttttaatttcatgattgtagtcacgatcttcagtgattttggagctccccaaaataaagtctgtcactgttcctattgtttccccatctatttgccatgaagtgatggtaccagatgccatgatctttgttttttgaatactaagttttgagccaactttttcattctcctcttccactttcatcaagaggctcttggatcctcttcactttctgacatgagggtgatgtcatctgcatatctcaggttactaatgtttctcccggcaatcttgattccagcttgtgcttcatccagcccagtattttgcatgatgtgctctgcatagaagttaaataagcagggtgacaatatacagccttgaagtactcctttcccgatggaaccagtgcattgttccatgtccagttctaactgttgctccttgacctgcatatggatttctcaggaggcaggtaaagttgtctggtattcccatctcttgaagaattttccaaagtttgttgtggtccacacagtgaaaggctttagcacagtcaatgaagcagaagtagatgtttttccggcactctcttgctttttctgtgatccagcgtatattggcagtttgatctctggttcctctgccttttctaaatccagcttgtacatctggaagttcttggttcctgtactattaaagcctcgcttcgagaattttgagcattatttgcttgtgtgtgagataagtgcaactgtacagtagtgtgagcattctttggcattgcctttctttgggactggaatgaaagctgacctttttccagtcctgtagccaatgctgagttttccaaatttgcggcatattgagtgcagcatgttaacagtat

SEQ ID NO: 33227 - DNA, 1276 bp, Bovine  19866880583544
ttcttactgaaattacgtgaatatctatctatattaccattaaaataggaacagtaagaattttctgaattctgaaggggttaggtatgaagaaataaatgtgtttcaattttgtttacaaatgtataacttaccaaattgctctaagttatagatagcttataaaagatatttcccttaaatctggtaagcaaagcttttaagaaccagcaatatttcaaacaaaaagtcataaaattataattatcaccaacagttcattcagtcccagataattcttattctccttaatcttcagttagcagtttatgaattgagtttttcctttagagttttagaaattcgtactgggttcagtggtacgattgcaaagctatcagaaacctatatttatcagagtgctttgctggaatctctttgaagacaaaacaattttgaaaaaacatcagagtaaaataactctgtagatgacaaaaaaagaaaaaaaaaaaaaagcttaaaaatagtcctagaatactttgttcttttaacagatgtaagaattaaattttcatgtagaacttgaaaaacttttgggttagtttctgtatttctgagagaatctttatgtaaatgcttatttttctttaagccaattaaatagagttctcttacaaattaattttggcaatgctatctggagattaaaacacacacacaaacacacacatctgtaatgtgtatatggatgtatagaaacatatagacaagataaaaacagaaatattatagtttttgttaaaaaattttagctatgagacggaccataacacaaaattcactggtttataaaatgaacatttgaacccaaattgtatttctggtggtgataataaaagttaagattctccagtaatatgactaaagcttttgactaatctttgtggagacaactttcagaatgtttttgtttgctttttgtaaggaatcttatggggcaatttttgactcatttagtcttagtagcttctgcttaccaaccaaaacacacattccattgttttggataagtttgcaactcctgtttccctatgtgtctcattaatggataagctcatctagacttaacttctccaaagtggccacagtaattccagatttctttgctaagattaacacacttgttcagacaaacacatattctgtacctataatttttgtgcatacattgcgtgagtgtccccgatgcaaattctagaactctttggactttaccaacctgagacctcactctgga

SEQ ID NO: 33228 - DNA, 4163 bp, Bovine  19866880604647
taataaacactgctcttgcaaccgccaatctactccttgtttctatgaatatggatcacttagattccatgtacaagtgagatcattaccactatatgtccttctctgacttatttcactcagcataagccatcaaggtatatatgcacattgtcacaaatgacagaatttccttcttttataggctgaataatattacagtgtgtgtgtgtgtgtgtgtgtgtgtgtgtgtgtgtgtgtgtgtatcacatcacatcctctgtatccattcctctgctgacacattgtttccacgtctcggctatgatggataccctacaatgaacatggaagtgcaaatatctgtttgaggtattgatttcatttcctctggatagacactcagaggtgatactgttgtattatatggtagttttatttttaacttttttgaggaccctccataatgttttccacagtggctccactaatttacactcccaagaatggtacaaagagttcccttttttccacatcgcctccaatacttatctcttgtcttcctgataagagccattctaatagatgtgaggtgatatctcattgtgattttgatttacatttacctgatgattagtggtgttgagcacctcttcagttacttattagacatttgtattctttggggaagcaagtccatctggacaccagcatcttgtgcaaggccatgggaatcatgaactcctttgtcaacgacatttttgagcacatcgctggtgaggcatcacacctggcacgttacaacaagcgctcaactgtcacatccagggagatccagactgctgtgcgcttgctgctacctggggagctggccaagcacgccatgtccgagggcactaaggctgtcaccaagtataccagctccaagtaaatataatatgcctagccgctgttaacggagaaggcaatggcaccccactccagtactcttgcctggaaaatactatggacggagggcctggtaggctgtagtccatgggggtcactaagagttggagacgactgagcgacttaactttcacttcacttttctttggggaaaatgtctgtttaggtcctttcaccattatttggattttttggtgaaccgtataacttccttatatagtttgtatattaaccccttattatatatttggtttgtaaatattttctgtcatcacatagtttgccttttcattttattgtttcttttgctatgtggaaactttttagtttgatgtaatcccacttattaatttttgcttttgctacttctgcaacaacaacaaaaaatcctttttgtgtcatatacaaaaaaccatggccaacagcaatgtcaaggcgtttttacaacgttttcttctagtagttttaagtctttgattcaatgttagttaattttttttgtgagcagtgtaagatagtccaatttcatttattttttgcaaatccagttttctcaacaccatttattaaagagactgtaatttctccactggatattcttagctctcttgtcaaatattagttgactgtttgtgtgaggatttatttctgggctcttgatagtgttccatttgtctgtctgcctgtttttgccactaccatactgttttgaatactacagctctgtaatatagtttgaaatcaagaaatgtgatgctttcagctatgttcttctttctcaagattgtttggcttttgggggtcttttatggttccatacaaattttaggatttttttatttctgtgaaaagtatcattagaattttgatggagattacattgaatctatagatgattttgggtagtgtgatcattttagcaatattaattcttccaatccataaacacgggatatctttccatttgtgtcttcttcaatttctttcatcactgtcttatagttttcagcatacagatcttccaccaattttaatttattcctaagtattttcttgtttttgatgctatacatttgggatagttttcattatttctttttcagacagtttgttgttactgtatagaaagacagttgatttttgtatggtttctttcatttggcataatgttttaaggctcattcttgttgtggtatgtatcaatatttcattcctttttatgaccaaataacattccagtgtatggatatgccacattttatttacctattcatcagttgacgaatatttgggtgatttccaccttttggctattatcagtaatgctggtataaacattcataaacagtgttctgagtgggcatggattttcatttctcttgggtatatatatccaggagtagagttgctgggtcatgtggtaactctgtgcttactcttttaaggaactgccagactgttttacaaaatggctacatactattttgcatttctaccagcagcatatgagtgttccaattttgctgcatcctcaccatcacttgttattacctggcttatttattctagccatgttagtaggtgtaaaatggtatttcactgtgtctttgatgtacatttcccagatggttaatgatatccagcaccttctcttgtgtttaatggtcatttatatttcttctttggagaggtgtctattcagattctttgctcagtttttaattgggttatttgtctttttattcctgagttttaagagttttttaatctattctagatacaagcctctatcagatatatttgctaatgtgtatagtatcttatttggcatgttttagtaattctccacatgatcagtcttcttttagacacatttcctacattcaatttaacttcatgcatgctttgtagttaaatccttcaaattaaatgcactggatacacattcagtatgatgccttcatcaacatttctattagattcataagactatgtacaccaacatatggagggactgtattgtagcagttctattaggggaagggagagctctagaggtagagtctgggttctaacactggctccaccatgtactagctatggtacttaggatgttacttcacctcactaaggtttagtttcctcatctgtaaaatgaggctaataacatacactatgtaatgatggattactgatgaaactaggctaatgtagtaacaacttgaccataatttaagacaaaaatagtgatagctattatgtatattattgttgtgtttactctgttccaagtaatctaaagattctaggtatatgatttaattctcagaattatatgaagttgatattataataaatattttccttttcttaatatgtatacactattaaatattattattatatagtcataaaacaccacactcaataactactgcctacctaaatataattattggattagaatatttgtaagacatatttacattttatttctcaaaatcttggtttgtttacctagccttatggattcattatttaaacatagtataacttaaaggaatacttcatttgtttaataaagaatattggcaaagtttgttttggcttcttattaaattctttagtaaacattcacatattttatttgaatggatttttgtactcttttcctcaaacatgctttagtgatttatattcactcatcacattaatgaaagaaatgctgaatgattaatttaaatgtttattttaaaaggtgaccagaggaaaatattttaggagatagaaattttggaacagcacatatttaaagacaaagaaggaaaaagttttgtgatatgtggtattaaattccactgtccctgaaaacagtcatcaagccttttatatttgctcaatttataatttatagatggcactccagtgccaattataaaaacatattttggagggttgctgaaagtttgtagaggcagcttttattgttaacagatacatttatgtacaggcttttctgacctttgataaacagtgtatatgctcagatgcaacattatttatctgagcacttaacatagaggtgaatgctatacttcatttattactaagaacaatgcacagaggcaggttttattacaactatttatacagaataggaaacagaagtttgaagacattgcatgtcttaacaaaagttcttcagcttcaaacagttaaggaagatgtattctatt

SEQ ID NO: 33229 - DNA, 1216 bp, Bovine  19866880701029
tccctaaatgatttttaaggagcaaaattttgttaactttaatggcaaaggagtcagggactaaagtcgatgaaagggtgccaagacagtgtgatgcagacaatttccagacaaagactgtggactccctgctcacagctgtgcactgcatcctagcctcaagccagtccacttaacacactgaagtgtgatatttacaaacatgaaacttcagctaagtataacaaaaaagtacaagtctgcaaaatttcttctacatccaaagaatctttggaaagtccaaccccctgtgactcatttgtcctaccccataagtaacattattttgaaatcatttttagcatgaagaaggattttctccaagttgaaatgagaccatgagagaatgaaagttaaaaaaaaaaaaaaaaaatgaggcaggaaatgtttactccatgttcagaacatatagaaatgcttagagagaccatggataccttcaaagaaaaggaacggaatacaattcaccaagactctttcctccttcttagtacagtccaagaaacagcccattatggagagctctgactctgattttcaatttgtgtcatgatgttggggagagtcaatgccaagattttttcactctttagatctttgcagagttgtttgcagttggatagatagaagtgtttgtgacattaaaaggcagcgatctgtcctggactacagcttatggcaagtgactggtctgaattgccttctactcaggcaagcaaaagggaaagttgaaaaagaagttcgaggattaagtttccatgtgtgtctccattcacaacagatggcctccacacggacaagctttacacatttgttgatctccagatgggcaaataaaatgctatttttgatctcattgtaaactgaggtgggggattcttacaatctttcagtgcaaccaaataaggaaaatgaatttttctccaggcagagattttaagctaaaagaatataccgtaaggctatattaggattctctgtataaatgtatgagtttttatggaagcttaaggtttaattcattgtaagctttaaagaaaaaaacatatgaaaaactgtctaacatttttgataggtcatacctacgacatattcaagaaaataaattagtgttttgggggtaaataaaaaaaattgggtaaaccctatgagattcaacacatattgggaattactc

SEQ ID NO: 33230 - DNA, 839 bp, Bovine  19866880735510
cccatgctcttaaccactttaattctccccataaaaaatgcacagactagtcaaattattacttccttccattgccattacctgttaaatggatgcagaaatatatatttttttaattttatttttaaactttacatagttgtattagttttgccaaatatcaaaatgaatccgccacgggtatacatgtgttccccatcctgaaccctcctccctcctccctccccacaccgtccctctgggtcgtcccagtgcaacagccccaagcatccagtatcgtgcatcgaacctggactggcatctagtttcatacatgatattttacatgtttcaatgccattctcccaaatcttcccaccctctccctctcccacagagtccatatttttaaaggccttatttttataatcaaagaatctcaagacaaactaaatttgtgctgaagagccatacctgctgatatccttgaagaagcatctcttgttcttgtatttctttttggatttgcttcaatttttcttcagtgacaggatcagtggtttctcccaaatgtaaccacctgtgttttttgtttgattcttcaaaactactcaactttgagaaaatgcaggtattgtttcatttggggaagaaaatgatacagtgagaagtgaggaagaacatcagaaaactccaggtgtatagacctaagactgtcttataagcacactagaattatcgtaacaccaactacaattaagtcactacagggatgctttgtactgatggttctgacggtggaagtaactcagaaatgctacacagggtcactttcctgaatctagaacttctatagcttt

SEQ ID NO: 33231 - DNA, 1842 bp, Bovine  19866880811215
agaatgcctacagttgggaattttgatctaaatgcaaatgggtcattaggtctgcctccatgcaagctgaccaccttgggtcattaggtctgtggcactggccaacaactgcttggtgtgtcttcctggctgtgctgtcagatgtgtgtgtgtgtgtgtgtgtgtgtgcgcgtgcgcacgtgcatgtggatgctcattttttagggtttataggcatcttttggatccctcctttatgtgctagtcctgtgtctgaattggtggtcacttggaaaactcaactgctcatgtctaccccttaacatggaaataaaggtccagtcccaaggaaacagctcccttatcacatgcacccatcatgacccaccacaagatgttgatgaagagtttttaattcactccatgggagcatccgtgttcatatgtgaaagtgaaagtgctagtctcttagtcatgcctgactctttgcaaccccttggactataacccaccggacttctctctccatgggattttcccagcaagaatactggagtgggtagccattcccttctccagggtaccttcctgacccaagggttgaagccaggtctcctgcattgcaggaagattctttattgcctgagccaccggggaagcccccatgttcatatacatcttcccaagttcagggaggtggagagaattatttgacctgatttaagaaggtaagaggatatccaggagtggtatgggaacctgggttggagaaagaaagatcagataattggaagaagacatgaaagtgttgggcatgtggatgggagaaggggcaatgttcagatagttctgagaggttcctggggcctgctaattgccctctccccactccttataaactggcctaaagtactcagtgcacacctggaaaaggcaagtttatttttcaggtggggctttgaggtgaggttatcatttttcattattgctgctggcaaggatgcattcagctactcaaaagagcaattagtctctctatacagcaccaataggcttgtttgagatatgtttcctctggaagaagtttattttactgattctaatattacaaagaaatctgacattaagagactctcaggagggagtatgtaggagcagctggggggcagagggcagccacacaccgagctctgtgtttcctgtttgctgtgctctgaagagagcagctaagtccagcacccccgtaaacaagcctcagcgcccccatctctccctcagtgtgtgttaaagcccagacattcctcactgtggtgacaatatactctggggactgctacccagacttgttggcagcttccagatggtgaagcagcaccagcttccgtgtctgcaaagcttagaaaggcaacccggggtttcaacagcagacatgcaacgtcctgccttctgtttgttgtttgtcctgttcgtgtgatggcccaggctggctaatttgacacttgcaagaaaagcactgcctcatggactttttcaagggtgtgaggtagaagcagaagccagaggttctgtcctccaaatctgtcttgatgattcaagaaccgagaggaaatagccagtgaaaacacaggatgctcctttcatcggaaggactccacactgctctgggatggagatggtgtggcctgcatcccattttgctcccccagagaacctcctatttccaggcatttgtcaggcatcctgtcttaaaggactacctttccactctcaggaccttgtcacctatgactttcatcacccctttggtctccatccatccctaactagttaatttagatgaatagggataatgtaagggagaga

SEQ ID NO: 33232 - DNA, 1103 bp, Bovine  19866880817885
gtttaatgaggatgagtacttgccccaaggtcccagtgatggaatgggacatccagaccaactcagctgaccttagaggagtttgtttccacttgttttgagtagagtcagtatataattggactgaaagagggcataggcttctgtttgattcaatttcctcataaatgatatgatcatgtgttataattatgaataatttactcagttatgataaataaagtgatttcatagagactcaggtgtttgaacaagactttggatgtaaaatatgagcccgagatggaatttcctgattgaaatattttgataaaatgtgtttttctgacatgtaagagacccatttctaaaaccaaggcttcttaaaggggtcctatttctgtttactgtgtcatgggagatgtggagaggtgggtgttggtagcgtcaggtagaagcttttgtgggtttctcttctttttctccttaaggaaaagaactaaaatgctgaaataaattagtggaacattaagtttggaagttttaaatatatacggtctcagaaaatacacacctaaagcatcattttcttcatgtatgaagaaaacaggtgccgttgcactttcagagcacatttatatcccccattgtacaactgcattggtggcaaacccactgtgtatcttttgaaatgaatatatcccggtgtactcaagagtctgtttagtacatcctacagattgccttggaatttgtccctgaagttgtaaacataggagagcagactagtaatcattctatcaaagggtttgaaatgtataagcacagaatactgcctactttttcttattcccaattacattttttatacctcaccctccatatagtaagcatgatttaagaccagggactgtgctaactatgggccactatattggtttctaaggataaaaagataacatctggtatctgccaattttaacagggctgctgctgctactgctgctaagtcacttcagtcatgtccggccctgtgtgaccccatagatggcagcccaccaggctcccccatccctgggattctccaggcaagaacactggagtgggttgccatttccttcctc

SEQ ID NO: 33233 - DNA, 1531 bp, Bovine  19866880882091
ttttggtaattctcacaatattttaaacttttccattaccattatacctgttattgtgatcagtgatctttgatgttactattgcaaaaagattatttgactcactgaagacacagatgatggctaccatggggaagcaataaagtattttcgataaagatatgtatatattttttaagataaatgctatgcacacttaacagaggagttacagggtaaacctgacttttatatgcactgtgaaaacaaacaattcctgtgactcatttgactgcattattcaatattgaggctttattgcagtggtctgaaactgaacccacaatatctctgaggtttgtctgtacattgaatatgcttaaagaaactcacaaaggataccaaagaaattcacaggagtgcctcctgctagggtgtttgagagtaggaaggcggaagtaggtgcatatgggacagaggtaagagacagacttttcattgtatgaccttttagtgtttattttatttctgaaagatattaaagtaatacacatttaatgaattaagtaaatgaattgaatttaagaggaaaaataatgacatcatccagaaaaaaggaaactgttcattctatgaaatcaaatgccatggattgaataaaagtgcactggaaggataccaggggcttcccttgtgactcagttggtagagtctgcctgcagtgtgagaaactcagctggactcagttggtaaaatctgcctgcagtgtgggagactcagcttcaatccctgtgtcaggaagaccccctggaaaaggaaatggcaacccagtccagtattcttgcctggagaattccatggacagaggaggcttgtgggctacagtccatggggaaggatatcaaggtcagcgtcataaagttttctgttctttttatttcaagctgccttaaatcaattttggaactagagaacaaacaaagaactgtgtatgtttatgctaatttgtattgatcagtcttgatttatctagataaaccaacaatttcttaaagttgggaagtgggtgtcacttcagaattatgcagagactcatagaaggcctacttgtgccctctcttagatgttcatgggggatctggtgagagacgggtaggaggcattctgtcattccatacaacgagaaaagaatcaataggatggataaacaacaaggtcctattgtagagcacaggtaactatattcagtgttgttgtcattgttaatgttgtttaattgctaagttgtgtccaactctttgtgaccccaaggaccacagcatgccaggctcctctgtcttccactatctcctggagtttgctcaaattcatgtccattgagtcagtaatgccatccaaccatctcattctctgttgctcccttctcctttggccttcagttttttccagcatcagtgtcttttccaatgaatcagttcttcacatcaggtagccaaagtattggagcttcagctccaacaacagtccttccaataatattcaggataatttc

SEQ ID NO: 33234 - DNA, 1944 bp, Bovine  19866880965659
acttcacttgcacttttcactttcatgcattggagaaggaaatagcaacccactccaatgttcttgcctggagaatcccaggaacggtggggcctggtggactgccgtctaaggggttgcacagaatcggacatgactgaagcgacttagcagcacttgtcatgctcagaagttactgatttacttcattagctcatcagagctctccttccattaggacataagccccgtgaaagcaggcttctggcttgtcttgtttgctctctgtctccagcacagtgccctaaaatgaactcccatcatgcttccctcttgaggtctgtgtttcaagtgtaagtttcttaacatggtctttccttattggtaggttgagaagctgaaagctgaatctggaaatccatccatccagcagaagatacgtttaaaagaaaaagcagctgataccaaaagaattcaggatctagagcgacaggtatgtgttcagggtaaattttcattaagatattttatatacagtgcatttttgttttttgttttagaagtttctatacaatgtaatcaacttgcaagtttttgctcttactcattttaatatagaactgcctctgctttcaactttgaatatagtattcaaagtaacaataaaagcaggaaagaaagtcattttatataatctgcggttctgtgaataaagaaatttttaaagtcatgtgtctcattaggtggtagacctactgatgaaaggttgtttgcatcacaactctgtttgacatccaggaagaaagaaacagaactctgacacttgggatgtagagctaggatactttctcctgaagaaggataggtgagagaggagggcggggtaggagaccctccagttgggagtgtgttagtagcgcttgagaagtcttgtgggatgctctggaaaccgaacatccagcctcccagagagctggccacagtttggagctctcgctcacactatttgtgtgtgtgcacactcagttgtgtccagctctttgcaaccctgtggactatagtccgccacgctcctctgtcactgtttagacttagaaataaaatactcatgtcatggtcagtgtggctgggagacttttttcaaaaactgtatagtgacacttattaggataaagttttttctttttcattgtagtagttattttgtaagcaggaatactaattaactttttccttatgtttttaaaaccttctgtaatgtagtgtttgtattcataactaagtattaaaacaaaattagaacttcagccctgttcataagggcacatgatgccgtagttgtgacacttagatatacagctattattccatcacagacctgaaactgtgaggtcatcactgggctgaatattatccccattttagaagaagaaggaaaactgggcaaaaaattaactttgttaattttacaggacctgttagattaaaaggtatgatttggtagtttggttcagtggccacaaaagaaggaaagaggtgatttgaagagctagaaatattctgaaataactatggtccaggattgtttgacttttttccccccagcttaagacttaggttagcccacgtagaagaagccatccagaattgtgagaagagaccaaaggaaccacttccccagtagatgacttaattttaagagaatactgtggaaccaaacatgtaagagtaaaaaataaaacatgcttaaagacaaaattaaggtttgaaatggtgacccacattgaccaggaatacaatgtttataaaagtagcctccctcttttactagcactttcattaaaaatttaatggtttattggattagagctttctaaaatattattcattaatttttgtatagtttgctacacatgcatttcaaatcctactctcttctcaggagcagatgtttctatcctaatg

SEQ ID NO: 33235 - DNA, 744 bp, Bovine  19866880994385
gtccattttgaggttccaggtaggcatgaatatggagggcacactgttgtaccttctacaaggagataaagtttctgagagcctcatacctgtcctcattctcaggtactacgtgattttaaaaatgaatgaaatgagcaaataggctaaattgaaattttggtgtcttgaagacaagaaagaaagagagagagcttggagatattatgcttctatccaaaatcctgatttcagagcttcccaggtggctttagtggtaaagaacctgcctgccaatgcaaaagacatgaggggtgcaggtttgatcccttggtcaggaagatctcctggaggaggatatggcaactcacttcagtattcttgcctggagaatcccatagacagacaagcctagtgggctacagtccacagggtctcaaagagccggacacaactgaggtgacttaacacccatgcactataatttttattagtatagatggtacagtttcagtgaggaacttggtgctcagtgcggcagcttgcaatgaggtgctcaccattctattggaaagtcactagatactcagtcccagcacatgaagaaggatcagaatgaaatgaaggaatggtaatactgaacatatggaagcaatgcagtgattctattaagaatgacagataaatgccagggggattgcaaatccatcacccagtttttcagtgatatataaagaacagagactctaaaacactgatcatttt

SEQ ID NO: 33236 - DNA, 1414 bp, Bovine  19866881036716
atgctgcagtccatggggtcgcaaagagtcagacacaactttaacaattgaaacacaccaattccactcacatggcttggtctgatagatgaagaacaacccccagtgaaatttcttaacatattcttaaaggacaggaaagatgatgtgggttgggagacagtttcgaggttaacaagagatataccagtaaaagggttgctgaacaaggaaaaggaccaatgtgggacattgaagaaatggaaggaactgggctctgctaagaattgtgacagggaggctaatgatcttgaacatgatctctgatggaaagcactgccaggcatgctaagtagagaagaggaagtacagcctagtgctattatttttaggaatgttgaaatataaatggacttgaatatcagcaaatcatcagctgatctcaaacatgagaaagggtcctagaaatctgaatgctgcctcatttgctacacataatatgaaattcccaccaggtccttggtttaaggtttccaaaccatcctagccacccagtttttaggtctgtatttagataaatagtttgggataaaagaagataagcatcacttcttaagtagaatatttttgctcattctctaaaatggtattttttctggctactaaaataaaataacttcattttcaaatatttgaaaaatacagaaaaagcttaaagaagaaaataaaatcatctataatgccatcactcagagacaaccactattaacattttgatgcatgtacttagtctttttctctacacaaggatgtgaatttctaattaccaaaatgtagtggtacctcacatactatattctaacccacttctcccctttaatttactgcaaacattttccaaatcattaactgtttttcatggacagaggagctaggcaggctacagtccagcacaagaacacaactatttttctaaaataattcttagtggttgctccagatataattatgtgtatataccacaatccattcatctaattccctatgattcaatattattataagttttcaactttttgctatcactaagagcacaactttctttcaaaatagtgaagaagaaattggtttcccattaccactatgttttttttgtcagaatgatacacaaattcaaatcatcttggatttcccagcctttggaactgggagaagtaaatctttgttgtataagccatgtagccaacggtatccttttctgtataagatgcacttatttatttttggctgtgctagaaggcaatggcaacccactccagtactctcgcttggagaattccatggacggaggagcctggtgggcccgcagttcatagggtcgctgagttggacacgactgagcgacctcactttcacttttcactttcatgcattg

SEQ ID NO: 33237 - DNA, 1657 bp, Bovine  19866881181358
cagactgctttttgctacctgttagggttgatctgtgacatcggtgaatttcttgctccttccccagtagacgatcatcaccttgtgctccagcaggcctaaaatgtaaatgaacttgtcttggttctcctgctctagccgcaagtcttagagcaggtactatgcacctggaccacctatgggcctttctcaaatcctccctgttcacactttttcatgatcatctcatgaggtacaggatcatgaaaaaagaattgagtgggtgcagagtccccttgtgtctgggcctcttggagttttaaattggcatacttggccctaaaagagttggttaaaattcagtttttatagcaacatttcttttctttctttttttttttttctattttggtcatgctgcacaacacgtgggaccttagttccccaaccagaaatcgaacccacaccctctgccgtggaagtgcagtgtcttaaccactggaccaccagggaagtcctggcatcatctctctttgctgtggtctgtcaaaggtgatgagaagtggttcgtgtgtcccatttcctcaaagggccttgtcatcctgtggaatttagagtcctaaccactgcaccaccagggaagcccacagcattacatcttaattaatctttgcagctcgcttgttttggaaaataggaaataactcaaagcataagaacatagttggccttttttttagtagcagggcagttcagagctggggtaactctcattggtagccctaaggcacagacagggaaattatcacatggaataggaaagagggggttggaaaactgatcctttagagataggatgccttgcttaatgctgttgtgtgttgtaaatcagtttaagaatagtaaaggtaactgttgttaataatgtttggtcattattctttctaggaaaagtttgtggattttttcccccaaatactcgagtgtaactgactcctcagactgctggttaatttttaatgcttttacacatcaatttccttttagttaaatgtcaggactatttttcctagtactaataatgtcacataataatgtcacattagatgacctttgataactttgcagttgaccttctgaagtgctggagacctttattatgctccatttcagttttcctgggcaaactaaggcatccagaccagattattttagcccttttcctaactgggctggccatcattgaagttgtttggtgcagtttgaatttctaagttatattcaggacagttgctacctgattctcatgtctctgaggtagtgctggtctcatttctagtctcctcgcccccctccttaaaaattgtgcagcagaacttgacagtaagtacttaagatactatttttttttttttttttacaaaatgtgtgtttatttatgtattttggctatgctgggttttcgtcatggcacgtaggcttctctagttgaagtgcacaggcttaattgccctgcggcacatgggatcttagttccccaaccagggattgaaccccaaatctcctgcattggaaggtggattcttaaccactggaccatcagggaagtcccaatataataattttaattgtagaggctttggtcaaatgttctgccccttcatggtgacagtaatgg

SEQ ID NO: 33238 - DNA, 2143 bp, Bovine  19866881205887
gatggcttcctgcagggcgcttccccgctggcatccccaggaggctccccgaaggggtccccggcgcccacccttgcccggcccgggaccccgctgccctcgccgcaggccccgcgggtggatctgcaaggagctgagctctggaagcgctttcacgagatcggcacggagatgatcatcaccaaggcgggcaggtaaagggcaagctggcgcgaacggcccgggccctggcctcactccacgccttggtgggtgagggaaaaggatctgcagcacgatggggtctctggttagcagtttgtacagataagactaggccctcggtagtggttcacttttgagaccgactttgcctacctaacctggagtgcagtcggcgcggggagtcctctcgttggatgctgcggagaaatcactgtggccgccgaggcggtgacggtgactactgatattccgtgggcaggggtgttaaagattcgtgatccgacttagcatctgttcatgtatttagttagactttcgttatgtttctgaaactgtggaacagattatccaccaccacactaccccttttttaaaaaacgcagtttactctttagccaaactgtcgtttgcttttatagattcgaaacttccaattgcttctttatccacagattcgctggcagtatgagtatgtgctgtgttatgctctcttgatattagattaggatgaaaattactagaatcatctgtaaaccatgtttaatccctgcaaaaacaattgctctgatttttaaaaaccattctttttatagattcacagttactatagttttttccccttagtgaaatccaacaaattagcctaaatttgctgaggaataccaaaacaaaatttgtaagttttatctattttttgaaagtgtgaaatttccacatccatcagttagtaaaataaatggatttgttgcacagatcatgttaattcgaaggcgcacagcaatatttccgtttttaagttttcagttcatttagtgcagtgaaatctatgactactatcttcttcaaaagaaacttttaacacacacacacaactctttcagggagtacacatggcaaaaacctggatagtataaaagtatccaaactagttagaaattacaaaaacatattttattgaatccatatgctaccttctacattttcacagagcttttattaatgatccaaattcagtcttcaacaacacaaagcaacagttgtcttataaaggttgtagttaaacacctttactctttatcttacaggtgcactgagaaaaacacttaaacagccagtgtattaaactgttctcatgcctagttaggaataatggactttcttttctctggaagtggtctttaatggcattattgttatgaaaacatttttggtaaataacagtactaaaatttgtgttataaggttaaattagcaaaaattagattacctggaagggtcctagacataaatcagtagatgaaagttttttgtttttttcttgaagagggaactgctcatacacacacacacacacacacacacacacacacacacacacacacacacacatatatatatacacaataatttgctgttgtattccttgctactgtgctttttaaaaagatagatgcatttactttagtatctcctttgataagcatctctgggaagctaaaagaaatgtgggtttcatttgttttaattagcaaagttgtgagtaagtgtggttaaagtattttcagggcatggtgggggaaggaatgatttggtaaatatacattgtgtttagtttctgctttcaataaagaagttttactatacctttcaaatttagagcaacttttgcacttcacctttaccatgcggcagacaggaagtcctgtctcaataaagaacatattgtttggttatggcatggcacattggctccttgtgcttttttataacccttttaaaatttcacattatagtatattttatcactttgagaaaatcaaattttctatttctactatttggaaccatttattatttgttttgttaaagtcagcctgcttactgatttttgtttaaaaaataaagtgctttctgtaccattatttcttcagaatatata

SEQ ID NO: 33239 - DNA, 1957 bp, Bovine  19866881209314
ctagatgacaatgcccccaccctggttgtagcaaccaaaagtatctccagatgttgttatttgcccctgggagagagggagcaaacctgaccctcactgagaacttctgagttagacaaatctgtgtctggagtcttttagatgagtggccaggcactggcctttagcttaagcaacagtgttctgagccatgggaatggtggtcagaatgcttgactgttaggaaaagagacagaggctgtgagctacataggatggggccacttatgagacaagcaaacacacagtccacaaactgtttcacttacccttgtgacccccatgaaaatgaatagttggccccagagtttaaacctttaggtcataataaacccatgaatttaattattacacattacatctctatagagctacaggttttgtttttgtttttagttgctcagttgtgtctgactcttcacaaccccgtgggctgtagcccagcaggctcctctgtccctaggatttcccaggcaagaataatgcagtgggttactattcctttctctaggagatcttcccaacccagggatcgaacctgagcctcctgtgtctcctgcattgttaagtgggttctttacctctgagccaccagggaagcctcagtttgcatcaaatccagggcttctattgctcggccttcttacaaaaacaaagggttaaatagtgacaggtggcatatattataccataaaaatatctagtcaaatcccgtaaacaaagaaagatgatctccttctctataataaagtcttctctggtgtctcagatggtaaataatctgcctgcaatgcaggagacctgagttcaatccctgggttgggaagatcctctggagaagattatggcaccccactccttgcctggagatttccatggataggggagcctggtgagcaatagtccatgggatcgcagagttcgacacgactgaacaacttacacttttcactttttttccccatgatacagggagaaattccagtacatgttggctaaaacgactccagggttgtgggctacatggagttcatactggatatttatcagtgggactacagcagccagtttgtgccaggaataaataaaataatctttaattctctctcctatatcatccagaatttggatctagttggaaggaaaggaatgattttctccactgtgacaatgctttaaccaacttcttgaactcatttagctgccactgccactgatcctattgttttgttttttacatcatcagagtttgatcaaagggttcagaaaaattagaaatataaagagcagagcatgctgtgcgtcagctgctagtagagaacagattaaacaaacgccagggtttatcacagtcctgggactacccaagccagcagtttcaaacacagcagacccttaaataatttcaaattctttttctattatcctttacaaaaataaagctggatacacactagattcataagcattctctgacacacagaatgatcaagggaagaacacatagcaagcaaaataagatgctatttctcaaaattaaatgttcaataaatataaacaacaaataagaaatgaacttcctcatgagttctgaaatgattctgcttgtgtcatactcttctatgataatcaagcagtggtatgccatctcatttgtagaagtctttgaaacaatttttatactactcatgcacgtcctttttttttcttttgaaaacacaatacaaagaagaaactagaaaccattgataaccttcacctataatacattgagttcagttcagtcacttagtcgtgtttgactctttgtgaccgcatggagtacagcacgccaggttttcctgtctatcaccaactcctggagcttacgcaagcttgtgtccatggagttaatgatgtcatccaaccatctcatctt

SEQ ID NO: 33240 - DNA, 1843 bp, Bovine  19866881250330
actcacttcctatactttctgggtttctttaaggaagaccacagaactaatgatgaaaaacctcctgaactcaatagaactgaatctttcagaaatggaatgtaataccttacaattcattttttttctattaataaggaaagttcatagaaggagaaaggaaacaaagaaagcagagaacaaggaaaataatatactagatgtatagaatgattaccttttttcctactttgatttgaggcaagaatagatctcaagtttttgctcttcatgatgtccttagaagttttcttttcaacattagaaaatgtcttgaatggtgaactgggtttgccataccctgaactcctaactgatgcatataatccactctggggttttcttttaaataaaggaggtgcacttttggtcttcttgtatggtagctgtttaccagttacagtcccttcttctccagaatcgagttgagatcttaaagtctgcatacaagtacaaactctttagtacttaaataaacttcaactacagttgcaaataagattaacaggtagcaaaatcatagtgataactaaagaacataattcatagaaggcaaaccattatattaaagttctctaaattcatcagaattttaatatttggaaccaacattttcaaaatcaagagtaagacaaagcaaaataataaaacaaaataagcttgccagaaagcaatgaatgaacatggaagaaaacagagaacaagtgttgaaatgacaagaatcttatctttcttctccagatctctcaacgtaaaaatgtagtagtaccctgccttattctacaaggtgatagtttatggtaaacacataactcagaactgtaaaataaaaacggaatgctgtggtcatggtctgattatatataatcagaataaatcaagaacagagaaaaaaggaacagtgaaatgtaagtttctcaagagctgtgaacagcatgtatatgaaatgccaactcacctcttttgtagaacagagactactagacgactgtaaagcactaaaatgatgaatacatgtaattttcttctgctactcaaactctagactatgttcactaaaaaaatgaaaatgtaaagaatggcttctgaaagagagctaatgctacagtggtatttttaaatttggggaccacagagtgttataatagatacttctcacagatgtccaggatttatgtggacatcagtatgtaatcgatcccactagcttaggaaatacatacttctcaacagtatttacgtaacttcatttatcagaatgtcaaatcaatgcaaattataaaaacttaccttatttgttttgtcatcctgaggtaataatgaaggaccaacagatatttttttcttcaaaatatcaaggtacattttatctatttgttcttccacagcatttgctcttggatagttattttctgtaacttcatttgttgccttttctaaaactacattctcttcatttttgtccaacaattggctcacagtttgtggttcttgagacacaacgtttgggttaatcttaaggggtaaagggctaacaaattcagtttctttattctcagcgagtttcttatagctataaaacaaaacaggacacagagaatgaaccctatataagtcctcaaatatcagttttaataatatgtgtatacacattatatataaacatatttacattaatatataacgttaaatatatttaatatttgtaaatgtttaaattaggttattaatgttaaagacattatttacaattctggttaagacagtaaacttatacagcatcacataattgttttaaaatgat

SEQ ID NO: 33241 - DNA, 1814 bp, Bovine  19866881278983
tttctgactcttaatagacaatttcttagtcctatcacacacacaccacaccacacaaatactcactcataatcttcatctttgagaagaaaaaaataattggaagtgcccaagttacaaatggtagactggttatattcatacaatttaatctatcaactgttacacctggattaaaggtaaaaaatgaagtagtttctctgctctgattatgttctttgctatatttaaatcttctgtgtaagtaaactctagatttgacgtgagaagttattgcattaaaagtcttcaactcacacgcttagtttcaaacttaaattttttaactaggaaaaatggaagaagccagcatgctaatatcataaaaactgataattttggtaatacacattgaaaatctaggaaccacataatagagtaaacatttaaacttactgacagtaagttaaatcataatattttgatgatgtaaatattcagctttgctagtgcagaaaataacctatagtttttatcatgagttagggaagagaaaggacaaagaagaaatgaatctgtgctaattcaggcaaataaacagaaaaaatcccctaaactgagtcattttccaaagcagaaaatctaattcactgaaaaatacaagcgtggctccaatttcacacaagaaagctaaaacaaactatggtggctcacgactcaagccgaaatttatagcagggaggagagagttcatggaaagcctcaggaaattatagggaagaatacttgagcaatgttcattctaactatttctaaatacaggtcaactttgtttctcagtatcatttatttctaggacttagcttttatctggtttgctatgatttttcaatcactcagtcagtcagttcagtccctcagtcgtgtccgactctttgcaaccccatgaatcgcagcacgccaggcctccctgtccatcaccaactcccggagttcactcagattcacgtccatcgagtcagtgacgccatccagccatctcatcctctgttgtccccttctcctcctgccccccaatccctcccagcatcagagtctagacagccagataatttcagggcaacagattttaccttaataatatcttatttcattttcatggtcttttacctgttctcttctgatgtgctgcatctgctattattcctctctcttctgcctaccttataccatgcaattgagacctcctgctcttggaaaatgaatctatttgacctttcccacatatggcttacattttctttctctgccacctgcaaaaggtctggcacaataagtacccagtaatgatatctggaaagtccttcatgactttcttttttaagtcactttcaaaacattgcttgaaattcaccttcattcatggggagttgttcaaggtcagattgatctgtatctgatcacttaaggttaccttagaatatattcaagtttgcactaaataacttcctcttattggcctatgtcttgatataagtattctttaaccccatgtttatgtatgttctttcttccacctaggaaaataattctgatgtcatttatttgttacataccacaatacctaaaatagcattccacacacaataagtactcaaaatgcagctacctgatacttttctgaaaattaaaatattatctacaaatatatttttatagttttaaatatttaaagatggtaaactgaatatatgcagttagtgtcttctaacccttccctaaaataaaagcaaagatggtgtgtgaacgtgtgtgtgtatgtgtgagtgagtgag

SEQ ID NO: 33242 - DNA, 1007 bp, Bovine  19866881282620
tttgaaccaaacacaccaatcaggcagcactgagaaaaggcaaagtagagagtaatcatcaagtgtttgtgactgactcctccattttactctgttggaattaaaggtaaaaagcccttaatttgggaacattataaatgccatgaaaccaacaactaacacagtaattgctttgacttccaaaatttcccccaacatttcaccctgaaaaatatcaagcatatagcaaagttaaaagaattttatggtcagcatcacctggattatatcattaacatttgctctctcatataactatccattggtccaaccgtcaatctacctgtcaatttatcttatttttatgcatttgaaagtaaattatagatattagttcataacctcctaaatatttcagcatgcatatctttagctggggatttacataaatccccatttacataacagggcacataaaccatgagatatttatatcaaagcatcccctccccatgaagataatttgtttcatagtaagtgtccaggtagcatattttccccaggcatttcagtaaataaccaaaatagaagacagaaatgttagtactcaggaaggagatggcaaacaatgggaggagatgaaacaagagccggtggaaaccagcaaagaactggaaaagaaaaaccatagaaataaggcaaatttggaggaaacgcaaatcaaatggacactgtaacaaaaaaaaaattctttgaaagttgaaaagaattggaaagaaaatgataaagaaacaggcaaaggaaatccaacagatagttgaaattaccaaagagagaaaaactacttaagtagtacgagaatgagagggacagaaacatactggtaaatatgatacaacccctgcaatatagagacatcgtataataattagtatatgtctagcagtataaatgtgatttaactattacacagtgaaatgggaagatgggcaaaaaaagtgggaagaaaaatccaatgatctgtaata

SEQ ID NO: 33243 - DNA, 1501 bp, Bovine  19866881285901
acttatgattaccttgcttgggaattccgggatatcttcaaaggtgagggtccgtagtgaaggtctccagaatgcatatgactccacaagagcttccaaacccattctaaatggaagggtcaggacaggggacgaacacaagaagccaagttaggagcagttggagttttcactcgtaataagctgctcaggaaacaccactggagttgacagtgcctccctcattggcaggttaaaagcttggcacacacacacaccaaaaaaatggtctggagatgagctactattctgtcaccaagagcacagaggatagaaaccaccagcaggtcctgttaatattctctgaaaaatgagctgatctcaggggatacaaaagctggcccctgcgctaggaagacgacgtgaagcccatccatcctggccgccctgagtccaaggctctgtgtgatctggaagcaccctttttccctgacacatcactacccctctgatgaggagggctctgccacaaaagtgtgctcctgcaaagaggcatttctacccatcgttcagtgccttgactgccagccaagaagagcagtcatccaaggaaaattcacttctctctctgaggcatgatcaccacacccaggacagccagggagagctcagggcagcagccctgaattctcaacccagcctccaggaggaccacaacaaggttatctcatagggggctaaggtacacagacctagtattagcatcagacattatggtaaagcctctacatacacttaataaatggacacaaagagataggataacttcataatggactatccacataatatctataaattttaaaacatggctgactactctaaatacacacaaaaatgtatgtgtctcctaccgtaagtgattcagagtcttccttattgtatatcagataattaagtcctccaggtcctagaaatgagttccttcactcaactagcaccttctcaaggcctttccacttttccctcaaccatttgagccctaatcaatctgttaattcaggtaacattacgctttccatgaaacgcacagctttgctgaagaaaatgcctgattcctgagtgtcacactatacaaggccacctttttgagattgtcagatacagttttagtgaatgcagataatctgtgtttaatgcaaatttaaagacagtgagtatgattaacagcttagactccatgtgatagctgctgtagattccctgcatctccaagtcataacctatgaactaggactagagaaacacccccttcagagtcacacctcctatacaacatggtgaaaactcctgggagacccagagtaagtgacctgtgcatacagataaaaccatcttcccttacttgccctgggctgcactgagcatgaagaacagagtctggctttggatggaatcattgtgccccagagagaggactagttagttctcaggacactggattggggtcaggacaattgga

SEQ ID NO: 33244 - DNA, 1385 bp, Bovine  19866881297561
ccccgcgcctgaacggctaggaaacattatttaatgaaaaacaggaaagaagagtgacttgtcagtttggacttcgggtgaagggagatggttcaacacaggttcaagcactaagggtcctaatcacattcaatttatccctgaaccactattacactattaggagaaagactatttgagaaatatagggacaaaattgcaaaaacacttatttagatgtataacagtaaagttgaatagttaaacacatgtatggtaagggtgtcaacttctattaaaaaaaaaaaagcaatgataatttctcatttctatcaccaacctcaagcagtgaagttaagtacttccagatactttggcaatgatcttaaaaaaaaaaaaatcacattacagtcaaagtttattaaagtcacctacctcctgagttgctattttacgatttagttcagctactttggaagaagaattctcaactgcattttggcaaaggagtttctctacttccctctgatgagatgctttgagagatgtgatgtgtgctgcagtttcttccttgaacctttacagcaaattaaagaaaaccacacataaaagtggttcttcaacctctaattcagttagcctataaacagtataagaagcctggagagtaaagaagcaaacagagagaaggcaccacatctactgcactgtgctcggtgctttagccattactgcctaggaattcttacagtcactccatgagcttgctcttatttactcaattttataaaggcaaacttgagtgcaggaaagagtgatatgtctggggtcctaggtcagtaaattgtagagctggggtttgagtccagcagagctggacaccaccaccagcctggggcactttgagagaaacaaaggctctaaatgtctggatttacggcaaagagctcgttattttaccttttaagataaattcagatttatggtcccaattctttagattctcaaatgttttgtctctaggcaacactcaccagtttttggcccgcgcataacttcagggctagctccaggttgtgcgagtaaaatgatctttatggtaattcttaggacataaggtagtctgaacctaattggaccattaaatgtgagagactgctcatttgtctctgtgacaaaatttatgcattcagtggcagttcagtaaatggcaaagttatgactaaaaagcgggacatttcttacagataaacatttcctctattattcgaaagattattaaaaaatgacacaattttattgaaagtagatatttagcaatcactgttgatacttattaatacggcaattcccaaactataaacaaacatatcagttgcttatttgactatatgaatacttcttca

SEQ ID NO: 33245 - DNA, 4200 bp, Bovine  19866881306189
cctgtcaagctcactatctactcttccctctcagataaacaggagatggaggctcccagcacattcttttcacactcacgaattcccgaagaccactctgcagtggcacacagagaatctcctgaagtctcactcaggtgttgcctcgggtagaaactaggaaaatattcttcctatcttctcatctgggatgctgtggacaaaccaatagccttatcagttaatattcaggactgggcattttacactcataagaaaccttatgtacaattcaagtaatgatatttaacgataagatatacgttggagggtcacacgcatatgaatcctattgctaaaatttctatcctgaaaccaaaaaaaagtacttatcctattctggaagtttaacatgattttttaaaatttgttattaccttttattggagtatggttgtttacgatgttgttagtttcttctgtacagcaaagtgaatcagctatgtgtatacatgtttgctgttgtttagttgctaagttatgttcaactcttctgcgactctatggactgtagtccaccaggctcctctgtccatgggatttcccaggcaagaatactggagtgggttgccttttctttctccaggggatcttctggacctggggatgggacttctgtctcctgtactggcaagcagattctttactactgagccttctgggaaggcccatgtatgtgtaggattttcaggcaagaatactggagtggattgccatttctttctcctatatatatatatatatatatatatcccctctttttttgatttccttcccatttaggtcaccactgagcattgagtggagtttcctgtgttatatagtaggttctcattaattatctattttatgcatagcagtgtatatgtcaatcccaatctcccaattcatctcaccccctttcccctccttgatatacatacatttgttctctgtgtctctaattctgttttgtaaataagataaaatgatgtttttagaagtaaatgaaattaaagagttaaaatctcccatctcacccaaattgattttagacaacttgccaacattgtcacattccatatggattcccccccttctgttgagttaaattctacactcagaatgctttcttaacaacatcaaaaaatcattctttaaattgatcatacaccttgattctcccttctctgaagtctcctgctaaagacaaggggaggcatacgtgcagaatggaggtaggtgtctgcttgcagcatctgcttttcccttcagaccttcccagcatctcagataagattcttttttgaaaccctctcacaccatttcgctcaccacagatcttctccatcttctccattttctcaatcatctgtttgttcttatcccatgtttgtgaacattctcctccttggccctcatctcatctgtgttgaaacttacccttacatcaaacatacccccttgaaatttctctcaacttctcaggattcacagatcaaaaccaacctcccaatcttcacctctctacccatcgtttcctcctgattctcttctttctgttcatggaaactattttcctagagcctcctctctagactctaaatgttagaactgtcttggaatgaacttctctcccactctatttgacctctaatcactatgtcctcaacgtccttctgattttcccttacattcatactgtctccaccgtcagtatggagaaagtccttcattatctctctcctaccctgttgtaagtgctttctggcaggtcttcccactttcaggctcttatttctcttcatctcacttgataggaacacagttcacttcctgatgcctggcactattcttaaccttgctctgctcaaatgcctctggtctcttcccattctccatgggaaaaaaatccaaagttttgttcctgacaggtgtgaccctctgaggctttttccccccaatctatgtaacacttcatttttcatcccattaaacctttttaacctacccccacccccgccacacacacactttttttttttttttagtttgagggaattccaagtacttaaagatatacagctctcaactttacttggccaaacttattctaagaaaaagcctctttccttctttgcgtgttgaaatcctacctacttttccatatccaaatgccatgaattaatccctgatttctccgagggaagagaatctttttatcttctattcttcacagtacttcgtacttccactgtggcacatactttgtacttgcacagcactatccttccatatagtaggaacggcttctttgaattgtagtaatttatttctccattcaataacatcttccacattgccaacttgaagcttacagtttgttcttgtatacagccacagtagccagtaaagagacatgaattcagtagagaatacttgggatgaacaaatgcatcacctaaacatgcaaatctcctcacatataaagaagattgcatggtccataaagcctcaatatttaaataaagtagcatttcttgcaatatgtgcctttttttctcattcaaatatgatgtggtgtatggatgagaaaagacgatgaagttaagaaacatgccttcagcaatcctgaataaaagaagtatatactcctaatctgatccattaaatggtgtgcttcattccactctgtagaaggcagaataatgactcctcaaagatgttcccgccctaattcccagaacctgtgaatatgttaggttatagtccaaagggacttaacagatgtgattaagtttgttaatcagatgaccttaaaatagggagatttatcctggattatctgtgtgggccaatgtggttacatgagttcttaaatgcagaaaatgtggattgtcagagtcattaggagagatatagtagaagaagaggtaggagagactcaaagtgtgaggagtcaacacacaattgctggctttgaagtagcaggaaaggggccatgagcatctagaagctgggaacagccctgatttgacaaccaggttgtagatcttcagtaatataatcacaaagaactgaattctgccaacaacaacctgaatgaacaaggaaattgattcttctctggagtttccaaaaagaaatgccatcttggtaaaacctagtttttagtcccatgagaactgtatcagacttctgacctacaaaactttgagataatacattgtgttactttaagccacagtttgtggacatttgttggaacagcaatagaaaactcctgtattctccaagtggttgttcagatacatttgatatacaatggttcgaattggttaaaactaagaatagagtgtgtatacttgttgagttagaagcctagaggcacacctgactattttttgatatggaaccacactaaagcattgtaagtaatacagcttattcagtatctcttttatccaatcactctttctacaagcattccatgaatacccatttctacactcacagtataatttttcttggagtttgtaaaattttataattaaatttcatcactagctatagaatggcaggcactcagtaaacagttaaagtttaagtgtgactctgtcactcaggctctctcctcttgaaattcttcattggtaaaatatgggtggtaatttatctaattgagaagtgaggtgaagtcactcagtcatgtccaactctttgcaaccccgtggactgtagcttaccaggctcttccatccatgggattctccaagcaagaatactggagtaggttgccatttccttctccaggggatcttcccaacccagggatcaaacacaggtctcccaaattgcaggcagatgctttaccctctgagccaccagggaaatctcattgaaagggtgatcttaaagacatatgtctaagcaatttaagaaaataggtcattattaatccccaaatattatttgtaagatctaaatcttgatcctttggtgccttgacttaagtatttgtctttgcactttctactagggtctctcatttcacactacagcttttgtaaaggactattattatctggtttctttctggctcaaaattctcaagtagctctccactgcctttaggctcaagtccagattcctcaatctggcatgcatagtctcacaacatgt

SEQ ID NO: 33246 - DNA, 990 bp, Bovine  19866881307806
caaggatgggattagacaggtgaaggagtgagactatcccctcaacaaagtcacaagaccctttggaggaattgttgcctacatagactagccaacctgcccttgtactttgcaggtaacattttcagaaaagaggtttcttttttttcagttggcctggtaagaacatttaaggagtaatgagtagctactgaagttaaccagggacatttttccacccagggaatttcccttctgttcaacatttggaaattcagctaaagataattgcaggtaagccttcaccaacagatgtattcattttccattgtagtttcttaaatgggtacttgtacacaaaagaccttcttcctgtatattttcagttctctagggtacaattacatgaaattattcagcagccaagtttgctttgtatcacttgactgggtaaggacacagagaaagctgctccctatggcactgaaagctgcaaatctattttgcctaaatgtttaacagccacattcatcacagtgtaataacaaggcctcccacagacaacatagttcacttgttttcaccctcctgttaagagtttaccagaaagaccaactcaggtcttgatgttgatttgatattacaaataactatgcatgggataaaatggattggtctaacataaattggtttttgttaccacctgcaactttccaacaccatctacaatttaagtgtttttgcatgatgcttacatttttgagtggcaaaatcttaaataagctacaaattttaaaacttttaaatttaaaaactataacacatcttacacttgaaaaacattttgctagctataaagcatacaggtgtgttgtacattatttcatttgtcccttagaatatatcagtagagtagacattattcttagtttaatgaaaagaccagaaaaatgtcttatttacctccggtctctttgaaaatagtaagcaaaactagtcaaagaatttatt

SEQ ID NO: 33247 - DNA, 1636 bp, Bovine  19866881658847
cttgtagaagttctctcactgctacatttgtctagtcttatagaattgtcagtgaatgagcatgatgaaagaaatccagaaagcgtatttcttgagcttttcataatggggtaaagtgctggctttcaagttctcttactctttgcagtgtagtcatttcatataagttcaatttcaaatcatataatgttcgttttttttaatttaggaagaagaaaaaactggcatgctggctaatggtaaatattatctgtattcataaatttttgtagacagttggtctgttcagatctatatctaattctgaataaattactgtctgtttttaaataatttctgatgaattaaaatttacagattttcccaatatgttttttatgcttatcttaaattcttcctgttgtatttaaggatatatgttttttaaaaaccttggaccaaatgcctttatggataaattttaccaaacattcaaagattattaatgttaatcttccttaaactcttcctaaaaaaaaaaaaacagaaaaagagggaattttttcaaactcattaagtaaaacccagcatcaccttgatacaaaagctagacaaatattcctcaagaagactacagataagcaattatatttgcagtgacatcaaaaagaatacaaacttagggataaattttattaaggaggtaaattatgcctagaactataaaacatcggaaagaaattgaacactaaaataaatagaaaaatattctgtgctcatagattaaaagaattactactgttaaaatgtccatactatccaaagtgatctacagattcagtgaaattcctatcaaattccagtgacatggggagcacatgtatacctgtgatggattcattttgatattcggcaaaactaatacaattatataaagtttaaaaacaaaattaaaaaaaaataaaagaagcaaaaaaaaaaaaaaaattccagtgacatttttcacagaaaaaaaaaaattctaaagtttttatgaaaccacaaaggacttcacataaccaaagcaagcttgagaaggagcaaagcatggaggcatcacactccctgacttcaaaatgtattacaaaactatagtaaccaagacagcatggtactggtataaaaacagacataataccaatgaaacaaaaagtccatgcacctgtggtcacctggtcttcaacaagggtgccaagaatatcaaatgaggacagatagtctattcaatacttcatgtttagaaaactaggtgtccacatgcagaagaatgaaattggatccttatatcacatatgaaagtcgactcaaaatggatcaaagatttaagtataagatcagaaactgcttaaatgaaaagaaaaacataggaatatagctgcttgatgttatactgggcaataatcttttggatatgacccccaaatcacaagcaagaaaagtaaaatagctaaatgggattgaattaaactaaaaaagcttctacatacatagcaaaggaaaatagcagagtgaaaaggcagcttataaagtagggcaaaatatttatgaactgtatatttggtaaaggattaatacccacaacatacagaaaactcacgcaactcggtaacaataacaa

SEQ ID NO: 33248 - DNA, 1095 bp, Bovine  19866881692594
tctatggactatagcctgccggctactctgtctgtgggattttccaggcaagaatactggagaggcttgcagtttcttcctccatgtgatcttcccaatctagggattgaacctgcatctcctgcattggcaggcagatgctttaccactcagccaccagcgatgccctacattcaagtaattactaaatccccctagattttaattcagaaatgttgcttgaatttgtctatttctgcacaccccatggatagctccttaggtgagatcttcatagtctctctccagttcatgctccaggccatcagcatacgtgttccttgacggggcggatgtgctgttaccactttctacttgacatcactccgtggctctcagtgatctagagcattacaacctaatttgctctgcagggatcaatttcctgtcatatcccttcagtcattctgagcttcttgctattctcttcctttattccaacatcaagcctagtacataggacctgacacaatgtactgcaatcttttgattacaggtctgtcttcatataataataaggatgataacttagctatcctatatcctgagaatttagtacaaatggctagcacatgttacagatttaagaaatatttgttaattaaatgaaacaaaagtccactctgccaaacagctctccaaagtatcttaaccatgttacattctcttcctcaatgtaggagggaattcattttcccacatgctagtcatcacttgttattgcttgtcctttattatggtctccttagtggtataaagtgatatcttattgtggttttaaattgcatatccctaatggttaatgacattgagtatctctttaagggcttactagccatttgtataccttctttgaagaaaaggagggaaacccaacttcattatcttgccggtgtatatctaatctatatttattgatagtattccccactgaattgctttgatacatttttataaaaccaattgaccataaatgtaagggttgtcaatgaattttcaaatctgttctattgatctatttgtctattctgtgtcaggacaacgctgtctttctca

SEQ ID NO: 33249 - DNA, 1026 bp, Bovine  19866881769644
acacataaattggggattccagaattttcacatgttcttatataggacttttattgttgcagtgtgttattacaactgtttctttgccccagaaatatattaagaatatattaatatattaagaacacaacctgctctatcctccaccacatatataacctttttcaaaggcacagaggtaatttcagaatttatttctggtaagcctggggtgtgctcaggcattgtgatttgctaaattgcattgggcggcagaaccaagaaagccaaggcaaagctgggtaattgaaattgggacatgtcctgctggaacattcttgtccatgtaagtgcctgttaggaaggaagttaccatgaagtccagtatcagaaggtaggcaaatggggacttcctttggcagttcaaatgattaagaccccatgcttccaccgctaggggcatgggttcaatcactggtcaggaaactaagatcctgcatgcagcctggtgtagccaaaaaaaaaaaaaaaaaagtagacaaatggtccagaaactgaacacacagattttgggatgtggaaaccgatgataagcttaatttgggagcaattcaggtactagctggaaaaaccaaggagtgaaccaaaatgagcttaatagccaaaggacaaatggaagtgagaggtcaaagcaatagagccaatctttctctctcaaccagccaaatacctcatttcaatggatgacagtcaacgtttctgggcttcggttcttttcccccaacttgctcccccttttcttggcaagaaaaataagtcttctctatgacgatgtagttggcaattgggagtgggcaggcaacatctcatggggacctttcagaagattatccattttaaaaaattattctcaaattgctccatccatttcaaggagtgaagagtcatttgggaatgtatttgatcatcaggatttttttttcccctggtgctttgtgtttaggatgaataaaagttcatggaaaatgtattaaggttgacagtgca

SEQ ID NO: 33250 - DNA, 681 bp, Bovine  19866881785744
ctaagttgtgtctgactcttctgcaaccccatggactgtagcctgccaggctcctcctctgtgcatgggatttcccaggcaagaatactggagtgagttgccatttcccttctctagaggatcttccccgacacaggggatgaacctgccatctcctgcattagcagaaggattcttgaccactgagccactagggaagcatattacagttgaataaattatggatacttgatcaatttccatcatacgatggaatacagaccagaaaatgcctttgcagaatatttcatgacatacaaaattgatcacataatatactgtaataccaatactgtcagaataatacggaaataggtactacatgaatcaaagtggatagaataaaccaaatattaagagtatatatttagggttgatgggaccgacttttatcactttcttttgtatttccctgtgtttctaagtttgctaccatgaatatatatgtgataatcagaaaaaaattgttttaaatagttcttttttaagttgtggtgtttaaaatgggttaaacttcagttatgctaaaagttcatatttagggaacagctcatttttcaacaatgcctgataaatgaggcagtgcagttcttgtatcaaaaaagcagattaatataataagcaataaatcaaacttagagc

SEQ ID NO: 33251 - DNA, 1377 bp, Bovine  19866881902346
aaggagaaaaggatgaaatcctagagtcttacaggtgagaaatggattaggaatctgctactaatacctttgattccagatttcagtcctgagttctttctcctgatatatctgcaacctctcaaaacagacagaagtgaattatatggttgggctctggctgtgaagggacaggcactggagggtatagtacaaccttgtggcctaggctactgtgatgtagcctctgacttcccatgacagagctggcaggagacaggccaggaagagtgcctggtgatgtccactcagcaggagcacatgacaggcaggcctctggagatgtgtttgcaggtattaagtaatatgatcttacaaagctgggccagcaagtatttcatatgactgatttcgatcacatctaatcaaactgtttaaacttgggaaaagtgaggtcatactgccatttgctagccctttcactagtctaaagaaataatggggaaaaaacaaacaaacaaacaaacaaaccccaaaactgatcataaaatgataaaccaggcttctctggtgcctcagtgatgaagacctgccaatgcaggagacacaggtttgatcctagcccagaaggtcccacaggccatggagcagctgggtccatgcaccacaactactgagcctgtgctctagagcccgggagccataactacggagcccatgtggcacaactgctaaagcccacatgccctggagtccatgctccacagcaagagaagacaccacaagaagaagcctatgcactgcaggctagagagtagcccccactcaccacaactaagagaaagtccacagaggaacaaagacccagcacagctaaaaataagtaaataaatctttaaaatgacaaaccaaaatgacagtagcagataaaatattatagtttatcaagactctacaaccagttatgactatactgtaacaaaagttgtttccatgaatatagaataagttacttaccaacatgtacaaggtatgaataatccttgataactgtctcggctctaaaggaatcatcccgatgatcaactattactgaatctaagttgatatccttaaacagaaatagaaaaggaaaataaacttttttctaaactctatcattatacatttaagctgatcagtggaagttcacatggtaattatttacagagcccacaagctaaacccacattactcctgtttttcgctctctcataccacgttcttctccttcaaagcatacatcataattttaactacatatgtgtctatgcttaatgtctaccttacgcattcatctgtaaactctaagcataagggactgtctaacacaactaagctcagcttatcaaaaagaaa

SEQ ID NO: 33252 - DNA, 1020 bp, Bovine  19866881963588
aatttttttttgcttatgtggcacccaaagtgattaatgtaaccaaacttgtgcaaaggattttcagcacttgactgggatattttaagtatgtcagctgtttcccgcatggtataacatatattattatcaattaatttctcgatttgatcactatcaacttcaactgggctccctgaccatgtagcatcatccagcgagaaaactccagcacaaaatttcacaaaccacttttgaaaagtttgatcagtcacgacaccttccccattcactgcacaaatctttttttatgtttcagtagcatttttacctttcttgaaataaaaaagtatgatacaccaaatatgttgctttttcttccatcttcagtattaaaatggatatgcaacaattcaccagttttggtaaggtttttttttttaatgcaccctgatatgccagctgtcacaatataatctaacaaaactttttctaatgaagttaaagacaactaagctctactagagccatttttgggaaaaaatcaaatgaaccttttggccaactcaatataaatgtgtaaggaaaataatattaatagtgaattttaagtttgcattgattttcatattaaataactttatatatgttatataattgagactctgtatttctgcattatcagattattttacattcaaataatttataattacttagttttagatggtgaataatataggtatatttatatgttatgtttaatggtaaattgatttaaggtgatttaataagatactctgacagtgtattaatgtcattgcatttggaagattttaatagatctgttgattttggtatcactgtctgttaataacagtaaaaaaaacaaataccattgtcttaatggtaaagaactcattattgatcctgtctagcacatgcttatacctctcccagaacttttcctagtcacattttacaatggaaaaattgcttccttgcccgtttcctgcattatagctagtatatggatactgc

SEQ ID NO: 33253 - DNA, 1279 bp, Bovine  19866882030316
ctcagctttacaacggggataatagtctttgccggctcgcccaccatgtggtggcgggataatatatattccggctgggagagacttgtcaactatcccgccgggtggcagttcacagccctcccagattggagggtggtggagtgagggggttacaggtcccggcctgcgacctcccagtagaaggggctagtggtcatttagtgtcctggccacgcttcaggccaggacacgtgatgcccttggggaccgctgggccgcactgtccctgagccctgcctagagcagagcagccttgctggaaccctatactaggctcttggtcgacctcaccatctcgccatgggcagctgccgcagcgggagactcctggctggaacagaaactgagcgtcacccaaaacccaggttgaaaggggacccctctaggttgtcctgaactgtcctgggtctcattggaaaatcaatgcccagagaagagattggcctctgatggtcaaacctcctgggagagtctcaactgaagacatccccaaactttttacaaagctataaaactatttagaagaaaaagcagctacatggatggagggagacagttgagaaaaacaaggtaaatataaagaggaacttaaaaggagtattaatgtgtattttctttgcacctgaatttaggttaaccccatagttttaatgctttaaaccaaagaaccctcctacaaaagacttagatatgtccaactaggccctgggcctgctagcatagttcccaggccagttgcagtgacctgttaccattatcagtacccaagatacagatggtggaggaatgagcttctcgttgtcatttacgtttaaaactgcagggcactccactgatgaactttcttgacttctctcattagtgaggtattcttgggttttgttgttgttgttgttctgttgtttaaaaaggcacatttcactaatttaaaagtaggttagattgtttcaaactgtcacgtcttgaatcacataacacaccaataaatgaatacaaaataacctgtatatggggtagtaagctaagatgactatgggctctccgatgcatagttatttctaacaagacttcatttgaaaaaatgaaaaacattctggggcagttacagttacattagaacatgttgtggaaataagcttgcagttagagaaaaaattattagaaacagctgtgatgttaatgtttcaaaacccagagtattcaatatgctcagtatctacttttcatcatctttttt

SEQ ID NO: 33254 - DNA, 840 bp, Bovine  19866880513816
actatatgtaagaagtgcatgggaggaggttggggtccccagtgaatctaggtgggtgggcactcacaaatttgagcaggaaggtgttctcccggagggccccaatgcagccggcaaagcccagcacggacatgacgcctccaaccaccacaaacagccacacagggtcaaggcctcccagatctgtcagtgccgagatgttggagagaacgccctgtgcagggggagcagaggcaagtagagggggactggccctcccaccatctcagcccatagcagccctgcaccatatcccactgccttaccttctcactccaggcccagagaccgatggccaggaacagggcccccagcacctgcaagagcagcagcaaaaagctgaaggctgaggcaccaacattctttcccatccccagcagagccccctccctgctggtgctcaggctcttcaggaagccacagggaaagagagaaagaggggaaagcgctgtaaatgggatccagggtcttctccatctttctaagactgcatctcagtgtttcttcccacagggcacagcttgaacactgaaccctccccagccctaagaagggatcccttcttggaacttcagaattggagcagaggagggccaaaacagtcccaccaagcagcagcgactggttcctgagcctcttccctcacctcaggcctatggtaggattccaggctcctggcatcctctccagtatcctcccaagtctggtcctcctgcttccctgcaattctgtgactgccactctactcccgtcccacctttccaacctccatctgccagagtacatcttggcagctcatag

SEQ ID NO: 33255 - DNA, 3503 bp, Bovine  19866880702054
ctacccatcactaccctctacacaccaccaccaaaagtgacattccactcaacattacccagcatcctgcctttccattccccaccactgagctccgccctgaacacaagacctcccaccagctcagcatcactcagaagttccaaatgtcattcaaactctgattgtcacctccactcatggttggcactgctgtcacccactgtgacactgtgtaccatggtcggtgctctgctggtcactcgccacctcccctccccagtgatcccccatcatcacttccgcccaccctgcctatgatctgggtgcacctgccttgtctgggtcatagaccaccatggtgaggtcctcaatggggatgcgcgtggaggcgtgctcatccacgtagccagtgaagttgacttgagtctcgttgggagtgaatgcgcagtcttggaggctgcagttgtaaaactcaggtacatggtcattgacgtctgtcactctcagcgtgacccatatgctcgccttggcctcctgcccgtggatgttggggtgcgtctcggtagcctgagagcagagttgaagccggaaggcagaggtcagagaaccagcattctgagagagctgagatcaaaggtcaaagtgggggtgcagagagtgggggtgcagagagcgggggtgcaaagagggcagtggccccctcactcaccgtgacctgcacttgcacttcctcatcctcctctagcagttgctctctgtccaggggactgttgactgtgatcaccccatcttgcttgccaatatcaaaccagccaggccttgtggaatctgggaagaagcagcaggagcagctccttccggtggctctgacggaactccccaccccttcccttgccccagccccagcctggggacatcccgttctcactggagatgctgtagatcacagggtcattgatgcctctgtcaccatccatggcctccaccttcagcaccgaggttccctgcagggaggcacggtcagtagccagaccctttccctaccactcagctccccccaggccctcccccaggtgcccagcatacctggggtgtatcctcagccacggaggctgagtaaaactccctaacaaactgggggtccaggtctggcttgtcgattacagagatggacacgaagacagacgaggagcactggatgacggtgtgattgttgtacaggccgcccgagtcctgccgggagacaggtctccatgaatctgggccttcgggtccccatgcccccagctcccaccagcgcccctactcacacaggccctcagctccagctgatagaaggaactcttgctgctgtagtcgaggctgccattgaggatgatggaaccattggggtaggatcctgaaagaggtactcactgccttccgtggcaggaatgacctgaggcatagcacagtcaggccaggctgccccaggatggctctgcccctaggacctgctctcagaggccctggggtcgaatcctggctttgctcttgacctcaccaggtcacataacctctctgattctcagcttctgcctctgggaaatgggcaagatactgcctcagcactccaggtgaaagggtggggagaagggttcagtctgcagcagatacccttcttaggcgactggaccgaatggggccagagggggccagagggggccagaggatggtgtggggaccagggctgggccatggcagagctcctgggctggaaggtccctgcaggttgtgtgggagatgctgccccctggtggccacgaggagcggcagcgcccacactcccacgtggaccatacactctcaccttttctatggagtatatcaccgcgccggccgagcctgtgtctttgtccgtggcctgcacagataacaccagggagcccaccggcaaggtctgtaacaaaagaaagtgaaagtgaagtctctcagtcgtgtccgactctttgtgaccccgtggactgaggctcctccatccatgggattctcaagaatactggagtgggttgccatttccttctccaggggatcttcccgacccagaaattgaacccaggcctcctgcattgcaggcagatgctttaacctctgagccaccagggaagcccctctaatacaaaaggtttcatcaactctgagttccaatccattttcttcatgcccaagcacatgcccccacctggagttccagggcccacagccctaccacggggatagtgacagaccttccagaacctgaagcccagtgttccacaggtggcccccttttcttcgcccgggctgggcctcttggggcatctgtacatcggcaggaagcagagttcccacttctcctctccctgatggagcccccttgccacatgaactagcttctgatttgctgagcccctcagggccagtataaatgatcattccagaactcaggttttgccactcccctgcttaaacttccctgtgggttctctgtagcctccagcccaggttgcagacagtactcttcagagctgaaagtttctttcagatgcctttgccccaggacctggccacacactcactaattccacaaggtggccagagagatctctgaaaatcctgaaccagaccacatcactctcaggtcaggtccacctctctgacctcacctgtttctcacactccaccttccatccacagcagctttctagctatgcctacaacactccaggctgattcacacctcacagcagttgctattccctgcctggaaaatccttttcctggagcagcccagggaggctccttgacatttagttctgctcaggtgtcacccacccagagaagactttcctgactggctcaacctaaaagcaaccccttatgctcttcattgagcacaacacctctgaaataatcctatctgcttaatgttttgttcattagtgtctgtgatcttcactacaatgtgagctactgagggtggcaaccaagtctatcatcgccagatatcttcagcaccaaggacagtgccagacacatagtaggcattcagtagagcctgttgaaggtctgtctggatctcaccagcctcttgtctggcctggggggtagggcacacctctcaggtctttgaatccacgtagcaatgaagactcaggagtgttgtgtttcctgcttgtggacgactggagaacctcctccctgcccatgcagttcaagtcaggctgtcatccttgctaaaggggaaggcctatgatgcagactttgacaactggagcattccacacccctcaactgcatgcatgctaggttgcttcagtcatgtctgactctttgtgaccccatggactatagcccaacaggctcctctgtccacaggattttccaggccagaatactagagtgggttgccatttccttctccaggcgatcttcccgacccagagatcaaacctgtgtctcttacatctcctgcattgcaggggattctttaccactagagc

SEQ ID NO: 33256 - DNA, 2132 bp, Bovine  19866880845209
ttggggtaggggccttatcccatgcctgtggccagggctctgcagtgaaattagggattgtgtgaaggtcacctcccctggacagctccactggctaagcaagtagcactcttgtgcaaattatgacaaggaagccccttcctctgggaccgggtttatagcttatcaagcagattgcccttgtgcagtgcactgcctttgcaactatatgtggcagccctatttaggcctgtctctgcccagccaacgataggcttctgggcacatgcagaagggaagtgccagtacaggtatagggtcaaagacaaggaccagatcaaacgtgggtcacggacagggttgagagatattccattcagatttctatcagggactaggctcccaagccctgttcttccccacaagccacccgccccctggctcctgagacctactccttaatcttttccgagttggcgcccacctcctccttgttcagtgagaactgcagcctcacgcggtaactctggtccacggtaaatagctatgggagggggacatggggaagatgagatgcaagggaccctggagtggcagagggcactgggaactgagacagaacctaacactcacgtttagggtgattctggcttcctgggcaggaccctcagaagggctgtcttgggccttgaccgtcacttggtaggtgccttggagagtggaatcaaggctggtcaccaggctacggaaggtaggagggcaccactcagttctgaaacccaggctgtagtcctctcagaacccccttggacccctcctaggatggggaactcactgccctgaggccccgcttggctcccccacccctgtccaggggctgcccgcagttactcaatgttgccagtgaacacgctggcctccgaggaagtggagacccggaagaagccctgaaaagggatcacgggccccatccttagcaatgaaatccacttgaaagatggagaacaggatggctgcgttgttccctgagtcgtcatctctggcctgggagcaagacagagtgaacaaattgtgggggctgggccaggccaggcacgcctccagccccagcaggaatctgaagctagggtagcctgggagcctggccctgccaatgacctcttttggccttccccaggccactgaccaagtgctttaaacaaacagtgtttgaatatgtccctgcttcaactcaacaggtcactgcccaagtctctcccaggtagaaggtcaccctgggaaggttccccctctcactgccacacacgcacaagcctagggacactcagttgtcctgagcacctactgtgtaccaagcaccttcccccagacccctcctttcagcactcgctaacaggagtatgaattcccccagcggaccatgaaatgaggcatttttattcattctagtgcctttcggagaagaatacgaccaacacacagagccgtgaggccactgatgtcactgttcaggatgaggctaaagctggtgttgacgtttcaaaagggagttgatttaaagaaaattgttcaaagccagggccacactcctgacgttggaatgaacgtcttcagccagggctgaagattggaaaactgaccctttgagcctagaaagaacctagagaggaagaattgcatgagtgctaagtggcttcagtcgtgtccaactctgcgactccatggaccgtagcccaccaggctcctctgtccatgggattctccaggcaagagtactggagtgggttgccatgcctgcctccaggggatcttcccaacccagggatcaaacccacatctttatgtctcctgcattggcaggcgggttctttaccactagcgccacctgggaaggcccagaaagagagaattactattccccttttatgggaggacacttggggttctgacagagacctgtcttccccagggcacactcggctgtaagtgggggagggccagacccatccatctccacacccatgccctttccataactcaaggagggccacccacatataaaacgcctgaaccctaaggagtcactgccaagagctgacagcttcttgtctggaagggaaagtgagttcttaaaaggcacaacagctccccag

SEQ ID NO: 33257 - DNA, 712 bp, Bovine  19866880852857
caggaagcttatggtctcaggaactactgaatgttctcacagggagtcctggatccccctattcctgaagatagactgccacatgagccaacatattcccttgtttgctgaagccaacttgagagaagcctagctttttctcagtcgctacgaaataaagcctcttccatcccacccaatcaccagctcatttaaaattgagagtcctttctcataagtgcccccgcctggctccagggtaggaatttccatctctagcaagctccatcaccccagcagaagcaggcactgggttgtcacgtgtggcccggctctgctgctccatctaccgagaagctgcacacattcaccttgctattaagtattgccaggagccagcctcctcttagctctgggccctgatgcagccgggctcagagctgcattaaataaagactgcagccctgaaactgttcaaatggatctacatcaacgaggacagcgagggcatgcctttaaatagattatcaccaagagtcagccagggcaggcaaagtttgccttcagatcatcctcccctcgttcctgcatccctcctctgtctacttttagcggactttgccccatatcccgtcagaaattaattcacactgtagtggcttaatgtgttactcctctagatttcagagaggaacagcacacaggagtgggcagtgtttaacctaaaggatgg

SEQ ID NO: 33258 - DNA, 1763 bp, Bovine  19866880972150
ttacggggccttagctagagaaccggggccgcagctaccaaggcaggcctgcaggtgccgcactggagagagcagcccgcaccacaacgaaggcccagagcagccaggatggtaacagacagattttaaatttgttttaaacattgagtgattcagacttttaaaatcactaacccctcccactaaaacagtccagggaaggatcaatgacttcactaacccagaaattaccacccggtaaagaacccaggactcactaaatgttgcactgaatattctcataactaagttcaagttgccttgaaatcaggctggtgtcttttttgctttgactttcattcctcccaatctcctacctcctcctcaccaataaaaggggtgagtttaagtcattttggtacaagaacttttctgaattttgatttgatacataagaaagtgacaaatttgtcatacccttaagtgcaataagggtactctttcaagttagatgctgggttcacaccctgggtgggttaataagatacaatttaatgtgataataagataatactaatcatttactaggattatattaataagataatagattggcatcatttaaatagtaagtctaaatggcagagagtaactactaacatctggtccagaaaaagtggtttctgtctagtttaaaaccttaaagggtaaaacataactttatcaaaaagaactaagtttaccaggcacttctggttgtctcgaagccattgaaagactgggatccaggcgcttttcctacacagactttgagctgagttccccgccacctagtaaaaataacaaagggtgttttcttacagcgagcaccaaagactagccccaatgctgttcttccaacaggcacagagctttatggctttaacacgtcaaagagccgatgagcgacaaacatgccaagggagaaaaaaaaggataaagtcaaaggattcagcgtaccgtcactgatcttaacacccgtgatatgacaaagacactatgcacagtgaaaaggtccccttaccagagagagatgatgtgacgattatgcctacaggcaggtattaatgaggaacatcgtccagctgctgcaaattagcaaagctgctcaggaagagtccatccatcccagaggttctgagaacaacaaacaaccagcgttggcacagccctgcagagtctgccaaacatctccctgtgtttcatgtctttgccataacaacctaaaaagagatactatactcatttcagttttcagtaaattagggctcagggtcaaaataacctgacccacggcaaggggctagggatcaagtcaataaattcattccttgttgctagtactgaccgacattcagacaacgcttatctcgtgttttaaccctcgcagcagtccattgtttattcacactttagaagaaacgaaaaaggagaagtgacttgtccaaggtcacagataagtggcccatcttgtaaggcagatttcagccccatttcaccgagcagttcaaacaaagctctgagggagccgttatttgctttcaacttgtcaactgcccccgacccacccccccccgcatcctgatgaagctcagacggcaaagtaaagagcatcgcagaagccaaagttccgtcaacctcggagcccagggagcgttccgacaaggccacctcccctttcacttcccggggcccggccctccccgcggcccgcagagcgctgacttctcctttaccagatgcaa

SEQ ID NO: 33259 - DNA, 1765 bp, Bovine  19866881007364
tcgactatgaggcctgtgacttggtcacgctggtcgtgcgggcctatgacctcacaacagacccccgcttccaggcctacagtgacaatggtgaggcagcctggcctgcagggctcagcaggctgcaacacaggggctgtggggaaggactggaatttgtaaggtcggggttcaaatcctggctccagccccggccagctgtgcccctgggaaagtcacgacactgcccagaactttagttgccccatcggtcaagtggagttgggtagtaggttgcctatgaagagtacatgagaatatgtatggaaggcattgagtgcagtgcttggcatgctgttgttgtccagttgcccagtcgtgtctgactctttgcgaccccatggactgcagcatgccaggcctccctctccctaaccatctcccccaaatttgcccaagttcatgtccattgcgttggtaatgccatccagccatctcatcctctgactccctcttctcctcctgccttcaatcgttcccagcatcagggtcttttctaatgagttggctgttcacatcagatgaacaaaatactggagcttcagcttcagcatcagtccttccaatgagtattcagggttgatttcctttaagatcgactggtttgatctccgtgttgtccaagggactttagcacttaatgctgtgatgctgagaggcagtgtaaagagacttcagagccacgtgtgtgctcagatcccacgtctgacaccaagtagcaataacagtcacatcaacagccagcatatattgaatccttactacagcccagcctatgctaggcaccttgcaagcatttcaccattttactcccacacaatccatgtggtaggtgatccctagccaattttatagatgaggaaactgaggtacagaacgggcagttcaataatgtagcttacacagctaaccagggccagaataatgttgtggccaggtgggacatacctgggctgggctcagtcctggcccagtggtctcactgtgtgactttggacaagttgcttatcctctctgaggtctggggagaatgctccctcctacacaggccagaggagactgagttagtaggggaggggtctgaccgtgggtgatgcatgggagggaggctgctgggaacaagcctgaggaccaggctttgtgggtcaagtcttgcttagagaccaaagccagccaatcttttccctctaggaagcctccccatcaccatcgaggatgtgaatgacaacgcgccttattttctgcctgaggataagacttttggtaagctgcaagcccctccctccccacccacactgtactctgccagaacttacctttgggcaactcccacagatgctgctcagaccccaggtgtgcctctggaaagggaggaaggcctccagccctgtctctctctcagggattcaacaggaggagagacccgagttttcactctatctctgtcccaactcacatctgaccctgggcccggccctccttctctggcctcagtttccccatctgcacaatggggggtggaggacctgctaactagcggctcaggggtagctgtaatgggggtctggcagtagagagcttaagggcaggtttggagggatgcgccccgagctgggcttattatggtcagcagttggcccagggggcactggccctgatgccactgacctcttcctgtctacacttgcagtgatcatcccagaactcgtcatgcccaaccagcagg

SEQ ID NO: 33260 - DNA, 817 bp, Bovine  19866881111834
ccctggctcagacacctatgagcacagcttgctgcccacaaaggtcccctccccccagcagctgtaggccccggcccagctgggggcggccctgggatttggctgggtgactcaggctgaatcatggcccagctgctccttggcagccctctcccctactctgcccagagagcctattttgaaggcagagatgggccttgtgtggagggcaggaagcatgggcacttgagaaggaggaatcaggcacaagaaggcctctgtgcccacttctactcctcagtggtctgcaggcacacaggcagcccctgcccatgcccctcgttctcccagaaagagaacccttttgcctggacatgagcatgggtctccctctctgattccaggacccacgttggcgcccttgtcccactttttggctttcataacaacgataactatatttactattctaatggattactcacatgttacagtattccacagttttcaaagcactttctcatcagtattgcatttaattttcttattagttctagagtggactaatagcatccttaggagtggaaattagtatccttaggtttgagcttatgtgaactgtttaaggtcacacagtgggtaaagtgacagagccaggaaccaaattttaggcttcttggtccaacctgtgaaaggtaagcattaaggctggagttgagctgcagttgggcgtgggggggggggcgtggcatgagtatatggggcatggcagggccatggtggggccatggctggggcatcaaaagtagcacaggggcgtggcaagatagggggtatg

SEQ ID NO: 33261 - DNA, 837 bp, Bovine  19866881125083
gaaggctgtggaagcaagggatatgggcaggggagggggcctccaggtctggggaccttggctttggaggacaactaggagaccagggcacagcaaagatgtgaaagaaaggccattgtcctttctttctgtccaagaaaggcttgggcagcagggagagaggtgggaggtagggccggagtgagggcccacgtgtacagggcctcaaatgtgagggctgggaagacatgggctatgggagccactgaagatttgtgaacaggaggagtaacaggataagggctgagtgttagaaagggccccctcctcgggtggatggaggatccccgctctcctctctgggccgtggagagttgctgagccttccagaactgtgcttcctaacacgtctccagctggaggtactaatgctgatttctctttctctttaaccctctgcctgtctgtccatcttgccctgctgttctcccctcacctaacccccttccctcaaggatcgctgacaaagcattctaccagcagccagatgctgatatcatcggctacgtgtacgtgtctcctttgctcctttgctggggtccctgtgtgtggttggcagtttcttgagtctctcactggtggggtatgaatgagtgtggctgggcccgaggcagtgatcagagaaggaggtgagcctgcagggtggacacaagcaccagccttcatctccatccccccagcaaaggtgtactgagcatctttgagacagatttgccaaatccaagcagagacaaggaaagaatgctgtccatccccaggtgagagaggcaaagggccaagcagcccaactccccccac

SEQ ID NO: 33262 - DNA, 1056 bp, Bovine  19866881151428
ctcacagcccttaccctgcagcatgtcctaaggaaggtatctgactttgtgcacacatgggttgctgccaccacttgcctggggtaacatgtctgcacaaatgtgtgagacacagttcatccctccccatggcccacttctgctcacgcctgcctcagggcctttgcacgtgctgttcctcctgcctgaaatagacttcccacacggtgtgcctcatcacttgggtgtcagctctaatgtcaccttctcagagaagccctcccaactaaagtagccccctcaccccttgactctctatcccatcgctcttgttttcttcatagcacatatccctgtctgaaatcatcttgtgcactggttagctgtttactgtatcttttcccactacagagtcagctccgtgaatgtaggaacctatttgctgtggtaacccctagaacgatccctccctggcgtgaatacttgttgactgaaaagacgtgagggaacaatcagtgacatatgcagatgaggccaaaagcaggccagatcacactcacgagcaggatacatgtacccaatccagatttgggtcacagtcacggggagtgccatgcccgcacaaagccacatgcagactcatgccgagctgtgtctatctgggccgtgcagaatgttaggcgaggtggcttgtgccccaggctggctgggggagcagggagcctggcggcagatttatgggtgtagctggtatgtgtgtgtgtgtgtgtgtgtgttggaaggatagctcaccttcagatcagtggggaactcctccttcttcaccagacctgtggctgctgcaatgttcccagccccagagaacacggctcctcccaggtgtgatgcctgctccttggttttctcagccactgtgtcaaggagagggttgggggcaaaggtcaagcagacatagatgccctcctcctccatagtgtcccagggcctgacttcccacagagcactacaccccgcagaaagctctgggggtgccctctcccgccgccctctgccctcactctctggatgtctgcagac

SEQ ID NO: 33263 - DNA, 653 bp, Bovine  19866881245564
tacagacacgaatgttgggagcaaaaattattctcccttatctgagctgcgttttctactagcttttattgtaaaaacaatataacatgaaagagactttgggaaaaaaagagggagaaaaatcacccacaattctccttggtgtaactgtttttgttttttgcaaatgcattgccttcaagccttttcctttaagtgtccacatgtttatatagctccaatcctagtgctcactgccgttaaaattccagctcaaagaccacttcccagggcagcttccttggaccccaagaaactccctcccactatgtcgctgcatttctcaccccctgagtgtcatgatttgttttcacatcatcgccggggaccaaactttctgggggcaggagttgcatcccctgagtgtctgtggcccaagcacagggcagggcgcgtgccagacacttctcgtggtctcactttcgcattctgtgctgtcactgtgcattggaacagacgccttgtcccctgtcgctcagtagttttcataacgatcatttttaacggctccagaatatttcatcaagtggatgtttcataatttagttaaccagtcccctactggggaacatttggggttgtttccatttctttttctatcacaaataatgccg

SEQ ID NO: 33264 - DNA, 835 bp, Bovine  19866881275797
aggtgacggatatggcaaagggcactgttccttcctctcctctcctacagagtgggggagccctcccactttgtgggagaggatgcagctaggggtccagaaagaggtcaaaggcctggggatggggggctggcctggtgtcttttctctgccccctttgagggatgacaggggtaggtcggtgatcagaagtcccctgcctctccctctctccagagggagactggtcattggctgggccatcccagccctgtttgagatggaggagacagggagattcatggccatcaggagaggcctaagtggcagctgctccccagagtaggccacaaagggcatatttgaggtcccacttagatgggggaggggactcaactccctgcctgtccacagtgagagcaccaagggccagtgtcctgatgggtgagtcccccagattcaggcccctccccacgccaagatgtcagagctgtgtccctctggaaggctcggggtcaccttgagctcctggcgaatgcctggctgaggtctggggaggggcagtcattctagactgatccttggagagggagctctggcccctgtaacccacccctaccgtagacctctccagccaggatggcagatgtgactctccgtgccccaccccagcagatccagcccagagcctgcagggagatacaccccgatttagaccctaccccctccttactggagcacagaccagatggagttgaggggctgttggtttttcccatatccgcatctttccagcccttctctccccttcccccaccaaaataaaaaagggggatgacgggcactgtcaggtagg

SEQ ID NO: 33265 - DNA, 3650 bp, Bovine  19866881339146
actcactttattgcaatgttggctttatgtggtggtttggaatggaaactgcaatatctccaaggcacacctgtcatttcccaactcagggtcagctggtgagcaacccccagtgacaccagccacctggaattaggccaacttcacaagttaatgttgcagatctccacagataccagacgcaagttcaggggcccccaggttgccctcacgtctaaccaagtcagggattcacactacccccttagttgttacaatttgctggaatggctcagagaactcaggaaaatattatatttctgattacaaaaggatataattcagagcaaatcaaggggagagatacaggggatgaggtctaggggccccaaatgttaaacttccgtggtctctccccatattgtcaagaatgctttaccctcccagcacgacaacatgcaacagcacagagtatcgccagccaggaagccccctagagtttcagtgtgaagagttcttattgaggtttcattgcataggcatgactgaccaacttgactgaatcatcggtcatgtgactgaactcagtgtccagcttccttctccttgtggggctcaaagttacaactttcctaatcccatggctggtctttctggcaccatcagcctccgttttgagtcacctcattagcataaactatcaggtgtggtctaaggtgccgccatgaataacaaatacagtcctatccctccagaatttttgaggatatagaggttactgaggatagaggttatataggacatagaggtccccagaaacaagggaccgagggtcagccgagtctttattgcacacaaccttaatttcatccacaaccttaatttccctctgccatgtaaactaccatattcacaggttccaagaactaggacataaacatcttggggccactattccatctaccacagcttcccagttgctctctaacatgtcaccctgttttgttttccccattgcacctatccttctataaaacagtcttatttattttgtttgtttgcttactgtctgtctttctctctgctgtgagtctttggcacgtgactaagcaagaaagcagaagaattagaggaggttacactccagctgggtttgaaggatgagcagagtggtttatgggtagctggggctctgagcatctttgcaaagggacagaggagggaaggtcaggtgaatctaggagccctgaatggatcattgtaggtggggcactggggagtgttgtgggagggagaggaggtattgggatggaaaaaggccaggtaacacagaacaacatgtgctaggctacagacctgatggcacttctgggatctgctctagcctctttgctctctcacccagaggccaggagagaagcaccagggtgtggtaaatagggcagggactctggggtcagactatgtgggctcagatcccagttctactgttcataggccacctcttcatggtcatcactgaagatggctcactcagcactcctgtacaacccacttctattctgccctcctctatttggagcccagggagtttcccagtatctcttgtagtgagtgacacagatccagccaatgctggaagcagaatcctggtgaggggtgttctgggaatggaaaaggtccaataaaaaggagaatatattcaactagatcagaattttgccttctcctctccttcctgctttgaatgtcaagttgcatcaggaacaggagcagccactttgtgaccatgagaagcaagctaaaagtaaaggcctaagaaaaactgggcagaatgatggaaagttcctcagtttatcaggtcatcactgagcaactggatccgtgtcaatcatcacccacctctgtgtcttagttggatattctgttacttttggtcaaacatagtcctaattggtacacgcgtgaagcctccatttcctctactattaactagaaggaacaataattgtcaatattcattacacttaagtcatgtgccaggaactcctctaggtgctggtggcaaagcagggaacaagagataaggttcctattcttcttgcatttacattttggcaggcaagacagatgatgaactcataagtaggcaagaatatatatgagagtgagaagtgctatgaggaaaagaaaataacatgatgtgtcggagagactggtgtggacataacatgggaatatgtgagaaggtgatacctaagctgagacctgaatgtgaagataatggcaggacagagcacagggaacagcattccaggagagggaacagcaagagcaaagggcaaagacctggaggcagggccacgcttgatgtgtgggcagaccaggaggaaggccagatgactgggcggccgtgaatgacgaaggcaaagaatggaggtgagaccagagaggtaggtggggtctgatgacatatgctccaataggcagaatggatttattttaatcacaaaaaggaagccatcagagggctttcagacaagtgtgggacaatgacttgaccaccttgcactctgtaggtgcttaataaatgtctacggcctatagtaggtgcatcacttggtgggattcctgtcccttctcaggctcaaccagccccatccccaggctggttgtctcatacccccagctcctgagctggaccccctctgactgccttctgagttatcccagccctgtcttgtcctcccccggggccgtttgctccctccagagcgggcgagcataattgccactttccacaatgacataaaaatctaagaggcacaatcaatacagctcgcacacacatcatcgtctttcattgcaaacgataaaagtgtaaacagcaggggtggcagcagctctggaggctgcagtgggggcagggcaggctgccactgcctccctgcccatcactttccttttggggccccttctccacgctgggaggtgaggcccctcattaaagcccattctctttccaaatgcagcaacccaagcctctttaacctggctagagaaatccaatttttcttccctttcactattttaaacgctctttttttttttttttgcttccttgaactttctatgtctcccaaaatacagagctaagagtgccttcctggaggcagaaggacttgcctgggtcttgcttgtcacaaacccacgaactgacctcagtggggggaccagctctcaatggccggcttctttcactccgcattcagcctgccacccacagcttgtcttggaatgtgcacagaaatcattacattcccagctctcacagactcccggcaacgacttcttcaaactagttacttaatgaacgtcatccaattccgtttcagcctgccatactctcatttgtgaaagccaatccgctttacgattctaacctctggctagaaactgctcccaatttcatgtcatccataaacttgatgaacgattagcttgcttctctgcagtcattcatttatttattcaaccagcatttagtaagcacctactgggtgctgggcactggatacacagtgagaggacatgcaggtcctgtcctggagagacccccatgcttgtggcggagctaacgggaaatgttcattcagtagatccaccctcac

SEQ ID NO: 33266 - DNA, 1573 bp, Bovine  19866880195044
tttccagtggtcatgtatggatgtgagagttggactgtgaagaaggctgagcaccgaagaattgatgcttttgaactgtggtgttggagaagactcttgagagtcccttggactgcaaggatatccaaccagtccattctgaaggagatcagccccgggatttctttggaaggaatgatgctaaagctgaaactccagtactttggccacctcatgcgaagagctgactcattggaaaagactctgatgctgggagggactggcggcaggaggagaaggggatgacagaggatgagatggctggatggcatcaccgactcgatggacgtgagtctcagtgaactccaggagtcggtgatgggcagggaggcctggcgtgctgtgattcatggggtcacaaagagtcggacacacctgagccactgaactgaactgacctgaaagacactaacttctccatccaagggccagtctttcctctacctctttcacatggtagacgtggagaggaaacaaaagatgtagacgtgttttgaagcctgtctatttcatcagcattttgcattctcttggaacacactgcacacctagttttttccacgatactgttctagcctgtacacccagtaaatgcttctcaactcggaggctgtaaatggactctcccagtgtttctctgtctgtggctatgcaccacctcccagtgagtcacccagtggacgagttaagaaagtaaattcctgagacacccgccccccatctggtgaattagaatctgtgtgtaagagtaaagtttcaagtggagaggccctggattctgactattctcaaatttctcagattattttgaagcagatgaaaagcagaaaaccagtggactaggctgacaatagtattgccagtcttctttgaaagctccctcgaaggaagaagtttaatactacttcccttgactggagaggcaagttcgaaacaggaaaacatccggcatcatagggtcttttgagatctatcttagagtgggcacgctacccaaagtagtacattttctgtaatcaatttcctaagaggggttacagctttctagttttagaattgtgtggataaaatatttggctgaataaaatattacctgccatgactgctaacagtcatgctgaatgtgggctgtgcaaaacgtccctgtggaaatagaaaactaggccagccctttctgggtgacaaaggccatgaataatgcacagagaatgcggtttcttttcatgtagtttgtactgtgctaatatttgtgaccactttagaaagtagaaagtgcagggaaaataggagaaggcataccttaaaatacatatcaagcaaaaaagtccaacaacttagatgttgctttctcatatagtgatatatgattacgggagagaatgacgaatacggtgatttctttgcagatcagatagtaagattagctcatataaggagagtttgcttggtatcaaagctgtgtattttacatttttatctcatgaaacctcattagtttgccatttactgtaacaccttttaataaagttaaata

SEQ ID NO: 33267 - DNA, 1893 bp, Bovine  19866880216519
ccttgactagacgaacctagttggcaaagtaatgtctctgcttttgaatatgctatctaggttggtcataactttccttccaaggagtaagcgtcttttaatttcatggctgcagtcaccatctgtagtgattttggagcccccaaaaataaagtctgccactgtttccactgtttccccatctatttcccatgaagtgatgggaccggatgccatgatcttcgttttctgaatgttgagcgttaggccaactttttcactctccactttcaccttcatcaagaggctttttagtttctcttcactttctgccataagggtggtgtcatctgcatatctgaggttattgatatttctcctggcaatcttgattccagcttgtgtttcttccagtccagcgtttctcatgatgtactctgcatagaagttaaataaacagggtgacaatatacagggtaacaatttactcttctactccttgcattatttcctcttcaaaatttttccctttttctgttgtttgtcctgatccttcatgttggatgctatcttgctgtactcaaaagtctggtgaccatctgttccattgaagagtaagacttgttcatcctttttttgtcattgtggctatcctccatgtctgctgcctctgtgatgaaagcaactcctctcactttcttccaaattatgagccttctattctgaagtgggagatggggtccagactttcaaccaatttcactacatttagcctctgtttgtccctcctaccctctcctaatggcccctggtgtctttgagtctgggacttctctggagtcctggggaaaagccaattattattgtattactcattatttattgctttgcactcatgagtcaggtaatgcaataaaacttatctatttttctgtcctaatctgtgctgggtacttcttgtgcttccaccatcaaactttgagactttggataactgctgagcactgattgccttatcccttcaccctacaggcagctgcagaaaaaaatgctttgatgcttcacatagaggactagagggctgccggtgtgatgcgggctgtaaaggccgaggcgactgctgctgggactttgaagacacctgtgtgcaatcaagtacgaactctgagagcaagtttattagcatgttggttgtgtgatcattaatgcatatgcaaatacttgccagacacttgtgtgttaatagtttgcttggactgacgtaacaaagtcccacatactgagtggtttaagccacagaaattctggaaactagaagtccaagttctaagtgttggcagggttggttcattccaagattgtgagggagaatccgttccttgcctctttctaggttttggtaagttgctggctatcctcggtgttccttggcttgtggcagcaaaactcaaaaatctgcccttatctccagatgcccatctccccgtttcttcacagtcttccctctgcatgtgttcatgtctaaatttcctcttgttacaagaagaataccagtcacactgggttgggacccatgctaatgacctcattttaatttgtctgcaaagaaccttttctaaataaggtcacattcgtagtcatgggggaagagagttaagacttcagcattttggggaagggacacaattcagcccataacaccttgtattcaggatctagcattaccctgtcctctttttcagtattctaaagatagaattcacactttgtttagttgaggttgaggaataacagtctccagcagataaaatactgtcaaattatacacatttcaaaggcaagttttcctatggcttgtcatcttgtttaatttcatttttagggttctggagagcataagactcctatagaaag

SEQ ID NO: 33268 - DNA, 1557 bp, Bovine  19866880342191
atcctctattatgctgctgctgctgctgccaagtcgcttcagtcgtgtctgactctgtgcgaccccatagatggcagcccaccaggctccgccgtccctgggattctccaggcaagaacactggagtgggttgccatttccttctccaatgcgtgaaagtgaaaagtgaaagtgaagtcgctcagtcgtgtccgactcttagtgaccccatggactgcagcccaccaggctcctccgtccatgggattttccaggcaagagtactggagtggggtgccattgccttctctatattgggcccttattaccaagcttattgcatcatctgtatagtatatttgattttatatgcttttctccaactcagcaaagccccatttgcagcaaaaatcactccttatttatctctataatcccagtagctaggacactgcttcatgctttgttgaatgagtgtgttcagtggaagagctcagatccttctcgtctattgatgcagtctaagtattcagtggaatcactcgaatcacgagaataaaaacatttggagaaaagcagtgatggaaaaatataaacatcttgagtattttgactgtgtgtccttgccctccatctaaagttttataatttgaagcaaagctgaattttataattaattcttaaaggaattttaagaaagaaaatgctaaatagactgaagaataatttcacatggcacatggtagaaaaagtccttgtctggaaaccatgacgcttggtttttgtcttgttttggccactgtctagcaatgaatgaatgaattgacaaacacaacacatttctaggcttgattcatcatctaagaagaaaggatctggattaggtgactctaaccctatttcacctctcttaattaactatgaaaacactctgatgtgtccacataaaattgataagtatattattttataattttgttttctcataattcttggtcgctaaattttcactaaaattacctaactcaagtctgttaaaggcttttctgtatcagaggggaaaaaatgaagactttacagggtctccttctaaattctctaaggtagttccctctgtccaggacaggaacctaaggccttcagcttagatatgtgtgaaatagatcaggaatggctcaaattcagaggtgcttctgctatcagaaaggactaaaaatccttgtgttttagtcagacttgccaactgagtctattacaacagagccaattatagtctgagttagcttaggagctgcccagaatactgatctattagtaacattaaatcatcatagaataaaattaaatatgcaacataactgaagaaatgaaaattgtctccagcggaattgaagtagacagtgcatttatgggaggaaaaagaaaaccacccatcaagtatttttgctgcaaacccaagaggcgcaccatctgttggcctcatcattgcactaggtcagcagcagacagttaccctgaagtcagcagagtcagacaactgacattctgaaagacaacagtactgtcagccctccatag

SEQ ID NO: 33269 - DNA, 1256 bp, Bovine  19866880416736
taggctttggaagctgaaaagccaagtggcatccatgtttttgctgttctgctccacgctcacctggcaggcagaggcatcaggctgcgtcattttcgcaaaggggaggagatgagattacttgcttacgatgatgattttgacttcaatttccaggagtttcagtacctaaaagaagaacaaacaatcttaccagtatgaatgtttttattctttatcactgaatgtcatcaaaatcctgaagcatatacctgctaagaattagccaggtttttcctggtgtaatgaattgttcatcctatccatagcttcaaagccatccaccatggctgttgcataaccctcacggaatgtgtttgatctgttttccaaaattgaaacttgtttttcttactattcccaggggcaactcaagtcgttgatttcaaaggaaataaaacttaggttttgtgctctaagcaccatttttctagactccccagttagtaatcccttggcttgcagttctggtaatggtaagatcagaagttttgaaagtttcattgcaataaaagtgaatataagatcactttttcttttgactaaggtattaggacatagctaattatattaccgtgtgtaacccggctggcaaccatacttgaagttctgatgaaacaacacagaaaggaatcttgtgccttccaatgatgaacaatttaaaaattttatgatgcttcattttgtcaaattttttgacattgagctcaatagttatacaagttcctaccctacttttcttcttaagagtcagatatttgtactatttatgaaatgagaataatagtaatatcttttatacatgcagtaattctctggtatactctgggagtagaaggatgaagtttgagtgatctcaagattcttaaggactacactccgttttatggtgttgtctggtgttggggctctctaaccagctttttttgggttgtctcagagttcctcaactgatatgtcatgagaggatataaatgttgaaatactgattcctccctctgaatatccaggcagcgaggacaaatctgagggccattacccagagcttgctgcttctggtctgtaactagcctgtccacttacctgacctggagccataaaaaattagtttatttatgtgcagtactgttcaaaaggttgaaaagtactggaaaaaataagttactagtaatttgcctcacaagtctgttttacgaaaataaatacctgattaagga

SEQ ID NO: 33270 - DNA, 1817 bp, Bovine  19866880477251
atttattgtgcgtccttccaaaattatcctgttcagtcataatttaaatgattaagatcaggaagaaatgatggtaggtcttgcttatgatgagctgttctctaatagctcttgttcaaaggcaggtggtcaaaaatggtagcttgaatctgtagatagtccacagatctgtagatgtcctgtttaagactagaaaagtgtcatgtttttatatcactggtgacttaggttgctttttatcttatgctctgtgcctttagacacatttaagaatttgaacacattatacatgcttcagggaaataaaagcagaaaccttttatctctctttattgtatgattgtcttctccacttaaattcttctaattatgtcagtagattagatctcattttatttttcttatcatatgatttcataacatattaaatatatctttgtctatttgaggacaaggtttatttgttggtgatattgactaaaaaagaaaaatggttattttaatctttgattatacattatgacctagagcaagcttcaggttcaagtacatcagaaccacttggggcacttgctagaaatgtagtgtttttttgtttttttttttaagctcctttccctccacctttcaaccctcaccattcccaccagagtcctatttagtagacttaatattggatccaagaagattctgaaggaggaaattcctggatcatattggaaatactggtttcctggctgggaaggagaccaactccaagcctatttgagaaaaactttattatttgcagatgcaaagtttgttgctttctggacaacaatcatttgcaccttttgttttaacctaaatagaatctctcgtggtgaagttctcttttagaattagaggtgatagaattttggtacagaaaatgtctcatacgtcactcttgcagaggaaatagtaatgtgccttagtggttctgactttcttgagcaaggttattgcacagatgaaaacaacaaaataactgaaagcaaaattaatgccatgctttgcggaaaacagagcacaggaaacttcactgatcaaatggaaactgtactgaaaataataaggtggaaagttaattttgtaaacattactacgtggcatgggcttgtgcattcacacaagtcaaattccttttcagttatctagacagttgtattggcttttgctatattgggaagcaaatattatatagaaaattttactttaatgagccaggtcagaaagagaggaacagcaaacgcaaatacaactggcacggtgttaaaagtttagggtcttttaagctcaggtgtcagcaatctgggtctgtgggccaaatctgacccactctgcttatttccgtatggtctgctgatgctaagaattgttttcattcttaaatggctgggaaaaaaaagaatgccttgtgccacacaaaagaaattacatgaaatgtctttgtcttgatgtctacaaatacagttttgttataacagagccatgccatttgctcaaagcctatttatttattatctggctcttcacagaaaaattttcctgatccttgacttagcactctcctctcctgaaaactgtcattccttgagaggaattttaagcatcagcattttaacctctttctatctgcaattcaccccctagttagttttcgtatttctctgggaaactttcatgttcatatttttagttattcaaacaacttctgaggaagaaacaacgtcttaatttcccactatcctttgttgcagaaacatgggagttcattcacaatacctgagacctgc

SEQ ID NO: 33271 - DNA, 1041 bp, Bovine  19866880506753
ttttttttttttttccagtttctagaccaggagtgggaagtggggggtgagggtcatgtcataatcacttctatcccaccaatgccaaaagaaggcctaactaaaaataatattgaaccaatgaataattattattatttttattttttcaatttggaaagagaaagaatgatacttctataaaagaaaacatgagtatctcagagtataatcttaccctgctggacactgtggttcatcaatgctgtcacattcttcttcagcccaacttttctcccctaaaatattttcaagaagtacagtgagttgaacacattcaacagaaacaatggtcgtgatgtttgtgagacacattaggacacgttccccccaaaaaacaaaaaagttaacagatacatagatcatgttgggtgtgattctcagggaatagaacaaatagaagttattctatttcaaaataagagttagttgatatcaggaattaaagaatgagtttataattgcaagactaaagcacattgctgtatttgtgagaacttgaaggcacattttccattttcaaattgtcattaataatattttcaaccaaaatttataaccctacttctatccaccgacagaatcttctgccttagttcctctcatacagtcaagttctgtcaaagaatttcaaggaaccctgcaacacctaggcaagacatcatagtaacaccagcttacacagaattcttaggcactaacttctctcaacatcaggcagacactgtcctcgtttactatgaaagaacctgctacatagtcagccaagactgtgaagtgattgttccacaaatacagcattaaatatgcagctaatatcaaaataacatgagggtgtagtagcagcagagtgtatgactatggataaaaaagactagccgtgtgtagacaatcatgattattaggctgggtgatacaagctttattacatagtctctctattcaggtatatatgtttgaaactttctctaataaaagcttttaaaatattttttcagccaa

SEQ ID NO: 33272 - DNA, 2029 bp, Bovine  19866880526982
gggcttcctgcatatcagaaatgtcagctatacaaatacgaatagttagatagaagaggttctgctgactcaactggatggtagtcccattggagagctgtatttaagagtaaatgaaatatgttcttactgcttcagagtctccaaggaatcataacgtccgtcataatcagaatcaaacacaggaccgctaacaacattgagaccgtttctttcttcagcatatctctgcagtaaggtgccatgcaagtagtgccatataactgaaacaagaaggaagacgccacagtgtcaaaagaacaagatgacataaatcaactacaaaccaaattatgaatcaaaattagcatttgtcataattagggataaagtgaagtctggccaaaaatccatcgttcagcttttgctctttgaaagactaacgagcaaatgctgaaatcaattctacttcagggcatccctaaacatatgtattatcaatgaagctgagatcacatattatcattaagcataaaaaatataagaacacaaacaaggcaagctattcaaatttattgttaacatctgtattttttttgaaatattctagggcaatggcaccccactccagtactcttgcctggaaaatcccatggatggaggagcctggtaggctgcagttcacggggtggctaagagtcggacatgactgagcgacttcactttcacttttccctttcatgcattgaagaaggaaatggcaacccactccagtgttcttgcctggagaatcccagggacgggggagcctggtgggctgctgtctatgggattgcacagagtcggacacgactgaagcgacttagcagcagcagcagcagagaatttttaactattcaaaagcattctagaggtaaactacaataaaattttccttgtatgctctgtaaattacttaaagtataaatgtgtatttattcttaaaaaagccaatagttacaataattaataatgatgtaaaatctattcattttaaattaaaaacaattatcaagaacttccaaatagttaaataaggcaacagactgaaatttattatctattagtagattacattagctagataagttaggagtaacattacattcttttcccaccaaaagtgtttgtaagattaaaaattttaccttgaaaactctggtacatgggcactatattagttgtaagtaatgcttcagaatatacttgacttgaacctttatgtaattctacaaagaaaataacaagaacaactatttcattcttcacaaatcacagtaagaattatactttctcgtgggggtatttaaaaaatgggctatcatcttaaactcgtaacactttcccagatactagatcaagggcgggtaatgcaatgtgatcaggtcccttaaaaaaaaattggatcttttcttcttcaagatgaagaaacaaaatctttaatacgaagggcctaaattaaacatattcaaattttacctcatttgccttattttcaactaaagtacattgtgtcaacaatctttccctgaactctttcacagagaaaagtaaaaatgagaacatctggcttcagaacacctactaaccagaaaaaacatcacaagggatgtcttttctgaaatgtgctgtacaaggcttctttgtatggacttctggcttggacctatttttataacgcaaaagccaggttctgacttcagaagcttgctctggggactgaactggatattgagcatattgactggagtcttctgacttttttcctttttaggctggcctcaaaatgtcttctcattaacatacagatctgccacttgaaaaaatagaataagatttcagaaaaaaaaaaaaaaaaaagccattccccaggggctctgtatcagtgcaagagcaagcaaactcaggctctccttttacctcatcctttgacaaatcaaagttttctttttaaacaacaaaatgctatctccttcctaagaaccctgatgcatccttttgacctgagttt

SEQ ID NO: 33273 - DNA, 807 bp, Bovine  19866880530248
gctcagatggtaaagaatctgcctgctgggttgggaagatccctggaggagggcatggcaacccactccagtatatttgcctggagaatccccaaggacagaggtgcctggtgggctacagtccatggggtcacaaagactcagacacagctgagcaactaagcacagcacagtgcaaatatataccaaatactgcatgggacatatttacactaaaaaattattcattgtttatctgaaattcaaatctaaatcaccatcctatattttctctgacaaccttatccctaagtaggtttgaatcagcaaataatgctgtaaaaggctaggttcaacgaacagcatcctagtgtcaactagggggtcaaacttcatccaaaaatatgaatcttcaacagtaggaggaaaatatccatcagttcagttcagtcgctcagtcgtgtccgactctgtgaccccatgaatcgcagcacaccaggcctccctgtccatcaccaatttccagagtttacccaaacccatgtccatggagtcggtgataccatccaaccatctcatcctctgtcgtccccttctcctctccccttcaatctttcccagagtcagggttttttcaagtgagtcagctctttgcatcaggtggccaaaatattggagtttcagcttcaacatcagtccttccaatgaacacccaggaccgatctcctttaggatggactggttggatctccttgcccaacatagccccagtcaaactccgattctctttcaatatctcccagttcaacctgtcctcctccagtcttc

SEQ ID NO: 33274 - DNA, 2958 bp, Bovine  19866880549737
ctacatacgcagatgacaccacccttgtggcagaaagcgaaaaagaactaaagagcctcttgatgaaagtgaaagaggacagtgaaaaagttggcttaaaattcaacattcagaaaactaagatcctggcattcagtcccatcacttcattgcaattagatgggaaaacaatggaaacagtgacagactttatttttgggggctccaaaatcactgcagatggtgactgcaaacatgaaattaaaagatgcttgctccttggaagaaaagctatgcctctgcatattaaaaagcagagagattattgccaacaaagatctgtctagtcaaggctatggtttttccagtagtcatgtgtggatgtgagagttagactataaagaaagctgagcactgaagaactgatgttttgaactgtggtgttggagaagactcttgagagtcccttggactgcaaggagatccaatcagtcattcctaaaggtaatcagtccttatattcattggaaggactgatgctgaagctgaaactccaatactttggccatctgatgtgaagaactgaccactggaaaagaccctgattctgggaaagactgaaacaggaggaaaagggaatgacagatgatgagatggttggatggcatcactgacgcaatggacatgagtttgagtagacttcaggagttggtgatggacagggaagcctggtgtgctgcagtccatggggtcacaaagagttggacatgacttagaaactgaactgaactgaacatattttctgcatagcaattccctcaactgatccctaagtcccaacaacttttttaatttatttatttatttttggctatgctgggtcttcattggtgtgtgggcttttctctacttatggtgagcggggaccaccctctagttgcagagtgcaggattcccttgttgaggagcatgggctctagggagcacaggtttcagtagttgcaggccctgagctctagagcacaggttcaatagttctggcacatgggcttatttgctctgtggcatgccggattctctaggatcagggagcaaacctgtgcctcctgctttggcaggtgaattcctgatcactgagccaccagggaagcccaagtcagctctgaaaaatagattcattaaatgaaataactgcccatggagaagttgtatatctgagacttttgatatcctcttccacatatttcttcaagccatatcagctatgggctggtttcaggacctaatgaagctcaggttcttgatggctgaatgcagaaagaatccagtgagagataaagtgtgtctcttttagaagtaagaagtggatttatttagaaacatacgccacagacagagtgcagactgtcacagagggcaagtgtggccagtgccaatcacttttgaaactttttcctaatagttcacctgagctttggacactggccaaatccacaccttccactgcatcttagacttgggaatagactgcctgtgtcacctagatctgaacctacacttacaagttactagaccctcagaagcccaggtgttccttttcttttcgaaagtgaaagtgttagtcactcagtcctatctgactctttgtgaccccgtgaactgtggccagccaggctcctctgtccatggaattctccaggcaagaatactggcatgggtatccaatcttttctccagggaatcgtccccatccagggatcaaactcacatttcccgcattgcaggcagattctttactatctgagccaccagaaaagtcccaggaatactggaatgggtagttattcctttctccaggagatctttctctttaactttatagcaatctgcacactctgggttctgaaagttttactctgctaccggggtcctgtcccagttggatccagggattccctcaggaggacggcattggtgaaagaatagcaaaaagggagagaaagaggcttgatctaactggtttacatggaaagccaataaaattcgtgacaccaaacttgctctgaccacggaggccacaggcaccctctcgaatagctgaaggtgcccccaccttaggcaccttctcaagtaggtcttagaagcctgggcaggtaagtggtctcagaggacccccactctccaaattagtcatcctgaaggaagaacagagaagaaaaggagagaaagggaagcaagaacgactcggggagaccaagcctgatgagcaaggcccttagctttattttcaaaaggagtttttataccttaagttgtacatagaggataataggggttgcagagtcatgcaaagtcagcagtccttgacccttatcgagaccaggctttcttttctgtatacaaatgctttaggtgatttacatcatcttctggccaggaggtctattaacattttatgactctttgttttgataaaggttagttaaccagaaaacttattttctctaaaagtaatttttctaaagtttggtgccactctccaaaagcactaaagttacattcctatagggcaaaggtgcagtgggctgtagcaaggaaagaatttactacctcaagggtctaaagttgctaacaccaaggccactagttattttttctatataccaactatattaattaatatactcccagggacacagtgggtaagggatatggaaacttggcagcaagcattagctcaacaatgaaatcttctactagttctatcctaataattttaactccccaagaagccctgcattgttagaatatcttaagctttccgtgcctcttgtggttgggaggctgtaaacagtcacatgcatagctgtaagagtccgaaaacctgtcaggcaagttagaaaactatctaagggatttgaattggaacacacctattgtaccctggagaattattaactagagctctaagttgatttt

SEQ ID NO: 33275 - DNA, 1642 bp, Bovine  19866880576997
tttgttgctaaatgtatgtgtgcatttttcttaagtctcatcatatattcatagagattggtgattttttttttaatctgcacccctaaagtagcaatgcaagtgaaatcaggcattgataaacctgtaatctcatcttggctctgcaagacctctcgccagtcctaaatcagcccttaaaccaatgacttaggacatagttgtctcaacaatcctattggtttaaccaactactatttgggccagagaatctcgtttgcgatgttttaactttaggatctgccatcccatgtttcaaaccacaaggatgtctaccatagtcatcgggctgaaaaagagcttgctctatagacaacatggaacattgagttttttcttctatgatatctatgctatgagctccctttctctaccatacacaaaacacatttcttctcacagtaaacacattgagtcttttattccacacagagtggctaaaaattctttgactggttttaatatttgcagcctaggccagctctagggtcactgaactcatggaagcaaaggggcaacacctgcttaccttggcaaacactcttatagtcagcacagcagtctttcctctgtaaacagtcatctgagcaagagcaaaggctggattccaatctggtctccccacagcgaaatttattgcatgtccatatttgagctgaagaattacacaattcagttttgagcatacaacttattttaagcatccaataccaaaaatataaactttatgcatttcttcttgtattatcatacagtcaaattcttagtttatctgcatccacaaatgaaaatacataaaacaaataaggggcaatccaccacttttcctcttttggcatgggtggcagagaggaatgtagctttacaagctgtggttctggtctacctatctacctacctatcaggtacacttctgagtttggagaaactgaacacctgtcttattcccacccaaggatagaagaactaccagccttgagtgaccattgccacccaggagcagcctgcctagcctgatctgaggaccgacatcaaggaagaggcagtgacaacagaagtaacaataacatggtcaggtctgtaagaacacaggcagccagggtacattccagctgacagtgaaagaatggtagatcagctccccaacgtgcctctggtatttttccaagataggcacttaatgtgagatcagtttgagtaaacctagaggagattgcttcctaaagggccacctgccaggaaatggtgattggcattaatgtcagccctatgatcagacaaatgcattggctaggtgacagctgtatgtttcagtcatgcagcgttcttcattcttcattatatattatgtacttagaaagaaaagatttttaataatgaattaaagggaatacagagcttatccatactgggttatcctctacctcgagcccttttcagaataatgtaagaagctctactgttctagtcttcaatatcattaaaccactagacacacggccaccgctttccttgacttcctagaaaattagatattgcaaactaagctgtctcttccacctcaagaacaatgtttctcccaattaaaataaataaatttaaa

SEQ ID NO: 33276 - DNA, 1358 bp, Bovine  19866880578187
tccatgaaattttccagacaagaatcctggagtgatttgtcatttcctacttcaggggatcttcccaacccaaggatcaacatatatatgtgtatttcattatttaataaaaattactctatggggcaaggcagtgtccttcatctgactctagtgacgtcatgcagatattccagaggacagtgacttgcaaaaattccttctcatgtgaatcgaaagcccacaagctcttcaaaacaacgatttctccatttgttgtgaaatagatgtattaacagaagctgttagcagagcggctgatcagtaacaaaaattgatctatttgtcactaaggacagcaattggaagctaaaaacctctaccccaggaacagattttctatcctcttcttgtcgctcagtcgtgtccgactctttgtgactccatggacggtagcctgccaggctcctctgtcaatggaattatccaggcaagaatactggagtgggatgccatttcctactccaggggatcttcccaactcaaggatcaaacccatgtctcttgtgtcttctacattggcgggagaattcttttaccattagcaccacctgggagtcgttggagcctttttatgttctagtgtcatataaatcactcagagattgtgttttatcttttccattaaaacaactctaaaagataaattagtatttattaaataacctgaaagtaggacttggggctcctgctcttaaacaataaattaattggaaggaggaagagcacattgcttacaaagtgcccttgtgattacagaagggctgcctacttgtactggacacctttagtctccaagctagtgccaccctacacgccaggagccatagagacataggtgtggacatcggattttctcccaaggggggctacagatggttatcaggaaccagagagtacatatccaacatttcgaccagagactcaattctcactgccagtaagaatttcctggagaggttttaaaagcatcaatgattggactcccacaccagcccaaatgaatcagaacctgtcagggacagggcttgaggatgacatattttggtttaggccagcagatatcaaactttagcatgcatcagaatcacttcaagggcttgttaaagcacagattgctaccccacatctaatatagtgcttttacctggtctagtaacaaatggataaatattgctagatttgtatttgaaaagaacaaatttctaggacaaggaagattaactggtgtccatggatggaggcggtgcctggaagcctgcagtccatggggtcgctgagggtcggacacaactgagcgacttcactttcacttttca

SEQ ID NO: 33277 - DNA, 1244 bp, Bovine  19866880584849
tttcaggtaacatacagattctttgtgagttatacctgtcagattactaacctgaaataaaagactttctccatttagcaggagtccagttttccctacattatacaagcagatacttcactgagaatacagttacatttactaggctctaaactaaatcagagttgactcattggaaaagattctgatgctgggagggattgggggcaggaggaaaaggggatgacagaggatgagatggctggatggcatcacggactcaatggacgtgagtctgagtgaactccaggagttggtgatggacagggaggcctggcgtgctgcaattcatggggtcgcaaagagtcggacacgactgagcgactgaactgaactgaactgaaactaaatcaaaaggataaactccctgcaaataaactgcctaaaacatattagctatttgaccttggatgagagatttgcattcccttggggtgcttcctctactgaaaagtgaaggcgtggtactagacagtttctgaagttctttccagaagtaatattctgagattctctctcgaagccaatatcctccattagctatgaatcatggggacttccaaaataacagtcaaacttaatccaatgctggaatccccactacaacatctgtttgaccatatccatttataggaaatttactacttctgaggcagtcaaatgaaacatccaacagttattttcaccagaaggttcttctttctcctaagttaaaatcaatatttttgaaacggttgactatagatcatggaaactgaatatctttacataattacatctctctatagtagggtttgggcttccctggtggctcagacggtaaagcggctgcctgcaatgcgggagaccctggttcgatccctggggtgagaagatctcctggagaaggaaatggcaaccttctctttcacatagcaggtttactatatcgaatttaacaacattttaatcaacaacttaaagtaaaattgtatgtaagtttcttggtggctcagtggtaaagaatcgatctctgggtggggaagatcccctggagaaagaaatggaaatccactccagtattcttgcctgggaaatcccatggacggaggagcctggcaggctactgtccatagggtcacaagagttggacatgactgagcaactaaacctctaccaccaccatagttgattaacaatgttgtgttagttttaggtgtacagta

SEQ ID NO: 33278 - DNA, 1769 bp, Bovine  19866880702336
tgttctttggaaggaatgatgctaaagctgaaacttcgtactttggcccctcatgcgaagagttgactcattggaaaagactctgatgctgggagggattgggggcaggaggagaaggggatgacagaggatgagatggctggatggcatcactgactcgatagacgtgagtctgagtgaactccgggagctggtgatggacagggaggcctggcatgctgcgattcatggggtcacaaagagtcagacatgactgagcaactgatctgatctgatctgatatctcttttaggaggaaaagagaatgatgttaatttgcaagttataatttcagatttttagctctgacatttaaaatcatgaattttgggcaaagtaatctttctgtgcctcagttttctgtactgtatataattctgttaactacctcatagaattattgtgatgattattaataatctaagttgcttatacgagtaccatttagaactgtaactggcaataataagtgctcagtaaatattaagttacataagcaaaatatgtcaataagttaaagatatgtatatttgtgaatttttcttttcttgtgatttttttttcttttaacagaagcttattaagtagaagcaagtctgtaaaagttgcaggagttaccaattgtttatattctttaagttaatttaatttctgattatttaatttctttttgctgctgttcaaagtcacatttcatggttgttttgtagtcttaactgctggagcttattgacatcaaaactttctagcattggagacgaaagcattggcagttgtgtgaacacagtttcctaagaaatcagtgcttacatagtttcctaattttccttctctgtcttctccagatttggctgacagctaaatatcaaggcctgaagacaggcacatttttttggccaggatcagatgtgaaaatcaatggaattttcccggacatctataaaatctataatgggtatgtataactgtactttttctaggacctataacacagaacagtttattttcttatcacagcctgagttctagcatttgaatgatatgttatctgaaaaatgagacctatcaaaataagaactctatttcaaagagttttaaatggatggtagatagtaaaactagatgaggtgtttttttttttttttctggagtttttctagaaagcactggtggtaacatgttggagtttgtgttcagatctttggataggaataagaattgaagtcctggtgaaagtaggggtcctgaatattttcactccaggaagaaagaactaggagaaggagctgaaagtattaaagggacataggtaggagtgaccctttggtgtccaaaaatactatttgaaagaagatattaatggcacctctagatttgcattttcaaattacttttttaaacattccatctatagtggaactgattagagtaatctccctgtgatattcaaaatccgtgtggtattgtggggaaaaaaaaaacaaaacacacgacttttttcctggaagactcccttcggattattttagtgagactagcaaaataatttggcttatacttggggaatttatgtcataaaaccaatacgatagtgtatttgagggacgaaagggaaagttcataaattccaaacaagaaatgcgtattttcttttgtaaccttaggctactgttgattctctgggttcatgtgagcaccttgttattgccattatttcattccataggggt

SEQ ID NO: 33279 - DNA, 1474 bp, Bovine  19866880766570
aaatgcctgctatgagaatgaaataccaattttaatttatctctctgtatcaaggtgagtaaggtatcttagtgaattataaaattatattttataagaaaaaattcttttttggggggtagcagagaaatagcttcatggaattttggacaatatcagttcagttcagttcagtcgctcagtcatgtctgactctttgtgaccccatgaatcgcagcacgccaggtctccctgtccatcaccaactcccggagttcacccagactcacgtccatcgagtcagtgatgccatccagccatctcatcctctgtcgtccccttctcctcctgcccccagtccctcccagcatcagtcttttccaacgagtcaactcttcacatgaggtggccaaagtattggagtttcagctttagcatcattccttccaaagaaaacccagggctgatctccttcagaatggactggttggatctctttgcagtccaagggacttctccaacaccacagttcaaaagcatatagtcaagccatatatttcaatatatctattttaagattatgtatcttctatatgattatttacttgtcaagtttgataaatatgattagaaaataacagtagtatcttggttagagtcatttttcccaacaattaagaaaacaaaatgcttgtaatgttttgattttggaatcatagtattagtacaatagacttaccactagatggagacaagccctcctagcttcactcatgataattttttttactatgagtagaaacccacaacaaaagagttaggattgtaatgcagtactggatgttcagaaccataacaaatatgtgtgtaaggtttcatttatcctcagcatctcagttattaggatctgtttaatctgaggaatgtagcaagtgtttacacaaaaaatctttcgttatcattgagggtaatttccaaactaaataatgacgttataaaggaaggtcttttttcccaagtaatttaacaatatcttcagaatacctaaattttgtttgtttttctgaggttttgttaaatagttttcaatgaaacatcagaaggagttgctctatcactatattattaagagtatatttattgttcaaatgtcaagcaaaccatttgctttgacataagcataaggcaaatatttaggaaaaactaacttgtattcatcagcgagatgtaattttggagttcttgcaggagcagatgagtgcacgtccttttactctgcaatcttagtctggatttaagaagaggtggcaagaatacacagaagaactatataaaaaagatcttcataacccaaataactatgatggtgtgatcactcacctaaagccacacatcctggaatgagaagtcaagtgggccacagaaaacagtgctatgaacaaaggttgtggaggtgatggaattccagctgagctatttcaaatcctgaaagatg

SEQ ID NO: 33280 - DNA, 1107 bp, Bovine  19866880810215
accagggaaagtcatcttcgaaggtgggacatgcagtctgaattgtctaccagcgagagtggcgcagcaactggtgagggcatggagcatgtggtcagcagggacacagcttgggctctaggatgcagcacatccctgcagagttggggctggtccacacccagggagctggcaaaacagagaagggacattcggggtagagggagggaggagactcaaattcttatgtgtaaaatgaggacactggatcatattggtgtttcctaaactatgagtcataaaaatccgattctagaggtaagtttaagaattcggatttagtaagttaaataggattttttacttctgtactttttggatttagtatattaacgatattgtgacttccctcccccctccctcagtgcagataagactccaagggacagtgctgaacagattagcttattgtctgtgattcctgggataggatgagtccaggaaacacgggagtgggggaaagagagagatccttggctcctgccttcagaatgccctccatgccttccaaagagtaggggaagtggaagggttctttggtgtatttgcagtgatgtcaggggttatcaatttacaaaaacaaatgacaccaaacctttctaattaaggtgaaacttgtgtttaggtagagtgtgtacagacctgtgatgtattgctttaggggctgaaaagttaactccactgcctcaaaagtctttagctactaacaatgaatcccttaattccagtcatgttctttgcatcttgttaaaatgcaatataatgcaatacctcaggagagacagagaaaccctgaaacctgctatcataaaagtgtttggagctgggacttccctggtggttcagtggctaagactccacacttccagtgcagcggacctgcgtttgatccctagtcagggaactagatgccatatggtgcagtcaaataaatagatttttaaaaaagtgtaagaagctgactcggtcagatcattttctgagggaagagcttgattgaaaatatagaaagaaagaaagtataaaaaactggaatatttgttagcatagagaaaaggaagcagaaag

SEQ ID NO: 33281 - DNA, 1067 bp, Bovine  19866880812295
aaatcaagatacgaatgttggataatacagttaagaattgaatggattttttaaaatgtcattttttctttgaaaaccaacctccttcaattttcttggaaaaaaattaaaaaccctgcagagcctgtgatgataaatacagcccttggccagctttgcctgtgctggagtgttggaggtgctgatgtagggtttttttcttaagttattttggggaatagagcttatttaaattccgccagttggaaaaaaaaaacccacccccaaacagtgctgtttcatgttggttgaataattcacgaatgggcagatggaaggacacatatagctacaaactgagtgtcccttcgtataagcactgttttgttaaacactccctagccagttccatcacagttaatgcagttcttgggacgaagaataagatcacttctccactaaagtactatgtgtatgaggtatttattaaaacacctactagccaagcgctattttctggaatcctctaaacaagaacagagtaatcagaattcaggcattgtactgcaaaagaagcttcctgtcaaagaattctactcctgattctgagtttctttatttctgaaaaaataaatctgtttggaaaaacacgatgattgcattactattaaaaagcatgagtgaaaaagcagaaataaatgcactgccatgttttcctgagctctcagcccaggcctcctgcagaggagcagtgggggctgcgtgactcaggaaattaagcgctgggatcagctcctggggccttcatctaattttcagtgaccttgtgaaaattacttcacatgtctgtacctttgctagcttttaaggtgaggagaataatattggcctcccaccaaaggagtatggggggtgaatagcaaatgcatataattgatattgccttgctgatactgtgtgaagagccatgtggaatgataaaccgactggatgtaagatggtggaaggatgacaagtagccaggtgtatttccagaactacagttcagccatgcttagcttggaatccttcgaacgctttgtcatggt

SEQ ID NO: 33282 - DNA, 4376 bp, Bovine  19866880856951
agatgatgcataaaaagtccctgctatcctgcaatgagagaaagttgactcagattctgtgaagaatggaaacagaagggggagagggaagtgctcaggtagacaccttcatgacattttgaccttttgggagctgaaatcctggatgggaagataaacattaggtaggctgagtagaatcccggaagcagaaatgcttccaccctactttctgattgggcctctgttggcagaatgttcccctcatccacatggaaagggcttcttccaaatgaaaaacagttacacatcgtggccagtcagaatctgaggtagcactctgagccttcactggctctcctgtaggaaaggagcaatactgaacgtctcacatgccttcggggatgctgaagttgcctcagttgagagccagtagagttacccagtgggcgttatagtcaaagacacttacttgtcacttgtgctcagtcgttcagttgtatctgactctttgcgaccccatggactgtagtccaccaggctcctctgttcatgagatttttcaggcaagaatactggagtgggttgccattttcctctctagggaatcttcctcacccagggattgaacctgtgtctcctgtgttggcaggtggattcattaccactgagccacctgggaagccctagtcagagataagatgaccctaactcagacagccaactgtttacaccatgtttggatggaagatgtggctgtactcagaagtggttgcagccctactatgagttgaggtagaatttaatcaactctgaaggattcctgagccttgttggaacaagaagatgagtcaggcatttaccaaccgcactctaaagcagcagtctattataaccgctagagcaactgtccacgcatgcctgctcagtcgcttcagtcagtcatgtccgactctttgtgaccctatggactgtagcccaccgggctcctctgtccatgggatttcccgggcaagaatactggattgggttgccatgccctccttcaggggatcttcctgacccagagatcgaacctgcatctcctgcattgcaggcagattctttacccactgagccacctgggaagccccccctagagcaactaccaagaaaataactttagaaaagctaaaattcaacagaagaattaccatgatataataaaacacatttaaaacagaagtttaaagaagtgaagaagaaacagaaagacaaaaaaaagatatgaggcatagagaaaagaagtagcagagtgctgttgctgttaagtcgcttcagtcgtgtccgactctgtgtcaccaccaggctccaccgtccctgggattctccaggcaagaacactggagtggcaggcatgaattcagattatttggcaaccccaggttttgttcaaaatgaggtacaaaagagacaatggagtggggaacaggggtagcagagaccgtagacaaccagaaagtgaggactgtactgcagttccctttagatggggtctgcacttgccattttcccacagcttctatgacttaattgcattcactttctaattttgttacctgactgacaatgaggtgtttttcctccatcccagaggagtcagtatctcttcctgataccctgggttctcccttcatagatgcatatccagtaggggctctcaaatcttcccagaaattatgcttagattatatttaaatcatttgcagttaaatcatatttaagtattttaatcatgcataatttatgtaaaattaaagcatttaattctctctcttacaggggtagggattgggtgatttaaatatggaaaggatccatttaaatttaatgtaaagttggagaaatgtaaaatattttattgacatttagagatactgtggttttatgtattatttgtaactccagtttataagtgaggaaaccaaggcacagagagttcttgtactctgtacaaagtcatgttgtcatccaagcttcttccagggggaatattttcacgtttacaaaaaaggaagagaaaccaggatgtcacacaaagctttaaaaatgaattaatgtcatggaaaaaatttttttctacatctcataaagatgaaagagacttgtggtttttttttcattttcgactggcctagatgtcttccatgtttcactggagaactggagggatttcagctggagaagctttggagcagctgctaaaataattactctatcgtatatttcacttttaaaaaactgagaaaagttgtttctcaatttctagaggccttagttccaaacacagacaacaagttggttgcgctaggtgttctggtcttactcacatcccagagttccaggcacccaggggagtgttcacatatttttgtacaatacaacctaaggaatcatcaaatcttaccctctcatctctcctgccagtctagactagaatcctcagtcattcaaggaagaatggtttaggactaaggacaacacattgattgcccacctttacgctaactggagaagttttgttacagttttatgtctcttgaccttattgtacttcgggcgtgtggagtgttcacatatttttgtacagtacaacctgaggaatcatcatattttatcctctcatccttactgccatcttagattagagtcttcattcaaggcagaacggtttaggactaaggatgacatattgcttgttcacttttacactaactggaggtgttctgttgcagttttatgtctcttgaccttattgcactttggtgtgggaggctatccctcatatcatgttgaatataaacgagatagaggcatgacttgtctatcgctcagtttgtggttaaacaacatgagtggcctgctcaatccagttttattctgattttagagtttcaactggattttttatagttacccataaaagtcccagttggcattaggcgaggcctgagcataaggcaaaggccacatcctggtggcctgtgtgccaggcccaccctgcagatgtgtttttacgttttgtttggccttgaaagtggttgaaagaaattgtttttctgaatttcatagacaaaattttgcaatctggagaattcacataaacatctaaatttcctgtttctcctgaaaactgactatctggccacagtgggcactagcctgctgagtaaatgccaccacctttaacagggcacaaactcacattcagggggctgcctcactcttttatgttcctgctggtcctggatgtttgaatccatgaccatgcagtcccctccaccaatgggcctagtctttaaaatgatttgttgacttgggatgcagacaatacacctacttcatttgttttcccaagttcaaagccactgggaatgtttctgttgtggtgcttttagaagatctgagactcatttgaccagtctccatggagtaaatctttgaccttgaatttgacttttgggaacagtcaaaggaaaatttagagccaagtttttggggtgaaaaatatgtgtgaccatgtaatagtgaaacctgtttctcttgggtggtttggtttgtaagctgactcaaaggtaattaagggaaaaaaagagctcaatcatgctttgagggctttacttcttccagatgtccattaccctttccactgagctgtcataatatcctatgtgtgtctctattatgcatctatgatttgagttttagttttttgtttactgccctctcctcttggatcagactggaagccacttgggaaagatacacttttgttcatcttcgatcttgttggaggccatcggcactgttgaaagccaagagactgaactgaaggattcattattgaatgaatgaatgaatcaaaggacctaaatggaaagcgtcccaagataattattttaaaggggacaacaaacactttatatcgtaggcatccattcttatttaaaaatatatttgcatatattcctgaaatcaaaatgaattgaaaaattaattgatattggattgtatgactttccttgttccctaacgtcagctccggtattgaaagtcactgttttctacttgacaagcaaaactcatttgtctgcacacttgttgtctccctaactgatgagcaaggaagtgtaaaagctgtagaatcaaaggtgaataaaaatccaccaagaatgatggcctactgctcgtgtcctagtttgaaacaaaatatcaaagtatttcagatattaaattttttggtagcagcagcaacctcaggatagcgcagcgacgacactttgaagctttccatgtagaaagtcaccaataaatatttcacaagagcagcagccccacccccaatgccgaaaatccca

SEQ ID NO: 33283 - DNA, 1527 bp, Bovine  19866880859954
ataactaaagtggcttgaatgaagcagaagcttctgcagctgtggaactcctgagctgtgttatgagacacaattagagagtgtatgctgttggttttggtgaagagcagagtgctgaagacaccagttaaggaatgacagtgtccaaggtggccaaggtgaagcaggatttgctccctttgtcagctgatgcctgcatcccttctcaattccacacctccctgctctatgcccttccattggaaaggggccccgacatcataagatctgtggcatgagagaaccgagtctgcttggtgactccctacttgtcacagaagtttatcagccacctgcacttttaagaatgttgggagagcagcagagagctgtgggaaacactgggcgattttaaactccttcaggaaatacaacaaaaaagagacagattttataaatgcttccacttcatttcttttatgtgaaactcatatacactgaaaaattaatcatatctgacagcagttactttttataatcggaaaaaaaaataccttgtaatccacccctccaattattttccgaaccagtttaaatgttaaggcccaaagctgtgttctttcccattcaagtgtgtcagagtttatcagggattcacaaaccatcctagaaaaaaggaatacccattccagttacaagacaggatttttgtaagttctctaatagccaaggtccacaaactctggatattatatttgtcacagtaagtgttaataattgtcataaaggtacattactcaagcacactttcaaaaaattacataaagcattttatattttttacttatatgaaagactaaacccaaagtagaactaaacccaaaggagactccttaccatcttgagccaccagcgaagtcctaaaatagaactgctcctgctgctaagtcgcttcagccctgtccaactctgtgcaaccccacagacagaagcacaccaggctcccccatccctgggattctccaggcaggaacactggagtggcttgccatttccttctccaatgcatgaaagtgaaaaggaagtcactcagttgtgtccgactcttagcgaccccatggactgcagcctaccaggctcctctgtccatgggattttccaggcaagagtactggaatggggtgccattgccttctccaaagtagaactaagtaatattaattatgttatatttttgctagaaagaaatgtaccaaaagctattggttaaatgtgtatcattaaccaattagtggcaaactgtgtttttccaagacggctgcaataagacttttgaccccacatactcttctaaaatgtaatattgatgctgctcccaggaagagtatcagtgtcaaaagggtagaaaaaaaatctatccctcggtttgggcaggtccaagactggcaaatggaaaggctttcaaggcaaagtgatacagcttctgcctagccctcttatgaaggcttgctccggactccactacactgtagaaagtcaaggtcacac

SEQ ID NO: 33284 - DNA, 2012 bp, Bovine  19866880870233
aatgattatgtctgaggtatgagcagagatgctttcaaagattaccccatgaactaaagttgataaaattctcaaaattccattcatgaaaggtgcagtaaaaagctgtctagcaataggaaaatttccctcataagggaaatacaagcttaaaacacatatagaagagtatatgcagcagtatgattccatttttgtttaaaaaaaataatacacacacagaaaagttctgagggaacaaaacattaacaccagataatagcacatacacaatttttattttctcctttatacttttttgtactttctgaacttcctgcagtatgtagtatccttataacaaaaggaaaatattataagctgtccatacaaagatttttaaacctagaagaaacccaccttaatccaaaacactcagctatcgtcagagagagcaaaacaactgctcaaaggtcacacagcaaattattctcgtgactctgagtctaggactctttacatgatgcctgtctctcaagatctttgactgtcttcccagaaaaatcaatgttctctttttctttgaaagtttccccaaaatgacacaggcataattacaccttcctctgtcaacattcttaacatttacttcccgtgagccgatcagtaaggtatttaaataaataccatacaagcagagttgttctgtacttatttccctagttaatctaaaaacagataagatcaacatagtctatttacaatgctcttaatccacaccctttccaccttcccacctgaatatacttcattcacctgtttctcctggtctccaaaagattctaatctaaatggtgttgggtggcactttataaaaagcatatgtgtttgaaagatgaagtattatggaataaactctgtgccaagaatgttgaacctgattcaacaccacctgaaaaagccctgatctaagattcctttgttttggtattgtgtcaagtatattgtggattgttgagaaggcactgcagtggaaactttgaattaaagagttctactgatggagcaatgtaaagtgaaatctacttgaaattctgatagatgaagagctgaactggaaagaacatgggcatgttatcagaccacagcaaggccagaagactggcagcttagagaattaaagaacaattaaaggacaagcccagggtacagtaaggaaacacaattaaagaaaccaataggagcagaggaagactcctaggagagggaaaacacgcacaggaaggacagtaagagactgcatgcaatgttcttacgcatgacaggcaatggggcaactttaatcaatgtgcctcttaacttcaaaaaaggaaagggacaaatgtcaccagcagcaccaccacttctacccaatgccaacacagttgaggtcattaaagaacatttagttgttttttaatcagaacattatgtgtgaagtcaatggcaggacaagggttgtttggaacccccagctaaagaaattcaggttggtatacctatggagttcagcccctcaaacttcaatgtgcagagagacccctggaggttgtgaaaatgcagattctagtatggtaggtctagggtgggccccaaaattctgcattttgtataagttccaaggagatgactctgatatgctagtctgcagaccacacttgcaaagatgtaagtatcttctgagtaagaaaacaaaaatcagtaatactgcagctttcaataataacatgaaaaatgactatttattcaagtcatactatgtgccactttgtaaactgtatctaacttaattctcctaacacctaacagagttttatgaagtctacctaatgattatggaagctgatattcaggaaatttaagttgtttccataccttcaaacagctaataacaatactttaaatccaattttgtctaacttcatttgtcaataagctatagcaatgagattaatagaattattagttttggggatccttggaaagctccccaa

SEQ ID NO: 33285 - DNA, 1565 bp, Bovine  19866880871594
aggcccataagtgctgaaggccttaaaacccataaaattaacttttactttaaaaatgcaacattcttcataaagtactcacaaagcaaaaaacactcagcagacattgaaagctaagacagagacagaccccagaagccaactgcggaaggaattatcaatcgtgttatgacagatggagtttcatcgggaaaaatcactcagagtttggcttgtgggataccctggagatttcacacaggactaaagtatggaaataaaaaaggaggtgtctcatacctcccaccctcattaagtctaatcctccctagagacctgcagtaacacaaaaagctgggataatccaggtcctaccgagtggtctttcctcaacttccctctctcctccatccctcagacacatgcccaggacaacagataacactgtgtgttctgggacccaactgcccccgacaaaacccactaggacctgggtcagagacacactgtgtccagggatcagtgtgtgtaaagagttcactttgcattttccacattgttcaaatgcactagaaatccaggtagttaaaaggaggaaatccaggtagtcaaaaggaggaacatgaatggcagtaactcaagtgtatgctatccacaggctgtcctccaggacagaatatcaggattgaggggaagcagttcgaagtgtacacaccttggtctgtgccctggccattctgatatgacctaagggtaagagattggatgattttgcacaacttcccaggtgatttgcatataactcctggctcaacacggggcttccttggtggttcaaaaggtaaagaatctgcctgcaatgcaggaaacctgggttcaatcgctgggtcaggaagatccccctgaagaagggaatggcaacccactccagtattcttgcctggaaaattccatggactgagaagcctggcaggttaaagtccaaagagttggatatgactgagtgacaaacactttcactttcataggtaaagaagatcaaatcaaacttttcacagtctgatagttttattttaaagtttaagtggacatcttaagaactctctctttaataagcccataacagaaagagtcgtatatttttaatcagccttttgaacttaggtgaaatgcaaattagactatataggttgtcagcaaacattgaaatccagcatggtgctgccatccataaaatttttaacaaaggcaaggtatgtaaattttgtttgtgtcaggaaatataaaggacaaattttttaaaatctcaagtgggttaggtaaatcacatacctaaaacatgcagaactttcctttgctcttttaccccatctttttacctgcagatttttacctggttctatacacgtttcctggtaatctagacagcaatttccaaggtcaacacaagcagcatcacagcggcagtttccaaatgttctctcaaaacagcgacccttgcaacttttaactgaaaatatcgaatgagttagatgtttctaatcattatataattacaaagcaaatatcaactaatatatcctaag

SEQ ID NO: 33286 - DNA, 1585 bp, Bovine  19866880928005
ttgccacaagatggcgcaagtccagttcagcttggttgtcttgcaacaagcagaggctaaggcaagttagaagtgaaaagagccccctcagagaagataaagcagaggcatggagcagtctgtgggggaggtggtggtgttggagtcggggtgaggaagtgctggtaggtttatttacaaatagggaaacttgggacctgcctgtggtattttctccagaggccgagtttctccctcttttcaggacagagttgcttcttgcacctcttcctcctaacatgaatctttgttttcctttctaaacctccctcagagatgcctttctggtctttagaagtgaccacacaatgtatacaccctacagagtgcaaggtttcttcttcagtcataacacatttttgaagtcagttcatgaatattttcatagaccgtgaactgccccaggactgtaacctataaccagtgatccaaacagtttccactgatcaggtattctgcctttaatccacattcctcccttcttcgcttgagggaactgggagagtatgtggaagggtagttacatcaaaggaacgttccacaggcttcagcttgacgtctttggaagagcatccaggtgtttcaacattttccatctgcgttgtcaactagcattgccagagcagggcaacccctgaggaagtcaacctggaggatcccctgtggggtattggttttccttttccagagaaagatctaagggtgagacaaagtcctgctgttatgactgagtcacattctttgaggtggttggcgttcctactgatgtgtatagttgagatttagaagcctaaaacagcacttagaaaacttcattttttctggtagacattactcactctcatagcaagtgttcctccgttagattattattaagtggggatattcccccaaaataattaatacataatttttgagtgaatgaggtgcctcataaatacacatatgtctcgtctcagttcaaagctagtgtttgaccagtcttgggtgcttttggtcctggtaatcaatacagtggttcttgccatcctgtgagcttttccctgtaacttaaatggcaagtacagcaagataaacaccaaaagaaaagctggtcaaagtcctcctgctgttttaaagagaaggtctgttacatttagaaaatgtctctgcaggaagtagaatttaagatggatcatggatatggagcatgtgcagagactcagttccaggctttcaatcatgatgttaataaaggccaacattcactgaatgctcagtatgagctaagcatggtgctgcggatgccacacatttactcttcacagcaaccccatgaattaggtacttccatttcctttattttatagagaagatgatcgtggcacagaaaggtcaaacaacccatctgaaatcacatatctgctaaatggttgagaaaggatatgaaagcttccaggccacgttacataacccagtctcttaccacacagtacaagctctgtttggaactctacagataaacgtaattgtacaggaatgaggtaaacaagcttattgctttagt

SEQ ID NO: 33287 - DNA, 1568 bp, Bovine  19866880972746
cttcctcctctgcaaaacagtgtaagtattaccagtacttagcacagtggctggaacattaagaccaatcaacccatatttgttttctaaaatcagtatttttaaagcactttcagaataacattgaaaagacaagaatcattgtctccattttgcaggtccatatagtcaaagctgtggtttttccagtagtcatagatgtcagagctggatcataaagaaagctgagagccgaagaattgatgcttttgaactctgttgctggagaagactcttgagagtcccttggatagcaaggagatcaaaccagtcaatcctaaaggaaatgaacactgaatattcattggaaggactggtgctgaagctgaagctccaatattttggccacttgatgagaagagcagactcactggaaaagatcctgatgctgggaaagactgaaggcaggaggagaaggggacgacagaggatgagatggttggatggcatcatggactcagtgggatgagtttgagcaaaatcagggaaatagtgaaggacagggaagcctggcgtgttgcacttcatggggtcacaaagaatcagatatgacttagaacaacaaacaaacatacactgataccaatatcataaaacgtgagagaagcatattcaataacagcataataaataacaccgtatttattgatgtggtgaaaaactgtgttgtttccattcaaaagaactaattttgccttgaagttatgatgttaagatcagctatcatggagaaaatatccaatttcatgaataaagatagatttggaaatttttaataacagaaatactcttctttggagagtggtttcaaagcagtattttttcaaatctcaggcaataaatgaataaactctctcttgagatccttaccaggtccgtgattctataaaatagggaactaagtgatacaaacctcttgtgtaaagaagcccacacataatacatacttgtaaagtactggggaaacatgactgatgttgacaatgggaatggacgtccagcaacctcagtagtcaagccaccctacagtgactagaactcttagggaagacctctcatttccacaagaactgaaaggccagcactctcttccgaggaactgtctgcagcttttctttaaagaactaaatgcttgtatgcatgtgtgtgcaattaagaggtagccttggtttctattttggagggcatgacgcaactacccagagttttaacataagtaaaactgtaagttcatgactgggggtaaagctacacaatagtatcattcaagataaaatcagtgaccccatttaggtagtgaaagccacaatctacagtccctttcaatatttcacatgaggggctttggtgtggtatggtgaaggcattctctgatcaaaaaatgcagttaccctgacaacaagtaaccgctgggattctgcattctaatctaacataaccagactatggatttaaagttcagccggcagctgctagccggctgtagcccagacagatgttggctggagcatcgaggattatttgccaca

SEQ ID NO: 33288 - DNA, 1044 bp, Bovine  19866881052597
ggaaaaattatggcaggcaggaaatgtaacagattttcaaattctagtagaaatagtttctagagaacaattgccactgttttttttcttttatatatgcatgtgtatttcaaaagtttgataattactactttgatagtgtgaaacacatgctttacttgttgacataagttatttctgttatcactaatcaagtacaataggctgactattaatttcctcagtgcttatttatttaggaatgtaagcttgaacattttgctgaaatccattcacataccatgtattttctgctgtcatagaaaaaggtcataacagacttcaaacagagggaagtttttgtttccaaaataaagtagtaatcaataaaattaaaagaaacaagacagaaaatgtgatataaaatattgatcaatactttcctttcctattttctctcttctcatggttttggttatacttccttcaccgtatttataccagactcccatagagataaacatttaaaaaaaagacctgtggtctccgcccaggacaaggctgatccttccagtcttcttgacttctgccaccacatcagccagcttttcacttgcttttcccacacaccttggattcttcacaatttgaaagggactgtcatcaagattatcagcaaaggacaggtccccataatctttcacatcacactctataattaaaagttttaggttagtaagtgaagtagctcagttgtgtctgactcttttcgaccccatggactgtagcctaccaggctcctcaatccatgggattttccaggcaatcgcactggagtggataggccagttccttctccaaggggatcttcccaaccttaggggatcgaacccgggtctcccgcattgtagacagacactttaccgtctgagccaccggggaagttaggttagtaaaggtgattataaaacagactttaggataattccaattttaccaaataggtgtatttgcaaaaaaaaaaaaaagaacctggaatggctgtaaaatctcatgaaagtaaaa

SEQ ID NO: 33289 - DNA, 696 bp, Bovine  19866881090388
aatgagttttaaataagtatgtcttctgttcgtggaacatctattcttgttctgatttaaatgactggattaatgattattatttctaatgttttctatgttgccattgattgaaactacttgcaatgttcaaatcagagttaaataagcaatgcatataaagagtctaccataaagcttcgaggcattttaaaggcactctaacatttgttttgtttaaaaggaagaaagaaaggacattttgaaggatttcagaggcaaaaatttgagccattttaataattttcaagctcactgcactctgcaaacccaatattacctccaatttgtgatattacaatggaaattatagagcacaagtcagacctggaaagaaagatacagaaaattacttaacatatcaaaaggaatccacgtttactctaattttcttctcggttatgctgacaatctctctcattttggaatgccttccatagatttgtaaaaggccatagacggacataaatggcccagtagagggttaagttgaaaccaaaacattgctcaaaataatcccagtgaaaaaaactatggcaatccttcatttgatgatatgcttccttgtagtgtatttttaattattctaggataaaaagaaatttcaggtgaatttaaaaatccaaggtagcagagactacagctttccatcttttt

SEQ ID NO: 33290 - DNA, 832 bp, Bovine  19866881096563
ggcacctgagtagactgaggtgctggagacccactgctgacggcttgcggaggcacggcagccggttccatcttgctaatgtgagtgatgaatcgaagacggagttttaaagccggttttaaattacagataatcttttctacctaaaaaacaaaagcacattaaaacatattttcaccagagaagttcaatttcccacttttaaagaagtgacttacacatttcctgagacaataaaccagggagtagaacaggtggatgagaagtttctctcatattttgtgttttaacaaaagcagataaaactatttctttcttacctgaaaaaagcatgtgttgtccctcacacactattatatatatgtacatttgtgtatgtgtatctatctatatatgcatacacttaacagaaacatactcactgacctagacagccagtcaccctcctgccaaaagctagtagtttacactgggggttctacacatccaccaagggactcatccttttaaaaccccatctttatgcaaagcaccattatatttcaaagatctttgaataactcaggttcaaaacatttacctatacagttaactttttttggttttgatttacacctggaatgcaaactaaatcatattagacttactcttacttaaaatgctttaaagaaataaatacatcaagtagttccatagctttcttagctttacttatatattcttggatcctactagggaaaggatcggtccattaaaaatccttcctttctgtattcccttgtgtcaaagtttcttaggctcaaatataaggaatatgctaaaaaaaacattt

SEQ ID NO: 33291 - DNA, 873 bp, Bovine  19866881107970
aaaaataaattactttttgaaagtcttacctgtcacggtactcttttgacactttaaatttaatagtgtatctatttactaatttggacaaatttatgataggtgatgttatcctattgcatagaagtatgaatagcagcattacttgtaatagtaaaaactagaaatgtgagtaattccttcaatgatggaaaaagtattagctcagtcatacaataaaatgaatgaggtaaaaatcatatatggaaatagcttcgtaatttactgacaaaataaacagaggctaaaacagtaacattagagctcattttattttaaaaactaaggacatacacatgtagaaataaacttgaaaggatacaaactgaactgctaaatttggttatgttgggaggtgggattgtggggtggacttattctttgtagtttatattatgcatctctctgttgagaggatgttttacataagcacatattctatttccctattcttgagctcagacaaaactcagagcaatataaataaattcaagaagataactcatcttaaaagatatgcaatgaggaatatgtagaatacatttcaactctcctgcatcaaagtcccctcacatttttttcagccaaattttaagagtgatctttaaatctttttcctcttaacaccagccaacaacaaaaatgtgtatgggtaaggaatatttttatatccccttgatgcgaaaattatgtctatatttcttgcctctttgttggtgatattaaatggaaactttaattcacaagatttaaaagtagactctgtggaacaactcaagtgtaaaaaccattagtggcaacagcctttgctaaatactgacatctggatggtgt

SEQ ID NO: 33292 - DNA, 1463 bp, Bovine  19866881142034
gtggcattgggcaatgggaggacagagagagaagagctacaggggagatggcagttcccccatggggtgggaacgtctgtcggtggcatctagacagcccctccctgggaaggaaaacagtacttggcaaagatctctctgcccctcccctcagttgataaaccagtggaaccaactgttctctgtgtgttcccatcacaatcagcagtgaccatgaagactaaagaccaaagggcccttcacgtaagacctggcctgaataagatactttggacctttcaataaccctggtgaaactaggggaagagaatctagtaacgaatgagattgaatttcccatcattacagaaggatggaggtttagaaatattacattttatttaaatgatgacagaaaattatatattttgcatcctgaaattaaggtatttggtggtgtgtgtgtgtttatattttgtgttccaaattatcaggaaattgcaaaccaaaagtcaattctaataatatttcaatagtttggaactatgaagatagttatccatgaaactatgtttatacatagaaaatagatcaccagacagccttcaaagatttcatttcatttaaaattaaaatcatttcatttaaaatgctatgtatctaaactggaaaatattattccaatatggtaattaaataaaagaaggaaaagttgggcacatttttgattattctttgttgtgaatgttggcacttgaggaaaagcagattgttgggagttaggttttgttctatctaatttgctcaagaaagtaggaacaactttcagcttagatggttagagcgctagtcgccagatggtgacattgacccatcactgtttggttgccatttcaggaaggtcatggaaacatcgtccctggggagtatggcagggcacggatctcaggggcaagaggcaaccattaccaggtgtcctgcagaaggcaagtctgacacgcagtcctctcgggaacttcgtatgcccccttttgctccatgagctgggaggccacttgctgttggtccatcacagttgcacacggtgctgcacttccatcgtgctgagctttcgggatagctttatacaaagacagtgtgggcggccattctgctgtgtgatttgagacacattaggccagaaccttgccgaaaaaaaatccaccctcactaaccctgcagcgtataaggtagaggtattaatgtctttggatgagggtccctgataaaatgcacatatcttctgggaaggtaatcccttttggaagaatttgcattagtatcttactttcacatagaatggaaataggaaaacatgcatttgttagatgattaaatattaacaatggatattttatagggaaatttttcttctcagttaaaaatagaataaaaattactaattacacgtcatgcagactctttttccgtctaaacaatgttaa

SEQ ID NO: 33293 - DNA, 690 bp, Bovine  19866881160380
atttgaaaagaccctgatgctgggaaagattgagggcaagaggagaaggggctgacagaggatgagatggttggatgacatcaccgactcaatggacatgagtttgagtaggctccgggagttggtattggacagggaggcctggcatgcttcagctcatgggattgcaaagagttggactcgactgagcaactgaactgaactgaatgtctgcactcggatttcttacagagttcatacgtacaaccacatctcaataatgcaaaggacagactataggaatctctattactaaaaaaatgtaaaaatttagaagaaaaaaacagaaaaattttccagctcattagcagccacaaaagtgactaaagaaaatgggcaaccccatgagtaggattagttaccatatttgctcactcttccaagtgcactgcccatatacagctcctggctaggggaatgaacttgtcatagtttactccaaatcctgtgcttttataatttggggactatggagttttaaagaacagagtacttcatacaagcactaaatggtctgtgaaaagcaccatcattcttgcaaatccagtatgctgtctgagcaatagggtttatgaccctagagagattaacaaatgacttcaaatgccaaagacttatcctcatctgtcttgggaaatcctttacaagaag

SEQ ID NO: 33294 - DNA, 623 bp, Bovine  19866881198019
tggaggtatgctgtctgccttgaatctgaaaagcaagagcagaaacaaagccctgagtgtgtgattgaagagcaggactgcggccaagcttgctcagcccctgcacttctgcaggggttagaagggtgggagagggggaacggatgctgaagttgtccattgggcagtcagaatcctagggattcccaggaacgtggagaaagggtcagacacacctttgagaaagaagagataaaacatgctctgttggatttcattttgaagctttcatcccaccttattcctttttcatcccaactttagttttacaataaacttccttctttgaaggaagtgggatcaggagttttggggcatctacgtaatcactgaaaaattctcagacttaacaaaagacaactgaatttgtggatatctgtctgttccttcctttcatgttatctgttgtggattcaggtaagatgcagtatctgttttccctgaagattaaaacaaagtgggacttaccgaccactctgcattgtctgtcttggaacatctcacgttgaccggcaggctaaggacaagcttattgaaggcaagaccttcctttttagtccatttaaacttgttcattgcatcca

SEQ ID NO: 33295 - DNA, 2527 bp, Bovine  19866881237367
tgagagctcatttttgttttttcaggagtttttctctgtttttttttaatgcctgagtttttggtctaaattgtggcaattttgtgtatccacttgtggatcaatgattttattcttaatactattttattaggctttttatttagttacctagtctttaatacacatgattttaatagctaaatgctggccctcttataagtggaccaaagatcacttaccgaatccaagttggttattgccaatttttaattcaatcatcaatccctaatttcatttcaagttacattgtgacagacatctgcatgaatataacttgatgcaagcaattactgggtctgtttttctaatatttattatttatcttttattggctgcaccagatcatcattgcagtgtgcaggatatttagttgcagcgtgcaaactcttagtggcctcatgtgggatctagttccctgaccagggatagaaccccaggccctttcactgggagtgtggagtccctcatgtgggatctagttccctgaccagggatagaaccccaggccctttcactgggagtgtggagtcttagtcactagatcaccaggaaagtctctactgggcctaaatttaatttgcattttgtgtattattagttaaagttttcctatattgatcactaattccagttgactcttctattttttcagaaacttttcctcaatgaagtattaaggagcttagagtgtttcccatcaaaacatattaactctttacattgtgaaaatactatgtattcacatactaatttactctgtgtggtaatagatgttaactagacttattgtggtgatcattttacaatatttgaatcattatgctatacatctgaaatgaatatgtttgtatctcaacttcttaaaagttaaaatattgattcttcgtcatgttagcagcaattatattgtttcttgcatatagtttacaacaagtctttgtgaggctgttcttttgctcttctgaaattcttaattaccccagaacctaaagttggcaaccagaaatctagatcatcgggtttcagtattcacctactgatggaaactggtttgtcatgatggttgctgagtttgacatctataatctgttacaaattagaaatacagcttttgatcattgtttctttaaaaaataaattctaacaaattcaaagttcttctataatattgttcctcatcttcgagtgttctttcttaagagcaatcaatgagcagagttccagttaagtcacatggtgacaggatatagccagtaaaatcaaagccacgaaaaccaatggacgtggtgactgtgaaatactgtagtgtttttccatatgcaattcatgttttgtatgtatctcagacaaagaagggaagaaagactgagttaaatcataatatatcctaaggctggatcaatgagtaactcaggaaaagaaggcttaacacagaaacacttgctacaatttaaaatagccattctgatccctttttgtctcctatgtgctttattttgtacgtgtgtcttaagtcgcttcagtcatgtccagctctttgcgaccccatggactgtagcccaccaggctcctctgtccatggtattctccaggcaagaataggagtggtttgccattcccttctccaggggatcttcctgatccaggaatcgaacgtgcatctcttgtgtctcctgcattgacaggtagattctttaccattgtgccacttaggaagcccatttaaaatattacacagattcaaaacatgtggtgaaatcagattcctgcctacagagctaatggtactctaaggaagttggtctctacatatttaataattttatttattcacttttggctgtgttgggtcttcttttgggcttttctctacttgtacaagcaggagctactctctagttgcagagcgcaggcttctctttgtggtggcttatcttgttgtggaacatggggtctagggtgcacaggcttcagtagtgtggcacataggtttagttgttctgctgcacgtgggattttcccagatcagggattgaagctgtgtcttctgcattggaagatagattcttcaccacccagccaccaaggaagccctctacgcgtttttgatcatgtactatgaccaccaaaaatacgcactattgtcaatctccatgttaaatactaggaaagtttgagttctggggggaggagccaagatggcggaggagtaggacggggagaacactttctcccccacaaattcatcaaaagagcatttaaacgtcgagtaaattccacaaaacaacttctgaatgccggcagaggacatcaggcacccagaaaagcaacccaactcttcgaaaggagtgcgactgaacaagtgagcctaaaaaaaaaaagtttcccccaccgtcccctttgtgtcagggcggaagccagacactgaagagaccagcaaacagaagaagttataacagagggaaacgcctggaagctacgggca

SEQ ID NO: 33296 - DNA, 1370 bp, Bovine  19866881272819
ctggcaacctagtaacagtcatttcatatacagaagtgctagatagcatataaaagatcaaggaaattatcatgcccaggaagattcatgtgattataataacaggataaggtcaaggaaatttattatgaaagatgattgttaaaagtattatgagaaaaattagacacacaaacctcacagcctgccactgtcgatccaccaaaagattgactttgtcaattctgacatttttggcaaaatgtaggcgttttggcaaatcaggactcaaatagggcttgaaatgctgatcaggttttcggcactgaaaaagaggtaaattatttcttcatgacacctataaaatgggaaaactatgcataaatgtaatggatttccaaatctctttgcacctctgggattattaggcatttgcccttcctcatctcaccaacaggacttcttaagggaaaacagtgtgtggatttagagtctgtatattaaaaattcactacaccgcccctccatcagcatggctacactacaggtaaaccctcactagcaggggtaagaggacccctcatgcttattcaagatcaggatattaggtgtaagagaaaaaaggagtgattaacataaaggcatttctgcttaagcagtcattcctacttcaaatttgcagtgtgtcccaggttatagtaactattctttccctagtgtttctttatcttcaatcactcgcattttattctgtttttactataattgcatattacctatatgtaaataaatctagccccaccccaagcaatggtaaacttataaatccatataaatagatatatatttgcaaatatactttaaacacagaattattaaaaccactacacactctccagaattggtgaacttcaccttgaaaaatcccaattgctttgagctatctagaatttgccctgcttttacaacctgagatgcaagagccaattaaaagcagtttcaattatatttaaagaaatgactgctcttaactgtataaaaagatctataaaatccatgatttgctatttcctgatattaaatcatacaaaaaatgtgaaaaatggtgttgcccaaaactcagtagcctagatcctttgaatgaaacatcagcccattcaatttagaagtcagtgaaactggtaccaaaacaaatttcctatagtggtgtcaatttcaaaacaaaaacagctaaagtaaaagcaactgacaggaatataaaaaattgttgactgaggtttaagaaataaattacaaatggtttggactagaaaatatagaatacaattttcttgaaacccagattaaagacattgcattaatctaaatatatgtattagggaggcagtata

SEQ ID NO: 33297 - DNA, 1050 bp, Bovine  19866881300748
tcgtattatgattgttgtttgttgctattcagtcgctaagtcctgtctgactctttctgtgaccccagggactgtagcctgtcaggatcctctgtccctgggatttctcaggcaagaatactggggtaagttgccattttctcctccaggggttcttccccacccagggatcaaacctgggtttcctgtgtcgcctgtgtctcctgcattgataggcagactctttaccatctgagccaccagggaagcccaatattatgactacctaccatttttcatcacactttactgtaacatatcatgatcatacgttactgtaacagagagaaaaggattactgacctctctggtgttatgactcagatagctttctggaatactaatagtgctggacgagaccttgctcctggagcagctagcgccacgacaggagggtctgcagctgtggaaggagcacattccgttccttccttgatcagccagattaaacaagagcagggctcccctcatctctgcagctgtgttccagccgggactggagaggtgcccctgacacatggtgtttcctactaagaaaagtgctaaaattacccagaagttcctcaaatcctggcacgagggaggccacacagtcagcacggctcccctctccttttcagcagttttccttgctatttttggagcaagttacctgtggcattttggaggatttatcattgttgtgtcttaaacctgtaactctctagtaatgaccaaatggtggaaatttcagcaaacgcagtttttgactatctgaattcctccacatgcacacctggcatttgcaacctgagtcctaggaaacctcatgaaataaagtctcctgacgggggtgtgtgcatctattgggccccatcttcaggattgcctctttggggcttccctggtggcttagataggaaagaatgtgcctgcaatgcaggagacccaggttcaatccctgagtcgggaagatcccctggagatgggaatggcaacccactccagtattctgccggagaatcccaggac

SEQ ID NO: 33298 - DNA, 937 bp, Bovine  19866881320326
aatttaaaattaaagctgcataatgtttgacttctaagagggaagaacatagctttaactttaaggtctttttttttctaatagaggaagtttccatttcagtatcaaataagtaccacacattgaaaaacagacattgaatatttagatatacatctgtatataaagctagtgtaaaccagtggtgactacttttagatcacacactgctttgtttgctctcttgtcataatatgtgattcctggaaatccaggattttcatattttgaattagattgcaaaattaatactgttatcaccatttcatatatctttaaaatgatctttgttcaagaaataaataacagaattttctactgtgtacttccctctgtcattctggaacaatgatgtctgtagtaaaagttaatgggaagcctgttttaggtgagacctgaaaactaattttttatgaaactcatcctctgtgataatataacatgatgcagctttaatggactaaacctagccttaactttctaagttcaacttcattccatgcttcttggcctctttgttacaatgaatacccattaactggtaacttctgaaactaactgggaggcttttggaatactgtatttaatctctgccctacagcacaagcagcgctgccctgtgctggaggaccagttggtggatctggtggtttatgccatggagcgatctgagaccgaggagaagtttgatgatgggggaacgagccaactcctctggcagcatctctcgagtcagctcattttctttgtgcttttccagtttgcaagtttcccacatatggtcctttctcttcatcagaaggtaagtacacaccctttttcagagccacttcacctgttgattagtatattttagacgggtgtatctagtgaacgcaagttccaagctctgatttct

SEQ ID NO: 33299 - DNA, 3556 bp, Bovine  19866881462920
ccgtatgaactgggatctgtaaacaattagtgatctctggtaaattcattgatagaaaattttaggaatatgtccaatttgtattgagtagacttgtaggttgttctttaatgcacagctccagaatggtaagaaatgtttgactttgaaagctaggattttaatttcacacaagatatctttggggggccaaaatatgaaattaactttcaggggatatgtttccctctgaaaatattgagaaaggaacagttctcttttctgggtgacttagtcacctgcttaaggtcagactcagtgaatcttatgaggtgactttcagtccaattattctgtttttatatggggttcagtaatcaggctgttatgagggtttctctctagacttccctttttagaggccttatgaaggctttctttagttttccctccctctacctaatactatttcttggggaatggatagcattttgacctcagaactgactgacagtttccagggtctcttgtggttaagaagatcttgctacggtgggccaggcccaggcctccacaaagaggtagaccataaagaaggctgagaaccaaagaagtgatgcttttcaactgtggtgttggagaagactcttgagagtcccttggacttcaacgggatcaacccagtcaatcctaaaggaaataaatcctgaatattcattggaaggactaatgctgaaactaaagctccaatactttggccacctgctgcaaagagccgattcattagaaaaaaatccctcatgttgggaaatattaaaggcaggataagaaggggacaacagaaggtgagatggttgggtggcatcaccaagtcaatggacatgagtttgagcaagttccagaagatggtgaaggacaaggatgcctggtgtgctacagtccacggtacgcaaagaatcagacatgaccgagcatctgaacgacaacaacaaagtagtatccatttactattctataaatagtggaattctattctataaataggccaaattctataaaggacataacatcctagtattacctagggagttcacaatccacactactgctggctggaagagctagaagctgtcacctgataattttctgcatttgaaggtaatccaatgaaaaactccatcctatcaagactgttaatccaaccagcaatgcctccttgagaacagtcattcaggtgacatttttaccattgcaatgatagcattaaggggctacagtacagaaaacaaatcaatcctaaaaatgccacagattccaagagaatcagagtgcttgcttattcaccacctgacaatcatagtctatgacggcctagagcttgtcccttgggtcatgccttggaccattagctgcctatgtccctcaaattaacctatgaaaggggcattacactgctgaagcacaaggcaaatctgaatcaaatctcttttgagacccaaagtggaaaattctgaacccccacctcttctctcaactttttcccccttttaaatttctaggagattaacaaaaaaggttttttattagtattatttcatgttgtccctctggctcttctctcccccttcacctccccaccaagtctaaaacactagggatctctggcctcaagggtgctagcctgttaccttagagactgtttctttacaaggcaatagagtacagagggcatgcctttgctgcttaccttggcaaccatgaactgctgaatgctgttctcatgaatgcaagtcattcactgccatctggacatgcccacaggtataaacattttttcatgaaaggaccagggaatacgcattgcatcaataaatctcttgaatgacaaacaaagccatcccatatgttggaaaagctatataacattaaaattaatataagtctcccatggcattacttccaggcaaggtcaaacattcagtttagatatcattcaggcttatcaggcaaacagcatgaatcaggttggggaatgaaatatgaagaagggggtggaaagaggctgtcactgtaaaacggaagaccattgagcttgacccaagaataaatacactatctcaaagagtctaggagagcttattcatttctcactagtatttctctagttggaaaccaagagtaggcttttttctcccccttggctcagtgaaataagataggcatttaccccattcaaaggcatgtttatgttcctcatagacaaaaattacagaagaaattcttaacatatttataaaagcacagaccttgtacttcattgagggtcagaggtggggaagagggtgtaacaagggctctcttatgttttcctataaacaaagttgctatgaaccttggaagtagtcatatttagccttaaacttcaattcttccaagtgtcaactttttaattcggatttgttataatttactgcaaaacactttaataatttactagtttctcatatatgatgtcctttatacatctatatcatgctcattcccccccacacacaccagggaaggaaaatatacagttctagccacactcaggcttatatgtgcccagtcatgtctggcactttgaaaccccatggatggtaatctgccaggctcctctgtctgtgggattttacaggcaagaacactggagtgagttgccatttccttctcttcacaagcttatataaccaaaataaaatttctcccatgaaccaagacttcccatggaaagagaagatggggagaaatcttagccaaaaaaactgttgggatattcttaatatgacaaaacaagggcacaaggaaggaaaagccgagactggtgggcacaggacaaacaggtgtcagggttttcctaattttgccacttttgaagatgatacatcttctaaaaatcattagggaccaatgaaataaccagggagagaggtaaatttctacaaaaattacatcactcctactaacaccccctgccacaaccactgattaatctggtctggtctcaaacatgacttgggatggaattgggaactctggaacaacacagcctcttgccataacacgaagtgatattttttttccttccttggcgataaagttttccagttccgtaaaaatctttgtttaccagatataaaaatgttcactttcaagctgtcaagttgaccttgagctttttcttctctcccttccccctccgccttttgcccttaaaagttcaggatgtctctagcagtaactgttacattctgtctagcaagcctggattgcggacagtgatctaagctctgggaaaaaacatggagttcacccaaaaattgagagagacatgctctcgccccagccgccagctcataggtttcaaagctctgggacagacctcatgaacagctcggggctctagcgtgtaaggtggcagcgccaatgcaaacacagaaagcacttcagcaggtataaacagcagccacacaccaggccaggccccagaaggcaggccataaagggaagaagccaggccaccagcccctgcctgcgt

SEQ ID NO: 33300 - DNA, 829 bp, Bovine  19866881520168
tagaatagttttactcacttgcatattcaaaaatgtattatcagagccatggaatcccccctcccccaatatttcctttctgaaggattcctaattgtcacataatacgaattaataatgcaaagtccactcataaagcaaaatcgacacccatgacattatttccattaataaagagcaactattttttgatagttaacaatttatttgtaaaaagtataccatttagcctaaagaaatgcttggaacgtagtagatgttcactaaatattagttctctcatgaggataaggaccttctcttctttcatattctttttctaaacactgaaagcacagttctctaataagggagagaccttgtaattctgttgactgaattctggtttactgtttaggttttgctggacagaggtatgtatttatcatctctggctttctggcttccaggagttaatgatcaagtttgagacattaacaatatgcacaatccaaataatttgctgaacataccaataaactgaggtttattgatggatttagtataacaagaatgaaaaaaacagctctgtctaatgaagatggtaattgctcattattataacataaagagcttttgccaatcatttgttagactttgaagctattattaggcataaccataacatgtagaaaagacacaaggcaagtggaacataagaaataatcaagatggatgtgaggggacagagcagtggttgttagctggaggtggccccctctcaccagggaattgcagcaatgcctgcacatatttttttgttgtcactactatagacagtactttttca

SEQ ID NO: 33301 - DNA, 1726 bp, Bovine  19866881582789
ggagattctcagggtcctgaacggattctaacaatactctctgtgggtataatgatagaataagagaggaaactgaggttcaaagaaaccaagtaactttctaacgttaccccctgctatcccctgaatgcttgtgtacccctaaaattcatatgttgatatcttaaaccagaaggtgatgctcttaggaagtgatggctttgggagataattaggtcatgaaagtggtgcccttataaatggtataaaagtgaaagtcactcagttgtgtctgactctgtgaccccatggacatatagtccatggaattctccaggccagaatactggagtgggtagccattccttctccaggggatcttcccgacccagggatcaaacccaggtctcctgcattgcagccagattctttactagctgaggcaccagggaagcccataaatgagatgagtgcccctatacaagagactccggagagattctttgcccattcttctgccatgtgagggcacaatgagaaatctgccttctagaaaaggaccctcatccaactatgctagaacattcatcttgggttttcagcctctgaaactgcaaggaataaatttctcttatttgtatgttacccggtctgcagcccagctggactaagacatcccccttatcaataccagtacattagtggagaatcctagctctttggtccccagtctcaaagcacctggcacacaggagcactcattaagtgcatattgagtgaaagactcagtcttctacgattgttacattgaagttcagagagcacagactcaaatttaaatccctggctactttgctacattatcatcattcttggatgacggttgttaggacccttgaataagaaaagaataattgaatatttctccaaatagtctcctttcacactgacactgtcattgtgcttaacaaacccacatactgtcaccatgacaacgtactgtccttagtcccattccgaccattaaacatactttataaatagaatattcggtttcattctatccaattttgccttaactttttttgtgtgataaagccagagttactaaacaatatactatgtttttgctttaaagctcaggctatggtgctctcatgaggttttgatttaatagttcacacaggtcatatgagacttgtgatgagcatttaacatttagaaactatatatttggttcttgtgacaagtagcaagaaacttttatctggtgggtgtaaaattaggagccagaaacaaaaataaacaaaaatgcctttccttccctggggacacttacagcacaacacataatttattcatgtgtatgatgcatgaatctgtacatttaaaattagagataatatggtcagatagtgtttccctcatttcgtctaacacaaatacgatgactattgatgctctcatatttgcagtttgttttacattttactctgagagtcgcatattatcctaatgctgaagggtttataacttgaaaaataacaagacagtcaaattagcaaaagaagagacagcacattaattccaatcagtgggttgtcttcctgtcttattttaaaatatatttggtaaagaagcagtttcctttacctcagttaataaaatatactccgggaaaattttcagaaaataaaaaacatttcggcctatttaattatattttattttcagtcttaatgattat

SEQ ID NO: 33302 - DNA, 1248 bp, Bovine  19866881702684
gctggctgcctaagccccgagaaaaagaatcaaatcttcttctgttcatttttatttttactttttaggtttctaggctttgggaatctgccagaaaaagcctgtgaacagccttaggagacctgtttgcagctccccctgggagttgttagccaagtttccaaatccgctcctcatcagtgagacctgtccattgggagtagctcaaagatactctttcaaccaagataattagcttagcaaaagggaggcattgtggcttggagagctcaccattgattacaggttgagataaagattgttctttcctttttccctcctgagaccttggatggtaaagcacttttgaccttgtgcagtagagatcatctttcccattgagaatactgtggggaggaatgagagggaggtggggaggagtgcgtgtccattgtaccacttcttggctctcctgttttccccatcagccttcacataacccacaggcatgtgacgctcaacggtcacatcaggggaaaaacatggccttcctaaggccaatgacggccctgaaggggttcagaatatgccacctcaaggtatgcctctttgacatactgatgattttgagttgaaagtacttgagaagcagcaggtacagatgaggccctctgatcttctctttctgtctaaaagcacagcataaaatttcccatgatggaggtgcccaccctgcaccaggaggagaacatgctcatcatcagagactgatgtatcaaccaaacctactgaattttctattacaggcttccttggtggctcagacagcaaagaatctgcctgcagtgcaggagacccgggtatgccctccgggtcgggaagatcccctgaagaaggaaatggcaactttactccagtattattgcctggggaatcccatggacagaagagcctagtgggctacagtccatagggtcacagagtcagacacaactgtgtgaataacactttcacttccatattttttaacggtctcacaatttgatgccctcccccaaatccctttgtcttatcacattcccacaatttatcattatttatttatttttttggccataccccaaagcatgaaacattttacttccctgatcagggattgaacctgcatctcctgctgtagaagtgcagagtcttaactgctggactgccaagggaagtccctgtcattttccttttgaagacactcatgaacacatgaaaatattaaat

SEQ ID NO: 33303 - DNA, 1657 bp, Bovine  19866881771391
taagaactgaagtgaagtctgtagaaatgcaccgtcaagcattgagtgaagcccctcctggagacaatgtgggcttcaatgtgaaaaatgtatctgtcaaagatgtttgtcatggcaatgtggctggtgacagcaaaaatgacccaccaatggaagcagctggcttcacagctcaggtgattatttggaaccatcgaggccaaatcagtgctggatatgcacctgtgctggactgtcacacagctcacgttgcttgcaagtttgctgagctgaagactgatcgtctttctgggaaaaagctggaagatggccctaaattcttgaaatgtggtgatgctgccatcgttgatatggttcctggcaagcccgtgtgtgtcgagagcttctctatcttccccagggctattttttgctgtggatgacatgagacagacagtcgctgtgggtgtcattaaagcagtggacaagaaggcagctggagctagcaaggtcaccaagtctgcccagaaagctcagaaggctaaatgaatattatccccaatacctgccaccccagtattaatcagtgttggaagaatggtctcagaactgtttgtctcaattggccatttaagtttagtagtaaaagactggttaatgacaacaatgcatcgtaaaaccttcagaaggaaaggagaatgtttttgtggtccatatgttttgtgtgtggaagtttaagttatttatttgtaaaatcagtactttttaatgaaaacaacttgaccaaaaatctgtcacagaatttgagacccattaaaaataagtttaatgaggaaaaaaaaaatgggcagattctttaccaaaggagatatatggatggcaaataagcatatgaaaaattgcacactatcataggaaaatacagattaaacgcacaattaaataaatgacatatctaatagaattgctaaaattaaacactaaaacagtggacaacaccaaatgatgatgaggctgcaaagatataagactcccctgtgttggaagatgtgagtgagtgtgattgacctctaccgtagagagctcaccagtcaggtacctgatattggtccttgttctagctgtcactctttgtgattctcagtgtggagtctctctggagtgggatagcttcaaccttctcttgtgtattttttgagctgagactttctccacactgtggcttatccattagtgtccactttctgtctcttaaaatttaatcaaaacttctagtcaaccaatgtacgcattctgtctacccctcagcattgcaaaaggaacagaactagacactcatgtcaacttagaccagaagttccatggactagatttgttctatgtactattcacacttctaaatatgatcgttgctttgaatgtattctcttgggagaacgtatactttttatagtgacaccattgctcaaaacattttttaatgtctttgattaaatgagtgaacaaggtagattttttaccctagaaaatgttgcactggagaaatataattcaaaacaaaatatcctacccacccagaaaacctctctacaaaagtaaaagagaaagaaaacacttggttttattattgaataagcattaaattagagtgtgatggacatcacaagcaatctgcaaa

SEQ ID NO: 33304 - DNA, 751 bp, Bovine  19866881816176
catattttcccacaactaattaaggctttatgtgtcctcaacgccaactctcctgctgacaatggtttaattgtggccagtggtagacaagcactcatgttgttttccaatatgggcaaatatttcacaaagttgcctgagttcatatgtatggttaatggtgacatcaatttcttaataggcacagtgttcatttatttgtgattttcatacagtgaacatactgtgaagcatattatgaaacaaatatgaagttattcattccttaaaataatttctgttgtttttgattttgagaggggcaatatgttcatggccagttttattagtcagttttcttttgaaaaatctaggtacctgggattatgtggtggtaaggagaatgtttatgtttctaatactttcccctgctgtcttgcattcctgaatttatatgagctttagcggaaaccagaggcagagagattttaagtgggctcagactaggagttcagtacaattctttttttgttattgttttaaaacgagcgtctttgtaacccaaagttcctgtcctttcactggtaccacagaacttcttgtgtatttctccctccatgtgacaggatggaattctagcaattttctgctttctaattcagaaattactctgttagtatgttgtggttcaagataattacatacaaggatgttttgagattcacataaaaaatgttgtaaatcagctctgtgttttaaaaatcagacttta

SEQ ID NO: 33305 - DNA, 1067 bp, Bovine  19866881987582
aaacccagtgtgcactgtgtacttctcagttcaattcagttgctcagtcgtgtccgactctctgcgaccccatggagttcagcgtgtgtacttttagcacatctcaattttcttaatctcatttcaagggctcaggagtcccatacatgctaccacaatagagtggatctaaatgatcctgggaagactccagacaaaattagaagatggcagcactttgtccttaatgctcttctcctctcttttccccagagagacaccttccttttccccctttcaaggacctgtcttctgcgattcaaattcttgctccaggaaaacaacagagcataggcatggaaatacattgcaatccaaggagccctggatttggaacctgcgatgccatttactagaccttgtgccgatgtgcatgcctgtgtgctaaatcgtttgtcgtgtctaactctttgtgactctatagactgtagcccgccaggctcctctgtctgtggaattctccaggcaaatacttgccatgtcctcctccaggagatcctcctgagccaaggatcgaacccacatctctttacatctcctgaactggcaggcaggttctttaccactagggccacctgggaagccctctagaccttgtagcacaacttaatttgaacttcagatgatattataaaagaaaaattttggtctttacattcattcaacataacagttatttagtgaaaatatttttaaagcaaagtttggaataaattataaatttggtttactttttataggccaagaagagtattggttttccaaaattggacaatctacaatctcactaaatatggcaatgaaaatcaacataaaaggagacatttgtggattattaacacttgtttaaacctcacagtttttcctacaaggtagacacatctaaatgctgtcacatgatagcagcttagttcagactatgaatcactgcccttccaaaaggaacaaaaatatacaattattaacttcccagaaagtgaacacaatattggcaaattcaataagctattcactgtaagtcagttaga

SEQ ID NO: 33306 - DNA, 1084 bp, Bovine  19866882030157
acctagtttgccttaatgttgaaatgctatttattctacgattgaatatcattgtagagcttctgctattctctgcccattttcatttcttgttgttgttaatttctagcctcctaaaattagttaataaatcaaaaatagctagaggccttcctaccaggaacgctttttgtttttaaatggtaggaaaacactgacagcatagtcacttagctgcaacagcataaggagaaaacacatccaaggcccatgtcacactccctttgaatggctccctaccgtgacacagctcagcctgccagagtttaggactatgaaactcatttcacattccattccaatcctctctgttcagcactcccttcagattcttgaaaccaagaagcctgtcacaattgatcccattctaaacacattttttccaagcaagtacactcgtatgtagagggtgtttgaaaattgatattatcaccctaaatcacagtgatcgcttttcctcttgggcccccttaactgtggtaggttattttcaagagctgcacaaagtacataagacaaatgagaatgagacaatgagaatgcggtatttggagtggaaagaggggattaacatggaggtagtatgaactggtaaaaggtagggcaaccctgcaactacatcagaggcagatcaagcaaatctttctccagacccatattataggacccatattataggacaactaaatgagatcaaaaccagctgaatgtaggggatggcgactttgcaatattaacacacatcaaacattatgcattcttcagggcatttcactggacccaaacaagattctattcctgagggtattttatagtagccactgaaaatgctcgtgatagtttgtatggtcagtgaactcgctttgaattcttagagtcctaattctctattgtcttatttagatagaaaaaccagttggaaagcaatacagtatatgcctctttatctggaatcaaaatacccagaaaagcaaaatgagttgagtggcaaaaacaatgataactgattatctacaatgataaccaaaggcactagtgagaatgt

SEQ ID NO: 33307 - DNA, 990 bp, Bovine  19866882036146
ggcctgagggaacagaaacctttcttaatagtctgctggcttcccattgttaattgaaaaagaaaaattattgcagtatagttgctttacaatgttgtgttacctactgctccttgaacacaccaggcacatgacttcacagcttcccccatctatctgcctgcctaatacctcatctcccccaaatctctatcagatatcactttctcaaggaggctaaccctaaccaccctatttattacttttagcaaactatcctccacattttcacaacacattgtcctggtccttttttattctgctttatttttttctttttatctatagtatttatctaacatataattttttttcatttaattttctcatttgttgtatctattttttattgtttttcttcctctctataaacttctcaagagtaggaatttgtcgattttgttcactgattatctaaagccatggaacaatgtctggaacctagcaggagctcaattaacattagttgaataaataggtttgatgagaagacctgaaataggcaggacatgtggttaatgaataggaaaaagtagttgtttccagaatcaagagacaacaagagaggaagacatttagtatcaaagtcattgaataaagatttgagtctaaatttttgttcttaatttgtggaaaactctgcttacatgctataagagcatgaagtcacaatctgaggggataattgatgatgaaatcatcagaataagcccattttctgagatgagatccagacagatcaggaggtaatatatgaatctattgccaaagtcagttgactggagtcactgtggacaatatttccggttttttctgtatcccagagtaacaggattaaccgtgccatcttccttttcttttgcccttaaattgctaatgtggccataacttataaaaatattcttgggcctaactgggaataaggactataatagaggcagaccaaattta

SEQ ID NO: 33308 - DNA, 1059 bp, Bovine  19866882051992
tagaatactgtattttagaatacaaagaaacacaattcttattgttttacagcatgactaagaacaaagaaacaaatttccagatcatttaaatgtatatactttcaaaggtattaggttcccctagataaagcattcttatttttattcatattaatttctaaaatagagaataaaatatctcaaaaagctttccaagaatgttatcttttacactctacttaagcattcattgccagtgacaaagctcacaaaacttattgtgtaaaaatagaacgagtgaatcagatgtatgtattagagcaattatgtattatttagcaatttagcctacatttgtgttttatctttcttgctttaactcacttgcctggatcaaaaacaaggaaatgttctagaaatgtgaaaagagagcatagtgtttgaattggtagactgttataatactgctcaaatgattcctgataagtagcatttacttgccttctacttctggtttgattctcccccagtaatactggatattagcaagactttcttattttctttataaaaaccttctttacattcatgctttattaggtcatgtcagttagtctccttaagttctaagatgtttttgtattcagtatcaaaacttcacatatcaccaacactttccctttcctcagctgaaaaacccaagacaggaggatatgacatgtgataacatggaaacacgtgagctgttggctacagttggtttctggaaggggcccagttgttttcaaggtattaaaatgttttctaccacgtggtatcaattattaagcatccccacattcaatccaggttttcggctggactctaagaataaaaatatgaataatatgaataaaacatagagcctcttatctcaagatgctcagcatctagtaaacagagacacactgaagatataattcaatatacgttgtgaacatcatgtattcactcacacactgggaccctgccaagccaggcactgtgatgatcatgctagcaggcaggaactcagaggaaaaggtctggcccaagagg

SEQ ID NO: 33309 - DNA, 736 bp, Bovine  19866882079801
acttataagatgtgatccagagagattcctgtatattttactttgtactctactctttatactactttatcttctactctacagctgatggtgacttgaggataaccaattcttattttaagccattattttcctcaattaactgtagattctaaagaagtcaccttttaactgctgttttcatctgctttcagctttgaaaagggacataaaagtagtacatctgcctctctgtccccttcacctcccccaccttagttgttttcttagatctaaaaccaccttcatgtgaagcagataatagtattattgacagcatttcaaaacggaaggatttgcaccaaaaaatgcttcacaccctaatggaatatctgtcatcaaactattttcacctaaaggtttcaaaacccttggagtatgaattatgcaatgatgtttgggttgaaaaaatatgccattttcaagaatattttaaatttctgagaaccttacagatttcaagctttatactagtctatgatacagctgtagagtgtaaatcatctacctttttgttttgttcatcatatggctctgttttttatcttcttgttgcttgagagtattaatgaaataacaaaatgaaaattgagttcttttatccttgaatctgataagatgccaaagccataatattgctgaaacacttaagcagtcatgcaaaactcataagaaattttaataattttcaaaaatt

SEQ ID NO: 33310 - DNA, 2063 bp, Bovine  19866880351679
tttcctctttataggcacaaagaagcattctcaggggctcacctgccccaagcactagctccacgagtcgccttaccttgccaggtgggtaaacggcattgtgtcataatcttaggtaatcacagtcatcagaaagaactgtttcttcatgagtttagcagttgataaggggacaactctggccccttgtgtatccagtcgaccctgtgttagcagaggtctttatctctgtcatcctcattgtaatgctcttccaaaaatggacatcatattcatagttggtctacaatctcctgctcacagatggaaagagcagaattgtgatcttccttaatgttcatctggacatgctgtacaagtgtttctttgagaggcagatggtgctaggggaggagtgtgaacctttggtgagagagacagacctgggttcaaatctcagctttatttcctcccttttaaagttcaccattatatcataagctttctcccaggttattaaatatttttaaaatatttaagtggttgactaacatttcatatgatgatactataatttatttgtatactgtatccatgggtaattgggtccaggacccccactcagatgtcaggatccatggatgctcaagtcaccctacaggttaaccctctgtatctgcaggttgctcatctgtagataaaaggaccaactgtattcatcaataatctggcatttatataacttgcttttttatcattaataactttacattctgatatataaatcttctgaatcggcaagtacggatttagggcagattcctgtatgtagaattactgactcaaagagtatgtatgtatttaggttcttgacccattattgtcaatatgacttccagaaaggtagtattattttgtacttttagcagtatttgacctttcaatgtgctcttgctaatactaacattagtacttcattaatttgataagaaaaattatatccatattgtgtttgcattatttcatcttttaaaaaactgttttctaatattaatgtatcttttatgttgcttctttggggaattgctgtacttcatccattcgtagaaggaaagtaccttgcattttagctcttcggaaataggaatcttttgcaatctttggcacgttacaattgaattagcagcactttttcttggttgtacatgaaataatagttcactttacaatcggtggcagcttagattaagtataatctatatctgtttgctttttcaacctctgccatgtccgcaaccccgtccaacaactgaaactcagtgtccactgagtagcccttgaactttcttgcctttgtcactctgcctgtaacactctttaggcttttcttccctggctaatttctttttgcagtctctccaaatcatctaggtagacttagtgctgatttataatgatttgcttattagtcctttaaccattaatcggtggctttttcaagggtgaggacagccttattcctttatgtcccagtgcccactcagacgacaagcatatattgtgtgctcattaatgcttaggaggctgggtgcactgttgtatgagtgagcattatccagtttaatttatgaatagatagaaagcaaccgtcccctaaagaaggctcatcttggtgtttggattgatataaactaaactaacgtacagctatacgactatactgactgctttttagtattgagtattagtattgaatagaccctgctctgtagtctctggaagtccatttcatcatgtccctatttgtggttattgtgctgtgagaattatagtaattaggaggcaaacagctctaaccccaacaacttcagtgtgtggtgatagtgtttgttcttctttgtaaaatcgtaatattcctgggtcaggtgggatctctaatgtcatcctggacccctgtgagaacaggcagagctgacctggttcccatctgttgaatggggacctattgctggcctgctgggtttctgagacctctgagtcagaggctcaggcaccttgtctttggctttagtttggcaatctaa

SEQ ID NO: 33311 - DNA, 1127 bp, Bovine  19866880440810
gccagtgcagctggagctggatgaatgaaggtgagagtggtagaaggtgagactgcaaaggccagaggaagcctctgggcccctctaaagatttggcttcaagtgggggagaggggaagccatgaacatttctgagcacagacaaaatacaatcgaattcatattttaaccagatgcctcaggatgctggattgacgactgtgtatagaatataaggtgtcaagagtgagagcacaggtgtcgtttaggccaagggagagatgaaggcagtttggaagtagtagtgggatcgccagaaagtggttagattctggatataattttaagacagtactgagaaaatttgcagacctttggtttctagagtgtgaaaaagaggagtcaagaattactctgaaataaatattcagttaacctttgttgaatggatgaataaatgaatgagtgagtgacatatagctatcaaacagcaggatcaggcttaaagcaaggttagtaggcccacaaaattctagttgtgattctcaactttttaaaatctgagagagagcctttctttagaaaaatgtacatatgtatgtatattccaaatttgtacacaatcttaggaggctcgagaacctcttgaaacccatccaggaatcccctgtgtgaagagagcctacatatcatcatataagcaactaacataaaacttgattttcaagatgcagtttgcttatacttttgcaaaaaataaaaatctctttataaagtacccactgcaatcttacaaaatagattcatacaacaggaagaagacacattgcacttctgtgttctatgtttgtaagtaatgattacaatacatattagtgggatatggcaaaaattttgaattcagtaacataaaaaatagtaattgggggccataaatcattcttaatattataaaaactaaagaaaatgacattttcttacaataagatcacagaagttaataaaacatcatttatttagtaatggctggaaatttaataactcagtctagtgacactggttttctcatgctggtagaagttttccttggcagatttaggtgcccttatttgataacaaattattaaaagaatttaataaatgcaatt

SEQ ID NO: 33312 - DNA, 3417 bp, Bovine  19866880478621
cctgtgatactttcctgtcacttgtgagggcccaaacctgttaccatggcaacaaaggggaagagtatctttaaaatcacatctaaatagcaaattgagatatttgaaagagggagtcgagtttaattttattagccaacagtagcccaaataaagtagcatagtgttttggtttttttaaaatagcatgttattttactggatagagcaggtttatttaattgaggccttcactgtgggccttaaaattaatctctttgaaggttaggatgagctttttttcaaccagattctttttttttcttctttttaagatttttctgatgtgaaacatttttaaaatctttattgaatttgttgcaatattttttctgttttgattttttggccttaatggatgcagaatcttagatccttgaccagggatcgaacctgcatcctctgcattggaaggcaaagccttaaccactggaccactagggaagaccttcagccagactcttgatcttcaggcacatagacacacaggaagcagcctatacagatgtcccaaaaaatctatgtacagagattatagctccccaacccaactcaaacatctgaacctgaggtctgatagatgcaagagtccttagtgggatgataaaataaatatttgaaatcaagtctattccagaaatcagaggactgtgattgctcacatatattaagcagacatatttcaaaaagaaacattaacctaggcaacacgccatggagctgccacacacaggtttataggcttttcttgaattgatgtattttctttagaaagaaggtaaattcagattctcccccacctttagtcatcctaaaaaaaactctccaatatggttcaggttacaatctatatcttcaccattagggttgatcagacttgtttggagccaggctaacagaaaggggattaaataacaaagacaacaagatttaattgatagagttaaagaaaaattaattggtgtgctatctttttcaagccattcgtatatattttatacagtatgaatggcacactgtgtcacatagatcgtaaaccaattaaaaccatacttctaaccctctaatttctataattccatctgttttagaaggttttaattagtgaagttacaaaagccaaatatatttgaatattttgaaagcaggctgaacagcaaaaacggaaaagttcccataaacatttacccacacaaccatgcacatttcatgagaatgtactttagattaaaatatgaatttttctaaactttaccaacaataaacacgtgcaaagaaaattatgatcatatgttaggctgtataaattaattcaggttttttttctgtttttcatcaagtttctagaatgatttcttctgatgaaaaccccatatctgtcgtttcatctcaactgtgggccacaaggagatagagctagaaaaaactaaaaacattgaacactctcccttaaatactctttccataggtttatgagagaggtttaccattttacaagtggaagggaatttttctcagaggtattaaaaaaacacattcagcctgccagtaatctatttttgagaaataaaagtatagggaagttacgtcatctttaaagactgaacacaaaatccaaagctacagagtaaagaactcaacccatttctctactgtgcaaggaacatgtgatttttcatttttaaagcaatgggtcaacatagaaggccttgctgttttctttggtttaaacgctgtgccgtgcagctgcgtgtggttgggggcctcatctggccacagtcaccggtgactgacagggaggggacaacgtgacgcacgaggtcctgtcccatcaaaatgctcgctttaccatgactgtgactcggtgggtgtccagctctgttcgtcctttcaattggatttctgacatgtaacgaggtgtaattaatatgcttgtctttttcattaccagaaatatgttgaatatagtttattattaattcagctcctaatccatactacctgaacaaactacttttgcttccatttgtactgtataatgtcaactgtggaaaatggctaataaggggaaaggggaatcaatttgactttgagtgtgcacgtcgtgctggaaaactaccctttattgaggatctaccatgtgatgcctgctttatgtgcatcatctctttaatccttgcatcgaccatccaagaaaagagtaattagccccatttgacacgtgaacataggaaaatccaaagaaatccaggcaatgtattacttgctcaagtaataaaaaagaaagaaatgaaaaactccaataacaagcacaggagtaaactttggagccagaaaacatacccagattgtttattttgccccgaagcttttaaggatgctaatgtacctggctactactaccatttttaaaagctcagcttggaaggccggaatacatccaacacctaatatttttattatgtgacagcatttactttaattataaaacatcaatactatctggacttcctatctttattcattttactgtattgttttaatttttactctcttatgaccttcctatctttaaaaggattatctttgccactctgatgtattttgagtttaaaaaaatgggaatcttcccaagaaagaggttaaatagattttgtttgtaaatagttcagcagttgcgggaggcatctgttccttttttgcctcacctgcgcttctctttctttggcttcatacttcctccccacctgccatggacctgtcgtcaggagacccacctccatcccctgccctttttcagagtcctgaagatggggaatgataatgtatgtcagagggaaaagtttctttctccttctaaatgatgattaataagggtctgcagagccactggggacatcttgtttctatgctgataaaaacaaacatactgagaagtaagggagaaagagatagaaggaagagagggggtggcgaaagtcagaaatcaatgttggctcagcttctctgaaacttagtgacaggagcctaaaagttctctcttagtctctctctttctttctctctctggctactttgacttggctaattatcctaatataggcatctgcaaaagtcagcagcattattgtgcaccagttgcaccaatttatattccttaattctgcagggttttttaattcaaaatttccaaagataactatggataatatctcaaaagatttatgtgtattgattttaaaggaagggtattccatgagcccatctttaattatctgtcattttttgtcattgattttatctaccaaatatttaataatcctgaggaatctttcattcaccacagcaatgtatcaatttggggtggatatatatata

SEQ ID NO: 33313 - DNA, 2867 bp, Bovine  19866880510954
cctaacaggctaaagcaggaggcctggcaagggagaattactagaagattccaggcctctccccaggatcaatcaagtctactctacaggggacaggtctgagcaagcaggctggcatgctggggcagtgtcaagcattggatggctcccttctcagcatccctgcccaagagcagcctcatgaactgtaggtaccatttcctgtggctggtactgtaggtaccatttcctaaggtttgtcttacggtgagccctcccaggtgggtttgcactcagaagttgatgcctttatgggcggatctctgctcctgagactgggcctcagcaaagcgggagggagtctggcatcaggaatgatggcagggttggggggaggctgtcatcttcctcctgtaggcactgtaagtctgcagagccctggtctagaggatcaaccctgtgtggccagctggtcatacccctgtctgctccccagcaagctgcacctccaccactaagaaacccaggatcttacttacctctccattcagaaagcaatagagaacagccaccacaaagccctaaggagagagaacaaacagaacctgagaatgctagcaaggaacctcccactcggggtgtgggaggcagcaggagccgggagtgacaccaggaagcagagaaataagtgaccgagatgcgagcacctgcccaggagcctgcagcaaagcagtcaaagttctgctccactgagatggccacacccctgaagccaagtggctggtggcggcattccctcccacccacaaccctggctttggatctcacattcccttggtcaaatccttcccattcccaagggccagctctgtcccactttctagaagaggccttccccacataccccaaagtgttcaggctcccaagccagcctgcaggccccctgagggcagcactccttcaggacagaacagccctgtctttatccaccaccacctccccaccccgttggccagacagcttcatacatggaacgtacggaacaccacgtggttcctgctacctagtaggtgtttggctcttctacatatattcttgacttatagtctgggcatttagaattcctgtgctgagagataggaacccaggctctgactcccagtctggggctttgccaataaacccctcagccttgccaggctaagaaccttatcaggtaaaacaactgagttaaaatgggaggagggagagaatcaagtcagataaacagaataacttctcaaccatcaaggtcaaatactcctctaatgagttgggcttggaagaggcactgtatcctagggacattcaaaggagccaaccttgccttccctgacccactcatgcacccatctgttcatgcactcactatgcatccttgcactgactcactctgcttcactcactcatttacagccctgtctgctgattccttcaagaacagacttactagtcctccagttttctcattccctggatcacttatttatgtaactgttcatccccctgttcagctcattcagctccctgggatcagatcctgtgctggggatctcgacctgggtaactcagagctccagcactcagagagggaagtcagatgtggagagagaggtctcttgaggacactccacccatccccagggctaatgctgagggacagggagctgctgtctgctgtctctgatggcccaagggaggcctggctcaggactcccagatgcaccagcaacacgaaagcaccggcatgtgttctcatggaagcctagagggcagagagtatgaagggccctcccaggtgtcttctaatctagtactgttattccagaaggggaaactcagagctgagtttaggttaacgacttaggaccaccaacaaggtagaggccagggacctggctccccacaagctcttccctacacacacacacacacacacacacacacacacacacacacacaccacgcctacctggaaggagcccagacccagctcaaacaccagtctctccctcttgctgacgttctccggggagaaagcaaagacagtgtagtggattccaaagagtgggatgagcagcaaggtggacctggcgagccgtctgtagggagagagcaagccgtctactccgggggccaccagggcctgaggccggagccgtgcagggcagagaactgcagtcccaaccgctcctctcccccagcaccggagcccctgcccatggacaccctcaggattctctcccagggcgtgggtcctagggaagatggtcaacagagccccagcttccagaactccctgggaagttctggggagacttccctcagtctgtggggtgcccatccctctaggccacacaggtgtcccgtggaaccactgaacgtgcacaggtgagtatgtgattgacagaaacctctctggggaggtatgaagccctctggaaaaatgaagtcagggcaaaatcctgcagtgggatttggacggacaacgtgatgcatcttcaagcaaaacaaatgtttttcactgaaaggaagctctctgtgcctggaaagggcagccctatgggaccacagagacagtcagcttctctgagtctggggctggccagggatgctcatgaagagtggtggggaggtgctgaccactgggaaggtgtgggcccagagggtagagcacaggagactcatgggagggatgctaggaaggatttactgaccctgaacgtaaacagccaccatccagcaggaggaacctgccacctgggaaactgcttcagaggtggtgaagaaggctgtctgcggggctgggagtggaaccgggaagagaaacggccctagggacctcacta

SEQ ID NO: 33314 - DNA, 1904 bp, Bovine  19866880513626
tctccttccctctgagtctttgcgtaggagcggggggtgctgctgtccacaggggtggttgatttcatggcaggtgagggtgactagaccagttattcttccttccagatactcattcatctattcaactgtccatctgtttgttactttatatccatctatatctttattcattcaactatccctgtatctatctacccatccatccgtatatccatccgtccactctattcaacattttgttgttgtttagttgctcagtcatgtccgactctttgcgaccccatggactgcagcatgccaggcctccctgtccatcaccaactcctggagcttgctcaaactcatgaccattaagttggtgatgccatctaaccatctcacaaattcagcatttactgagcacctattatgtgccaggctctgtgctcaatactgggggatgcagaaataaataaaatcagagaaacgggccatcaggccagtgataaagctttggaatgcttgctacggcaattacatatgacaatatgcctggcacatagtaatgtgatgaatatgtctactttgcatttttccaaagacctggcccaggtcacagcctgttgggggtgggggaaaaggtagtaggaagactacagacatccaaggccaagccagggtgatggggtcctttctctttgacctcacagggcttcattgttgctatcctgtactgcttcctcaaccaagaggtatgtgactcagactacccttattctttaagcctttcctcccaccactcctaagcctgcctctctcctgtccagcccctgtaaatcccacctcaggccataacttgagtcctgcaatcctttgtggaaatctgtcctgagtttctggatcaagcttaacctgaatacttcctgtgaacatcttttatccatccttcctctggtcttggccaagcttactatccattcatcatgaggtagaaaagcgcctctcagggattagaagagggatgtaggggctggggtgggggctaaaaggggtccttccattctgtattcctaaaattgaacattagagagagttacgggaaggagtaagtcagatcctagagagacagagagaagacacagaggaaacaataaagtctaaggtagacacacaaagtctaggaaaatagattcaggcgaaagacagggaagatgatggagagcagaggcaggggtgctgagagagagcacctggaagagatacgcaaaaagaacaaaccaaaaaggtgaacacacacgtgaacagacagaatgtccctgtcctgcccagtcatgtctgactctttcccttgggattcctttgtccatgggattttctaggcaagaatactggaatgtgttgccattcccttctccagaggatcttcctgacatagggatcaaacccaagtatcctgaattgcaggtagatttttttttggctgttttttgccactttattattatttttttgattgaaggataattgctttacagaattttgtttttttctgtcagacatcagcaagaatcagccataggtacacccatcaggcctccctcctgaaagtccctcccatctccctccccatcccaccttctaggttgtcacagagcccctgtttgagttccctgagtcatacagcaaattcccattggctacctattttacatacggtattgtaagtttccatgttactctctccatgcaggcagattctttactgtctgagccaccagtaaagtccctatagacagaatagatggtgccagtgcacttgtagaatcatggagagatggcagagaggagtaaattataacattcaacccagaagacacttcatattttccccttaggacagacttgctatcgggcagtagtgt

SEQ ID NO: 33315 - DNA, 2684 bp, Bovine  19866880519203
agagatgactgtcctcatgaaacggactctcgaccggccggaacacactgaccggccccgctccctctgagctgtaacctttgggccacgctaacgtcccagtgccccacccaactcctttctcctccttcctggtcctccttccagagcatcttagtccccaattattcagagccacaggagccctgccaaggaagaaattagagctacacatcagctcttctatatttaccacctgacggctgaggaggatctatcttctacacaattaaatgaaaagagttttaatatcggcaggcaaaggactcgggcatcaatggagaattaggttagagccagcaattggattagcgcccagctgcaagtgaaatgaggactcggacacagtagggttatccttcttctggcgacaggcccttcctacgtggagggcggagacgctgtgttcttgagactggtcgagtccacccctcaaaccctgggacccaagactacgagggacaacctttgccagaatcctctgtgaagagaaagccctgggctggctgcagcagacgagggcacaccgaggcctccagagccagtcagacaccacctcccatgctgagaagtaaaccgcattcgcatcccctcctccatgcctcctccctcctgcagcagcccctcccaagagagctgctttagcccctggccccccaactgcctctcttctccccttccagcctcacctgcaatcttccctaagccgcctccttcacgaagcagaggagagagatgcaggtgcacaggtgtccccccgtgacagctgttgaagacgcagcaaaaatgctagttaagtaattgtccctttgggttttttttttccaatgtcacactaagttggtttctctggatttattaagtgggaagagcatgaacacatcctaattttgccaagagttgatttgggggcaaattccagcacttcctggggagcgacctcacacacccgtccccttgtttctgactaccttctaccttcccccaggagacacaggttcaatccctgggtagagaagatcccctggaggaggaaatgacaactcaagtattcttgcctgaaaaatcccatggacttaggagcgtggtgggctgcagaccatggggtcgcaaattgttgaacacaagtgagcaactgagcacacaggtgctaccttccccaggctgccacagcctccctgacaaagccacctcaaatccttggctggaaactatggcaactccttcctgtcagctccctgaaggtggacgtcacatctctttctccaaacagaaccccaggagagacatacaacagcccagcctcatgacaatactgagcccctgttctgcttgcgcagacctccagaaggaaagactccgcggccaagtgcgtctccgctggctgtgttccccctttctcactcacagtgagttcttccttcctctttcctaagttctctggttggagtccaagtgtgctggcatcacctcaaaggaagacagaaatcagctggcaattgccagagaaggccagtcatcttcctccaaacccgaatccaatagccctgaatgtgaactgggtcctgggtgctgtgcctcttgcagaggggaaaactgaggctccaggaagcatcagtaatgcagcccctagggaaccggtatagaatgaactgtctggagactccctggtccccaggtcagtgactgaaaaggacacttactgactgcccatcagtgcacagcctgcccggtcctgagcagaactggggtggggtgtcaagagcagcgcagagactgatacatcaccctgtttgtagttgtcatttagtcagtgagtcatgtctgacgctttcgcgaccccatagactatagcccaccaggctcctctgtccaggggatttctaggcaagaatactggagtgggttgccatttcctccgccaggggatcttcccaacccagagatcgaacctgggttgcctgcattggcaagcaggttctttaccacggagccacctgggaaaccccgttatcctgtgtataagctcacaagttagcctgctactgttacacagatgccagccaaagagcccagactcctagatctgagaccaaggacttcattactcaggcaaaagcagtccccagagcactctgatggttggctctggttctctgctgccactcaagtcccacacaggctttgcgagaggcccaggatgggtggggtactcagtggctagagtaacaggagaggaacactggcctcgggagattttccacttttatagaaagtgggagaaagactgctctttgcctttgagatgttacctcttctctcaagattgcttgtggcaaacatgactctgaggagtggcccaggtgaagagaggtcagggccttgcattcgtggagtacccaggaggaatgtgggaaaatgcccagggttgccagagagctgtctgtctccgcacgagggaaatgcaggagcagggtgggcacggttcctgcccctggggtgtcccaagtgaccacactcagtgtgctgcctcgtgcttgcccactgggcctctccttggaggcctcgcacacgtttactacagaagtaacatcataaataagggctgggtcctctgggtatcccacagtaaaaacaaaaagcta

SEQ ID NO: 33316 - DNA, 1166 bp, Bovine  19866880570159
agacgctgtggcccatggtgtagatgatccttaccgcggagaagtaggatttctggggagggtggaggcagaaggaatctcagcaacggggcctctgaggaaagggaggcttgaccatcaagcaggtgatgctttgaattctacccccaaactgtcggtgtggtgtgaggctggggtgtctgtggggaccaaggcaagctccctttggagttttccctttggagtttgtttacagcctgtaagctagggagggaacaggatgggggagggaagcgggggtgggggggaaggaatgaggatcaagatgcttaactctagctgctgctgggagatgggagaaagaagctgccacagaaactgtgcgtccctggggagtgacaaagctcaggaggaaatcgggcttgtttattgacatccagcttgctcattagcttgggaacacgacatccgcaaataaaggggagagcaggaacagcttcaaggctaagctctttccacaaacaagtatttgaatcaatcaactcagcctggatcccagagatggagacagaaggtgtagcctttcggggaggggattgatcagggacccagctcccctgagggatgcaggcaatcacccctgactgcccctccctgactcagtctttttatctgaaagaatgtcagactcatgctctgccttcagggctggagggagagagctatggggttatgggaatggaagcaatttgccaaggcactgctcagtttggaagcatggagtgtgctgctggggtaggagtcacttccatcattgggtttccctcgctgtcccacagccatgcacaccactccacagactgaggatcagagagggcagggagcttttgcagtggtccttgcccagaacaactcagagcctttgtttcccgcaaccacccccagctcccagtcctggagctggggcacagagagggtgtcgaggagacactggccaggtaacactgcccaccctgccttctgcctccctcttcctcctagcagcgtagcccacctgtcactctggagcaagttgctctctactaattctcactccctctcttccagccatcttccagaagtgtgctgtcattcacattccgacccgccaacttcagtggaggtggcagcccctaccatcgtgcagt

SEQ ID NO: 33317 - DNA, 1050 bp, Bovine  19866880598046
ctccaaatgtccctgcctgcctggtacctgcacctgtgtgtttccttcccccttgggtgtaggctggacctagtgacttacttctaatgaacagaatagggcagaagtgatggcagatcacttctgaggttagagaacatagagacttttgactcactatcacttgtttctctctcttttctcccgttgctctccctctgggaacagccagctgccaggttgtcagccgccctatggagaggcccagtggcaaggaataatgtcttcagccaacagccctcggagaatctgagatctgccaatagccacgagtaaacccagaataggaatcttccctaaatcaggttttgagatgactacagccttgtgagagactctgatccagaggactagctgagctgctctggcttcctgacctatagaaactatgatatggtacaaatttgttattttaagctgttaaacttgggggtaatttggtatacagcaatagataattaacacaaattttatgagaagaaaagaaactaaacacataacattgctagaaatatttggaagcatcatgatttcaattactgtttacaacaaggagttagatcttcctattttgggagttaatcagtttggtaggaaagggagttccatttggcaataggaaatgatcactatattaagaaatactaagctatcattgtgcaagaaaacacagttattgacttacaattaaatcataagcatgtataagacacctacaatttgtgcaatactactttagatgacagaatgaaaacaacataatcaaaagattgcccctaccatttattgaactagagtctattgatgcataaactactcactgagattatactaggcagattttgaagccattttcattcttccaggccatctggacacctcacatggaaactccaaatggacaacatagcttctaagatttagttagcttacttctagaaaccagtttatattatagatggaacctgcagttaaatactcacaacttgcaatgtctgtgtaagatgacag

SEQ ID NO: 33318 - DNA, 1488 bp, Bovine  19866880600461
ttggtaaccccatggactgtagctcaccaggctcctctgtcccaggaattctccaggcaagaataatggagtgggttgccattcccttctccaggggaatgctggactattaaaaataaatctattatgaacatagatgtacaggctttggtaagtgttcatttatctgaaacaaagcccaagagtacaattcctagctcatatggcaattgcatgtttcattttatgagaaatggacaaactgttttccagagtggctgcagcatttcatgtttccaccagtcatttatgaatgatccagtacctctacatgcttgtcagcatttggtgtttgatttttttaaaagtaattcttataggtgtgtaacattatctcatcatcattttatttgcattcccctaacgagtaatgctgttgatcctcttttcatatgcttgtttgctatcttaatgtttctttggtgaaatttgtcttcatgtctttcacccaatttctaattaggttgtttgattttttttttaactgttgagctttgaaaattctttatacgttttaaatactaatccttctgtatcagaaatatatttttgcaaatgttttctccatctatagcttgtcttctcaatttttagcagagtctattgtagagaaaaagttttaatttttaccatcgtatatatcattagattagctataaagcataagttgagatgatttctgggggtcttcagtgaagctgaacaatgttaggaattttaaaacagtcttttgtcccttaatttcccaagttcaaagggaatattttcaaagagagaagagagtatgaattctttatttcccgttggatagacatctatttctcccaagttcaggttgttggtggtgatgatttttttcccagggctttctatgcatactttaaatgattatgcccaacccccccttaaggcagatgtaaacagcaactgagatggcagatggtaatgtaaatctagacctcggagagtttgaaataacagccacatatgtgcagtgttgaagtcatggacccttggcctacagtgttcccagtttaagtgcaaggagccattgtatctgtgacatgatttgtggatccaggagccctctgatgtgcggctcaattggcttctggcttcatttctgatgaatgcttaatggtaaatagctttaaatgaacgtatttttattttaatcacaaatgttcaatctttatgaataagagtggtcacagtgatggacattttcagacagtttatttcagtcaatagccaataaaatgtgcacttgaaatatttgccttccaaaagcaatctaaggcagctccgtgttgatgggtgttggggctccagcttttcaattaagagaaagagagggaaagagagagagcactgaacatttgtaggctggtgtttaatcccagagatcggctggcatcacttaggttatctctttaatcctcagagagg

SEQ ID NO: 33319 - DNA, 1762 bp, Bovine  19866880615597
agaacttcccagctgagctgaacccaaattgccaacccacagaattgtaagtgactgttgtctgaagccacttagttttggagtgtatctaacagatacagtggtagaagagatagcagtaattgatatacccgctaatagggtcttctagtgtgtttacatcaataatatcctgtttcctgatccaaattttgatagcacttatgcattcacactaagattcactgaactgtataattatgatatttgtgcatatatatcatagccctgggtattctttggaaggaatgttgaagctgaaactccagtactttggccacctcatgtgaagagttgactcattggaaaagactctgatgctgggagggattgggggcaggaggagaaggggataacagaggatgagatggctggatggcatcaccgactcaatggacgtgagtttgagtgaattccgatagttggtaatggacagggaggcctggcgtgctgtgattcatggggtcacaaagagtcagacacgactgagccactgaactgaactgaactgaacatacatacatagcatgtgtattttacttcagtttaaaaagtagaaataaaataaaaattttatgtactgttatggtataatttcctagatatatagttaaggaagaaaataagagatcagaagaaggcatatggtatctactatttatgtaaaaaaaagaacaaagaatatgtgcatcttcttatgtgtgtatatgtgtatgtgacttctttacttgtatatgcatcctttatatctttaaatatacataagaaactcaataatactgcttcatgcttccttcaagaggggaatgggtaactaggggatggaataggaaaagagagacaattttcactgcctattattttacactttttgaatatgaccacacatgcttatcaccttgttttaaattcaatagttaaattataattctaaaagaccattctcctaggtactctactgtaacagaccacataaaatcagagggagcaaatatcaagagagatgctagagaaatactcagctacatgaggtcaagaggaaggatttggtatgggaaataaaatatgacactcacagctgtaatttgccacccaagtctgcgatcaagaaaaaccagcccttggatttgaattgttttacatggcagttatatgggcttgctcacaacttagtggaataaagatgaaagaatgagtccagagaactgattagaaaccaaaaatatgcctataaatgtacagttatctctctgtgccaacagttccacaactaaggattcaaccaaccacaggttgtgtagcactgcagtatgtatttattgggggaaaaaattgtgcataagtgatttgaacacacaaaattcaaacccatactgttcaactagagtttgcttctaagagagattccagagcgcttacttgagccctccaccacctgagggaacagtgagaaggctctgtctgtggaccagaacacagactctccagaccctaaatccaccagcatcttcaccttggacctcccaggctccagaactgtgagaaataaacttgttacttttacaccactctttctattgtgttctataatagcagccttcccaaatggactaagacacctctcctttcattatgtttctttcaagtagtcacttctctgctaccatggtattcagctaatagtctttgttgggggtctcacccaagcagcaggcttcagagc

SEQ ID NO: 33320 - DNA, 1354 bp, Bovine  19866880643065
tgtaaaagatttgtcttagactgatttattaggaagtattccctgaaaaaatagtagaggggtgtgaagtaggactggcaacagaataaggtaattcactttttaacacactcttccacacactgataaagatctaatttttttcatcatctctgattccacaggcactatctgttattttagctttgaaaagagctatgaccttaaatcacagagtagattccctagatatctgggagagtagttttcatgtttttcttttttttttttttctggtttcctctgtgcccaaagcaagaaacagcatgagaatcagtacaagtgaatgagacaaaacccacaagtccaaaaaggtttctcaaatgcgtatgttggcagtgtaaaaacattagcttgtcttttaaacaactgtcagaatcccaaacctttcctgcctattttttgcctttccaaatctgagtacttcattaataaaaaagaatgattttaatcttggtagtttgcatatacggtgtgtctgtcctggtcacattccaatctagataattgtatcttctcttcctcaaaccccctgttgcttatattccaagtggcattcttctttcctttttaaccaagggcttccaggcatcaccctgagatggtaaacagctggagggagctaccccagagatagctgcacatcagcggcagttgtgctcatcccagtataatttatctatcaacttgttcaatttttaaattccttggcatgcttcagggagaaaagcctagagaagggaaagtcctattgttactcctataacctcagtagatttggagcactgctctaattaaaatggagacaacaccagcaattaaaaagtgataggcctgtgcagagaggatgattaatatggagtttttcaatatcaagtatttctttgataacctataatgaatttagcctcaagttttagatgtcaaggtatcatacctcagtgcaacattaagcatttctaagttacacaagaggggtgttgagatatatataaccaaatacctttagtaatttacttaaaatctatatcagcataaaatcaaaagtatcttgacttttgtgaataacactgcactgtaggtggaaagaacagagttcagaccaattatttcagaggaaacatatcctgattggtctcctccattaacagtcactctttagacaagtcccttacctttcacatcattcaatgtgccatttctaaagaaaaaatatcactatattctcttgtaattttctggtttatgtttttgcctcattcctgctctcacagtactttagggacagtgctttacctaaaataaattcaataaa

SEQ ID NO: 33321 - DNA, 1451 bp, Bovine  19866880644209
aaaacagaaaaagattcatagacttagaggatgaacttatggttgctggggatgaggaaggatggggaaagggatagttagggagtttgggatggacatgtacacactgctatatttaaaatggataaccaacagagatctactgtatagcatatggacctctgctcaacgttacgtggcagcctgaaaggagggagtttaggggagaatggatacacatatatgtatggctgaatccctgcgctgttcacctgaaattatcacaacattactaactggctataccctaatacaaaacaaaacattaaaaaagttaaagtaacaaaactagagtacaaaaccattaaacttgactaaattctttccaagcatctatctgcaattgtgttagtttattcttcaggtttaaagaaatgactgaatagtcaaatacctacttcaagcatcatgtcttaaacccctaaacttctgcacaatcactgataatatgacacggagacaatcgttcctaatcagtgttttaacaagtcaagttgttcagattattataaacatttgaatatttttatttaattacaggtgagcattctataagcaattggcaataagagttttcttacatgctttatatactaaaattctgttgctcacttgtataaatatacaattattgttgcaataataaattactgcaaattattatttgggatgactgctaactttatgtttaaaaagcaattattaagaaatctcaatttaaaaaaaagaaatctcaattaattaaaaataaaagcagagggtggacagttaatatctatattaatggtgggcctttagccagctaattttggaaagttaattttagaaatgtcttctgggagcaaataaaggtttataaaaatttcagtgataacataagacagaatacagaggtgattatatttctaaactatagaattatttcatacactagaacccataatacgacaaaataaaatttagaaactacatttaatgttagttatttaacttttgagtaaaaaagttctctctggcaattgcattttgtatgtgtgaattataaaaaaaagcatcaactttgacactgcaaaatctcacaaggaggaaacccccaaaatcatgctcaacaacattcatgaaatatcagactcagtaaaggatcagggtttgaagaaaagaataatgtatgacaaaagagtaagattccccaagtagtcttgctccttaattaacctagcggaaagtcagtttctgtatagcaaaaagattttgctttgtagtgggaccaggaggtggtaagcagatctgacctcaaattgctgcttctgtcctataaagtggaattttcacctatcgactactttttcaaacctgatactgtaaaaatcatcaaaactttagatcaagctgctgctttatacatacgtccc

SEQ ID NO: 33322 - DNA, 1273 bp, Bovine  19866880675564
cttacagatccctcccccgcagaggtggatggggtcactctaacgtgtacctattcatttacaagtttattggctcctctggccttgggctatggcccagattctaggaggagggacatgagaagaacagcagcggacacaaaaggacctgggaaagagagtcaggaatgagacaggaaagaagtgctgggaggaagcatgagagttcccatgggacgctgtggagggtggtagacccaggtagctgcccaagttcaggtgtgggctccagtcacaggctgtgaccagactaacacgcagatgtcagcaccttcaccctcgagtgtgaaggtgtcgtccacttgatatgagtcacccgggctggcagaagttcaagatcgtggccgtgccatctccgcgagatctcagtcctcacctccaagaacaagagggagggcgttaggaaggtcccactgtcacttctttattcagccccagtggggttgagggtgccggggaggccatgcaggagaaactgagacaggggtttcctgcagcaggagaagctacggttggccacagccacagctaagtactacctctagaggatactacttcctccttcctgcaagtatttctgaccattccgtttggctccttctctgtcttttagtactgcttttgtcttggaccacttaaagacaattatgggtgttttcttgagtttctggccaaaaaataagtactctgtcctctccaagtagcccagggcccatgagccattacaggcaggtatggaagtcctgtgtttgctcccagatcccaaataagtctgcaggagactcagagaggctactgggggcaaagaatgtcagaagagagggagccaagaagagacagaagtgtcaggtaaggggtagcaatgctccacagctggagcctggcaggtctgtgtacccaggtctccagcagaacagctgctgctgttgctgctgctgctgctgctaagtcacttcagtcgtgtctgactcttagcgaccccatggactgcagcccaccaggctcctccatccatgggattttccaggcaagagtattggagtggggtgccagtgccttctctagcagaacagctgataagctggtaagtcacttcagtcgtgtctgactctgtgcgaccccagagatggcagcccaccaggctcccccatccctgggattctccaggcaagaacactggagtgggttgccatttccttctccaatgctgggacagagttaaattctcacacta

SEQ ID NO: 33323 - DNA, 3077 bp, Bovine  19866880702820
tgtccgactctttgtgaccccacggactataaagtccatggaattctccaggccagaacactggagtgggtagcttttcccttctctaggggatcgtcccaatccagggatcgaagccaggtctcccgcattgcaggtggattctttaccagctgaaccacaacggaagcccaagaacactggagtgggtagcctatcccttctccagcggttcttcctgacctaggaatcgaactggggtctcctgcattgcaggtgaattctttaccaactgagatatcagggaagcctcatgtttatcacatttaaaagaattcagtgcttttttgacttagaaaatgtcactttaaatgcagatacaggcttagattcattattttaaaaataaatctatccccattccattagactattatgtatgaataaaatttcttttctgtgtaagagtaagtagagtctcatttcttatatcctcagaattgaaattacaagtaaatttggatgtgcagttgtagagcaatgagagattacctgttctagaaagcctgggttctgagctataacagggataatcctgagtaataccctttgatttcatgactccctaaccttgtttttacccatcttctgaaaatgtgttgaatagtgtatttactatttaagttagtagtgctgaaagtcagtgtcttacatacaggggtttcaaattcaaatggacactgaggtaattaaaaaacaagtgaagtggaattgcattttctttaaaacaccttggggtagcttttagttttacaaagaaagataattttcattaaatatgtggcccattgtttatcattttttatgaagatcctcttcttttagcagagaaatagtataatgataaatggcatatattgtgtggccgtaggtcgtggagacaggaggaaatgatgaggacgatggtggggttcaattttcacaatgtgagaatcgaacccaaggttcccaggtcttatgaatttgcaagagaaaccatgagcctgttttcttatgttgaaatatcctacattttatttatttaaacaatttttaaaattaatttttattggagtgcagttactttacaatattgtgttagtctctactgtacaataaagtgaatcagctatacatacataacccctcccttttggctttgcttcctatttaggtcaccacagagcactgagtagagttccctgtgctctgcagttggttcccatgagttatctgttttatgcatggtctcaatagtgtgtgtgtcaatccccatctcccaattcatcccaccaccactttcccccttagtgttcttacatttgttctctacatcgggtctctatttctgccttgcaaataaggtcatctatataatttttctagattctactatatgcattaagatgtgatacttgtttttctgacttacttcactctgtatgacagtctccatgtccatccgcatctctgccagggaccccggttttgtttctttttgtggctgagtaatagcccaccgtaaatatgtaccacatcttgtttatccattcctctgttggtggatgggaagtcctaccttttaaaatagatcttttaagaagtagtttacagaaaaaatgagacatgaatgccaaccagatccaggaggatcacaaacagtttgcaattgctgcttagaaaaaaaataacccggaaagttaagggaaagcagtttcagtgagatgtctgatatgaagactagctctttcctggattgaattgttatccctaaaggtaatgtgagctgctcagtgagtgtgtatacagtagggtatcagaaatctatttgattgaatgagacatgataagaaatacataacatttttgtgatggaatgttgagagttgaaggcctgtgcttggaacaagtggggaagaaagcagcctggaagccaccataccaggtggcaaagggcaccttggttccatcactgaggactgagtggggctcccagataaaacatcagggcacaagatgggatgatacagtctagctgaagcgtaccaagtctctgtgaggcagagaccagtcaagacgaactccttttaaaggtgacttttctaaaatcagcaagtgttaaacaaggcatttttgtttaggatagttcatataaaaggttggctttaaaaaaatcagtgtttccgaatgcttttttgccttgcgccatctccctagcaattgctattctcgccttccctgtcggtgatgcatcccacttttccattcttcctaaagaagtatatgagaagactccttaaactcatgatggcctcaccattctgggtcctggcccacaaagctcatcttggccaatcacctgtatgtgcttgtagactgaaaaggagcgaacagcctgcactcacagttagtcagttcatagtaccacatgcatttgtttgagtttttcttttagcaaggactttccccatgtgagaaaaagaaatttgtattcacactgctttgtcgagttttcaaatgtgttttagggggatacaattcaaacactaaaataatccatttcatgcatattaattgatttttacatgaaaacaattcccatttgcatgagagctttggcaagttttgagtctggggaagatattataaacagtagtggggaaaaataaaaccaaacattgcactatgttggcaagagcttagggaaacaagtgcgcttatactagtcttcttggtgtcagtggcagtaagtccatggatcctcctggctcctggctggctcctatcactctctatccagagcctcaagtttgtggttccttggatttgaatcctgagcattttctgctctccagtgactctttctttaaatgaattaattctatcctgtggatttaaaaaactttgtgttgctgtctctcaaatttgcttcttcaggccagatcactcccttgatttccacctcattaacattcccctttgatgtcccagggacacagagcactcatctccaaatgatttagataaaaaacatttattggctcacatatcacattgaa

SEQ ID NO: 33324 - DNA, 2542 bp, Bovine  19866880715881
ctccctgtgtctccccagcctccagatggccaagggtggagggaagggaaagcaaggatgagcccagcccctgatgaacctctcattccatccccacccactcctaacagtcagagctgggctcctgctggatggacagatggacagatgatcagcagtctgtcctctccaaggttcctcttaccgatggtttccgtctcccagactgaaacagagcaagagagaaaacacagaggtgagcaaggctggctaaagtcaatctgctctctgagccctgctgatggtgccctcctccttcccactctcagactctgaagagaggttgtgctggggccccagaggcctgagaactacaagctgggattctactgttcaactagagacttctatctctcctgcaagaacagggcacagttactgagaaagtgaggcattccaaaggaggagcgagatcgcgttcctgcatctccaacagctgcaaagcagcaactattactatgagcatgagattcggccctgggaaccaggaaataaaaggaaaactgcggttctcagctttctaagtatttaagtcaagtctaactttgtgaatggagatgctaaaaggccctgccttaatgaaccattaagaggcaggtgtaaataacacattcattgtgcaattgccagagggaggcatagaatctgaaagaaagcgtatcttaagaaaattttatttaacggctgattcattttaccttttctgtgcgtggtggaaaagtagtcctgccacggtacctgacccagagtagatgttctgtcaactttaaataaatgactgaatgaaaggagtacgtgaatggaggaagtgattaattggtttctataggaatgaattagaaattggagctgaatcactgggctgtcaccccgcttgatgaaccaccattcacactgtgcctctcctttcagcacttcccgttctgctctgggttggatccagtcctcatgccactgtcaggatgggagagtttaactgctggactggcctggactgatattctggaggtgggaggtatggctaacgggcccaaacggaaagtcggggaggcgagatgggggcagcatagctagaccctgccttccctagtcctgggcggggagccagggacagggccgggcatccccaggacgctgcctctatctccccgtaccacctcctccaagcagactcccctgcaggcagaaacaaggttgctggactttcaggtgtgaaaaaaatttgcctctgcctctgacgtggactagaggacagtggagtgaagcacagcctggagactctctacttctagagggacactggccgaggccttaggcacgtgagggaggaagctgaggaccaggtctcaagggactcatgcatggctacacaagtgtctcagagcctctagtccctgtaggagtccctaccctccttcctcaaaccaagaccccaacccaggactaggtggtccatgcatggttctcagtacatcacctgcctggagcccagtccctccatctccctctacccagcctaactctgggacacccacagagttggggcggagggccggtctggctccaggcccctcccagtgtcaatgtgcactaaaagcagacaccaaccttcttttgggattcatgagtctctgccaaggcagaaataggcctggagagccctccagactcacatccaaaggagagatccctcggaaccctttcccctcaggcccctccccatggagaacagtcatctgggcctccctgtatgagtgatggtggtcataacatcagctcacactttcggctgaccatcaagctacacccagtcctgctaagggacttccacatgcatcttccacttaaattctcccagtcaccattccacattcccatctgatagactaggaaatggggggacagaggggtgactgccctgctcaaggtccccagctgggttacgcaatggagcccacatccgagagcctagccttgcccctctgacgtacctctacggggctttgccatgtgtgaggggtgcttctgtgtccctctgtgcacaggggtccctgatttcatctcaccagcacagagctctgaaatgggaaccacctccctgcaggttaccccggtctttggtgcttgtctcccaggaatgcctggggtccgacttgggggaacaggctggaccgagtgtagcctaaagaggccctgggggaaacccaccttggtctgggttgaagattcggaagagttcagggcaactgaccaggaccatctcacccacgtgggcgggcttccaacacgtgatgttgtcccacatcccagggcaccctgtggggatgaaaaccatggtgtccagcagtccagcagtccctccccacacacacacacagagcacacacactcacagagcacacacacacagcacacacccacagagcacacacacagagtgcgtacacacagagtgcatacacacacacacacacacatacaacacacacacacacagagcaca

SEQ ID NO: 33325 - DNA, 2506 bp, Bovine  19866880808847
cgaaaatcttctaacctacctggtaatgaagcagcagacaaacaaccatctgggcagatatttatcttgttaagttaaacatgcacctggccccttaattatcaactgtaattgacaactttcatcctcgcagagtacttttctgtccatgccacagtggtgcaagtaattaggtaataattaatgattctttaagtgcattatttcctatgagctcaattttcactatatgtgtatttcaagagcaacaactctgcttgttttgcccttatagataaatgttaaaaagaattaaaatcactatgcttatcctaagtatctagaggatcatctataatcaattctgaccttttatctactccatgtagtgcttattttattttcattcagccgtaccaaataaccataaagtatcagagctaattgtagagaccaaatgaatatacattcacaaagacacttattactatgttacacataataaggaaacatgtaaatatataaatgaccaacactggacaaaggataagcaaatttatggtacatgaactaaacaaaatattatgcaacattttaaaataattttgaagactatgaaaaatttcttaatagattctgattacaattatataaaatatgtatgatgaaaagcaaaaaatgaaaggaaataagcaggtcaataaagcctacaaatgaaaatgattttaccagagaataggaaaacgcatgttttatttttaaaatattttacttacatttctgaataggtcatacatacccatagtacaacatcccaaacatacaggaggatatgttcaatgtctgccttgaatctgtcattcaataaccttgtctcattcccagaagtaacttttgtagaaagtagtaacttttaactagtttttgtatgtattccagacagttaatgcatttataaaaagtatatatacatgttttttaacacaaattgtagcagtaatgtcatattcacaccttgatattttcattcaatacatcttggaatagttccatatcattacatagaaagccacctaattatttttaatggctatgatgttttattatgtgaatttatcataatttatttaaccattctgtattcatgtcatttaggtttattccaatctttcactatttgaaataaaatgttccagacaaaagccaatgtgattcatttaaaatgaaaatgagatcagacttctgatttgaagatagcattatagagttagaatttcctccttcatctccccataagtctttgtaaagtaaaaagaacaggaaatataaacatggaacccataaacattttctttgtagcagtggataaagagaaaaaccttacagatatctatccatcttaggaaatttatctatctatcttaggaaaaaagataaaagtaaaatgaatttatataccaaatcctggatcataaagaaaaatctaccttgatacagaacccatacttatcctccacggaaaccttattaaaaatcccatccaggaaagtgatatatacttcaaattttagtaattaaaggtttatgcttctgataattacatagtaactggtttcaaaccaactttcccactaaaatcaaccaaaaacaacacttggaatatgcttttaaaatatgtatttgaaagtttttgaatagctacaaaacagtgaagatttgcaaaaacaaatcctgaaaagaatgagtttgcaatgaggtgagcttgaccttaatttcctactgcttttctgatcaaggaatttgatgattcacaagtggtggctaataatagagaaactgagcaagtatttcctacacttccataagacttcgggcaaaacaagtagaggagggaccctaataaacaccgaagaatttcagttgagagccctaaaggatctgtgttgtagaagtagagatgaacctggaaaatagtccatcccttataaagactgaagcctagtttcaaattaactcattacctgactgggattaaaataattctatcctaccctggatgtctatcagggcaaaacaaaccctttctaggtatagataacaccatccagaccatctccaaaatatttttatatgcaatgtagggacttagtaaaaacttgttgcaacatcagaaaataaagccagatggtataaatcatgagggaaaaaaaaaaaaagaaaaacaggtaacagacactgagtcacaggtgaatcaatattggttttatcagacactgtttttaaaatcagtgattattggtgttcaagaaattaggtgacaagatggtaggtttaattagagaactgcaaacagtacaatagaaaaaatagaattttaatttaaaaactaaagtttaaaactcaaaagttgtgttaatagcaacatacattatatctacacacagatacatacacatatatgtaatatattatatataattattatatatatgatatatgggtttatatgtgtatacatacacacacg

SEQ ID NO: 33326 - DNA, 977 bp, Bovine  19866880823144
cttatacagttttacagtggaatctgggaataagggtgagtcagcagcctaagaagaggacccttaacatccatgaccatgatccctgtagcactaccagtgaccccaaagaggctctgaatgtcctactgtgtctgtggttaaaggaaggtctgtggatccttatggagcccaagccaagaatctgacttgtttgcccgtgaagttggtaaccaacaggagttagtctgcacccattgatggtggttcttagaaaggaaaaagagaaggaaactgaaggatgcccatggggctctttcctgtaagttatccatgtgtcctgatcagaggttccctgaagataggtaaaaaggagactgtgggaccactccgctaatatgccctaatgtttgtcagaagacagggcagaaagtacaaaaccatgccttgcgaagactcgggatataagtagtatgggcagatgtgtccaacttttggtaactcttgatattcatatggaaagaaggagcaagggcctaaaggtaattttcataaaaggagcatcccaaatgatttctatcagtaagtgaacctgggtaagcaatgtttcaatgaaagaaacttcaaagtctcttgagactttgaagagacttgaaagagacttcaaaatctctctcaaagcctcaagagacaaggccctagagggagatccaggctctgctgatggctctgggaagccagggaaagtgtcacaagcacctcaggacctcttggtcactggatcattcccatcagccaatacacctggtgtaatagctctcatccccagaaaaagaacatcttttgtctctacctctcctccagctatctttttagtcactgctcccttttgcctcatcactcctccaaatacttttctgtctccacttcctctactccgatttctcacttgaagggtcatataactggcctttctctccaacctattcctctgaaat

SEQ ID NO: 33327 - DNA, 2007 bp, Bovine  19866880825259
agttgactcattggaaaagacccttgatgctgggagggattgggggcaggaggagaaggggatgacagaggatgagatggctggatggcatcactgactcgatggacatgaatttgagtaaactcctgggagttggtgatggacagggaggcctggcgtgctgcagttcatggggtcgcaaagagtcagacacgactgagtgactgaactaaactgaactgagaagaaagaagtaaaaaaaacccaaaggatcggattaactactggtagaaactacctcacagcagtagtgttgactgtagcagcatgatcaatggtgaagtgtattgtaaatcattcattgttaaaaccagtttagcactagagtctcacaggtttaatttttaaagtaaattagaaaggattcaaagttattgttatagcaccatattgcatatgagagaaaaggacagggtaccagctagtgttcccagaactgttcatcatctttggcctattttacccaccaaggttcatgacatgggcatactctggggagtatgcagagtttatgataatatattaggcttatatgataggaaaagaaaataagaaaaacaagtccgaggatctctgccttaaaaacaaagaagtttgatcaagatcaaggtccaggcaagcaaagacagaaaattaagagtgtgaatctatcccaaatatcaacatatctgatactgaatgtgagatccaaaaggagactagatgtaaaatacatgccatggaggcctcctcttgcactgttaggatctagagtacacaagatcatctctattaacttttcttggcacacccatcccaaagataaagacaaaagtttcaagacattctacttgcaagctacaatgcatcagctaacttccccctatcccctacattctcagcttaccaggcaactttctggtatgaattgacctcctgagtagcctttccttcaggagaaagaaaccactgactggccagtagatgtgagcattccagtgtacatgaaggatatattttataggaaaatgataatcaaaacaacacccctgggcacaagtattcatttcagtgtcaacaagtcttctatagcagaatccacctttcatttactgtcaatatggaatttatttgtctgacaatgtcaaaaataagatatccatatacatgtggatttgaaacttctaggctcttccactgacccttttatctatctggatgccaatactatactgccttgattattatagatttataagtcttgaaagcaggcttacctgttcagtcttccaacttttttcttcttttcccaagctgctttgcctattctgagtaccttgcatttaaatataaattttaaaacgagctcgtcaatttctaccccaaaagcctgccaggattttaacggatggcatggaatctatagatcaatttagaaagaacttaaatttcaactatctctggaaaatactcagaaactaaataatatactactaaatagtccttagatcaatgtagaagtaaaaattagagaatattttgaatgaaatgcgaataaaaatgcaacatatcaaagtttgtggcattttactaaataaaacaatatttagagggaatatacagcatgatgcttagtgttaatctatagtctttctatttgtttcctatttgtctcatctattctttgttatcattttttttttttaccttcttttggattagttattcttacgatttcattttatctcttttggttgattagttatatgtcattattttgttactttggtaattgttttagagtttatggtaaatgctcttaatttatctcaatctactttcaaatgacattgtatcacttcatgtataatatcagaactttataatagcatatacacttctcctctccagatttttatgctatttttggcatatatttattttatatatactataacccaaaatatattttgttccaatagtcaatta

SEQ ID NO: 33328 - DNA, 1857 bp, Bovine  19866880837758
ccaccaaggaaagccaaaaaagagaaaaggccagtcaccctcttccagtcctctctcacttcagaggccttccccttctcctgacaatgtctcatttccataccctgttgtccagtggggagaactgagcccaccattagcatcatagaaatacaaagcaaatgggatggccctggaaggtacagtgtgtatgtggctgctgtgtgcgatgcttcctcttggctgagaccccacctcctcccagctccccttctctagaccaggggcagccttgaccttccagggagcagagtaagcagtggatagccctggcaagctgatggtcaggtgtcctgactcacatccacgtctgttttgcaggagagttcggttttgcagacagtaaatccttggatctctcaggtaagggatgagctaaaattgaccatgggctggctagagggagaacatctaacatatgaggtcacagggagctaacctgtgagcttgggaacctccttccaggctgggctatgcccctctgtggctctgtgatctttggtagctcactttccttctctgattaagttgtgggttttctccatggaaatttgcatgcaagtgctcagacagaacactgtgcatataatttcaggaaaggacagatctcagtaaaagaactcctggattaaatggcctgtgatagcttggagctcccacaagtagaacagtggttctcatactttgtgatcacagtcacgggcatgctaagtcacttcaattgtgtctgactctttgtgaccccgtggactatagcccaccaggctcacagaagtccatgggattctccaggcagaaatattggagtgggttgccattcccttctccagcacagtcacctagtgggcttgttaaaacagattcctgaacctcaccccaagagtctctgatagagcagtctgggtggggcctgagagtgtgcattttggccagtctccctggtgatgctaatgggcccgtctagggagggcacccacttcgagaacctctggcctaagattctgtgcttctatgaagttgctggagcaaaacagcctagtgaagtaggcgcaggcactgcagggtgtgggcagtctggagagtactccatcttccggagatttctatcagaacaatagaccagcagattcatggaatagttctaaacaaaaaggtttatacttttctgagcccacactatgttttgaaaagggtaagaaggaaaataaaagaaaggaaatggcttgtatctccaggatacttttaaaaaaaaaatgtttttcagtgcagcttccctttcctcttcccaccaccctgatgtgggcagagcagagaggagacccagggaagggaagggcttggccactgccatggtcccctaggacgtgcagactttctgaaagaaatgttcagagggacttggaaggagggtgccaatagcagcctgaaacagatttgctggaagaaaaaaccatttggcatcaaactgtgggacagaagtgacctcgtctctcctgggcctgccagacgtcctccttgtcctgggtcacatacaactcagaatctgagctgcaataagagaccagtctccctgctctgggcagaggtctctttatggcagggatcacccaccctctgctgctccccaaagccccaggaagtgcatttctgactcttggttgaaaagaactggccttggatcttccaactcaatcagcaggacacgaggttggaaaagtgttggcgtctcctgtgttggctgctgcccttgtccctgtccgagcgccccagagatggccttctgagcagggcttcttccagcagcatggatgctggggc

SEQ ID NO: 33329 - DNA, 2596 bp, Bovine  19866880871930
tgttctgaaaggacgtctgcatagttaggagaacagagggagaaacagggtgaaacacatatgtctcagaacacaaggacagtgtgtccatatttgcacatgcatctggtgatgtgcaaacatctaataatcaacttttcaaatatcttaataaaagcaggttctttatcataagaattcatatctatggaggctacactagataacatgctttatacaaagggtttttacatgactgatttcattttagcctcacaaaaccatgaggttttttaatactaccactgttactttgctgaagaaagtgaggcaaagatgtgctggaggaattgagctgagttttgtctgctgctgaagcctacccttgctagaacgatggggcatttgctgttccataagctatgtgctactatgtagcttaactagttctcactggcttaactagttctctgcttctaccacctgcttcctctcccctcttctacacatgaacgttctctccattatgcacaaactgtctaaaaacagcctcctctagaaaaccagtctacagttcatagcccaaactgagctcccagggtccttatctgaggccctcgtttatgatgttatctcttactgcatatttcagctgcttatgtgtttctcttatctccgttttataaaatggaaagtttctttccagaaaggaaaagttctatttcttttgtctccctaagagtaggttgtgaatagagaggacattaaataaatggcctgaaaggaaggggtagaggaaataagacaaaacttttggaaacaagagagtgtcacaagtcacatgcatggttgttacagagactcattaactgttcccaagactgttttgctctgctcctgcctcagacctgggctgcatttctcagcctcccttgcagtcaggtgaggaagtgactgaaggaagtgtgtgcgcctgccaaccctccattctgtctgccctgggtctgctggatgccccttatggtgactttagaagccaaatgctgatggtgtccattgtcttgagttcctgaatgactgtttggagcaaagcctgcctctccacttcccccaacttccattgatgagagaaaagtaaatttgtattctgttatccactcatattttagaatttacgtgttatagtgaccctccttagagtaactaagataaatacagagactgtaccaatgattgaaaaatattgattgaaaaatttaaggggaaaaaaatgtaagatccatgtggtctagaagccagtagctcccttttacagacatgcaaactgacctcattgtccattacctggtatgaaaggcggaacatgcagggctggtgtgtcttttctccttggttttttctggtctgactcaacattcagggtgacttgtacatttttcccctttataggcttctttttgagatcacaatccttaataaactggtctgaaagatcatctgattttgacaagatccaaaaaaaaaaaaaaaaaaagaatatgacatgagcaaaggttcagtcacagactggttggtttacagttaaatctgatgggagggaggaatcttttgatctgagaaagaaaagcatttattgattgtggcctcttctatggaggactttgcatgcacagatatatgcaataaaagggaaaagtagaactttgtaaaactccaaatgaagggaactcaaatgggatggataatcaaggcaaagaggaactttaaaatccacttaagcaagccacagagtgggtttaagttacatttcagattggggaacagattctctgtaccagaatgttcctcctggattttctttactcaagccttactctctttggaaggcccaagggcccgtagggagccttattctctctttggtcttacagcaaggttctgtctattcctcacagctttcatttctatggctggtcaagtcacaccagtgattaaggcttgcacttcagcactggtctttacactgccccctggctttacaatcctcctatttacttatcccaacccaggccttcttatcttcttattcatcaccttacagtccccactcccctgcgttacctcaccagagcctctgaagtctggattcggcatcaggtccatcagatgttgttgtatacaattaattccatctgataccctgttgcccattaaggtattttctctgctctgtcttactcctctgtgctttggtttctgtggctgtgcttcgagttcctctgtcattgttttagcacttcattccctaatgatctatctcctgagctggatagagccttcttggagattaaaggttaaacgtcctttcgataattttattcttagttgtgtttcccaccaataaatgcatgttgaaacaatgattaggtggagttagactgatatgagttaaaattttgactctgtttcttgttagttctgagaacttggcaagaatttcttttttttgggggggggggggagtcttaatacttaggaactttaatattctctcaacttataagatggggataatattaaatcaatgtgtgcgcatgtgtgtatgagagagacaaag

SEQ ID NO: 33330 - DNA, 1037 bp, Bovine  19866880894249
ccttttccaggccttgggaacatgctaacactgattctgaggagcaaggtgacacttagctaagtcatgtgatattctaaagaatttccctatattagtcaggcttggatttacttgacggaatgaaaagttagaaggttatgtccacagcccaatgtgatatctgattaacgtaccctctggttatataaaaattcatatcttttgtcaaacctatttttaacctgagggctgaattcaggtcaaaaataccacattttaaaatcaaatttgttcttttagaagacctaaatttgcagtattcctcgaggaatgactgttactcaaagtagggcatagaaaggttttttgattaggacactctcagctttggaagataagcctctccacactgttgagtgaatacacagatatacttgtgttcattgtgaaacttcgcaatttaatttgtgagggctcttgtttttacagaactcaggactccacttctcttggaaaaatgatttgaaagtggtaactttcccaggtccccatctagccccggcttagttttgctccagaaagtacccttatccctcacaccccctgtaccaccagctgcagccttctttgtcttagcaaccacaaaacagtaacttactggaaacttgcttttctcgccgtaaatgttctcagagtaaagacctgaagcacttaccaggcagtccaggtgctgagatgagaaggcaagggatgggaaggaagcgcttcctctctgaagctgggccggctcctcagtggcagtgactgctgctgcccgtctccagctcctcttatcaagggaccagctgctgctgttgccatggggatgctctgtttctcaggcgccagggtaagggggatggagagggaaagaggactcatctcacagccactgctcccaattgtaataattgtccattacaaaaacaatgcacagaatagtgctttgagtacctggtgtgcaagaagtccagacaaaccagctaggtcctttaatcccaataacaaccctgcat

SEQ ID NO: 33331 - DNA, 752 bp, Bovine  19866880916632
ccccctccccatcccacccctctaggttgttacagagcagaaagccttttttttaaagaactcccccaggctagatttggtcctctagatgcttcttttggagctctgtttttcctgtgtacaccattatcatgcaattgtttgagctgcatgaccgcctcccagtgttggactctgtcatgtccatggccagctcattctgaatgtcagtcttatgtctgaacttgtgacagtgtgcagactctctctgggtagaagtcagcaggggctccccagcatcccctgccactagcaggccaaggccgtgccgtcagaagtagctctgtgtggcttgggtttggaagagaacaccaagaggaagccaggtgcaatcgagcttttggtaagcaggccagtggaggagtttggcttttcaggacagccgtgttgggtatctggcattttatccccagtgttactggtatgagcagctgtgtctgtagccaaaagcggtggaatgaggaattcgccacagtggtcccctggtggggcatgggcactgcttctgactcttctcctggagaccagtgagctccctaacatcactgactacatcatgtttctacttaacccaacccaagaagttctatcttctgacccatatcctccctagccagaccctaagccccttgaataagggttgttctggagctgtttgcagctgtgtttctaggctctacaagctgtctgccacctaagcatgtactgagcaa

SEQ ID NO: 33332 - DNA, 2069 bp, Bovine  19866880920892
cctaggagtggtcatggctttctgctcttgctagcctaggggtgcttccccatatcttataggtgccctgaattcagctcacctcagcgaatagttttttttcaaagatctcttcagttaaactcttttgaatatgctattgcctttttgtccgagtgtaacatcctgtacaatcaaccagacaattaaaaatattttgcaaatctagtataaaacacgtagcattgtatctttttattttaatcctaattagtttccttttaatagaaaggggattagggtttctagggacctgaacccaccctagtttggagaaaagatcgacagaggactggacactaacctccatatctgtcatatttaatctctttcacttctctgtcctgttcattttgatgtttgtctaaagaatgtatttcatattaccttcttatttttgcactatcagtattattttttattacttctaagtcattttaaagtctgataaaattattttatatattcccattcatttatttaacaactatattactaatttgctactctgtgccaggcactggtggaatgaagagagttgaaagacacagtccagcctgtgaggaacttgtttagtggacaaggcacagattatgggtaaaatagatggtaaagaaaaattactaaagtgccttttaatttaataacaataaaaatacactagaaaaaaaatacactagaacatatttttcaacatatgttttaggaacacataattcacaaggcatgcctcctaagcaatgaaataaagtaatcttaaagctgatgactagccgctgtctaggaaaaaaaaatagcttgatgtatttattcatttattccagaaatatctattgagtgcttactgtgaggtaggcagtgttctagatttaggggataccatgtaaataacattgtatctctcctctgcagaagttcacagtctcatgttctgagaatgaactctgaggatgtcagtagcccttacaaagtaaaaatgtccttctcacaagagcctttggacacttttgaaactaagtccctttatctggggtttcagtaacactgtcttttcccttaaagcatgatttcaccgacacgagtaaactatttggattcaaatctaaaaactattcagaagagaaattctgaatacctattacagggaggaaaaaatcaaatgaagctgtcgtaggtatctttgtgatattcatgatagcaaaggaagacatgataacaaaggagaaagataatcacggatctataaatagtaaaatgcaaacacaagtatattagaaaatcttatttctacctagtagcaccagattagtgactgtaattggaatgttgttaatcatattgctcagaataaggttacaacacccaaacctaatgcatgattgtggtcataagctgtgtgtgtgcacgctcagtgtccagctctttgcaactccatgcaaccccatgccaggctcccctgtcactggattttctaggcaagaatactggagtgggttaccatttcctcctccgtgggatcttccccacctagggatcgaaccctgtattggctggcagattctttaccactgcaccatctgggaagcctggtcacaagatggcctatttcgaatcgactttttgaaaggaattatacaactggcttaatttcaagcaagcaattttaatgtcttttgttacacaaagtaacttccattgctttgtgtgatgttatgattctttttttcctggcctttgtttttacaaaagaaaaaccagaagatacatacagcagtaacagattttgaggctgaattctttttttcttggtagtacatgtttttgccaagtttgcaacccacttgaacttctgtttgttctttgattttagaataaacttgggttccttttaacattgggaaaaattacaaattttgccataaagaagtcttaacaaagtttactcaagatttttttatcatcaccaagtatatgtaattaaagaaccttcttaatacatccagtgtagcttaatctgaaatatatatcat

SEQ ID NO: 33333 - DNA, 1913 bp, Bovine  19866880986493
gaagaaattaaggataaaagatgcttttaacattcctaagactttcactgaaggtttcagattcaattatgaaaatcaatgcaacttcacagtgggtgttatgaaacatcagatcttataaagtggtttcacagattaaataagaaatgttgctgtgaattatacaatgatttactaagcattagagttggggttgtagaggagggagagaaaacatgtgtcttcttgctgtatctttcctgagcacccttcctgtcctagatgacttgacaagagacagaaaatggtgaactgagaatctgaatacagagtttcccaaagtcagctagtgaatgtccctgagacaagagaaagggaatcaaactggccctaaagagctcttttttgacattaaattgatctgattctgcgaatagggaatttaaattatcttctgaaaattctatcagggatacacttttcaggtttcagagaaagattaaaatatctttgtagttgctcttcagccattaagtcatgtctgactctctgcagccccatggactatagtctgtcaggctcctctgttcatgaaattccccaggcaagaatactggagtgagttgccatttccttctccaggggatcttcctggaccaaggatcaaatccatgtctcttgcattggcaggtggattctttaccactgagtcaccagggaagcctatttaatgagagtcagaatgttggaacctctttgactaagctgacatgactccgtgtgtaggcaccaggcaatgtcaaccagttccgtgatcctgggccttagcacagcccctaaatttaaaagaccagtgagcctgaatctacacacatacaaaaatacatctacacaagggcttcccttgtggctcagttggtaaagaatctgcctgcaatgagggagacctgggttcgatacctgggttgggaagatactctggagaagggaaagactacccactccagtattctggcctggagaattccatggactatatagtccatggggttgcaaagagtcggacataactgagcgacatacactttcactgtcaaggccttttagagatattctatacaattccaagagcttgtctgattgggagacattctgtaggatttaaactctttaaactcaagcattttgtgactttccatggaactttcaggttttgtgagcgttctggggaaacagtaggatacatgaagaggacgagggttctggagaacgtactttcacacataaaatgtaactgagagctatctatctgcctataactctggtatcaaaccttagttctgtctctgccttttttttagtctcactgagtcttagtctcttcatctacaaaatgtacatagagtaggtaagaagataatggtagaattatggtcacaaaagttcctcctaatgttggacatttataaccagaacaaatttgatctcctatggccaaagtcagactgagtctcattaggctagatcactgtactgatcaccaaactactccaagagagcagaaagaaatgaaactacacagaattccatattttttttaaaatggcagtacaaaggcttaaaaattagcaatactgttactgaacagataagaaaagataatgaaagaaaaaattcaggaatgattgggaaaactataaatgaactgtaaatgaaaactcattttctaataacaaatttaactttttatagggcagcatatacattgtaagacttttttattggtattacctttaatgcttcaataacagctggtgggtagctcagtccaaccatgtttgatgtccgtctatacattctggcaaagtcagaaggaaaaaaaatacaatattatatcttacaaagaaaaattagcaggccacaagtattacaca

SEQ ID NO: 33334 - DNA, 1619 bp, Bovine  19866881071280
acagtaggaactgttgatacacatttgcaaacccttataaccctaaaaactttctccagtttcatagatggccaccctagagagatgagatgaagtgtctaatgccaataccaggcaataattccactgatgccccagtgatagcattactgacagatgacattgtaaactcagtgaatatgtgctgtgacccaagccttaggccctaaatacccccaagagtgcctaggccacagacaatggagccatttaagattaatccaagacccaaggttcacctttaaagtgaaagttgctcagttgtgtccaactctttgtgaccccatgaactatacagtccatggacttctccaggccagaatactggagtgggtagcctttcccttctccaggggatcttcccaacaaggggtcaaacccaggtctcctgcaatgcaggcggattctttaccagttgagccacaagggaagtccaagaatactggagtgggtagcctatcccttctccagcaaatcttcacaacctagcaatcgaacaggggtctcctgcattgcaggcagattcttcaccaactgaactatcaaggaagccctaaggttcaccttggctaccaaaattggcactgtcatatgacagccattgtctagctaatagtcctaaagaaaagtccactgacaactcagtaggtaggaaaacatttggacacatctgactatttttaatcctcttcacttaaatgaattaaagaagaaaaaaagctatcactggaaatgaagagataatcatagtaaaaagtcaagatttattctgaatattagaccttagagaaacagaaggatggatactgtgagaaactgtgagatggatagtctctctagcccctcatttttgggagactttagctcatattctcaaatttcagtgttctttagaaccacctggggtgctcagaaaaacatgttgattctttggtggaggattctgaagaatcctggcttgtggcctggaatatgcattttaacaagcacctaatttaactgccttaaaccaatcttctcttcttagcaaatttggcccaagcactagtcctgtgaatttcctattagtctaacgtgaaggaagcctgaacctcctcatttcctcccactttaaacctggagtctgtccagggtgtctcttcctgagtcacacagcatatgcccttctaaagaacagcacaattctccatttctgataaccgcaccttagaagattagagataaaaccacccaaattagaagttagtattcactgcatggaaacaaataaaaagaataaaagtgcagcatatttcaaatttagagattggtggtggctaattattctcttccttaaatgttattttgtgctatgttcttacattaatcacaaaggttaagatgacagtagcaggatgattattttattaattgtattctctcaggcttttgggaaattttctgtaacagaagaaaacaatagcgattccatataaattgctggcagcggagtgaaaaataacctttttctaataaccactatgtaaaaaaaaaagaatctatgtcatctctccagttcaacttcaatccactgaaaataa

SEQ ID NO: 33335 - DNA, 1000 bp, Bovine  19866881168420
cgtatccgactctttgcaaccccatgggactgcagcacgcaaggcctccctgtccaacaccaactcccagagtttactcaaactcgtgtccattgagtcggtgataccatccaaccatctcatcctctgtcgtccccttctcttcccgccttcaatctttcccagcatcggggtctttttcaatgagtcagttctttgcatcaggtggccaaagtattggcatttcagcttcagcatcagtccttccaatgaatattaaggactgatttcctttaggatggactggttggatatccttgcagtccaagggactaaacgtagaaggagaaaacaaacaaacaaacaataaaaaacaccaagtttcctgccctgggtaagggcaagtctacagaaacaaagtaaaattaatgtatgtgaaagcacttaatgaatctgtaaggctaatactaatggagcatattataatcactaatgtgaattcaccaaggaagaaatgttgtcaatagaatgtgcttgctagtttacggatttgccagtctgtgggaacagggaaatgtcaaggactgaggtctgacctagggataaaattaccaattcattccaccttcctttcagggttcttatgacaattaacttgccaagtttcaaccgcaagaccatatgtttgttagatcaggtggggaaatgtggtttatcctgattgtttgtattaacattattagtgcaatgcttcatttattatgctgatccaaattcagtctgtcaggaggtttctcaggacacaaaagtataaaaatacgtaagtgcaagtgatttttaggctaggaaaactgaacacctcttccccagcagatcttgtgggcaatcaacttggaccttacacagagttgtactcagtgctgatcagagtcccaatcctttttaaagccttgaagatccttccaaagtgtcagaggaagattcccatgtgctaatgacagctttaatatttaacaaattt

SEQ ID NO: 33336 - DNA, 1441 bp, Bovine  19866881217279
tcttgcctggagaagcccccatggacagaggaacctggcaggctacaatctacagattcgcaaagagtcagacacaactgagggattaagcacataaacatatatagatatacatataaatacacattttttaatgtctggaagctcacacaccaaaattgtaaaaatggagaaaaaggaaaggggcaaggtatagactgtagggaatggaatagttgcttttgctccagtattccaatgtttaagaaaatgtatttgtgcactacttgtaaaattaaaattaagatcactagtagctagtgtttagttttccttgtcaccagtgggtattgtagatgtcagggtagagtctgtcctcgctacaagcaggtggggttttttttaatggactatcaggtttctccctgagaatccctccaacccacagcaaaagccccaaggcacttggccgcacaggcttttcagtcccacctatgtctgttgccccctggtggtgatgctgagtaactgctgccttttcctgatgtcagtgggaggggccaggctagaaagcagcccttgcctcaaaatggctccaggcatgtgcatagctggggctggggtcttatagctgatggacaggcctcaggatgcagctctttctggatatttggccctgatctgctttcctcgagtgggctgcagacagagggtacttggccagagcaaggctggagcgagccctgtccctggctgagttttagcacctcttcctgttccatgactctgtccttccttcaggggcaggaacaggctagcacaggagctggagtcctggggcctcagcgtggatccctatggagagaagccccatccttggccctctgaaagggaatcacttagctgaggctctagagctccagctgcctgaagccatgaccactcacatgtgcctatgacccagctttgcatgaagctggggtcagggctcagtctctgtctggagtcatagttcagtctgtgatccctttggggtcagagttggatcaggttctgagctcagactggggtcaaggttagggctcaggctggggctgggtcaggtctcagcctccatccaggatcaggatcaggaggaggaccagagcctctgggctctgaaggcaaatccgtttctcttctcaggttttcaggtcaatctcagagtcccaaagtgatttttcccctgagcagaaattacggccccgcaggagcacctgctaaatgggggtggggcggggtgggacaaggggagtggcagggtgggggaggcgcaccggccctcagccaggcagcacctagacaatgcgacactttgttctttaactgaagaaggcgcgcgctttgatttgtgtatggataactcatttcttgataaactttaaacttcccgcagactttgccctcctcccagagcaggctt

SEQ ID NO: 33337 - DNA, 722 bp, Bovine  19866881623191
aaactcctaacctccgtaaaagacagaaagaggcaggaagggttagagagcaccgagctgaaatctaagaaaacattgtcaagaacgttttcctcatcaccgggagaaaatgccttgctgaagggcaggaggaaaacagcaagatgagtaggctgtgtgacgcgctgccagcaaaacatcccaagtgatgacagctgacgtgctcacagtattttaggatctctccaccactcgcacatttgttccttagatacactgacgaaggcccacagtacagatgattgactctcttcccattgaggctttgctactgaggcataacagtatcaaagtcatggtcctgggaaacacaagctattggtgcaatgaacactacactgtgtatattaataaaattcttcagtgcctttcccacaggattcgggaaccttcttctttgcctcttggtagcacagcttcctctgcagtgtctctctcctagacattgcctcgatgccaccaacagtgtttgcccagccaggcctctgctgttagggccttgatctgttaaatatgataaacttactctcaataacatggctgttcatagtgtcatgagtggcgctgttgaaatgacagctaaattgaagcttcattttcaaggcctcaactaggaatgcaacaatacaaacgatgaagataattggctcccaggccctaagatcactagcttatctcagata

SEQ ID NO: 33338 - DNA, 652 bp, Bovine  19866881727960
ggtttctgttagttcagaagccagctcccatgaagatacacaggtgtggttcaggaaacatgactgaagctgaccagagctgatggcctccaagatggcactgatgggcctaccacagccagcatttcattccgagactgtgagatctccgcaacagagaccctgagtgaggggaagggcccacacaccaccccctgcttctcctggttcagtggatatctacctaggctgggttccagttaagtcagccactgtcttctgcttgagaacagaagccagaataaatgtcaattcatttcaaatatgtctgccaatattttaaagaaaaaaatggatgaggtggaggagcattaattaaaataatcaggaattaataatgtttaaattgacgttcatgaatctttcagtccgggtttcccactgcacccagactgaaattgttcaatgtgaaaacaagctattattattttttttttttttttgatgaaacacttttaggtaggtttcctagaggagcactgaggcttttgcagatgtccaataaaaacatgcagaagaattctcacttttctaaacctccctgaacccaaattcacttattagataaaccctgtctaaggttctataggcttggttaccaattctaattcta

SEQ ID NO: 33339 - DNA, 631 bp, Bovine  19866881734743
tacttacttttatggctctcttagataattacctttcctcctctgtcatgtccctggaaaggagtgcctgttgtcctctgaggtgctgctcaatttcttctaaatgctcccggaaactctggcacaccgtcttcattgtttccatctcatggactgtgcactgcgaacaattagaaagagctgggaagcaagggctttctgagtcactgcaagagttcactgcagtggcacctgccttcccacctgggctttcttgtgtgcaatgtagccctgctgctaatgtgctggagagagaacaggaaaagcctagacttcggctttttcagtcaaatagagacatatgtggctgggacaagagagcagtgactattgaatggcccttggagacattatgttccagggacaagaagtcagtctggaaacctaggtaatatagggtgtaaggatgtagacaggatcagagaggtagggccccataatgcaggcttgtgtttagaaaagctgagtcttgtataatcttgttttactttggtgccaagtcctgcctcactctgaatctcagtgatattgaacacatctactggatgatatgtgcttgattagagagtctgcttagaatattttttactag

SEQ ID NO: 33340 - DNA, 1054 bp, Bovine  19866881793431
ccctgctgagctatgtactatatacagtatctgttctctttcctttaccccaaggggccatggagatctgctctgtggggtccctgaggggaataaagacgaggttttcctccctgacccagactcaagaggctgctccaatgcccatcttgcaacaggaagaccgctgggaataaagccagctccccgcagagacaggcctgagatgctctcagcacagaaacctcaccctcctttttctgagccagtcagcttctcacagaggttaactctgctcccgagaaaaggaaggttaaccctgaccccagaatggggctgagccctaagccctggcttcaaacagcgttgagcctaagcacaagcttaacccggactcaggcccacactccatgcctggccactgcccaagttctgagcccagccattccttctcccagcagccagtgagagtggaggtggctcagggctgctgccccctgcaggaacctcagcccccagcaggtcctctgattgggtctggagcatcatcttggtctacagaggagggcaaacgtcatcatctgagccgctggaacaaacctacaggaaaaggagtgagtgccggtctgtgggcacaggcaggaggtcctctccgtctctcctggggattcccaggcttaaatttgttctgggaacagagggaaaacccagaaaattgttgtgggcagatctgaaagggtctcagcccaacacataactctgctgaccaaggggattcagacacagctctgaaatctcccctctcccatcacatcctgcccctttttgaattcccccattgtcccctcctctccccacccagcagtagatacctcccagctcaaagcactccaggtagggcagttttgtacaagactggaacccactggggccttttcttccaggaagccttgtttaatatcatcttgcctgtaaattccttgaggggaggaataatggtgcaagcaagcttggagtcaagggcctgcctgcctgcactgtagctacagcttcattctttcccacggattcatcc

SEQ ID NO: 33341 - DNA, 801 bp, Bovine  19866881961475
tttccttaaattaggaaccaagcgtatcaccaaaaactaaaccacacaattcttaaagtactgggaaatcctatcagattgaaatttggcatagaaaagttagtcatcaaaaatactaatggtggagcttctctgaactaggtaaaaccaagaaaagcctttcatatttaccaattcaatgtttttcaaagaaaagcaaatttttgtaactggaagtgctttggtacttatggataattcaagtgaaaagagtcttctaagaaaatcaataacgtatcaaaggattgagggaggaatattgggtgtttaagaaaacaaatgcttcttcaacccttcaaaaccttccatttacacatggacatcatgaattaaaacttgaatgcagtttttaggctgagatgaataatatgtaataattccacaagaactccacatttgattagaaatttagtaatccttttataaatcaggatgtacagaggatatgtgatatccaaatctaccccatttgtgaaaactaaatctcaaatcaaaccaatcatttgaatgttaccacctacttgccatgtgggacatttcaaaaagtcatataatagaaaatttatcatcgacttcttgccattttagctcacctggtttcatcaatgtacacagattcaagcacggaggctgcatattccaaattcttcttgagatctaccactgaagcctcccctctctctaactgtttgaccaaagatcgtaacctggaggtgggggaagagacatcattcaattagaatagaagaaacaaaaaataat

SEQ ID NO: 33342 - DNA, 911 bp, Bovine  19866882042959
ctggggctgccgcagctgggccctgcaacctgaggagcaggactgctttgggaggtagagcagggccttggaggacagcgagaagccaaaagctgtcaatgtccggggcttttgtgggaaggggctggtctgtagtgtccccctcatccgtctgaatctcctggtgtggatatttctcttctggggctccccccaccctgtctctgtgtgcacgtctctctccttctgtgcctgtccttttgtttttctctgactctttcttctactttatggggctccagcttccagctgtgggaagtgaaggaccaacccattaggcagctggcttgtctctgtgatactggacatctggggctagggttggctggaggtggctggagctttgcacttgcatccagatggccagctacctgctctgtcagaatcctggttccctttgcacactcccctcagtatgtctctctctctttcctcactgtcttctctctagattattctaccccaggtgtccctgacacagacaggatgctgtgtgtgtatgtgtgtgtgtgtgtgtgtgtagggagtctggggaatgacaggtgggacagcacaacccaagttcacggagcctgtctgccggctttccagggagcaggtcaggctggcaggcaggatgaggttgatgggcagtccgtttcccagcctcagagatgttgcataagcagccgcagccccgcgcacattcccatggttacggggctgggaaaggctggcggtggtggcatcgccatggcaccagcatggcccagggctcagctggcatggtgctggcacagagcaactctgagttctcactggacagatctctgccaggcagggctcctcccgggcatcgagtggcttgtggagtcaggcaggaggcaagcagc

SEQ ID NO: 33343 - DNA, 2691 bp, Bovine  19866880158608
aatcactgcagatggtgagtgcagccatgaaattaaaagacgcttactccttggaaggaaagttatgaccaacctagatagcatattcaaaagcagagacattactttgccaacaaaggtttgtctagtcaaagctatggtttttcctgtggtcatgtatggatgtgaaagttggactgtgaagaaggctgagtgccaaagaattgatgcttttgaactgtggtgttggagaagactcttgagagtcccttggactgcaaggagatccaaccagtccattctaagggagatcagtcctgggtgttctatggaaggaatgatgctaaagctgaaactccatattttggccacctcatgggaagagttgactcactggaaaagagtctgatgctgggaggaattggaggcaggagaagaaggggacgacagaggatgagatggctggatggcatcaccgacttgatggacatgagtttgggtgaactctgggagttggtgatggacagggaggcctggcatgctgcagttcatggggtcgcaaagagttggacccgcactgagtgactgaactggactgaactgaactgaaggtgatggatagggatgcctggcgtgttgcagtccatggggtggcaaagcgtcagacacgactgagtgactgaaccgactgactgactgaagttggtgccagcagtaaagaatctgcctgccaatgcagaagatataggagatgcaggtttgatgcctggtttgggaagatcctctggagtaggaaatggcaacccagtccagtattcttacctgggaaatcccattgacagagaagcctggtgggctgtagtccacaggatcgcaaagagttggacatgattgagcactgaaaaggatctgcacccccaaaagcaagcattcgttttgggctatatgcaccctatttcccagagtcccgagcaaagtctgacccaatggtctaaagaaaatgtttatttcagtagaagctgagcataaccagggacatattacagtcaaagaccttcttctgcagaatcttttaaaaacaattagatgaggagatgcagttttttggacttaattcatgccaagatcatgcatatacttaggagcaaatacttgcagctgtgtcattataaacaaacacggcaaatattgctacccaatctttttctgcacaacttttcagacagctaataccaataaacaagagggtcctgcaaattaaaatctttcattttttatagtccagtaaacctgatgccaaaattggatggccctagagatcaacttaacataaatttactgaataatcatcagaatactttgtatggttacatgagatcacagtgaggcataaaatatggtgtacacccttgaggaactttgaatcctcccgtaggagggtcctacaggaaatctagatgagaggagagagctggaagatgtaaaatgtttaagcatataaagagcaacaattggggaatttggctgaggtagggaggagcagagaaaaagaaggtaagatccagagaggaagagagttgctcagaagggctccagcattaatgatcactgatcctgaaaaacaagtctttactgtctgctccactctgcattgtctacaggatgtaggtgcctcgagttagaaagaaggattgttggagccatagatgcatcagtgtttctagaatgcctaataatataaggaatatgtttgaactatttgaagtattttttaaaaatggagaacaaacagtgaaatcaaaccaattcttgaagttagtactttgataagattggagaacactaaggcatttttatactactaaattagttactagacatagaaatgtatctgtaaagtatactgtatacttaatcaaatatttaatggacagcatttgtgtgtgtctttgacaacttaagccaactcttttcactgtacatttatgagaggaaactgttagttctttccatgatttgtagaaattatttttgccatggaactctttacaaagttatcttctaattttattttccctagcacattctacttaggctagcaatacattataagtgctctatttaataatgctgcataggaagctttatgtctgttccagtgattaaatttactgaaagtaactatgtaaacttaattttttaaatctaatattatatccaaaaagatatttatccaatgaatatgccaaaatcagtgtctgcatttgttaaacataactttttacaattcctgtttactaatatctccaactaatcttatatttttccaaaaaatgcacagtgtctaattgcatgcaactggatataagcttcaaatgtgcttacttggatcattctctgtttggaaaagaaatatctaccattataaccaaggtttctctttttatttagttttaaagcagctgaaaacataacgcagtgaactcatctttaaagaggtttcctattggtatctcagagcttaaatactgcaagtaggattgcagatggtccgtctgtatgatacagcctatcaaatgactgatctcttacatgggcagatggctgagaggcctgacagcagctcagtttccaagttgcgagtgagtgtgtgtgtgtgtgtgtgtgtgtgtgtgtgaaaaaataaagagagagagagagagagagagactg

SEQ ID NO: 33344 - DNA, 2037 bp, Bovine  19866880216256
tttctttatatatatataatgagttgttttttccccccaatgattctctgcctccaggcaaatctatttaagtgaatgtgtacacatataatccatgggttctagaaactgagaaaataggaaatcttgacctctcaatggctctcaggtggtgttccacagcaccctccaggagcaccaggaacaggactgaagcagtgagaaaccaagatacaccagtgatgccctgctctggtcactcctataacttcaacaagcagctcaacttattctcttttttttttttaatataatttttgctttattattttattcatgcatatgaagaaaaggttttgtgaacctaaaaatatttatgtaaatgcttagtatgttttagctttgtctttctcattagattccaggcttctgcacccaaagggccgggcacagtaattgctagataattgggtcagtttgttcctgattggctcctctgcaaatgtacagatgacaaccacagtgatcatgtctcttaatcttttcaaacaactctattctagtctcctaaacgctagttcctttctgtgttctctcattttcttaaataatggtgtcttgggcctcccagaatgaacatgaattatagctccattatgtctttatagatagcaagttttagctttctttccaaagcacacaaatggattttaaggagatctgtaaatggttataatttaagatcagagggtattatccttgagataagattagaatttggcagggaaaaaaaaaaacaaaaaacacaacttttatttagaaacttggcaacttgaacatagaagcttactgcagcagaatttcaagtcagatacttggttgggatgcaagaagtaaaggttggaaaacaagaagtaggttacatttgaaaggactaagtagtgagtgaatttacttcttaaactgttatcttcttccccatatttactctgttgtactgaaatgtttgttttgttgtttcaggcagagagagagagaatgcacaagcacttcatcataagaaactagcttacatgttcatgatggctgacaagttcgaaatctggagggcaagctgacaggctagaaattcacgtaagatttaacgtcacagtcttgagtcgaaattctgaaggctggtgaggcaagtgagcaactcaggcagggtttctacattggagtcttgaggctgaattccttctttggaatctaggctggcgctgaccgaactactgcacaccacaggctagtcgagttgacatagaaaattgaccatcactgtgtcttgttactgatcagcctctggtttctaaaatcttttcctcagtcagctctactcagttccacctcacttcacaaagtaaaataaagcttaattttagtcttttaagggtcttccatttgctagagaccagccatccctgaactagtctggatttccgagagcttctggatgacacagccacacaggccaaatccccaagcagccttgtgtgacagaggcattcctggctggtaggtttggcagaagagagagcggagagagaaatggattatgtgaggtaggttgaccccagaatttcaatacagacttatcagctaatcagtactattacagacagtatatcatttgtatcattattgctaaaattttcaagaagtctgaggcagtccacctttgaggtacacacttcaagaatgtggctaagggcggctctgaactgctctttcatcctgtgttcagaatctcagtggtcatctccatggatttgtttagagaagaactgaggtattcaacaccataattcaagctcccaaaatgacatctgtccaaatgaacacaagtggctgcataaaatgagcactaaaaaatgaggttaaccgtagtcatgcttcatgagctctcgtatgctgtttcagtctgcttaaaaagcagacatatgacccaggatggtatggggagggaggagggaggagggttcaggatggggaacacatgtatacctgtggcggattcat

SEQ ID NO: 33345 - DNA, 4047 bp, Bovine  19866880234178
tttcatatgctattgctaggaatagaaattgtttaaaagtgttttaaaaatctcttagcaatttttaataaattcctaaattgaaaaaatatatccaaaccataaaaagtcccaatattatatttaagaacattctagtagttctcaaaattattactcagaccatctcaaacttccctcacatttttctgaattgaaatgttcagatgagtacttgctaaaaagacacaaatatgaacaagtgtttgttcaacaaagtccttgccaaaagagattcatggataatttcaggcgagagacctgaaattactaatagagaagatcatggaagcactagaggatttacaaaatgatatggtaaaaaatagatgagaagtaaaattgaatctggttaaagaaatgtagaaagtgcatgaagaatacttgccagaagtgatattatgtagggccttgcaggataatatgagttttcctttccaattagcttgggagagatgtggagatagaattttagatcacatccacgatattaaatgtacagagataagaaactgtatgttggaagagtatgtgtagtaaaagaagaaacagaaagtatattggggccaaatttcataacatatatgttataaaaagaagtaggatagttactgtgacttcctagtatatcaaattacttaaaatctgttgctattagaaatgatacctatttgcagaagtacatcatatcactactttaaattttatatgtactatttacttgaatatcacaagaaactcctattattttaaagatttatgtcattttaatgaaataattttgatgagagtaaaatgaagaaatctgaaatgttacgtgtatttaaaaaaacatgccctgttactttgagactgtgtgtgtatactgtcgtgtctgaccctttgcagtcccatagactgtagcctgcccaggcttctctgtccatggagttttccaggcaagaatactggagcgggtcgccacttcctactccagggagtcttcctgacccagagatcgaacctgtgtctcccaattctcctacattggcgggtggattctttaccactgcaccacctgggaagtagctgttactttgagaaattcactgaataagagtgtttctttttcctggaatttttataggcagttaactgcttgttgaaacaagtagcatgtgttttatagtgaaaaaaatgttttgtctttctcatcccatatttaatatgtttagaaacatgcaaaagtctgatatgttactgacatacttgatatctgtaacttttaaaatggaaatcataagctaggattctttagcttataggtaaccgatatccacttctacttggttgagctgaaagaggaaatttacaatgaggatattcagatatgttgagtaagcaaggagatttgaaaacgccttaggaagagtgaacacaccagagggtgagatggttggatggcatcaccgactgatggatgtgagtctgagcgagctctggggttggtgatggacagggaggcctggcatgctgcagtccatggggtcgcaaagagttggacacgactgagcaactgaactgaactgaactaggaagagtgaaaaccagggtgattctatggatctcagaagtaagagttctgtcatttcgtggctccagctggctctcaagaatccaactgactgtcggatcaatcacctgtggtcatcctgacaggacatagaacagagcaataggggcttaattcacaatcagcatacattggtgaaaatataaaatttgggaatgattcttcctccaaatagattttccaaagaattaaagcattttgttttatacataaatgaatgagtctaagggaatactcttttcttaaaatctcactgaacttatacatcctctttatcctagcccttggctgtaagaaaaaggtatgcaaaaatagaacaggctgcgtccaacattttctttacatattgtttgggaaaatgtctaacatactgtttgtcagaggcaaaagtttccagagagctatagttagtggctataaaaagattaagagaagcattgtattaaatgttacccttagctgatctagctgaaaaaaaaaaaaaaatgacaaaagagaagggtgtttgagacgacaaggggtatgataaaaagtcactgctcacggtttggataaatcaaaaaggccctgttgaagcctgaatgcaacctctctatttggctgtcctgtaacgtactaagtcgcctcagtcgtgtccgactctttgcaaccccggactgtagcctgccaggcttcctctgtccatgggattctccaggcaagaatactggagtgggctgtcaaccccttctttagggttcttcgcaacccagggatctacctgtgttggcaagcaggttctttaccacagcaccacctggaagcccttggttgtactagcagagcgaaacagacctgagtcacagagtgaggtgtacacctagggtgacctggctgaagcattagtgtaggtaccagcccaagaaaggttaaaaagttcatgtttcctgaggtgtctgggaaagcccagaggagagaacactgtgcttcctaacacaggctaatatttagttgctaaatgataactaagggcttattatgtgccagataactcagattggcttgctttatttcacttaacattcaaaatagcttaatgagataagcactgttctgtactccagtttactgaagcagccacacagaaagtccaagcttttggaccatgtgattttattttgatactctgtataaacagatgtcagcataaaaaaattttaagaggaaaaccagtccctttgttgttaaaagtttatcctaaaataaactaagtgatgacagtttctcaggcagcacccaacattagtgaagctctaactttgtgccatattaaagatgtgtaagcttgaccagggttatgaatttgattattgtttaaacggctggcaatttagcagtttatctttgccagacccctcaaagcttttctcaattatagaaaaaaaaaatgccttgcactttggcaagtgaatatttttcagttgttgctcatcccaaacaggggacccagcatttttatttctgtatatgagagtcaggcttcccaggtggcactactggtaaagaatccacctgccgttaacaaacatgggtttgatccctgggtcgggaagatcccctggaggagggcatggcaatccactccagtattcttgcctagataatgccatggacagaggagcctggtgggctatagaccatggggtcataaagagttggacatgactgaagtgacttagcatgcatgcatgcagagtcagcaaggatattcattattattctgagcatgcatgataaaattgttaattagaagtttataaccaagtgaatgaacttatggtatttctgtaatttatatattataacaaataaaatgtgtagtcaatataatgaattattagttacaaatttaatgataacaagggtagttcatactttgtagaactatgaattctcatatcatatgtatttttttcctttgggcatttttttgtctcctaacttgtattctgattatttgaatatctccccctctatattttaggcacaactagccagggactataattgaattatactctcagcattttccccagttatgtcaagaattaggattctttaacttttgtacctcaagcacacaagttttacagtactttggggagaattattttccatgtctgagtttccttatcacagcgattcgttctattgcttatttctattctaggacctataaattgcttcacagtagggtttttcaaactagacagtgtataccaacctccacagtttttgccaaatagatcatctgcactgttacctaattaatattttcaagtaaatttgagacttttatctaaaatttacttggaaggaactatctaactatgcaaaggaaaaacagaataaggcaa

SEQ ID NO: 33346 - DNA, 1900 bp, Bovine  19866880283109
ttcccaaagagcacacatacttcaggttttctcttaatatgtgtagaagaccatgtaggggtgtaattttgtttgttttatttcagaacttctctttcttgaatcacaagcaagcatgtgtctgaagtaaacaaacaaaatgggcatgtgcgtttcttttcaagaaactaataggatttaggatgagttatcaccaggccttgccagtttgtactaatgtgttaacatgtacacagagataagttccaggtgatagaaggagctttagctgcattctcactacagcccagactctacttttatgcttctaattttagttggggaaaatccaaccagtacatctaggtgtgcaaggttgtggagaatcacagccaagctctgtgtgaatcagtgtgcgttgctgtgaagcaattgaggactgaattgaatttttcaagtaaatatgttatttgaaaattctccattgagtttatcctaagaataatatatactttttgatctatataaggattttcttcgaaatatccaaggaagcatattttcagccagtctctatgataaatggcttgatgttattgatcaagggaatgaggacgacaaaataaaggcgacccagaggtaatgatgccataattactcaactctgagaaaatacaaccaacatactcttaggaaaatattagcttatactttacagctgtgtcctctaaaataatgaccagtatcacggggtttcacttgatcatgcccatggaagccagtttgaaatgagatgcatgccttattggtcacactgtaattgtcaccaatcttattaacatggaatgcttgaccattttatgccttctgaatacacgaaactgatggaggtgaaatccactggtctcaaaagagatgataaagaaccaatccgccagtggtatgatcttaaatacaaacacataactaaccagagtagttcttatctgaatcaggaattaaattcagtgaaacattttgtatgcattcatgcctggaactgtgagaatggactgtgtacatggtataaaaagaagtactttgttctctgtatttccacttactaagcaaaatgactcgctttatttataagtgtgttttctgtccttaggcttctagaccagctgccgagagccaatgtagtttttctgcgatatctttttgcagttttacgcaatattgagcaacattcctcatccaatcagatgacagcttataatttatcagtgtgtataaccccaagcattcttcatctgcctaattctggcagctcagaattaggaaactttaccaaaaaggtaacgagatctcttattcttatgccttgtggggcagagtccccatcttgaacctgaagtctgtagtattaactctgatgaaccagtttttaaagtgcacattttaattacactgccttggagtggcagagtcctactctggttgggcatgggaaggtgtattataactgagaacagttgactcacttcccctttgccacccaagagattaaatgatagagaggtaagagtaggatgatatgatagaaaagaacctggctttggaatcagagagccaaggttcaactctcagcctaatcactgagggtatacaagcctccaaactatgatttcatcattacacaatgatgacaacacccaatacatctggtcactgtcggcacaccttagcagcctgggcaatatgagcacctgaggctccacacatactggccgcactctgccagctgtggctcattcaggaaagtatttggcttccattgtgtctccgccagaggatgaggaagctagtaaaatatttcagaacatcctaacagagccacaacatgcctaatatgatcacagatctttcccaagctgccccg

SEQ ID NO: 33347 - DNA, 3813 bp, Bovine  19866880289689
ctaaaggagatcgtcctgagtgttcctggaaggactgatgttgaaactgaaactccaatactttggccaccttatgagaagaactgactcatttgaaaagaccttcatgctgggaaagattgatggcaggaggtgaaggggatgacagaggatgagatggttggatggcatcactgagtcaatggaatgagtttgggtaaactccgggagttggtgatggacagggaagcctggcatgctgtggtccatggggtcgcaaagagttggacacgactgagcgactgaattgaactgaaatgcagagtacataatgcaaaatgctgggctggatttttcagtcatatgctggactcaagattgctgggagaaatatcaacaacttcagaaatgcagatgataccactctaatggcagaaagtgaaaaggaactaaagagcctcttgatgaggctgaaagaggagagtgaaaaatctggcttgaaactcaacattcaaaaaactaagatcatggcatccaatcccaccacttcatggcaaatagaaggtaaaagtagaagcggtgacagattttattttcttgggctccaaaatcactgtggatagtaactgcagccattaaattaagacacttgctccttgcaaggaaagctatgacaaacctagatagtgtattaaaaagtagagacatcactttgctgacaaatatccgtccaagtcaaagctatggtttttccagtagtcatgtacagctgtgagagttggaccagaaagaaggctgagcactgaagaattgatgctttattactgtggtgctggagaagaatgttgagaatcccttggacagcaaggagatcaaactaatcagtcctgaaggaaatcaatcctgaatagtcactagaagcatgaatgctgaagctgatgctccaatagtctggccacctgatgcaaagtccctcattggaaaagaccctgatgctgggaaagactgaaggcagaaggagaaggggacagcagaggatgagatggttagacaacatcgcagattcaatggactaaatttgagtgaagtcaggatacagtgaaggacaggggactctggcatgctgcagttcatgcagtcgcaaagatttgtacaagcctgagggactgagcaacaacaataacaaaagtgcttggatgtgcaaggcaaagtacctgataagacaggctgtgttgtgggtgcgggagggcgtaaaggaggagtagcagaagacagcggctagccaggctcaacatgtatttgggaagactcttaagagaacaagcaagcaaaaaaaaaataaaaataaaaataaataaaaaataaataaaaaaaaaagagaacaagcaaaaaatacctgttgaaagctgaaagtggaatggtgctaccaattataaaactgtttgaagacagtgggcactgcctcactctagtattcttgctggagagtcccatggacagaggggcctggagggctacagtccgtaggtcgcaaagagttggacacgactgaagtgactgagtatgcacacacacaggatgcaagaaggtgattcttggagtatttgaaagctgttttagttgactgatgagactttgagaggagcctaaatgacatgtgagagagagaacaatcctcgcctagctgcatagcagaagccatagagaagggggaaaatgacacatgcaaatttgtatcaatactagggatttgactttgaatgcactttgcacctgtgcttttgatcttcacttgttcacttcacaagtttgtctgttaaatccaaagtgagcacaagtgtttgagaaattaaattacttttccattgactctaaaaagaatccacctaagacaacaaaattttatgtcactatgaaaaaattacttttttccccaagtttatatttaaaatcgataggttgcattaaatagtattatagtaaattcatcctggaccaatatggaaatcttcaggtatatgagaaaattcagagtaaatgttaatagaagaaataaaacacactaacttatattgacagtaaactgcacacgacaaaactacaaaatttgagtggagaaattagatttgatagatttatgactgcaaaagaacactcaaaaacgcaaaagctgtaaagtgtaaaagtggatatgaaaaacaaatagactgattactcaaaggaaaatgtaatataaaatgtttatatacagtagttgatacctgctgaatattttcaaataaaattccaatgtagacaaaatttcttatttatatatttacatttattaaaaataattgtcaaagcatcctcaggattaaaacagtgggataaaaggaacaggtgaagcatcttcttcatgtgcaagatacatctaaaacaagttacattgtttacagaagagtgtaacaatttttctaacattttattataatacttgctcagtcttctcagtgatacttaaaatcatagatactgagacagatgctattaaatctgaaaaagttgaaactcagtttacatatgttctgatagttattaatatatcaaagtgtactgcaacccatgctttgaaagttctcccatatcttgtgtaactctgtatattatggaattttcatatttgtaaatactcacttgcaaaatgtatttgaatccaaatcaaacctacctgacaggtcttcatcagagaatatctaggtcccttcagtgcaagtgggacttggtaagttctcaggatgctttggtatgttccaaggtgcaagataaattagaatccattttggaaaagatatttttcacatatcctgtccctcccccactctactagagagaatgttaaatcatcttcttttctacaaaattaaagttacatggttacaaagtatcaacattcagggtaaaaattaacctcctgtaagctgtatagtgggagaggtaggacatgagtgataaagtgataacaaaaatgaataaatatatgtgtgtcttaggtttaagctgagaaaccatactttgcacatttttaacgacagggccatgaaactggaaagactctggaggatgatgtacaatcacttcttattgtgtatgttgaaaacggaatgcagttctctgccttcagtttagtgcttgccctgaaaagttaagcaccagcaagaagtttctgctttattgactatgccaaagcctttgactgtgtggatcataatcaactgggaaattctgaaagagatgggaataccagaccacctgacctgcctcttgagaaacctgtatgcaggtcaggaagcaacagttagaactggacatggaacaacagattggttccaaataggaaaaggagtatgttaaggctgtatattgtcaccctgctaatttaacttctatgcagagtacatcatgagaaacgctgggctgaaagaagcacaagctgggatcaagattgccgggagaaatattaataacctcagatatgcagatggcaccacccttatggcagaaagtgaagaggacctaaaaagcctcttggtgaaaatgaaagtggagagtgaaaaagttggcttaaagctcaacattcagaaacgaagatcatggcatctggtctcatgctttcatgggaaatagatggggaaacagtgtcagactttattttggggggctccaaaatcactgcagatggtgattgcagccatgaaattaaaagacgcttactccttggaaggaaagttatgaccaacctagatagcatattcaaaagcagagacattactttgccaacaaaggtttgtctag

SEQ ID NO: 33348 - DNA, 3354 bp, Bovine  19866880292038
ctaatcagtactattacagacagtatatcatttgtatcattattgctaaaattttcaagaagtctgaggcagtccacctttgaggtacacacttcaagaatgtggctaagggcggctctgaactgctctttcatcctgtgttcagaatctcagtggtcatctccatggatttgtttagagaagaactgaggtattcaacaccataattcaagctcccaaaatgacatctgtccaaatgaacacaagtggctgcataaaatgagcactaaaaaatgaggttaaccgtagtcatgcttcatgagctctcgtatgctgtttcagtctgcttaaaaagcagacatatgacccaggatggtatggggagggaggagggaggagggttcaggatggggaacacatgtatacctgtggcggattcattttgatatttggcaaaactaatacaattttgtaaagtttaaaaataaaataaaattgtagttggaggaaaaaaaaaagcagacatatgcatttctatatttgatgtcctacagataagtatctggtgatattcagatttcacttgctaaaggacaaatagtaaacactggggtcagaactagatcacagccttttccactatgtcatctagtctgttaaacattcgtaattactattctgggaaatagaatcattaggcttctaaagtaaattatggacaagcagcacggaacttacttgttttagaggtaggggttctgacagaaaacgaaaaaaaaaaaaaccagtggcatcactttgaaaatctcttactgtgaactgccatagaaaagttaaaatttacatgaatcccactgataaactgtaacattaaaaaaatggaagaataaagaaatggtgtttttcagttatgataataaaggaagcaattttcttttgtgcctggcaattacactgaaaacataactgcaagtcaaatttagctgaatctttgaagaagtagagcagggtaagagactcatttgtgggttctgagaatcagcttgatctttccttccatcacaaaaatcaaaaaggttattgtaacttgagaaggaaaagcaagattcaacaatggctgagatgaaagacaccgggagcagatttgctgccttttcagtattttctaactgggcatcctgtctccaactggatactcttctaattgattcttcaaaatcttaacttccaataattaaacttccatggggtcgcaaagagttggacacgactgagccactgaactgatacagaggtgagagtccagaaggaaattagcattcattggataccagtcagcttctttcatgttgccttgttttatttacttcagagctttacctactgcctgaaacgacctcagttgtttgtggttggtctacccttactagaatcaagttccctgaaagcagagctctgctctgtcatgtcttccagacgctgaggcaccaaaagaccatagttgacacgtagtaggagttcacgttttgtcaataaactctaggcctggtgggctgccatctgtgtggtcgcacggagtcggacacgactgaagtgacttagcagcagcagcagcaggcacaagactagacacattgtgaatcttacatcatatgctctcaagtgatcttgaaatgcaaatactatcattcctgtcttcagtaagaaatcaaggtttagaggaactaagtaacttgtcaaaaatcaggcaattaaggagaggggatttgagctaaggtatgatgcacattgcttgtggtccatgtcataaggcatgtttcccaaaataaaccgtggttggaaataagatgttcgtgggcatttttggacatggtggtgggggagggtgaattgagagagtagcactgaaacatatacattaccatatgtaaaattagatagccagtggaaatttactgcatgatgcagggagttcaaatccagtgttctgtgacaacctggaagggagggctgggatgggaggtgggagggaagttcaagagggagaagacatatgcatacctatggctgattcatgttgatatgtggcagaaagcaacactatatggtaaagcaattatcctccaaataaaaataaataaaaaatttaaaaactggcatgaagtaacatagcattagatcataagacacccactcctttataaacttcctttggttaacttgattgcatcaatggtaaagactgagattagtgccagtgtgtatttaatgcttctctaataactgctactctctctcgccctcattcagttgagagctggtaagaaaataaagccaaagctttgtttccaggcttttattttaatctatataattattctataggtgattatacctataaattatatgcttgtgcatgcctggtcgctcagtcttgtccgattcttttgtgaaccaatggactgtagcccgctaggctccttagtccatggcgttacccaggcaagaatattggagagggttgtcatttcctcctcccgggggtcttcctgaaccagagatggaacctacatctcctgcgctgtaggcagattctttggagtctgccgagtcattggagaagcccattatataaacatagtctatttataaaggatctacacaactattgcaaatcacttgccttattctgtttttccatttgcaatagttagatagttccttcacaagtaaattttagataaaagtctcaaatttacttgaaaatattaattaggtaacagtgcagatgatctatttggcaaaaactgtggaggttggtatacactgtctagtttgaaaaaccctactgtgaagcaatttataggtcctagaatagaaataagcaatagaacgaatcgctgtgataaggaaactcagacatggaaaataattctccccaaagtactgtaaaacttgtgtgcttgaggtacaaaagttaaagaatcctaattcttgacataactggggaaaatgctgagagtataattcaattatagtccctggctagttgtgcctaaaatatagagggggagatattcaaataatcagaatacaagttaggagacaaaaaaatgcccaaaggaaaaaaatacatatgatatgagaattcatagttctacaaagtatgaactacccttgttatcattaaatttgtaactaataattcattatattgactacacattttatttgttataatatataaattacagaaataccataagttcattcacttggttataaacttctaattaacaattttatcatgcatgctcagaataataatgaatatccttgctgactctgcatgcatgcatgctaagtcacttcagt

SEQ ID NO: 33349 - DNA, 1098 bp, Bovine  19866880421497
atgtgcatttctctaaaaacactccacttatgttcaggtctacagattcgtgaggctttgaaataagaattaagaatacaaagtaaattctcatttacactatttctctctattcctttaagacagtggatcaaatattaaaatatattcttccccattaaaggaattttacagttattattattttcttatcccattttgagtacagattgcatctggaaaattcaacaggttaaaaaaaaatgtatgtatgaaatgatatatggatccaacatgcattcatgaaataaatattccagaacttatcatctccaaagccaaattgctatgaatcaaaaactcatatatgatggcaaagtattgcagcaacacattttccctaaaaaggaaaagaatagaaaagagaagagtttcattctttgaacacctagatgtgctaaatatcatgttagagacatttatatgtctgtgtaatggaaatgcctgtgactgttttgtgatgtagttatttttatcctcgtttttatagagaagtcatttgaagttcggagagattgaacacatgctcagcaacacactgttagtgagatctagagtctgaatccctgtctgatgagcccatgtctatcagaacctgtgtcttttccaatcattcttaccatgtgctggcatgggctgcactgggcgtgggcagtggagagtgtgcacagctgtgaggacagggtggctgttcactgttgacgggataaactccgtttctactcccagcatctatgctttgtttttttcctcatggagcatctattcagtaataagcctcacatcctcaggaagcaattgtcccatcattcttagaagactgttatgtccttaaatgttagatggaatgaggtcatacatcaggcccatggtgactggtctttgtttaatgatgataatgcatttgtcctaaggtcaaatgggattattaccagaactctactgaaacataaaaggcaaatggaaaagagacaaaaaaaacaggatcggtttcagatctcaaaagaaaaccacaaaatggatgtgatgttgaaaagcaaaacctggggacaaaaagca

SEQ ID NO: 33350 - DNA, 1158 bp, Bovine  19866880470153
atgaaaatatctctggtcttgaggttcttttttttttttctgtggcattataattatatcacacttcccttacatatttggaaaaaggcaggcttcataattggagaaggaaatggcaacccactccaatgttcttgcctggagaatcccagggacgggggagcccggtgggctgccgtctatggggtcgcacagagtcggacacgactgaagcgacttagcagcagcagcagcaggcttcataatgatgtctatgcagtcatctgagatattttaaatgagactgagcatcacctaaaaaaattttagtctgtaacttacaaaggaaagacaaatgattctccaggctagaatcaagatcaacaaaactatatctcttgatttacatttaaacatacacatttgtgttcctttaacctttaaagagtctatttttaaatgacctacttttaaactggtttttagttaagtgtgtcacacccagatgcagttgacttttaaaagtgtttcactccttgctatttctttctaaactaattattttatttttagccattctgactagcacaagatattttctctagagaatgaaatcttttctttaacaggaaagtagatgaaaggaggataggtttgttctggatataggtgttttaggttatttcatgtttctgtgaatggtgcatattatactgatcaattaaaacaacaccattcttctgtttaatatcttctgcagatgcaggtgaaagggcagtgagaagcctcaggagttcctgaggttgatcttccctgagacaggacttcaaagcgttaccaacagatggttgtccacctcatttgtaaaagttgctagggggaaattccacagttgtttttcatcctgaatccatctgtgctgcatccctttgtcaggaacgtgtgtctagtatctgtccaaaatctctcctgtttgaatgtaagtccatttcctcttcgttgtgaccttccttgatgggaagaacagctgctcgccatccactgtgtaatgtctctcccatggatcagcctttatatatcaaatagaattcttggctgcttcaagagaccttaggtaaaaaaccctatgtttgatttggagggaaaatgctgtgtactgattgaaatcattgcactgca

SEQ ID NO: 33351 - DNA, 1078 bp, Bovine  19866880490743
attcagaatcaatctgaattgtgttttagagtgtgaaccccattaatgataaaactttgttaaaatatattgtatagtgaaattgtggtaaagtatcaaatgataaaaaaaattcagctaagggtccaagataaagttatgagtgttaataaattgcaggtcaagaataaaaagatcttcattttgaaagataacataatgattaagaattttattttctctataggttattgcagtaggaagctttttttttttttttaaggaagactgcaaaaatctatgaagtgacctaccttttcacaaacttctttccaagaatgtctataaatatctccacaaagaaatatttctgaattccatagttttgataaaaataattacttctttttctggtttgtagaaaatagtcacagattaagaaattaggatattacatggaacaacagaatggttcaaaattgggaaaggagtatgtcaacactatatattgtcaccctgcttatttaacctatatgcggactacattgtgcaaaatgctgggctggatgactcacaagctggaatcaagattaccaggagaaatatcaacaacctcagatatatagatgataccactcaaatggtagaaagcaaagaggaactaaagcctcgtgatgagggtgaaagaggagagtggaaaaagctggcttgaaacccaacattcaaaaaactaagatcatggcatccagtcccatcacttcatggcaaatagatggggaaacaatggaaacagtgacagactttatttccttgggctccagaatcactgtggatggtgactgcagccatgaaattaaaagatgcttgctccttgaaaggaaaactatgacaaacctagacagtgtattaaaaagcagagatatcattttgctgacaaaggtccgtatagtcaaagctgtggtttttccagatgtcatgtatggatgtgaaagttggaccattaagaaggctgagggccaaagaactgatgctttccaattgtagtgctggagaagactatcgagagtccccctggactgcaaggaaatcaaactagtca

SEQ ID NO: 33352 - DNA, 1764 bp, Bovine  19866880512263
attttccaaaaaaaaaataaagcaaaaaaaataaataaataaaaaaattaagattttccaaaatgttaaattgagtgccacatatgttgtcagcttttcagctttcctcttatccaagccttccaatgctgctcaattattctccttctgtagtgtcagctttaaaaaaaaaatttataaaagaaacattataacgtaacataattttaataaagagtttttaaaaatcaattcatggtggctgacatctagaatttaatatcagaaacccagacttcctatgttctcaatgttttctcattgagaaaaagcaattaattaaaaaaaacaccctgcttggatcattggatagtctatacaacttaaattaaaacatcaatgataaaggcttacaatacctgaactaacactctaacgcaaggaatctactgttcaacaaacttctaataaaaggttggatttggaaaatagatcaataagagttattaatttctttaacaaattattcttttcacaaagcttaaccaatggattcttttaattagttaatgtcccttcttttgcctcaggacatttataacaattcatttaattaagtctgcatttctagatatcctgtgaattatcataccatggattagtatatttcatttaagtgaaagtaaaactataaagttcagtattgtgcaaaacatatctatctatattttaaacaatggacaattataaacatgagaagtatgaaaagcatatttcatgactgtgtgtgctgtttttgtcccactttagtcaacatggctttccgtttatctgagaaaacattcaagatgttcatttaaaaacataaatgccaaatgaattccagagaataataaattctttggaaatttggagaatgtactggggtgctttgatgatacattatctagcaggcctgacaggctgaactgtaacaaataacagattaggaaagtttggaatatttcaagaacttgagcaaagtctctagaacaggaattttaaagacatgtttaaggaacagagtgaaactatctcactaagggaaaattcagaaagaaaacaaagagataagctgtagtataaatgtaaaaagccttaaatgtcaggagagagtcagatttgaattacagaaatatttgacgtgtaagcatttatctgaaaaaaattatattaatatgatggctgttaaaaacaaacttgaaggacagaggtaaaaaggacactagcagtcagggatcccctggtgactccatggtaaagaatctgccagtgagggagatgcaggagatgtggattcaatccctggatcagaaggattccctggaggaaatggcaacccactccagtattgcctggagaatctcctggttaaagaagcctggcgggctacagtccacagtatcgcacagtcagacatgactgaccgattgagcacatgcacatcttaaatataggtgatatctatgttactgaaacaattaatcatcaaatgcatatttcagaaagtacacaatgtatgtgcttcggcaaaggaacgctctatttatcagtagagtggtaaaagagtctcaaaacatcaacctcagtcagtgattctcaacctggagtaagccgggtaagagaactgctgcccctgacagctgcacgtcaagatcctcttcttttccagagagaatcactgcatgaaatgagaaatgctactgggagagcgtgttgtgtgtgtaatcccctgcggaaacagaa

SEQ ID NO: 33353 - DNA, 759 bp, Bovine  19866880526772
cacctggaaactaatagattttttaaggtaaatttatacagctaagttttgcaccattagggtttttatttaaaagttttaacctttatttcaatttctagggggaatatttaacagttcacgctatttttacagcatcaatcacacatgtgttagtcactcagttgtgtccaactctttgtaaccctacggactggagcccgccaggctcctctgtccatggcattctccaagcaagaatactggaatgggttgccattcccttttccaggggatcttcttgacccaaggattgaacctgggtctcctgcattgcaggtggattcttcaccatctgaaccaccaaggaagccataatgggcatataaattttcttttcgactcttaatataacctgcagtgccaagaaacaaatatgtcagtaacgggaaacatcatctcatttttctgagaatgccttcttccaccattcctgcagtagacatgttttactaaactttatgtaagcatgtaaactccctgaggcagggattttgacttattcactgatttatcccgggtgccgaaaacatggagtattcaatgaatacaatctacaatctaaaccacatattcaaaaaaagaaaaatcataaactaagatgtgaggctttaaaacaatatacattatcaatttgatatccctcagtctattaactttcaacatgtcatttttaaacaaaacctctgttgaaacaggattataattacaaaagtatat

SEQ ID NO: 33354 - DNA, 714 bp, Bovine  19866880567748
ttttaataatggttgggagaaagttctttcctacttaacatggctggggaaaactgcttggtgtttattagtttgtcccccaaatatttttcaaactaacagtttggtaaacctgtaactgttgtattgagttgttttctttccttgttttcagggctaagtgtaggataaaggctcttcttaggataaaagcctttggtaaggactgcggagaaggcaatggcaccccactccagtactcttgcctggaaaatcccatggatggaggggcctggtgggctgcagtccatggggtcgataagagtcagacaggactgagcgacttcactttcacttttcactttcatgcattggaggaggaaatggcaacccactccagtgttcttgcctggagaatcccagggacgggggagcctggtgggctgccgtctatggggtcgcacagggtcggacacgactgaagcgacttagcagcagcagcagcagcagagtaattaaataaatcactgagttgattgatagtgaagggttgaaaaatgattgaattttgaatgcagagtagctactgactatgcaggacttcctatgagattagtttagctggacagatacagatttagttgaccaattgatgtggctgattgacgtggccttggaaatatctgttaaatcaggttcagttaaaaaaaaaaaaaagtacctgtgaattacaac

SEQ ID NO: 33355 - DNA, 4451 bp, Bovine  19866880597964
tgacgtactccttttaaatttggacccagtccattgttccatgtctggcccaaactgttccttcttgacctgcatacaaatttctcaggaggcaggcaaggtggtctggtattcccttctgttttaagcattttctgaagtttgttgtgatccacgcagccaaaagctttaacacagtcaatgaatcagaagtagatgtttttctagaattcatgtttttctatgaccccaacagatgttggcaatttgatctctggttcctctgtcatttctatatccagcttgaacctctggaagttcacagttcatgtactgttgaagcctggcttggagaattttgagcattactttgctcatgtgtgagatgagtacaatgctgcagtagtttgaacagtctttgccattgcctttcttagggattgcaatgaaaactgaccttttccagtcctgtggccagtgctcagttttcaaatttgatggcatactgagtgcagcactttcacagcatcatcttttagggtttgaaatagctcaactggaattccatcatctccactagctttatgcatagtgatgcttcctaaggcccacttgacttcacattccaggatgtctggctctaggttagtgatcacaccattgtggttatctgggtcatgaagatcttttttgtatacttcttctgtgtattcttcccaccttttcttaatatcttctgcttctattaggttcataccgtttgtgtcctttattgtgcccatctttgcacgaaatgttcccttggtatctgtaattttctggaagaaatctctagtctttcccattcaattgttttcctctatttatttgcattgatcactgatgaagtatttcttatctttccttgctattctttggaactctgcattcagataggtatatttttcctcttctcctttgcctttcgcttctcttcttttctcatatttgtaaggcctcctcaacaatcattttgactttctgcatttccttttcttgggtatggtcttgatcactgcctcctgtacaatgtcatgaacttccatccatagttcttcaggcactctctctctctcagatataatcccttgaatctatttgtcacttccactgtataatcaaaagagatttgacttaggtcatacctgaatgatctagtggttttccctactttcttcaatttaagtctgaatttggcaataaggagttcatgatctgagccacagtcagctcccagtcttgtttttgttaactgtatagagcttctccatctgtggctacaaagaatataatcaatctgatttcagtgttgaccatctagtgatgtccatgtgtagaatcttctcttgtgttgttggaagagggtgtttgctatgaccagtgcgttctcttggcagaactctattaacctttcccctgcttcgttttgtactccaagaccacacttgcccattgctccaggtatttcttgacttcctacttttgcatcccagtcccctaccatgaaaagggcatcattttttggtgttatttgtagaaggtcttgtaggtcatcatagaaccattcaacttcagtctctttggcattagtggttggggcatagacttggattgctgtgatattctgtaacttgttaagaacacttaaatgtcaatattgatgaatttctggaggtcaagtgtggacttagacactcccaaggcccaatcttagaagagccaccacattttcatacgttttacctccaattacttgaaaaggttcttatattgaaaatcaaagaaaaatcccctaatgttttgggcaaagagaggaaaatgtagccatcatgaaatacacccagagtgttctttatccatgacaaagttctgccatgcagggaaaacttcagagccctaggtgatgtgaggaaaaagcaaatactcaactccactcctcttggcctccctgtctcacagaaaaggagcgaagaaaaaaaagctaagaaatgcttctaaggaaagagtcaagggactcaagtccacatagatgtaatcaaattaatatagagcactgcccctctccaaaaacttgtcattgcatcaacccgtgaaagtgaaagttgcacagtcatctctgactctttggaaaaggtcagttttcattccaatccctaagaaaggctgtgccaaagaatgctcaaactaccacacaactgcacccatctcacacactagtaaaggaatgctcaaaattctccaagctaggcttcaacagtacgtgaactgtgaacttccagaggttcaagctggatttagaaaggcagaagaaccagagatcaaattgccaacatctgctagatcatcacaaaagcaagggagttccagaaaaacatctatttctgctttattgactacatcaaagcctttgatgtgtggatcacaataaactgtgggaaattctgaaagagatgggaataccagaccacctgatctgcctcctgagaaatctgtatgcaggtcaggaagcaacagttagaactggacatggaacaacagactggtttcaaataggaaaaggagtacgtcaaggccgtatattgtcaccctgcttatttaacttatatgaagagtacatcgtgagaaatgctgggctagatgaagcacaagctggaatccagactgtggggagaaatatcaataacctcagataccatagggtcgcacagagtcggatacaactgaagcgacttagcatgcatgaatgcattggagaaggaaatggcaacccactccaatattcttgcctggagaatcccagggacagaggagcctggtgggctgccatctgtggggtcgcatagagtcagactgaagcgacgcagcagcagcactagcaacagatacgcatatgacaccacccttatggcagaaagtgaagaagaactaaagagcctcttgatgaaagtgaaagaggagagtgaaaaggctgacttaaaactcaacatgcagaaaacttagatcatggcatctggtcccatcattttatggaaaatagatggagaaacagtggaaacagtggcagactttaatttggggggctccaaaatcactgcagatggtgattgcagccatgaaattaaaagacacttgctccttgaaataaaagctatgacaaacctagatagcatattaaaaagcagagacattactttgctgacaaaggtacgtctagtcaaagttatggttgttccagtagtcatgtatggatgtgaaagctggacaatgaagaaggctgagcacccaagaattgatgcttttgacctgtggtgtagaagaagactcttgacagtcccttggacaacaaggagatcaaaccagtcaatcctaaaggaaatcaaccctgaatatttactggaagtactcatgctgaagctaatgctccaatattttggccacccgatatgaagagccaactcattggaaaagacgctgatggtggacaagattgaaggtcggagaaggggatatcagaggatgagatgattggatggcatcactgactctgcacaggagtttaagcaaactacgggggatggtgaaagacacggaagcttggagtgctgcagtcaatggggtcacaaagagttggacacaactgagcgactgaaaaagaacaacaaaagaacgtctttgctcattagtagaactgtgatagaaccagtcacctaaaagacatgctaacagaagcttcccaagcagaaatacaaacataaaaatgaatgggaaaagaaatagagtagtatatccaggaactatgtgataattaacaaaagatgtaaattgtacatgatatgcaggctagaaaaagaaacaagaaatatttgaagtaataatgactgagaatgttcccaaactaatggcatgcactaaagaccacacacatgaagctcagagaacaccaagtagaataaatgctcaaaaaaaaaaaaaaaaaaaaaacaactcctgtcaggcataacatagtcaaagtatagaaagtcaaagacaaaaaaagaaattttgaaagaagccagagaacaaatatattttccctacagaagccaaagtactagttattctgatagatttcctttcttcaataaattcacctatgaatttctacatttagcttatgtggactggatgctgagagggaggtccacagactagtggaatatgctattacatcatagtttattatcctaatctttctcgatatactgagaaagcatcaggaaaattcttgttgaagggtcactgaacatatttacagttactaggtaatattttttttcttatacttgttttttactatctgacatttatccccatttaggcagcagctgcagtgttctatgtctccagaagaggataatgcagaaaaatccacaagattaaaaaaatgtcaattt

SEQ ID NO: 33356 - DNA, 1253 bp, Bovine  19866880659914
ctagctgattttaaattaggttactgctactgacaaatggaagatgaaagtttaacatggccatttgttagcaggtctgcatgagtcccagtgctatttgccctcatctaatcttattgtgctcttcctgggaagctcaaggtagccatgagataaaggccagtgttaggtgaacaaggtaagaagccattctagtttcttcctccccaccttccggagtcaggcacttttatttcagtcgctgcgaaatcacagagaggcaagctgtatttccaaagggagctaaagcattatgctgatcttaacaggcaaatccaagtcctatctggtcccaagttaatcactagtacgtgttaaaaactacctaaataaacacacttttggtgactttctaatagacagtagaaaatcaaagattttcttaaccaaatttcaaggattttcttaaccaaatatagtggtttgagtatggggaaagtaaatacaggaatggttttagttaatggcatagctgacatctggcttgttttttctgcacatggcagatgtctcaagattctttcacttatgggagttttcatgacatccatccatgtttctacctcttgaaatttttctcagtggcctacctgcatttaagaccaaaacaaaaatgtaatgggtccctactgtgtgtcatgcactgtaccaggtgccacgatgtttacccaaagtcctggaaacccaaaaacacaatgcaaaaggacatattagaaaaataaataaaactccagtctcaatatcttattaacatcaacttttcagctgtatttgatcatgaagtcttacattacttacaaggtaattgctattataaaaaagggataggtcgttaatagtctcattttccaaaacccattttatatatgctctaaattatgctacatccaacaaagtgtgcactttgaacttacaaacaaaaaaactatcttcatacagtatgcattctaactcttgaaataattgtaccttgtaagtcatagtttaagatagaatacatatgcttatcatgtttattgcagttgcatttcagaaggggagctaagaaatttatagaaactagaaggtttggcattaatgaagtcaagtggcctcttgaactttaaacttccatatcacaatatgaatctggttcaaagataagaaatagaataaattctctcctaaggacggacctgaatctctgattgctcagaggctgaattaaccagaga

SEQ ID NO: 33357 - DNA, 3388 bp, Bovine  19866880685432
taatagtaaaaatgtctgtctatatcacatagaatttacctgtagattaaaataaaatgaataggaaatgtagaaggatgaaatttataatgggtgatttgactatatttatgggcatggggaaaaaatggagagagacattagtatctgcagctgaggaactcttaatccagtccataaggaaggcatttgttacagaaaggatgactgttgggaggtgctggagacgctgctgggaaggcttctgcacagcagtaaacagccagcttgccgagaagggagggcagaaggtggtgccggggcctcacacgcgttctttcatcctgttttcttctgctgtctctcctatccctccctcctttttcctcatcagccacagcttctttcttcaattcatctgatggctagaaccctgggcccaggctgagaactgaactctaaacacagttctcccactacctacctagttgggacaagcattccatctccctggaagatggacgttttacagattcaatgactgaatctgtgaaatgtctggattaaaaaatttctagcctttcttctggtcttggcagtctatgattcctcctatgataaatgtttttttccccaaatacttaaagaccgtttcctatttaaatgtataaagacaaggacagcatctactttctgtatttggggcatagcatctaaactagtcagttggatatgttagggagaataatttaaaaaacccaaactaacaagtatatgaaaatgggaacctgcaatattttcctagctgccttcctgtaatcctcataaaaattttcttaacagtagtaaagtcatcctatgagaagaagttagataactgtttttccttatttaggccaaaatttagtcttaaaaagaatatgctaacatagagtatgcagaatatacttcctttgagtgtagcactggcacatactttttctcagcattcgctacatgaatttgctggagcctagcatgcagtaggtactcattagatatacatcaatgaattgacatttttgagaaatagtaaatataaaatgtgttccttgttcagtacaaacagcatgttcattagtaaaagaaatgtcctgattattttacttctagtttcttgattaagaaggaaaaaaaaatgtgcctgatgttcattgcttcaatttacttcataacactgtcaaaagtctagtagttttcatagtaaatacctcatacagttgcaagcagatggcatctatgaatccaacttgcatacttgggattttgtttttcttctcccggttcattagatcctgaaaacacagaaacacacatacacagatctgatttccttaatgcaatacaagttggctcttaaacgatgattccctgggttagctgaggaaggccagacacctgcctaccgcctcttcaccttctggaggctcctacccccctgcaccaaaccatgctcaagaaggccctggtcctctctctctcgttcactggggctgtgactgtccctgcgtgacccccagaaccagaactgatcactgacctcagatcaactggtgacctagagttaggcactgacctagagtccactgctgacatgtatctggaaaacagacacgctttctaattgtctactgatgtggaatcaaacactctcagctttgtgaaagacgccactgaggccacagtcgattacaactcagttcacacagagagctctctgagtgaaaagaacgcagatatcactgttgcttattctcaggagctcatgacgacataagacaaagccagcacctctgaggacagcaaagagtctgtctcagtgctcgtttaaaatgaagcagattctctgttagctgtgaccatcactctgctacccaccattttctgagaggattccgagcttctaacaagcctattactgtgtgtgtgtttagttactaagtcacgtctgactctttgtgaccccatggactattgcccaccatgctcctctgtccatggggttgtccaagcaagaatattggagcaggttgtcatttccttttccaggggatcttgacacagggatcaaacccgtgtctcctgcactgcaggagaattctttaccactgagccaccagggaagctccaactactatgtctaggagatcaaataattgcaaaagacgaatgagacatagggtgtgcccagatgaggctaaagagtaaagcagaggcaatggtaccagaggaggggcatcttgtaaccatggcccatttaatgtgggctcaataaatgttcatttgagtaaaagaatgaccctatgcaccacttccaggaaaaactcatccatttcaggaaaaacttcattggttgagaagaatcttcttgtattcgagattctctacctaccctgagcaaaaaatgcagtatacaaatatttaacaacaacagctgtttatcaaagtgctgtttgtaatagtaaactctacaaaattataccaaacagtaaataatagctgcatctgtttcatgtggggcttaccacttctcagtgataaagaatccacctgccaatgcaggagactcaggagacgtgggtttgatacctgggtcgggaagatcccctggaggaggaaatggcaacccactccagtattcttgggcaaatcccatggacaggggagcctggcagtctacaaagcatggggtcacaaggagttggacatgcctgagcatgcatgcactatttcatgtaaccattataaatggcatataggacagagcatctgttagaatgcaaagtggcttatgatatataaatggaaaaaattacaaaaagcaggtatgatttgataactcagagtcttttctgtcctttgttatttgcatgttttctgtaacaaacatgtttaattcttcaggtaagaaaaaggactttataaaaagatgagaaattgtcttcctaaaatctcatagaagcacaaaaaggaatctacaacaaaaacatgtatatgaataattcctcccaacaaggtctcatacttacagcgggctctatgttgagttctttcctctctctatctccttggtcaaaaaattcagtggcaacaagttctgctatctgaaatcaataacagactaagtgtgggtaattaaaggcatatcactcagtaaaacagactttaaatgaagataataaaacccatcaaatctgtggcttttaaccacatcagtaaaattagaataaagcagtaacagtaaatactttattgtaatgtgtacctaatcacaaaggctagagtctgtaatctataactcagagaaaagagcaacatgttatttccgcctccgcagtagtgggaagaaagcactgtgtgcccatccata

SEQ ID NO: 33358 - DNA, 1735 bp, Bovine  19866880692184
cagcctctctaacacagtctggccagtttatgaactctgtgcagaaggaaccacagcaaacagaacctagaatgaatttcagagatacacagtaattggtagaaggaaaaaggtttcaagaggacaaagagggcagacagtaagtaaaaaccacgagtacgagaagctgtgagcaagcaagacccgcagggtaaactgcagaatacccggagcagttgtcacaggagcagctgggtggtaaaagctgaaaatttacacatggaatatggcatttggggttcccttcaaactgcttcctccccaatctaggataggggaggtagtggagagaagtatagaagaaatgaggttggtctcaagttgacaactgttgcagctgtttaaaatgatccccttattatctacctatctgacatgctgacacctgacaggtccactgggtacctagtaggaacattaaacttatctccctacttctgtatgtatttgacattctccataacaaaacattaaaaactttaacacatacatatataaatccagaagccaaccacttcccatcactttcattgctatcatcttggtcaccactaatctttctcctgattactataataatcactaaaaagcctttttcaacacagcagtcagaataatcctttataaattaaaatcagatgtggtcattcctctacaaaaatactgcaatgtctcccatttcttttacagaaaaagccaatgtcctaaaatggcctataagaccctaggtgatcagatccccttattacctatctgacatgtgttccttttcttggactatctgggggaagaatgtttcaagtggaggaaataccctagaacaaaggccttaggcaggagcagacctgtaaatctgagtaacacagattaccttgtaagagtctccaaggtcatctagagattataaaaaatgtgaccaatgttcaggaaatagaggctgactcagctttcctagaactcaggaataatgtggcaaaaagggaacgggttttagaatcacatagacttacccaaactcttatctttcccattactgactaaaattcaagttctgagccttaatttttcttacttgaaaaacagggaaaagtagcaatgattttctgatgtgctatcaactgaggtattatatacaaaacatctagcagagtgctcagcacatagctcatacacaataaatgttaccaaataatacgcccctgtgcccttctcttgcagagaaaacagagcaaagtctggctggagaaaacaagagaattctcttcttaacatagccatcacgaggcctgtgtggtagatggaccctagctggtagatgagaactcttagttctggttcaagctgtgacaactagatggggacttgaggccagtcatttcatcactttggaatttagttcaatcatctttaaaatgagctaactagacctctattgctaagatacagtcctgagatcctgtctccgaaaaacagtcagggactctaccctaaatagccccccctggtgtgcagcacagggacgtgttgcaaggacagagggtggggtggtgagaggaagacatcttccaaattcttaagcctggctggcttcatggctgtgtgacctgtgcaggcccaggaatgggcttcagtgaatgctctgctgtgagagtctcaaaattctcaataaagtttaacaacgagatcgcattttcat

SEQ ID NO: 33359 - DNA, 2262 bp, Bovine  19866880702917
ttactgctgtgcagaagcctttcccagcaggggtctccagcacctccccaacagtcatcctttctgtaacaaatgccttccttatggactggattaagagttcctcagctgcagatactaatgtctctctccattttttccccatgcccataaatatagtcaaatcacccattataatggtgattataatttcatccttctacatttcctattcattttattttaatctacagttaaattctatgtgatatagacagacatttttactattattacagaagttataggttcttatagaaaaatcagaataatagagaagcgaaaagataaaatcacttataattctactactgttattttagtgcatattctttatgacattttcatatatttttcatttaacaaaaattgctctttgcaatccataatagaatgtacatctttctgtttcaaatgtgttttctatgacagctttaatggctgcagaatagtaacacaatatttctaaccctgctgttgggtatttaaggcaatgtttgtctatgacacagacatctacagtgaatgttcttataagctaaatatttatggaactatagttggtaaataataatgccatatagagtttaatctttattataatcttggataaaaatttaatgtatattggataaaattattttatagaaaatcacaaaaactaagcatccccccatgaagtcaacacttagagagaaccatctgtagtacataaaagcaaatggattctttctctacagagccaattccacacagatctgtcttcactgcttaataatgttatgttgaaatgtgtgcatttcctctctgtctcagcatgtgttgcccgtctgtatagcttaagaggagtcattcataaatgatctgtgatcacagctctgtgagaaccccagcagtgggtctgcttgggaagtgagtgtgtgatgtgaccctctgggacaagcctggggagagggcttatttcccggtaccatctagtcaccggctttcttcctctctctttaggccttgacccatgtgtcggaggactgtttccctttgctggacggctgcagaaagaacaggcagaaatggcaggctcttgcagaacagcaggagaagacactgatcaatggtgaaagcagccagaccaagcggaactgagagacctattcatgcagagctgaagttgacagatggtgtcttctgcagtatgcctagttttgctatatactgtacagatttggttgtatactttgccactgctgtatttttatttttgcacaatttttgacagcgtagcatgaaatgtttttagaggactattgcatattttctgtacatttgttttatgccactgaactgagattatcaacgacacccactcttagcacgtgaataagagcactgtttgtaatactttgtgtactgcaaggtacaagttgcattcttgcacagaggctaatttggggtttgtttttttttttttttctggggattttaaataattggttttgtgttttctgaattatcaatctttcaagaatgtttagaatcttttctttcttaaaaatagtctaggagcaaactgaatatattctgtgacatttaaaaccttcatagaatagaaaaaagtgttgacttttaaagcttgttggattttaaaaggaattggctatatttttcaacactgtattaccttaacgaaagaaagttaaaactctaaacaaatggaaagtactataaggcagtattgtaaagaaaaggcattacttaattaatttggtttttttgttgttagagaacaggcaagagagaggtttcttatttcagtgcaatacatctcccccaaaggctacccataaatgctcacttcgacctaacagacctggtagagagcaggaggagcctgggaagaagacccagcccctgagtctcgagggatgagcctgctgcagaaatggagcagccaggacagccgtcagggaagagaacactccaccggaggacaccctgacagtcagagggtcacacactgagcttccttttcgttcacctcacgagtcattgttgtaagtcaacactttaaaacacaagcgatcatgggcgcacaggcctgaaatgagctgtgaccactcaggataagagggtatgcaccctaaactggcccctgagctcgtacttggtgggatttacttctcataacttttagtccatttagaaaatgctaatgttttcttagaa

SEQ ID NO: 33360 - DNA, 830 bp, Bovine  19866880732468
aattaagacttagagtcactgaattttttatcttaacatattctttaaactgcaagttttatttaagaatttccttgatgaagcagaaacatcactgattttattaaatctcatcctcagggacacatatttttaatattatgtgacaaaatcgtgaaacatattgcaaagggagcttaaagtttctgtcagcttcccatagcagatgctgtttttctctttgtggtagcagaggtcagttgctcagtttaccagagggctaaagaaagacagcatgtgagattagatgctctaaaagaagagatataaagacaatgcaggcatatataaatgtatctatgggcatttatgagtcactctgcaaagctatttaacctcccggttttgcctgttatgtagtcacagataggctctcagggtgaccccagaaaggcattgttgagtattaacaatgatgtactagagtgggctcatcacagatcaggaaaatggattgtgtttgtcttttcccaactccacattcaatgatgtcaggttggtagaccgagatcagacatgatgctgttctttatgtgcatgctaagttgcttcagtcgtgtccgactctttgtgacccatggactgtagcccatcatgctcctctgtccatggattctccaggcaagaatactggagtgggttcccttctccaggagatcccttctccaggggatcttcctaacccagggatcagacccatgtctcttatgtctccggcactgtcaggcaggttctttactactgggaagccaggtgttatttaccaccacattaattaacaaacaaatggg

SEQ ID NO: 33361 - DNA, 1959 bp, Bovine  19866880737011
ctgatgtgaagagctgactcatttgaaaagacccctgagctgggaaagattgaaggcaggaggagaaggggacgacagaggatgagatgattggatggcatcaccaactagtgacatggggtttgggtagattgtgggagttggtgatggacagggatgcctggtgtgctgcagttcatggcgtcgcaaagagtcagatatgactgagcgactaaactgaactgaactttaactgtataaattctatggttctgaaaactgagatgatccaaaatcaagactttatggattagaagtgataaacatagtataaactagagtgcagctaaaggtcacctatggggaaaactataatccagaaatcaccccttcagcagatcatgcaggcactactctgtgtagccccccgccatatgaaaattccaagtaccatttgacaatacttgtactaaatgcatagtgcaaatataacagcacattcaaatttttattacttcagctgtaatttgtattctctatctgctcataaaatttaacatgctaaagacaggaatttccatttgttcttgattttcatttgaaactaaatatgatgacatttccatttcctctctattattacacaaacctgaagcaaagaaacggaattaccaagccttgttttacaggaaaaattatctccacgttaattaaattagttgagcataatatggcatcttctaatatttgaaggaaatggaacagtcaaatgacaaataaatgcattaaagtattttaatcaattaagattcagtataaaatcatttggtgtaattgagcacactacagaacagtctgtataaattatgcttttaaaggaaagaaaaaacatgttaatttattcaaatcagggcttgactaattttacaaattgtaaaagaaaatttaagtgatactgagtctcctcctcttctcatgaaacaatctgaatttgaatgaaaatatcaaatcaatacctttttttgaagtgaaatggtttggcatccatctttcatagtaacacatctcttttactgtttgatcacatttatatttgctaagacttgctttcattaagagtttgcttcaccaagtactgagttgtctccaggagcagggactgttctgggcttgccttccccaggctggctccagagaacaggaagaacttagcaattgaacctcaatcttaaaaggctggttatatgacatgccttgataactatagagaatcatcggagtcagaggggcactgaacccatgaggattgttttaatccaacaacaaattgtgtattaagcacacagtatgtgcaaagtactatactctgaaacatatgaagatgtttatggtagagttcctgaacaaagctctctgaagtggaaagctgttacattatctgctgcaaaatttagtctcccatttctgtctttcatttgtctatccttccttgcccccaccctttcatctttctatccttttatccttctatccttttatccactcctcccctcctcctgcctcctctgtctctcataatgatgtttcttgcagattctccatagacaacaattacagttgatggacccaatctacttgttattcacaatgatgtgaaaagagatttcttgtgattgagtgtacatttaagatgcactttcacagattcctttcagttcaattgagttcagtcactcggttgggtccgattccttgcaaccccatggactgtagtacaccagccttccctgtccaccaccaactctcagagcttgctcaaactcatgtccattgagtcagtgatgccatccaaccatttcatcctgtgttatccccttttcctcctgccttcaatctttctcagcatcagggccttttccaatgagtcagttctttgcatcaaggggcaaaagtattgcagtttcagcttcaacatcagtc

SEQ ID NO: 33362 - DNA, 750 bp, Bovine  19866880747482
cctctaaaaaccttcccccaaagcccgctcctgctctatcctattagagaagaagctctcaaacctaagtgtctgtacatgaggatcaccctgggatacttgtttttatcagatttcccagtcctacccctagagattctaaaccatcacatttcaactggaccccagaaatctgcattttagcaaggactccaggtattcctgtagcaggtggtctagagccataattagagaaggactgacttaaagggaacccacccagctgtgtacttcttaatgacagtgccagcacccatgatgacacgaagatgccattgggtctcatatccaaacatgctaattttggatttcttggtgtaccaaggaccaatatcattcagaaaacattctctgagaacccatcgtgtgaaaagcattgaacagcataagaacaatcatgtgcacaggtaatttcaaaaccaggctgactttgatagaatcagcaagtccttaataggaaacctgaagacaagaaggagtccttctaaatgctgggatctaagaaagcaccttggaaatggtgccatctaaggtgaagctggaaggaagatagggctgcatctggtatgaagaaaggcacctcaggcagaggggagaggtttaaacaaaggcagggatgcctcagaattcagagtgttggcatgtgcctggcctgtgggagtgtgagatggagacagaaagcagattaggaaaaaggctacaagggtgggg

SEQ ID NO: 33363 - DNA, 1391 bp, Bovine  19866880790198
tttataattattataactaatataattttccattaatctaattagatcatttttttccaaatgcctataatctagaagtattaaataggatatgcaaaacactgcatagtgaaatacaagctctcacatggcattgcaaatatgattagcaaaagggacacacacacacaaagtagctccatccaataataactttactttctaccaaagttgaactgctcactcaggttacaaaacgaatctgaaaaagacaggaataccttcaaatacatattcagtattccagatgctttgaaagggaaaaataattaaaataccttgcctaggttttaaagaaaatttcttggcatcaagaaaaggaaacaatttacaaagcagtgtaaaattctaatgtaaacataataattctcatgagctaaaaatataattagatgaaacctacttgtagagcaactagcttaatgtgttttgtactcttgcctaaaataatgtaccagaggataaaaattctttgaaaatatactgcacgtagggtatccatagcctaatactaagaatataattgttaacagtctaatacctacattttcagccattctattttatcactagagagttcccactttttatgctttaaaatcatatatggaaacaaaaccgacttgggcaaggtctctaggcagctcatttagtgacgtgcttgcacattagaggcaccagcaggaacctcagcctcttcctgagttaaatttctcatgatattaaatctctgagtctttcctttgtttccattaatactgaccctgaacttcagtagagaatgaagggccccaggtgggacagacttaggcttcaaccggagtcgcttctaagatttatgcggtctataaaatgaagataagggtattaatcctcataggcttcttaagaaaattaagaaaaatgacacctataaagtgattgcacagagtctggtactaaaggtttaaaatattacagttactgtttttaagttaatcaaacattaactggaggatattttcaaaggcaattaaattttttataaaaataaaaagaatgtattcatggatttttacagaataactagatgttagccatttgttttccaagctcctagtttaaaagcactaatttctctacaaaaacacttgtgcaaaacaaaaaaggtgttctaatgtctgtagtttctcaaattagaattgaaaaaacatggactccttagaccaataactacttatgtatgacataattttctaaataatacataaagaataagagctgatcatttagctgagaaaaatcactgtgagagcataatttttttttctattactactcagaacttaatcgctaaaaaataagttatagaa

SEQ ID NO: 33364 - DNA, 1903 bp, Bovine  19866880805831
tgttttatgactgataaaattagacatgtgtttttacctgccagtgtgtgtgtcgtagctgtggagcatcatcagatcctctaccctttacagaatttgtacggtacatttctacaacagccctgggtaagagcttattaaagcatatttaccaaagatgttagtagtaatgcatgtgatcacattgagcctctactttatgaaaccatagcatatatgaatatctactctgtgagaggcacaaatgtgctaagggtactaagtgatgtctatctcagttttggttgtttctgatttaccaaatatagatgtcactcagtaatgacaaatgtacaaaatgttagtcaaaatgtttacttatttatatttatggcaaggttttggaactatggacgagagctaagttgaatggtaaatggaactgtacgtgatttcttcatttttgctaaggtgttacctttgcagtgaccatgtctctgcgtggtgatggaagctagggtaagcagacaagaaagaaaaaaataaaaataatcctctgttagatttattggatttaaagcttcaccatttacctgaaataaacatttgtaggcttctctgtcccctcgctcccttcctggtattgaaataacttagggatccaaaggtgatccctaggctttacataataagaattgtttgaacactgcaacaggtatttgagagtataaatatttgatgtatgaaagcattgaataagaccataaatgtttgcagatactttaatactttagtacaaaagataaaacatgaaatggtcattatcaatcagaatacatcagtatagcagttagctgctgctgctaagtcgcttcagtcgtgtccgactctgtgcgaccccatagacggcagcccaccaggctccgccatccctgggattctccaggcaggatcactggagtgggttgccatttccttctccaaagttagctgctaaatgctaccaatgtttttatcattgcacaaagtgagtgttaggtgctcatcaatttcatcatgttattaaacttccttgattttttggatatagcacattagttcttaaagatcatccagtgtagtaagttggtaatttatatacacacagagttgggaaacattgttttaaaggaatagtctttaaagtttagtcagttgtagtcaatttcattcatctgatatgaaaagtagaatggtgtttgaataaggatagaccgcaaattaaaaactgtaaaacttgaagtctactttgaaagtgtaaaatgacagtgctctgagacagtatcttaggtaaaaagaataggagctccatctgttttttcccggtccacaacatgaattgcaaaagcctagattttgacttctaattatctttctttttattggttataagtattgaatacaattgttcaattgcaagagcccagactttgaattctagttatctttctttttattggtaataaatattgaatacaattgtccaatgtactatgttccagactttacataaattcttgcttttaatcttaacaaaaacttttgttcaagaaataggcttaataagattaatctggtaaatgggtgaattaagattgaaacccaggtctaggttcatttcaaattcaaaatgtgtctggttaaagcaccaccctgatgctgtcagttttgtaaaaaaaactgttacgtgcaacttgaatgagcctgtcagatttattgatttctagtctgcttgtgaggtgctttagaggaactggtacatttagttgttattgaatattccctattattgtaactattgaactgtaaaataaatccagctctaagaaggttaaattactataaagtaaaaccagagcacctagaacagaaagtagtaggagta

SEQ ID NO: 33365 - DNA, 789 bp, Bovine  19866880819696
ttatgtaagtgagagaatgcagaaacaaaggaaaagcagacaagaaaaaatagttcagcgataaaacacaatcttaaaccttatgatggtggaaacttgaaagtgtcttttaccactctggatctagttgctcatatataaagttggtgtgtcatggtcctctaatgtctagtttctcctcaagggatacccataacaatccagcacacatctttgagttattctgcaggaactaagacccccacccagaaggagggtgatgacttcatgctgcatgcaagctagtagactccagactggtcagtgccaggctgatgactgtgattcctgaaacaccaccctgttacctcaccaccaaccaaatcagaagaaagtcatgcacgctgcacccctcaccccagacattgcctttaaaattcttccctgaaagccatcagagttccagtcttctgagtaggagctgcttcttctccttgcttggccatggcagtaaacctttctccactctaaactcaaatgtttctatttgtttggcctctgtgtgtgacaggcacagaaacttaggttcagcaccactctttctcccttttgtcaattagagctattatgtcagggcctggctggattctgaaggaaatgctgaaggaggggtggggtacagagaaggaatgtggatgatagattcccagcccgtcattcctttccttttgcacagggaggccacacatgacacaaggaagaactggactcattaatcgggttctttggcatatgtccttcttttctttt

SEQ ID NO: 33366 - DNA, 2203 bp, Bovine  19866880822779
aaataacatcgtattgggagttagggtttaacatatgaattttgtgggtatatgttaggctgtcccctgcaggcctgcaagccctgcctgttcttgccccacttaaagactgaagaaagagcttggagtcagcgacagagatatcaatagtttcataggtgggtgaatcttacacccacctatgacagcagatggctactggaggaaggggaggtgggtgattcacatcatgttggctcattggttaccggggaaaccaacagaggggcatatgcctttgataagctatcacagtggagataagtctgatttaaagattgaaacaatcactagctggtgtggagcaggtgattgattagattctatgattaacacaaaatcagtcatgtgaataaggtgcaggtgaagcagggactggatggcccggtcatacacaatacacacagtcagcctgtagcggactttttgagaatattggctgacttaattaggtagatcttccacatgttttcacatttaattctgcaatattaagtaatcatcttaataccactgttgacctcggtagaaaagttttaaagtattgggaagctttcaagtttttcagaagttgtaatattcttttgaaagctcaattttgttataatggctgcaaatactatccatagttttctgtaaagtgagagcctttatttttaagaaaaatgtctgctaaatacccttaataattatagtttgttagccatttttaaagttaaaaatagaattctgtggagacaatagcttgcaagtcagtcacttaagtgtttttcttcaacataactgtcatattacgttgtgcagaactgctttatatgtatttttcattttgtcacacagaatattaaaaagacattaaggtcaaggtttataaaattttaggtatgtatattttaataataaaataaatatagcgatgtaataaaatattttactactttatgtaggacacttttgagtccaactgacttttttgtaaaactcagatgtgtaatataataaagaattgagtgactagactgataaaatagtacagtttgattccactgcttttatttatcttttatccagtatacttatacactctcagtgaaccataactaagtaaaaaaggaaatactaatatgaaaatagttttgatttttatgttccccgaaaaaagtctcaggggctcttgggggtttgtggaacacactttgaaaactgttgcactgtcatcaggagaagagtgctttttctatgtcaggacgattttagtgggaatcaccttagccatttatttggtcctgtgtaggaaaacaaaaggaaaagattatgattgtgcaggtaaaaaaattgttctaatatatacaaaatataagatttataattttaactattttaagtatgcagttcagtggcattaagtaaattcatgatgttgtgcaaccaataccactatccatttccagaatttgtcatcatccctaacagaaactcagtaccttttagacagtaattcctccattctccctatcccacaggtcctggtaacctctattctactttttgtctcttattaatttgcctctgctgggaacatcatttaagctgagttaacagtgtttatctttttttgtctggtttatttcacttcgcattatgtgtttaggatttgttcatgttgtcgcttgtgtcagaattgcattcttttttaaggctgaataatattccctttatttgtatatcacatgttgttggtctgttctgttgatggagtcagcttgtttctgtctttggctattgcgaataatgctgctatgagcattggtgtacaagtatctgtttgagcccttgctttgaattcttttgggtatatacctagaagtgaaattgctggataatccggtaattttatatgtttaactttttaaggaaccacagcatctgtaccatttttacattcccaccagcagtgtaccagagttccaatttcttcagatttttgccatcacttgctgttttgttattttgataatagccatcctaatggatatgaagcaataattcattgtggttttgattggcagttccctaataaccaatgataatcttttaatgtgtttattggtcttttgtgtatcttctttggagaaatatctattcatgtcctttgcgtattttt

SEQ ID NO: 33367 - DNA, 1299 bp, Bovine  19866880828164
tgattaaagtgtttaaatgtgatcagagatctagaaataaaataacatactccataaaaaaattgtgcgaaatcacaacacaggtatattgtaaatgagcaactcagaaatgcagtataagagaataggaacataagagatgctattaaagtaagctttagaataagcaaaaccatataaattttattgtttttttacaaagaataaaggaaaaacaagattaaaatgtcgatatttaattttgccactctttgaacttaagggtgaattgtagcttgagaattttctaaaggtttgatgaataataatttccctttaaatccaaagtttttccctaatagctttttggagaacagtctgatccttgactgtacacagtcttggcttatgaataaggcaaaacagtttatgagggatacggtgtatcccaaagactgtatcccataacagtctttgatgtatagacgtgtgtgtgtacatgcttaaactgtttataatggaaatgtaaccagaataaagataaaattacataatggattcttaaatgatgtaaccactgcctcagagtcttgggaaaactgttgttcagagacttccaggattccaagaaatcaacaaggaagtcgaagaaaaaatgtaggaaaaaaattttttttaagttcactgtccaaatgggacctacttaaactcaaaagctttcgcacagcaaaggaaacaataaacaaacaaaaagacaattctcagattgagagaaaatatttgcaaatgatgtgactgataagggagtaatctccaaaatttacaaacagcctatgacacttaatagtatccaaacaaacaacccaaagaatgggcagaagacctgaatagacatttctcaagaggacatatgatggccaataggcacatgaaaaaatgttcaacattgctagttattagagaaatgcaaatcaaaactataatgagataccacctcacaccagtcagaatggctattataaaattaaaaaaaaatccacaaacaacaaatgctggagacagtgtggagagacgggaaccctcctgcactgttggtggcaatgtaaattgatacagccactatggagaactagtatggaagctccttaaaaaactaaaaatagagctaccatatgaccctgcaatcccacctctgggcatatatccatggaaaaacatggcccaaaaagacagatgcaccccaatgttcattgcagcactgtttacaatagccaagatagggaaacatggtaaatgtccatcaacagaggaatggataag

SEQ ID NO: 33368 - DNA, 1712 bp, Bovine  19866880831638
attccatactagcatccgaaattattttttttttttcacacacacacacacaatttccagagcacatcactacattgctacctcatgtttcatctggaagttctgcacaaggttgaggtcagtgaacatccggattgtgcacagtgctgtttccaggtcagacagctcaaagtcgctgaagctgaagtcagtgattttaagggtctgggcagatggtaccacagcagccttgggtaaagggagaagaggaaactaagtgaagctgtttcacaaatgcaacacaaacgcagtttccttgctttgctttcagaaatggcacgttggacttaattttttatttttaatgtcatacactagaaatattttactacagaagttattcctttttttttttttttttttaaaactgagccccttgtgggtaactgctatgcttctaagtaaggccaggtggagagagggtaactgtacctggaccactaggcagatctaaggagtccagtgatccaaccgctttatatttcctcagcgtcaattcactcaacagatatttactgagtagttattcaggacccgtcccagtactatggactgagaataagtagtgagcaggataaagataatgttctaagcattttatgtttaattctcaagacaaccttttgaaatggatactctagctccacccttggtttgatttttaatcatcttctggtagtaaacacttgcaatttcttcagatacaccttgctctttttaaaaaatcaatattccttttacctcctgcttctcctactttctttaactaaaggatttctttaagacacagttcccatccatgcccttcacagccaagcccactgtgggaatacctgtttaatcacacaagtcactacagtctactttcctgtttatctgctcctaaccacactggactgacaggtcgggctgaatctcacacatctttgcatccattgtgtctactgatggatagagttctgatatttgttaatatgaatacttattaaatgaatgggagggggaaaaatggcattctcttcacttaatttgagttacaagttataaggtctggttttaaggtcccaaatcctcctagaaaggtgaggtccattaattttgagttggaaaactagcagatgcattcattccaatctgttttgtttggcactgaatattttaaaaaatcaccattatttgttacactattttaaaattgggagattttaacaataaagccgtatttctgatctttcccgaaaaatcaggccacattgagcttcaattcccataaagcgactagccacagccagctctcctccccaaaacctccaccccatacccccgggcccctcagactgagcaggtttcacacccagattctctgccaggccccccaccagcatgaaaacttacaagaacctcactcctcaaccctcttgactatttattctgccagcactttagcagccttagccacatctggctgaaatttatctaagaggctttaacttggttggggggcagagggaagaaaatatagaaatctcaaccaggttccttctaatgttttttccttgattttctctaaacccctcaagtttcctctgagtatctgccatatcacttccttgctctcaatccatctttttggtgaagtgaaaaggtcaaacacagaattataaaaccgtatg

SEQ ID NO: 33369 - DNA, 1841 bp, Bovine  19866880851387
ggaagaaaagaaagaaaaagaaagaagggaaggagatggaggatggaagaaaaaagataagcagaatatgcaagaaggtaatagagaattgccagaaaatgaggctggagaaatagattggaactaatttaggaagggctttgctgagattgacctacctcttctaagcatcaggggagttactgaaggacctcatctggggaatgacatggtcagactgaaatgtggaaaagtcactctgatagcaatatggaaaaacaactgcaggggcaagtctgaaatcaggaggatcaaataacaacctactgttataggttgttatttgttacaaacaacaacctgctggagatgactagagttgaactaacataataccaccggagacacactagagaaaggagacttgagatacaatatgtgtgaccacttaggtactgaaagtaagagaacagaggaagcaccaaataatttagataaataaagtgtaaagtagataatttatagtttagatagtggtggtgacatttcactagtgtagacagagaaaagaaaagtgcaacagtttcaaggtggacacactgctcaattctgggtatgttgactaaaggaaattattagacctctggctgaagactcatgtttagagttattcacttttaagtaataattgaatacagagatagacaacattatccagggagagacaataatgagaagaggactaaagagtaaaccaaacgtaatcatacgtcaagtaagtgtggctctaaagaaaatgtcacagaaatagtaggaaatccagaaaagcatgatgtcacaggaggacgacatcatcatctcatgggaggaaatacttttaaagaggaaataatcaacactgttaaatgccagaggaaaacagcataaaacagagactgaaaaatgctcactggacttgacaataatgaggtgaaaagtaatacagtggtaaattcagcagaataaggaagtaggaattcagatggtaaattaagggcaaagaaacaaaggtagtttcttctcatctctcggatcaaattttactctttattttataaaggtattattccagtcagatggtgaagaaggacagaaataaaagaggcactaaccatggaaagaacagtttcaaagtgttttaggcttctttttaatgtgttcaatgtcagttcagtccttttttaagaagatagaatcactggcaggtggttgacctttaaaattctcctcctaacaggacaatcattgctgaaaatttttaaatgttttgaaatagaaactttaaaattttaggaaatcctttgcagcagagaaacaggcatttgtgagcaaggcaccctaataacttcacttattggagtgtgcgtgcacgctaagtcgcttcagttgagtcacatactagaatgaatagcaaatgaatgccttcagatgtgctgcaaatcaagaagctgttgacaccacggaggtaacgtggtggttaagaacagcgctgaaatccatctgtccaggttcaaggcctggttctactttctctctctgggacattgtccaagttaattacgttgtcttcagtctcagttttctcacctgtaaaatggaggtaataatgtaatctacatattataattaagttctgcaggagtaaatgatataaaatttctctggtattaaatgataagaatgatgatggttgatctggtatatttttcctagatggttacgatgctgattatacatagtttgcaaaatcttatttaaagctgtgaacctggataagactgggaaggcatgagggttgacagaaaagagaataggtataaaga

SEQ ID NO: 33370 - DNA, 1350 bp, Bovine  19866880878077
ttgtcaagtaaaaataggatacaaaagcattaaggttctgaaaactcaacaagaaagctattttaaacaaggccttaaagatttaaaaatctttgtgctaaattttgtaagaggacaatttaagatgaaaaagattaaaagagtttttaaaaactgttaaaaataacctcgatggggaaatcatattctttaaagcacaagtcatttgtcttgatggtttcaaaaacagatgatacaaaaagatgtagagttagcatttggtataattcctttggtcatttgttttccttatgtttttttaacaagaaagaagactcttttccaggtgaagttattaaaggtgactccatatttcataccaatgtgacctcaaagcatatctacaagaaaagaaaagaaatgtttaaataaaaggctaatcaagaatattccttttttactttatgaacacaaatatttaatacattagtaaaatagtatatgtacactcataaaaggatcagaataaagttcttttcaaattaagaaaatgtaaacatagttcatcatttacattttcaaaaaatatcaaggtgatattaatcactatctacttcaagatttcaatggttgcacgatggtttcaaaaagactactagaattaacttagatttcaggtagtcctttgaataatactaactttactgtcaatactattatatacttctgtttattaaaacaaattcatctacagagactctgtatcatctcttacttctacacagaatcatatttctctaagaatgtcaatagattttatgtaaactgacctgcattaaaactcaggagaaacattaaattgataaatcttagggaattaaatttccacactgttcatgaacacatgctcctggctaaaaggatttcaaaatgttcaacttcttaattaaaaacaatcaagtattactaacaaagtttaatcaactgaatttttttctgcattctttcattcaacaaacattagactgagacaggttctgtgccaagcactggaactgacattttgatgaggaaagagagaccttaattcagtgaataataaattgtagagtgtactagaagaactgtgcactgagcgctaacataaaaacaatgtaagcaaaggggatgagaagtgtatataatgggagatggtttgaacttttaaacaggaaagtcacagaagatataactgagaaggttacctttacacaaagatttgaaggaggtgaagatgctatcttggaaaagactttcctagcagactgaacagcatgcctggcataccagaagactgtaaaaagcccagcgtggcagaagaaacatgaacaa

SEQ ID NO: 33371 - DNA, 1292 bp, Bovine  19866880921931
catgagttaaaactctgtccctttctctcttcaacttctgtgtaaggaatagtgtggcacactggaatgaatgaacatgttttcagagtagtgctttagaaggtaatgatatttagcactgagataaatttttctgcctacttatctcatgaaaaacaaagaaaacattgaaatgaaatacacaatgatactgtatttatattttttgattctgcacaatcattaaattcttttccaggaaaagctattattaacagtcttaattgtagttctgcaacagctctcaatggcttgtcatgttcagaagggtgtttttctgtaagcttctgaaagccctaattaatggaaaagaccagcctctaattgcttctcctataaatgcttaaagtacaaaacatgcttgatgaaatcatactatcatatgatcaaaatggatcttttttccaatcacagaaatgtcatttatacaaccacaaatcctaagacattaaaaagactaaaatattttcctgtatctaagaatgttattaatgcattcatcagagtatctaaagacctttttcttttctcattgaaaagtaattagttttgaatattatactatttaaatttattgttcatccaatttttcaaaattttaatgtgaaaattttcaaatatttgtaagttcaaagaatcttagagtgaaaatatataaactaacaacctggattctaccattaatatcttactatcttgttttattacataaaaaaagaaattgccaagaaaaagaaatgcaaaaaggcaaaatggttgtttgaggaggccctaaaaatagttgagaaaagaagagaagcaaaaggcaaagcagaaaaagaaagatacacccatctgaaggcagagttccaaataacagcaaggagagataagaaagccctcctaagtgaacaatgcaaagaaataagaggaaaatgatagaacagtaaagagtagagatctcttcgagaaaattagagataccaagacaacatttcatgcaaagatgggcacaataaaggacagaaacggtatggacctaacagaagcagcaaatattaagaagaggtggcaagaatacacagacgaccatacagttcaggtgagttgctcagtcatgtccgactctttgcaaccccatgaatcgcagcacaccaggcctccctgtccatcaccaactcccagagttcattaagactcacgtccatcgagtcagtgatgccatccagccatctcatcctactgtcgtccccttctcctcctgcccccaatcc

SEQ ID NO: 33372 - DNA, 2618 bp, Bovine  19866880962968
tggatgtagctgcaaataattttgaagatgtgcagatataaagtggaggtcacctattgagagggaggtggcagtggtgtcctaggaggtttaaaaataaaggtaccttaaaacataagacaaagcccaatcttggtgatagagaaaggaattctttcccttatctaaaaccaatgaataagctctactgatttatggatttaggtaaagcccataaaaaaataataattgaagttgaaatagccactgtagagaatggacagtggctgtgcttgaaattaaatgggcaaaggcatcactattcaggtaatcatcaagttagtgctaaatatagcctccaggagatggagattatggagggataaggaagggctcatttcttaccaagtagactagggtgcaggacagagtcctagcatagcaagggacttggggaactagtagaagagagaagcctagtggttattagggtggataatcactgggtggataaaaactatggtggttaagggaaatgattgtaacttgatgggcatggaagagcccaagcttatactgcatgattgattcttaatcccacctgcagatgggaatggaagccttattcacttctgttttaagcattagctctaacagctattgaaataaagtctggcatattgtggaggctcaataaatatttgttgaacgtgtaaatgctgcatactgttacagtactagaaatgcgtactttgctgaggaaaatgtttttttttttccttccataaactggctgatttgtttttttctggcattttggcaccaaaagagacatagatgatacaagggagaagcacacggtactctgagacccaaaggggagtcatctaagagtcttgaggtttcagaaaggggcttcccagagggggtgagctttgagtttgtatagagcaatccgaggatgaagcaagatcactttatttttgcaaggatgtgtccaggtgggctatgggaggcaaagttgacactgagaaatttgcctcttgccttaaatccctttgctctcctgccagagaaaaattctgtagaacagaaatctccaataaaagctataagtctaatgggaccttatacacattcattgtaagctgcctgttttacatactttaccaaggatcatatgcatgaattccaaagtcaaattacagcaaattaaggacagtcaattgaagaaatggtgaaagtccttacttaatgtggggatggacagcaaggattttgcattggtatcatcaattgagtaatgtcactgaccactgcaggtgagctgctaaatattcctgcctcagtttccttttcaatagcatggaatctgtgttatctattgacattaattagtatattaaaaaaaaaggattcagaatgcttggaggagaaagtaaaatttatttttctattcaagataaatatccagccatattcaccagaaaacacatttgtattaatctgtaatttagattttaggttatacagcataaatagctttttttttctttttttgtgctgaaataattttttgctcctttatgcttgatgttttaaattactggacctaattcttgctaatgtgtctttttgcattcgatccaatgtacttgcaacaacttgcagcaactaacccgataattatcaaaacacttcccaagcaatctaatgcacaaaatggggctgaggaagagtgctttgctggcttatacttgtctgatgaaaaaaacctgaaaatatgtttatttgtgaagcatttcatgtttttcaagatactttaccatatattttaaaatttatttttaaattggaagatatcatatattaatgtaatattgccacactaattctgtgaattaagtattataattttactcatttgatagtttaggaaggttaggaggttaaagaagttggctgactgatcatttcagactgtctctgcaatatgtctctggtaagaaaattaagcatccaggtgaactggataagctaagttctggactgaaggttaagttgttcagctcctacacatttagaactagctggaaatctttgctgttaggtcatagatcctgtttttttctctttgaggaatcaaagccaaagaagtagaaacattaaggatatttttcaaatgtggattttaatggtctcccataagaattaattttggaacgaatgccagctgatttggtttaactatatctatactttgtcatcttattcagtagaataagatggaccattcttcctgaatgatagaaagtggttgtttgctcttctgaattcatattatattatgaatatatggactatatgaatataattatggaaccattgcatggtccaacagctttaaaaatcttttctctagtagatttccactgaaaaggtatttgtgtattcatacacatataatccagggggcttccgcagtggctcggcagtaaagaattcacctgctgtgcaggagaccagggttcgatccctgggttaggaaaatcccctggagaaggaaatggcaacccactctagtaatcttgccggaagaccctagaacagaggagccggcagactacaatccacagcat

SEQ ID NO: 33373 - DNA, 794 bp, Bovine  19866881008925
ttgccttctctgcctgcactggcaggcagagtctctactattgatccccagggaagcccattctagcatatagcaggtagtaaattatgaaatttaacagagcatttaaaaatgcttatcttagagtttttcacacacatgaatattgttttacagatgtagatgtcatgcacctgggcaaaaaagtcagcatccccagagacatcatgttggaagaattatcccatctcagtaaccgtggtgccagactgtttaagatgcgacaaagaagatctgacaaatatacatttgaaaatttccagtatgaaactaaagcacaaataaatgtaggtataacttgataatatggttatctaaataaatgggcagcatttctaaatttatatgtattattaaattcccaaacaagtattttacaaattttcttttcattgattctgttatacttttttccatgatgaataatttaggtggataaatgaatattatgcctgatatgagtatctttttggttcagtagagacactgcatgtttgtagatttggcactgaagaactggtctgttctgctaagaggagggagagggagtggagactggtggaactaaaagtttccatatcttatcaccactggttaaatgtttgggatggaaacaattccaaagcacacagtgctccataaagcaagtagaagcattttattgggctgaaaacatcctggcattgaaacatgcctgggaacgagacacagctgatctcctttcaaagtattcattccacgttgtatagagaagt

SEQ ID NO: 33374 - DNA, 1523 bp, Bovine  19866881033634
ctctgcaggaaggcttaggagaatcccggcttgaagttgtggtctgtgttgggtgttcctctcttgtctaacatgcattccttctgttctcgccccataggttctgtcttatcatgcttcagctgcagaggaagaaaccagagagctgcagtccttagcggtaatcctcctcctcctcctcttttgtagaaatgactaaccagaggcacctaattaagacgtagatatgcttctctcagggcagctgctgctgtgggtagtggtccccagacctttaattaaatgtggtaaatatttatatggacatttataaaaaaatctaatcctattttcttgcaaggctagaaattcactgataacacagagcagatgataacattgtattgattttgtaacacattaaatgattctgatattttcccaataattgttataatctttacatctttcttaagtcaaaattaaatttagtttttggttcctggggaagtgtggacaggggactgcaaggtggtgggtgtggttcgagtactaacaacaaagattttatagcttgttactgataacgtactctgcgttattagaaatggagaatggttttaatttcaaaccatatggcttgcagaatgttatttgaaattgggtttaaataaggtcaattcctgaatttttgcaaagttttttttatttatttattatggatgcttttatataacaagcatctatcttatttaggatgctaggagagaaaagcacattgatgtgtgtcttgatgtgtgccccaacttgattgagattgccttggttgaggttaatggaaattcaaagcacttaggcactgataaccaagcctgccttgtgagtttacattcatgtgagacaatgtaaagtgtatgtgagatgtcgtgggagtgagggaccaatgagagggtcgctgaggctactgagattccttctctttgtcatcatcattatggcttgccagatggtcatgctccatgccctcatgtacgttttctcatgtaaactgcacaagctgcctggatgccacactgaagcccacggacttgctctgggtctcaccagcaggaagtgaagagtcaggatagacatttgcactgtctgtctccagagtgctgcacgttagcgctgtcctgtctgtgatgagcctttagggagggaaggaggttaaagatgattcagacgtcctggccttggtagttcaaagaatgatcatccccttcattaaccaaagtggaaatattaagaaggaaaagatggatttgatgcagaacacggtaagtttgagatgcgggtggaacaaccagatagacatcttgcacactgggaagggcaggaaactagaggtggcaatttggaggttaaacaatagggtttgggggtggaatcccttgatagtgagatgataggaatggagcaagtgtggaagaatgcgggaagaatgcaaggctgagggcagaactgttgtaggtatacgtttagatggaagctgtaggaaaaga

SEQ ID NO: 33375 - DNA, 1227 bp, Bovine  19866881041342
ttctttgtgtatgttaagtgtattaagtctgcagcccccctataaggtcagtattagcattttgaaaatggaatctgaggttgagtttagattgccctgctcagaatctcccaggttgtgagtaggtaccaggacagacagtccagacccagagcacacacatcattgcacagccctggagaaagtgactaggaaaggaaggagggtccagacttgtagattcttgattaaatcactgagtatgaagctgagtcatctgccaagaacaatcgaaggaactcgagatgatttcatctgaaaggttaagctctctgggggttagcctcattcgaattggctatatttcttttgctcatgatgatgtttgaaggaatgagctgtttttcaattatttacaaaggtttaaaagtttaaagtatctctcacatcaggcttaattgcccatttgtctaatcctcctagagtgctagagttttgcactaactgcatgctgtgagcaggaaatgatcacatggagagaagcattttgaagcgcttgcaagctctgtgggattaatatcactgcaaaacgaggctaggttatactcttccatgtgttgtttcagataaataaaaactagcaaagataatgctaaaaaaattcattaggatattaaattttgctttttactctgaaaatagcatagtctttcagaaaaatctgaaaattattttctcaatcatgtttataattttggcaagaggaaaacactttggaaaaactgagcattgctgtcttgcagtattgttcaaaaccatctgttgttccatttggaaaagagatttctggcagctgcattgagaaatttaggataacgtaggtcagataattcatttaaattggttgaaattcagaaaatgatttcaactgttttctgtcaacctaataaaaattcctttgcagccccagctacacaggtgcctgcatcatccagcaattaccagaattgctatcttagtcacgtgcctgatggttcatctcaatttaaaacctaaaataattgaaaagctgtcaaaggcttaatttttatttttagaaatgcgttcttgaaatactatgcttaagtacactaaatatttctgtgctcagaaaagttctcgttacagcagaaagtataacaaagttgataggaaattcagaatcccttttttccccttgctttacttgacatttttgtcctagttttt

SEQ ID NO: 33376 - DNA, 3960 bp, Bovine  19866881043035
attcctgactgatagtctttttatattcgttacaagcccctgccaagcatacctgagctcacggtaaggcagtctcatgggggagaaggcctcaaatagcttcaggactggggctggctgccaggaaaaccaactgagcgattagaggatcagaacgttcagccctgccactggataaggaagaggggcctggagactgagtccaatcaccaatggtcagtgatttaatcaatcatccctacatactgaaaaaaaaatcagattgagggaacttttgggtaaaggtcacctactgtgtgctgggatggtgttgccacagaaggtggacaaggaagttttgtgttccccgcccctcactccttgccctttgtatctctattaggctatttctgaatgttatcctttataaacatacagctacaatcttaagtactttcttaagtacaatcttaagaactttcctgagttctgagtcattccagcaaatcattaaacccgagtggggaacccctgcatttgcagtcagcccgaagcaagtgtggctagcctgggggtccttcctatggctggcatcttaagtggggacaaagctgtacaacagggtccctaaccttggggtctgcactcactccaggcaactagtgtcaggactgaattggaccatgggacaccccagctggtgcagaggtgaagaactgatcgtcgtctgtaaagccaaatgaggttgaaagaacgtttgtggtattcctgccaaaagcgcctaacgtgaatctattcaagaaaaacattctacgagataactggcctgtctccttccaaaatacatgtcaagaaagatagagaagcactgagaagctactgcagatttaatggaaaataacaagataggacaaatacatgcaatacgtaaccctgagtgacagccttgaacaaaggggggaaaaaaatcactgcaaaggacattcatggggcaactgaccaaatttgtccatggaatgttagctaagagctttgtatcaaaaaatttccagattttgataaaagtatgacaattgttggaagacaatattcttgttagaaaatacgtatagtaattgcttctcagccttttagctaagatcaagtgcagtatctgttcttatctgaaaatacatatagaaaaatgtctccgaatggctcagaaaaaaataatatgcatgcgttacttacatgcattacacacagaaaaagaagataataaagcaaacaggccaaaatataaacaattagagaatctgggtagagggtatacccaagtttctgatactggtcttgcaacttttctataagcttgaaatcatataaagataaaaataccagaaaccaaaaaaggaaataaccaactagatttgccaaattatatgctggtcttcttccacaaagtggaatatctaaagattattagagcatttaacaaagatacagcagttcccaaactctgttccctgggacacaattacaacatgacaaatgtatcagaattggtaatttattaagaatgggacagcagctattgctacttctttcttctgaaattcattttggaaataattttattcatcagaaattcacttgagtagcacctgagacccgcaggatgagagatagtgaagactatttatctgaagaaggactgaaaaggggggaatgaggttggggcgggaagagctgcagctcgagggtaaaggccacgtgagtggtgatgtgacccttccctaagaaccctccaatttttctccctaaaaatcatggtgtccatggagaggctgccccatggaaacaagagatgggtctaagttttgcattcctgttgccttaggaaataagacggttatttagacaatatacatccttagacataggaaatcttgggaggcgtaaggcttccatcagacatagaccagggcttcagggcaatctgtgatagttaattttatgtgtcaacttgtcagctaagggatgcccaaacggctgataacacgttatttctaggtgtgtctgtgaggatgtctccagaggagatgaacatctgaatcacgagaatgagtagagaagatctttatcaatgccagtgggcatcatcccatcccttgagtaggcagaggaaagaaggacgaattcgctctgtttgaaataagatatccatattcttcttgccctcctgcagtccaccagagctcccggctctaaagcttttgattcaaacacagaccagagttacaccactggcccccctgattcttaggcctgcagaatgagttataccatcaactacaccaatcttggttctccagcctgcagatggaaggcagactgtggaacttctaagcctccattcccaagtgagcttattcctacaataaaccacttcttatttatctctatatatcctactagttctgtttctctgaagaacactgagcgataaacaatctgatctaaatactggatgatgtctagtttccaagtattaggaaaattccaacacattcatataagttgttctgattattgtgtcaataccttattattaataaatgctgtgccacattcaagaaagttgcatgagtgatggcctgatagaggaggagatgatgtgttgactgaacatcactgacatttgtggtgtaactgaaactcactggtctaagctgtggatcatgtcatgttttaaatatgtgaatgtattattttatcagtaataaaacagttgaattccaaatgtataccattctgttacaaagttttaaaatgggaatcaaatgttgaccatttcttaaaattaatttatctaagagacttttttattcttagcttcaatctgaacactactttattttatggccactgcttggctctctactgctgcactacaacttctaagcattctgtggtcatgtaagctcaagaaatgctgctatacagtgtctacagattacatatctaaggagtgtgtaggactaagaaaagagaacgtgccatttccttctccaggggatcttcccgacccagggatcgaacccaggtctcccgcattccaggcagatgctttaacctctgagccaccagggaagcccggggatatgcatagtgatgaagaaaaaacaatgaaagaacacaactgtgagatgagctatgtcaagttatcattaaggagaacaagacaacctttctctaaggccgctgtgttggactcagccaccagtgaagaaactgactttcaaagatggggagcttcttaaccatagattcccactttaaataagtttgtaaatgatgaaatctcagtttcaaatatccctacgattgacagtagttgcccatgccccatccatattccacgccccaccctgcctctgttccaagagttcatttacctcataggcgtctttgatgttcaagggctcgccaaaagcggccacgtgtcccacgatgcctttgttccactctaagcggatgcagttgtttgaagcttcttccagtgttgaaccttctgcaacatcaaagaggcggctgataagaaacttgtcgttggagctgtcctcacagacgaggaataaggagtagcggtcggcggagatgagtccatggatgtgcaagaaaattttgtgacataaggctgtgacatccaagtgactagaaatatctttcactaattccaagagtctcgagcactggtccccttcatcattatcaaaccgtggggaggttagaggcatctgttccttcttgtctgagtcagagaggaagctcacagttccctcagaatccttgataacgatgggtctaagcggccgatcgaattcagaggcagagatcttcctggttggtgttccagggacactgctctctgcacggggacttggctgcaaggggcaagagcaggattccgtgtggcccttgattccttccttgcacaca

SEQ ID NO: 33377 - DNA, 1115 bp, Bovine  19866881043449
ctaaactctgggttgctaagtgctaaatattattcttaaagcatgactcagaatcatgctagaaacagaagcagagcatgttgggatccatgctttcatgtataagcaaaatcaatcattgattttaataggctttagcagggtgtgagtccttggtaaatgaaatccagactcttatttcaaactgttcaaaataccagagaaaagagggattgaaaacaaagtgaagcaaaggcatacaactattaatattaaaaaaaaaaagaaagaaaaaggaaaggacatgaagccacacaaaagtgaggagatgaagaagcacaatgaaactagttataagaaaatatggtccaaggagccataaaaggccttggctcattcaaatcctagaatggcattactggctctaacaggtcacttagcacaaagttcttgagattttcctcattcacaaagacacgcagctccttttgaagatttcagttcaaaacaactctacgtaaaaactgcctgccttctctcttggatacaatatacttattcactaagcaagtaccagagacgaaaagtagctttaaagatagaagggctgttagaagatctagatcacacttcttaacctttttcacaacacactgcacatggaaaattattgtctggcacactgagataaaaagaagagtctgtctactaggaactcaagtgtttggcaaggaggtcacgctgctgcaggcaacacttggtcacagagatcaagatctcccacgtgacctatctctctgtaactcatttgggaatatatactagataaaccagtggatcatagaaatgaggaaaaaaatcaagtctcaaagggtggcttaacaccagagaagttcacaaagttacctagtgggagagtgaggactggattttcacaggcctcatatgaacagtaattctaatcggtatgccattcagaattcaccaattctgagcactgatggtgttattttaaatgatataccaattcactgaggcctctggcattagcaagagaaaagaaaatgacaagacaaccatgtctctcacaaatatctgtaccatttttatactgtatttaaatgctatttaaaaaa

SEQ ID NO: 33378 - DNA, 1318 bp, Bovine  19866881081965
aggagtgaaagcttatcagaaaagcaggtgaaagaagcaaaatctaaatgcaaaagcattgccctccttctgacagatgcccccaaccccaactccaagggggtgttgatgtttaagaagcgtcgtcggagggccaggaaatacacactagtcagctacgggactggggaacttgagcgagaggcagaggaggaggaggaagagggcgacaaagaggatccatgtgaagtagcatttctgggtgcaagcgaatcggaggtggatgaagagctgttgtctgacactgaggacaacccacaagttgcaaactttgactgggattctggtctagtggacattgaaaagaaactgagcagaggggacaagatggagatgttgccagacaccacaggcaagggggccctcatgtttgccaagaggagggagagaatggatcagatcacagcccaaaaagaggaggagagagcggttggagtgccaagcagagaaccagatgctgcccagacagatggcctgagaaccgtgacgtcttaccaaaggaaggaagaggagtcagtgagagtgcagagctctgtgagcaaaagctacattgaggtgagccatggtcttggccatgtgccccaacagaatggcttcactggggtgtctgagacagcagaagctcagaggatgatccctgtgaatagaacagccaagcccttcccggggtctgggaaccagccggcaacccccttctctccaagccgaaacgtgacaagtcctatcgctgactttcctgcgcctccaccttactctgcagtcacacccccacctgaaaccttctccagagcagtgtcgagtccaacagctggcccagcaccgccccctccgtggccccagcctgccccatggtcccagccggccttttacgattcatctgaacgaatagcttccagggatgaaaggattgcggtgccagcaaaaagaacggggatattgcaagaggccaaaaggagaagcacgacaaaacccatgttcacttttaaagagcccaaagtcagccccaatcctgaactcttgtcacttcttcaaaattctgagggcaaaaagggccctggagcgggagcagattctggacctgaagaagactacctcagtttaggagcagaggcttgtaacttcatgcaaggctcctctgcaaaacagaagaccccgcctcctgtcgctccaaagcctgctgtcaagtcctcatcctcccaaccagtcactccggtttctccactctggtcgccaggagtggctccagcgcaacctcctgccttccccacatccaacccgt

SEQ ID NO: 33379 - DNA, 616 bp, Bovine  19866881145737
taaaagaggctagtctgagttagaaaagaaaaaggaaaaaaattacagaccatcctgtgggacatcgggccaataacagccagaagcccccaaatcagattatcttttccttgatgttatcaggtacagccagtttcttaaattaaaaaaaaaaaaaaagaacgtttcccatggtatgtatatttttatactgaattaccatttggcacttggaaatcatagaccttactactcagaagcaactgaatgaagagaaatttaatttataaatatcaaatcctgtcagatatttctcagattcctgattttatcagagctatgccagctaataaagtatttcttaagcataaaaagttagacttctacacgatcctatagtttaaatagttgttactgatacacagaatttcataagttttcctttttttggttctaaatgtaaagttcctcatgtttacctctgtttatacctcattcttttgtttatctaaatcatgtgtgcttcatgacttatgaaatacattcagggcccctaataaaagtaatcacaaagacctactttccagccaacacttcttcctctgtgctgtgctcagtcgctcaactgtgtccagct

SEQ ID NO: 33380 - DNA, 1006 bp, Bovine  19866881163177
tctaccctctctggctctgctttctggcctctagagactgcagtggccaagttcccttgcatgctgactcctggttggctttggtcaacaggaagctccaacaagagataaagagcaagggaaatgagagggcagggaaatgctgtccctgctggacctgctgggccacggtttggcaatggctttgctcctcgatgtagacagtcagagctcctgtctgtctgtcgctctaccatgccttaactcttgttgtgttccaataacacacaccacctccttgcatcttcagacccaagggtaataatagcttcctgctcttcacctctgggtgcttcatttccattcgttggtttccacgagcctgtactatattatctttaattactcctttgaatatgccacctattttctgctgggaccctaaatgatactaatatgtttagatttcattttacaatatgaatttaatggtttttaaagaatcatgtatcatgatcacacaatctcaaagttaagaatactttaagatcatcttctatatattttccaccaaagggatccctatttgactattaaactcaagattatgagtccaaagagctcagaaccaggtgagcagcatttcttagagtgttttcatagccaggctcacttttgattgggcacgaaatgtatttcagtttatctctaacagttgcccactaattcttgctaaggtcttaaatgataattaatttgctgactgatatagctctaaagtttatatctccatgtgcatttacattttacatgatactcctggaggcagaagcatatctttaagtgccagaacaatgatgctaatgaaatttgaagtgtttcagttagttttcttctgggagggtctattcttttattgtcataaattataagaaggccttccccttttctgaaaaaaatcaatctcattccttcttttttgaaagcacacaacaatttattgcaaaattaaatgaattcaatattt

SEQ ID NO: 33381 - DNA, 1074 bp, Bovine  19866881164168
acagtgggagaagcagtggtcagaaagaaaaaataaacagaagaaaaaaatccgtgaggtcactcagaaatgatgctaataactgtgtgttctcaccctacggcctccacatacatggggttccttgtgcttcacagtcagcccccagagtcagtaacccttcagtaacccagagtcagtaatctcccaatcacatgatttccaaaaggaaaacaatggtcacacatgtgcctttatctgaagcctactcacctttttttcattcctcctttataatgtactctaccgcttgcctcagctgaggaaaacaaacttatgctttcatgggcaattggagatgtactcactgagtttcttaagtaattggggagggaggatgggaatcaacctctaagaataattatccctcttgcccatccagttcactttaaagaagtctttgaaataagctaatatatatataacatctggcaaggagcctggtagataacaagtactctgtaattattaatcccctctttcttatccaccttactaaactatgtacattccaacaatccccaagttctctgtgacatcaaacaggtggctgaggttgacagaccagagctgatccctgtcctcaataaatttcttatcccttaatactagtaatagagataaagcactacttagaaaggaaacatcagtcaatacatgttatattttcactacaatcgaaccttttcactgtaggaacacagctgttctgtcacataaagactgtgtcctaatgttgataacactgatcactgtcttgtggctaaatgcataaaccctaagtatcctgcttacttaatacaatggcccatgtttatttgggggtgctcccagattttttttaagtgtgcaacgaagataaatatgttttaagtcaatctgagttagatttctgactcattaaaaatattctgcttggacccagattgggaggtgacatctgaaattaagtaagttgaggacttgctaggcattctctgggactcaagttaacaccgcaaacaattcgtttcaagcaaagtggacactcagctt

SEQ ID NO: 33382 - DNA, 2399 bp, Bovine  19866881170299
actctgtgaacatgtccctttatgtggctttgcagaagtggttgttaagcatttgaaaaaggaagttcatcctggattatttggatgggccacatgatcatacagatccttaagagggtgacaggagtgttagagaagaaaccgtgaggatggaagcagggataggtagggggaagtgtgtggtgtgtgactgagtggggagctttgcagatgttatgctgttggctctgaagatggagaaagaggccatgaactcatcagtgctgggagcctctgagagctcaggaaggccaggaagtggcctctggatggaatgtagccttgctgacacattttagactttagatcacctgaacagtaagctaataaatttgtgttaagtcagtccatttgtggtagtaatttgctgcaccagcaataggaagctaacagattttttttttcaatgaaaatttaggaaattgagaagagatatttacctagtttattaccatgtaaaaatcaatccatagtggtagtgttcaagttcaggaaccgcttgtttgggtgaatgctgcaacaggaggctacgggtgtcacctgaggggtgttccttgcatttggaagcacaagagcgaggagccagtgatgcctccctgcagcctctgtttaggggttctgttgcctgaattttttgaggatctgatcctacagtcttatggcttctgactttgtatggtgtgaattactgtttcctcgtgtatattgcaattatgagtttgtctttaggggtataaattgtgtggaaatttcatgggcctgtttgaggatgtgttcatccaaagacattttgcctttgctttcaacagttgttcacggatattacctgcctgagacttcttgcttgctatttgacttggagagtcccgcatcagcttcaaatcccaaatctgggttaatgtgaagatggactctatgttattattttttaaccagagctcagattacgacaggcaggcttcctttagttgtcctgtgtctctgaatttccccccactttctacatgttgagagcacagctcttcagagtgctcagtctttcttggagggccatttcccaggtgctcccctgactctcaagaccatgtttccaggtctgatttaaaaccccctcatgatacagatctgcaggtattcctgggcctgacatagtatcagctcacacacttacactggatttttgattagcctttctttggcctctagagatttctctgatattttcttaaaaactcaagtatacacttaaagaacattttgctggaatatataatctataaaaatattgaatcatcatattgtatacctgacactgacataatattgtaaatcagctacgtgtgtatgttagtctgactctttgtgaccccatagactgtagcccaccaggctcctctgtccatgagattctccaggcaagaatcctggagtgtgttgccattcccttctccaggggatcttctcaacccagggatcaaaccctggtctcctgcatttcaggcagactctttgccggggaccagccccggctgatccagggtattcgaagcggggacggcgtcggcgacctatttatttaaatattttatcagagatataaagagtaataggatgaggatagctcagtaggaaaattcagtggagaaaagaggctgagtagcttggtttacgcaggagaccagtaaaacttcgacaagaagtttgcaccacttacgtaggccgcaggcatccttccgttctcccgaaggagaggagacactgaggcctccccggttggatcttagaagcccaggcataattagtaagcatggcgggttctgcactccagatggagactcagccagaatttgggcgagagagcgacatggggagaccaagtttcagtgaacaaggcccaataagtgaaaaacccttcaccaatacaatttctaatcaatcttttaactgctcaaaagaatctgtgtttagacagtttagaacatctcatgcctctcacagttgggaggctctgagcaatcacatgtggccggaaaaacctattcaggcaggctagaggatttccaaaggagtttgtaggttaaacactgtcacacccaggaattattaactggagctgtaagctaactcttttttcagagagaggtagtgggggacagccccctgtaaagtcagaggtgtaggtgaaagcacaaagtataaagtaggcagactctggtttttggggtagatgctcgagaatttccagggagactcctgaggcttgatcccgcctttgcgtatgccgagcatttcttcctcatgacctttgccatgggcggagctcattccccgcaattctttaccgcctgagccaccagggg

SEQ ID NO: 33383 - DNA, 957 bp, Bovine  19866881174000
tcagtatttaatcaggatttgtcagcacattaacaaaactgaaaagcaaggtaagcatatttgaaagtgatgttcattcttataactcgttttgatgctattcatatagggtacttataaaattctttcctaaatgatatattcataaatgaaacttcatgcagtgaaaaagctaccttctaaagaaatccaactcaattagatttagtgataagctgagatactggcttatctgaaacttaggtgtgtgcaatgataatataatcataagcacctgtagaacactctgaagtgcctttacatatattatcatttatcatttcatcacaaatagttacagaaaaattttggggggggggtggtgttcaaaatgtagaaaaaaaaaactaaacctgaacttatatctcaaacatcttttattagtattttactgataaggaaatagagcatttaaccagaagaaataaatacaggctttgaacaaatagttcagaaaaatggtttttcatttaaatataaaaatgcatgtaccatgactactgtcaatcctattaaatttacttttgaatatataactattaatacattataacttaaatgggttcaataagggtactgaccagacacagcaaaacttagggactagagcctgacatgttaaagctcggttaggaatttaacaaagaaggagctaaaatccagaaaagaaataaatggtgcaaatagtcattgttcttaagaattacaaaggagttatagttggggaaaccaaatatgtataatagaaccacagtctagctggtaacaagaggctgatccaagggggcaacaaacagatccaactggaatggaaagtcctgggattactgggtgtggagttgtagtgtgaaccgtatgccctcatgggtcagctggtccttaggcacagaagatgggcctttcttaaaggtgtgtgtt

SEQ ID NO: 33384 - DNA, 909 bp, Bovine  19866881376991
aatagaaagcccagagataaatccacgcacctatggacaccttatctttgacaaaggaggcaagaatatacaatggattaaagacaacctctttaacaagtggtgctgggaaaactggtgaaccacttgtaaaagaatgaaactagaacactttctaacaccatacacaaaaataaacttaaaatggattaaagatctaaacgtaagaccagaatctataaagctcctagaggagaacataggtgagtttttttcttatgtccacctgcagtgtattgttctgtaaagtatcaggttgtcagctttggttgaatgacccagctccataagtatagcctgtagtgcatttggcttaataaactaaagaaactaaactaaaggaacatgctggccacagccaggaggattttatagaaccattcctgcttgggagagcataattgggatttgaattaattataatccagaaagttgtcttagcccaaggcatatgacctctgagaccccaaatgccaaaatcataactatgtaaaaatgatccatataataacagaacacataagctgaattgaatttcatgccatgatgtttcctaaaatgcactgtcaaaagaattgttgtgtaccagttcctgctgatatataaatgaccatatttaaatctaattacagtaaccctccggaagtgaaaggctaacttgttcagaaactgatttagggctcagtgacaccagggagtctgtagccctgttgctgcaagtgagcagaaggtttgtgaacattaacacacattacaaagtccatatttccaacaaaacattttgcagagaataaaatggaaattcaagaaacatgtacacatttactgaatatttttattatattagcattatagaaagaatacatttca

SEQ ID NO: 33385 - DNA, 1063 bp, Bovine  19866881480136
attaaaatgaaattaactatgttcttgtatgtgccttagtccagggtggaattaatgaaaccatggtatgctaactgatattagcagtaacagcaaggactataacattggagaagtttccaatggtagtataagcaataattatataaaaagaatttccttggtgttattttaaacatttctttgaaatatattttaaaatctgataacattcatatttggtttttggaaatgagacaaagacattctcagaaagaaataaatatttgagagtaagacaattatacatttcagttggacttctgaggtaagtggtgtaatatgtggggaatagaagatgtaggtataggatttatttttaatctatttaaaggcaggggcctgagacaggaatagactctgggttcaggtgtcctcacttgtgagatgagaaggtcagattatttaatctcctcgatgcttaacagctctgatattctgaactgagtttctctcatttgtaaaatgatctttgatgcattattcatttttgttgctcatcatataaatatcaaactaagtttaagagtggattaagtcattggtgtcacaacacgtatcattaaaggttcaagaggaattgttgggcagcagggtttgagctatgtgttacatgagtgagggctgatgagaagaaaaaaagctattaatggattaaaggaagtggtagatggatgtgtctgttattatacaactgtaggtcatgaacatttatttaattacagaaagcatgccacagaagcctatgcaacaagtggtgcttctttagaaaagcatcattaggatgttcaaaggaagttaaacagttgcttggacaactccatgacccatgcctggttagcatgaccatgagacaatcagttaaacatctgctcctcactgtcacacccacaaaggattaaacacaaggaaattcaaagtactttacatcataaacaagtatgagaatatttaaaaaataaaaacatcttgagtgttcaaaacattcttaggtttctaaatatgattattttgctttgtttta

SEQ ID NO: 33386 - DNA, 1259 bp, Bovine  19866881577519
ctttgataaaagtggatcgtagaaatggaaataaatgccatatctggcatgcattttaggctcagttctttgaatagttgaatgtaaaccgttgtcttttatggggttgtatcgtctagcaggtattttaacagctttatgttttatctaatattgttatataaattaagccattttcagttcaggtcagttcatttgttcagtcgtgtccgactctttgcaaccgcatggactgctgcatgccaggctttcctgtctctcaccaactcctggagcttgctcaactcatgtccatcgagtcagggatgccatccaaccatctcatcctctattgtccctttctcctcccaccttcaatctttcccagcatcagggtcttttccaatgagtcagttcttcacatcaggtggccaaaatattggagcttcagcttcagcatcagtacttccaatgaatattcaggactgatttccagtcaatattcaggattgactggtttgatctccttgcagtccaaggggctctcaagagtcttctccaactccacagttcaaaagcatcaattcttcagtactcagctttcttcgagacttccctggtggctcagatggtagattcccctggagaagaaaatggcaacccactccagtactctatgcctggaaaatcccatagacacagtccacagggtcgcaaagagtcggacacaactgagcgacttcacttcagccttctttatggtccaactctctcatccatacataactactggaaaagccatagctttaacttgatggactaaaatgactttgactaaaatgacctggaataggccattttggggtaaaacaaatcatatctgaatatcagtatttaagtgtttctaacataaaatcatctggaataatttgccttgttcttagagcctaaattttcctgctatgaacatagcaatagtgaaagtcatctttctatttcttgtgttgccaggaaagctattgtacagatagtgtaaaataaccctctgaatttagccttgaatgaatgatatgggcctgaactaaaagaatatacgaccttatagggtgccttcttgggagccaaatttaaaaggctaatttgttttcctacccttgtttatcttttgctttgattttattacttagttctttagcttgttatgttccgtatgtattttgtaagagcctggacaaaccctcttagaataaagtgagggtataaataataaaattttaatt

SEQ ID NO: 33387 - DNA, 1574 bp, Bovine  19866881632003
ttaatttcattttaattgagaagagtttagttgcctaaattctcccatattaatgaaataaatggaatttctgtgtcatcagcacaggaaaatgagttctttaaagaaattctctatgcatctgcagaggaaggaagtgatttacactccaatgtgcatacacacacagataaatgacctatgagaacaagccaagatcaaaagtgattctaaactattagaaaagtggaaaacactgcaaagaaacattaaaaaaaaaatctaggtggcatatgaccagttctgctaacttcatgtttgacgtctccatcccctcgggtgtgggttatagttgcagttggttatggagagacaataatcagacctggtctccatggacattatttcagaatcgtttctggaaggctgcctgtaatatgcatgtggtgcctgtgaaccatactgggagttgggcatactataattgggtagggatgcaacattatactcttgctttgcaaatgagcccacactggtcttctgggtttgagggacataggacagtcttgcattccattcctcagactgccctggaagcacctttctacgagctgctgagaccacatttgccacaatggattcctgaatgtttctgggtctgaaggcctcatccactaagccaagaggagacttggctgctgcttcccaaggagtcagtctcttctttgcttcctcgagcccatccgttggcttgctagtgtagctgtaagcaggctggtataaccaaggagatgttgcagagatggcaggtgggactggtcttccaggaagagaaagagagcgtccagtctgctagaaataatgaaaatgttaatatatctcattcattttggtttatgctgattggctactactccaaagcattctccacacccattactaagcactataaaaatcaacaaatccctacaatgcttataattaaagccaaaataggctgcctctgcctggtgtattattagtgctggtctgggacttgaccttcctttaggacctccttgctctgcttttctgaacccatagctccaattgctaccgtctttcttaggcaccaccaccactgcaagcactctgttatcactggggccactcttactcctgtctaccctcttcatattcgtacctacatctacagcccaccctcattctagtcctgtttttctaataccgaataagcataaatatataaataactctagaaacagaccatgttctactgggctttgtactttttccaagtgacttttaatattttgtcttatttttgtcttatttaatatttcccgtttgatggagcagatgacatttttccagccaagttctatgtatatactggtgaagatcatgtggatctttatttcctgagtgtagtatattgcctgtgtctctgaaggaaagagttcagccacttgtttcatttgtgctttggttccttttatgcatattatattccttatttctttgaaagtgtgtgtccctgaaacattcctttgtgtatgctaaatgttcagtttgtctaatatcatgaaatacaa

SEQ ID NO: 33388 - DNA, 860 bp, Bovine  19866881830927
agagtcccttggactgcaaggagatccaccgtcctcctaaaggagatcagtcctgggtgttcattggaaggactgatgttgaagctgaagctacaatactttggccacctgatgtgaacaactgactccctggaaaagaccctgatgctgggaaggactgaaggcaggaggaggggatgacagagcatgagatggttggatggcatcactgacttgatagagtttgagcaagctctgggagttggtgatggacagggaagcctggtgatggatagggaagcaagctcagggagttgcagtccatggagtcacacaactgagcagccaactgaactgaaggtctgactgctgctctgccatcatgtaagagaagtaaacacttcacagtcgtgttcttgctccagcagtcttcaggatgccattttcaggtcttccagtcaaaagaactgtgagtgtgaacaagggaactctacagccttgtatgacactctaccacatttaaaggtccttctaggacaaaaagagtaatttactcttttgaatttgcaaatgcatttattttcaaataaatactcctatttagccctttgtataacatctgtaagaattctgacagcctctaagattatcacattgtaacaaataatcgcaataaaattaattggatagcaaagccagctttaaggatagtaatcctacttacaaaaacaattccttttgatgaggatcttccaaattgaattgatttttcattataagttcaaaaaattctcctcgtctcctttaaaataaagaaaaatatttggtagttatgatgagtcccctaagctcttatctttttggtcaacaaaggctcatca

SEQ ID NO: 33389 - DNA, 1613 bp, Bovine  19866880392085
tataagctcatagtattatcaaattcaaatctgaaaaatgttctcaaattatcctaaacaggaatattttcacatataatgtatgttattaaattaatccttagtgtgttcacttttatcttaagatagtctatatagttttaactagctttaaaaaattgtttttgtatagctgtgttctcttgccctttctcacctagcttccttgattcagcattgtgattttgaaattaatccatatttttgcatgcatctataattctttttattgctaagtgttctgttgtactgttggttaacttattggttaacatttgagattttttctaggtttagactcttagaaataaaactgctatgaatagttttttataggtcattgtgtgaacatagattttaatttttcttggggaaacacttaggaaatggttcattcatatggtagatatgtcttttttggaaactgacaaactgtattctaaattttgttttttctcagagtaaatgagagttttagtttttaaaaacttttaaactttaaaaactacctaaatttggctattacactccttcctaagaatgaaagaaaatttttgaaagtatataaatgtgtcaaatattattttgcataaaacttttcatatgaaccttataaagctgtagttaatttacatataaaagacttaataaatatgtgaatttaaatagtctgtcaaagatatatatgaaagataacttataatattgaaaataggaagctaatgctctaagtcttaattttaagttttcaaattttattctgatgctcaaaataagcttcttaagttgtccaaacatgaccacagctttctaaacaattaatattcgaagaatgaagatccaactagaggagaatgagcaagagcttgtgtgtgtgtgtgtgtgtgtgtgtgtgtgtgcttaaaagaactgacttatggaggaaaagcagaagatacatggtgtgctgagctttagctgtgcagggcccacccggggggaggtaccatagtccatgttcttcattccctccttggactttaatttcataaactgattccctttcccctcaccaaatagtgggggaaagtattgctttatgtgattgtggaggctagctagacaagtctgaaagccatagcacagacattgggaatggaagatgaggagcaagatgggacttgctatttgatttgatgggacaaatcaaagctatttccatatatagaatttctcattttactaagatcaggaaagacagggatacctgctgttcatcactgttttgaaggttcttatattacaagaggaaaataatcattacaaatacgaggagaaaggagataattaatttcaataattaattatatgcctaggaaacccaaaattaggaacaagaattcctagaataagaccattggatggctcaatatgagataaatatttaaaatccaataccttttctctataatatttatataacagtttgttagcaatagaaatgataaaaattattcattatagtgacaagttacacagaattaaatttaacatgaaaggtatatgccatacagaaaaacatctttaaaaggttt

SEQ ID NO: 33390 - DNA, 1906 bp, Bovine  19866880449954
tggacaagatcttggcattgccttcaaaatcagtaaggaagttcttgctggacgaccactcttcccacatgttctgtgccacaactgtgcagttgaatttaattttggtcagaaggaaaagccatattttccaatacctgaagactatacttttatccagaatgtccccttggaggatcgagttagaggaccaaaggggcctgaagagaagaaagattgtgaagtaagtcactggaaagaaattttttttgaagcttggctaaagttctgtttaatttactgctgtacttgttcccattaaaaggctgtggaagttcaaatgtgtaatctgggcttttgtgtatttaaaaaaaattatttaaagaattctttccattgtaggtggttatgatgattggcttgccaggagctggaaaaactacctgggttactaaacatgcagcagaaaatcctggtaaatacaacattcttggaacaaacaccataatggataaaatgatggtaagtaaaatgggcttgatttcagctagaaggtattctaggtaatatttttgttttttatccattttgtttagtattttagagagaggagtttgggcagttaaatgtttatgtaagtaggtgctttacctgtaaggtaaattgctttccttccagtgactagagtccattttctgtagaagttttttaactcaattatccagtagataacgacgagctgattggcattgggtggtgttacaggataaaatgtcctttcttgtagcattgaggaaaggcaatgtttaaattttttttcaatttaaaaaaaggtggcaggttttaagaagcaaatggcagatactggaaaactgaacacgctgttgcagagagctccacagtgtcttggaaagtttattgagattgctgcccgtaagaagcgaaatttcattttggatcaggtaagctgtaagtttgaagttgaaaaaactgataatagtagaattaatgtttggggttttaaactttttttttttttctttttctgaaagacaaatgtgtctgctgctgcccagagaagaaaaatgtgcctctttgcaggcttccaacgaaaagctgttgtagtttgcccaaaagatgaagactataagcaaagaacacagaagaaagcagaagtagagggaaaagacctaccagaacatgcagttctcaaaatgaaaggcatgaagttctattatgttaaatatcctgtgatttgtatctgttaactttatgtcagtaataactgtttcaagagttaaattaactgtaaatgaacatatatatttaacttgtgtttgtaagaaaatgtaattaaaatatgactaggtgttgtgtgttttgcaaaaattaacagctgattgagagttacaggctttagggttgtgaacgtgtatgtagtgggtttgtaggttaatatgattttatgttttgcaggaaactttactctgccagaagtagctgagtgctttgatgaaataacctatgttgaacttcagaaggaagaagcccagaaacttttggagcaatataaggaagaaagcaaaaaggctcttccaccggaaaagaaacagaacacaggctcaaagaagagcaataaaaataagagtggcaagaaccagtttaacagaggtggtggccatagaggacgtggtggattcaatatgcgtggtggaaatttcagaggaggaggcaagttaattttgagtattatttggtccaaggttgaaacaaatgtacccttctagtttgggtctgtatattacttagctgaatttaacatgggaagcttttgatgtgcattatcttagctgtcttggtaagcatatctaggttatgttgaatggttaaacatttttctcctaaatgaaggaatggtccaaaagaa

SEQ ID NO: 33391 - DNA, 1659 bp, Bovine  19866880561894
tgtacagttggaggtgtgtgtactggcttgggtatgccccctcaaaacgttggagaagtgtatggagttgtgaaagcttatacaactagagttggtattggtgcctttcctacagaacaagacaatgtaagcctgtttctcagtaaatctgattcaaaagtttgaaaatgaaaaatcatgcttttttcttaaagaattattgtcttttatgcatttcacttaatttgcaagattaatcagcacaactctaaaagaaaattacatatacctttattgttagtggcaacagattggcaacaaaagggggaaattagtgggcacttaaaggtaactgtaattgcaggcaagtgaaggtgggttatgaaggggattaagatagtagaggagggagaatttaaaaataacaggtatctttcaccaagagcttattaggagtcaaggttgaggaaagtgatctccagacgttgtctaatcatagcccactgtttacttggtggtgacctcaggccagcccctgtgtaatcgctgtaaacttaaaaagctctttgtatcctcacagcaactctgggagctgggtgctgttaccatccccattctacatatggggaaactgaggcctggagaactgaagtaactaccccaggccacacagataaacaaggctgaaattcaaacctgacaaagcagtatttaagttgtaattccgtcagagtatgtgtgataatgaaatgatggctttaatcagaaaggtgtaaattaaggaatagatagatgatagatggaaaaattaggttgtagggagtggctgtagcttagaactttgagcattgttttcagccttaattttcttcgaaggacattgtggtacgcaactactagatgggaatttgccttatggttttcaggaaaaccatcaaactatagttcttagaacaaattggccaaacttatctattttagtaaatatttattagcagcttagtttttaatatgcaatatttatatatgttaatctaaatttttagaagttatctgtataatgtaaaaaaatgttggtcttaaaatagtgtttaaaaaataaagtcaaaagtggatgtatttcaaataatgcctccttcacataaaatctatctctgtgaaattataccttccaacttattttttctgaaagatgtttatctctaagaaactttatgccttgttatatcatctgtaacatgttatatcatctactagatttagactattggtattctaatcctaaagttttattttctgttctttaggaaattggagaattattacaaacaaggggtagagagttcggtgtaacgacaggaaggaaaagaagatgtggctggttggaccttgttttgctcaaatatgctcatatgattaatggatttactgcgtgagtattcttagaaacccttacttcataaatgacagttcttgactacaggttaaattttgtggagtgcaaacttgaggtagtgcactaatacaaaaatttcactctttagactccaaatgaaattgcagttcagaagtggaccagaatacaggggaggggtgcgtaaggagagagaccctagtttttctccctagatatccaaggttgggagagaaaatcttgatactcttacatgcatataagtt

SEQ ID NO: 33392 - DNA, 2580 bp, Bovine  19866880578474
aagacagaagaacagaccagtgtaaattcaaatttaatctggatttggttagtatcacaagttgatgttccatccatccatccaaccaacaaaagtttattcaaccaatatttcattcagaatactttttcgcacatgttctaagtgctagttgagtatacagagtcacatgaaacagtctagttagggagaaagaaaagtataagtcgtgattacactatggtataatagatatacaatgtacacatagatttaacatcatgtactgttgacaaaggtttatgcaaggctgttttttaaatatttatttatttatttggctgcactgagtcttagctgcagcaagtggggtttttgttgcatcatacggggtcttttgttgttcctgggtttagttactctgcagcatgtgggatcttagttccctgatcagggatcaaaccaatgtcctctacgttggaaggcagattttttacccactgaacccatcaaggagagcttccctagtagctcagactaaagcatctgcctgcaatgcaggagacccgggtttgatccctacattgggaagatcccctggagaaggagatggcagcccacttaagtattctttcctgaagaattccaagaacagagaaagcctggtaggcatacaatccatagggtcacaaagagtcagacacgactgaaagactaacacacacatgcaacaaaggctcttggttgaatgctataaaagacacaataatcatagttcctgcccattaggaactttaattagatagaaaccataagacataaaaaattctaatgcaaagtagaatgtagtataatttactctaattattctataatttacagcattttaaaaattagggacagaagctccctataaatacaaaaaagatgtagagtggctattattattttggaatagaacagaaaatgatcttgagggtcagagtatctcctgggttaaagataatagtcagcaaagagcccagcagtttatatagagaacttgacttttggatgcccaaacaaaatgagttcagcaaatataaatcataagggaatcagtgctctctaaactaggattggtcttcatgacttaaggaaaaattggaagaaatagagacatttcatttcacaaaggaaaataaagagagggtttctaataaaggctaaagtaaacacactacttcacagactgaagaaaagacagatgcattctttttaaaatgcatctatttttactggactataattgctttacaatgttgtattagtttctgctgcacaacagtgtgtatcaactatatgtatacatatatcccttccctcttgagcctgtgtcccaccggccttatcccactcctctaggtcgtcacagcactgagctgagcttcctgtgttttacagcagctttccactctgtttcacgcatggtagtgtatataagtcaatgctactctcttaatttgtcccatcctctgctttcccccatgtctacaagtctgttctctacatctgcatctctattcctgtcctacaaatagattaatcagtaccattttcctagattccatatatatgccttgatatactatatttgattttttctttctgacttacttcactctatatgacagactctacatccatccacgttactacaaaaggctcagtttcttttttttttatggccaagtaatattccactgggcttcccaggtggcgctagtagtagagaatctgcctgccagtccaggagatgcaagagatgtggattcaatccctgggttgagaagaccctctggagtagaaaatggcaaccttctccagtattctttcctggagaatcccatgaacaaaagagcctggtgggctacagtgcatgaggctgcaggaagtcggacacacctgagtgagtgaacacacaatatgccattgtatatatgtactatattttctttatccattcatcaagacagctacattcttattactaagtcccagaggagatttcagtgaggaacttgagtcccttcctgatgccaactcttcttgtccttcttgtagactttttaaaggaggaaggcatcatcagctgagtgagctgagtttgggcgtggaccttcttggtcattaggagactgacttcttaggtgactttctccttccatttttatttcagtgttatcaaacactctaactgatccttctgtaattgttttttatttcagcatgtgaagaagaggagaaccattaccaccaggttttcccttgtccttctgttgaaatcagcctttccaatgcctacattgtagttccctgaaggagactcactactctgggcttacttaccaatgaaactgagtcactgggtatcagccttcctctctccccacgtactgtcttaaaaagagtcatcaagaattctcaattttcacctgaccatcagttaagagactgaatgctctctctaccaacttcttcaaactctttcccttttgaaataaaccaatgaaaataaaggcaacaataaagtgggaaacataggaacactttggttataat

SEQ ID NO: 33393 - DNA, 1581 bp, Bovine  19866880608218
ctgtaggctttcactccaaggatgaagacctagctgtgtgcagccccttagagtttacaaggtgctttcacctttgttacctcctgtgttctcataccagtctcaagaattccttcctcaaacttgacagtcggggaaacagtgaacagagacgactgacctgcccccggcaggcaggtgagaagggcgggcagaggctggaatccagatcttccggtccccagctcagccccatcgtccttgcccaggactgtcaggtggtgagcagtttaaggctcagcggctctccacctttcccactgcaaagcccctttctgacaggccgcctgagttcaggttttgcagcaaatgcattcttttgattcagttctttaatagtgaggcagagtgttagtggtataattaatactccgaatagtctgcctgacaggaatctgctggcaattcaggcttaatttgtggactgctcgactgagggagttctctagattttcggaagaactgggtaattaagcagagttgctggagggcactccccttggtctgggagaaggaatgcagagcagtgtctgcagactcaaacgcagaccggcatctttgcccagctctggaaggctcttcagatggaaagaggagcgagccctcctcgcatcttgccgcctgggctgccgtccctatgtctcaaagccggttctctggggccttctgggccttctgtcctttctccttccagcagcggcagaaggaggagggcccaggtcctttctattccatgctgagctgggtcgtgcggggagggaaggaatagaaaaagaagactctggctccgctttccagaattaatggttagcgtctgctgaggctatttgcactgtaaatgaaagcaaacagcaaaaagcagggatgaagcaaaacagcccaaatgatcaagaaacattgtggtgacaggtgtaaaactcactttctgtcagcagcagaggtccacgctgtgtgggcccactggccagatgaattgctgaagagaaaccccacgcagtcactttttgtaagggacacacaggcgaaggaggcgtttccaaaggtgcacgcggtctgctgccctcagaagtagcacgcgcctgcctcgtaagtcactggagactttgtgaaaattatcaaaaggggtgggtagaaattcagcggttttattttgtgaagtaaggaatcattctgtgtaagctaaccatccttctgtctcatcaagagatttcgtggaagactcgttctatggaaggttttgtctacagttttccatctgttgtgataatcgttattaatcaagctgctgtcataccatcttgggctgtgatttttgtcaactttctggtgtgaggtagggtcgctcccggggaagaaagatgtacctgaaagacgcagagggagcacgctcccgcatcatgcgagaaatctctgggccattacatgccattttctaaaagaaacgtaagacagagactgcaaacctgtctgtttcctaagactcacccagcagatttgcccaagatcctatttaaccgggaagtcagcttcctatcccacagg

SEQ ID NO: 33394 - DNA, 2109 bp, Bovine  19866880632169
tgtctttgtgaccagaaaggtcacagataagtcctagaaaaaggtgcttctaaaacccaaaaaggatttcatggagtttaagaggctcccctgttgtggagaaacagatttagttgtgaagtcatcctaataaattcactggttgagcaaactcatagctgtgccaagttcctcttctgcagcctttgttcggccctttgaccctccccactactagactcttgccccttaagtgggttgatgccaacctactgaaaataccattcactgggtcagaaaagatggtctcacctgttcacaacttggttggaatctttactgtagccggaggtgtttcagcagctgttcagaccattaatgggaagtgggttcatacttctgtccctgcctttttttaacctgagaagaaacttagtgcttttcaacactatcacaaagcagaatgaagatggatgaaggcataaaactcgtaaaagcagcgtgaagtcacctcccattatcctggggtcacagaagggacccctggttccactgccacccgcaccagccaatcagctctagcgatctttgtaaaatatgaatgagataatgttcttcctcttcttggcttaataaccccacaatgacgttcctatacttaggatgaaatccaagacgcttaacctggttgagaaagactgagggatctggcctttgcacttgcttttctctctcttttcccgtcagtttattcacaaccctctgtctcagtatcaacgtcttttcctcagagatgccatctctttctcctttgaaagtgaaagttgctcagttgtgtctgactcttcacgaccccatggaccatacagtccatggaattctccaggccagaatattggagtgggtagccgttccttcctccaggggaccttcccaaccccagggatcgaacccaggtttcccacattgcaggcagattcttaaccagctgagccaccaagaaagcccagaagttaaagtgggttatatggcaatcacacatttcaaaattttaagaaactgtcaaactgattttttttttttttttagcttttaaaaatctggctgtgctgagcagcttgcaggatcttagttcccctaccagggattgaacttttacccttggcactgaaaacatggagttcctaaacactggaccaccaaggaatttccctgtaaaacttgtactgtttgacaaatataatatatttatataatatacttgtatatatttgacttatatattcatatcattttgtcttcccatcagcaatgaatgagtttctcttattttcttgacagaatttgatattcaaagtgtttttgatactaacgatactcataagtgtgtagtagtatcttactatagctttaatttgcctattcctaatatttaatgatgtagagcaattttacatacttattttccatttatatatcttcttggctgaaaaaactgttcagatcttttacctacttttaaaagtttaattgttttcttagttttgagttataagagctctgtatataggtccattatcagaaatgtgatttatattaaatgtgtgatatgtcttacaattttcttaagagagaaaacatctctttttatttctgtaaatttcagtgtacaatttttttttcttttataaatctcatttctgatgctatatgcatcataaccaaatctaagcttgcaaagattttctgctatacttattttaaattttttttatatttagaaatatgaactgttttaagttaattttgcataagttaaagcaggttccatctgctgggtggggaagatcccatggaagaggaaatggcaacccactctaataatcttgcctggaaaattccagggacagaggagcctggtgggttacagtccatgggggtcacaaagaattggatgagactgagcacacacactttaagacatgtgtttcaagactttttaaaaatttattttatttcttgacttgcaatggctaagacttccaataggatgtctaatatgagtcatgatatttttactctgttcctgtattaaggagaagttagctgtgggtatcttgttttttgtta

SEQ ID NO: 33395 - DNA, 1035 bp, Bovine  19866880635412
acaaaaggtagcttcagcaagtgatgaggcttggggatgctgcctagcgacacagcattgtgggaattttctgactgcccaatcctgcctgcttctctgtttaggagaaaatctgtttaaaaagaatcagtgagattaagctttagggtcagggttttataaacctacttttagtgtaaaatgagcaaactttgtctaggtataaggaaaagaatttttaatcttttttcccagaccgaaatgaatttagatatattcaagcttcacgttttattttcctttattaattagcaaggacacctgcattaacacgggttcattaatttatgatctagtgagtcttttctacctctaacttccttgatgaaagagaatgaaacgaaaaggaactgtttgatcaagacttctcccacagatttaaaagataacccttgaataacatcaaagatattgattctgctgttgtcactttagtttgttgtgagataaacatattaacaaaaaatggaggcattaaaattcggattttgtattgctactggctaaatcattaacatgagagcatgttgtcattccttttaaattctaaataaaaccctatgtcagtaatgctaacccaaggtgtatcatttcttgaaactaaaatcacagcttcctctaaggggctgtcagaaaatataattgaaatgataaatagtttcattgcatttactctttgggggcaatctcatccttccacatccatttccttctctttctgggtttgtcttggtggcttgttctggtactacattctggagccagtcagtcgttaattccaaatagaaacaaacacacaaaaaagcatgtatcacaagtatattattgacagtttcttattgctgctggcgtaagttaccacaaactcagggctttaaaacaactatctcctcactgttctggagaattgaagtttcacccaggtcttcttgttgttgagttgctaagtcgtatccaactcttcagtgaccccattaactatagcttgccaggctc

SEQ ID NO: 33396 - DNA, 947 bp, Bovine  19866880667185
atggagagcatctgaattgggttcaggagaaaaagacccagagaaaagttgaggaatttagcaacctagggacgatggagtagaattgaaaagtgagcaagacttgagaatggaagccctgtgggtagcagaagagaagctcaaatcacctctatctgatataaatatattctctctaacagatacaaaatatttattctttatattcactgagagcccaatagagaactaaacagatacctttgggctatcctagggggttgggaatccagcatttttccatgtgtgcatttttcatccattaaacccttgaggagtgggggacagtgtgggagaataaaggagtctgaatggggtcagacaaaaagaaaaacatcaagagatgaatggagctgaaacataatggccggatgggacaagtgcaaagtgttttgtgcctggctcagcagtgaaccggtgatcagtttccttaaaaaaaaaaaaaaaaaaatgtgaggatttcccccctttgttttagaattatctcaattcagtttcctttattttaccaaaaatgcagctttaatctaagcctgaagaataagtctaggtattctatgtagtacaccaaaattccagataagccttttgagagatatttctttacctgtaacaggggctgaataggtattggtttattaacaatttaatagtttgttaatgaactgaagtcagtagcacctgtgtgaaccccagttgctggcatgtgcgtattcaggatgaatcctgcatttgttttcttccctaaatgcagtctgagtaaaagaaatctatcagatctaatatctaactgattttgtttttctttttttcactgatgttgagagaagagtcttttcagctagtttctctctgcaccacctgatcacaaaacaatgcaatgatgggaaagagcatatttgttcttg

SEQ ID NO: 33397 - DNA, 1028 bp, Bovine  19866880669152
cacccatattaaaatgtaccaacatcccacattagaaagcacttctatgctataaaaataaattttcaaattataattttgcttttgaaattctatggctataagtaatttaaatcattaaattactttagtgatggtttctgggcagttcttgagtctacataggaattcttgtaaagagaaaatctgtacattgttttcaagtgcagtgtaatttttattaatactaaatttggtgattgaagaggtggtggtgatcaggtcatgtgaaaattaaggacttattaatttcagttttatagttttcctttgagacaatgcatttttcagttcgcaaatatttgcttggtctctaaatacctatttcagtggttaataactggaatgagctgtcccaagtcctgaagagtaaaaccatcgcatgaggggatcccatccgttaaactctgcagcccagtgtcctaagttcccccagagctctggtttctctgcaggtctctgacaacagagtacacaaaaccatcttaggtgcccaaagaaactgccctgtgagggaaggaataccacggcaggaggcagaccgctggagcagtctatcacaaggatggctccaaagactccaagaacaagatggtcccttttgtgatcttgattttttaatatccttttcaatagacctacaggtcactcaggagtaaagaatccacctgcaatgcaggagactcaggttcaatccctgggtcaggaagatcccctgcagaaggaaatggcaacccacttcaatattcttgccaggagaatttcatggacagaggagcctggtgggctacagtccatgaggttgcaaggagttgaacatgactgagcgactaaacaacaaaccttgagataacggcttcttctggcagaggcttcatcctttgtctttctaggcccaaggcatgcttctgaaattatattctgtctattggttctgcagtgagtttccttaggcttaaggctctaggcacaacatctccaacatttct

SEQ ID NO: 33398 - DNA, 1173 bp, Bovine  19866880697050
tggagaggtcaatgttaagggtagattgctgacctgtggttgaagtgacaggagcttgtgagcttgttcagagaaagtatctagagtaagaagagaaacatgagaagagaaatctgggaaaactggcattaaaagatcagcagaacatctattaagagactcagtagagagtacttacagaggggtgatggaccagaaaggagaaaacagacagggatgatggtgtaatgagaagttgaaaacagtcaacagtaatgaatgcttctaaaattttaagcaagaagaggactgaaggtagcctattcattgcctgctggttcatgaaagtttactgtcagttaactgataggattagaaactgggcgtcactgatttagatttgaatatgaagtataggaggtacaccaagaaacatattattccctttttaaaaagttgggagttgaaaatgatgtagttaaagcattcagtattgtattcaatttatttgaatccaaggcattgggtgggcttcccaagtggcttagtgatatagaacccgcctgccaatgcagaagacatgagatatgtgggttcagtctctgggttgggaagatgccctggaggaaggtacggcaacccactccagtattcttgcctagagagccccatggacagaggagcctgggggctacagtccatagggtcacaaagagtcagacatgactgaagcaacttagcacacacgcaaggcattggttatttaaatgctgagagcagaaactgacttgttcatctttaaatgcctctcatggaaccaacaaagtgttaaatgcatgtttgtttatttaggacaatggtaatttttctgtaattagttcttctaaaaatatttgtagttgcttggaaatagtttctttcatcaaggatttcagacattgttcattgggggttttgggtgttgttctattagtttgcattctctgggaagaagagctagctaaatagacaaagataaactttcacaaatcacatttgagttatcaaaagttctgaacttataacaggccaaattaagatttatttttgtaattttggcagtcaaatgtaagtcaacaagaaaataagatttaccttgttgttcagttcagttcagtcgctcagtcatgtcgactctttgcaaccccataaccg

SEQ ID NO: 33399 - DNA, 1507 bp, Bovine  19866880703666
ttactcccttgatacggataccccagcagcctggagtgacaagagtacaccaagaattctgtggtatgccacagtttatgaccttttgatctctcttcagggaataaaccccagaaatgacaagagtaaacaaaggtgtacttcctatcccccgcaaccctgaccccaagatcctattcatacttgaactctctcctatgctaattagacactgctttcttccagattggataggcatattatggtatcaagaatatgtatctactgtacacaagtacactttaattggcttacttggaatcaaaagtcaatgaaatgttagtaacagctgagaacagtcttatagtgagagatcatgtttagcttgaaggtcaacaaaggcagtagtttgaagatgataagtatcaaatttttaaattcagaatctcacatccagggagttaattaaacagacttccatagcatcttaggatgtgcatgcttagtaacactgtatattattagctcttgacagtttttaaaaggttgaattataggttctttcacagaattcacctaatcatctttcagttccaaggaaatagtctggaattgctataaaccaaacaacaacaaaaatcccattgacccaaagagtgatttcatttttctaataactgcaaaacacaaaatattccctttttaaaaaaagggttaggataagatgacaaactttcatcattcctgaatatacaagcaaaaagccttattctaaaatactttaatgctaacattaattatgcatatcttaagcaatttaggactcagctatgctccccgtaaattgtatttcacttaccaaaatcaatatctagtagtgctgcatttgcaccttctaccaagattttctttggtggtccatggagagcttcatacaggaaataaactccatctctcaccattggcttaatcctttccatataaccctatatacaaagacaaaaaccaagctcgatgtatactaataaatttacaatgtaaactatctgagtaaaaatcacccaacttttgacaatgaaaactgacaactgtaaaggagaaggggattggtgacaatgctcaccctattgcaacatttggattggctttggtctctcatgctgattccccagaaccagaaaagagacactattttaagaaaagtagagatacaatgaaattcaaaggttctacttcaacctcactgcaaataatgataacaatcttctgaacagcccagtactcatacttcatataacagcttttaggaaaacaaaaagaactgaatattgtgcttttatattttgtaggtattaaaaaagcagcacttaagagtccatataaccataagtgcatcaaagtctttctcaaaatgttgtgaggaccacccagtgtcactgccaagcaagcatcaataattgattactaatattcttttcccactgtattccattacagtaaaataccttagcagtattactagtaatat

SEQ ID NO: 33400 - DNA, 1843 bp, Bovine  19866880708081
tattatgagtatgggacttgatgcccacactcccccaaagtgaaaagactattagctaccttaaagcatttctaatgaaaaactcaaaagatggtccaattagttcttgaactcttgttgtctggtcattaagtcatgtccgattctttgcaatcccatggactgtagcctgccaggcccctttcctagtcaaaaacctttaaccaggttattcctcaaattacagattgccttcctaatttcagacagctgccttcaaaaacatgtgaaaaacagactatcaacaaaaaacatatcaagaacaggaaaaaactggcaagtccctggcagtctagtggttaggactttttgctttcactactgagggcacaggttcaatccctggtcagggaactgatatcccacaagctgcatggcatgcctcccaaaaacagaaaacaaaaaaataaaaccccaaactctaaatatatatatatgtattttggtcagtcacctctcatctatgaatagcagcacattactgaagaaattaattaagtaaattcgatctttctccttggtgtgatttaaaaaattttttttctgaatggactccaaagaaaaagagggtaaaaattccacagagagtccgtcagagtgagaaatgctctccaaatgttcctgtttctgttagggcttccttgctctattattagagaacacgcctggaaggcttattactctttaaaaactgggcaggctgcctgcaggagacgagcgtttaattcaaggtcagcaaaccttatcgagtccttctgcctcaaagtcctgccaaggctatgcagacaatatggaggatgcctattttaagtggagatgcatgatataactgtaaacaaacaaaacacacattagcggtctctcggtatctgcaagggactggttccagaaccgccccccgaccccccagactccccagtccgagatgctctagacccttatttgaaatggcatggtaaaggcatctgtggatacggagagctgactgtatatgaggacttagtcttttactgaatgattttagttgtgaaactccccctaaaatgactagctgtggcgacttactcatgttgagtaatattatcgtctcacagtttaagatttttaatagcagtgtttctcgatgctcctctaacttgatttccaccctttgtctttaaaaaattatttacgtaccactgctgaaacatttcacacggtatctgtggaataaacatcttctcacaaagctcaacagagcttctcaaattcactatgtggaaattcatgcttttgtagaaccataaaacattgatattttccaacagaagatgtattataaatatgcaacatgaaatcacagccaagaacatgtatccatgaaaaacaaacaaacaaaccaagctgctgaattagacatgactggatgttagcaagatttttgttaatttctgttggatatgtcttcattgattttgttgtctaagtagcagcagatgccaaaagttttaaacttacatacttggggaaagaggacaattttatttaaaggcttagctttttatttgaattgggaaaagaccacttgtatttctagagttgggtccaagcctaagagtataaccagtattcagagactagttgaatacgctgctctgagacaactgcagaagctgggatgaagaggtttacacatgacgacactgggccagccctgcagagaaagtttaccacgcagggcatgtgagggcggagcgacacgcaacactgggggtgagccaccaaaggaagctttatgttcaagtttacccaacgctgacaacca

SEQ ID NO: 33401 - DNA, 1408 bp, Bovine  19866880715803
tttaatatgccttttaaggaaatcagacccagactctaagtgattatattaaatgttttaagttccagactagggagatagcatttatcatagttgttgctttcaagcaggaagcataacattttattaagttgataaaacaaatcactgactaaaatgaagtttaatgaaagttctctatcagaagaacttaccattttaacatatgactgtaatatagtacagtcagttcagttgtgtaaataatgctttagaaataataagtggaaatatttaggccaattttttgcattgaagcaagattgagttcaaaagtagctgcagttatttatgtattcattgctttcccatatatttcaagatgatgatttttctgtgaattgtttcctctttttatgttaatactctggaatattttgataagccttctaaccctcagtgacactggcaggcatcagagggggttaagcatgttctagtagtccttccttggccctcttctcttcgtttacttgccatctctgtggacttaagatgttcaaggctgtaaggtcctaacaccaaagtgagattagttctccagtcctctgctcatgtccttcttgaatatataagaaccccataaaaccactgccttacagagaccttttactcagatctgtacttctcaagaagataaatcattgcttataggcatcttaaagcagagtcgaattaactctgccattgtttgccatccagtttagtgagtcactgctcttggtaatgtggcataactcccaaatcttgaaggttctgagaattaacagatagccagaaccagtctgctatttacatgtgcatccagccctttatcagtctgtagaacagagtatgagggaagaatcctaccaatatgtgtttgctaagactaacgcttgatgtttgctgtaggtcaagcactctgctaagtactttatacatactaatgtatttcattctcatagtagtcctctgtggaagactctgttcattatccccattttgtaaataaggacagagaggataggtatctttccccaggtcacacaagtagtagatagtgaagtgagaatctgaaccaagggtgtgaattggaatcagtgtctcttttttgagtcattgggaacctttacaagttatcagatgtcagggtcagggagggatagattgggagtttgggattaacatatacactctatttaaaatagatagccaacacagacctactgtgtaccatagggaactcaatattgtgtaaaataacctaagtgggaaaataatttgaaaaagaataaatacttacatgggtataactgaatcacttttgcagtacacctgtaactaacccatcattgttaatcaactatactccaatataaaataaaaa

SEQ ID NO: 33402 - DNA, 1143 bp, Bovine  19866880730285
atcctctgtcgtccccttctcctcttgccctcaatctctcccagcatcaggatcttttcaaatgagtcagctcttcgcatcaggtggccaaagtattggagtttcagcttcaacatcagtccctccaatgaacacccaagactgatctcctttaggatggactggttggatctccttgcagtccaggggactctcaagagtcttctccaacgccacagttcagaagaatcaattcttcggcactcagtcttctttacagtccaactctcacatccatacatgaccactggaaaaaccatatccttgatagacggacctttgttggcaaagtaatgtctctgctttttattatgctgtctagattggtcataactttccttccaaggagcaagcatcttttaatttcatggctgcaatcaccatctgcagtgattttggagcccagaaaaataaagtcagccactgtgtccactgtttccccatctatttgccatgaagtgatgggaccaggtgccatgatcttagttttctgaatgttatatttagaatattttgttttcaagaatatttgatccatagggaagaaatatatgtcttaaatttgttacacatgaaagaaaatgggagggtggccaatatttctttccatttggcattattctagtctctctcccccagaggcaggcacatcacagatccacattctggtttatgttaaccattttcccccaatagtcattatttatggacttgaccaagaagtgcatttcttaaccatgccccttttctacaaatgcttgtaatgtgttttcagatgtgaattcataagtgttcttatttgcatgatatgtaattagtattttataaaattagagtggttgcataactctaacagtatggtctttgttcattaattatatatgtgctacgcttagtgcctcagtcatgtccaactctttgcaaccacagggactgtagcccaccaggctcccctgcccatggaattttccagagttttccaggcaagaatactggagtgggttgccattttctactctgggtgatcttcctgacccagggatcaaacccacatctcttgtgtgtcccacattagcagcagattctttaccaccatgccacaca

SEQ ID NO: 33403 - DNA, 1194 bp, Bovine  19866880732855
atgtgtatagactgagtacacatatttggatgtaatcatgagctgacatctccgttgtcaagaacatcatcattaatactttcaagcattagtgcatagatggaactttcatcattgcaaagtgtgagttaaataatccaggctgaaaaaagaggaggtagcattgtgttatttggacctcacatttctggtaaagcatcagttttcaaatgacaacatctaggctcatccttctcacttgaaaatgatttgagaggcacgcacgtgggttaacattcagagatggagtgtttgtgctccttaaaaaaggctttcctgaatgggaaaagagaaacacattactttttgatttgtggtggtacagaataatgattttgtgagtttgaagatacttctgttttcaaatttaaagctgaaagagcattcttattcattgaatggtttctgttggtactggtagaattggcctttgagagaggaaggagaaactagcttctggtcaggggacaagctcctgagcttgcttagttctaccaggaaggagtaaatgcagtggttctggccctatggcccatgtgtacccttggttagtactctgtagagcagaacccacaaactgggagtgtatgacatacacattgattcgcacgtgtaactcggtcaattacaacaccactaaaggcagcctgatagaacattatgccatagattactctaatcggcacaacatattggtttttgagcattctcagtttgtttatcagaacaaagttgattcttttttaatgactttgccaatttatcgttgtgttccatggcttttgcaatattttcttctacatggttttaccttgtgtgggaaaggccctaccacaattaatgttgaaatggttatcacaaactggtttaataggatcaagacggcatggaccgacttgaatgttgttagataaaagagtcgtggcagcaaaagatggatagatagatgtaaaaattgttgtaagggggatttttgcctggattaaatctaaatacatatcaaaaaattgtaaaatagaatctaccagctaaaactaatgagcacaaaactgcattgatttggcccagggtggacaaatagaacatctggcatatttggcaccaatgacacagctggcattgttggaaacgtttctgcagaaggtacagatgcag

SEQ ID NO: 33404 - DNA, 1404 bp, Bovine  19866880754807
ctgatcttcagaatggactggttggatctccttgcagtccaagggactctcaagagtcttctccaacaccacagttcaaaagcatcaattcttcggtgctcagctttcttcacagtccaactctcacgtccatacatgaccactggaaaaaccatagccttgactagatggacctttgttggcaaagtaatgtctctgcttttcaatctgctatctaatcttaatcacctccgaaagtccccacctccaaatgtggggattggggcttcaacaaatgaacttgggagagacacaaacattcagtctatagcaattttttttccttaaaggaattatagcaatgaagctcaagcatctgccttcctgtatatgccaagtgaacggtgaagtaggaaaaaaaaaaatcccctcttactgtggttcctctttcactggtcttcttatatcaccttcttcaccgtttcaatcctcattatgctccctgggctatttcgagttgcatgatacgcttcttttaaaattagcttagttatcaatccctggagagcttggtagattcaccaatggaagaaacacgtgtaagtgtactttagcgacacctcgtggtaagatatgcaataacatcgtgtgccgcctctaatggcggattcctgggtttagtcctcatgaaaattaaataaaaaggaaattttaagaaacagtccatagagttagcaacaaaaaagaagtgtacttgtagacatgcttgcgtgtgtgttattcctccttgtgcattaaagatagaaatgatctatcattctatgaaggtgaatctcaagcttgatcacaagcttgatcaagaatgtgtcttttattctgctgcttctattctgacctcatacaaaatactgaaccatttgggggctcactttctcatctataaaagaggaaattttaataacctctacagagttcacaaaactcttaagtgaactaagtggtaagtgaaaagtgttttgtgaattgtatgaatgttatgctatacaaatgttagctttcagccacaaaattttcccttcaaagaattttaatgttacttaaagacaagacagaattaatctggaccttgtaccttacaacaagtccctttcacgcaggggttaactgaaatggtaataagtccaatcatgaagatggaaacagccatttctagggcagtggttctcaatcaggggtgatcaccctccaggggacatttggcaatgtctgggactttcggttgtccctagggggcttggggggaggcttactggcatccagcaagtagaaaccagggatgatgctgaatgtcctgcaaggtgcaggacagcccccacaacaaagaatcaatggcctaaatgtcagcagagccaaagctagaaaccc

SEQ ID NO: 33405 - DNA, 1064 bp, Bovine  19866880758835
tgaaactaaatgttggagttgaataaaagtgaatctggatttcctgaatagcaccgtggcaagagtgtgctgtcagtatgtaagccagtccaccaacttaagacagaagtgttgctattccataaatacagtagaactccatatgctgagtttttcaatttcttctgttagaaagtttggggggaaaaaagggagactttgaagtattttgtttatactaacagaagagaaaagttctcctaagaaaaagctggtggcaggagtgtagaggagtagcatatggcattaaaaggagcacagctggaggtagcatttccatctgaacatgatgtcagagcagctgacagcctgccatccctcagccttttattctaacacacagacagggagttagtgtgtgcggatctgtggtggagaaggtatctcattcctctctaacatcatctccactttgcatctgtctctcttagtctgctttttttccaccgatgtaacagacctggagccagcgagactcagaggaaaagacttaatcaggtttatgtgtcctaaaggtaggagtagcaagagattagattgagcatatttctgttttggtgttttgtttatttaatttaaaaaaaaatcacattacttttctaatccagtttaggggtaaaatgtggaattgaggataaaatgaacatcttattggcattgaaagtcttgggcttgtttagttttaatttttatccctttttgtttgagcggtaaagaactttacagaatatttcaagttttgagatgttaagaaaggctttgaaatacttctttttgagatcacttcggattaaaatgcttttttgtttgttgttcactgctatttagattccttttgcttttggagtggggggggggagaaaacagtaaactgtttggaatccagcattcaaacttatatgagaagattattctagttaagaagctagattgttgtgtaattaattccactgtgaaactttattctccaaaacattcagcagcactacttactgaaacatacagcctgtagtgcttttgaaccg

SEQ ID NO: 33406 - DNA, 2539 bp, Bovine  19866880761366
ggatgaggcatttatgtggaggaactaagagaacacaaggaaggtttcatgtcctggaacccttccacatcctctaaggagcaggtgacagagcactgagacctcccatccatcagttcaacagcaacacgtttctaatatctaccagctgtgcagcccttcctccccttttacagatgtggacaccagagcagaaggaatggcaagaggctgacctagggtcacaggcagcccagcagggattaaaacctgcaaactttgaatttctagcctatgacttcacctgtcaatctaccacacatgctaacacgcacggtcggcttcgtatctcgcttgatggagtgtgactgtactcaatctgcgctgagtcacccttcagagaggcaacagtggagagagcttgggctctgcctttacctccaaagcgcctggggaaagcctcgcagggggcagatgtaaccaaatgtaaattcaggagtcaccccgccctcaagacccagcaggctgtgtgggttttctgtgcttcgtttcgttatccaagtatctacagacacgctgatttcctccggagagccagagactcaggtggagagtctagctgaacacattcatctcagaacccgctctgcttctccaggctgtgctgaacaaatgggaaccacgcccactccactgaggccatgttctgacatttcaaaacccaactcctcttcagtatgactaaagaaagatacatgcatgacagtgactcgaacgccttatctttggaaagcccacacgtctaaggaaatggcaaataggtctcccttctccttaggctgtgaatgctgtgaatagggaacatcacgatttctgagctccgtctgcttttccacacggcaagtggggatggccacgggttttcgttcacatcttgggctgaattaataacgacctctgtagcgtacatgcaagccacaactttcacatttggaggtgcttctcccactgggcccctcacccagctggaaagggaataatgcacaacaagccccagactaaaggtgacactttctgtccctggcactacttggtcaccatcttacttcctgccactccagcgaggctctacaatactggggactcagtgtgtgatctgtggatggccacagattccaggttttgttttgctcagtgtttgtaaggacttccctggtggctcagatggtaaagtgtctgcctacaatgcaggagacccgggttcaatccctgggtcaggaagatcgcctggagaaggaaatggcaacccactccagtgttcttgcctggaaaacaccatggatggaggagcctggtaggctacagtccatgggatgacaaagagtcggacacgactgagcaacttcacagtcacagtcacagtgtttgtaataatgtaggaatatgatttatgggattagtcatttgcttatatctacttaattaaaagacatggcccctcattattgtcttatatgaagtaagagtactgtatcaataaattctgatgatatcatttgctttgaaaggtcagtgattattggtgaagcaggtgtcccatggattctttgctcatgggtcataaaattttcagaagcacagaaatactaagcacaatattaacgtgatcttaagtaaacatgatgattatgataaaaaccagaatgttgtatataacttccagttactataaatcagagcaccataaaaatcataaatctggcaataaacttcagaggacacgttcagactaaagttaagaattagaagtccctggtgatatcaaccatgtttatacgatttgtatttttttaagtgttactaaaaaccagaatataataacctggtaataaatttgagaagctacttttcatgtaagtcttggagtcagaattcctcagtgataaaaaaaatttttttcctacaatttgttttttttaaatgtaatgcccaaagtagttatgctgaatatgacaaatgtttacatgaaccattggggttaaattactcataggccctacattatactatgatttaaaatatttccaactagtattacttttaatcattttgataatataattcacaaaggaattactttttttctgattgttttgagagctgcacataatgttctaagagttgcctaggctctcaggtctaaaggctgccctccctagtctccttcttcatatttattttaactttaaaactgacgcctttgcctttattcaggaggttctatatacatttttgtgtataagacaaattaagataaaggagactactgaactgctgattttgaggtatatgcttagcctaaaattatttcatatacaatcctctactctttgagttaaaactgaatgcacacataccataccatgattattcccatttttacaaatgagaaagctaaagtgtaagattaaatgagttatttgagatctcccagtttatttagggtaaaatgggctaagtgcagatctgtctgatgcgaagtcaaggcttttaactactt

SEQ ID NO: 33407 - DNA, 1549 bp, Bovine  19866880762266
aaacaggctgatgaatgggtcccaaagccaaagagactgctctttgtaatagtgaataagtaagtatctgattacagacagactttagcttcacttatctctcagcaagcccaggtaagaatcttgcaatctgggctgctctcccaagggtactacaataacctcttctatacctgaaagtaggagcccaaacaaagctttccctctagaattttagtgtcttcaagtggacaagttctcatattcaatggtccttagttaaaatgaacatcacttaaaggaatgtttttatttgtgtgtagtaactgatgagagtaatttgcttcaaaatggaagttttgattgataggacaatatatgtgcttaaatcattctagaagtgtcataattatgctttaaaaatgtcttacatgggagattgtcttatatatgagaacacataacattagtcatgtacatacatttctttccaatgtctcaagtataagtaatagcatctaaaagtgatttatgcaataattcatgcatgcgtgctaagtcgcttcagtcatgtctgactctgtgtgaccctatggactgtaccctgccaggctcctctatccatgggagtctccagacaagaatactggagtgggttgctaagcccttctgcaggggatcttcccaacccagggatcaaacccaaatctcttatgtctcctgcattggcaggtgccactagtactacctgggaaacccttatgcaataatatcaatttcttttttttaattaatttatttattttaattggaggctaatgactttacaatattgtagtgggttttgtcatacgttgacatgaatcagccatgggtgtacatgtgttcctcatcctgaacctcctcccacctccctccccatcccagccctcagggtcattccagtgcaccagccctgagcaccctgtctcatgcactgaacctcgactggcgatctatttcacatatatatcagtttcttaaacaggatattctgattatccactgctacataacaaaccactcgttagtgacataaagcgtcaagaacaatcatcattttcattataagtattagatgatggtgatgatgattgtcactcatgggtttggtgaggctcagggagacagcgctcactcaagttctctcctgtgactgtgatcagacaacagtgactggagcatctcaaagtcttcctcactcacaggtctggtagttgatgttggctgtcagctgatgtgttaagcgtacctctttattctgatgctttgacatctggggcctcgctgaccctagaaggactgcccctcccagagttagctggttcctagagagtaaatgactttcatatgcaagccaaccacctcctttatgggttctcacaccctgggcccctagctacatgccttagtcacccaggggcaagtattggacaactagagacaaatcctacatctcagaacccatcaaagtccccacactagccagtttgccccactgagcctgtttgccctatctcatctgctcctt

SEQ ID NO: 33408 - DNA, 1526 bp, Bovine  19866880835316
ctggggaaaagaagaaagataggcacagcctgggtctcatagagtgggagagacattttgcaagcaatcacatgaatgtgtacaaatacacatgcatcatatttgtgattcatatgattcaaggaagacacgaagagagtgtgaaagtgtgtgaaagggaccctcactgagtgtgaaaaaaataagaaagcccttgttgaagaagtggcctttaagctaaaggagatgaccttcaggagtgagagtacaagcctgactcttgaatgtttgtaacaaaatgacagctcccatcctcctacccaccccaatacagctgtcattcagaaatttttgttctcacttcaaacaacaacatagaacatctacctgcagatacttgtaaaattcagcccaaagtcaactgtttttgaagcttgcttaaaagattggcaattgaataccttggattcctcttgtttaccatcaccatcttgtgaattttacttcttgaatctatgtgtttacctccctcatttgtgtataacttctcatagcctggtatcgtctctcaccaggagttttgcaatcacctccctgcctttagtccttgtcaaataaattgtccccactgctgccagagtgttctctctaaaacatgactttaccaaggatatttcattctgactgtgctagctcctgtttatcagactgagtcagtagacctcagccataattcaaccagtgcctttgttgtgtacctttgctgccattgcatggttgtggctgcacacacagagtccagcaggcaaagacttagaagattcaagatccgttaagatgatttccacatccctaaagagggtcaaagaaacacatacaatttaggtgtggaggaaatcagttatatcttggtggaaattgcagattttccaaagtagacagaaaactaagtagtggtagaatttgagtcttgggacatggacaggagaccaatccctttatcaagttttgaggtaccttttatagtgacaacaaagagatctcattgagttgcatcaggactggagcaagaatcaagcccatgatctaccaaagggcatctctaggtctttaagatacctgaatatatttgcttgggttgggaatgatacagctgttactttagttagttgttctgctttgtttttttaatcctgagaagatatagaattaaatatttaaatgttgaaataaataaaatataataaggttttagctaaatttggaaataattatgtatatttgctgtattgaatatttggaatgcttaagagcaataggcacatttcaatatgtaacagaatgtcattctaatttcacacttcattttaaaacatgaaattttgctaattaatttgaattatgatttttaagttgaaaagtataagagaatattaccaaggttctaaacaatatggttaatagtttataagaacttgagatttatcatgggatttatcatatgtataagctttctttttactagatttcaaagagcaatgtaggta

SEQ ID NO: 33409 - DNA, 1456 bp, Bovine  19866880888142
ctctgggggacttggccgtgagaaagtgaaaggagcccgcgggcggcggcgacagctgcgctgggaggggcttgtttccaggctaggaggcctcgcgcgctctgggcgagcggagcgagcttttcggtgtgcgccttgacaaccgtaaatacacttttaagcgaagtggggctgggctgcttgaagttacggaggtatccgcggaggcagggcgcccgggacacacatgacctaagtccggcattaggtggcttcctctactctggctgctgtgggtggcgacgcccaggccctcgtgtcccagagcgcagagggtaggactaagggacgttctcgctccgtctggcgctgccccgtcagcaggtgcaggtgcgcgccgggctcagcggacgccactggctccgacgggcagtttctgagcgtcattctcaaggcatcttgtcacaggcacggcagagcgcctgtatttctcgcagaaccctcatgtcacgtgtattgcactgttacaagtagccattcccaagtgaccaaattctagagaactacagtgaaagtaatacttgtagaagccataccctgatttcttaatttgtacgtcttcaagccacaaaatcaaagtacggagggaagatgtaagacttgcatcgtttctgctttccttcaaatacattttaattcgattcccattcttttgcaattaaactctgttctttacggccaccaagaaaagtagaaacttcaagaagttgaaaatcttcttgaggaggcaagacttacaagtaaaaagttgaataacagggcagaaaatggtttacgaatgtagaaaactgcggagtggaggaagttagtacccttgtaattgtcaaggaaatgtgtttattctttgctaactgaactgagactggcaagcctgttgctaaccaacttggcaggagacctttcaactgggcaaaatgtgctctcactttgttccaggtcagatgggtaaaccaagctgaaagtattgtttaggcagtcagacatactgaattactaatgaagtaaaaaacaggagcactcgggattcctgaagctgaaatactattggaatatcctattagaaacagtggtgatattctctactctttcctcaacctttcatgtgcccatgagattgataactgaggtcaaggccattctatgacaaccagagttttttattccatgaaatgtattctatttgtgcttttgctgacttctggatcttttagtctgttgacaaaaggccaaattttagttgacttgttaaaagatagggagtttataaatattcttgataaaggaaatacactctttaaaaaaaaacaaacaggtggaaagaagtacatgctttgccaacaaactcggggaaaaattggaaagaaatatttgcattctcagagttgtttttcacctactaaaagtttaaggaaagtaa

SEQ ID NO: 33410 - DNA, 1015 bp, Bovine  19866881107353
tgggcttgtcagagggaacttttgttccatgtttgggctgggaggcttccagatagaaatcaggctggcatgtgaacttggggaggcagggagagaactgaacacagcagccactgacccgaaaggtctggccctcagctgcagtttgcatctgggtgttctttgactgctgtccatgtggcaccgtgctgccagctggggtcactggcctgcatgggtaccaggggggaggaatgtagggcaggcagtccaggaccaggcgctatccacaaaggggatgaacagactttggattctgagcttttggaaggtggtcctcactttggggctttgggaaaaactagtcctaattctgcaggatttatttgctgtcaggtcccagttatcccaagattgttggaagcatccttaggatccctttactacatggactaattgctctagagataaagccatccttcaccgtgtctgccggtgctagttttgggtaggtaaactcatgttgatgcccgtctagaaggcataattcagagggccaatgatgtgactgctgccacataattcaaggtggagggcctgtccaaagctgtccgggggctactgtctctctctacagatggactggacttacactagcatggtgtgtatttggaaagaggtaagctcgatgaattatgaccgtggtgaatgtcattaagacacggtagaactggaagcatcccatgcatgtaaattcactgcttctcacataaccgtccccaaggccacggtctcacaatgtcaagtctcactttacattaagctttaaagctggaaaagtatcttggagatgacacggccaaaatttccatatctgtgttggcaagttccctcccaggaagtagttcaaagatggtggatgacgagccccttattttgcaaataaagtaacggctcctggaaagggcagccatggccccaatcacactcctaattggggctggaacacagctgccaacatttcaggttactgctg

SEQ ID NO: 33411 - DNA, 1376 bp, Bovine  19866881198220
ttttggatttggattactccaaagtgtgtaatcctccattcttattaacaggcaaatctggggaaaggggacctaaaatgctgtagtaataacagcattgatgaccaggtttatattgtatagactgagattgccttcttaacaagttttagcaaagagtttaagatctagaacccctgtaaagtgagaatcaacagctcatactctttattttaaaatacttggtcatggcctcccttcagttttattgtggtactggtaaattctacctggtctggcatgcttcactttgatttcctgctatcctctactgcttgcctctaaatcaaggtaaagagcagagcaggtatgtataaatgtcacattgtcttgattattttatatacttaaaatacacatatactaaaccttgatatttgttagctgcataggtagtgtacacttcagttcataatttggcaagaatgacttggtgggagtggggtttaaactgaaaattagaacagcatctgcaaaaatgtagtaagcagcattcagaaatacgtgaaaatttaataacagctttgtctacatggcagatgtttatagtggatatcaaaagaaataataacagcatttgatataattgcagataattgtgatctacattttaaaatatcaagagatcgcctcagtgcttcttcccttaccatggagagttttgcttttctttgggctggaggaagggcatcttacggtgtgtcaaaaggcaaagtctgttttgagatgaaggtaaaagtagttttgtgatgttctttttttcttaagctttgtgaggtttttgcctgatgttattagatatcagtggaacttgtatttttttcaagtttttgtgggttacaagagggactaaccatatgttttatagtagttgaagatgtttgttatattagaagttgccatatagatagagccagcataatttttatttagggtgttcattttttatgaggcacttgaaaggcccaccaaacgtttgaaaaaatttggttaggctccagtttttgttctgagaaaaacatgttaaagagtaaagttcagttggttttgagtattgagaatatataatttcaacattttcttttaaatgtgaaacaaccaagtacattttcagcttcaagttataagcccttagtttttgaaattcttgtaaatgttgggggggagtgtaaaattggtgtggtctgtacttagtagctgaagaagaattagcccattgcccaaatgaaataaaccaggattgatgagggggtttattttccttggctcacagtttatctttgacttttcaggttacagaagaagatccccggtgaggcatttatatacgaaagata

SEQ ID NO: 33412 - DNA, 1919 bp, Bovine  19866881283200
tatatgtacatatatatatgcatatgcattttatatacatatacattttatatacatatacacacagaagtacacaaggtcagttatgaggctgcaaggatgagctctgtgttgcacaaaatgaatcacatcataggggttggctgcttcttgcccatgaagctgatgtgaagaagtccacactctgctgactttcacttgggctctggcactttacattcttcccttaagattcttttcaagcactaccttacatttgccatctggtcaacctctgaggactaagcttgagtcagtctcccactcaggccaaattaggcaaaatatttgcctgaagtggccctcaacccacataatccaaagggagaacatcaaccctagcctaaaatgaaagccggaggtcagtacaaaaagagttgtaccaactaccaaggcaaagagacaaagggaagactacaaatgaaaaacgggagagaaatctgaaatcaaaaagattcagaatggttcaagagaatggtgtgttatggagaaactattttttacatgcaggggaattctggtcttattcttattgggtgctagcctagatctggacaagagagtagctattttaacatatgtcttctctacactgagctgtaagccttttgatagcatgatgtgatgtgcatcttgtcatttttgtatctcccatagagtctgacatatggcagacacttaccaagtatttgttgaatgaattaaggaatgatgaatagagttaatgatatactaccagcactactaccccaaccagtcataatacccatcacttttgggacatttgctatcagctcaaaattgtgctgtgtacttgacatatgtattttttaattcttacaaaactttataaggcagatgctgttcttaacccattctatacatgacaaaacaaaagcttagagaagttatcttttccaaaattgcatacctaacaagtggcagaaatagcatactaacccaagtctgtttgacacctcagtccatgaacttgatcactcaattatactgttatggaaacccagttttgtttgagcttgaattggattctaaaggttgtataatcccctgtttttcccttcaacttccactactcaaactgggctctgtattttgggggcaagtctccaccactatactcaaaacattgtcagatagttatgtgtagatgggcgtcttgatggaggaacacttatgttcccctacggtaaatagcataagccctggaatacagtaagtgttaaataaatgtttgtggagttaaatagctattgacttctgaattaatgatggtgattataagtctatgtttactagagaccattttgattttgatccatggatttcctcatggagggactgaaaggtcaagagataagatatacaagcctgtttcagcacctcccagcagctttctttggggctggatttattgccttcttggttgaaatgttagctctcaactttgctgagatgtcaagagcagtgattttaggtgtagggctgtcaattgcccccacaaacttactttttaactcaaaagtgccatctggcactggaatgggagacctgtcatgaggttcacaggccctctggacctccaagaaggaggggaagggaggccttcagaaacagggtaccctgttcccagctttaaacattaaagtagtaaaataaaggaagaaattttaagctataaaaaatctaaaactttcagtaaaaaatcaacaataataatgggcttcccttggtggctcaacggtgaagaatctgcctgccaattcaggagatgtggtttcgatccctgggtcaggaagatcccctggagagggaaatgggcaacccactccagtattcttgcctgggaaattccatggaca

SEQ ID NO: 33413 - DNA, 1181 bp, Bovine  19866881299951
aaaaaacaaaaatggagtttcttaaaagttaaaatcttttagatgaataatataaattagatattgaccaaagatttttgagaaagaattttggggaaaaatccaaaaactgtatttctgtgatgctaaaacatagctacatagaaaatgaattagacgtgcttgataaaggaggattttgtaaagcacacatttgcaaagtttaattcgggttcaagagtgtaacccactccagtattcttgcctggagaatcccatggacagaggagcctggtgggttacagtcccctgtggtcaggcatgactgagcaactgatcaacaacaggctcccatggacagaggagcctggtgggttacagtccccgtggtcaggcatgactgagcaactgatcagcaacaggagcaactgatcaacaacagcaactgatcaaaacaacaattccccctagtttgagatattatatatatatatataaacttttaaaactagccagaaatcagtttcctgtgctcagttcagcagtagattcaagccaactgggtagattttaatttctgaaaaaagaaagaatttacttgtgtatctcttcatccgaagtgggaggggggtaaaaattaaattccagtcctggatattagaattgtaaaagaaagaatgtaaaagaggtatctaagtaaaatagcccaatttgatttaaaaaattccacatattccccccaaactcttaatatttaggaataaaatcactgcaaatgaactggagccacatgtggccagagagactaacagtgaaatcagcaagaaactgcttattcagcctcttcaaacaaaaatgaattgttctaatgaatgaggagtctttaatgaattaccatatgacatgccagtgatttttttcaatatcaagcagagaaagttttcatttgtcttttgttcagctacagctacttaaaaataatggaaggtcatggcggctgagacaacacttgacattgcagccctccagcggcaggatgtgcttacactgagcccaggagaaggggcacgcggggtgaggctctcctcagatctccaagaccctgccttgctcttgttttctctccatggagatgaatggcggcatttaatgagtccactggatgacatttggataccagcagcgttcacacattctacaga

SEQ ID NO: 33414 - DNA, 634 bp, Bovine  19866881304493
agagcccatgctcagcaacaagaggagccaccacaatgagaagcccgagcagcacgatgatgagtagcccctgctcaccacaactgaagaaggccacaaataaatagataaataaataatttttttaaagagtctatttccttccctaaatagtctagcagaagctatgaatgacccttctactttcaagacagactttgtagtactaggtaggcatgcctgggaaatgtgtataaacttgcaataagaaacttcacttaaatttttttttcagaatcttatccatcatgactgccatccggctacgagaatttattgaccgccgcccagcaatcccacccaggtaatggtcttccaaatgcagacacctccagagctgcagcacggaagacagactcctgggaggctagaattattcatcctgctgcttgctccctgatttagagataactgctgccagaggttctactgaagtttctttgggtttagaaaaagctgtttaagaaaaaaaaaatccaacatttatggcagcatctatgcaaacttggcaactccaaattttagtatttagttattttccacaatgtttagtcatcaaagatatgtccttttgcttccagaaatcactgaagga

SEQ ID NO: 33415 - DNA, 519 bp, Bovine  19866881522456
aaatgggctcagtgccttcctgaaactgccttaagctaattttggtttgtgcagaagaggatgctagcaaccacaagtgacaaaatgagcttgtttcccagagtcgtgccaccaacatatagtaattctagctacctaaagataaggtttgcagacaaccaatgtgtaaaaattcaggacttacacaatgaacttgctatgcttgttttttgtttagaacactgattataatgaataaaatataataaaaatttattcaaataaataaaaattatgacataaaaattatgtcccaataacctgtaattttaaagtagaagataaaaatgtgaagttttttctggaatgagagcccctttaaaactttacccttgccccccaccaaaaaaaacaaataactggttaccagataaagcagactcattctttcataccttttcctttttgaacatttttttctgcttcctcaaacaatccaggtagatgaatcaccacaccatttccttaaaaaataaaaca

SEQ ID NO: 33416 - DNA, 1598 bp, Bovine  19866880346221
aggagaggacacagaggcgaaggccatacgaagatggaagcagagataggagagatgtggccataagccaaggaatgctgggagcaccagaagtgaggagaggccctggattctccccaagggcctccagagggtgcggagctttgccaacacctttaggcttctcgcttccagaactgtgcaggaataaatttctattccttttaagccacccagtttatggagatttctgaggcaaccctaggaaactagtagaatcagtggcaacttatgagggccacagtgtcttcatgcataatatgggtcccacctcataaggctttggggttaggattaaaagggacagtgtgcctatgaagcacactcatgtgcccagcatattgaaaccagtcaatgaaggtgagatattagatgacgcgctatcacctgcttctagcagccctgtcctgaaccccctcagagctagtcgctcatcctaccactttcctgtgtctgactccttgtcactgggccccctgagcccagcctagcatgttcctggcttaggaatctcagaggactcgcatctgactcccagatgcaggctgcagaacccacttctccctctgagccattatcaccacagctgtcagagggagactgtgaacatccacgtgtggccttttaatatttcatccaagaagtcattttcctacatgattcagacatagaagtcttggggaattaaatcaagaaggtaactctgggccagagtgaaatctgccaacaggtgtgtaggattttcctgcgtccactctgctctttctttcttatctgcatcctgcagcagaaaggaagctggctgacaagattatatggtcataccaattattaaatatatatggcagccttctgaaaatgcatttgcataccaaggaaatggaatgcattcaccaacccaggctcctgcactgtgggctttggaggaataacaaggtagctttaaacactatgatccaaggttggatccatactctgccacctcctagctgtgtgaccttgtgtgagtgacacaccatctctgaacctcagtggccataaggaaatatatgctcctcccttacaggtttaccataagcactgactggagtcatgtgttcaagtgcctagcgctaagcctgacacccaggagacccatcactgtgacttttgttcccacccccggactcagaatttcctgcctttatagggaaagtaacatgatggctcggcctgcctcccagggaggtcttgagcagtgctgctgcctatggagtagatttatacctttaaatgcatggttctactgtgaatgcatttctggagacattactttactgacaaaggtctgtctagtcaaagctatggtttttccagtagtcacatatggatgtgagagttggaccataaagaaggctgagtgctgaagaattgatgcttttgaagtgtggtgttggagaagactcttgagagtcccttggactgcatggagatcaaatcagtccatcctaaaggaaatcagtcctgaatattcattggaaggactgatgctgaagctgaaactccaatactctggccac

SEQ ID NO: 33417 - DNA, 838 bp, Bovine  19866880362441
tgcagggttagcaatcctgcctgggggccgcttcccacatcagtgatgaggaataaaggaaccgaggggaaaaagtcaaacagaagaaagcgcctggaaaagatgtttttatgttcacttatcacatggaaaaaaaagaaccaaagtatacagcatgaagatatatgtgtctcagaaaatttatcctcatgaacctgtttgttcaaatggagttataattcaagaattgccaaatggaagtcataaaatcagggtaggggtggggaaaagggccaccaagggaaaggaagtaattatgtggtatttcttctctagtttcagatcattgggaacttaaacttttccagcaagtcattcacataaacagatgccatactgaaatatgattgtgtaaaaatataaaactcctaaagtatgatggcaataatattttaggaagaaaacattaaagtctggtaatatcagaaaatacaaataggatcatttgggagcagttctgtctatataaacagcagttgcaaacaatggatgtatattaaagaacaaagtgtttggtctgcacataacttagaaaggggtaacatttctaaacactgactttgtaagaaaacatgaaggacatcttatactcaacaatggttaaaaggaggaaatcactttctgaaggatgcagtgggcagaatgccaaggcctttgtttttaacctgctcttttttttaacttgctcttaaccgtcttgggatgcgtttacactgcatggggtttcctgcagaatctagcaccaatagatggatcagattttgtctttgatctgagtcctttatgtcttcagttttga

SEQ ID NO: 33418 - DNA, 1226 bp, Bovine  19866880364852
acttttctgctaaaaaacggttgcaagaccttttgtttccatgaatcatagccaaatggcttttaatcagttgaggatgcttctcaaacacagagaattttcgaaaaatatagcttcccctcagtaccattaacaaacagcaatcagaataaatgctttgaaaagttataagatgtgagatacaagaataatgactttaacatatgtttaaaatgatcccacttgaatccaagaataaacttttaattttagcccgattttacagatgaggaggttgaagaccaggaagcttgagagaagaaagaactagaagcataggctgacttcagacctaggacttttgctactacccaggtatcctaaagtgacatgttataaagagatacacaaattttcaaagaaaggggagctaattatctgggctgcctgctggctataatctccccctgaatcacacttgctgaggccagagccttctctgagcatttgctggagtttggccagctccagggcacctctgggctgcaaaacacttgagcttgctgtgaaattgcccactttcggtggtaactcctctctttctttctcctttatataagaagtacatgtaatgctatttcaaagtgtttctattagctacaccactgtacttgacttttcctctgagcaatcacacctcactctctgctctgtgtgacccaaactgccctgaaaatggagcttgcctttgcacatagccctgcctccaacacttcctgccaactgctagatattttccctgagacaaaagggcaaggatttgctgcgtgacagagtgtgggtcccccaccagccaacttctcttacctgcagctctcccggccttctccatgcagcttaagaaaacacacatcttgtaagaacagggctgagctcctctccccttgagcatggttaatttgtttgccaaatctgaaactaagtctaagtcaaaatcaagagtaaatcccaaattctgggtaaagaaagagatcatttctatacacacctggtactaaacaccaagagtacatctaagcaaagacgaagttgaggttgatgagtgaggcgattcatttgtgcttgatatttacacttttccaatgtgctccaaaattatgtgcacttttacttagagaaaatagagagtattcaagtttatgctattattttaataaagaatcataattttcacagaaaagtctaga

SEQ ID NO: 33419 - DNA, 910 bp, Bovine  19866880366439
ctggataaaatctctgtttctgagacagataaatcaggtccaaaatatcttctagcacttcctgaggcagggaaaaaaacaaaaacaaaaacttcttgcaaacttaagtaatcctttaatagtttttgacaaaataaactttatggaagaaggaaaattaaaagaataaacttcttacaaaattagactaatatcttcccagaacagatgtaccatactttttaggattatttatgctacttgggaaaattagttctattagatagttctaaaatttttgtggatttcttattatgcatggtaaaataatattcttcctagcacatattttttcaaggaagtagaaaaaagtaaatgtccttttttttaaatttcaaattcatttatatcttgagagaacaatttagaatttgttattagagcccctttctaagaatttaattcatttacctcttttttttttttttccccacaaaagtgttttccttgtaagataattttaaaatgaaactaagtatcagtcccaggaataagtattcaaaagtgatttctaagaatgacattttccaagttataaagtttaaacacaaatcatttatcaatagactaacaagttaactccaaaaactgttactaatttttagacaaaattatagtgagttaagtatttgtgttgtgaaaaagtaaagcctaacctttgaaactgctacaagacgtactcttgattggaaaggagtggggaaggcaattgaaaaaacacagtttttcactttacgcacataattttctttaacaggatcagttggcaacacagctgacaaaaaaaaaaaaaaagaccttcttaatgttctcatttgttgcatatacagcattaataatccttagaaaggctacagttcttcaagaaaat

SEQ ID NO: 33420 - DNA, 1573 bp, Bovine  19866880488170
atttctttttctgattactgaaatatcacatttccattacagaaaatgtaaacagcacaagacaagcaccaaagagaaaattgaagtcaccataacttcatcaatcagacagacctgcggggtcctgtaagcacttacacttcacactcagatatctttttcttttatttaattctttccaaccatttgttttgatccttcacattataaagcttcttctatggcaatggttctcaatctttttacctcatctctccttttttaaaaattataatcaaatgtatgtaacataaaatttaccattttaaccatttgtaagtatacaattcagtgaccctgaacatattcacactgttgtgaaaccatcaccacgtccatctccaaaatgctttactctttccaaacagaaattctgtccttattgaacaataacttcccattaggagtgatcgttttaagctatgatttattttggggatatttattagttattttcaagtgtttgtcaagatatcataagtgatttgctaactcattttaaagggaaattgtagtatttgcaagctgtgtccaaccaaacagttattagcccagcaaaagtttggttgcctttccaatacagaaacctaagaatgtacattttaaaatgttgagaatataaatagtgagcaaacattttcaagtaagtaatatagttagacattagtggtatccccactattaaggaaaatctttagataaagatacacccagatcctgtatgggaaacaaatctgaagaggtctgtaatactaatacaccccatgcatttctctctgcatcagatcagaatgccccccagtgtgtgtcaaggtgtgttagcctgtgagcttgctaagcaggagggaagtcgtctatgatcaggggaggacagctgacataaatttcagctgacaagctttgaatgctaatggatgccagctcagcctgtgtgtatttgagcaggggttactcacacacacttggatgtaagcctctgtgcctgccaagctaatggccagccctgtgggaagggggtgaaagaagctggaaagattccttttctcatgggattgcaataccatttcaccccctttcttctttttcagtggaattcaagctttctagaattcttgcttaaaccagtgtttggtagtgttatcctaaaacaataaagaagcctgttaccagcaagagggtttatataggagcaacaaagaactgcaattcaggacatgaaaccatggcaaactacatggaagtccagttcagcatgggagacgaaactcttttatagagaaggggaagttggaggggctattataaacaaaagtccgttgaaggaaatggggagttcgaattatagtggctttttattggctgagttgtgacagtctctcgttggcagacctgttgccaggcaaggagaagtctttcctgctggtgatagtaagctagggtcgcttcctgccagagatacaaggtatgtctctctctgttgggatgtatgttgagaaagtgagtaatattagtgatttgtgtgtgagagctcccc

SEQ ID NO: 33421 - DNA, 1728 bp, Bovine  19866880501933
ttaagatcctgttaaaatgcggattctaatacattgggtctgtgagcgggaccggagagtctgcagctcaaaaagtcaccaggtgataccgatactgctggttggtgggtcacacctaagtggaaagaagccagaagactcctaaggctgcaatacagagggggaggtggagagaacggaggccaggagacacacttgcttgcttgcctgaaacaaagacaggacaagctagcactaagactgtacagctggaaggggagaagcagctggctgacccaacagtgtgtggcgctgttgaaacttcatggatttaggttgaatttgtcacctttttttggactctgttctacagaatgcaatggttataactttttaagactggaaaagcgtcccttcaattttctttcatggaatgtgctccatccctgacgtatctgttgtacacagcccctgctcccaccctgctttggcccctccaccaccaccaccatcagcagcagcagcaccctcatacagtggatggctgtgggtggtcttccagcagagctggaggttcacacagactccgctatggtccagggttcctaatgctgcgttttcactcagatctccacagtcccaggctttgaatgattctttcataaatgtgttcaaatgctcattgtgtccattcagtgccatgtcagacgctgaggaaacatggataaataacgtagggttcatgccctccagggactcacagagatgtggaagcaggaaggaaagaggtactgaactgtaccagttacaggccccatgcttccctcattattcctcatagtaggaattattgtcccaattgacagacaaggaaaataaggataagagagggcactcaacagggagtagagtgctgagatctgaacccagggtgtgggctcccagagctcctctggggtccagtggcagctctgcctctcatttgcgttacaatcacaggtaagaccttccctttctaggactcaggactgtcacctttgaaacgaagtcactggactgcactgcttgttctcaactctggcctcactttagaatcacaccaagaccttttaaaacctgcagaaaaccagaccccagacaaatgaagaaccctggacgtggggaggactgggcatcagggtctaaggtacagccagggttgagaaccaccaaagtccttgtgacctgagctcctgcattctaatttcctgaataaccctcttctcctctagccctgccacaaggcccatgccaaactgatgaacaaatggtagggaggaggaggaaatccccagcaccattcagctaaggacaatttggagcagtaatgctgggcactgtcctttgccctgttgtcattttctcctttcagtgagaaaaacagcagcagtggacaacagtggagcaagctaggcgggtattctcttacacggttgcagggaatataaattactacaccttccaaaaaaaagagaacacaatgaaagaccttgaaaaaattgggcaagcaccagacccaacagttttaggagtttgtgctaagaaataattacggaaaagatcaaatacagagatacaagaatagggtcatcactgggcttccctgggggctcagtggtaaagaatctgcctgccaatacaggagacacaggttcaatctctggtccaggaaaatcccacatgctgtggaacaactaattccgtctgcca

SEQ ID NO: 33422 - DNA, 1627 bp, Bovine  19866880585091
caaagggaggacagttgggcacaggtgtgcatctgagcacgcagaggttggcacttggggaaagctgaggtctagtccctgctctgccaccagcccgttgggtgtccctgggtggaacacctccccttccctcagtttctccatttataccatgaagtagtggggtgaaatcatttctaaggccctgcacttgtgacactgtacatgtcattaagggttgggaacatctcttaagaggtaggcgggcttcccacatggtgcttgtggtaaagaacctgcctgccaatgcaggagacataaggagacatgggtttgatcgctggctcgtgaagagtcccctggaggagggcacgacaacccactccagtattcttgcctgaagaatcccatggacagaggagcctggtgggctacagtccataggatcacaaagagtcagacacgactgaagtgactgagcacacacgcatgctcagggtaggcagagaaagtggcacccagaaggtttcaacacaccaagaaaatgtggatttgccccaggcaagtatcataatttttgagtaaaagctaatcatgatagctactacttgctgagcaggaaagatatgcacgtgtttctctgtgccgtgtcatgtagctcttcccacatcccaagatggtagataggatcacattcctattttatagatgaggacactggcatgtgactcaaaagtggtgagtcacatgcttatacactggacttgtgctcagatagttttcaactcacctctgaactgctctttgctacaatgctttctttacaaatgcctaaaaccagtcattggagttggtgtctaatcctaacattcagggggaaaaaggcaataaaattggcattcacttgtagctgtgattggccaatcaatattttacaaaatattctcccagaacgatataatttgagaactggaaatgtgacaagagaatttagctgcaatcactcactcaaaaaaaaaagtaagtatatctttgccaagatgcttacattgttcagccaatgaagaagtaagacttaacaaatggaaaaataattatgtttgcctaaaattacatcttttgtgcacaccagaaagctgacatgcgtttcaattatccgccacgggaagacaaatgggtagatctacaaagtcgcattatggaacggtggtaccagagaacacctgattgatctgaatctggttgagatttgcctgaatggatctgaataacttgatttcatttcttgcttttccctggatgattctgggatctgctcaaaatgagtggacacagaaggcactgctcatttctggattttccagaaacattcagatactgaaaaacattgcattaatgaatggtctgtctcatggttctgcctaacaaccctactaatgaccatcaaaggctgaatcgaggttcctccaggcagaacacctggcccagctcctcacagatgccctatgggcctccatctccccttcgtcacacgaggagcattgtctgaatggctgcggaggtcccttctgattctgacaccaggaaaatcgaacaaatgattcgttttcttaaaacaaaataaaacaaaaaggcctgaaaatagtgt

SEQ ID NO: 33423 - DNA, 1828 bp, Bovine  19866880684911
tctgaaagagatgggaataccagaccacctgacctgcctcttgagaaacctgtatgcaggtcaggaagaaacagttagaactggacatggaacaacagactggttccaaataggaaaaggagtacatcaaggctgtatattgtcaccctgcttatttaacttatatgcagagtacatcatgagaaacgctgggttgaaagaagcacaagctggaatcaagatcgccgggagaaatatcaataacctcagatatgcagggaagagttagggacctgcaaataccctaaagaaacctatgtttccctctttctttctttctttcatttctctctcctccatcccgttcgccagaatgtattgggttctttttctgtatcaggccctcttcttggcactgtggatgagggatgattaaggcacagtgcctgccaaaggctagccagggagagagatataataactaattatcttcaagtcacaagatcactgtggaggtgtgtacaggatgacggatgaacccaaccacaactttggcttgggcaggcaggaagcaggggcctgagttggtccatgagagttgagtaaatgttctttggaagaaggacttgctttgctgtgattgctttgtgagagatcaacttccttctgacaagccctgagcaaggaagagacaactgctttgcaaacaaacacctcatgtattatttcctccattctcctcacatatctcatctcctcccctgaataatatgcctccctgtgtcacttaatttccacaggaagctggaaagagcaacatctgtctaaatttcccctaactcattccagatttccagggtcagaatgtggaccctgggagatggagacacagtctctgtgggatcataggtgacagccccaggactggtggactcccacagagcccttgtggcagccgggccgccctggcgccagttctctgcacaatacagatgttctgctcaacaagactttcactgggagcataatcagcggctgaggcagcccctggagaggcgagtgcaggcctcgttcccacgggctcctgcccaacgtggttcctgagtctgctgttcctaggagagagggcggccagcaatgctccagctcccacaccagctgctccaggaaagcaacttcctcatatggcttggggccgctcccagccacggggacattgtttcattcacagcccagtgctaatggcatttatttaggagacactttcccttctgctacccataagaaagcagcttggagcagagtaaggaggagagatccacctttagggatcgggttctagcccttggaaagctgccttctctccctgagtctcagtctcctcacctataaaagaaaatgggttagtccaggtggcatccaggggcaatgcatgctcaaggtgtgatttttagagaccagcagacgaggtctgcatcccccctgtgctgacctcatggtcctacctcggaggccctgcacctcaccaaccatggtttcctcatctgtgaattgagagaggtgggacccagtcacccccaaggtccctgagggctttataatgatgggagcgtctgccttccataaagcaactgaggaaaagcattttattctttcctcatggtaaatctttctaattctgtgcctggtgagtataagcagggtcagcacgaaagaactggcctccaccagttacccttctgccttctgccccacatgactgagtctctgcagatcaaaacaccatttttctaaagcaagaatcttagattccttagggtatcttcccaggtcctttaggatccagccc

SEQ ID NO: 33424 - DNA, 1246 bp, Bovine  19866880703823
tgggaagtattccatctggtaaacgaatccaagttgtaatccttgtctgttttctaatctgaccacagatcttaaatgtgttgagtgtttggacagaggccaaaagacacagctccaagcctttcctatcacacctgccttccaaccagcagactctattgtgggtggagtcatctcccactagtctgataccagcagcagttctgggtcgaagctgcgttccctggttcactccaaaccccattcccctctggagccctgggggacatgactcatggaagagccataccctccagggagcccagttactagagactgtaaattgaagcagatggcaagttagatcctactctgcctgagccatcaacttgttggacaccatctcccctctgtgtctcaggctccccatgtgtaaaatgagagaatcagaccagacttctgcttcttaactttttggctgtgatccctttgaaaatagtgaatatctgataaaaacctttggactagtttaccaatttacacactctaactttctataggagatacaagactatcaatttccctgagttgggcaccagcagaaggagttccagattaaccaatatatgatttcaaatctctgatatcactttaacattcaggtaacttcttcacagctgctgctgctgctaagtcgcttcagtcgtgtccaactctgtgcgaccccatagatggcagcccaccaggctcccccatccctgaagccttcctaaacccttaaaccagattctactagtataagtccttttagcaccctgtaatttttcttcaaaatacttatcacaatcctaataagttatcttttttattatctatccatttcaacacactctcaacaccatgatgtcaaaagtatctgtcttatgacaaagattttctccatgaccaaactctagacaggttcctccaaaccctcttcttgactagggctcaaccatgggctgtaaaagctatagactcaacacaaatgattttatccacccatttcccctcacattaaaaagacttaaacactaacatagtttcaaagactatgaccctgggacttccctggcagtccagtggttaagactccaggttcccactgcagggggagcaggtttgattccctaggagggaatgaaactaagatcctgcatgccatgcagatcaggcaaaaaaaaaaagaaagaaagactatgatcccttaagtgcctgcctaagaaag

SEQ ID NO: 33425 - DNA, 1838 bp, Bovine  19866880749448
agcatgtagtgggcacagtagccttgccggatgatgaatgagtggacctctgacccctgacctccagtccactcttctgtaagctgcacccactgccccaggacctttgcacttgctgttctcgctgcctggatgctgctggtgctcttcgccttggtatctgcacagctcgctccttcgtttactgctaaaacatcagctcctgagagaccttccctgaccaccgtctataaaacagcattcttcgcctcccctgtcagcccctcccaccctgctctgtttttccttaccgccttgtcagcttgcctgtgttctgttttggtccctgttgagtccccagtgcctagtctggtaaaccccttttgaatgtgtgaatggatgtttctccaaaccccccagatgctggtcttgtctccttccctgtctctctccctgttctgataacttgataccccagatcttctgttttcccctggtctgtgtccatctggctctcctgttccactcagacccgccttttcttcaggaagcccacagtctccaaatgcttataccaaaccttgactctgaagcccgcctgcctattctctccaggtctttctctgtctagctgaggggtgctagtcttagtgtttattccaagggtagctaacagcagttgagaaatcataatttaaaattgttctgggatagagtgcagggttttaggcccagaagctagaactctaagaacatggtggttgcagccattggagagtcagcctagccatgaggacccccatcttctgtcttcacagcccgatctggggtttggggaatgctgggagcctgccctgaggggggagtgtgaccagcacgtggcttgagacccacctgcagctgcaccccaggagtgcagtgtagatctgctttctgtgtcggggcttcttgtagaatttcatttgaattaagattaccacgactttatgaaagtttgaagatcactcttgaggcaattttaccaaattctaaaatgtcttattttacattctttccctcttgaagatgaactgactggaatccttaagaaattatcacttgagaaatatcagcccatttttgaggagcaagaggtaagaatactctttttgagtgtccatttaaatcgtagcataaaacagttgtctaaataggtaggttgtcattctttaagcctggattgatctttttcgttgagatggctgaagaaatagaatttgtgttcagcacatttggttcattcataacagtgaaatcctggggactttctggcttgtgttataataaaattttgtaattttgagctctgctctctgtagtaaagtttgtgtctgttctgatctcttttagttgaaggggattacctagccagtttttaggtttaaagtaagtaaaaagcaaattctaatgagtctgtgttacgtatctggacataaagagtctgtatcagtctaaaagagttcctatttgctctcactcaaaatcctaaaagcacttacaatcacattttaaaaaattactgttctgcagtttggcagtttctcaaaatgttgaagagaattaccatatgacccagtaatgccactcctaggtaggtatatgcccacaataatcgaaagcatacatttgcacagtgttcacagcaacactattcataatagccaaaaggcagaaatagcccaaatgcccatcaattgatgaatgagtaaataaaatgtgttatcactctaccttggaatgtagcttggccattaaaaagaaagaagtactgatacactctacaaaacagatgagccttgaagacactgtgctgagagaaa

SEQ ID NO: 33426 - DNA, 946 bp, Bovine  19866880798744
tttatctcttccactgtgtctcttccttccctccattcatcctccctgcctttcccaataaaacaacctaccccagtggattttttttcctagtgggttttcaaatgaagtttttgcctgaaattttcaaagagacacatgctggagagaaaaaaaaaaaagcaacagtcaagagaaaagcatattcatagttcatagtatttttttctcaattctgcttgttgcttttttaatagcctagttgagttaataataacaactaatgctacttaattttcttaagcacttgccatatgttaggaattccctcaggtccttcagacacctttatgtggtgggtactgtcaccccttgattgacctgcagttacacagcctggggagaacagaggcagaattccaacttcagtcatctggctgtagagcctctactttttaaacacttcacccctctgccctcctggtaggacagggcatctgctttttatttctgtttaagtggattaaaccctgctgccatgtgcgccccttctgaagagccagtggagaggcaggggcacctggatcctggagtaacacaggcgctggcactgcgggactgagttctcaggctgctgagggtcgtcttgagacccctgcccccatggcccaacagacatatttgcaggtaaaaggctgccttttgtgtccatagacacggaacttgttcgactgctggcatctgtctgcatgcaggtgaataaagacaaaggccggcccagccacccaccacctctgccccactcgaaggtccgacagccctggagtgtcccggtgctgcctgatgacaaaggcgggctcaaggtttgccttttcctgtcttgaagagcatcagagagccatgcctggataggtgaagcgggaagatgcttgccacttcctcattacccagagcgctttaggacagg

SEQ ID NO: 33427 - DNA, 1506 bp, Bovine  19866880805081
gagccataaagtcttgtttggaaaggacagaggaaagaaagacataaagtatgaaaaagaacctcaagctgggcctgtagaagcctgggtttaaaatctggctgtgctcctcgtctgctgtgtgacttttagcaagtgcccgcccctctctaggtctcagacacttgtctaccaaataagagggttgtgttggaacctctggcctttgagatcgcttcaactctgacgtcgtacttttctgagagaaaggagttgaggcatcatattttgctagccatctagtagatgaatcatttttattattcagaaatttttttgatgtgatcctgtatggcaagaaatagctaatagcatctcttttgccattcctgctctagtgtctagaaacagtcattaagtcacagcccccatttcctcacttcctgctaactcccctgcagtctagttcccaactccttaatcctttgaaactgttctcaaggtcaccatgacctcccctggcagactcaacagacatgtctcagacctttacttcctccctgcacctctcagaaacatttcaacacaggggactttcctgtctttcttgagatactcttctcctggggctcagagactttgccctcccagagacccatgtttcaagggcaggatttgtacccacagagttggtgccaaggcctagttccacagcattatttgcagccatttgccttcccattgtcatcattttactactaaactctagattctctgggcaagttattcattcattcactgattcatcagctgtttatcaagtcagctatttactggcactatactaggcaacgggaatacaatttacccctgcataacatgggtttgagcttcataggtccacttctatgtgagtttttttctataaatactacacaactacacaatcaatggacagttgaatctgaggatatggaactcaagagctgacagtaaagttatacactgatgttcgaccccagagggaatgggctcccctaaatgcccccggcctcatgttcaagggtcaactgtatagcaagataggagtcaggcattaaggaagtaagtacaagatacagggtgtaattacaaatgtggatgagttcgctgaagaaaaggaccagatgctgtgagagaagagagagcagggggaccggcaggatgtgcgaaaatgtcatttggaagaaggatggtggcaggaagatcttaaagtaggggaggagcgatacaggcagaggaaatgccattgtggggcctggttggggggggcgcagcattttgaaagggtgatctggggaacatggcattgtcctgtaccaacagcaccctgcttttacttggattaaggatttgggagtggctttggaggagcagatgaagactctttccattgtcatcattctaccaccaaattctagattctctgggcgaagtcgttcattcattaattatttattggagagtcatctatactatcctaggttt

SEQ ID NO: 33428 - DNA, 1229 bp, Bovine  19866880812643
tggctcagcagagaagtcgatggcacccccactccactactcttgcctggaaaatcccatggacggaggagcctggtgggctgcagtccatggggtctcaaagagttggacatgactgagtgacttcactttcacttttcactttcatgcattggagaaggcaatggcaacccactccagtgttcttgcctggagaatcccagggacccgggagcctggtgggctgccttctatggggtcgcacagagtcggacacgactgaagcgacttagcagcagcagcagctggtggctcagatggtaaagaatctgcctgtgatgcagaagacctgggttcgatccatgggtcgggaagattccctggagaaggaaatgccaacccactccagtattcttgcctgggaaatcccatggacagaagagcctggcaggctgtaatccatggggtcacaaagagtcatacacaactgaatgactaacactttcaggcccaaataagaaaggactgttgtccactaacagaggctatgtgatgatgcccaggagtccggaaatctgagctttcattctgcatctgctgactctctgactttgaatcagttgtttccatcctgtaaacttaaatctgcttctctgagcaatggaactacctgatctctgaggactctctcccagctctaactttgtcattctgatgctgcagaatccagattcccagcctggggtgggattaggaatggttcggttgtacctgcaccccgagatcctctgaggcctttttcaactgcccctgccctgcctaggtcagtgcttctccagtgatttttctctagcatttcaccactactcctctgaccaagaaccttccagaactgctaggacagagctgaaatgccacctctgtctcaagctgtgtgggaaggttactgcccaccaacagcatgactgaggggtgttaaggtgacattcaggagtttgtcaaagcagttccaagagagtgcaaacaggtgctggcttgttagaaataatttccgtgtctcaccactcggaccacattagtcattcaagtgctgaggaacaatataaattcctgtcatcctggtttatgtgaccactaagatttattccaagtgacaggtcattaagggttcttctctttatattttttctcagattcactgaaaactcatatttctgctccatgttatagactgctaacagctctgtttt

SEQ ID NO: 33429 - DNA, 1488 bp, Bovine  19866880864948
cttgtgagtctcttggactgcaaggagatccaccgtcctactaaaggaaatcaatcctgaatattcactggaagaactgatgctgaagctgaaactccaatactttggccacctgatgcaaagaactcactcactagaaaagaccctgatgctgggaaagattgaaggcaggatgaaaaggggatgacagagggatgagatggttggatggcatcaccgactcaatggacatgattttgagcaagctctgggagttggtgctggacagggaaacctggcgtgctgcagtccatggggtcacaaagagtcggacatgaatgagagactgaacagaactgaactaggtcatatacctgaatatctcatttaatagcaaaacaattagaggatagatattattactattcctgtttgacatatgagtaaactgaggcttacataacctataaagaatctgccaggggtcacacagacagaagtgggtacagtctggattcaaacccaggtctgtcttcccaaatcctttttgaagaaagtgaggggaaaagaggagctaaaaataggagtacaaaatgggaacaaagagatgaaaagacctggaaagagacccagaacaaaatacataactctacagttatccaaagggtgttctagattaatgagaaattcttgctgtctaattctaatcactgactcaaaatgtctgaggttgcatgcacttagagataatcgagttcaaaccctccaggttaaagctggagaagaagacctggagaaggaagtgacttgtccaggggaacagagaggctggtggggataggcaggaaccagggccccatttcccaagcagggctggttcttcctctcccctcgcccatacttcctttcttccctccaaaagactctgtgatgacccacaggcagctaaggtgagcatgtggctctgcccagagcacagtgatggagaatgctgggagccccgtgactaagacatctcaagagagcgtcctctccagcagggcctcttgctctgagacatccagcaaccaccacagaaacaggtcatatttgcccaaagtatccaccaggcgtgtggatgtgtgtcactgccttgcacgactgcggtaacctggaccgccacacccatgaacctgacagtggccaggagcctggcattgccttgggatggacaggatccagtgccacccccaccccccaggaaaagagaaactgcatgccttgtagtgacacgcttttcctacaaatacaacttaattaacctggcataaatttcagcctcatatctaatcatcaaccatctctctcacacatgcatatgcagaagaaaaagtttcaaagacaagacccatttatgatgggccaagaaaatcctggtttcccacattctacttcagggagagcctcccactcagcctctccctggactcaggagccccttcctgagatctagctgcccactcagtgcca

SEQ ID NO: 33430 - DNA, 3006 bp, Bovine  19866880871471
gagggcctctggcctagagaggttgacaagacaagaaatgggttatgaggtgcgggctgtgttatttattgcttccctgatggctcagtgggtaaagaatctgcctgcaatgcaggagacaggaaatgctgattcgatccctgggtcaggaagatcctctagaggaaatgacaacccactccagtattctcgcctaaaaaatcccatggacagaggagactggtgggtccgtagggtctcaaagaatcggataagactgaagcgacttagcactcatatatacaatgcagaaacagtatatctgtggtaatacaatttcatgagtgtggtagaattaggaaaaatacaggtttcttaggagaatgataatgaaaaaaagattgaggaacgtatatggttctacatcacttccatatcacataccgtgttccattaataagtgaattacacagtgcagagaatagtctatcctgtatccaggtgtttcctactagactataagcttcttgggggcagaggactctcattttcttcatctcctagttaccagtgcctatcacaaggcgtgcctggtaccaagtaggtcctcacagagtgctacactgaactaagtgcagggaataagctgaggactctgaaaccctccatggcagtgtttctcacaatgtggacttgaccacgaagaggccaaggacttgggagaaaaatgcagatcctcagcctccagctcagcagaatccctctgcattgtcaacagggtgattctcgtactccatccccccctgccctaggcatctgctaccagactctggggcagatccagggctccagctgtgcatgggtgagggacaccgaggggctaagaactgggcagtgcccagcaattcggcgagttccagggacctgaatcacagggtgagctcagaatagacttctcccagcctgagaagccaggcaaggagaaggtaggaacaaagatgtgggtcccaatggagagtagctctggaggatttctgcgccccctactctttgagaacacagccccacttgctgtggattggattctgggggtcctctgcccccctcccccgccccctgaggctgagtttgaaaagacggtgggtgagtgagtctgccattgctcaagggatttgatcaatcccttaacttattcaaaactgggctctgaaacagagtttcacaaatgggaaaatgcatgtaatttgtgtaattgaaaaggagctctgactgccctttaggggaacaatgcttgctggacagagacagtctggaatgtgcaatcagttgcttctgtttcctggtgctacaaaaatagagatttgcgccacaaaggggtgaaaattcatcctggtgctaaaatcagttaaatttaacttttgccttttgctgggcttcttgattcatggttgctgcatcaagaggctaatattgtttaagtcgtgatgtgagtcactgggagcgtcagctcctccaactagaggggaggatcttcatggagtctagggcaggcaattcgggctctatccctgtcgtcctggtcagatcccattcagggtgcgggctcagatctgggcctcacctcaggggaagcccaccagggtatagccttgggggcatctggggagggtagagttctggctattggagaactgagaatgttcagactggagagcctgcagggcgctggggaggacagaggagtcctagctgcctgagctgcatggctctttgagagccgttgccgggtttctgagatgtgggtggggagatgcaggagcatggctgaagtgagagggaagcagggcttccctgcagtcacgcccttgctgctggaggcatcgggcacagagcaggcttcctggctgcgaagtagtgagttccctgttgccccgttgccccgcacattctggtctcatccagtcctactgttagggagatttaatacccagagtaggcatacaccaggttgctgactgtcacactatatggtgagcgtcttttatgagggccaaagatgtgctcgtgttagtgcaaatttccgggctccacgctgagcaggtccaggttaagggattcatcacatccttcaaggatggtggaccccactcctcacccccactgtcgtttcaggtggcacagatgcagttggtttctgggaacttgctaggccaggtgatctctaagtcctgctcgtttcccaaacctcagaatgctgatgagtgctgctggctcacacaagtttaatttacgcagccccggttggaaagaggacatggagacagcaggtgctgctgctggggccagcatcccaggacaaagccctcagcccatggcgtggcaagaagttctccttcacctcgcccctctctttgtcacccacctgctccttcatccagcggccacttacaggctgtctcctcagtccgtggtccctctgcctggcagagcttgctcattcttccagatgcggtttggccgcttcttcctctgtgaagcttcctgttccttcccccgtgctcccttacctgcctagttttcccatggcgtttgctgccttgtgcctgcgcctccttccacccccgccctcaagcggccagaggtcagggcctggtgtggtcctgactcagatcctgagtggtccctggagctggatgcctgacttctgcaccttaggctcgtccctaatgatgagggcagactcagattcagactcagagggacccgagggctttccagctgcagccccttggtaaaaggacatgaagggacatctgaaatgatctctggcttggctttagcccacatctcgcatttctggccctgatgctctgtaactgatatgcttcctttgaaaatgttttcagacctgctcagaatcctttcctcggagatctgaaggtggctagcttctgactctgccttgcacagttttggagatgttctataaacctcccccaatgtagtctgtccccctaaagcatggag

SEQ ID NO: 33431 - DNA, 819 bp, Bovine  19866880875609
tacatttttatgttccctgcttgtttttataaattgtgtgtgcaagtattttccagaccattttttaacttaatactttatcataagtattttctttgatccttcattaacttcataccatcatatttaatggttatagaatatttcttcaaggcttataccccaatttattttaccatcctctctcccctttttgaatatttgggctgcttccagtttttcactaagcaactctttgatgagtatttttttgtatatggctttttccatatttcagggtattttcttaggctagcttcccagaaggggattatggagtcagagtgtatgaacattttttatggcttcaaagcatcttttgaagaaggtaggtgttccatttcatgaggttcacaaacataaaagaggaaactttgtttcaaaaaaatcccttgtaacacatgtacataaaaatttgggcaaagagctgttttaatagttttttaagttattaaagcttgcccttttaaatttaaaagttacttttgattctatttgtttttgacgagagtctttgctaagatgttttacacttctgagcttttctaaaaagaacccacagagcacagtttaaacttttcttgatgactcacgtggtcagtatcaccatcagctgtttccctggactgaacaccctagggctttcaggaatttttcaggtggagaggctactgctctccttcacaaaacagccacagaccaggagcacttctggaaatctgtcccaatctctagtttcatggctctgcatctgagttgctggctacttgcagtgagctg

SEQ ID NO: 33432 - DNA, 2817 bp, Bovine  19866880878965
cggggcatgagggagccaagggtgctttctcagtgaaaagacagtgagtgatgagagcttgctctggcaagatggactggcaggtgggtggaggctggactgtgagtggggagaaggggcatcagtgaggggcctgatgccaccctgtaggcaaggaagaatgaatgtcaggtcagggcagagagaggggtgagagatgtggacttaagattggccactcctggccacggactgatggtggcaggaaaggagaggagggaggagttagagaagactctgtttttgagtccaggtgactgggcggatggcgatgccattcttggaagctgggaacatgcaggagtagacgggaaaagatgctgagtgcaggtttgggtatagagagccctagggagagacatccagcagggaggaccaggatggggtcagaggcaaggtcgggcttagaggacagaggcaggatggcctggtggttccctatgcaacacccctccccctttccctgtaccttctctcctttcattcccggaagaccagatgctccatcaagtccaggttttccctcggggccctgaggaacatcaaggacaatcagcctacaatatctttgataagtatcaaatacgaaccctctttggaaaaggaggccagagctgagaagacccagcgggtgaggcgggtgggtctaaagccttgcgtcagtctgtagcggaacaactgtcctggccacagctcggccactgctggctgtgcgcctgtagacgagtgtccttcactctctgggttgtgctttctcttctgcagggcagtcgggggcagggctggactagacggtctctggggcctcccaccccaggccgagcactgacggactacgtttccaaggttttacacagattaagatgaagcagtgaaacaacgtgtaggacgatattttccttggctgttgcttcttatctggagtcttagtaatagcaatgtcttggctgaggaagattttgtttacaagtgccagctagctgctcacacctagtcataagccttagcactggggtctgcagtctgtaccccctccctggctaaaggaagccccatgggtaccgagagggggcggtgacttcggtagctcaccgggggaccaggttcaccagtaggtccatcctctccaggagatccagggggtcccatgaaaacatcagttcctggttttcctgggatcccaggtaagccaggtgggcccgggagacctggaggaccctaaaaaaagacaccgtgttaaaaaacagggcaggaggggacaaatgaatatgttccactcactccattgttgaaaacgaccctacgggtacagactggtgttgctccttagaagatggggaaactgaggctcagtgagatgatgtgacttgcctaagagctcacgcatacagctaattaggagaagagctgagatttggacccaagtctttttaagcccattatataatgttttctgcccagatgtatgtatacgatacagatgcaatttgttggaattcttagaggtgctctactttagttttctgattacctgagaggttagtctaaaactgcctattgttataaagtgaaaaggttagtcactcagttgtatccaattctttgtggccccatggactatatagcctgccaggctcctctattcgtgggatttcccaggcaagaataatggagtgagttgccattcccttctccaggggatcttcctgacccaggaatcgaacccaggtctcctccattgcaggcagattctttactgtctgagctacagggaagcccaatatgaagatggaagtactgggggttgaacccagggcctcacgcatgctaagaatgagctctatcactgagctattcccctagaaatgaggctttttcaagaatctctagtttgcattttaggtacattcctcaggggttattttgtctgatactattgataaaaatcagtcaaatagaagaggctacagatggaaaaaggccaaggcaggataggtggaaaacccagccacaatatgcccaatgaggaaaatgtctgaaattcacaataacagacacaataacagacctacattataatcagctcaaacaaagcttctcactttcctgtccccattcttttgtaagcatagctgttttttctaactgaaaacaaattcaagtgaacagactgagtcagcctctctccccaggctggaggtgcacacagacacctggtggctcatcacaggtaccctggctgcagccatggcctcagagatgagcagagatctgggccaggccagtcagactccttgggaattttgttggatttattgagggaaaggtattccattttttctgggattactagctgtggggaacgaagagttgctagtggccaactttgcttccaaatgagacaagcctgcctgaggtgcctgacaacagaaaatcaacagagaaaaaaggaaaacagacacaaggagaaatgaaacttgacgacatcatttgagcccctggatctaactctacctgaagccaaacacactcaactttagttactgaagtcagtaaatcctctgttctcttttgtcccttaaactatggctccttctcttatgaagggctcacatcctgataaacccattgtaagccgaaaacatcataagttgaaaatgcatttaatacacctaagctattgaacatcataggttagtctagcctaccttaaatgtgctcagaatatttatattagcctgtagtttggcaaaatcatctaacacaaaacctatttca

SEQ ID NO: 33433 - DNA, 1130 bp, Bovine  19866880882917
gcagctgtcttaggatttcaaaaggtgtaaagtagccttagaacgtgtctctcattgcgacaacaggttgagtgattctctttgttccaaaagcttcaggggctcagactttggatttccaccatgggaagacatgtactttctgtcactttctcttgagaattgcatagaatccatggtatcgtctgtgctgttccctgatggtgtaagcttataactgctcgtaaagctgtgtacccttaagacaattcattttcttaatttcacgttaatggaaagaatggaagaggtttatttctggatcagaaacaacatgctgtggtaaagttgcacaggccttaaaatcaaactcaggtttgaatccagcaggctcactggcaatgaccttggcataacctccttcaatctcagtttcttgatctgtaaaattagaatcatccccctttccactcaagtgtgtcataaacgctcattgatatgacctgtgtcagtttccttgcacggttgcagaattttaggtggaccataaacagacaaagagagaccacaccctctctcaatttatgttcctggcttatttagcccagcatatggaagccgggtatcagccagcaaagcagatgcagcagatgactcttgtctttagctcctggggtccctaatgaggggtgctcagctgcctgtgacactagtcaggtctcactggctcaagaagcttaattttgtgctgccccatagcccagttataattggggctgacatcaccactcgcgaagaacttacagaaacattctctgtccttaataagaaatacaggcctcgaccctgtattcctgtatcccttctgacccttcagataaacagcctcagcaaagaccagcatctttatgggtggggcatgggagcagagccagggccaggcaccaagggcttcatctcttcctccatctttccaaccaccctggaagaccctgtccagggcacatgggtgtttaataaatagtcatgatgataatgatggtgcatatcttggccttaatatacatgtgttggtttcattattttgtgctcctcaaattatccagataaagtcacaacccgttctaaaaacaattagcttaattttgcat

SEQ ID NO: 33434 - DNA, 1411 bp, Bovine  19866880893403
acgactttcttccttttttttgcttttctgccctatccagtctgtccttcctgccttctcgatgccgtaaacttcagtggcaatttttctcgttgtcaaaaaaatctttcctgtttgcagatggctggctgcttttatttcatgtgttctgtgctttctgaggagctggctgggtgtggggtctctgcctcaggtctgggatggtgcggggaggggagtggccagtaggatcagggggcaggtgttttccatcaaaaccatgtcacctgttccttcagcctgtcagtgtcttgtgatctgaaaagcccctgagagatgcagggagcttatcgttatcacaggggccctctctgcatctcagagagagcatggtgttgggtgcgggagcagacccttccccactgatgcaaacttggttcaagattttttttttttaatccaggaaagtaaaatgaaaattgaaaaaaagggattctcttggagctgaggccccggcagggatgccagaaatgttagaatttctccggtaaaaaccagggatcgaacagctttgagatgcccattttctgatcctttctctgcctcagttcttcacagtctttcttgcctttattgcttctgcttgtttcttttctcactctgtctttccacagcctgcatctctcttgtccttggggggtaaacatggtaagtaccgccatatactcatattttctgtacagtatcctatactgttcaaagtgcagcaacattgcaatgaactttctatcagcaggacttggctttctaccactctggtcacccagattactgtctcagacttcccttacttattttgttttcagagtctttctagaatgcacttctaaaaattccagggtgagagctgaggacagtttatttttaatgatattttcaaataaacattcagcataaagccgggaattgaaaagtagtaaatcatcattaattcactactaataagcactaatagctcataatcatgatagtccggttgtggttgggaaaaaagaggtgtggcactgagcagatggtagcaaatccccctctctctccccaggtggatatggaagcattcctcacactcaccgacggcgacttgaaggagctgggtattaagacagatggatccaggcagcagattttggcagcaatttctgaactgaatgcaggcaaggtattgttcccaatctttttttttttttctgtttcgaacagctgacagcttcactaggatccttggccctggtgttccaaggaccttcgtggtctgatttggtctcccgcacatgcctggtggaggcaggccccgctcacacacttctcaaggccagtgggtcactaccttccagtatgtctattccttttccaagacctctcttctcataag

SEQ ID NO: 33435 - DNA, 2125 bp, Bovine  19866880899266
gtatataaaactcctgcataagcctcctctgaagaggaacgtaatttactggagaggagaaggggacaggaggaaggggtgcccagtgctccactgacatcttgttctctttagggtgaagctgaggaggggtttcctggcccccctggacctgctgtgcctactgaacccacggtgagattcctacccatgcttgtcatgggcacaaagtgcagggggccagggatgcacaaaacagccacagaggattcgtcccctcaagtgccctgcagtcagagctcagtgctcactcctgtaccaggactctctcctggagcccagcagttttatatttataaagctcctttatatcctgtgccctgaaaggcccctgggtccctcaaatcccaagctgaacttgtcaccatgctcctaggcctgctctccctgcagggctcccctgttctgggaatggtaccccatcttcctgatcaccaagagagaagccaggaaatgtcctcaagtgcctccccccacctccctgatccagtcagtccccaagcccctcagtctagttgtgcaacacctcctcatccctcagatggggacagcagcctcctaactgtctctctacctccatgtcatcgcttcccttctcccacccacatgcacacaacctgcccagactcagttccaacccctaacccagatcctccttgatgattgaaggaggctttgcctggttcccatcctcaggaattaagtaccagaaaggtgttttggaagtttccttttgttctttggaggaatttgatgacattcaacaagtagacattgagtgccttcctggtcccagatctcatgatggaccctgggcacccagaggtgtctcaggactgggccaattctggagtcttagcctagtggggccgacagatacacacaactgagcttcaaagccaggtggccctacggccaaatccagacttccacagaggctggtgggaacacagagcaggagagatgaattttgtctgaaaatggggttgggcagggcttcctggaggaggagaccatggaactggaccctgaaggatgagtagggattggaaatgcaggaaaagagaggatgagaggctgtgaaagtgtcctgtgtttgagcactggctgtatgttggctgcacagctgggaaggagagaaggagggcagctgtagaggggaccgggcaaaagagccagaagggaagtcaccagcagcagttacaggggcacagaatactggaaagctttcagtgacatgcctgtccttggagaatgatggtgaaacccagcatgggaactttttctctctgcaggtggaagtggaggctgagggctccggcctgggctggggcttggatgtcagctctggctctggtgacctggtgcacagtgaggagctgttaagagtgagtatgaagggttaaaaggcctggtgtcaggtagtgaggggagggcagccttcatgaggatccaggaggggggacacagggattgataacagatgaaaccagcctggcctctgtagatgactgctgaggctgacggtgggctcctgggactcactatacttcccatctacatttatgtatgcctggcatttccatctttggtcagttttaagtgagtctgaccttagtttatagtcaggagccccactttacacttgcctccttcccctggcagccttctccagcacctcttccacagcaggtatgcccatgaccttcacttctaccactggctctaccctccacccccttacccatcacagagacctgctggcctcttctctacacagcatttcacactttgacttccagacccttctcaaaaccctccctaccctgaggcagccccctttctacctctgcagaccactctttctgcctcctcggcaactcttggtcccccagcctcttgcccaaggctgggccaccagagcttcctctagatttccccctgggagcacctctcctctcacctggatctcatgcatctgtgctcagagccgcaacctcattccatcccttcctctgagcccctgtcaagaatccccatctagagggctctgctcagctgcctttctgcccactcatcatgacag

SEQ ID NO: 33436 - DNA, 2791 bp, Bovine  19866880907096
caccctgtggccaaggagtggtatgttctaattggtcaaggcctaggattactgctcatccctgacccaatcatagtggcaactgcctgggattacggtaattgttaaggtcagtcatggacactcaaatgcctagagcccatccaaaccacaagggtaatcccactgtgaactttcacaagatagtatttaccacttgctcctgggaacacacactcatattttgtaattctagcttcttgaccaggtaatgttcaattctgtttcaatttttaaaaatcccggtctgagccagtagattgacttcactactcactaacggtttgttgcccacagtttgaaaaatgccactcttcaggcctgcacaaactgctggcattgtttaaatagctgttaaatgcatcataaattctccaggaatttaagggggaaatgtgtagggaagtggaagttgggttaatagagtgtacaaggtcattaagtggatacgggtggtacttgccacttgtgaaaaggccttgagagaagacacttttgagctctaaggtgggactccagcttcaaggagtgagacagtccaccagggctattcccctgattaggttggacttgggctacaagggactcatctggagtgccaatatgctcatgccatacagctgggtgccctgagatgttttgttctgtgatttttcttacccagaacccactccaactagactagactttgtcaatcctttggagagcacagggaacacccaagatgctttttggttatgtgagggccaagctagtctgagcacctactgtgtgccggacagtgtctgtgtatgtagaggatgtgcgggaggagtgagaacaaacaggccatgtgcgcatgtatacaaagtgaaatgacatacgcaagtaaatagtgataaagacaacatttggaatagcagctgagatggagagagaaagctacaggggagagacagagacggtctttctacaggtacagcaatattttatttcctaatctaagtggtggattcgtggctggttgttttgttattaatatttattaaacattgatgatgcaatgtggacacattgtctgtatacacatacacacacctattggtatgcatgacaaaaaaatatagtaagccatgaactctacttaatgacttcacagatttgagtggaagacagccataatcacaatgaatatatatcacaatgaaatcataagaaatataaagaagcaatccattttggctaaacatatgaacttgggtaagttactttatttattgaagcttcaggcttttcagatacattttacagatagacaaatagataccagatagataaacagataacgagataaatgacagatatatatatacacatacatacacacacatatatattaggtttattgtgagagtcaattgatatgtgatgcatgaaaaaaatctctgacaaactgtgaaactgtaaaaaatgtgagataatattttcactttgggcatatttgcaactgtctatttctccttctgtgaaggcactaccccacagttttgtacccgagtggtagtctgaaggaagcaggctgtaagcaactgtaaattattctcaatctaacatattttgtgtctagcacaatgaagaagcaaataaagatgacatcggctaccactgaatagcttgcaattatccgaacaaggacttggagtttaagagctccatggaggccagggattagcaggcttttagggggcagggggcagagctgagaggagagtgctgcacttcaccttccctgggggctttttcggtccagccggcagattcccgccaccatgaccacacggccccgacaggtgctgcgtctccccaggtctctggcctgaacgtggacataaatccctcccccagctctcctgggcctcagggacactggcttccgatactgccagagtaggctctctttcaggagtgctggtcctctatcgcatgtcacacctaacaccagacaaacggccagcccagctctgcaggctcctactccaggtcctgacttctggctccttgccatctcctttccaccttaaggtcccagaggcctgttctctagaatgaggttagaatttgttattaaagcataggagttcaggttcaaggaccccatagacaaactgatacctgaaatgaggctctgaaggttctctctcttgggatagaatatatctcagagctcggggaagattgagaccccaggttagaatcaggtcatttgtgagcccaagtcccagctggacaggtggcacattcaatggggtcatttgacgggagtttaaaaaagggttatttttcaaagggtatggagaaaccacgagggagaatacagaaccctaggggctcacggaggcactggtaacagaaggtgctgtcaccagtccagttggaataggggaggggagcagaactgttggtgcctagagagagagtcatgtgcagggagctgcttgacaggagctgagcttttcaacagagggaggcagccagacctggagaaaccacagacatggaacctagcaaataagtaccctgagctcactctcctcccttcctcccatcaccacttggccaaacctaactgggcaccacagggcaagagaaccctactgctgtgttcccgtggatcagcttgcagggcacagagccaggtggttctgatggaataactggctcacacagcctcattgtgaaactgggaggcagctcaatgggggccagtcttgag

SEQ ID NO: 33437 - DNA, 1534 bp, Bovine  19866880999896
ttcttctgtgattcttgcctctcttcttaatatcttctgcttctgtcaggcctaccatttctgtcctttatcaagcccatctttgcatgaaacgttcccttggtatctctgattttcttgaagagatctctagtcgttcccattctgttattttcttctgtttctttgcattgatcgctgaagaaggctttcttatctcttcttgctattctttggaactctgcattcagttgtttatatctttccttttctcctttgcttttcgcttcgtttcttttcacagctatttgtaaggcctccccagacagccattttgcttttttgcatttcttttccatggggatggtcttgatcactgtctcctgtacaatgtcacgaacctcattccatagttcatcaggcagtcttatcagatctaggcccttaaatctatttctcacttccactgtataatcataagggatttgatttaggtcatacctgaatggtctagtggttttccctactgaacggccgagaggagctaccccgcgtccgaggtcaggggtagtggccgagaggagataacccggcgtttgaggtcaggggtggcagccgggaggagataccccatgccccaagcctgaggccaggcgccacgggcggggaggagctaccccacgcccctaagcccgaggccaagggtggcgggctggaggacctaccccaggcccgaggccaggggcggtggccaggaggaccaaccccacgtccaaggagccgtggctgcacgggcgcaggagggcctagaggagctgtcctagcacataaattagtaaatttcttgtcctgagatggtttttgtgatcatttttaaagttagaccagaattcacttctcttgtttctggtgtttacatactttttccctcccattcttaaaacttaccagactcatctttctgaactaagatttgtaaatcatttcttcccattcatggccccctttcagaaatgtttaccagttcctctttctcctacagctcttcactggtcatctggagcttggcattcagtactcctcacattccgacgcagcttccctcctgttctactgttttactacacacgtccccattctgcttatctaagctggttccctaaacatgtatcatcgatctccttccttctacttttgcttgtatattcctcctatctaaacaccttaccttctcttcttctttagtcctgtcccttctgtaaacccagtataaattcagcttatcttttaaagcctaccttgactgttaggagtttctggatccttttattagtttcctttttattatgaattactgatttcacaaatttactctgtatttcctcagtgagattttaagtttttgggtcattctttaacacctatcctgggttagaaacacatactaatattttgtattgaatactgtttatttttatccttaggtttaccattgcttgttcagagaacaattgcgagaactattgtgttacaagaaagtattggcaaaggtcgt

SEQ ID NO: 33438 - DNA, 1156 bp, Bovine  19866881030255
cttcccttggaagatggaagactgcacagactgcttttctcattcagattttatgcctgagcaaaaccccttgtgctgtgatttattatagcaacactgatttttccaatttcaagacaacaatgcaacttgaaataaaacggaaagaaaacattgaaacatttgaaaccttcactttagatccttattacgtcttgcttgaactgttccaggcctgtatcattttctcctcctttctccagtctcccctcattccaactgactgccagagccacctttgtaaagccgaatctaagcatgccctctgtgattcagaacccacagaaaggttcctggtcccctccaccagtacttcctaaatgacattcctcatatatatgatgtaactatgcgacatcctgcaagtgaaaaaggagttccatggccaaaggagttttggaaatgctgacttaaaatatttattattggacttccctggtggtccacgggttaagaatctatacctgccaacacaggggacatgggttcgatccctggtctgggaagataccacattccacagagcaactaaacctgttcaccacaactataatactgaagcccgtgcgccctagagcctgtgttccacaacaggagacgccatcgtaatgggaaacccacatacctcaactagagaatagcccctgtttgctgccactagacacagcccatgcatagcaacaaagaaccaccacagccaaaaataaatatgtaaattatttattattgggactttcctagcggtccagtggataagactgctctcaagacaggggccccaggttcagtccctggtcaggaaaccaagatcccacatactgcagctactgagcccacgagccccagtgaagacctagtacagccaatatacatataaattaattaaatatttattattaaaaattaaagttaaaaacttctggttaaaaattgtaaactgtaggacttcacagagcctttaacatgctaaagcccattgtacttttccaagaggcagattcatcattttgggcatttcttaagacttttggaccatgaaatctccccagtctctttcatttgggggggtacctaatagaattagtattccatgatgtatactcaggggaggatgctg

SEQ ID NO: 33439 - DNA, 1452 bp, Bovine  19866881037564
ggaaaccaattctaaggcaaatgtggaaaggtacaaagatcatttcaacgtcctagaaatctcaggaagtgctctgcatgctaaatatttatcccaaaacttctggaccaagactgctaaccaactgcagaatgccccagcttataataatcataataatataatagcataataagaatttctaaatgttagcattcattgcattcattactcatacatcctttcatccagcaaatattttgagtgccattcatgtatcaggcacagtgctaagtactggagccacagaaaggaaagtggatgtgcctgccctcagggagtgcatatcataatgtgagagcccggcggaggcatagaccgagcacggaactcatgggaagagcattcaggggagtcttggctgagttctctttccaactatgatgagcatctatttctccatgcaccgcacctgcaccctggaggaatcttgagatcaggaaagttaacagctggggagtgactgctacaagacacagtgtttcttccaacatgatgaaactgttctataattaggtagtggtggtggctgcacgaccttgcaactatactaaaaatcaccgaatttcacaattgaaaggggtgcattttatggtacctgagttatatctcaaactttaaaaaagttaacagctactttcaacccacttgaaatatttagcaaattctcccacccacacacctggcccttcttacctgttctccttttagtcctggaaatccaggtacgccagtgtcaccttttggacctcttgggccctagaaggagttattggagagtatttggttgtttgttaaaattaaaatgctttaactaaacaaaggtttctttctttttcctccaaaagtaaaagaacacagagtgtcagtggaagtcacagttacgatgttttcctaattttaagtggtctggaaattgtggtctgggggaggaagacagcatcgagtgttaggagccctagaggccccatttctctttgaactatggtttcctccaatgggcatcactgaaacggccttgcctgctgcctctgctcacccatgggtccttggggctgtcctgcagcccacttgccccatcatccatcctccatgattcccaccccttctctggctccccactacctaaggaatgggatctagacaccctagtctgacatccaaagtaatcccagctggtcttggcacttcatcctccactcccgtcgctccaccaggggtgagcctgtccccttagcctctctgcacccacccccaacccccaccaatgcctccactattccctctgcagaaccaaattctgcacatccggtgagaggtgacctcgtctcaactccaacagacacttaagatctgcgacaatgactcacacagccagacgtctgtccccaaaaagagtttcaacacttttta

SEQ ID NO: 33440 - DNA, 911 bp, Bovine  19866881088196
aaaagtaaataaagagaaaaaatcccttattaagatataaaatattagattggggctcacctaaaaccattgggtgtgccaccaattcacataaaacataaccccatccacatgcaaactccttgctggtttgagaatcccatccttgaccctggcggacgatcctcaagatttccttgaatagctccagtgacggggaactcagtacttagcaagattgtgattcattcttgaataccttattactaaatatttcttctttattggttcatattagcctccctgaaagtcatactttgatctgagctttcttattttttaacaagtattaatatttgtgtgcttcttatgtaacaacttgagtgcttgttatcttactgtcttatggagggaagtaaggatgcagttacggttcagtgtgatagatctgatgggggtggggaggtgcacttggctcggactggaggtgtagggaggtgtttaggaaggcttatttgtgggggaatgagagagagcctggtatgctttggaaagtaaaaggctggagagtgagagtgagaaaggaggctagagtggtagaaaaaggtgatgcatgagctgactaagtgggtattgtaaccctcatgttccattagcacaaggacctacttcctgtagaacattttcacagttaagttctcatttcaaaaaaaaaaaagagccctggagagttgacaggacttattctttccatttcataggtaggaagactgaggtttaatggattgctggtgggcatgcagcttacactggaagagctgggtcttgattgttccatagtcacactgctttccttgtgtcctagccgcaggctcactggtccaggatgaccttctctgtccccctaagaagacttcacattctggaaagca

SEQ ID NO: 33441 - DNA, 1072 bp, Bovine  19866881091585
ctgttggagaaaagcctgggtgcgatgcagtccagggtccctggcagactacacgcaaggagagagaccatgcgacctgcgtggagggcccacctctccagccagggtcagttactcctgggcacatcctctctgcgaggataagatggaaccagcatgtatctgtgacaagggggtcccacaggaggggagggtgagggggtggttgtgctggcagtgaggaagggcacttggcctgctgcccccgtactgagaggcagcgggagcccctccactcgaggaggcagaatcctcccctccccaagtcagcagggtaggatccagctcaggactcagaggctgttaggtcagaagagccttccagcttctccctctctgggctaaaacttgggggtcccaggagagaccccttaccccttgagttagctaacgggaggccacaggttccagaggaaggcctgtcaaagtggcagagggtccaaggtcctagcaggtgctagctgggggttagtaatgttgacaagacccttgacctggagcttccacctacacaataagccaagacggtccctgcttgtctattctccttgtccacaggggcctgtttcctcctgagtcactcagtttccagctaagaggcacagataccattccaggatttgtgtggatggccaaggccttcctgcctggagactcctggaaggctggagccagaagaggcctcagggactagccagtcccagctgtgcccattctccccaatggccttcacttgggagaagtgaagacttgcctgaggctctgtggggagctctgggggcttgacagtggcttctgccttgaatacgcaagtgcttacacacaggggatgatctggattcccagccagaaaacccagcaggtttaaaacacttttcctaaaacaacccaccaggatcgctcagcagcatcactaggtcaaaggctgtgtacccattttttgcacgaagagtaacatcagctccttggtttagcagatatttgacaatctctttgttcctgtggaagaaagaaaaagcctgagtgagacctg

SEQ ID NO: 33442 - DNA, 1395 bp, Bovine  19866881111196
tctactttacattgaaatgtttctttcatcagtagctcagctgtttttttaagtacattgtttgttttcatttccatctttaaatggttaacttatgaatgatggatccaaaaactattagctgaatgaatctaagttgcttttcttttttcacaaggcatgttttttaaaccataaaattgggtttcaggcatcaaatgtggtctggtgacacagttcgagtaataataatagctaccatttattaaacgcctacctattctgtgccagacaccttggtatgcatcatcttaatcttcatgactgcctgaaaaataggtgttaggatcccagtttttcaaattatgagactgtggtccagatggattaaatgacgtgcctaatgatactcagcagaggcagcaacagggcccagacccaatctgtctgaccccagactcctacatttgcctctcctccacatgcgtctccttggagatgcccttataggacttataggaggaaagggtctttcaaaagtaaagaatgctactgatggtcaacatgagaaagaggtaggatgatttggctaggatcccccgctgaaggagagatgaagtcggttctcctttatcaggggagagagtctggcctggagacagtctggctaaacctttcaggagtcagtgccaaacctggggcaggggctggagaaggggacagggtggggggagcccagcagggcctgctcttcgtacagtctgaggacagtaggaggatggggatgtcgccatgctccatgtcgggctggacaggtcctaagtgtggataggcagaaaatttagctcataactgagaggtctccagaaggacacctccttccatttagaggtttcaaaaacactaagatcccttacaaagaggatcagagatggacaagaggcacagtttaggaacagagccttagacggggaagcatcctatcaagtgtctggtccaaccactcaccaaaccttaggggtaatggcgagttttggagtcgggctgaccaatcattagtggtacagttctgggaagtcactcaccttcctgagcttcagtttcctcacctctaaagagggaataaattattcctctttcacatcaaggttgttgtaaggattaaataataaaaacagctaatatatattgagtactcacatatgcaggggactcttccaggaacttcacatataattatctccctcattaagtaagatgatgcacagtactagtcacttattaggcaaacaactaataataatattaatagtaataataataccatcgaagatggcaagagcaatgcctcatgaggctcccactccattatttcattgatgggatttttgtacattatttcttaggctctaccta

SEQ ID NO: 33443 - DNA, 1496 bp, Bovine  19866881193320
tgtcttttcctattttatatttttgcctcctttgtcaagattaattgattgtaattgtatgtgggtttatttttaggcttcctgaggtcttaagattgaaggataaagggctggttccaagactgactacagacacaataagtaaatgtaacacacggtccttgactgggtcctaaaaggacattactggaccaattagcaaaattaaaaaataggtagtgtattagataatatactgtatcaatattatatttcctgaatttggtaggtatctgtggttatataagagaatctttttgttcttaggaaatacatgctatttagggatgaagaagggccatgatgtctgaaacttaactctcaaatggctcactaaaaatatatgtacagtttatattttttcattctctggttgtatttttctcctcttaccaccatctggctgattctctcctggagtttctcagctcactttcctcagagaaggacgctcgggttgaatcctctctaccacccctctgaggcagagcactttgcactaggaaagtgcataggtctctgacaagcctctggattggctgcctaagttcagagtgtctaccccttgtaaaatcagctctggcccagagtgcgtcatgtggtgcataacatggctgctaccactgcttcctccctggaggtggtgggcacgagggtctccttcaaggggtgtggcaggccccatgcttggtctagccaccagatactacatttccaactacccaagttaattccagagaaacccgaagcctcctgccctgactctgcctcattcttgccttcactcttttaacacatgctatgggtgaatgcctgctctgggccaggtcttatgctatgtcctatggcacagaagtgacccagtccctactctcttcgctctgattcaagtcggaaaggcataaaaaaactcagataactgaagtttagagctaatcacaaccaacaaacagaaagcagtcaatgctggctgagggtggagccccacggaacacaagagatggggttcaaaaggcctcctggatggtagtactggctgtggctcatgggatggaaatgggctatgaaacagggacctgcctgttaggagggtgtccggtgccatccctgggtttctgttttctcttcacacagccggacccagcaggacgggacatctccatccggcctctcctggagcactgtgagaacacccacatgaccatctggcttggcatcgtctatgcctataaggggcttctcatggtaggtgcagagctacaggcatagtaggggagatatttctctggcagagctccctctctaggggtctccgtcaacgtaaaagtaagcagaacccccaggactaagcccttgctctttgccactctcagtgctgggcacgtaccatttcaatcccacggcaaccatataagatacatacaaataatatccccatttcactgatgaggacgtcg

SEQ ID NO: 33444 - DNA, 945 bp, Bovine  19866881202731
ttatcttcccttctctgccactttctctactgttaaaagagaacaagtttttcagatattttcccttactaaacatctatttgtgtgttattttcccttccatcccattcaggcaaataaaatgtcattgtactgggtgaggtatctaatgcattgtttggggtctaagataagttttaaaatacaccagattcttttggtattatggagacatattagcatttatcctctaagctaattgtatatagtgatatttcaggagtgacatgatttgacctgtactgtcttcaaatctttgagacagtaaatttatatggacaattttctctaagatatgatatataattaaatcactaaaatagaatcagtagacatatcgaacattatttaatatatgagaaggttcactttgttcacataaaatgtaactcaagaatgtgaatattaaattcaggtttacctatgctctcctttcttctccctacagtgtcactcagatccttaaggagtatcccgttctttactatacaaggttcgtttgtttgaacacatattaaagcatcctgcttggtttgagggcaattcttaaaatagtgagaattttaataacgaattggcgttttcccttttagatttagagaactgttcaaagccaaattgggattacttggaaaaagcgagggtgatgatgatttaattgcatttctcttacatgtgagtttattatcgttttatctttttttcctgattaacatttgactgaatacactgtatattcttggaatgactgaggttgctaaatgtaattattttcattagctcatggaaaagacagaagctgactttacaatgacatttcggcagctcagtgagatcactcaaagccaattacaggaactagtcattcctcaggtatttattcatgcctttggctttttcttaact

SEQ ID NO: 33445 - DNA, 1239 bp, Bovine  19866881262288
tatccttgttatttttctatttggctatatttttcttgattttaaaatgtaatttgggggaattccttggcagtccaggggtcgggattccatgtttccactgcagagggcctggatgctatccctgcttggggaactgaaatcctgcaagatgcgcagtgtggcctaaaagaaaaagaaaaaaagaaatttgggtatatttcaggctattaattcagctattggctatttttaaagtatcaaaaatttacctgaattgtctatttatctaattaattgcttaagcatcaaaggaatgaggcctcttgaactcttctctctaagactttgctgctccgaggctttttctgatgcaggcaaaggcatccaagggcctgggtggtgtctctttgagtcctgtttgttcaacctaatgagtacattcagatgacgtttcaagacgtcttctctatccaggacatgccactggggcatccttgaaggtttctgcgacattcttaaagttgttgcgggtgggaagagtcagaccttcggcgaacagacacagtattgcctcaccaggaggtatatgaatgtagtttttaaacttctttgatatagtttattggtgatatttccatgtgtgtagataatagaggggatcaagatcagactgtttattcaatttgacattggggccaacacaagtccctatatattttttaggtgtacctcttataaatccctatcttttctatctcataaaactgttcatcaaccagaggaaagggggttggagaacactggcaatgtgcctgtttacctcacttctgtgggtaaagtccttggagtgggacaccccggtagcttaggcctgaaaggtgacctcattctccctgtctttgcaagcaccatgctgaagtcattgctaccacactatgtccgggaccattcatcactgttccccggtgaagccggcgccaatctccctcaggcaaaacaatgacagcagaaacagacactttcacaattgtctgagaaaagctaatagttgttcttaaagcaggtctccaattattcagggcagaatttcttccgctgtaaagcggacactgaaaactgattgattactcatgctctgaggtcaagtttatcttgagaggctaaaagtttctgagaaaacaagttttatatgaagagtcccaattactgacaggttgtaccccacatatttttgagaaggcagttgttggaacgtgg

SEQ ID NO: 33446 - DNA, 2895 bp, Bovine  19866881423467
tgtaataatatcctcccttttctccctgagaatatatagtatttacttagagtcctgattagtttgtgttcttagctctgtttcctcaggagacattccatgattgatgctgttctctttcagagtgtgcttttgctcagatgtgtagggtttcttgcttgtgtgtttatgctttagaaatcggaatccctctttaatctgttttctgcctctgtttatacaaagtactggcgagttgggtggtagctacttctgcaggttttaggacaggaggactaggatgtgcctcaacagctgctcttaggtgtttggggtacccttggacctcccagagtctgctagccacctggggctctgccatatcccattgtttcaataaacagctcttattgtttttgtagtgaaaatggaaggtgaggggagagggccagggctccatggctatctagctccggaatgtcaacttctatctagcagagccatagtctgctcttggcttccactcctcccttacctgatatttttctccctgtggtttgtctccatggctgaagcctctggcttcagctttcccgtgttttctcgttggcattcttcactgtttcaggttcaagtgtcactcaccatcttagttttgagcatgactgtttaactatccactctgtcacttctgtggatttgatatagaaaggggaagaggggtttgggagaaggcgcagccttagactgtggctttgttatggtgtcgagagccttctgtgtggccatgcggtttctggcttcttctcttgagcgtgcttggggtggtctccttggaggttctcctgctgggagcccccagctgcagtcctctgatgcagggcagtgtatcctgtggctgaccacgcctgaccatcagctcccattggtcctcccctctgctttgaactcacagctggctctttacctcgggatccacatctaaccccctagaaaacctcttccatggcccccattggtggtggacacataagctgttttagagaccctcccactcaattctggggctattccagccagcttttgctctttagatttttccagaagagagtcagccattatatacatatctccaaaagcctagggaatacatatcaaattcttgaagccccttttcttggcttcaaggaggagaggcacccctttacttccatctggggaaggtggggagagggtccactcagtacactgacagctttccagggaaatccttcctttacaatctttccctggttcatcttcaacttctgcttttcagtcttgaggtaggtaatgaactaatggttgaaaaatgggtttcacaagctttcagcatgacctgcctggcaaactcacaattactgtattgggctcgggtttgagacatcagtcaaaactgcacaggaagagtcccattttaacatcctgttacttatgtgtctgtaatcctgcattttcttctaaacgtacctaatggaagatatattattatattatatataatcagccatcatttttttttcagggagctagaggacctaatggctcagttggtgaaaaggtaaaagatgaaaaagaaaaattttctcttccttcttcctgtctctctgggtttagtataattgaactgttgggctgaagtacgaaacatgtaaatgtcatggatcagagaaaaacatctggatggaactgcttggggaaggcggaacatctggagctggaggagactgaatagcctgccaggttctctcctctgtcactccctccacccaaacgcattcagtgagtgccgtcagcttatctccaagtaaaatgtcagttggcaagacggctgtttctgtaccattaagcagcaccaatcagagaatccatccatctaatgaaattcaaagaacaatttttctgactcaggtgtgaatgttgttccttccatgaatgaacccaagactagatagtcagcctgtcctcttcctcacagggtgatcctggcaacagaggcttaccaggacccccagggaaaactggacaagttggtgctcctggggtcatgggacccccagggcctcctggaccccctgggcccccaggccctggatgcacaacaggacttggatttgaggtattttccttcatccctgtggttaaagagcaatgtgcattacagataactggaaaggccagctaactggatgccatggtgctgctggttccctgctgagccccagcttccagcaccatacctggcacaaggaggtgtctgggagtcagatctgaaattcttcttcttccttccctaggataccgagggctcaggaagcatcaggcacttacacgagcccatctctgggccaacggcttcaagtgtaggttgacttttgaaaccttcactttgaggattgtcatgctgtcatgctggagcagggaagctgtggggtgccgtcctgctctgttactttcaataattcatactctctgagcctccagcttccagctgtgcggtggggagaccaggtgctctttatagcttgtttctttgaggaacagcatagtggttttgcacaagatataatatgggaaaacttgaaaattacctttctctctctctccacagtccctaaccatcaagcatctctacttcattgcctcctttctgctgccctttcaagactcacactttgccccatttcagaatcccatgctcctaacaggtacccctgcccgctacctcttcccccagggaggtgtggtccatcttctactatgatatttctctcaagaccagtccctaggatctcattatgtttgtcaagtggtacccagagctgagcacactggtacaggaggagctgagccccacagaggagagcatcactgccc

SEQ ID NO: 33447 - DNA, 1365 bp, Bovine  19866881774620
tacctgacacacagcaaatcgttactatttgttgaataaatgaataatgcacccaaactacccacatgtgaaaatccagcaaagagggaatgattcattttttgccaactcttaactgtggacctaattttcaccttgatcatactgttttcaaccaaatagttttagaacaacttgttttcagccaaatggactggcacagttctgggggcacttcccaaccattatacagctcctcacctgacacctgaatcccttatttatttagaaagcacatctaattccctagacaaaatttgccccatcacagccacacctttactgcaaggtgcttgctggaaaggctgcctgccagcccggcagctggcataatcatgaggttggtaataccagggctcaggaagactacaattagttcttgacaagcactttatggcctgcaatttaaacatctatgccattgtaattcagttccttgatgaggcaaacatgatactaacctcatctggagaattggatgaaatgcctcctcgcactgatggcgcctaattagtgcacaagggaaggtaaggctctgcagcctccccacctctgaattttgagagtgcttccctataacatccttctagaaattcaggacagtgaatgtatatctactaactctcacacacattgactaaacattgactgcagggggagagaggaggattgaatggttttagcttgtcgtttctccatagggtctcaatacagctggggatggatgattttagatgattttgaggacaaagcccactcacaaagtgtctacagtctagctgaagatatgcagtcacccactgggcctgctgaaataaatccttgaaatgcaaacagttcatacagaagatgttgaaaacacatttaataaaattcacttaaatttctgacttaaaaccataaaacccaatcctcctagtaaatgagaaagaaggtacctccagaacacaccaaagcctggcacaaaccacagccagcatgcccagcaacagtgaaacacaccatcaaacaagaatgcctgtgttcacaacatctacctggttctgctctcacagtttatgacaattcaatctgtggacaaagaagccacataaaaatattgaaaaaggaagaggtataagtattgttacttgcagaaaaggatgactgtctacttggaaaatccatggggaactatttggaccaatgagaatgctcaagtaggtggctggttatgaaatattcacaaaccaaagctttctacttaccagcaataattagttagaaaatatggtgacgaaggggagccattataaaataaaaggatatcgctcacaatacaacaaa

SEQ ID NO: 33448 - DNA, 1697 bp, Bovine  19866880418408
tcaaaagcatcaattcttcagtgctcagctttctttatagtccaactctcacatccatacatgactactggaaataccatagctttgactagatgtacctttgttggcaaagtaatgtctctgctttttaatatgctgtctaccacagcaaagagaactgtaaatgttgaagtgataatgaaaagagtaaaatcctgttcttgaaaacattgtttcccatagaatttttcagaatctctccctctacctttttttctacactaaacctttaccaacattcagttttatttataatattacaaaatgtcaggaaacatcttctaacatttcttgagatgaaatatgggcttataatatgttaatagaatttaaaatatgacatctcagttattattttctaattttttaaaatttcaactctacaattcagtgacatgatgcatccaataatcctttatagagtaggattaacaattaggcaaaatttacaacatcatatatatgggaaaacatattccaagtactgaatgaccaatttacaaacaaacttttggaacccaatctattcctatgttaagaactgtctgtacttatgaactcgtcaacacattggttagggttgttagcaaaataacaaaattggctcatttaactattccatttcacttattcatttgtccatcctttcatgcatgcatgcattcagcaaatatttattgagtacctactttagcaggacactgggctaggagtgagataacggggacacagaattgaataatacatggtcctgccagcgggaaacctgttagtggagcaaacaaagcaacaattctgatacagtatgaagaaaaaaggaagagaggaaggaaaggaagggaggaaggagggaaaggaaaaggggaagacattctaataagagttgtcaaggcctcagggacaaaaagaaagttcagtgtgggcaaggaactgcaaggaagtcaacattgtgaattgtgcagttgacaactagaataggcaagatataaggctggatctctggtcatgaaggaactaacagagtattggacgggggagcctggtgggctgccgtctatggggtcgcacagagtcagacacgactgaagtgacttagcagcagcagcagaccttattctgttgtctcatgttggcagaactttgatgatggacttaagcctgcaaacaaaatgttcagatttatactttggttagctcattccagtaaccctgtacaacttgggtcagcaaactgcagcctgcaagatatttgtatgatctgtgtactaagaagaatatttatatttttaaggttttaaaaaagccaaagaaaagtatcttgtaacacatgaaaattatataaattcagatttccctgtctataagtaaagttttattggaacacagccacaatcatctatttacatagtatcaatgacttctattacaaagctgacttaaagcagttggaaaagaccatataacctataaagcctatatgttactctctggccctttacagagaagtctgctgacccttggtatagaacatagataaagaaaggaagaccagttgaaaatgacatggggttgaattagggtaagtggtacaaataagcaaagcatgtgaatgaaattaaaggtcatgtcagaaacaacctcaggttttctgttttgaa

SEQ ID NO: 33449 - DNA, 2526 bp, Bovine  19866880437336
tcggctcttagtgagtgctgtgtctctggctcgtgagaggggtggccatgagacaagtaaaaggaatccccctttggctcgacattcttttgggattcggtattagggaaaagtttaccttaaagaactgagaaggttctttcatcacataataaaaatcgaataactcatgatcatttccctttctgcctttcctgtcaggaatctcagagtcaactaaaaagataacttttatgtgtgattatcaagcaatatatatgttcattacaattatctaaaggaaaaaatataaagatgaaaacaaaaatcacttcgtgtcatcagctattgttaatattctggtgaatattattcccataatacactacaactcagaaaccaatgaactagctcatatttagtttcagtctcttaaaaaaagagcaaacaatgatgcaaatatataagcttgctaagtatattatttgattataaaatgttcctattctatttttgagctctatacattattttgataaacaattataatgattattcatgataataatggtagttaaaaaaaaaaaagaaaactaccaatctaggtatttaagtaacctgtgcaagcacctgctccatgacctaatggaagatgtattttcagatatattgtcctttgctcgacatccaatttaagcatcccccagtccctaaggtgctgacaagtgacagatccgcagggtggctgccgaactgtcctcgggtgtgtgtctcctgccctctcaggattttcttccagcagtgaaacaaattaaatctatgtgaggaattgtttccagcatatgttaatgtgtcttaatttgtcttaatgatttggccacgggctggtgcctctgcttttattccaggtcccagatggcaataaaaggcttcataataatgagattcttggtggaaatactttaaatacagcccccaaagtagtcagctcctggctgttgccagtacaggaactctcttgcagttactttcaagaagaactttgttcaccatttctcaaatctactgaggtcctacagatctcctggatatatcagaaatgcattcaaattaacagtcatacttctccacatctctagagctacccctctacctttctagccaccactgattgagggcaaaggcggcaccgaaatccagactctcaacatctcgaggatgttgaggatggggtggggtgtggctgccataaagggagggaacatatgcagggagacattccaatatttgaaaacctctacaacaggaacattactgaactgaacatgaatataaaatgtctggatggatagtctagccacccagttgccagtaataacaatgataatgatgattattataatgaaaatgacaatggatactgtgtattgagcaatgactgagggttgtatcatctcctttgatgttcactataaccccaccaggtcggcatgattactcccattttacagagaaaactgtggctcagaaaggctaagtaacacaccggggtcctacagctgccgagcagtggagctggtttgacccccaaaggccagatcttaaccactatgtatgtcacactgggtctatccatgtgctactaaattctagaccactgctgcccagtagaccttcctgtggtattagaaatgttctctgtgctgtccactgcagtagtcaccagctaccgagggctaggaagcagttgacatgtggctactgtgactactgctttcaaattttgtttaatctcaacttaaacagccacatgtggctaatggctaccatactggacatcgacacaatctccaagcctcaccagagtgtccagcatttcatgtgtgctcaacaatgttgaatgaacagattcaagcttaactccattacaataaaccaggtaaacgatgaagataaaccagataagccatcatctcctggtgtgcttttccttccccatgctgaccatagcgctctgaagactgaggcttattcttttctggatcctcagtgcattaaggtgctttgtgaattttgtactaaatgtttccatgtgacagaaaaagctacacttcttatgtgtgtatgtgtgctcagtcatgtctgactctgtgatctcatggactgcaggctgccaggcttctctgtccatggaattttccaggcaagaatactggagtgggttgtcatttctctctccaggtgatcttcccgacccagggatcgaacccgcatctcttgcacctcctgcactggcaggcgggttctttaccactgtgccacctggaagcccactgcacttcttatggctccttacaaagtgagcccatctcaaagatctcctgtgtgagagatttaggaatttggcaggttaatctccctaaaaaccactcacacagggcagtttggtatggttcccagagtggcaaacaagaacgcttttcactcataacagacctccatgtgagaacacatttagcattttcggtttctcttttttttttctca

SEQ ID NO: 33450 - DNA, 2187 bp, Bovine  19866880524294
tcgttttgtttttgtttttactacctagattctgcatgtcccaactagtcactgcttttgtctttttttatctttgctttcttggtatcttattatcttacggttgtaagattacatttttcagattttggatatgatgctgtacaattcatgcagatccttcaactgttattcagataaataacaagttaaaagaatacagtctataataagtaagagaaatacatatacaaagaactgaaaaatagttttctctattggagaaaaacgataggattgggattgatgaaagtaaagacttctcagaggagggaacatctgagttagattttgaggaccatataggagctttcctgtagataaagggaggcaaggcagcagccacagcatgtacgaagccagagtcgggaagtagtgtgatatgtcctaagaattataagcagtgacaatactgctggagtgaaaatgctactggggagtataatgtgtcaatttagtaaatatatgttaagctttttaagtgacattttgagacttttttctattggtgtttttctcccaaagtatttagaatatcattcatccttatgtcagtataatggatactactatagtttttgtttttcttttttgtagtttactcatacattaatttttctcatactattttaaaaaatgaaataagcttgttactctgtttaattcaagaatagtttctgaagaagtaaagtttatttttgcacatattatcattccagcattatttattatagaaacaaatagaaaaactatggtcatcctcaagagttgattttgtctccatttaaataggtagtttaaaatctttaacatttagtgacaccctttttcacagcccttacaagtgtcactaaccctttcatatattctctttcctttaaaagagaccaaaatggataggaattttgtgcctgagtaagtcacagtgctgccatggagaagtaaacaggagaagcagtgatctctctgaatagttgatagagttgaaaatattccctcttcagaagtgtaacaaagctaaggcaaaattgctgtgtaggatttattttatgacatcaggtataagaaataaggattgtactttctttacatctgacccctagaagttattaaattctttaactttagtttgagaagaagtttaaagtcacttaaataatcattatgtttctcagaatttaaaatgacctagtcactgtatccaaagtgttggggaaatatctataaagcttgtaaaactctatgagaaaatgctaaaatgctattttccaatttttttaatgaggaaaaaatcatttatttttaattgatttccttgtgttactgtgtatttctcagtaagacatttgtcctcagttttgtttttacttatgttctgatgtggaactttaacatacagaagttcattttgtgtctagagaaaggatttattgctgaactattgaggtagccttgtaaaatttctatgatgattctcggataacattcttggttggatgagtctaaataaagctcagcactttgctggttctgtgattacttgagtggtatcaactttttgaccaaatttcttactaatttgggtaaagatgacagtacacctttagtagcatttggattagtttggtattttgaagcaaaatggcagcatttccaaatatacttaaccaactttaaaaagagtttattttctgtgtctaaacagtgatcatgattagatggttaacataactaaaatggttaaactatatttacttttataacactgactggattggttttgcatgcagtattttactatatcagacatattttagtaaattagagaaaatgtaatttttctaaatctaagtctttgttggctcagtgtagtttacttttgaaaagtaaaggtttgaaaagaaaggttttgctttcttttccatctttccaaaagaaaaatttatagtctatgaataaataatactgaatctcctgaaattatctgtacttaacttgagcctagaatgaccgaccagacatgtctatttgcctgggactttgggctttccctagatacagggcttttatagctttaaaccaatcactctactttatcctgacaaattatttgaaataaaatttactggggaattctaaaagctattt

SEQ ID NO: 33451 - DNA, 918 bp, Bovine  19866880653481
catccagtgcatttcctctataatatcctccagcttcacaggcacatgtttgcacttttctgttgttaaaattgcagacaagagtaattttgatttattggtgacatctaatatagctgtgtttatattgttgccaataaaatgacttacacgattggtttttgtttatacaatcttttctgaggagtcagtcacctgtgttaggacaaggtacattctgcttattaaaatgaactcctaggatctaagaacactcagctctatctgtccttgattgaattgcaaaatgtgctttacactgcagccgtgcatgagaataacttatattacctatcaataggcttttcatttctatattcttctggctacaaagctgtaactagagaaacccatgggaatagcacggacctattagtgatcaaggcagcaatgttgaaaaggcaacgttaatgaaattatacaatcattaacccaaaggggaaaaataaaaggaatcaataaaaactctattttagatggtttatatgtatatataagaagtcagctcaggggcgatttgtttgctgaccagtgttttgtgtctcattatcaggttttctgtgcagggtaagaaatgcttgtggcataaaaggaatggaaaatgtaacaaaggctaaatgtagcctaaggaaatgaaatgatgtatgaaaattaataattaactggctcatcagatgaattatgactctagatgagtctattaataatattaagtaagaaagggcttttggatgtaaatggacattatggaactaatatttttggaattctcttgaagatatgagttaacattgctttttaaaatcttttaacctacaaggcacagtgcctcgagcgttgggtaaaaggtaaaagtatgatcttgtattttgattaaag

SEQ ID NO: 33452 - DNA, 1354 bp, Bovine  19866880704019
tggatgtgagatttgaaccataaagaaggctgagtgccaaagaattgatgtttttgaattgtggtgctggagaagactcttgagagtctgttggactgcaaagagatcaaactgttgctgaaagagggaccgctttcagagcttgaaagtgggctcatgtctaacactcagaaatgaattgtctgaggagacacatgtgcagacaaagcaatatattttattgggaaggggcacctgggcggagagcaggagggtaagggaacccaggagaactgctcttccacatgactcgcagtctcaggttttatggtgatgggattagtttctggattgtctttggccaatcctctgactcagagtccttcctggtggagcacgcattgctcatgagaagaattctgggagtggttggacacctggtgtcaccttttgacctttcctgaactcttccggttggtggtggcttattagttccatgttccttaccaggacctcctatcataaaacaactcatgcaaatggttactgtggtgcttggtcagggcaggtggcttcagtcagtgtgttttccctgacaaaaccagtcaatcctagagtaaatcaactttgaatattcactggaaggactgatactaaagccaaagctccaatgctttggccaaatgatgtgaagagtcgactcgttgaaaaagaccctgatctggggaagattgagagtcagagaagggggcaacagaggatgagatggttggatggcatcatgaactcaacgtttgagcaaactctggagatagtgaaggacagggaagcctggcatgctgcagtccatggagctgcattggacatgacttagtgactgaacgacagcagctaggagcactcggctaaaacaggataaacaggggcccacttctataactggagagccatttaccattcagtacttccctcttcatcgaaacttaagactctgaacacagtaattttgtggtcagtcaatatgaagaaaggacagattatccaggatatctacttttttggagaaaaatgctcaaatggagaaaatcaaggcctgatgttacctgagatgggttataatagacctttgaaggccccttttagatacataaatccagaattattttcagccattttaatgggttattaatgcaactagagaattggaattcagaaatgttaaaatatagccaggtctgagcttgtatggaaactgcttttggaaaacatgtagtactcaacctgttagtaattaagggttaatttctaaacagcttctgctaaagtaagcattctatatcaccttaaaaataacataataaatagctcatgataa

SEQ ID NO: 33453 - DNA, 840 bp, Bovine  19866880799188
gctgatgacttgtgttggcattggcttctccaaccttagcaagaccctcaagtgacattgtcagaagatgaaaggcccaaaggcttctagacaacgcagaagctgccaaggaaccaaagggaccagattcatccaggactttccaacttcccgcttgaaaacaatcaggatatccgaacaaaaaatgtctctctacctgtggttttcagccatttttccggggcagacattcctcaggaggcccagtcacaacgggagctccctcggcttacctggatgaagagtgtgccttcgggacacagttgtactgctgcagcatcacagctgcgttttagcactgcttcctgagcccacatcctcgggcttccgctgtatggctattttctagacctttggagtttgttacagttgcttctgcaaggactgaccctcctgaatcttggtttctgtgtcgggattaaatgagatactatgaattggaagccctttatgaataatgtcatgtaatgcaaatgtcagaaattggtgtgttagactattttatcccttgtcttatgaatggactactatcttggagatacactgctccccatctggttcattgtatgtggattttggggggaatgaatgcctagggactgcaagaatccaactaaagttattgaatattttccatatctcgggtgtgctatgcatgttctcatttaattctcccaatagcccagtgatgtagatttgattatccccacaagagaaattcaaaaaggatattttgttccttttgaaatttgataatatagagatattagctctcctgatttcaagatctaagtatcagag

SEQ ID NO: 33454 - DNA, 981 bp, Bovine  19866880864089
aaaaatgagagacgtttgccttttcaagggtgctcgacagctattggtttctccagagaggattactgctggagacagttatgaagagaacaagtaactcttttaaatgaccaacatgttcttgcttaaatatttcccagaacaattctaaagaaatataatccaggtaagttttgttatgttctcattgtgaattatgtttacaggaaacaaaaataggattcgaatcctagaggaggaaaatcaggcttttttgtacctgtggcttatgttttatgtgtcatgaattgtaaccatttataaaattatctggtttcttgcccctactcatggttgattttttccctctttttccacctagagagctttgaattatttttattcataagtgaaaaatgtgttacagctttatttccttttattaatagttccttcttgcccttaaccacatctctgactttttggcatgtaaagtccaatgagctcatgcttaatcatgtataaacagccatctaattatatggttttgaattttcatttgaccggctaaacaaaaatgacacagaaaagagaaacctgacaaccttcctgtctttgggtacctggcctttctctccctcactttctcttcatgcatttagtaaaatgcacgttaaaacttatcaaaaaatcagtttgtacttgccaagtttctgaggtaaatttgttcttttcaaggctacgtgtcaaaaaacaagtcagttaagctgaattattgtctttacaaatttctttcggactccagtctttcctcctctaagagggaggtgttactagaattccttgatgctactggtgtcagatgacagagaagccagtattcacaggacaagatttctcaatcctcatctccttaccttcactgaagaccaataacaagggatccctgttgccatatcttcccaccctccccaagattactctgattgacacatttttgaa

SEQ ID NO: 33455 - DNA, 1525 bp, Bovine  19866880877936
ctatgtttggggcaggtttcatggagttagaattttgaaatattaaaagatctgggtaattgctcagaagagaggtgggctgctaggcaaaggccatttgttggaagttttgttcttattaagtgttcaagaagagagctctccattcatattattgccttagggaataggacatagaattgctttctgaaaaaattttgataactgtcttagaacactgagatatctaaggacttaaggaatgtgcctgcatggaattatgctcaaatttaaatcaagtcatatttaggtgtattttaagaaaaataaggaacagctcttaacaatggaacaaatgaacatgttttactataggcagccctcaaaccaaatagtataatttcaaatgcaaaacatatataggtgtgtaaaatacttcctacctgctattcactgcttgactggtttgatctcctttcttgatctctcaaaccagtcaatcctaaaggaaatcaaccctgaatattcattggaaggactgatgctgaagctgaagctccagtactttggccacctgatgcaaaaatctgattcactggaaaagaccctgatgctaggaaagattgaaggcaataggaaaagggagtgacagaggatgagatggttagatagcatcacccactcaatggacatgaatttgagccaactccgggagatagtaagggacaggggaagccctgcatgctgcagcccgtggggttacaaagagtcggacactgagtgactgaacaaattcactgcttacaaatctgaaatgctctggtatgacagtgaccaggcaaatgcaccatttaagaatgttatataaaccacctcaacctcagggtgtaaagcaaagtcagttgtctttgccttatatatgacatgactactgatttgacttgggtctgaaagcaattcctgaatctccctggggaaaggactaaaaggcccttgacatcctatcaccaggagttatctgcagggagagctacatgctgtgggtgtgctgagaaaataattgaaagcattcatggggaattaaaaagcagatggttcagaaactactttgggacttgcaaaggacttcagcccaaatataaggatctggacagagaaaagaaaatctgtgttaggggcaactggacttaaattcttgctgtgtttgtcaatggtaaacattacttcactggatgaaaacaccagattgacaatggtgtaatctctcacctaatactgtgcatttcagagtcgagatgttttcttgctaatctcatgcttgtaggaaacagtgttcctggcttccattttgtgaaaagaagtaagaggaacagatgggatgagaatacttctattttccctcagttcttttgcaacaggttgctttataacagctggaagtagtaagtgggctcatcctgggaaagacagacattctatacaatatttaaaatttttttgtcagaaaaaagactgtaaaaagccaataaaagcacatattaaaaag

SEQ ID NO: 33456 - DNA, 810 bp, Bovine  19866880902591
ccagtccatctgacaagcaggtttcagagactcctagagcacagaggtaatttttcctgggtattttccaagagcaggttgttccccccccccactactggtcaacaggtgaaggccactgggctcactgtcatctgcccatttgatcccaattgcctggaacttgtcaggttgcctggcactgccccttaaaatacagcccttcttagcaggtccccctctagagcctgctagagcatggcagtgagaggagtcacaatgagctccctctggcagctccacagaccaaaccatgccagagggtcctgcctcctgctccaccaagccactcagacactggaatcacctacctttggggtctaaggagttgatctgcaagctgaggggatggaagatctgggggtaggaagagaatctgctcaatggggccccctgaagtcactacacggcagcttttagatgtattggtggtacttcttctgccaaagagcaactttcccaaagccccactgacctctgctccaggaattaagttattaaactccattataaggcaacaggaaacaagagagccaggcaggctgcactctcatgagacaggggccccaggccaagttcagccaagaactaactataagcaggtgactgacctctttttcatctgaaaagtaaggatatcacttgtttttaccatattccaaatgtgttctgcggctcaaagagcatagtaagctggcagggctttgcagcatttaaaccactccccagatgtaaatacagcggcatgtgttgtgcggctcctagagagca

SEQ ID NO: 33457 - DNA, 1019 bp, Bovine  19866880960221
tatatgttgctctaaaatggtaaatctccaatgaagaatggcctcttacctaaagatgcatacaaatacaaactgtgaaccagaagtcattttaaagtgcaggagagtatatacatcatactctctaataataagtatttttgttccatttttcttttttttttaaattttttaaattttattttatttttaaactttacacaattgtattagttttgccaaatccatttttctaatgcaagttactacaaaggttcagggcctgtgaaagaatcctcatagggttaaaacgctgcactttatttttcatgagtaacacacacctttgagttacaacccataatgtgtttcagtttaaaagataacaagttattttcatgcatgactgcacttccttaaggagtgaaaatgggctgttactaaaatgtcaacacaattgtcccccttgaagcttagtttatcttgaagtatttttacattttcagcacttctttgtgtttgttttccaagagcattaagatccagccatggttaattttcagaattaaaaaaaaacaaaaaaaaaaaaaccaaaaaacttaccctcagtcattctgaataaaatgaggaaaacaggcgggggtgggtgactggagttttggtcctcaataatgaaaatctggggcccaatatcttctgtagttctttgcatttctccatgaaaaaaattagttgcactgttgttcagtggaaaatgctttcatgacctaaatccacaggccacagttttctagcaaggcacaggccctggcagggtcacttggaaggctgcatttgctgactgaggttaactagaaaatgggagaggggcggcagctaatccctgcctgcttgcctatgagtagaaggggctagttcttctttttctttcctcctaatgtctgggccaaggaaccacccaccactgccccccctccaccccgcttcttctctctctccatcaggaagggcatcattccatattccatctgtattaggaa

SEQ ID NO: 33458 - DNA, 1159 bp, Bovine  19866880965864
ttctggaacagtgtatctgggagttcctttgtgactgatagacactcttaaggagtgaagttttagtctctcttatttgaaagaaatggggagatctatagagttctacattgttcttgattttatcacaattctttgtcatgtgtggcacggtagttttagttctattccccttgaaaattcttaattaaaacaaaaaaattaggagtgtgtggcagagctctggccaactgtgtaaagaatgaaggccttatgacaggtgctttagtgagcagttcaggctatacagtgcctagcacagccaccttatagagatggttcctagatagttgctttttttgattgattgacagaaaccttccaagcttctccttttctttctcttattagattctgatcaaaatgattttgtaagaaaagcatttatttcagactttctgctgcctaaacataatgtcttataatatcatgacacagctcatcaggccctccttgggttttgtctttgtctctacttctgaagaactggcccctcatgcattacagcttcctctgctagttctctcttctctttccttttcagattcagttgaattttgtctttgctaaccatgagtaatattcttctatttgtttgtatcttgagctctaaagatttattttcaggtgactttacacaggggcttggataagcctaatgtgaaaacttttcatgtggatactgggaaggtggctgggtctcaagagtagtttctggattggatgtcagaaggtatgggcttcttttatgcagtacaatgaattgctccttgactttgcttaaattacagtcccccagtttttccatttccccatcttcatagctatcttgaacagcaaacatagggcttcaaaggtgaaagggtaaccatcttggtagaaagtgttgttacacatacctgcaatccagggtggtctattgtgaacaacaacagaacaataatgtccttggaaatctttttctttgtaagaactgaatactcttgtagatgaagacctctttcagtgaggactaatagctagtttctgtaggtcatatggatgcttggatggtggtgcaaaaatgatccagaagaaagaaaggaagttgagaccaaaaccagaaggaattaaaatcaaa

SEQ ID NO: 33459 - DNA, 3002 bp, Bovine  19866881006766
gtttggctgtaacacagggttatttggaggaataagggacataagtctggaaaagtaagaaggctttgaacaccaggtttaaagtttagacatatagcaggaacagagagccattgttaagttgttgagaagtaaacacaaattttgtgtgccaaaaatctgtaaatttgttgtttgaaacccagactgttttctaacacagtgcaagcaattggagttaagagttccaggttggtccacaaaagcttgtttctcaggtgtttataacctgtatttgcaaggaataattattttactcaatcaacatgcccagaaaattattcagctatagagctatataaatgttgctttgattctcattgtcttaacctaaaataagctttcccaggaaaagttcctcagttaacatgtacagagatttatggccaactactaaaattcctggaaggggatgccatgataaaatatagattcaatttttttgccaactcatttggatgctgagaagtaatttgcatggaggtggaaccatgaagtcagaagcttatttagctgggccttcatttccagatccctaaaaagaactacttacccctaattgacacaaacctgttgggcttgtttttcagaacccatctgtgttgaaagcactgatttcagctgccgtctgtgcaggaatccctgcttccacctgctgctggagaaatctgttctggcattcaggtaagttctacctaaatagcaactgaaaggaagcctcaaatttgggagcacccaacaccagtgcctcattctgacatttcatgttaactaacagtcatttattcactcacacgccacaaatatttatgagtatctgctgtgtgccacatactgcactgataccagaggtagtagagacagcccatgagaatcacactgcaaacgagtgtttcactacagcattacaatttatcttatgggccgtacgtaggaaaagaggcatctaaaattgtctataggattgggaaaaagcttttctgaaaagatagtatctgagctgggatgtaaaatagaagctttagagagaattggaggacagcatctcatgtaaagaaatcagcaaataacaaaagcatttgattacagagcactgtgcatattcagtgaatatttgctaaggggcatgagtggatgaatacatggatgtgaagaaattctttggaaaccctgtattatcttctacccagtgatgtcagtgccttgaggtttaatttcaactctacctctagctctcagaagacagctttcctcattctgttaaaaattttaaatcttgacaatgaaagatcttcatcctaatgcacattttaagcactgaacacaaccccatactcagtgctaggatttcccattctaggagttctgaagctgcctcttacctagtgctccagaccccaatccagaatacaaactcttaaggacagttcagaaataccctgggctgataattgggttactaccaataaagtcactgagtcagcaggccacttggtttggttgctggtcaaactgcggagcctgaaatcttcttccttccgaatcatgcatgtgatgggatgtacaggctccaagaattagctggtagcagtttttttctcccttaaatttcttttaggagacatgagtcctactccagtacctggattcaggtaacaatcctatgtccagtcctccaactctcctgacacattttcaaggctctgttacccaaaagagccgtattcctaactgttactgcctgcttccagacccaaaggccagcagtcctgtaactccagccccaccccccacttacagtttgttcatttctgatatactgagacatttaatcttatgcttgtagtccacttatattttaaggtgaacgatacaaaatttctaaaattcaacagcttttacctatgagaactgcaatcacagaaagtcaacttaatatttttttgtggattttatttttttcatattttatccattgtgtctgcattttggagcagagggtatgtgtccaaatataatttatttttccaatttgaccagaagtcttgtctcttaaaatgaaattctcattcatgatgagttagaagttgactatcagaaaaataaataatgaagatgcagcattcttaaggtcaaaaagaaagatcaaaggaatgacatgtaacccaattaaggagactaaaatggaagggaataatgatggaagaggaaataccagggtttaaaaggggggcaagatgggattaaagaatcaagaggacgctgttagagaatacacttgtgaaacatgtttctagaggccagttcaagaaaagtgagtgtgaggtccaggaaaaggaatgctgctgctgctgctaagtcacttcagtcgtgtccgactgtgtgtgacccaatagacggcggcccaccaggctcccccgtccctgggattctcagacaggcaagaacactggagtgggttgccatttccttctccaatgcatgaaagtgaaattgaaagtgaagtcactcagtcatgtctgactcctagcgaccccgtggactgcagcctaccaggttcctccatccatgggattttccaggcaagagtactggagtggggtgccattgccttctccaggaaaaggaataataggcttaaatgttaagtgactgcaaagaaagcagatttgacctaaactctgggttgccctaggaattcagtcagaaagatcctttattccctgcaaaaagaaatagtttagctggcctaggttcaaagaggtaggttcaaagaaactcaaattacgtagatccatctcaggtcgacatgctcaattttgctttgtatatccctgtctcttgtttggctgtagagaggttctatccacagtaaaatcaaagtgacttgactccctacagctaggtaaggtactggtgattcaccacagagcatcagccctggaaagaattcagggttaaga

SEQ ID NO: 33460 - DNA, 703 bp, Bovine  19866881074067
gatagtggcgtggtccacgttgagtactgtgataagggctatgatactattgaccacagagtcaccaaggaggggaaggtcagctggacttgggaaggtgagggaaggcttccaggaggagggggagatttcactgagtcttagaggaggagtaagaatgcaagagcagaaggaagtgaaagcatgttagcatgcatagcaggagaagcaggtacggggcttggcagcatgacataactattctctgagctctgagatgtggactcagctactggcttagccaccaactttgacaagatatttgatttgctgagtctcctcttccccatgtgtctcttcactggagacatatattcctgtcctctctctcattggaccataatgaaagttgaatgatatcatgagtaaaaatgctatttgaaaaaaaaaaaaaaaaaatgaagagataatgtcatctgtgaacctgtttctctctcccatttacaggcttgcaatccactccattgtaattctcccactgatatatttcataattgtacgaaagaaccctttccagttcgccatgggaatggcccaggctcttctgacagctctcatgatctcctccaggtaaacagaagagggtgtctggtggaccaccacttccctggtggtccagtgtctaagacttcatgctcccaacgcaggggcccaggttcaattc

SEQ ID NO: 33461 - DNA, 1459 bp, Bovine  19866881108236
tatatttagtaagtatctactacaataatactttggggcacattaagcactacatgttattttaagctgtttaattttacacatttttggtttcctgttgcatgtagtaactcattcaatatatcttatacaatctatgtgtaggatttctgatatttctttccttttatgaaagaggaatctaagatacaggaaattcaaatatcttgcctcaagccacacaggtgggatatggagagccaaaatcttaattcacatgatggattttcagaacttatattctaccaagaacataaaagagatgagtaagaaagttccccccacacatcaactaagtatttagtggtatgtaaataattaaattgataattttgatataattgtcattgataattagactgcccactgcatataataaaagtctcagtactcagtagattctttaaaaaaaaaaaatgttggttaaatgaagaatgatttagtcttagcaaatagcttgcctggactattcatattcctcccttcccaaaataaaaccttatggatattttattaggttttatatttttttggctaaaatcatatgtatttgtatgctttgtgaaaaagcaacatacgtcaccctgtcactttgtaaaaaaaaagtacatagatcattcaattcaattcagtctctcagttgtgtctgacaccacgatcccatggactgcagcactccaggcttaccctgtccatcaccagctcccagagctttcacaaactcatgttaatccagtcagtgatgccatccaaccatctcatcctctgtcatccccttcttctcctgccttcaatctttcccagcatcagggtcttttccaatgagtcagttcttcgcatcaggtagccaaagtattggagcttcagcttcagcaccagtccttccaatgaatattcaggactgatttcctctaggattgactggtttgatctccttgctgtccaaaggattctcaagagtcttctccaacaccacagttcaaaagcatcaattcttcagcacacagctttttttatggggaaccatgttcacttataaattagcccttgaaactctcagaatcaacagaaaactaaactagttggttttctatggcagaattgagggtgattttatgttttcacatgttaacttctttttttattgctacagtagtaatatatttaaaattctgaagtcccttggaaacaaaacactgaactaacctaataggacattacttggattctttccttccttttctcttttatccaagcaaccctccacactcctaacacgtggaaatcattcaatctctgggtttttccaattctatttctaaacacagttctttggcttattatcacaaagccccagatatcattcagcaaataaatttactctggtaaacaccaatggccccttatggatttttcatct

SEQ ID NO: 33462 - DNA, 1473 bp, Bovine  19866881123373
cccagttctcactgcatttgccctgaggtttgggaccatccctggcaccttttcctgacatgacttcattacccacaatatggagattgaattacttccttgcctactcacactaagtatccacaggttgtgaaagttaatgtctatacagcactgtatgttctttgacccaaaggagctcaacaaatgcagagtcatatcatagtgatacattgcccctgtggtttagtgacttccttaatttaggagagaaggaaaaggtagttcaaaattaaaatgtttatgatatgttgaaatgttccttgtggatcctttgctaattgcctcaaattgaaattactggagagagtgggaaagagatggaagggaaagaatggattttacactttctttgcttctgtgccagtttctaccacacagagttttcatcaaacaaaaagtctaagacagagatggagtgaatttggacttaggattaagaagacttggagatctagtcttagtcgaatcacttattctctatgtgacctcggttgagtcgctaatcttctccaaacctcagtttcatacctgttaaatggggtgataataaatcttcctgcccccaccactgctgtgaagattaatttagatagtgtatgttaaggacgctacacattaagtacagtgtataagcgacacaaattcttactgctgtcacattgactaagaactttggaataaactcaattaaatcacttgaatcttcaccctcatcagattaatatactgatgattagtaaattaagttccatttctgcaaaacccaaaagaaaaaagtatttctgagccaacacaatcttaggcccatctagggatatgatttatacacgttgcaatacccccaggagcacatatatgaaacttagcatttcttcttacttctatttcttttttatctcccacaaagtaaaattccaactcttataaaacatataatacagtggataactcggacagtgtgaaagagacttctagaggtatgtaacaaattatcctggaaggtggggtgatgtatttggcatgttgcttcagaaaaaaataatatgattgaaaaccaaactctaccacgacaaatggtatatactaagtatgaacaatgattaaatatctggaaatctattcatgtaattcagtacactaacagaatcagaaatccaaccagattactgtctcagtagaggttaataaagctcttgacaagattcaatcccaaaatgataaaaatgtattaaaagcacattcattaaaatgagaagaaatacaagcaagtttgctatcatttcaccactaagaactcaactatgtatcaaaggtcctaaataaggtaattaagaaaacaaatgagatataaatattagaaaagaatatctagaagatctaggaaaatcaaatgaaaagaaataaaaggcaaatatttaaaagagtttaata

SEQ ID NO: 33463 - DNA, 1886 bp, Bovine  19866881188359
tttgtgggaataaaaaaggcatgtaagaaatttagtgactagggtagtgtgtagcttaaccaatcagccctggtgagcactaaggctggttaagatgggaggaaaaagatctgccagtgtaagcttcattttccgcacctggtctggtttctgatgtaagaatttgatttctattacaaatataaaaacagacaactaagtaagaataagaacaccacaacttttcatttttataccattttataccttttcaaaacatcctcttgtatagcatgtgtcattttattgttgcataatctagtatgaaaggcagaatgggcagtcttattatttccatttttcagttcacttcagttcagtcgctcagtcatgtctgactttttgcgaccccgtggactgcagcatgccaggcttccctgtccatcaccaactcctggagcttactcgaactcatgtccattgagttggcagactaggaacctgaggctcagagaagttatgtaagagaattgtccaggttagtaagttatacgacagaatcttctttatttttgttgttcagtcactaagtaatgtccagaacagacttccttatccttcactatatcccagagttgactcaaatttatgtccattgagttggtgatgctatctaaccatctcatcctctgtctttgctgctcagtcttctttatggttcaactctcacatctatacatgactgctggaaaaatcacagctttgactatatggacctttgtcagcaaagtgatgtctttgctttctaatatactatctagctttgtcataactttctttccaaagagcaagcgtcttttaatttcatggctgcgatcaccatcggtagcaattttgaatcccaagaaaataaaatctgtcactgcttccaccttttccccttctatgttccatgaagtgttgggacctgatgccttgatcttagttttttttatgtagagtttcaagccagttttatcacaccctaccgtggacataggtatccttactttgagctctgcgtgcaggtttgtttaatgtctttcagaagtgtgtgagaggtagcttggagagacaagtgaataagcttctaggagaaattaaaccacgagtctatctatatttgagtcaagatccctggaatttttatgtctcagctttgatcatggtttttttccctatgaagagaaagcaaaaagttgaagaagaataacactatagcaaggtattagaagaatttttcaacaactttgaaattaaattaagtttagagccatcctgatagttgtaaggtactattgtacagtatatatttggaagaaggaaatgttatgaggccttagttcacatccaattaatctctcagaataatttgtttactggattgtcttgctaaacccacgagttactttctgcagggtgagagttcatcagtgaagcaatttattatgtttctattacactgcatatcaatcctgctcatggaaaatgttaatggtgtcccttatatatcattcatcttccactcccccattcattattcccatcccccatcagtagttcttgtatcacagagggacatcttgttaggaatataccaaggtcagtgaatgacatagctctgtttgttgctgcagaatttttaaaaggcagtcattactcagaattgtaggaaggaattagcatttaagtaagaaagtattacaaagtcttagaagtggatcttttcatagcttcagtgagaaaattctgagaaatagaaatttgtttttattttcatatctcctaactgtaccagctcttccttctttaatcatacaatgccctgctgtgtagaagaatctgtgggcctctcactgtgatactga

SEQ ID NO: 33464 - DNA, 1374 bp, Bovine  19866881220071
tagaaatcgtgatgtggccttctatgaatccccagggcagctaacactaggaaagagtctctaaccggtcagcgaattgttttaacattcctaattatcagatgtggactgagcttcttattggaaattctctaattaacatattcctgctctgaacatgctcacagatctctgaaaattcaagaaacattggaaaaatgtaccaggagctctagctttaattgaaaatataataattagattgtgggatcctactttaaattgtagagccagattttctttggtgtctaacttatattctgatgatattatgtgctgagaattaataaagtttctggaaatctgttacaatttttaaaaactccatgactcagtatcgacccagaagtatagataggacccatatcattccacttttcttggatcctttgcctgagttgttggagaattaagtccttgtgttgtcatgcacatgaatggaatgttatttcatctggaatagctgagcttaacttttgaagttggttaagtggtatattaaagcgctgacaagtgccaggcaaaacgtcactctttgatttggacaaaagaggccctatcctagtcccatacttgaacttcagtgtgcatagggactcgcttagagattttgattgagtggatccaagcagggcctagaattctgtatttttaataggttcccagatggtatccactcttatgttgatggagcacacttttgaggagcatagctctgaagaaccccagagctatggcccttctttatcttctcccttccctgtaagataaggaatctacagatccaaggagatgtgcctgctcacagcctgtgctccctccttctagaccttgctgtggatatttagagtcctagaattctctgcccaaatggccttacaccttactctagggtcttctctgacctcctcctcaggttctttcacctgaagtggatgaaccccaggtctgagggtggctgagggccagtattgtggatgtgtgttcgataccccttgtggtgtaagatagaactgaggtggggaaaagggggaaagtcaggatatggggggctctcctggcacagctctgttctagtgcaggactctgagaagttgaagaattctacactcaacctggatccagcctcaggttctttgaggaacttaaaaggagaatgccaggaggagctaggggtcttgtgaacaggagttgcctatcttgaatcggatagagggagcagacacttcacagcatatggtctatgggcctccatttgtactcttgcccctattctacaaatgttagggtcggtctaaccggacaatgccttagaccctaaagaagcttccagca

SEQ ID NO: 33465 - DNA, 1418 bp, Bovine  19866881229281
acaggccaatatcactgatgaacatagatgcaaaaatcctaaacaaaattctagcaatcagaatccaacaacatattaaaaagatcatacaccatgaccaagtgggctttatcccagggatgcaaggattcttcaatatccgcaaatcaatcaatgtaatacaccacattaacaaattgaaaaacaaaaaccatatgattatctcaatagatacagagaaagcctttgacaaaattcaacactcatttatgataaaaactctccagaaagcaggaatagaaggaacatacctcaacacaataaaagctatatatgacaaacccacagcaaacattatcaaaaaaaaaaaaaaagacatggatgaaggactcttacgtgactatttattactggcctaaagaagccagtgtggaaaagctatattgcttagtccaaatataggccattctggaaaatacaaaactatggacaataaaatgatcagtggttgtcaggtgttcaaaaaaaaaaaaaaaaagaaaagcagagacattactttgccaacaaaggtaaaaaaacaacaaaaaaaagtaatatctgattttataatattttgaagggtctaccaagaggaacagtggcctcattgggaaattatttaaaattgaggtagggttaccctggttaatttgagattcctcttaacctcagggaactcagtgtaccccaaagtcattttacaaagattccaaatatctaaacagattgcacttgcatttcctaggacagccttgcttcaaagtttcctggtcttttgggagaggcagccagaatggggaagacactctgacacttcggcctcaatgagtcaactacttcagtgcatgtcacttatctggaattctgaagtggcctactgtactcatttatcgagattttctggaactactaaaattttgtagaattaatataaaaccctttctgtaatgttttcctaaactgtaaaaaagagatcccagttactatgtttttccttgttattctagtgtacaaaatgaatctattaactagctcataaatacaacttcctggcttgttgtgctttttggttttgattaagaaatctgtataaaacaaaggttaccgaaatgggcagtatgaatgtgcttcttattggtttaagaaaactctctctctctttttttttttaacattttgggtcatgggcagcagctgacttttaaaagggcactctaaatgaggtggcaaaataaatgagggtgtaacataaaaattgaaaatggaaaaaatgtttttgagaagccacatgacaatgtagagagaaatatgttacttctgtgccaacatttgaaccatattaaatttttatggaaattatcacgtgtctggtttataaaaatgaaaggagttagggacaa

SEQ ID NO: 33466 - DNA, 890 bp, Bovine  19866881290322
cgttgatttcatgcaatctgcaaatacatatccactagagcatgtgtccttcagaggttcacagtaagacctcaataaatgcactttgcttatatgccagaagagcaaatatatttaaggctatgtaactggccctgtgcaaatatacctaaaagaaatcaaattatttcattttccgtgtatctctgtttctgaccaccatctaggcatacttaattccatacacatgaatctgcaaaagcataatacttctatgaagtatatataaagtctacatataaaagcaactttcatatattttgatgctctatattaaagaaaacagttttgcaaaaaattttgagcatcagtctatataccaatagacccgggaatattgagtttcttgttcactcagcactttataggctgtgcagatgatacaaaagcatcaccaggctccatcctgcctttcctgcattcatattacattccaagagatagacatacactcagaacaaattttgaatctgacccagcctgctccaacacccccaaactattttctatagactaaaggtgaggaaacaaatgttggagaaatcatcttttggattttagggattattttttggatttttaaaaagtgtcagaaatgttctctaaaactctagtttctctaaagggtctctcaaatttcagacagggatagatgaagtaaaagagaaataaggaaacgagaagcagaaaaacaaaaaaagagaggagagaaaaagaggctacgggtcaaaggagggcttagcacagacatggtcaggcctgtctcctccggtctgtcctcccacctttccaccggactccaggccagtccagctgcagttccctaattaagcatcattgttccactttgc

SEQ ID NO: 33467 - DNA, 1694 bp, Bovine  19866881322037
acaggacaaatttggggctggatatactgattttcacctagtatttcaattctgtgtgtctggtagcagctacctagagggctgtggtgaggattatagactgccaggctcagctgaaaagagtggggtattgattagtgatgtctcaccttgaatgcagtatgtaggagtggtagtatgtattttgagtttttgccatttgtcctctaaccctaccaagagggaccacagggcaattatgttttcattttatacacacacacacacacacacaaatacacatctcacttgaactgaattactgatgaatctacaagcatggatctattcctttttatgatgatttagcttcaattaaatcaaatttcttctcctgattcacatcttaaaaccaagaggaatagagaaaagggtgtgtaagtgacttattttaaacaaatcaccacttcaaacccagatgttcaaaaaacttgttcacttgtagaggaaaggtactaaattatagctagttatctatctaatatagtatatcattgagtcctaaaatgtgactttttaaaatggctatgggctaggaacaaaatggcatagaggaatatgtgtgggaaatttaatataaactaaatcctaaatctacttcaatagtgtatactaatatttttataattgctgtatggtatttgacaaaactgtgttttcaaaataatcaagtgaaatgtggaagagctacaaagcagtatttttagaatgctggatgaagatgggtgatgttaatcagatttcaaggttcatcttgacctgctgcctcttgggacagtgatcaaagttccatgaatccttctgatgcggagttattcattagagttctcagcacataattatggactgtcagaagattttggttttgtgtaataagtgagtagcatgcctgcagcttgctgaggtgttagcttaataacctcataaggtaggttgtttttcttctccctcaagacctgagcaaactggcttttatcttgcccacctcatctcagatgaagataaaacattgaagacttagatttccttaaaagtttatttataagaggaaaaaacacagcttcttattttatcccctttctctttgttccatcttcttttgaatttgaagcataacaaattttgtttttatatggaatcttgattaggacgtatacattttttttcctatcacacatagttatatgcagtaggatattagtaaatcagtgctgataaacaacaccacatttaaattgctgcctgcgtgatgctcttactcggagatgcaattatttcccttggttttgacaagatgtcaactgtgatattcacagagcacaaacaactcctaagacactgtagtgcattagaaatctttccagaagaaaactcaagtatgtgtctggggttcccattctgactctgtcttctgtctttggatgtttgtttacatttagatactaactgcttgtgcacatgaagtggcatttaagaagaatgagtcattttatctggtgatcataattaataggggtttctaggaatatttttgccttcattttcaagtttgagactataaagaaattgagggtaattcatcattagtcattttattggtaatggtggtggaggcacttgtttataatagcttcaagagggaaattgaggcagtt

SEQ ID NO: 33468 - DNA, 864 bp, Bovine  19866881418721
gctcctcggtccatgagattcttcaggcaagaatactggagtgggttgccttttcctactccagggtatcttcctgacacagggatcaaacctgcgtcccctgcatggataggcggattctttaccactgcgccacatgggaagcagaggtagattttaagagcctatgacataggtttttctaatttactctctgacaatatgttactatagttggggagatttcttcttaatcctgattttcttggcaagcttttttagttttgtgtcttccatcttcacagattgagtagtggaaatgagagattacagtacatatatttctctccttttcctctacctcctcgaagatctttaaataggtatttcccactaccctaatattatccttctgcattcagagaacaagccaagaacttacctgaagaagaaatacttaaaagtgggcatatcaacagtgctcatagaaagtaaagatgggcttactgcctcaggcttaattctgttgacagcaaatagcatgacaggacaggacagaaaagcgaagtcactgaggaggtcagaggaactgagtcctggaggcaggatcaccacatacttaatcagtggaccaacatggaaggagatgggccctgctgcctaccatctctactgaataaagaataatgcttctttattgaggtaaaaaaatggagaaataacttctttgcaatgtaagagcataagctttcaaatatataccacaaggatgaccttgtatattaaagcttttcatgtggaattccatttctctatataagcacactttaggtaatagtatttaacttgaaattcatcaagcagagcatactgctataccaggca

SEQ ID NO: 33469 - DNA, 1730 bp, Bovine  19866881484785
tataaatttcttgcattattcttacaggattatcctttttctggccacaaactgaaatatgtgctgaaagatcagtaagtagtgggaaatccctaagggttgtctcataggaggaagaggtgacaagatgcccagtttctagtaatgctgtaggttgagtgtgcagatataaaggaggttgctaagtgatgtgtcactaaagcttataagctcttaccttgctaccacattcctttatagtttctgcctgtggggctgtgttgtttggaggaatttaactataccacgtacagaagacaggtttgtgtgttatcttaaaaccatttctaggttttaagaatgcaaacctagaatgcaaacatgcattcatatctcaccagttttaaattcaaatgtaaagttcattcaggctagatcactgtttccccagctccaagattctgcatgtgtgtgtgtgtgtgtgttagttgcttagttgtgtctggctctttgcagccccatagactgcagcctaccaggcccctctgtccatgggattctccagaccaaagcactgaagtgggttgccattccttctccaaaagaaactatggaaagaaagaaagtgaagtccctcagtcgtgtccgattctttgcgaccccatggactgtagcctaccaggctcctccaaccatggaattttccaggcaagagtactggagtgggttgccatttccttctccataccacctcataattcttatccacatctctgtaccacttacattatttacctaagattttctttgaactaattttctttttccaaatgaatgcattttaaaagaaaattatcactgttgcatattgaaaatcaataccgccccaaaaagaaaatcaataccactttccaagattatggtataaattaaaaaatgatgaaaacaaaacaattttattaagtgctacaaagagatcattgcctattgaagactctgagttctgggcttgctgtcttttagggatatactagcttaaattgtctctaagatctctgatttcagctttcaacacctatggtgttccaaattcttctcttcctactatttgtggatttcctccctcagttctcactcatgcaaactgtttctgcttacctcatgtacaaatgattcctttttaccaatgactgcctccatttttagtgttgagagtcactatggaagaaaaaaaactcaggaattctatgtaagaaatataaaaaggggggaaattgtgaaaagcagaaagtgattaggagaaggtgactcagacaaaagtcatcctgcttccttgacctagaatagtttcctctattttcccaaacattgtcttttcatgtccctgtactttcactttgaggttagaattaaaataagcatattctaaaaagacagatgcttctagcaggatgaagaaaccattgaaggaaaagaaatgaaataattttgatgagtgctgtaattggaaaaccaggggagtgtaagaggagagagggttggttgagaaggcaagaagaagtgaagtcactcagttgtgtctgactctgcaaccccacggctgtaagccctgccaggctcctctgtccgtgggattttccaggcaagaatactggagggggttgccgtttccttctccaggggatcttcccaacccagggatcaaacccaggtctcctgcattgcaggcagattctttaccatctgagaca

SEQ ID NO: 33470 - DNA, 1048 bp, Bovine  19866881872661
tcagtcctgggtgttcattggaaggactgatgctaaagctgaaactccagtatttttggccacctcatgcgaaagagttgactcattggaaaaagactctgatgctgggagggattgggggccaggaggaaaaggggatgatggaggatgagatggctggatggcatcaccgacttgatggatgtgagtttgagtgaactctgggtgttggtgatggatagggaggcctggcatgctgcaattcatggggtcgcacagagtcagacacaactgagtgactgaactgaactgatgatgacaaagaatgtgatggtgcttcctagaaccatgcagtgcacatcttcacaactatgcctctagaagatctggatgagcagcttcatgaatgatcaacaatgtcctaaagaaccagaagctgagataatccaaattccgaagctggctttatgggctgtgaagctatgcagttggacagggcctcacaaatagaaaggctccacacttggtttaatactctgctgtcaccattctaatattcttaacaatttttgaacaaagggctccatattttcatttccactgggccctgaaaattatgaagctgatcctgactaatttcaaactgaattttctctggttgggtccatccccaagaaaaatatgtaacaaagatttgaacttttattctaaagacctgaacaggaaagtacagaggtaggtgacaaacaatttcaaaatggataatcacaaatcgagagaaaaacttttcatttcctggaaaaggcaggcatttggggtctgtttcagacccattatttgttctcaactaaaaagcacaacataaagccacattttgtgtgagccagtccactccttttcaatgaaagaaaattttaaaaaaagaaaaagaaagagagaaaggtcaactgacttcctagggaacagaaaaatgcagcctgaaaaaaaaaaaaaaaaagtttacccaactttgtccatgataccaaaacaagcctttgaccattctcagcaaaaacaggacagcactttt

SEQ ID NO: 33471 - DNA, 1527 bp, Bovine  19866882040664
attctagactctgtcttgggctccgcaccttacatctcttaggctcatgggagaattggagtagccagaacttgtttgctttctcatcgtgctcagccaagaacttattcacctaatctaggcttaacagcaggactcctctgcaactaataatattaatgtttctttggctgatttttcatgtgtctgttgtttgaaacctgctgtcttctacttactttccactaattttcccttttaattctctccctctctctttctgaatcaggtttcttctgaaacattaccagtcttttctggacttttctacagcttctttatacctgaactcttaaagaatatgtgtttcctaatttctgacagtaccagagattgttttcaggggaacataattgtaagtatgactggagatactaataattttcatattgaaaaatgccacaggaggtttcgtggcaagagggcattctgtagcagtctcttaaaaatcttcaaagataagccatctctttgtttcttgaaagtttattctctttgccttgatgcaaacttactgggctttctaattaaaatgcatgagtatcacatagcaattcacatcaatcagttggcaacagttcatgctctgaagtcaatagtctttgagtaaatcttcctcagttacctttatgatttaaccacagctctttctttctttcttatttagaaaccttatgcttgtcaaattccgggatgcaccaaacgctacacagacccaagttccttaagaaagcatgtgaaggcacattcttccaaagatcagcaagcaaggaaaaaggtaattttaaatgaaaatttacccagccaggaaaagcacatttaaattcctcttgcagtactgggagcttctgtgggacattggtaatcctaatgcttctcaaagtgtaacatatttttgactctgagtagagaagtctttcatgaagtagtagcaaggctgtgattttcatagctgatgtaatcagatatgaatttctggggaggatttatataatagaagttgatgaaattggtgaaagtcaccaaaactggaaagtaacaaaatcaagttcaaatagtaaagaaaattgaattgggaaagcaacacaacaaatactctttctggtgataagtgcttaataaatatcaatacaaaacataaaatatcaattggctaaaattattagctctgactaagatggtaggatgagtatgtatagagcattgttccctttaagcttagaaaaaacacgtttcttaatgggtactatatatgaatgtctgagaaagaaattgaacctaacatcacttttgacatcattgagggcttagtgcacctctcagagttcttaaaagctgtagtatctctcagatttggaagaaatgttaaagatcagcctgccaacccacctgacttatcctcctgacttcataagatctcgagcaagtggttgacaatactgttctttaacatcttgaggaacgaagagcttactacctttcaggcat

SEQ ID NO: 33472 - DNA, 1578 bp, Bovine  19866881006062
tgtgtatacattccccaccagtaaatgaacaagaggttttgctgccaaatatcctcacaagcatttggtattgtcagtgttccagactttggccactctagtaggtgtgtggtggtatctcattgttgctttaatctgtatttctctggtgatatatgatgtgctgtaccttttcatttgccatctgtttgtcttctttgatgaggtgtctgttaaggcctttggctcattttttatcaggtttttgttgtttttgagttttgaaagttctttgtatgttttgaataatagtgctttaacagatatgtcttttgcaaatattttatcccagtctgtggcttgtcttctcattgtcttgacattgtctttcactgactagacatttttaattttaatgaagtccagcttatcagttatttctattgtgaatagtgtgttttctgttgggtctaaaaagacatcgccatacccaagttcatttaggttttctcctatggtatgttttaggagttttattgttttacacttgggtctatgatctttttttgagttaatggttgtaaagactataaatatcttgaaaataattattttcaaaccctataagtcttgtgcttttgagctgtggtgttggagaagactcttgagagtcccttggactgcaaggagatccaaccagtccattctgaaggagatcagtcctgggtgttcactggaaggactgatgctatagctgaaactccaatactttggccacttcatgcgaagagttggaaaagaccctgatgctgggagggattgggggcaggaggagaagggaatgacagaggatgagatggttgtatggcatcaccaacttgatggacatgaatttgagtaaactccaggagttggtgatggacagggaggcctggcgtgctgcgattcatggggtcgccaagagtcagacacaactgagtgactgcactgaactgaactgataagacttgtgaattttatccctttatcatattttactgtaattgataaataatgtgtaaatactatcatataatataaaaatagcagggaagatacctcattgtgttaatttatgaagccacctttaccagagtttgtaattttttattttgatgaatttgtactatttgtatacttttcataacaaaaagtatatatgtatatataactgaatcattttgctgttcagcagaaattaacacttcattataaatcaactatacttcacttaaaaaaaaaatctattcttattgtcatttcattccatggccacttctagcaatcattgggatgtttattgctcttgtagtaaaattatgatatttacagtgcaataaatcattgtttctttgcctaatattagagaaaaccagataggtttaaagtggaataactttaaaggactatatgaaatacctttccaaatttataaaagctacacatattcatgacatttttttgttgtcctgacaagaagacatacttttcacgataaatcttcagaaaatgcatagaatatgaaaatgcaacttagagaagtcttaacgttagcatctg

SEQ ID NO: 33473 - DNA, 982 bp, Bovine  19866881085445
agtcagacacaactgagcaactttcacttttacctattttaataggaagtacctcatggggcttccctggtagcatagttggtaaagaatgtgcctgcaatgtaggagacccagattcaatccctgggttgggaaaatcccctggggaaggcactggctacccactccagtgttcatacctggagaaccccttggacagaggatcctggtggactacagtccatggggttgcaaagcatcagacaaaacagagcaattaacactttcacttttcacctcatggggaagttatgagcattgcataaaatattacatctaaagagcacataattcagtgtatttgtatttctgtatctcctgcatggaactcttcttgcagatacttaaggcactttatcagagaattttttttgaccccattttaaatagcatcctccactttcccacctcctttcgttacctctgaaataacctaaccatacattaggaaaaaaggtcaatgaatttgacatatttcctgaccagatttctttacagggtcattcctactgacatgatcctcaagataaatgttattaaagaggaacctactttttaaaacttagacagaaatgttggatgcatacatcagtggaatgttaagttcttgggagacagaaactttagcagtcaatttgatatacttaagcatgcaatagtcctctaatctttgtaaaaaattttttttaattaaagaaattgtcatgcagctgtaatgttgtcatttatcagcataatgaatttaaactgaaggctactcttactgtgagaatgaactgattaactggagggactgcattgataataattagtcagaaaagtgcagtggtgcaaatcaatatcctttgtgctgagactttccttggggactgtaaaccataacaaagctgtcaggctgctgaaatgggggaatgttgtttattttgtgttgctaatttactct

SEQ ID NO: 33474 - DNA, 1046 bp, Bovine  19866880144866
ctttcttatgctcttcttgctattctttggaactctgcattcagatgtttatatctttccttttctcctttgcttttcatttctcttcttttcacagctatttgtaaggcctccccagacagccattttgcttttttgcatttcttttccatgggaatggtcttgatccctgtctcctgtacaatgtcacgaacctcattccatagctcatcaggcactctatctatcagatataggcccttaaatctatttctcacttccactgtataatcataagggatttgatttaggtcatacctgaatggtctggtggttttccctactttcttcgatttaagtctgaatttggcaattaggagttcatggtctgagccacagtcagctcctggtcttgtttttgctgactgtatagagctatgctctatgctgtaaacatacccacaaaagtaatttgttttcctgatggatattctaaaaatgtcaagagccatgaccattgaaactggacaggaattataaggaggtgaggcaagtgtcaggcagggcccaggcggaaacagggcagagaaggaagaaggaggttgctaaggagaagccaggagaacctaccaaccaagaggagctggagaggaaccaggaaaaaatggctctccattcttcagaccccaaattcattgctggtggcagtgagcagggcagggtcctttcagataacaggataaacctgtgagtctttcccctctctgtttggactaaaatatcacagttgcagtcttccaatcaagggctctgtgaggtttgcaatagcaaacattagagcacatttgagataatactcaaactttacaggtttttataattcacacgttctctttttcccaggaaagctctatctacagtcaatattttagtcagcctgttctcagtaaaacattgagccctcattaacaaataattacctttcatgagaaaaccaaacagataaggctaattaatttgccattataactccttaactttaaatatcatgttgcagtataattctt

SEQ ID NO: 33475 - DNA, 752 bp, Bovine  19866880544400
ctttttaaagtgtaaacccagatccctgtaatttatcgttctctacaaaggcattgtaagataggaaacaaattacaacctgcagttttctttctatgttgatctttttctattccggtttgatgtgttattttatgcacttatctgctgagaaacacaaggtgtgaaattgcacttcaggtgtgaaaacacttttctgtctcagaaaaagggctctccactcttcaaactgctctatggaaaaagctgtcagcaaactgacaataagggagtgaacttgtgtttctgcagctgtacagctacacagttcctggaggaaaagttcaatccagtcaccaaactgatctggcaattctgctgccagttatggcagtgggaattgaattaatcttgcaaacaaagacttgctcatttcacaaagagagcaatttccagctttctcctggtcagaagattattttctaattatgagaaaggctatttaaaataagccagaaagaaaaataccaatacagtatactaacgcatatatatggaatttagaaagatggtaacgataaccctgtatgtgagacagcaaaagagacacagatgtacagaacagtcttttggactctgtgggagagggagagggtgggaatgattttgggaagaatggcattgaaacatgtataatatcatatatgaaacgaattgccagtccaggttcgatgcatgagacaggatgcttggggctggtgcactgggatgac

SEQ ID NO: 33476 - DNA, 1255 bp, Bovine  19866880592957
actatgggatttgtcaatccagtgactggacatcagcaaagaaacatgcagtcttgcaagtgggagaggttggtgacttgagccgacagtatacatcaggagttcagcagcattgggagggaagagagtgggtgggtttgggagctattgtggaggcagaatcaacagaacttagtgattgatcagctggactaggggtaaggaagccagtcttgtcaaaaatgcgtaaagttaaaaaataaaataaaatttaaaaaaagaaaaaaattaaattaaattaaaacttaaaaaaaaaatgcggtcctgagttctgatttgggacttgagcagatgatgctacattcacagagttgggggacactaaagcagctagtttttaaaagggagacatggtatttgtgagatgggattttacaagaaacaatgtggtattacattggattttgagcttggaagggaagtctaggtcacagatacagatcaggtaggtatatgagatggtccaaagaatatgtagagaatgagaaaagaagagactttttaggcataaatagtacttggacaatgaaaagaaaaacacatagggcaaaatgtatatatattgttacataaataaaatatggatgaagaatgtgcgtgtccacaaataccactgcacacatgccttcgcacgtacacacccctgcacatgtgttccttccgatgagcatcagcatggtaccccatggtgggccacatgcaacattaagcattaaaggtaatcatccctttcctgaagagttcgtgtaaggtgtgtgttgtgtgtgtgatagtcactcagtcatgtctctttgcgaccccatagactgtagcccaccaggttcctctgtccatggaattctccacgcaagaatacttgagtgggttgccattcccttctccaggggatcttcccaactccgggatcaaaccaaggtctcctgcattgcaggtatattctttactgactgagtcaccagagaagcccatgtgttagtccaacagcaacttccaggcctaaagatgctgctcagtatgttaaaaaggaaaaatgtactgccatgtagatattgcaattaaactagcaaaacagaaggcactgatgtcttctcatttccactgtttttttcctagatacatacggaaagctctttctcttcaattctgtgggtcaagagatgtctcgctgcaagacgtcaatccgccgtgggcagcccaatcccgtctataaggagac

SEQ ID NO: 33477 - DNA, 1533 bp, Bovine  19866880614113
gcgccccaactctctgcacgcgggtaatataggaaaggcaaggaaggtgtgttaggaaagtgacttgctttggataaagctctttaagcgtttcttaagcgaaaggcatgcattctcgcaggtattattcataatgtttatggatacgtgttggttcagccgctcagacgtgcacacgtgtttcagcatgcacatccattacatcccagaggtaaataacccacactggcagggatcggagtgcctgggtctgcagttggcaaagttttgttaagcagtttttcaaggagatgagatttacatgtgtttgcaggcaacttcagttcactttcagcccaagaggtctgattcctacagttagtgtttctgctgttactggtcttgagagtttccagggctcctcagcagtttgtgaaccacccctggtttctcacctcacctgcttgtatttctgtgtattgacaagtagttgcccgcaacgtcctacttgcctgtgcttttcacatagttcccatgaggcaaaatgtctgctgcaaataaattaaaatgtctagagcactctacacagtgcaaaaatgcttctacttcctaatcttcatactgcctttgtgatgccggtgttatccttcccacatgtatgtgatgaaatgataactagaatgaagtggtctggtttggccaaataagtcctttgaagactctcaggagtttaatgatttaaattctggaggatgtcagttgtgaggccagaatgtgaatcagttttgaaaaccctgtttgaaattaacaagtgggggaatcagatggataataagaaagactcatttagatatttattttacactttgaggaattgatacttttatcatatattttgtaaaattacagctagcttgtggagtagtctcttaaataggagaaaaaaccataacgactgtttaactgtaacatcaaattatattgagttaatttcccttcaactaaatgtactttgtgaaatttagaagtggactggagaggaagggccaaaatagagattgacattttattttgtgaatttctgaataggaattagagataagtctaggaatctgaatggaattattaaattagtacccggttaggagttagattgggcaaagctctaaagaacagggttctgaaatataatggtgcagactgaccgatggccattagaagcatgttttccaagagagatcctagactggttttctttacccataatccgcacatttgaatcacctgagggacttttaaaaatccctacttttaaagactctagatgagactggctgtggacaccagcatcagtatttttcagctctccaggtgatcccaatgtgcagtcaagtttgagaacctgtagcctaaatgaagatcacaaggtaagggctggaagaagcataagtataggaagattcaggttacttgaaaaagtggggtgcctatttagatctgcctattttcccactggctgtagatttaaatgtaaattaaatttacatatcttaa

SEQ ID NO: 33478 - DNA, 2398 bp, Bovine  19866880683648
agttaattccccaaattatactcatcggtaaatgagcttgcaggagtcggcaagaatcaactgtacctgcttatcatttttgaggttttattttctttatgattacaggcactatgattattaattctccacacatttatagtttcctaaaaaagtaagacacctggaaccctatcaattatatcactgtagtacaattatcttatctaagtattaaaacattccattaatacttctcactccatagaaaataaatatatcatttaaaaaattcaagaacctggaataaactttgatgtctttgtttcctttcctctattcctttttttttttttttttgaacgtatggcactgaaacaggtcgcaagcaggcagatgccctcggtgtcatctgagggatgcccacaagactaccaggtgggtcagcgatcaagactccgcctgccaatgcaggagatgccagatcaatgcctgggtcaagaagatcccctggagtaggaaaccacaacccactctagtattcttgcctggaaaattccatggacagaggagccttgcaggctacagcccatggggctgcaaagagtcagacacgagtgagtatgcacacacaggcgcaaaactacaacctcccccattcctcaggaagcgcctacatcaccaccttcattgtctaaagtgaaaccatccgaatgtctttccttggccaatatgattattttcagaaggtccttgtcaaaatattaatttccttgggagagtaaaagcagccgaagttaccatttcttgagggcctattttgtgctgagcgtgttttatgtattaaatctaatctttacaccagtcttctgtggtagctaacctgaacaccattttccaggagagagaatagagctgaagggacaggctcgctgtggcagagctgggataatacactgcacctgctaacaccaagtccatccccttcctcataccttccgcctgctcctccacatgtcaaacctgtcgccacctttgggccttctcctgagctgttccctttgcccggatgctctctataatcttcacatggctggatgcttcttgccacttgggtctcagccaaaatgtcaccctatgagtcctctgccactctaggtaaagcagtcaccttgtcatactccaccacaccaccctgttttaattctctacttagcacctaaccaccacgggctattcttgtaattacctctttgcctgcttattgtctgtctctccatgagagggtaaaagccctgtgagagccgagcttctgaatgttgtgttctctgccccaactataacacctagaacagagcaggcgctcaatatagatcgatgaatgactgaatggctttcctactgcctcctccacacattaggatggtatcaggaaagaatcaagtccagagagctagattcaagcttcacctctaactggctaggggctgcactctgggcaatctccattcagctcaatttctaggagtatcaggctattttccaaggtgtcagcaaggtgagctgtaactcaggaacaaaaaatcttattgggttggtggctcagatggtaaagaatctgcctgcaatgcgggagacctgagtttgatccctgagtcaggaagatcccctggagaaggaaatggctaccgactccagtatcctggcctggagaattccatagacaggggagcctggcagactacagtccacggggttgccaagagtcagacacaactgagtgactctcactttcaaaatggacccaggccacaggagacctggaatcacaggacaagaagagtaggcaagcaccactgattccatcgttttgtcttggactagcacagtggttcaccataaggcccagtacagctcaagaagagggtaaatattttaagtatactgataaatcctatctctttttacagggggttatcttaacaaaagacatcaagccaaggtcattcaaaatgtcccattttttttttttaactttccatctattgcaaacctcaaagaaacccttcaacagtacagacttctgaaaatacctaaataacacaaccaaataggtcctaaaatgggtcatcatctagtatatttcactgggagccagaagtgagaacatattttaagtacataccctaggaattagaaattaataacaacctcatttttgataccttttaacacctgaagccgggtatccgcagtcaggcttctggggaccgcgaaactgatgacactgttcccagcatgttgtcaatatgcacatatgtgcatttttctagaaacagggtccatagcttttatcatcactaaaacggtccagggttcaaacacggtttcagaagcactgcatctactagaaacccat

SEQ ID NO: 33479 - DNA, 1200 bp, Bovine  19866880695962
cctttatttacaaagctttggcttttctgtttataaaagtaattacacgtcttcattcaaacataattacaaagtaaatacatggaaaattgaggagaaaataaaatagctataatcctgacacccagagatagaagtctaaatacgaggagaaacaaaattatttatggcttttagcatccaaagaattgcagattttagagcacataagatatttacaaaataattttaactatgtttggtttcccccttatgtcctaattatacttaatacttcacagcatgtgaaagaacagaaaaagaacagaaagggagaaaacgaaaaaatataccccttctttttcacttatattacaaatatttcctcatgtacttagtcatcaaaatcaagatttttttaacagttacatactattcctgatgccacttctatgaaatcctacaattagctagacttctgcttaagttgatctgaataagaggacatagtattaataatctagtcactgtactatgataaagatcagatttattagcttggaaaaacaagcatctctgatagcagatgattactaactggacgtggtgttttaattctgaatgtagattcccaaagaagaaatcttaggtcaggagtccccagacgctggggcactgactgatacctccagtcagatcagcagcagcattagattaggaataaagtgcacaataaatgtaatgtatttgaataatcttgaaactgttcctcccagcctggtccgtggaaaaactgtcttccatgaaatcagtccctagtgccaaaaaggttaggaaccatcgtcttaggcgattattcacttttttttcttgtttaagtttatttatttataattggaggataattgctttatgatatcatgttggtttctgccaaatatcaacatgaatcagtcatgctgctgctactgctaagtcacttcagtcgtgtccgactctgtgcgaccccatagatggcagcccatcaggctcccccatccctgggattctccaggcaagaacactggagtgggttgccatttccttctccaatgcatgggccccataggtataagtatgtataccacttgaacctccctcccatctcccaccccatcctacccctttaggctgtcacagagcactggggtttgataaagtcactttttaaaaaaactttgg

SEQ ID NO: 33480 - DNA, 729 bp, Bovine  19866880704609
acctgaattttacaaataaaaatatgaattgcccaaggggagtttagtttgatggtctcaaagatccttcccatttcatcacacctctctgaaaaccaaggtgaggccctcagagtctccattcttcctctggaatctgccttcagagggcatgttgtctgggcattcttcttgtgaacattataagttgccaggcaaatatttttaaaatatctgtgtattttatatacctttacataccacatttgtaaaaaaaaaaaaaaagtccttctggattacttccaggaataactggagaggattctggttttgcttaactttagaactaatttttctctcaagagtaaatttctttggggacaaaaatagagaaagcgtccactgtagcccaaaggcaacactgcccaggtgtgatatatgttcacgatgccatgtacctgcaacacattgacaggactgaagaagtgactgtctctccgtgctcctacctgcctctcacctgtcattcccacatctacagagagaagacagggagcatagtagcttcagcaacacctgaaacttgaataaaacatcaattctcaggctacaacacagacttactgaattgcagattttgcaagtgggagccagcaacctgtgataacaagccctccaggagattctgattcagattaaaatctgagatgtattactttaaaaaaataaaaatactaggctcaaggattt

SEQ ID NO: 33481 - DNA, 2396 bp, Bovine  19866880710269
gtgctaaatgtgaatagacctgcaaattaatgcagtttagctcatttgaaacccagtattgtaagtctttctctgaactcaaccaaacaggagttagttttgaggacatcatcatgtttaatatcaagaggcctacagttatttgtacattgtaaccttttatcctttaatgtgctgcaaatattttcaaagaaactttacagccaacattcaaaataataaacaaagtagattttaatagttcaagaaaatctattctatgtagcttgtgtgcttttcaatatctcatgtaatcttcacaacagttctacgagacagatattattgtttctccccattttatagataaggaaactgaggcacggagaatgtaacacaacatgcccaaagtcacctaggctttaatcacaggcagtttgtttccaaagttcatgttcttcaacttgaattaaatgatatgacatctctgatgtttactaataaccaaatgcaacagatacattacgacctcaattttcttcctttgcagcttttcacttgatgaatacaaaaggccactgtcgggaaatccattttattgcatttatgcttgacttcaatcaatgataacacactctattcactaacagagagaaaggttaaaaccacctttgaatctgaataacatatagcaaatgaaaatctctacaaccatgctgcagactaatgaaagctacattctgctcctggcaaggaagtgaaacaggtagttcaatgctaactatgtgagagagaaagtgagagcaataaacaaaatttacagcacaaaactagatgggatttgggctggtgtggggctggcctccatggatcttttattcagtattttccaaccaattaaagtcaatcaaggccacacttgtctcagtacaattcgtcattcaaagacatttcaaaatgatttctactcaacggattcatctctttggggttgaattttcaatatcccattcagcaagctctattatagcactttcagaagtaacttcttcccctcacagcacaataaatgtggcaaaggtaccattctactgaaaaggaactgatgggaaaaaaggagtcagagaaagatgtacaagaacggctttcatctaagcagaaagacacatttcaatttggttttgtattgaatctttccaataatggtcaaacctccctcacagagctaagcctccccaagctttccggcactgtctgttgatgcccagccgaggaagagagtgggaggaacgggtggtggagggtggtcacctaccagctgctgttaaaatctgtcaactggcaaatgaagccttctgatttgtgagcaatttccaaaacaaaacaaaaaaaaaaaatcagaactaccatctgggaagtgggaagaagataccgcttggcaaaaatgtttcataaaacatgagcaaacacgtgaaacacacacaaatacaccgatgtgtacacacacatacacatacagaaaggcaatgccctcagaaaaaccggcaatctctccctactgctgagacttttttccccaattgcctaacatgaagagggagctgggagatcttctccagagagtcagcaggtgacagaaaaactggattctgttggaagtcccactgctgactcactacctgacttcaagcaaaccacctgttatgaatgtagggcatagtttatcaatttgcaaagcaggtgtgagcattctcaccttctgcaaaccatgcagtgcatgtaaatgaggatttcaaagaactgtactattctgggaatagaattcccgaaaggaagtgtaacatatcatttttagagttccacatgatctccacagatgcagcaagaagcttcacaatcaagatcaaaccactggtgggcatcgctatttgctcacacaggtgcagcagaaaagcctgacgtctgttcccagtgggaagtgtggcacagccagtctaggggaaggtgatggatgctctttgtatctcctttcacctcacattcacccaagacattgctccaaaaggaccacttcattcctgatggtgatgcttaggctggacctatggggaccactgagatgaaaggtaattgtgcaaaacatcacacactgcattaaatgctggtccctgaacgaatttttctctgtggaatagaccaatatttttgctttaaagaaatagctcccagaatactgctgctgctgcttctgctaagtcgcttcagttgtgtccgactctgtgcaaccgcatagacggcagcccaccaggctcccccatccctgggattctccaggcaagaacaatggagtgggttgccatttccttctccaatgtgtgaaagtgaaaagggaaagtgaagtcgctcagtcatgtctg

SEQ ID NO: 33482 - DNA, 1207 bp, Bovine  19866880742522
ttcattctggcatactggaaagagaatgggccttgagaatttttaattatgtataaagttattaggataacaagggactattcccaagaagttggtctacaaattatggcaactgtgaaaccaaactcattcaagccagtatattgataaaatcaaacagttatctctttacctttttcttttttaaaatgctatatgctaggttgtacagatttctacttctctggttgattgtgcagagtcaagcaaccattccagggaccccaaaatctctcttcctcaaatctcttacttcctgacctcaccactagatgacaatctttttttgtgtgttttggctgatgagtgagggtaatactttgagttaattgttgtgcagttgtatctttctagatgaccaggtaagatcaggagcaaaacattatttataacctctgagcaccctaatgcgattcttgggatgcagtacagttaaatgcctgtgccaaacaaatggaaaagaaatttcagctcaagtatttattataatactcagaatttaattatctggtatttgggatgttttctaaagttcttgaaaatcatgctgtcacttctttataatgattcaaaattaacactttactaatagaaatttgaccttttcttcaaaaccatgttgatgaaaatggttttaagactacattctttattaagaccataattaataaattgcggaacagctgtcagtctttttgtttggagaaatgaatagtctctcttaaaagtgaagcttcactcaaccaaacttaatacttagacagtgctatctatgaaatgccatggtcctcgctggatcagggatggatgggaaaggggtatgaagacactgaaggtattttgacataaaagttgagatggtacttctttacacattagacagttgcttcgaatagccttttttatgaccttatatatacctgtcactttgctagggccaggagagacacagaagaggaatatagggaagatagggggcaaagggtaagggttatttgggtgaagcttatttattgagatgatgaaatttcaagcaccacaggactcataataatttgtgggtttttgagaatattcaaaataatttgagacatttaagccaaggtaatgcccagatctcatcatttatggaatatttgactatgatatataaggcttagagtgtcat

SEQ ID NO: 33483 - DNA, 1812 bp, Bovine  19866880775611
tgtacttactaaataagtacatatttagtaagtacatacttactctggaaaaaatatttttcaaagactgttaaacaacttttgaaataacccttaagatgccaggccacatgcttacaaattcagagaagttacatgatttgccaactgacagaactagaatcttttgattaaaatgctctttcagtctagcatctgaaagtgtcacaagactgaagaaatatatattaatggaagtttcaacttttctctaactggaattaaaatcccttagttctctttcagtagcctctttgatgtctgaatacaggcataagcaaagcagatacccaactaacttcttcttctaaccatctacttaatggacaacattcagaaacactgcattattaggagagactgaattttgctttcaaaaaaaagtaagcagaaggcattttttcctcttttctttttttggccatgatacacagcttgtaggatcttagtttcctgaccagggaatgaacccaggccctcagcagtgataggagtcctaaccactggatcaccagggaattcccaatatttttttcctactttaagaaatcttttttcttttctttttttttggccataccacatagcatgtcgagatcttagttccctgaccaagacctgggattgaacacatggcccctgaattggaagcacagagtcttaaccactggaccaccagggaagtccaagaagccttttctcaagtattggaaattatataatactctttccactttctggagactgaggaactttacggacaatgaaacagaatttctcattttgaaaaccaatctctttcagataacataccaatttaggcattgctgtaaagtgaaatgctctgtctagtcgtagcttcctaaaaatataagctgcatcaaaatgttgtgcatttatcaaatcttgctgaaattttaaaatttcatcccaatccttcagggcaactctaatctacaaacaagaggaataaaaaaattgttaataaatgcaaatcttttttcacaaatgtattataattttgaaacactggtatttctctttaaaatcagttggctatgaaaatactgcacctgtttcatatttcagctggaggaaaacaattcacaaatattaccttttgttttggttgacacagttgcatgttatataatccatatagcagatacaaagcaccaactctgatctggaaggtatatggaggtaaaaagtatcgccaagccaaagtcaaagcttcttttgtaaacgtgttcttttctaaatttctcattctaccactagaaaacagaaagaacctatattatgactgtgaaaaaaaataacagaagagatttacacttgtttaaatagcagctgctagaaagtggacaggcattccacacctgatcctttcatgattcaaggataaagacctaattttctgctgtgtttcttacagtgaggccctagatactcttgacgcatcttccaaaagcatcaactttactgctgaattgggagcaaaaggaccaggggttacaactaactactggtttaagaattttaaatatgtaatatattaaaataaccatggtaatgttacagaataaaatacaaagatcaggagcattttgacaaaataaattgaactaaagggtattatgctaagtgaaataagtcagacaaagataagttctgcataatctcacttatgtgtggaatctaaaaaaccaagaaacaaaactgaaacatataaacagagagcagggtgcaggatgtcagaggggaagagga

SEQ ID NO: 33484 - DNA, 2099 bp, Bovine  19866880785606
tagcacttgcatttctcttttccaaactatgggatggttatcaaacatgtatctccaaaggtgtttgtagccaagaagaggcacagggagaagagaaggtatactgagctagatttcagagtggaagaagagtacattctgctttgcagtgtattttatacttggaagaatgagagaaaaccagtactgcggaagggaggtgtcgctcatccctggggcacaagaggttgtaggtgaggaagggagaccagtgaaagtgcagaacaattcctcctccccgacctctctagctttgatgtactttacgtggcttatatcaggttaatattgtcaacgatatccctgaagggatagcagaatcaggaaatcacagtctgagggttgtatataatgtgttcaaattaaagggcagttttctttaatttgccttgtattggtaaattgctaaaatgaacctcgggatttcttaacatcagctactagaggcatgctcctctcccagttgcttcctttctgagtcacagctcagccaagctctgtcttttcagtctgttggaagtggagcttatggttctaatactctctcccctatcttttttaaaaattttgattggtgtatagttgatttacaatgctgtgttagtttcaggtgtacggcaaagtgaatccgttatatatatacatttatccactctttgtttttaaagattcttttcccataaagaataagtagagtaaagttccctgtcgtatatagcaggttattagttatctactttatactcttgatactgatttgttcaaaactatttggaagaaagcaacaatttgcagtactggttgaacccccttgagaaaggtttccagagtgtatcaaactagaatccttcacagtttcttgatagaattattttaaatactattcgacatagtcattaaataactatctactaaggtaatctttatgtttctggagttcagtgtaacagttataatttctacatgttttgctaaataccttaggttggaaacaatggaagatcatgtgtaattaattcaagcagttggttcatgagtatttatgtaatatttgaaatttaaatttatgttcttttttcccatcaaacttcattactgtaaatcagcaatgtgacatgtctcatgattattttttccttattaagtgggccatgtctaaaagtttgtcccttcatggttgaaccctttggattgtatttctccattaaagtttctgtctttccataaagattattctacagttgagtggataaagaacattcctctacattaacacttttcaaatcttgtgcatacaagtcatgagacatcaaattagaatacaaactctttttagtaggcctggtgtggagtctgagagtctgcgtttctcaagtttcctagaggatatgggtgctgctggctcactgagtacactttgagtagcaatgctctacatggcttcgagaatgaaaatatacactcaagtctacagtcttactactttcaaagcatatgcattcatgtctgcttttccatggaaattttttcttcaaagaaatgaaaggcaagaagtatcataagctaatttttcaaattggccacaaatatgacaatattctatacagtaaaatccctagaaaatgatttataaattttatctacatcaagtgcagaaaggggataaggaggtagtgatgtaccattcttgaggatccacgtgggttgaagaatttgggaaacctgaactgaaaatggtacctggaacttcatcttcttgtcttgaactctttcttgagttttatgccatgaaaagtcctccctttggtacagacattctgtttctcttaagctgttggtgtctgagtgaggggtggaggattggtgtgaatgagggagtcacctgaattgtctgatttgagcatgccaagtgatttttgtcaggctctcttttggtcttaaatttggtatagctattgtgaaatatagtgccataagtttgtcacaaaatgaaaggagaaaagcagaaatttagttctgtggaatgcactaaaaaaccaaacagatggtgttctacaaca

SEQ ID NO: 33485 - DNA, 992 bp, Bovine  19866880789339
aatgtaattagggatcttaacagtggcctaggctttatgggagacaaattggttgaggtggccctcagggagtgaggagctcccaggggacaaaaactgcaggagccatgagtggagaagcaactggaggccgccccctctgactcacaaacagagcaacagcctagagtgttcctagaagaggcgatttcttcggcgcacgtgtactggggactatgtctgtgtgtgcgtgtgtgtttgtgtgagtgaacatcttctgcccttgtcctgtagggctgggcgaaccaggaagcgcctcgcagaggaagagatttagtagtctcggccacgtttgtcttcagaaccgacctttcctgctctttgtgcaacaagacacacctctccgaggaaggaggcggacatcattactactgccctattaaaaacacacacacacacacacactcacacacacaacaaccgtgtaattactctccgcaggaaaggcgcacaacaggatgggcccgagctgaactcgggatgagccatccctgtaaagattaggaaaaggaacctccgcgccatgcacccgcctccggccagggcctctcccagatggtcaggctgggttgccagaccacctcctagggtgagagggtggtcgcgggcgtctcccagccacgcgggttccctgttccttctcctacccgccttccagctctcgctgggtctgtctcccacgcctcaggtgtttgctggggctgggccacaagcccttccctttttggcctgcacctggggtaacctccagccccgagcgccccgccagaccctgctgcagcgagtgcgcacggagcggtgcgagtcgactcgcgtggggctctccgggctgcgtgcgccccgccactgcccgaacacagggccgggctccggctgcgcgccacgcccccgggcttcgcacggcgcgcgagcccttggagggttctgtaacttgagccgagcggctcgaggct

SEQ ID NO: 33486 - DNA, 1864 bp, Bovine  19866880855807
caaagaattgatgcttttgaactgtgatgttggataagactcttgagagtcccttggactgcaaaggagatcaaacccagtccatcctaaaggaaatcagtgttgaatattcattcgaaggactgatgctgaagttgaagctccagtcctttggccacctgatttgaagaactgattccagtggaaaagaccctgatcctgggaaagattgaaatcaggaggagaaggggacaacagagaatgaaatggttggatggcatcaccaactcgatggacatgagtttaagcaagctctgagagttggtgatggacagggaagcctggtgtgctgcagtccatggggttgcaaagagttggacatgactgtgtgactgaatttactgagaatagttacaattatctcatggatacatcctagtaaagttctctgaagtatgtttgagtcacttgcctcatctggtgagattcccagaaggtgttaagtttttgatactggtaaagcaatagtaattataaagccatgttcacacagacagtctaagaataacattttaggaattggttttatgaacatgtatttagtagacaattgttttttggaacaaatgtatgaaatctggatgaaatgcagatatgcatcccttgtcacacagacaaatatgcagattaaatgaatagaacaactctgctgctgctgctaagtcgtttcagtcgtgtccgactctgcgtgaccccatagatggcctcctaccaggctcctctgtccctggaattctccaggcaagaacactggagtgggttgccatttccttctccaatgcatgaaagtgaaaagtgaaagtgaagtcgcttagttgtgtccgactcttcgcgaccccatggactgcagcccaccaggctcctccgtccatgggattttccgaacaaaagtactggagtgggttgccattgccttctccgaatgcatcttgacattactagtattaagacagcattagaactgtgagggaaaacttattgttcctttgtgtttatagatttgatatccaaaaaagtttagtaattcatcagttaagaggcatgaacttaagttatgtgcacatttggctttgccaactacccagtgtttgaatcttgatacacattaatattttatttattgttgtatcatttctttgctcagttttgaaacatcgtcatcagagcaagaaataaccatcaaacaggtatagtggccagataaatgaaaaacaagctcagagttgtgtgaagggaaattttttcaaagactaatcttagggtggtagtgtagagaaaaacactgattttcaaaaatatagtgatctactaatgatagtaaattttatcaaagcttacttgccatgtcagactcaactgtctctgtgttttgttttttactagcataagtttttttaaaaaactgctttgtttttcttcatactcaggtacttcactgcacaggccatattcatgtatacgataccaacagtaaccaatctcagtgtgggtataagaaaccaccgatgacgtgcttggtgctgatttgtgaacccattcctcatccatcaaatattgaaattcctttagacagcaagacttttctcagtcgtcacagtctggatatgaaattttcttattgtgatgaaaggtaagtgaaaatataacttgaaatttttaattagtccacaaaattgttttaactgttgactatagtgaagactgaaagctggaagaaaaatagacctctttaataaatctagttctctagttgtggtgtgtaggcttccttccacttaagttgaatacaatcatacatcctagaattttgtaatgaaaggtaagt

SEQ ID NO: 33487 - DNA, 1724 bp, Bovine  19866880893684
agaatttacaggcaagacagggatgttattatgggttaactgtccatgtagtgtgattcaccagcatcagaaaagtatctcccattggacactccagatggtacatcaaataattagaaattcctttttatggattagtggtttattgctgttgggttttttttttttttttttggtaaaatgcaaatgccctgagaattagaacatcattcactcacttaattcttcctttactaaacatttattgttactatctatgagtaatttgctagatactggaataaaacatgaataggacagtccttgttctcactgtgctcagaatctaatggaaatttggcagagttatcaatgactcctgaactggttgacagagccatggtataatatcacaatatactgtggaagaatatataacgttcttggagaatagaagagggaaggaggatggtgaagataaagaaagactcttcacaactgaaataagacctgaactgaagataaatgagatcgcaacaggtggataaagtacaggtgaagtgagggtagaaattagactttataggaaaaaactgggcccttcatcagatcatatccagaggacatgaaactagagattattgtaaggtcaaatgatgaaggacctcaaataccattctcagcagtcaaggaaggattaagtggaggagtggctctttaatatttgacccacagaaaaatcatcctgagcagtatggagaattgagtgggaaaggcaagactagcgaatgaatcggttaagagggccttttaaaggttttagcaagagattaggaagtgtgagctaatgaggtagcagcagtgagaggggagaaggtggagggattctaaaagtatttcgtttctgccacacaacagtgtgacccagccatacgtatacatatgttccctccgtcttgaccctccctcccaccgctctagattgtcacagacactgggttgagctctctgtgttatacggcaacttcccactagctatctgttttgcaaatggtaatgtatatgattcaatgctcaattcatcctaccctttccttcccttgctgtgtccagacatctgttctctgtgtctgagtctctattcctactctgtaaataggctcatcagtaccatttctctggatcccatatatattcattaatatatgattgtttttctctttctgactacttcactctgtataacaggctcttggttcatctacctcactagaactgactcaaattcattcctttttatggctgaataatattccattgtatacatgtaccacacccctcaaagcaattaaaaataaaagaattatttctaattaaaataaaaataaaaactaaaaataaaagaattttaagacagctggcatgagggataaagagagtattgtcttagtactttagaatgtttgtactttcccattaaaaataataaaaaatttagagaagtaggaggttactggacatgaccttgtaatccatttgctgtggtgaagactcaaagagggtgtgaataattgaaggaggagtcctaattagaatcatgcccatgttgttgtcctgggtgactggaaagaggttctagcatcagctgagatgagaaatacagagggaaaaaagtgtgcaaaggaaaatgattgaattttgttttaaacatcttgagacagagcctggttgaggggtctgaggga

SEQ ID NO: 33488 - DNA, 629 bp, Bovine  19866880937098
ttttcaatggaacaggagaggatgggggcgggaaggagtggaagctcgggtgcaagtgggggcgaccaagctgcggctcatttctcttcccggggttttcaggctgggggaagtccacccggagcagggcacgcggcaggctgggggtttgaggcgggcaggagggcgatgcgaggcccgggctgccgggaaaggaggcgagcagggcccagcccccggcccccggcccctgaaagcactttagacgcgtctcccacccccacgacaagatggcgacgtggacagtggggagccgggccggcgaggctgggggagaaagagaggaggggagagaggcagaaacaaaaaggcggccccccggaacgcggaggccggcccgccagcccccggcggcgggcgggggcgccggggggagaaggcggccggcggaggggagtgggcttactttttcttgtcgttcgcgcccccggcgccctccatggtgaatcggtgcccgcgatgccttcacggcccgcggcccccaggctcgctccggcctaagcgctggctccctccacacgcggggaggggagaaaaggcacgtccagaggtggggggtgcgaggcgggaaacccctcgtgagatcagag

SEQ ID NO: 33489 - DNA, 656 bp, Bovine  19866880954625
tacttaactatgaagtcatgatcccagccttttttgaaattagctttcaaagcagtaaaatgtttatttacacagcattttggagtttttaattttaaggaatttagaggttagaatttagaattttagaaagggtttttgagtctaaccttcttggcaggtttgctttttatttagtattctggtgcattaataaatagtatggttattggtaaaagaggagatggtttccttatcctggttttggggtaaattctgcacatatgtccattctgaaagatctcgaaaggaatctggggaattgaagctagaattactatagttgcaatgttggccaaagttggtttatggaaaaccttgagtttgagtctgttggttagcgcatctgatgttgaacagggagaaggttctgagttagggggaataaccagaaagaagtaaagttgcaatattttagttgcaaaagtccaatggagccacctttcaaaagctgaagtgagaatgtttattgctgagaaaagatggtaaatagcctctttgaataggcattaaaagatgtttccttgacttaagtttgaacatataacgcattggatgtgaattattctttcatgctttcaaagaggaaacaattttataaaagtgcatcatttgac

SEQ ID NO: 33490 - DNA, 1124 bp, Bovine  19866880979435
tgcatgcatacatatatcacatgttatacataaaccacactgtgtgtccagagagagttctcttgatccactggacccaagtggtgataatttagaagtactgcctccatccagtatattctgtaacccaagtaaattcagagagatagcaaccgactttctccaaaacaatgttagaactaagttgccacttatgaaaatcaaaggcaatctctgacatacacaaagaatgtgtcttcaaccctagaccactaaggctcccctcgcccactctcaacctcacacaggaagtcatctagtgctgaacagaaatttcaaacaccaggatgaaatcctaatgctgatgacaagtttcaggggagaagaaacaggtcttcctgcctcttcacctgcccactgacacaggcgttattggggaaaaaacctactaaaagggatgccaatgtaactggcctggtacacagagcctctgctgccctgttcatttgaaacagtaagagcagaactagggttgctggaaatgaaattgaagcacaatgaaaccaggctctgtagcaattaatttttctatcaaaagattaaatcatttctgttttccccagatctcagctccactgagagaattctgcatgagtgtaattccaactaaatatatatatatatataaagcttgagaaaatgaagatactagtcagacactgtgttttgcatgaatcttgatttcagatgaacatgctggtgggtgagtgtcacataaggtgaatctgcggatgcttccatccataggcttttgagctattttcgcggttcagcttttagtgctaacagctctgaccacttgctcagaagtactgcgactgccttgctctgctcaaatcaagcaaaggtttagcatcaagctaccgatagcagcatctctaaagttagaaaccaccataggtttaggtagtttgggtgtcatttcctgacctccctatttttatgagaaagggcttataacaaaaacccagtgcagaagtagaccacacagtaaaaataattagagaaaaaggataacagtttccaaaaatgactgaatttttctgttgcgtatatcacctaattgtcacctaatgtcggtccca

SEQ ID NO: 33491 - DNA, 1284 bp, Bovine  19866880982287
tgatcagatagtatcaggaggcagttcttcctgacctccgggctcctttgccagtggtgcagacttcactttcagcttggggagagttccccctagggtggcagcagcacttccagggttctatcattgaagctccaagtccaggagaaggttgcttccttctttaatacctcaaaaagcatcttggaactggctcttattggaccattagggctatgcacttgtcctgtggcccagaggatggatacgctcattgacttaattagagccaggtcacagggctcccatactgtctatgtactgttagtcgcccagtcgtgtccaactctttgcgaccccatggaccgtagcccactaggctcctctgtccatggaattctccaggcaaaaaaactggagtgggtagccattcccttctccaggggatcctcctgacccaggaattgaacccaggtctcctgcaatgtaagcagattctttaccatctgagccacagggaagccctatactatgtcctaaacacagttaaagacattgggcacaattaccagaagagggaaatgaatgctgtataagcaatacagcagacatccatgtaaggatggaatactctaggacagtaatcttaacttttaggatcacaaacccctatgagaatctaatacaagcgctgcatggacgaaaatgagcaaaagcactcacaagcatacaaggcagttgtagactaaaaatgtatgtccttcacgcaagcagccttgcaaagagttacatttcttgctcatttttcttatttttataagaaattaataagttttataagaaaattataaaattaataagtatttcctgaaaatgatagaaataaatccaaatttccccttccccaaaaaatctgctcaaaggtaaatttcaacaaaagcttgaaggtttttacttaaatacaaagttgaaagtatgagatggttctgaaatagaatgcaagtcatctttaatatttaaccagtttttcattttgataccaactggtcctgaggaaaattactcaaaaagacacagcagccaagaatcaaagcccccatatttcaccttgacagacacacaggtttgtatcaagaagcacaagaatgctccaagatttgggttgaattcaagttgtaccatttcctttgtcctgagattcatgagatcatctttggcaaagactgtatcattgatgcactgatgtcagcagggagaggattaataatccatgctttaacacaaaggtcttccagtagaagcaac

SEQ ID NO: 33492 - DNA, 1227 bp, Bovine  19866881054974
tgaaaagttttaagaaccttgtgggctgtgccctactaagcagttctggctttaaggtgaactttaagagatgccattatataatatgatgctaaaccttgtagttggttcatgagcctcacctcatgtcatactgcagagggacctttggtaggattacagtcctcattctttctcactttctttttgagccaacctgctcctccacatggcagtcttatagaggcaagccctacctttgtgaaagtgctagttgctcagtcatatctgactctttgtggccccatgtactacagaccaccaggttcctctgtccaagaataccggagtggattgccatgcccttctccaggggatcttcccaacctgggaatcaaacctggatctcctgcattgcaggcagattctttaccatctgagaaggagacctgaagttatccagcattgcctatgatgagtacagtggatctaattctcaggtacactgttaggaagctcatcacaacccccacttccaaaccatcttcttcaacccaactttaccagtagaagtgcttatattttagttttctgctgtctgtgcccctcacagttggttctgatattggtcctctaaaatctcaacagttggtgacttcctatatcctgccccagtttctctcagccatgctggctcatccatttactctctctctcatcctcagccacacagttcctctgttctttcctgcctcagtgagcacacaggtgcagggagattgtgaaacccctccaggctagtggatgagttctgtaatgctctgcctgatggttaagtggtgagcactcctctcaggagcattctgtatgcctagttgttatttctcattagaaataaatttagttgggaactctatgcctgacactctcatcctgcagaattttggccagaactctctagtgtttccaaaacaaaactctgccttaattgcctctggcaaaatatttgaaagtaaaatccaaaagcaagggaagtatattgctgacattgatggtacccaatttgatacatttgcctggttaaggaacttatgtcagaaagaaatgaaaatagaaattcaagtcacatgagccttacttgggcatgttctctggatttgtgcagaaaagcgcatgagtatattcactgtcctctcttgaggaaaacagagtacagctgtacaaacatgttcaaacagcttccaagaa

SEQ ID NO: 33493 - DNA, 1217 bp, Bovine  19866881089986
tgaaagctctccgtgttgctaacttggtaagttttcagattctggttctagatgtcttttccttgaactattttggtatataacaactgaacatcctttcacgtatagactgagacttggtctcttttcaatcactttgagatcatctaatgatagttattgagaaaagtaaagaacaaatcgctgaaaaggtgacttactgtagaacacatccagcctcactgttaaaatgctttttgccccacactgataaatccttgggttttaaagtgaaagggcactgttagaggtcacctactttactgctgaagaaaaatgaaggaattagggccacttagctttacattttttcactagtacttttcctttactcattcaacaaactttgatagtgtctctaccatgtgtgtgtcctggaactagaaagtatgaacacagtcccagcactgaaggtctcacagtcctttggaagaggaagcctggccaataattaccacaacaagtaaaaccttctaacataatggcacactcaaagcactctgaggccacacctttgtagatgaagagttgactcattctagaagatatgtatttgccaggcagggtaggaagagagggcatcctggacagagcaaacagaactcaggaaggagcacagtcactttggaaaacgctcagtgtgttagtgtgatgagtcagtaggacgttagaatgaggagtggtgaggactggcggagtttccactgtgggtagtgtcagtgggaatgctcacactcagctggaccttcagttagggcaaaatgtagggtattgaaatagttccaagttggttgaagaagagccattgatctgaggcccctgcaactgtcctgttgcacccctagacctcctcagagctagtgattcagcagttgaagagtcgacacccagcaggaggcccttagggaaccccctctggctgtaagggcaggaaggcagtggtggtatcaattttttgagcttctctcctcttggttgccatggtaaagaatgtaaactttatcctacagggtagaacttgaaaaccacatgcctccaggagtcagacagactacacagaaaggagtgaagctagtgggtataaaaagagagaggtgatgacttcagtgagctggaggcattcaaattaatttttaaaaaattctgtgttaacaaacatgaattaacctttgccattg

SEQ ID NO: 33494 - DNA, 877 bp, Bovine  19866881092391
ttttttaaaaatgagttaaaaaagggatacatcttttctcatttggtcaataatcccaacctctggagaagtcagttgatttaaaatctgaatttagtttccactcagtatgtgagatttatgcgtgagctctgctgtcagcaaaatgtgtgtcctctcccctgctgacgttacaggctgcgtctgcttttggagataccatgagagcaacaatacaaaaacacaattttatcaggcctttaaaactgtgtgatggagacaactatgtagtttgcagataatgatacttaccctgagttgtatgagggtcttttagcacttttcctttctggggcttaatgttctgtagggaatctaataggaaaagtaggattaaaagggagaaggagtgctgaggaggagaaaaatagcttgagatttagtatcttttctggtgagcccaagaatagaaaggaactaacttttcatttggtaaataccacttaccatctcttcaacaaaattatgctgctacccatttagttttcctacaaaaggactgaaaaagcaggttggatcaatgaaaagagcataaatttggaggcagccaaaatatacttgaattccagcctggctgctaacaactagtgtgacttttgggtaggtttttagacattttgagaagtcagtttccttgcatgtaaaataagggtgaaatcatcttacttacccctcagtcctcaagttcagtcgctcagtcatgtctgactctttgcgaccccatgaattgcagcatgccaggcctccctgtccatcaccaactcaaactcatgtccattggagtcggtgatgccatcccagctgtctcttccttttgttggccccttctcctcctgcc

SEQ ID NO: 33495 - DNA, 1481 bp, Bovine  19866881097758
gagatcagccctgggacttctttggagggaatgatgctgaagctgaaactccagtactttggccacctcatgcgaagagttgactcactggaaaagactctgatgctgggagggattgggggcaggaggagaaggggacgacagaggatgagatggctggatggcatcactgactcgatggacatgagtctgagtgaactctgggagttggtgatggacagggaggcctggtgtgctgcgattcatggggtcgcaaagagtcggacacaactgagcgactaaactgactgactgaactgatacctaggtgacagtgataaagtttgatatatttttgaagggagaatcaagccaataggtatggctgatagaatggacacagggtgtcaagagaatgaaatagtcaaggacaactgcaaggtttcggccccagcaaacagatggcaccacttcccacaacccagggatgttttaggaggaatatgggtggtgaggaggaatcaaaagtctgtcttagaaatgttcaaccaaagatgcctactagacacccaagtgaagatgtcacttggataaatgagtctggatttcgagtaaacacctgaaaataaaaaaaaagaagagtcctaaaagtatattaaaatagcacacaagtactgaatgggattccttcacagagacagcatgattcagcaacaatataacatgtggagctcttgcttcaccaacagagcaagagtagatgtgtttcatttgtacttcatctaggtacagaggccaaacctttcctctcagttggagtgttgcctggttaagaaacttcccttgaacctgagcttcagaagtcatgaggcttctccaatcctgaagtgatataaaaacttactacagagagattaatgctctttcagactgaacaaattagaactcccctatatcatttcaaagatgtcaacaacttttaaaatttccataaaggactctccaaataagaaatacaggtgaggcgatcatgacacagccagtaatgtcatccatttgcatgctaaagatgtgacataactgatttctccaaaacctgcttcaaaatattagatttgccagtcagtctggagcttctccaattccgtgtggctccttttccttgacactgcaataaaatagtttgtagacaaggctgctgtgttgggcaaagccaagttttggcctcgtcccatgaaggagagccattttgcctggtgtattttcaacatgcacagatgtaagggctttcctttagctttattgtctccaagttttcttcagccaaaaagaacaaaaaatgccatgccacacaaagatcttatttccttctctatcattttcagttgaagccaaaccaagtgtaaatgaagtccagtgtcctaaatcataacagagggtatattttctttaacttccatcaacaggaataattgtccatcacctaacagagtataacagca

SEQ ID NO: 33496 - DNA, 1817 bp, Bovine  19866881101337
cagggacgggagcctggtaggctgctgtctatggggttgcacagagtcagacatgactgacatgacttagcagcagcagtagcaagctggcattgcattaattaaacaaaaagcaaacaagatgtctgaaccatatgcattaaagatttcagaatgacatggcgagcaaattatacatgcaatgcttacactttcagaaaaacaggatgctcagagagacctaaattacgtgtgggtactatgaaaaaaataatgaggtggggcatagctggttgaaggtgagatttgggagcttttttcctttaaaatactttgagctcattcaagtgtgtgatgcctcagtctttaatggaacaaagaaaagccacaaatacgaacagaccaaaagttctctccaaatggaagacacgaatcagaatctttaaggaggtttgcctccaccccctctttagaagtgattggcacacacttaggttagactcaaggtaacatgatagaaaaactttctgtcaagaatccacagtggtctgtgctgcccttgatctgccctatcccatggtcattcagtaacaggaatgacttgagtgagctgttccgctaaatgagtctggtttggtgcccttgagctccagggtcatgtgactagatgtgttctgatgctccagagctgcaatggtatgactaaccttgctgagtcatgctatacttgtggggcatgaagcatcagtgctttaattaaaatgcccttaggagcattaggaagcaatgaccaccctttcccttcacttggggtgtgtcagtgacacaggacagagtcccacacaggatataattcatatgagccagtcttgagtagattttttttttcagttaaaagagtgaaaacctgaccaattcttacagatttaacaaaggaaaagacattttcctaatttttctgtccatgcaagtgatcatactgggggagaatgagcagcaaggctatttgttgatctgttccctcattccaaccccttgatgtgggaaaggagaagaaattctgtctttgggaagattctgcagatgccagggtataatcaattccagtaatattaaaaagatcttgtacttgtacagacttctagagcttgctaaccacttgccaggtggctcaatggtaaagaatccacctgccaagcaggatacacaggaaacttgggtttgatcccctggagaaggaaatggcaacccactccagtgttcttgcctgggaaatcctatggatcgaggaacctggcaggctacagtccacagggtctcaaaagagttgaacctgatttaagcaactaaataacagcagcagaaacactttcacataaataatttcatatgtgtctgatagcctcccatgggatatcaggattgttatctttacatatgttgatttttaaaaaaactttaaatgcactgtaatatgtatataagtgatgttcattatacaaatgctttttcattgttttctacaaatgcatgtagaaaatatcaccatagaggccatcttccagcccccacaaattgcacatgccaccctactctaaaatatacggaagaatgattttctagagaaagtgacagttcacacttttttcttctaaaacaggaagcaggcaccacagtaggagaaaagggaagctaaccttcctctttcatgttctctggggctgtgatgcaaagcaatgatgcaaaatattttaacccccagttaatctctataagagaaaacctaaagtgtcagagttaagggttaatataaactattttttaaatgacaatcttca

SEQ ID NO: 33497 - DNA, 1261 bp, Bovine  19866881134902
taaatgttctcagtagaattagttattcattctttaatatttctgatatgttcaacatgtaagttgttaaaggagttttagtcactgctgtccttcattcctggctttcatcttatttaaagtgaaggttggcaagaaaggagtgtatttgggggattagaatggaataggtactttttcagctatcctggggtgttttcactgtttcttaatttaaacagttacaactgattaaacatttctctttttttctaaaacagtgatcaacattctgcatttattcattcaattgaaaatttgaagttattttctctacatgacacttttttccttttcactcctagtgtttactaaaggacaagtcacaacaggacagtacagaatgcttgccaaaagaggtggatatgtctggatagaaactcaagcaactgtcatatataacactaagaactctcagccccagtgcattgtatgtgtaaattatgttgtgaggtaagcttggaaaataaatatttgggggcagcaagtagtaagtctttgaatgctcttttcttttatagaaaagattataaatgataactgaattttcacgtttctacccaattactgttttcagtattctgagtttctaaggcagctatctttcactgattccactaattaccatcagtagctagtcatccccatcctttctactcccatttaaaaaaagactttgaaaaaataccacatctctgatggattagtttgttctagtcatacagctatcatcataaattatctcaaggcaactatattatttttataaaaagaattctggccctggaatagttaggtttgtgtcatagctttgtccctcattaattccatgacttggggaaatctcatttctctgaatttcatccatttaggagagataataaaacttacctcaaaaggttaaaatgaggattaagttaaattatttgtgagattactataaaaggctgtatgatgggacccatgactcttgtgtattcatgaactcttctcttagtggactggcttgtgaatattgtggctatcaaatttcagcttgttgacctctgtgacacaaacctcctccattttagaaattatcactttgtattttaattgtttgcacacctactttcacattggattttacactgcctaaagcaagggttagatattttgaactttgaatcctcagttcatttagtaaacacttaaagtttgttattaaagcagcagggttcag

SEQ ID NO: 33498 - DNA, 1724 bp, Bovine  19866881146483
tgtcccatgacgccccctgtgcccatgtactgtgcttagcacactgggctgttgtgctcctgagagcaggcgtgggttctccttcatttcatgcaactcagtccccacccagggcctggcagtgtgtgcccagtaaacatttattcctccttgttgagactcttaatatgagcccaaaaggtctctctgaaagactcagtagactctatacagcccataccagaactcagaccctgtacacccatggagcactgggacccaagtcagaggctcttgagtctctctctggatgtgactgcaactagcccgatggcctggttacatcaggcatcagaatggctgttaagggagaaggtggttagtaggggccttaataatgaccaaccggggatgtaaagacccttcttcctattggcttcctaatcccacctcctactgcctgaatacctgctccgagacagtctcaaaattgtcctttccaatgtcccatctttcatgtgaaaatcagagaaaatggaggaagccatgagtgactttggtttgtttctaattatgagtaatagtcatcatagaaatcttcagcaatacggaaaaatataaagagataaatggcatctgagatctcacaattgaaagcaacttgtcatatataagcattctttttttcatcttttctgtgcatgtctgcctctttggctataactgaaatcattctgtacattcatgtgtatgattttttttttctgatgtaaaatatcttcaccattagttgccagcagcagcaacccctactgtttattgcactttttagaagccccacctgaggacatgtttaatgaaaactttactgctgaggacggcttctcactcacccccagctaatgatgagtgaatcttctttgctaaaaactagagatttttgtcatttatctccacctctgcaaaagaaatggtggagaaattgctgccaaatgttaactgtctctgcagcagacatttttttaaaatagagtgaacagaattgtatgtaaacagaaggtctcttcacaacaaacacattttgctagctgatcaacatgcttttatttttctaccttgtgaccttattgtaggtctttggtaagatgggccattactttttgttaaagcgtcattgtgtctcagctggcttgttttcccttcctgcttgcttaaagagtcatgtgtcgcccaagggctatgagctgtaccctctgttctaggtggtgccagacaggaggttagaattaaactctgggtgaaaagcaacccctgctttctcggttctaaagtttatgaccttttcctgtgcatcccaggtgttcctgcctcccaggaccccctgcattatctgagaatctgcctctagggcaggtggtgggactgagacggagaagcacgaccaaggcaggaaggcagtatttccttccccagatctggaatttagcccagagtctagcttttcagacttgaagttatgaggattgttttgggggcaaactagaaatggatgcaatttcccttggaacgccctcgtcttattgatgcctgctgtcgtcgacacttgtgctaacttcactgatgtccacagcctacagagtagccacttacctactgaccccgttccagtaacaaggcattttgagctattggaattcatgggctgccagacacagccatgaaaaggggacaggccagttaacaaa

SEQ ID NO: 33499 - DNA, 3828 bp, Bovine  19866881151712
ctggtgacacagccagcctgggaaaactgggaagaacacaatgcaggtctttcggctcttcctgactcttaacagggttgtgttttttcctctcctagcactgctctccttttctctggcaccatctggattcttctcttacctttacctgtgggcagactagtctcttatagggaattattggataaaccatgtgttagctgataaggacttaagatttaccttcttatggggtgctggcattttacaatgggacttgcccccaaatgaatgaagttgtaatcacttaaggtgaggtggtgttcttttggcattttccaaagtcaaattcctctgttctctagaccagacttaattttcagtgcttgaaaataaacagtgaggtggaagtttcaggagacccagaggccagactgtttgtacctaatggcattttactgtggttcagacacagtgcacaccattcatccagttctatacatctcggaggtctctgccaccatctgtgcattatcatcctttccagatcttgtccatccaaatggtgggaggcaggtgggtaaggagggtttgcccacatcgcccctgctcctgtgctctgggtcttaccccatcctggtgaggatgtgattggcaatgaggatatgtgttggtctcatcttcagcagctttaacagcagatgtcctttgttcttggggaacacattaaacagtgagatttaaactgaactttgaactgagatttcttaccaaaaaaactgcaagtactatactatatctttcttttcctatctttttcttcttcttctttatttttttggagtgatgtgcaatttgtctttctgaagtaagtgggttaaccagatcttaatgagatttccttgggctttagaacaatagttgttactagctatcatttctatgcttttcctcctaagaacaaaattcactaaacattatagatgttaaggtgaggttatataaaaatgaattcaactaagtatctcctaaatgagtagcgtctctttgatctgaactggtgtctgtcaaacattctttattcaacattatatatgcatttgtttattaaactgaaagtctaaaatttgctaagtcatgttctacaaactgagattataaggatgaagatgatgcatttcttctccaagggaccttgccctacagtgcaaaagacagcattttagaaaactgggcttcacttaagtcaggaaaatagtaaaattacacgtaggattgctgtgaggattaagagaattaatattgcaaagccactaggatactgactggcacatagtaaagggctatactagtgcttccacaaaataaggaaactagaggacgttaatgtgtgataaggacatagcatgagaatgtggatgtaaatatgggtataaataaaacactctggaaacctggagtaagaagattttgaggttgggagtggcttcactgaagagttgagactgaatctggatcttgaatgatgagtgagattttagtaggtacatagagaaattgcaaaggagatttcctgaaatgggaatagcacaagctgtcttgtaaatcaaagagccttgtctaaaacattctgtccaaaatcctttactgataccagctcatgccgctgggccagatgtgatcaggtcccctcctctaaagcacttgttaaatgccttgatttcagcattatcttattttgcaactatttttctctaattttcaatatatgagtatattgaatactgccttggtgctggttctcctgatggatgtagtctctgttcagaaaccactagaaaaatggagcactgtctttggcaccagtaggtttccatagcacactttctgacccatttagagttaaaaaatgccattgaaagaatttatgcatatataagtaaactaatcctcttctcctgggttttgatacctaagaaattgtgagaaagggacaattgtgttcactctttctatgatttctgcttgtatatccagagttgatttttacaaaaagctcagagcacctcaaaggaaaaagaattattgaatattattgatattggtttaggaaggctgtccttaagggtctgccagtttctttaactgaacagttagttacacttcatagctgtttgaagtctgcatgtattttccttgcttctgtctgttccaacactgggttcacaatctatattttgaacataaaactctctgaagtgaacctgaaggatgaagtctgtgggggagtaggctggggtcaatacaagcaggattacaaagctgctttgcaattttcaatcctagaaatcctatgttaggaaaaagaatcagcttggcaactttcttttaaaacaatccaggctttctcattttaccccatcatgagttttattcctgactatctcatttatagcagaaaactctgatctttaaaataaaatcataaaggaagagtggtggtcctatgttatatgatgagatatgtattttttaaagacctccgacagagataaggaggatggtgtggggggtagggggatcgtgatgaacactggtgtcagagagaccaacaaggagatgatttcagtaatttgtccataaagttgtgcactaaggaagcagagttgaggatgaagagaaggaaatgcttaagagcgactgtgattcttttcagatagaattgactggattcagtgattgggtgagagagtagggggtgggctatgtggactccaaggtttctggcttgggttttgaattatgcagtactgttcattatgaaaagatgagagatggagaaactggtttggaagaaaagatgatttcaattttggctgtgttgagtttgacacgactgaggtgacttagcagcagcagcagctgcagcagtgggatatgtgtgaagagaagcttataaggctcttgaacaaaccaaatcaattagagagagaagggttgaaagtacagaaataggaaggaatagcatataaatcctattgatatgtggaccaagaggagatgagtgagacagacattttcatatgaccttttaagcgcttataagatgattttaaatacattggcaaataatgaaacaaaaaaagtcttgttaggctatttgttttgagttttggtttggaatatgtgatctgcaatgtcaaatgacttctcaaggtgccttcccacacaaagattctatgaggcctgggtgaaaaaaagaggtatttttaagtgaagctctattttacaattacaactgtgggacagcagagaaatcagactttgagctgagatagcatttttcccctcccctccaatttaagctttcattgaatttggaaatcatatctttctttatctgggtcaaggacttgagaagaaagacagtgagtttagtgcaaaacagcatgttcagatcactgcattaatccccttaaactgctcacccagagaaggtagaagggaagaaaagacaaaaagaaatttctcaacagatggttatcttttttttttttttttcccctatttaagcttggctactaaaatcactttgaaaacaaaccatgctgcttttgtaagtggagaaatatcaataacctcagatatgcagatgacgccacccttatggcagaaagtgaggaggaactcaaaagcctcttgatgaaggtgaaaaaggagagtgaaaaagttggcttaaagctcaacattcagaaaactaagatcatggcatctggtcccattgcttcatgggaactagatggggaaacagggaaacagtgtcagactttatttttgggtctccaaaat

SEQ ID NO: 33500 - DNA, 956 bp, Bovine  19866881152158
ttctttgcttttggagtattggtttggttttaagcagtcaaaatgacttatgtcttatcaaagttagtaactcctaagaattaaattggtccaaatctaaattgctcaggcttggagaggatttagctcatgtctaaatgacttttagcattgatagtgatgttggtcttatttccttggcttagaatcaaccttaaggaattacagtgggttctcattttaaaccgtgcaattgtatcttttgatttacactaatgggctcctcattctatgggactggtaaattatgtccctgttttcttgcatcagagagagactgggaatcccaccctttgagcttttgctagaagccattctcactagcatggtaattaatgctttgttgtcctgaggtgtctgtagccaccagtctatatatccaccctacgtgatgacaagtgctataaatcacttgtacgatagacagtttaattagatggcagaatgggcccaagggtattggctattgtagtgtttaagtgctatactggagaattttatgagatgggaaatttttgttgcgaatcatggccctatatagagagatttatcaagattattatgttagtgtatttctgtagcagtgattgtcaaagcatctaggatattttaatagaacgactataccaacaatgctttaattatgtgctgtcttctggaaagttcctttgatttttacataagtttcaccctgacacaactttgaccttacagggggagaaatgcttaaaaggtaaccaaaagtgtttagtttgctctatggttaaaaaaaaaattaagaaatttgccagaggataggaccacggccaacacgagcccctcataattaccttaatgaaataagtcatatggggccagtgtgaacatgttctcaaggtagtgctttttctccaagtgcttaaaccagaaccgcaaag

SEQ ID NO: 33501 - DNA, 3675 bp, Bovine  19866881152284
ttaacttatgaatttaaaaatgctaaaagttggttttttactgctgtatggtattattggatgacaatgccacaatttaatgcatccactctactgtatctggcacatatttttttcaactttatattcatgagatttatccattttgttgcaggtaactttagtccattttccacgttgctgtagataactataggccagtttattcaatgctgtataatgttccactgtaagaacacatttttatcaattctactattgatatgcccaccatttgttttcattttctgcatagtataaatactgatgctttgaatattcctggatttacctctttatgcatatgttcaagtgtctccattgggttttaaggtatgcatattttccacttcatgtggaagttattttttcctagctatttcgtaccaatttaccttccccaaagtagtcctagaagtttcctgttccctcatgtctttaccaacattgggtagttacagtcttactatttagagtgacttgctgcttctgctgctaagtcgctttagtcatgtccgactctgtgcaaccccatagacggcagcccaccaggctcccccgtccctgggattctccaggcaagaacactggagtgggttgccattgccttcttcaatagagtgccttactcttaaataaaacagtataatgaagattaacagctatttgaggaaaacctccaacatgaaagacaaagacagtgaaaacagagactgcagaaggcatggacaataaagaaaacatacaaatattttttaaatgttttagtagcctcagagaagtgaaaagccattaattccatataaaaaaggaatgtttttattgaatagagaataagaaaatactaaaattcattggaaggattgaaagataaatttaaggatttctcccaatcttaagtgggaggataataaaatgaaatattaaggagaatttcaaaaaaaatccaagatgccccactactaatttataggagttccaggaaggaaaaaaaaaatagaaaagagatgagaggaaattattgaaaaacagttacaggaaaaattcctagaactaaagaacatgcatttccagattaaaggggctccccaagttcttgtcacatgaactgacacaaaatagaaaccacactaagccatgctgtcaattaattttggaacaccaatgataaaaagaggattctaaaagattcagagtataaatcacagactatatacaaaggaagcataattttaaaaatgcgtcagtggggctctacaagtgcaatattgaagttaaaaaacaatggggagaaacatacactccgaaattgggaggtgaataagccagatatccaagcaaaaaggaagagataaagcaaaaagctgacatagcaaaaagcacatgtggtttcattacactgatacactgggataaaagtatgggcatggtgtgtaaatgtaaggatgtttgcttgtgtgtgtatcatgaaatgtagtaaaatatattaaaatattctaaagataattatttccaactgacgattgtctaactggccaggagatcaataatgtatgagaagtagaacaaagacatttttggatgataaacatgtctaattgcatcctatgcacacttctatgtacactttctgacaaaacatggtccactagagaaaggaatggcaaactacttcagtattcttgccttgagaaccccatgaacagcatgaaaaggcaaaaagataggacactgaaagatgaattccccaggtcagtaggtgcctgatatgctactggagatcagtggagaaataactccagaaagaatgaaaagaaggagccaaagcaaaagcaacatccaggttgtggatgtgactggtaatggaagcaaggtctgatgctgtcaagaacaatattgcataggaacctggaatgttaggtccatgaatcaaggcaaattggaagtgatcaaacaggagatggaaagagtgaatgtcgacattttaggaatcagcgaactaaattggactggaatgggtcattttaactcagatgaccattatatctactactgtggacaagaatcccttagaagaaatggagtcgccatcatggtcaacaaaagagtttgaaatgcagtacttggatgcagtctcaaaaatgacagaatgatctctgttcatttccaagtcaaaccattcaatatcacggtaatccaagtctatgccccgaccagtattgctgaagaggctgaagttgaatggttctccaaagacctacaagaccttctagaattaacacccaaaaaagatgtccttttcattatagaggacttgaatgcaaaagtaggaagtcaagaaatacctggaataaaaggcaaatttggctgtgaagtacagaatgaagcagggcaaagaataatagagttctgccaaaagaacacactggtcatagcaaataccttcttccaacaacacaagagaagactctacacatggatatcaccaatggtcaacaccgaaatcagattgattatattccttgcagtcaaagatggagaagctctatagtcagcaaaaacaagactggaagctgactgtagctcagatcatgaactcctttatgccaaattcagacttaaattgaagaaagtggggaaaaccactagacctttcagatatgacctaaatcaaatccctaatgataatacagtggaagtgagaaatagatttaagagactagatctgataaacagaatgcctgatgaactatggacggaagttcttgacattgtaaagtagacagggagcaagaccatccccaagaaaaagaaatgcaaaaaagcaaaatggctgtctgaggaggccttacaaatagctgacaaaagaagggaagcaaaaagcaaaggagaaaatgaaagctatatacatttgaatgcagagttccaaagaatagcaaggagagataagaaagccttcctcagcgatcagtacaaagaaatagaggaaaacaatagtatgggaaagactagagatctcttcaagaaaatgagagatatcaggggaacatttcatgcaaagaaaggctcaataaaggacagaaatggtatggacctaagagaagcagaagatactaagaagaggtggcaagaatacacagaagaactgtattaaaaagatcttcaggatccagataatcacaatggtgtgatcactcacttagagccagacatcctggagcatgaagtcaagtgggccttaggaagcatcgttacgaacaaagctagtggagctgatgggattccagttaagctatttcaaatcctaaaagatgatgctgtgaaagtgctgcacttaatacaccagctcatttggaaaactcagcagtggccacaggactggataaggtcagttttcattcccattccaaagaaaggaaatgccaaagaatgctcaaactactacacaattgaactcatctcacgtgctaataaagtaatactcaaaattctccaagccaggcttcaacaatacatgaaccgtgaacttccagatattcaaactgggtttagaaaaggtagaggaaccagagatcagattgccaacatacactggatcatcaaaaaagcaagagagttccagaaaaacatcttcca

SEQ ID NO: 33502 - DNA, 1065 bp, Bovine  19866881235707
ggagtttctgttgttcttgagatttcctgatgttttatgaatctttttcttaaggatgtcaggtacagcattatcacaggagacattcttgttcatgacatggaaggacttttataccatttcaaaaatcagttcctttagggaaaaagaaaccattatgaagttgaaacttaaagcattaccttcttaagctatgatatcaaagtctattacaaaatcaaaattagaacttcaagtttttctgagactgtctagattttattctgttttgatcctacaaaaagcagtcactgcttatatggaacgtttgaaaattgctctcctgcatttagatccataatgacaagcagttactttcatttgagtctgtgatagatgagctttactcttgctactttgctttgcaaggttggacttcttagtcataaagatggcattgagcaaatattgtttatgtaccagaagagatgctatttataaaactgaactaaactcaaactatatggaggatttctcaatttcttataagcaaagaagagtggttgagctcaagtgactgataagtgtggggataaatctggttcattgaaaagttatatccaggagttcaaatgttgtcttcggaacttggtctctctccctccctatgtctcttatttctgcatccatctgggctggttcccttctatggctccatgtgtagtgagatggttgccaaagctccagatttatatcctcttaggttataatccagtgcagaaagaaatgctactttctggcaactgaaaaaaatcctgaggttagcactcattggcttgattctccccgctcggcttgaattatgtggcaaaccttagtaatctttgaaatcagggaaatatggaactctgattggccaggcccaagtcatttgtcatttctatagctggtgtagagagagagagagctttatcagaagcaaggtctaagcatagagaaaaggtggtttacctagaagaaaatcagggtttcaaaagttgaaagagtagatatcgggtggcaaagaaaatgaggctctattggagg

SEQ ID NO: 33503 - DNA, 932 bp, Bovine  19866881246175
gcccgagggaagtaactgatagctgttctgagtagcctcggcaggaagaaaggacataaccaaagtctgctcccctgtgcttgtgtccattttaaaactagttttgaccttgacacagagctttgagcctaatgagcctgtatatagcttccccatctgtttgtctaaatacctagctaggagaggtagtctatgagtttctggagtcatcagaaatcccatggcaacatggtctgacatttgtgggcccctgattcctttgagtctaggtgagaagcccagtcttctgggaattgtcaggagcaggtggtggcaatgacattctgttctcattcacagagtttgtttctttgctgtaagattggctgatgtctgtagatattggctatttctctctgcaaagacacatggaggcatctggttatttctttttttaaataacctgggttaagaactgagcactgcttccttcgggggctggagcctagtacacagcttgttatccggaacatgataatgaggataagtacataaataagcgtgaaagcacatcccagagccccggctcttgaaggaaaaaaggtgatttaatacacataagcctgacacttcctgcatacatagtcattagtgacaacctgtgagggtgaggggaaattgactctgtcctgtggagcaagaacattgctaaatgtctatgaaaatttttcatgctcaacaaattttgcttctttgcctcttcaatattggcttagctctgcttttctatccattctgaggcccgaagggacagtgataaggggacttctggaaagaaacttctaattattatttatgtagtcagttcttccagctctgctccgtacatctctgtaggaactgatggagcagattctgtaaagtttgctcgtcaagcctcctctccaacctct

SEQ ID NO: 33504 - DNA, 1035 bp, Bovine  19866881257469
atagtgtacaagagcgtccatttaccttccttattcagttagatgtaatcacccttctatccttgccaatttgccaggggaaaatgatctcactgtcttaccttcatttcttgattattgagattgaacttaaaaaaaaaatctatatggttaatggccatttgtatttcttctgcctgttgcctagtcacaagttttacctgttttaaaatttgagttagtttttggattacattgtagagattcattacacataatggacagcagtaatttgttaattggttgcaaatattattgttcagcttgttttgtttatgataacttccatatttttatataatcaaatctatcaatctttttatagctgctgggtttcatgacttatttacaggatgatacaattctaaatgaaaaagcagaacacaaaattgtactttcaatattctcttaattatgttacaactgttggagagggaaggaagaaagacaggagggagaagggagagttgggaaaagctaaaagattacaagtctaggtgatatgttcaccaatgattttttcttttttgtactttctaaatttttttgtaggaattacatattaatttgataaccaggaaaaagtcataagatatgtatttatatattttggctttagtccttttctttagtctctctactctctcaggctataattcccaacaaagatgtgtagggaaagtgatctactggtaggagtggaaacgatttattctggaaaccaggttgctagggcatgttgaaaaaaattgccttacttccttagggaatgtgaacatttgtgtacttggaattctgatctgttgtcataagctcattttttttaaccaatgaaattatttaaagtgtctcacatatatgaaattaccatgaatggcattgatattttcaaatgctccatgatatgtccctaaagtcttaatgaacttaaagagaaaatgaggcccctgctaaagaagcaacgttctaatattaaataggtccccatgccatttg

SEQ ID NO: 33505 - DNA, 1718 bp, Bovine  19866881324675
tggagtgggtagccacttccttctccaggggatcttcccagcccagggactgaacccagttctcctgcattgcaggcaggttctttactgtctgagccaccagagaagcctaccatgtgcctatattacatttatagttaaaaagtcaaaaaattaaaagcaatgattcatggtatttctagatgtaatagaaatctattgtttggaaattttttttaaaaatgtattttggataagtctgcagttactttacatacttttgaagaatcaggacaaatataactattttcacaaagcaattgtatattcttccttttatccatcagtagttaagtaggaagaaatcaccctggtctattcatgaaaatgctccttgctctggattatgtctgagatttttaactttcgtgtacaattttggcagggttctgaagcagccagacctgtgggctttcaactttatgcttgccatgcttgtgatgagggctacagaaagcaaactgattggtgtgtgtgcagaaagatcccatctgctgacaagggtgttccagagaaatgccaacactgtcactgaaacttacaacacagatcctcaaactccaattatcactcattttctccaccttcttatcacttgtgtttgacagctgttcagtgacaatgaaaaaaaggttttccatctccaggtattatactggttggccagattaacctttggaaagatttaattatctttgagaaggcagttcctctaacaacatccctttatctatctcgtccaaattggtatttgcttcggtgattctcttcctgaggcttaactcccctggcacctcacactgtgagtgggtgtcatcaaacaccagaagctgagcctcttttcaggaaacattaattctgtggttgcctatttccagctgtatcttgatacacagaaacctgcttgaggttgtctatcaggataagaattaaaattaggtcatgggaaaaacaggttacaaaatgatcagtatggaatgagcctttcaaatggagtaaatgtgtgcatagcaatgtggtctaggaaaatacaagtgaccaccagtgactatctctgtatggtgggatcactgattgtctttatttgctttatgctgatgcacttgctggtttttcagtctacatatatttcccctttaaccccacaaaataacaaggctattttaagaattaaatatgattcagagttagggaattttagaaagatgattgagtgtgacccctaacttgaaaaagagctctaaaacagtcttattttggaattggtagacacgatactctacttttttccaattccaattcatttgattgttgaaactgtttgtttgaaataaaatcactttttggcttccagacttaatttctatgctgaagggaataggagattgtgtggcatcaataactgaataacacaacacctcagctagatttcagtatctctgtagacaaactgttcatgtacttgtgtctgtgtgtatgcaggcgtgtgtgtatatgtgcttgtgtacatacaagtgtgtgtgcacatgtgtaaaaccttgtctaataggtccaatgggcaagggttacaatcaaagcaaatcaacttccccaggaggcctcagctgaagacagtaacaaactcaagacaggggtttcttcagtcacctcctgactgcctctctgcacataacaggata

SEQ ID NO: 33506 - DNA, 1522 bp, Bovine  19866881329987
tgttcttctttctcctctccctggacaaagtctagacaactttaggctaattttttaatctatctttgtgaaacttttacatatcctaaacagacatttgcccctaatgaattcatctttttctgaactcaactgtggaaattcctcaagtaataatttaggttaatttactattcagttcttgtattctattaaactttcaggccatatgacttcttttactatacaatagcatattctttgtggatagatactactttattccccaggacacaattctcaggtaaatggaaacttaataaatatttaagggtgatgcttttcacccatctgtaaaatgactgcccaaatagtcatgtagttactattcaaaataaatctggacttagattttttatttgttcagttttgtgttttgaaaatttttctaaaaaatcaccaaatgataagtttttcatcattacatattttgcattaaatatttcaagttaaaatattgtggttttggaatggtctttattaccaacttttttaatctaatgaagattcagcctagagcagaaccacattttgtgcacaaggctgccctgaggtaattctctaattagcaacaacagcaaaaaacaacaaagtgaatcatccttgccaagtatgaggagattacaggttcccatttatacaaaggaaatactaaatatagatgcaccccattgagctgctgcatcagaaagaagagagaaaatgcgcaggacagaagaaaatgggtacaagatctgaaaaatcagaaacttctacagagcatcttgtcttccatgatcacaaactttctcgactgaattcagccttctttctcaaacatttcccaggcagcatattgtgggctattctggggaaatatttgcacaaaatatctcaaacttatgtttgctgacaagctatgaagtctgcatttttagtaagaaaattcattttactctagaatttcctgatccaactggcacacctgcttcccatgaatcttgaagaaacagatggaagtgggaaactgatttttactgagattgagtccagccttaggaatactttttaaattcccttattaatatttcacaaggttctgctgttttattaagtagactggctcctctcaggaaaatcttgagaaaataaaaaaaataagaggctgcttttaatgaatatcaatatatattaaaatcagttttgctaaatgagttcaatcactgattaaaaatgatgatgaacatgagctatgtctgtaaaatatgacacagatgatagtaataccattgttactgttaattggtttcctgaaaacatgaaacaaattgcatcttgaccctcttgttctataaatatgctgcctttgctctatttgagcctcggcctagtggcctcctcttttctgatcaagaaatattttactacctgaagaaaagaggttaaatgtttggtaggaaacatcagtggaaagtcagacctggagtgttttggctagttggag

SEQ ID NO: 33507 - DNA, 2101 bp, Bovine  19866881331385
aatgtagggtactctgaagatggtcagttgtgactaggaaaaagcagggctatggttgaagagagcatatggtggcgaggaagggctcttaaggatgggagacacacagtgaatttttaatgcaggtgaaaacaatatggtatctactaagggaagtagttgaaaatacaagaattggtgggaggggggagatagagatgattttaagtgtagttgatttacagtgttagtttcaggtgtacagcaaaatgattaagcaaaaatatacagacatattcttttttcatatcattttccattatggtttattataggttattgaatatagttcctggtgctatacaataggaccttgttttttaatctattttatatgtagtagtttgtagctgctattctcaggctcctactttatcccttccccatccctctgggataattaatgcaagagagggaaaggggtgtggagcacagcctgtgtacaaagcaacacatccatctcatatttgattgcccctgggtattttaaaaggtctgcaaagccgataatgatgctactgaggaagatgttagttcctttttgagaactgtctatgtgctaggtgccatacaggttattttccatgtgttttatatttattatcttcttttattacttagaaaactgaagcacagagaggttaaataatttgctcaaggccacacagataataagtggcagattgtgatttcttcccaggaggtgtgactgctgaacctatgccagtaaacgttgctacctgtgttacctctagaggcagagggaataatcaatgcatgcatactttttaaattcacaatatatgttggttttgatcagcaggcactattatcattttgcagattacaacgctatttttgtcttgtttgttctttctctggcttgccactaaattgatttagtgaggcagtgccatttattttcttttcataggagttgggactggtttgattcatcctctctctctttatctggaaggtagcacaacctggatattatctcttcatattattaatccacatattaaacctgctcaaggattaaaactactctcaggagagtcattttcctaagctttcacactactacccaactgccttgaacaactcttcctgacacctgctttgtgattgattcctttatacagcttgatttttggatttctttatgaaatgttgtctttactcaaatgacatttctttgaaggagtcttttctcaacctgaaactagctctgacctttctgttctatgtacctcacagctgaactcaatagctgggactatggacctggggagcacagagtcatttaaagctaaggaattttttgatgaggaagggacaggggaagatggaaatttatcttctaatagtctaaaatattagctttcaaaatataattctaatttataatatggatgcacagattaggaattttcttgtcactgttggtaatcatcaccctcatgtgttgcttatttgaattagaaaaaccatatccaggaaatgactttcctccaattgctaatttgatggatgtatgtctgcaactttgtcttgtgtaattagtttttctaagttttaggcagttgtatttttaaaagacttgcttttataacactggtcagccatttcaagctcaacccatttgactgatatctaatagcttgcatgcttgatgttgaatattaagcaaaggataggggctagaggagttatattataggcagaagaagccacatgtgtgaaggaatggaggtctgtcatctaggaaccagcctagcttgatgcacctggcaatagtccttttcctttcccctgtacacagttctgggatgccagcaggtcaggacttgtagagtatctggcattctaataattgtgaagattccagataactttgatcagttgttagaactaaaaggtggttcacttggtgatattttttcctttgtgttctcttgctagtccctcccgaggccatcggcttcttgtctgcagctggggtctttcttggtcttctgggtggcctcttcctcttcatcaacaagaagctgagttt

SEQ ID NO: 33508 - DNA, 917 bp, Bovine  19866881360415
taaaaagctaacacagccccatgtacaattaagcacttaataatcttgatgatgttggtggatgttcaaagagaggatgaagataatgacagctctcagcgtgctgtgaaattactactcataatttaacaacactaataacttctgcattgtgcctaccactttgaaaatgctttcatggtgctaccccatttgaagtgggtaccagaggtgttatcatcactgcattaaggaataaagactgggtagcagtggcaagtcgaagaaggtgatggcaccccactccagtactcttgcctggaaaatcccaggcaaggaggaggagcctggtgggatgcagtccatggggtcgcgaagagtcggacacgactgagcaacttcactttcacttttcactttcatgcattggagaaggaaatggcaacccactccagagttcttgcctggagaatcccagggatgggggagcctggtgggctgctgtctatggggtcgcacagagtcggacacgactaaagcgatttagcagcagcagtggcaagtagaggtcttgtgatcctcagactagtgtgtgttctttccattctattatgtgaggttgcttcccctgccaatcagcgatttagacaaactgtttttaatacatcctccatctctgaaattctgtgtttaagtttctaatggtcaccaagctccatgacaaatgattacaatccagaagagcatgcatgacttcctgacagtttggggattatgacacccagtggagtcaacattaggaactcttttctttttttttttttaatatacttgatttacaatgttatattagtttctggaatcaagattgccgggagaaatatcaataacctcagatatgcagatgacaccacccttatggcagaaaggaagaggaa

SEQ ID NO: 33509 - DNA, 1012 bp, Bovine  19866881680484
ctggtggaaaaaaagacctacaccaaggtacattatcatgaaaatccagagctctggggataaagataaaattctaaaacctttcataattaggaatactagaagctggaagactattaataaagaacaatgggatcaaaattccaggtaaataccaggacaaaataactaaaggagaaaaaggggaagatagctgccttttgagatcaaaagtccaggggcaggaagtggtggagcaggactgctgaactgtataagctacatagtattattagattttttaaattatgcagaggtgttactctgatgaaaaaattaaaatgtgattaaaagagcatcaagtaaatttctaaattaccttattaaataaataacgtacctgagcaacaactgaaaaggcctttgattttattttcgctaatgattctgccctttcacatctctggaagtaaaaacaaaccggaaggggaaaaagttaaaacacacaaacattaagtaaaattacgaataattaagtattttttttaccagaaataagattcaagacagaaggttagggtaaaagaaactaacatttattggacacatattaagtaaagacacatagacatggcattactttctaacaggggccatgataacaaccccatggctactgactgttttcattcaagatttaaaaaggataagaaagaaagccgtgagccctggtgactatgccactccctcttcatctgcctatgcccaaagatggctctttgcctcattcactacgatggatgaaaaccttgaaggcagaaagcagtgaatagtagcttaagctgcagactacgcgaaagactgacaagcagggagaaaagacatagcattacagcagtcttcctctgcccctgtaaggactgagggcaccttccaccaccatccgtcccctttcccactgaaaacggtgaacattctcatgcccagtctatacctgatgtggtctttcacaagatttccaggaaagaacaga

SEQ ID NO: 33510 - DNA, 1508 bp, Bovine  19866880358161
ggatactagattatgtttttaaagttgcatgcatgctagttgcttcagttgtgcctgactctttacaactctacggatggtagccaccagcctcctctgtccatgggattctccagacgagaatactggagcgagttgccatgcccttcaggggatcttctaacccagggatcgaacctatgtctcctgcattgcaggaggattctttaccactgagccaccagggaagtcctttaaagttgatatgagccatcaagatttaacaaagcattcctttctcataatgtataaaatgtctgctaaaacattaacattagtattctaaatatgtatgagtcataatagttcccaatcagctattaatagttactgatgtcttctttgtacagaatgtttccatagcaacgtgccacatcaattttccaaagtagaatcaaacataaaataaactaacatagtattttacctttcaaggataaggaacactagtctatctatgcaaagagattctgtggattaaaaacatatttagaaaattcagaaggaaaagcactgtaaccagacaaacttagaaaatggaggaaaaacttttagtttgaacaaagtagataaagttttaagaggtgagaccaaattgcataaatgaatacttattgatgaaatgaaacaaaacctgatactgagagataaaataaatggcacccaggagactccgaccccaaagagactttgtataccaactacagtataggtttctcaaacacaagaggaataaagttacctgctctggtttcctgatgaaattaccccaatgctcacttttctagttctaaaactcttggctaagaatgctcaatctcttatttgggaacacaaatggaatacactcagtgatcattgtatttgctcagttggaaacaagccctgtgtacttcctcagtaatgcaccctatttggggtgatgggaatataaagccactgcatagacatcaaaactgggaggtggacctcacttcttgtccaccatttcactgtgttatcacaaagggtattcttccttatttatgagttttcttcccttggtatagaaggactaacacctacttactttccttcaaagttctcagggatgactcataaaaaaggctcttcaattaagccagtgcactaaggtattttcaataataaataattttctttaagcttgcagaaactttcatctgcatagacacttatctagaatctcaactgacctttcctatgtcttattcatgctcctaaaacttttcagaattgtagctggaggttcccactgtttcttggcctctctatagctataaattttctagccatgtgatcttacagtcaaccaggtttggtgaaagtgcatccagatacagcattaagtgagccatgttcaaatttcagctctgcctaatgttagcttccacgtgaccctgactaaaccaagcatctctctcagcctcagcatcttgtctataaaaagg

SEQ ID NO: 33511 - DNA, 802 bp, Bovine  19866880419621
ttcatatgatctaaaataatctttagtaaataaaagctagtttaagtttgttgggtatgttagtaaacatatcttgtgacacattgaaaattttactataaaaattatgtttctaaaaaatatattttttaaataagttgaatgagttttcatatcaaaagtgtgtgctcagttgtccagttgtgtgcgactctgtgggaccccatggactgtagcctgctgggctcctctgtccattggattctcagacaggaatactagagtgggctgccatttccttctccaggggatcttcctaagccagggattgaacccacggctccaactgcctctcctgcatttcaggtggattctttacccctgagccactggggaactttcccaatatcaaaagtaagctggtacaaattaaaagttggttttttcactgttaaagggaaaaagttttattgaactattggtctgatagtgaaaggtttttctttaccttttaaaatgatctgcctagaaaacaaacatcttgagacttgttaaaataatcacttgtattgcatgttgtctttgattacttaagtaaaactagtcctctcaatagtaaatgagggaagttttgctcagaatatataaccttccatatttgcttgagaagtctttgtcactttggtttagtagataactaagtattgtttcacagtgacctgtgattctattttgactgtttttaaaccttttgttattttttacaaacgtccccaaaataaaattctaaatgaaatcttttaacctaaactaactttgggat

SEQ ID NO: 33512 - DNA, 1071 bp, Bovine  19866880575631
ttcttacctggatcataggatgctgctgctgctgctgctaagtcacttcagtcgtgtccgactctgtgcgatcccacagacggcagcccaccaggctccaccgtccctgggattctccaggcaagaacactggagtgggttgccatttccttctccaatgcatgaaagtgaaaagtgaaagcgaagtcgctcagtcgtatccaactcccagcgatcccatggactgcagcctaccaggctcctccgtccatgggattttccaggcaagagtactggagtggggtgccagggccttctctgggatcatagggtagtatcttattattaatctccctagttcaagtttcatactcttctgatacagctttaatggtactgctaaaaggaacttttaaaactctatttacttcaccaatccttatatactccttaaatctcttctttgctgcttccttctcctcaggaaacctgaggctggtgtttcatcttctggtagaactcttacatatctggtacttatcacttagcgtactaaaccaatactgtcccattagatgtaagcttcttgaagacaagaattaaatcttgtttccactgtatccccagcatgtaacaggataaagtcaaactccttccatagcataaaatatgaccccttccagaatctgtcccacctctcccatctcactgttgaactctacttcacatcattacttccatcacacagaaatgtttctgtgttcccctgtcttttcaggcatttggttacactgttcttgcttcctagaatgcttctcaaaccctgtacctagcaaatactcacttttcaagacagacctcaaacatcactttttctatgtagccatttatcatcccttccctgcagtaaaacttgtcactccctcctttgaacccacactgtattctgtgcagcatctttttttttccttcgtattttaacaccattaaaaaaataatcatttatctatttggctcttctttctaaatataagtgggcttcccttatggctcaactggtagactctgcctgcaatgctggagacttgggtt

SEQ ID NO: 33513 - DNA, 1145 bp, Bovine  19866880691680
aatatcgcgggccgggcctgttgtgttttattttttcgcacaccgggccagggcagcggttcagcatgagccagattttgttccagcaactcgtcccgttgcaggtgaaatgcagagactgcgaggagaggtgaggttcgcgttaccccgtgcccgtgggtggcggttggggttgggccaaggggaaagatggcggcccccgccagtgcgcagcggcctgcgggagggtatccagccggagtccccgggaagagacctatctgggacctggctctctctcactaagtaagttctccgtcgccgagaagggaagtgtgtgagggatgggacgctgacctgcatcaaattaatttaaagaaaaacttatctctgaacgttatcgtggacattatagccctttgctctttgacagataagaactcctgctgagaaaattaatttactcgagggcttacgagttcaacgcagggcgggcactagaactcaggccttggttcccagccatttttccactcttttttgcgttatattggaagtaagttaagcttcgatttaatgaactatgtggtatattgcttctttttcacattagttactagagataagataaattacttttaatagactaaagacgattggggaacaccgtaaattcatttatccattaaaccaatattgcatatttgcaaaacacctgctaggcactggggatgcaatggtcaggaaaaagtccttgcgttcgtggagttcacattctattggggtaggaaatagtcgcacagataaatgcagaattacaactttgacaaatgaggtggtgctgttgaggcttaagtagaagagatcttggcgagaagtcagatcagaccagatcagtcgctcagtcgtgtccgactctttgcgaccccgtgaatcgcagcacgccaggcctccctgtccatcaccaactcctggagttcactcagactcatgtccagcgagtcagtgatgccatccagccatctcaagctctgtcgtccccttctcctcttcttctggcgagaagtcaggagacttcaattttgtctcaattccaccagagtggcagctgtctcatttgtaaaactgatataacatgcctacctacatggttgtttgttaggagg

SEQ ID NO: 33514 - DNA, 793 bp, Bovine  19866880705701
cctgaaattctatacattattcacaatgacatttacaatagcttgtacacatattttagcagacttctcttactttatttcttcaccctgggtggtttttagagaaaaggaagaaagagaggatatggtttcaaaatgaagagaggtctcatgaaacaaaccataatgttcccagcactttaccactaaaaatgtttaagggtaatttagagagaatatttctaaatgtgatttctgatacatatacaaaaataacatacacataaatacctaaatttcataatggcaacatgtagcatgagggctttttccttttataacaaagatggataaaaagaaaacaaaggttaagagaacaatagcagaaaatgtccaatattttcccttaattggtttagagttctagaacaaaataatagaatgtttattactaagacacagaaagtatagcttttgttgataaatatgacatttctgaggcccagtatgtctataatatgaaaagttaaaaagttgaacacagcacagtaagttatcaagtagtccttttggtggttttattttattttactctaaagttacataaaactatgcaatattgaaattagtggcaactcatctttctgattgaattcagcagtaaacaaaatctcagtaccttgatgttattgagagatgccatgagaaaaagttttcaggttgatcagagacagaacatgtcccctggaagctagaagtgatgctctttgtttttctccaaaaacaaaaatcatcaagtaaaaagagatgaaaa

SEQ ID NO: 33515 - DNA, 1516 bp, Bovine  19866880891586
tgtatcttaaatcataatcatgagtgtaagagattccagtgattcctctgagtctttctagtaaattactgaacttgcagttggtgtcagaagtaagcctggtctgatagaccaacccccttaacttcacactctttcaaaaataatgtataagctatgtttttataattgcaaatcatgacaagttacctatgaagaattgctgagcaactggcatgagaataatactgatggttattcattataaggaagagagtttggggtttaaaatacctgacaggtcctctaagtaccgggggggacaatgcaagcccagttttgaactgtatgttgtagcagaaaagagcacatgaacaggtttgggatttacttagtcacagagacttcaattatggctgcttttgctgccttttgttttattagtagaataccaaagagatttggctcttgcatatacagaagtgcaaagccccagagaaggtgaaattgcattttgtaatctcatggcttttaggcagaaggattatgaagcagctgttgagagtaaaatattcattagtttagtctgtagcaacattcaaacgtttagaccgtttctcatctgtggtagctcaagcccttccctagacattttaattgtgcagaatatattgaataggcagaactacacgaatctttggtaaatcgcttatttctgagactttcttcctcctcatgaaaatgtatagatattagacattagtctacccaaatttatgggatgaaggcaagagacagcaaaacatgaaaagccaagctaacattttataaaattaaaatgctttcccctgagtacgttaaaaaaagccatgttacctcaacatttatctctgcacaccactgcctacaggcagtttagctggtgtaggccaccacactagtctcttccaggtaattagacctctatctgacatgacaccttgggctcttctctcttatttctcaaaattaatgaatctcttggctagcagagtagattatattatatgaattttaagtaaaatgctaaaatttacaaggctagacagtggcagatttaaccactgttcctcttcaatggagtcatggtctccgaactctaagagtgtgaagtagaattaacaggggaagcttgcagtacatgtgtgtgtctgggtgtgaacacacacggatgctgattcacagtctggtgcatggaccaaaaatctgcatttttagcaaccacattggtaattctgaaataggtgattgtaggacaacaccataggaattatatatgaaggctgctggtagcaaaaactatagtttattcctccattgtttaaacattatgtgctgtttagggttaataccattctctatggtgtagaagaaaatagagctggtttccctaaaggagaaatgacgttttatttttctcagccttgcttgatgtccctgctagatgggcatataacacttttgaaagttttagggtcggaactaagttttacccttg

SEQ ID NO: 33516 - DNA, 1211 bp, Bovine  19866880926138
taccagttcaaagtgttttgacagttgaagatttccacgaatataaaggcctgagaacagagtatgaaccccagtaagaaactgatcactattcattattattaattttattaggcacaaataatattcatgctgctgaagaggcaaatttgcctgctcaagggtatttaaagacagaagtgtagaatttaaatgtatggcaagcaagaagcttgccctttctcagcacagagtcaaataaatattgtgagaggacagtgacacaagagaaccttagaattgggaggtaaattgaactcaaaactttgagagtcatcctttaaatgatagcttcggcatgtgagacatttacaaaccattcttctctaacagaactgattttggtattgtcttatttcctgatcctattctctccctggtgatctgagcctgacgccctctgactttcagatttaccaatgcaaaacttctttccaaatgtcagaatgtctgggtgctcaccattgactacatgccatagcacaggaggtatctaagtgacctataaatagagctgtgtctgggttggtgccaattcttcctgcaacagaaatattaataatctcctgctgaaaatttcagactaggcttcctagcaaaatagcaataatcagttccatcacaccttaactttattctggattgctgtctctgaatacaaaggacttgtttttgttaaaagaatgaattgatatatagatgcaggaaagatttaccctatttagttcataaaatataaaaaaggaaagcaatggaagaaactggctggtaaatttgattttaaaagcttaaaaactcacagtgtaaaaaattataagcaatattaaaacgtagatgatgcattggaaaattgtataagttatgacaactgagaaattaatttctcaaggtttaaatagcacttatatgccaataaagaaattgaaaatggaataaggatgagaagagataattcagagtaaaagtaattaaaatcaataaacatgacaagttttcaaattttcactaggaatcacgaaacaaataatgaagagatgctttttttggcctgtgctattggtaataattagaataggtaatcctgacaagactaccataaaattggttttcttttagaatatctaaacctcactacaatattgtgggaaagtaccatgctttaagaatataat

SEQ ID NO: 33517 - DNA, 993 bp, Bovine  19866880926724
catggactgataaatcatctgctgcttttctgaagaaggggcaggacacataccaggaaaagggaagagcccaaatgtgaatttcccaatttgaacctggaaagtaagttatgctgtaatacttaataactggaaacagtattttatatccctctgctatttattgtgtattatttttccataggactgctcactagacttcaggaactgattcttagttacaatagaatcaaaactgtccccatggaactaagttactgtgccagcttggagaaacttgaacttgctgttaacagagaccataagtgatcttccacaagaggtcagaatgatgtaaatgcctatgattatattttccatctaatagtgatttatttctcccctgtatgatcactaaaaataacactaatgaaaaaatgctataaattttatttcagaaaatatttagagaaaacaatttattattttaaagcatgtttttaattagagaaagacctatttagcataaaagatatttctattattggcacagtaccgacattatttgttgactagactatgatctccttgaaggccagggtgagaatcgtgtttctattcccagaattgaaggctcagctcagtatgaagtcattacataatactgaatgaatgtccttatcataaagcacaggcagtgtggtgacagaaaaactctttttatctgttggtttttataggtgatcagcttttgagatacaggtaaagtgaaaagacatgaattcttcatattaggaagtatatttgctagcttcccaggctctaccaaggaaaagacaaggcaatgggcttgtgaagctctcaaactttcattggtatatcttgttattggcaaaactgatcataaagatacagattcttgtattatttttcaagcatatttaaggctcttatgaatcagcaaaggaaatttccatggtgcttgcctagaaaacaagattttgcaggataaga

SEQ ID NO: 33518 - DNA, 2037 bp, Bovine  19866880939724
acactggaaggactggggagttaccaggtcagagtaaacacacctgggagacagatgcatcatcccagtcagcgtagacatacaatggtaattaggctgttattccatgacagataagaaactccagggaattagggaaccattcatggtctgagtagacactcctgaggaagtagagtcaacccaagtcacaaaagacacacttgggagatttaaaaaagctttcagatcaagggagacatacctaggtaattagagagacatcctaggaagtagtagacaccaggatatttaaggaaacagtgagtcacacctagggaattagggagacatcactggtcaaagtagatacacctgggaaataagggggacattccaggtcagtgcagacacttggataattaaggaaaatccaggccaaagcaaacaagtctgaggaataagggaaacatccaatgccagggtaagcatagctggggaattaagaagacaggccaggcaaagggagacaaacctctgatgtgggatacctccttaggtatcagaggagacacccttgggtatcacggaaatacaagtcagcaaattacatgggcaattagagagatatcccgtgtcagtgtagacacactggaggatttagggaaacctcccaggtcagtatagacacttctgagaaataagggtataagagcaggtcagagtcgacatactggggaattagggatatttcccaggtcaaggtaaacacacgtggggaactggggcgacatcccaggtatgggtaggcacacctggggaaatttaataagacacatctggaaaataagatagacatgccaggtcaggtatgaggaatataggagacatcccagaagaaagtaaacacatccatatcttaaggtgtgtaaactgctcagggaattttaccgatgggggagtatgttcatggagtccagctgcttgccactcaaaagccaataaacaggccaggttggtggaaaggaaagtttgctttatttcagatgctggcaactgggtggtggggagggtagtagacatctgtcaaaaggccaactcccctcctccaacaagcagagggtgagagcatttatagacagagtcaggagggtgctacatcctgaaacagcacatcatctctaacagtcatcttcaaattggtcatcagtcatctgactagcatcatcttggttgttttaggtacagttaatcttcagttctgggtgcatttgttcccatctctttgtggtcaattctcagaattgttgcagttcatgtcctgtatacagcctggtcattacgtaattaacttctccacctggggttttagtatctataaaacagctcacaggatattgctcagaatattatctacagcccttttagaaagaactaaatgtccttgactatgcttaatgactacattattattattatttagtctcctctgactgtttttctttgcttccacatttctcacttttctgattaaacttattctttgactaaagttttccacagacaaaaggcagcaaggacatgggagagggcgggtggggcaaggaccatagggtcctgctttgtttcacttggactggctgccttaaaatgtaatattagttagttgggattataagaaaagttgtttcaatatgagctaaatctttttttcttctggtaaatatgagtttgattgctcccatagcaagaacaagatttttcaagcaagtaacattatgtctggaatatcctagcagaaacctgggtagattaatgtttcaacatacttaaatatttagaataaatttgtttttcaaaacaaatatgaaagcctcaataatcagttttttaattaattaaatattcacacatataattatcaatttcatacatttagtacaagtgaaactgtctcaatataagagaaattgctagtaggtagtaatactgtctactatatttacattttcagagaaggcaatggcaccccactccagtactcttgcttggaaaatc

SEQ ID NO: 33519 - DNA, 662 bp, Bovine  19866881028919
ggaagttgaaaaacatcttgaagccctatcagatcaaaggggaaagaaagtagaattctgagcagagaaaaagcaaatagcaaacctaaccacagagcatagttcaggaccagcagacaagagtcaacaacactaaaactagagtccaaaacagggttcacaagtcagaacaaaagccaaactaagaaaggtaagcacccagatcagatcttttccacacgtaagggtaaaactttaaatgaataaagacattgggccatctgtctcctttataaaaggagaactgacagatagccatggtctttggatgatgtcaatgtgggtcattaggtcactctgcccccatcaatccaggggccatatctggcacttaaacactggcagaacaatgttttcaatgttagctggatgatattaggtgtagaacaatctttaatgcaaagcctttttaattgacaaagtactctagtcaacataaaaagtggataaaacctgcaattagaaccagtgtttgctggatctgactaagttaacagactccctatccaccacatacttaatgtatatttcttgaaaatgggctgaagaatagagaacctactcacattcaagtaatcacaatacaaggacattggttggttgttgttcccgtcactaagtca

SEQ ID NO: 33520 - DNA, 1160 bp, Bovine  19866881061007
tttttaaagtgttagttattttgcctacctttggtcctgaaactgtgtggatgctatttttggcagatataggatgagaaaaggtattctggaatgcaaacgcagaggagacaggataaccaatcccacaagctgggtaagtcagtctaccctcaacctaaaaataaaagcataaaaaaggctgaggatgagaaatttgttctaaatagtatttggcgatgcaggaggcattagcatctgccataataactaagagttaagaacactctctcagaggccaaacttgcctaccatgacaccaaactctgtttcattacatattatgaaactggaatatctttggcccagacggcttttcagagtggctgtgtaagcttagaccaaaacaaacaaaacaaaacaaaaacccactggacctgattttgaactgaagtaaaacaaagacctctgaatcatcttggttccctctaggccctgaattcctgaaaatggagttcgggggtagtcctagaccaaaaagccaataagggataaaataaaaataatcgagcaatacctttcacacagctatttatcattagtcggtaagattaagcctgtcgtcttttcatgtttttaattcagtaccagtaaggaccacttaaaaatgtaagtaccacttaactctgtactttttcccaagttagcagaaatccttacccttctttaaacatcaagtactatctcatttactagagtagattaaaaattctactatggatttgcactttaaatcctctgccaatgccctccagtcaaagacttggaccagaaatacatctataggtgtacacactctttgcaacaaggaagactgaagaccaggtggaacctagaaagagacgtgtctctgtaagacaatgttaaaaaggactatttattggactttgtcatgtgttagatgaatcaaggaacagtttaagaatgtggggctatactgtggactggatgctatcaagaaatggggataactatatgactaggtatatgaatagattttatccagtaaggtaggatgaatgcactaagaccaaagttataactggtaatgagcagcagtcactcactttagccggatcggaggatacttgcccatttttatggtttggcaatgtcctatt

SEQ ID NO: 33521 - DNA, 1490 bp, Bovine  19866881092218
gtgggccctgtgcccagaccccaaccaatgaaagggattattgttagtgagtgtgagacaaggccaaaggctctttgctcccatggtctggcagagatagggaaagaccaggacgaggtctgccccagaaatagggcagcagatggtggattggattgagtaagggtgacgtgtaaatgcaagtttttaagccatatgcttgtttgtacagaaagtgaagcacagataaaaatatggaaaaaaacaatattttgccacaaattgaaagttaatattagatttatctttgccaagtgcaagatagcagaggatagctcaaaacgtataatttgattaaaagaagttaacacagaatccctttctttgagctgactcttcgcatgccaaggaaaatgatctccccgatcccatgtttcatattggaaaggactcagagggttgtatttatatgctgacttttaatctgcaagtgaaattttcttttaagtaaagaataaataaattatttcaaagagcattttgtttccctgaagtgtgttaaagattccaagtataaaaagaatggaatatttttgtttcttaatttaaggagttggaacagcttcattaatctgtgcatgtgaatctttgaagtagacaacaatcatatgatatcctttccatatttcacatgggaaatctctggtaataagagttaatgaatgggcttctgaacccttaacaatagtatgggactgggaggacctactaacgtaagttctagattatagtcttaaacttagggatcctgttagttaaggcatgtggcacttaaatacattttaaagatgcaaatgaaagcatttgggtcttttgttgggcatatgtcttgaaaggctgaaattggaattaattatttgaaagatgatttaattttatctgggctttcccccaaacagcttctagcatagatgttgtaaatgtgcacagattcctcagcatgaataaaagattaccatcttctgtcccatgggaaaagtataagcttatatggataccactataaatagtgctatgcttaagaatatattgatgtatattctacatgcctaagagtatgctaaaaaaagagtgcatttaccttaagaacattaagttaatgataaaaagatgaaactatcctatatctaggtatttgctaaggtcaattcttgttttagataattttctagttaataatgttggtaatattgacaccagataggtggtgtctcttttactctcttcgaactgcaagtccacatcttcccattgtgaagtgcgctgttttagacatgtcaaggtgtcttggcatccccattcatgagcaaagatgataccacttagctcatagtgctgtagtgaaggataaatgagaagatgtgcatgtagcagggactgaaggtaagactcacatgaggtttatgtgcatagacaacaccacttcattaccctcccttagatcttctctg

SEQ ID NO: 33522 - DNA, 2000 bp, Bovine  19866881200564
gaaatagagggacatcacacgttatactcatattataagcttcagattcccattaaaaatttctatgccttcacagtcttcagatcagagatacacagctagtcagagcagcataggaactgctcaggtagacagtttgggattttaattccagcttctccacttaataatcccagatctccatgcagaccaatttatttaacatttaattatttcctgagcctcagtttcatcatctgtaaaataaggctattaatattaattccacagggttgggaggatttcatgaaataaatctaaaaagcattcattgcagtctctatcagaaaaaccaatgtgcaatcaatgagtcatatagaagatgttttcaaattattaatatattccatatttgatgtattatttaatgataggccatcccagaaaaactcaagcctcaacaaattcaataaattcaagtcattggatatttaacaagcagccactgtgtgacagacactgtgcaccttgacagcacgttattactttataataatggttcatgcctactaatgcctttcacattcttctggcttcctccacgctgtgcaatctggattcacagtgttccttaatacatgaaggctgaaagtggaaatcatgaaaatacctttaactggcaggagtggagcgttgggcaggggaaggagagaggtgaaaactgagtctaagactcaatgaggagggccaacaacaaaaataatgagatgtagttctatgattctgtgaacaggcagagacaggagtgactgcgagtgtgcttgggtgtgtatatatacacatgagctgtattttcatacccaagatactttggcttttatctcaaagtcaactttatgtgtgttggccgctcagtcgtgtccaactctttggactgtaacccaccaggctcctctgtccatgagattttccaggcaggaatactggagtgggttgccatttccttctccaggggatcttcctgatccagggattgaacccccagtctcctgcattacaggccagtgttgtacaaaatacttacagattttctgtctacttgttctgtgagttacctagaaaggtaacattttattttacagttatggatttgcctatttctctttgaagttctatgtgtttctgttctagaagaatagcaatgatacctacacatagggttgccgttagtattaactgagataatgtacataaagcactagtattagaacatagtaaatgtacaataaatatcaactgtactattattcaggaaaatgagaaatttgtatagaaatttggattgtttttaattggcattttttctaatcattttcctaatcatttcctaatcattttttccttcatcatttcatgttcattttataattttgtcaagatcaaacataatacattcatataattacaatttgagtctcataaacttactctaaaagaaataaaattaagcctgagaggatgtttatctctatacttacattacttataatggtagtgtcctgttttcgatacttaaagggactcctttgtaattgaaagtcttaaatcctaaagattgaatgtcaaagaataatttcagtctaaattctttatacataatctttagtatagcctgttttattttgtagtaaatgggtacatatgattgttttctaaaagagaaggcaaaatcaccagctatattgcctattttattaacccaacaagatatatgtttgattatatctcataaaatggctcttctttctttaagatccccttggaaaggacttccagagctgaccaacgagaatggccaatactgccctttcagctgtgaaacacaagcctggtcaattgctgctgttcttgaaacactctatgacttatagttagttgactcatgcatatatcttaagtatgcaaccaattgtattgttgaatgcagttataatggaatgtaaatgctttatatgcacatg

SEQ ID NO: 33523 - DNA, 684 bp, Bovine  19866881232253
agagtatttgcaagccgcactctgactcaggactagaggctcctccaggcccagctgcaatgacagctgacgttccctgaggatcagcatctggaaacttagaatgtattttaaggaactggatattggaaagaaatcttgggacctaaaacaggttaactttagtaatatctgttaacatgtaaaagatataataaagttttaagaatttaccattaattttctcttcaaataacatcattcagttttttccaaatacatgctagggtacgagagctatcactatacaggattcatttgttgttctggaaagtattaatgctgtaagttgaaatatgtcgcttttttcctatgatcataatcctgtttttataatcattacatgtaaaatacttatgttttaattatatcttcaattaatactgctttctttgaaaaaaaaagtggtactatctaaaggcattttttaaattgaaggacacctaatcattacttgtgttttcaaaatttgttatataaaaaagcaaggaatgaaataattaacatataatattctcattaaaagtaataaaagtagttaatgaagttcataccagtatgattgtagacaacatcagttatacaaagcatattccattcctttttcaatttttgcaccagctgtccaacatcagtccaggtgta

SEQ ID NO: 33524 - DNA, 1169 bp, Bovine  19866881351232
taggagacacaggagactcaggttcaatccctgggtcaggaaaagggcccctggaggaggaaatggcaccatcctagtattcgtgcctgtgaaattccatggaccaaggagcctggaggctaccttccccggaatcgcaaagaagcagacaaggtttagtaactgagcacacgcatagacctcttacgaagacaaggaaagcctatgagccacgcttttcttcactaggcctattataacccctctgcctcctccatactacacattaatctgccaggatttcaacttaatcattacttgttcagaaccaacatatcacattcattttgaaatgtgtatgactgaggcagtgtttaaatgtaaactcactggttaaatgcaattttcacataatacaggcacatactacgctatggtttttcttatttttttaatgtaactttcagaaggttatattaaataacaataatgggaattaaatacattatctacagccaccataaaatagattgcttaatattttactcccttacagctcttattaatatgtatatatcatttttacataattgtaatcagagtagagatacaattttgttttctcctttcccattaattatgagtatattttcatattactatttagttttttaaattaacattttcctggctgtattttacccctagagccactgtagcaaaaggcatttaaccatttctatatcattgaacatttaggttgttttgatttttactgacataaataaagaacaataagcaaaatagaactcggactctgggtgacctacattgagtcctaactttgctatagatttgtacttacaaatacctgttgtgttagaaagcaggcttggtgctgggtatgcagtggagcataagaaagatgtggtccattccctgcataaaaatgtggttaatggattagtatagtctaaaatgatgataacagtattatctatcttacatggttgtcatgagaagtaaaagaaatcacaactgtaatgcatttagccaatgcctggcatataataagcatccaatattcttcttatcattatttgtattattattactatggtgatcttattactattattgtttttaggcttaaaacttgcttcagtgccatggttttcaaagattataca

SEQ ID NO: 33525 - DNA, 846 bp, Bovine  19866881476813
atgcagactgttcttgctctgcttccctgcttaggttatctgaaaacatgcagtctcccttggtactttgaactccctctcggcattgaacaatttccatggaaactgggctaaagagaatatctcaaaactcattactcattatgccacttaaacaagatttttaatttcccttgttctcctttttgttacatagtcaataaaaaccaacacatatttcttaatgatgcaactcctggacaagtctggaaaatggtgtctgattaacctacaaagattcctacttatagagaatacaacatctgtttttaaaaagatgctttgcatctcagaaaatgcacctaaatatttccagtgtagcttagccttttagccacagaaggaaaatcctatgctgagattccagaattgttctttgtcttggcaaccttccagcatttgtttctactcttccaaatgccacatcggagtcacagatggcagcatgatttgagcaggtttgagcttctctgtttttttaatccaaatcctaaattagatagaagtcaatattcacctctcagcctcccccatccctgtcctccccttcctgcttctttttgttttcatctcactgagctttcaatttttgaatgcttagtaattttttaccagcacaattaaaacaccagagtcacagtaaagtcaataccatttcccagcacccttcttgtttcaatctgtactccaaatctaaattaattgaggttatcaggtgaatgctggatgctagtttggcccacttcaaaaggtagatataatgttgatagtaggttggactggagtttaaaaagaaaatactacatt

SEQ ID NO: 33526 - DNA, 839 bp, Bovine  19866881876636
tctccagaacacaaactccatgcaggatatgatgcagccatcttatgatagtgaggtaaccatctaaaattaaagcgaactcagaggtggtgagatggaaggctagaatgaccttggctccccagtggcatcgttgggctgtcaaatctgccctagatttcctactcagagcctcttgttatgtgtgcaaagcctacctaaatttgtttaagtaagtgggacattttgggggagtaagcagtagtttctattattcatagctgaatgcatcctgtaaccattataaggtttctgcattctactatctacttgaaagcctgatgtaccatcaaagtggtgactttgatattctaggcatgtaggaagttacccacattacaaactctgcttaactgacaaataaaatctgtggctttgtttcagtcttgtcttcccttatagagcttttactccaataattgcatgcacattacatgaaccctaaatataagcctaacatgagaggactggccatacttcttcttgtgaagtatggaaaagcctttcctctgacaaaatgcctaatacagtgacatatactcagctgggactctgggaacacatacatctgaggctgctaatgtcattcaaaccaaaaacagcttcctgccactctttagtgaccaccaatgtgtcatttaagtgtagaattggggctttctcacacctgtcatttcccagtttcaagaagtcttggttatcaaaccaggaaaatctgttggttttgcataaatgagtaaaacagttttcattttccttcagttaaaagagaaacagtctagatgaatttttgatccata

SEQ ID NO: 33527 - DNA, 1484 bp, Bovine  19866880435746
ctgccttttgaggagcagtttatttctggtccctatttctactaggaatcagccctttaccatacagacccaaagctaggagggtttccaagggtcctctttcttagtaggttctggttttatccccccaaagtcattgacactcccctcccttctcagcctcccagtcacctcttctggatttgaaagatgcctccaggagaaaaaattgtcaagttccacgcacatttggaatttcttctcccagatcttgttctcatacttcattgcctgttagctctctgacaactttaaacagatgttttaaaatttattttttgtctagcatttccagtcattcttaataagaggaaagatctgaattacttagtctatattcccagaaatccaagtccaccacagcccaacttgtcgcaatacaagataatacttgtatctatggaggcatcttcaaaactccctattcacagaaattaaaaaaaaaaaaaaaaactgagcagatgcattcctggaaattgctaatcagctgctaaagactcaaaagcatctggttaatgatattagcctgaatggatcacattactaagcccttttaaaacagaaattcaggccaccatccctaagcaaacttctggtagcaaggtcttcacttacctgcagaaaaataagctaaagattctcaaagccaaacataacttgaaagaacatcctacaccctaagctcatcttctaaagctttgcgatgtttctgctcccaagagatcccagactctgagcatcttctcttttagacagaatctagtgtcagtcatgggcttccctggtagctcaattactcacccaatcccagcctttcttgcgttaagaaaatctcagtccatttctcttctggactccctccccacatatctgttgcagttcaggatatatacatttaattaattcagctttacctcccacctgtaaatagtgagagaagtgtcagatttacatggtggataaataacaagggttttcccaggagactccatcctggtgaaagagggtaagtgtaattttcagctgtgagtaattgtacataatataatcctaaatgatttttcttctgtaatttcattagagtttagaaatttaattagattttgaatcactctgaaataaagtagcaaaacaccgagagactgagagcggtggttattttgtccttagaggccacattcttggtctcaaattggcatgtcttcattaggaggaagtttgcagaacttcttgatatattattgtctttcagaatggactctgaataggtctttggagagcattagaagagtacacaattattatgcacactcttcttgaggtttaagatcatctgccttgcatatacttaataaaaatatgtctctaaagttgtttaagaaactgtggagataggaaagatgttccttgaatgccccgatgctgttccggattattagcaagta

SEQ ID NO: 33528 - DNA, 1279 bp, Bovine  19866880456263
tggctcctagagcctgggatccccgagagccgggattcacaggagggactgaggaaggacagggacaggggagatcctgcaaggcgaggctgggcagcccttatcctcagcaaggccaagaccagcccctcaggccagagtggaaacaggaaggcttcctgaagccagagcccatgggtgtggggctttggattgggctgcatggaagccacctggttgggagtcaagagctcttttccaactggttctgcccaccaactagctggcccctcctgtctcttagtttccccagctgcaaagtgaccaacttcctcaggatgctctgggagatctggcagctgggatcctggcacaaagtctctaaaagaggattgtggacccctttagtaaaaccaaagacagcatcagtctctcagacacacagtacaaacttctgcataaacttttgagattctaatcgcacctgtaaacaaggaacaatcacacccaacgccccaccaattaaaaagccttaataaacagaaataggatgccagctccttcaatagcaaccatggcccccacacagaccagctcctaatgagtttttctcctgtttgctgatggaggacatttgtaataaactttaatgtggaaaaacaaggtgcatttaaccaaagctgcaaacatctctaattctatttaaactataggatgtagtacattaacatctaacaatcagacactcagtcagtgtgaagctagtggagctgtgtttactagaaagcaggcaccaagtcatcttttatcaatgaccacagaaggagcagaaacctgccgtggctgccctccaaccccaccctgtgcattaattaagagtctgctccaaatctttcaccccatggagtgacgctgatggctttggagaagatcggctgagcaggacagacacactcagtgccgaagtctgctaggcttgtgcattcggggaattgtttatcccagaaaaataaatcttttaataaattttttttaaaatgtaaagtgtgtagtgttagtcactcagtcctgtctgattctttttgacttcatggagagaggcctgccaggctcctctatccatgggatttcccaggcaagaatactggaatgggttgccatttccttctccaggagatcttcccaacccagggattgaacccatgtctcccacgttgcaggctgattctttactgcctgagccaccagggaagcccaaaaacaaaaatgtgaagtgagcaattaactcagaagagcagag

SEQ ID NO: 33529 - DNA, 1527 bp, Bovine  19866880503097
ggatctccttgcgtccagggactctcaagagtcttctccacaccacagttcaaaagcatcaattcttcggcgctcagccttcttcacagtccaactctcacatccatacatgagcacaggaaaaaccatagccttgactagacggacctttgttggcaaagtaatgtctctgcttttgaatatgctatctaggttggtcataactttgcttccaaggagtaagcgtcttttcattccatggctgcagtcaccgtctgtagtgattttggagcccagaaaaataaagtctgacactgtttccactgtttcccatctatttcccatgaagtggtgggaccggatgccatgatcttcgttttctgaatgttaaatacaatactgtaggtgtgtgatgttatttgagttgcaaaaaatggatattatgtttctaactggcttggaaaactaaccattttcttggggaaataaaatacatgaaaagataataaaagaagacagttttataatacttactaactcacagcaggtggtggcatctttagcactgtgtagtaaagtttgtttaattattaagtacccttttttcaagttgttggaagatgtctcgtgagaaatgttttgcttatattccgaagcagttgtcactttaaagctctctcacctttccctgctttgtaggacatggtaatactgtggaatagttttgatgttaataattcaaggagactgatcattttgattcattcatggtatttagagccgtaggattaggaaaggcagcagtggcataaagatctaaaggcttagatgttacaattgccaggccagggcttgggtcttgggtctgccattttatagctttgtgacctggcaagctgctcagcttctctcagccctgtttgaactcctgaaaatgggtattttttttagtaatcttttgagaatgtgttgggttcgtacgggtgcacagtaaacttagtgtgctccccagcgtgcagcgttcacccaggtgattcctggtgttgaaaacagagtgtggctggcctcttcatctcagtgcttgagaaaagacattctgatgcttctgactgattcagtatgattatgcgtgagatagttcacactcgctttatcaaagatattcacaatcctttacctttttcaccctgtgtctaggtacattggctccaagtggatacagtgaaagagaatgttaaaattcttttttgggaaaggcagggtgtgaccagagaagagtccacacaaggatgggccgtctggcaccactgccatcgcatgttctttaaaaaggcccgttttctgaaacgctagcatgaaaagacttggctttttcaaagctgggagtcgagagaaaacataacaaaagtagaaaaggaccacgtggtcccttaggcatcctaaatattttcagatccgctccaagtacacaaattataacacaaagcgatgttagttcctgttaactttcgagacggcgtgcacacctgatacgagagatgatcgatg

SEQ ID NO: 33530 - DNA, 783 bp, Bovine  19866880546559
gacgtccctatatcttatcttcttgctaccaccttccactccttgttactattaattaaaatggcacgttattcaaaaccatgagtgatctggatcactcattcagtccttcactaaaaagctcgttataccagcacgtgtcaggcacgtgggtttgtctaagaacttcacagggtacctggaggcaaggtccctgaccaggaccactgaggcagcctttcctcttatcaccatccgcctcagccctcaccaaccacaaacgtgcatccagctccattcagttatttgcaaatccctcttctcccccatccacgcctttgctctggctgtttcctctcctgacgggtgtggcccgcagtcgcagagccctgctcaccctgcggccccagcggaatgccacatcctccacgtgaacctctaccattcccccgagtatgtgaccttgtcttttccgtactctcatgcaagtgtcagcctcctctatggccttttcagactttctatcagctatgtcagtaaagtctatccaatatatacccatatcgacatacttctccagattgtgaggttgggtcccaggccagtggggatcaaacctccccacacgtacctctctttgggcaaagcacagggatgacaggctcataaactggggcttcatacgtgctcctgagtttgttccaatctcttaaattcttccaagaccacggcagttagaatgaggatagacacaatgaaggattgtttgaagttgtgtttaaattacactctggttgtcaattt

SEQ ID NO: 33531 - DNA, 1284 bp, Bovine  19866880568910
tatgataaaccgctcccccaccaaaaaaaagaaagaaagaaaatgtaacagaggtgctctaattgacgtgggaccttcctctcctggaggaagtgacataaaatcgagacctaaaggatgaatccacatcagcccagagagccgtgctggtgttgagggctggggaagcacctctgcaagaaggaaagagttaaggagactttgaggagtggaaagaagtccccagcatctgaagagcagtgaggccatgtggggaggagtctgaaaaaggaagtcagaggtgggggaaggggtcaaggtcaaggtcacgctacagcaggcagtgtgaaggccccttagtcccggcaggccctcatccccaggtggcaccctgtctcctggagagcgccgcacactcacccatcacgatgtccatgccctcggagctgcgttccacccaggagcctgcaggcaggccgtctttaaatcgccctcggagggaggggcttgacaaaaagtgcagcagcagcttcaagcccagcaccactgtgctggggtgcatgtggccctgcacgaagagcaggaaccagtcggaccccaggttcagaaacatctcttcctttgtcctggtgggaagggggtcaataaatgctataaattatctctcagcccataagcaaacaacatgtccagaaaatacaaataacatccagcttcattaggcgcccaggagaggcaggttaagggtaacatctggacatcactcagcaaagtatatattacattttaaaagatcggtaatgtcggcaaggctgctgtgaaagaggtgaatttgcctattaatggctgaagcgtaagttggccaaagcttttgaaagcaactggaaaccatgtaccaaatgataaagccctgctcactactattcatacttacacagtgtctgaccggccactcactaatgacatcaatgtagtcgcataaaacacatcatggttacttaattcccttttaaaatacactgttcagaattagtcttaatggaatagcacattatttatgcatctttattggtttagacaaaaaaaaaatgtttaactgtcactttcaataatgaacttttaaacgatgtgtctagagaacacagacttgctagagggaaatggaggacagagagacgggagccgatgctcaggggcaattgttcagcaaaacctgaggttcctgagagccaggaaagggtccatcctggctgggcagcagtctcagcaccagttgccagattaggtgaggtgagggcatggcca

SEQ ID NO: 33532 - DNA, 4099 bp, Bovine  19866880657410
ttgttgttttctagagtttctgcggttgcagatttaaagaaattttttattaaaaaaagagatatttttgattcatctttttccaatgtccatgtagttaaacttttttttaaattgctgttgtttatttccagtttatttctgtcctagtcagagcaagcaatctttacactttctatctgtgggaaatttattcatggctttgttgtagacctaatgtgcagttaatttgaggatagctgaaaaaaaattgttttacagcatagaaagtttattactttttaaatcaatgctatttagaaaaagcaaaccaaagaaataacatgaaagcatttaaaatgaaggaaatacctagtatgcagacagcagtaaaaaataagaccaaacattgactttataacagcaaacataaaacggttaactattgtataacagatgtgacccttaaacagtcttctgggatctaacaaacatataacagaagcaaagtcagaggcagactttggttcagtgaagctatctgccatgaaagcatcatttaccaaatatgatagacaagcaccaaaatctaaaaggcaaaaactgaaaggataagagaagatcagaaatagaattgtagtgaatgtctctctcggtttatttatcttgcttataactttactttgcttgctgttattcccttgcacagggataaccatagatatgtttgcttccttgagcttggtgtcaatggaaccctacagtatgtacccttttgcatctcgaatctgcttgcaatgcaggagatctggggtcgatccctgggttgggaagatcccccggagaaaggaatggctacccactgcagtattctggcctggagacttccatggactgtatagtccgtcgggtcgcaaagagtcggacaccactgagttcactcaatacaggaggaattcgcttgtgttgtatatgttttgtagttccttttttttttaattgttcagtagtattttattgtgataatggatcagcatttattccttctgggttgtttccatgtggaaatattatgaataaagctgctatgtacatatcttttgatggacatacacacttctttctgttagaaatatacccggatgaaattgtggttaggctgtgcacatgatttgttttagtggatattgccaaatagtctccaaaatgaagagtcagtttacactcactagctcttattctgggaaggttccagttgctccaggtccttgtcaatgttttgcattgttggtcttctagatgttagccattctgctgtgtgcaactatccttgggagcagacagcatttccttccttgtgcaaatatagacactgtggaggttaactcactcgggcaggatcacagagcgagagcacggtggaaacatgtgtgtccagcattaatatttcattctggggcacctgcccccgggatccagcctggtgctttgcctaagcaccttcgggggatgccctgcccccgggatccagcctggcgcttcgcctaagcaccttcaggggatgcctgaacaaattctatatctgaccttatctcccagcttcttctatattcaccctgtactagccactatgaaaataagcttgaagcactaaaatgtctcatttaattctcactacaatcttaagaaaggggtcatattattactaggagtcttgcaacaaggcgtcttgttgagaggctcagaaaggaggtcttctctccagatctcaagtcctctggctcctatgcagccccgagtcatgcccccacatgctgcctctcatgaagcgtgtccacagccctcgacaggttctggagacagcgcctgggaacggacattcccggccagtgtgctgcagttccttggcctcgtgcacagcgcctacccccaggatccagcctggcgggcccctgagttcctccagaccttggctgcggtcaccttccccctgggaacccagaaggtaagacacacctctgccttgccccggtgagagcaggggtgagcatcatcgcccttcaaggacaaaatgccttcacacccctccccggatgaaaatgcattttgagtcaacctagccaaaaccctaagtaaacaactccggtagttttccttctctttatgaggtccagcttcagctcatttttggctctgagattcaataagtttttgagttgtcaggaaatctcagtagtgagaaatttgatggtagattaaatccagatctacatagaatacccacacatgaagcatgaggaaatcacagattccactccaggaaggccaggggtgggactgccataggccccgtcttctttccaggaccctggttctgttggcaggccatggtgcctttcaatcagagggcttgctgagccccagctggtagggcagagggaccacctgggtcttgaggacaaggggtcagtgtcgggtagagaacactatgggaagagatatgagtgagtctgagagcaagagccagtcccagccggtcaaggggactcgtgagcgcggagcatctgggagctaagaacagcaagtgaggaccagcgtgaagcgaggtgctggaaaaggaagggcagagatctgctcattacctgccttggtggaataggagctgagacccagccaaggagagtgaattatcgattcctgtctgcaaatcagtaactgtaaccaaaggaatacgttaggcatattggtaaggagaggatccagaagtcataccaagcgcaatgagggcaagtaatgtttgctccataattatctgctgatcggccaagaggatgaatatgttcttttagctaagcttttctagaagtgtattcatggtgccagcctccatctcctgagcctggtgcttcacatcccctaacaagccccgatgcaggaaatgttaaaggtggaggcgagattcagggaggtgaagctccacagaccagctccctcccgggttagtggggccatgagacccatctcacaaaagtgtcgaaagggtcgagaagatgaaacatgctgcagcttatgtgattcataggtgactaaaccaagatttacacctcagtctctcaccccgaaacctattcgtttccatcagtcagtttaaaataacaatacatgacctaacaaaatttaagtgtttagttttaataaaaaagactaactataaagaccagaagatttgcaaaaagataaaatgttttgatgggttactatcaactaaagcaacatactggaaaagtaagtaaaaaaaaaagatgtaagaaagatcaaaggcagcactggagggggtgggggatgggacctctgcccagaagctgggcgaccccagccaggcagggaggaagcatggttctacagactgcccctcaccattccgctcacctggaggaggacagggccttaagttggggggctgccattctatgcccacaggccaggctcaccatctgctgagtcggagttccagccagctccctgccagtagccacagaccgcagcctgacccagggttcttcctccccatattcagtggttcccacctgagggagagctggcccaaggtcacctcccagtctaccgtggatgagacaggccctgatgccagaactcatatcacagcacctcctggcctccttttagctccaagtcagctccaaaatacctttgttgcacagaacatgtgacagacctgttttcgtgcagaaggcaagtggccaaaaggatttctatttgctacaattttatatggcatctttccagccaaggccgcatggagctaattaatacagtcaccacctccctaggtgccattaaattcattttacagcttaattaagaatggctgcattaattttatgaatgagccaagggaggtgccagcagatgaacttgcatgaaaagttcatgggccaagagtcaggagtccctggccgcatgtccttgggtgtgtcacctggcctcccagcatctccatgtcttcccagacgtatctgggctaatgactcccatcacatttatctcccaatatttttgtaatgtaaaactagaaagtaagaccaaggcacttcagggt

SEQ ID NO: 33533 - DNA, 2057 bp, Bovine  19866880697175
catgtcaatgtctcactatttgagttcaccaacttcattcagaactagcaatacaattaataaatccggttggcattgggggaaaaataagatgaatcatttaggattgcatcctttatttaggaatatccctcatcacacttgttccatttcaagacagacaacattgtttatctaaactttcaaaatcagcatctagtcaagaccagcaaccatttctcttcctgtggttggaaatgcttggaagatttgttcatggctaggagagttgtgctctgtggtacttggtggatttctgctgaaatgtgaaagatggaaagttcatgggaaaggatggaacctcagcagaggctctgagcccagaaggcaagggtccaacctcctggaccgggctcattttcagcatggggcctgtctggggctcagagagcgcttgagaaagttgtgtagagctttactgttgattgaggtatttttgagaaaatcagcattttgaggctaatccataaggacactttccaagtgtttaaatatttaagacagattgttttgatgttttaaaggatgcagatgttatcgctgtctgatggatatgatgaggtctggagcgctcaccctgctttcttttaagcaacagcacactttcccaatgtagcctcgctccacttcctgagaagtcaagtccaaggtctgaaaagaaatcagacccgtgaaatatgctgtgttcttcaaggacagcttctcctaagtacactctgtgaggtcctcccaagagggtggagataatgagattcaggccctcacccactcggctctagtaacaggctacataaaccttctccaactgggcattttacctgcacccaagaggtcgctggagatgcaggcgctcactccgtgacgagagagacctgcctgtgggctgtgtctaccacaggtgccaatccatcctgcgctttctcctgctggacataaggttgccgagagcaggggtgtggccttgagtatggacacatccacctctttgcagtctgctctgtgtgggctcttgagaccctaacagttccaatcccaataaatgatgctcacagcccatcctgtaaccattcatcacccaccaaagtcaggtcagccatactccagcactgggactggaagtagacaagggctggttgccaagaggaaagcctcaaggaggctacccaggagtttctatttagccaaggatcatagctgcctctaagtcaccagcatccctgcctctgggtctgatgtggcatttggcccatcgaggtttgaaccgaaagacttcaccctgtgcccgaacatgggcattctgaacaccttgcaggtgcagaaactcaggacttttgcttatttagtcccgtcatgtgctcagtcctgggaccacatatagccttctattatggattaaacaactgttcatctctgagggatgaatgagggatcctatcaccgacactcgtatgtctgactgcagatattcaagaaaacacatttgccctgcgatgaaggctcaggcagacatcaacctccaggttgcacaaatggagccttaaggtggaagggatgatcttaaaagactaatttgcaactccagatggacaacccagtagcttgggatcgttcatcctctatgaagctcaatatggaactacaaatgcaacaatagtctccaaggagctgaaatattttccccaaatgagtgttcatttcatataactaaatccatataaaagactttggatagtcattattttcctggagtcttttattaaaaaattggagtacttgtaaaatgctatgatcattttgggtatgaatttaagaactgtggagaaacaaagtaatcttgttctgaaataagatttgctttattcacaataataatactaactgcttaagtttgtgaggcaccatattaaactcttgaaaatattgtctcatttgatccttatataatcccatggttttattattgcggtaatattactaaccacatttgactgatgaagattctgtgtttccttcagatt

SEQ ID NO: 33534 - DNA, 1436 bp, Bovine  19866880701198
tgcttcgtgaagacaggattactgaggacaagagtggaagcagagacctgcaaaggcgggctacagttgaccaaacattagatggcgggggcttggaggtggagggcagaggatggaggagaactgctgtggggcgaggggaatgagcaacggaaaccagttaagccccagatgtttgacttgacccaccagggggtgggcagggatgctacttccaactccttgtcaagaccaggaaaactgggtggaacaggtcacagctccagtgccccaggtgggctggctgagatcaagagggaaccacctgatattctcgccacctgcctggcctttgtcagctctgcgtccctccacccccatgaactctgcgcccctgggtcattgcttgccagctttaggtgacagggtccttccatgcagcctgccctggtcatacccccatcctctaggctcacagggagtcatccctccctccaagatgcttctagacccaagagtagctcatcagtcagtccccctgggcaggctgtgcttacctgtagaaggccagctggagggccacctgaataaaggcatcggggctgcatttctgctgcttaatgaatgttttcccatagtcatcaaacttataaacggtgaagtcgagattctttactattctgtggaagaaaaaggaaagaagctttcactgcatgcaaaatagaatgcactcaccacagagtctaatgaagtttctcgagcctggtccatgtcaaagcagtaaggtgtccaggacacagtcagagacaggccttgatgtatgggagtggcagagggcatgccgacaagggggactctgaactgagggtgaggctcggctggatagggcagtggttctgtactgggggtggggagggggcctggctgcagggagggttgcagaagcacgagggtcatttgcgtgggcaaggagcaaacaacctacaaagtcctagggagtcactgcccccgaagtaggcctatggaggccgtgcattttgacctgtgtgtgaagtgtgtccagcatccccgtggactctgggcctcctggccatcttgccagacctgccaagcccgggtgctcagggaaaagcttgcttctctgatggctgcaagcatctctcactgaggctcgtgttcagggaaaagcctgcttctctgatggctgcaagcatctctcactgagactcgtgctcagggaaaagcctgcttctctgatggctgcaagcatatctcactgagactcgtccctgttgtgctgtgggaagaaaggcttggggcctggccgctggccacagtcaccacagctaaagctgctcatccaggctttgttggtgactgaaaatccattttacctggaaatcgatgctgagcctcccgtgatatgcccagacctttgctgcccacaatcactgtca

SEQ ID NO: 33535 - DNA, 1195 bp, Bovine  19866880706308
caaccctggatgcctgacagggtggttgttactattaagcatttatatagcactttacattggccaagtgctcccaatcatttattagttaattctcccagcactctggagccgtcagtggactctggttgccatttctccaatctggagacgaggttgctgaggtcaggcgaggccagatgcctcgtgtagggttacctggctcaggtggcccgagtcactggctctgcctttgacccttgactacctgtgggtttcacgtcttacaatcttgttgtcaacccactctaatctccagtgaggtgccctgtgggtggatgctcagttgctcagtcacgtccaactcttctgtgacttcatggtctgtagactgccaggcttctctgtccatgggatttcccaggcaagaatatgggagtgggttgccatttcctactctgggggatcttcctgacccagggatctaacctgtgtctcctgcatctcctgactcggcaggcagattggatggctgaaatgcatgacctcagtgacactccagaggctgctgtcaatttacagcctcatgaagggatgaacactggcttcagagtcaaaatctggttgtataatttgtaagatgggtgattatgaacacatttcttaatgctcccaagacttggggtccttgattattaagtaagaatagaaaaaccaaagaggttgttatgaagatcaaaagtgttaaataaaagaggacacagcataagacaaagcttcatacttgttaggcaagcctctaaggactgtcatggcacagtcagacttcagcttcgaagatgacacaggctggcccatgggaaatgtcataaaggaaagctttgggtccaagaaatccatgggactctatcaaattcttgccttcagcttgggaacctaagagtagaaaggtgaggaaaagggcaaagctggagctaccactgcttccattgcacacgaacgcatcatgctagttagaacctacgctagtcaaaacccagtgagttttctcattcagatcagatcggatcagtcgctcagtcgtgtccgactcttcacacccccatgaatcgcagcacaccaggcctccctgtccatcaccaactcccggagttcacccagactcacatccatcgagtcagtgatgccatccagacatctcatcctctgtcgtcct

SEQ ID NO: 33536 - DNA, 1397 bp, Bovine  19866880706315
ttaaaagctactagagcaaattatgcaaatgtagaaaagagaaaagaataggactgctttgagtgcaaaatatgaatgcaaagacttaatgataatatctgcccaactccgtggcccagttttgtcccctccccaagactaaacgtccatctgccctgctaccaaccaatgcttagagatgcctgacttttgaggccctggcccaaagcattccagtagaaaaagctccacactggggaactggtagttgatcctgaaacctgtgataatgagacaagattgtgtcagctgcccgggccacaggctgtaggcaagagaggtctggggcaaaaatgagatgcatggccctttccaaatttattgtgcctgtatgtgtgggtgagtgtgtgcatggagagaagacagaagtgtatgaaatggcaaagaactaaaagccctctgatcaacaaaatcacaagccaaggaggtagggaaaggtgttttatgggcttgactggagaagctcttgcagtaatggcagaatcccctcagttttctgaggatgcagcccattgtcaccttccctccacctcccttgtcccttactgccttagggtcagggtcccaggtcacctccaatcttcctgggattccttggccatggagttgggtgagaccaaagtggaaaagatggcctttcttggtatcgtcgtggccatgctcttgattttgttcagcttgtcccgggcctgttggcattttttcaggcaagtcccacacagatccttctcttccaccagatgtaggttgtccagccttctgatggaatccatgaacatatccgatgactctgccttgggaaagggatttcgctttgtgttgagctttttcagcttggggagcttggagatgctgttgggaatgttgctcagcaggttgtcatggagccccacctcatggagctccttcagagcacccagtgtggtgggcacgctgtccagatggttcaggcctaaattcacagtgcggatattcttgagttgattgagctctacgggcagcccgttggtggtcagcctgttgttgctgacattgaggtagagcagagaagtcatctggccgatggtctcggggagcttgtcgatgtagttgctgtgcaagtccagccaccgcaggttctggaacttggagatggcatcgggaatcttcttgatcaaattccggctaaggtcgagctcatccacatcagtgagtcgcaaaatacacttgggaaaggtggtaattcccatcttgctcaagtcaaggcgtttctttccatcaaatgtgatcttgatacaattcttggccacagcgagggtgatcttcttgcccttggggccttttgctcccttggccatgttcttttagtagaggagtgt

SEQ ID NO: 33537 - DNA, 1908 bp, Bovine  19866880716191
catgggattcttcagtcaagaatactgaacaaggtagccattcctttctccagggcatcttcctgacccagggattgaacatgggtctccttcattgcaagcagattctttaccatctgggccaccagggaagcccaatcgttatacagtaggttttttttgtatagctggaattagcacagaattatcctgagaaaatgttggccttgatcttattctggttcctttgagctcctgtcaccgagaattcatgtattctctcactcatcccttcagagatttattctatgtaaggacccaaatagtccttacttaatgtgggactctgcttcataccaagacatcatccccagatcagcctccccagaaagccaacactgagccagagatgtgcgcacagcatgtttgttgggggtgcgggttgctggatgtgcaacctcactgcggtctcagccaggcctcggctgagcccatgggagctcagagtgaatggaggcaaagggccagtccctctgcctctgtgctggcccgatgttggggacagatgaccactgagacggggacctgacccatgacaggtactctgtttagctgaggggattctgggaaactgccagcatcttcagctgctgagagaatgtgcttgagccagaggaagggatctggtgcctcctctgcacacaccttggagcagctttggcctttgcagacagcagtaccagtcttgcatttgtggttctaggcagagctggttctggtcctgtcctagttactttccagctgttttcttgacaagtttcttcacgtctataactgagtgatgcctcagacttcaaaaactttcctcattgtttactgaggagtgttttgcgtggttgtagaggagcttaaagtgacgggaaaaatgtcaacatgttcaaaatagcaataaacactcatccacgtgcctcagtgggatacggtggcctcaggtaggtgaaataatgaaacagggtgtcgggtgtagaaatcccacttagactgtgcagagcagtgcagctggggacagcggctccatcatttacagggtgctgctcttacttcccagtgctcagcgggcgaccagactctgccctcttgtcctccttaagaagctgggtgtgtttccctcatgcatggcctgactctggcactctctccctgcaggtgatgcagaagtactctgtggtcatcgtgcagggccacatggtctgcgaagggctcctgctcttcggccagcagcacttgtacatctgcgagaacttcacgctgtctcccgtgggtgatgtctactgcacccgccactgcctatccaagtgagtgcccctccagtcctggcagactctgccgtgaccccacgccgccttctcagctgccccatgcctatgcctcccaccttttccttcctatgggctcgggtttgggcctgaaactgagccatgagataaaacagaagaaccttaggcacaggcatccatgactaggattccccaaagctaaaatctggagcagttaagcatacagcagctgctcgggttctcctgccatgaaatgcaccacaggacaaaagggatcgctcttcaggttgtttggagaatagaatccagtcccatcagcgtacctattcaacaacttttttttaaatcggagtatagttgatttacaattttgtgttaaatattgctgaaaaataatgtatatttatgtataaccgagtcaacaacgtcttgcttgttcatccttatgtaagacatcaggcactgcctctttatccccgcaaggcccgtaatacaatcaccagcatatgcaggttcttttggaaagagtttggagcacactatcaccaagcgacaaaatgcatgttcctgcgaggcctcttcagggttcaca

SEQ ID NO: 33538 - DNA, 1780 bp, Bovine  19866880785560
tctcatcctctgttgtcctcttctcctcctgcccccaatccctcccagcatcagagtcttttccaatgagtcaactcttcgcatcaggtggccaaagtactggagtttcagcttcagcatcagtccttccaatgaacacccaggactggtctcctttaggatggactggttggatcttcttgcagtccaagggactctcaagagtcttctccaacaccgcagttcaaaagcatcaatcctatacatgtagctgattcactttgttgtacagcagaaactaacacaactttgtggagcaactatattccaatagaaataaataaaaataaaaattttaaaagataatagtttaaacaaaaatgaagacaatacgttatcaaatttataacatatgtaaatgtaaaaagtggcaacaacagaatacagattggagagaatacactcttataaggttattatacttgatgtcagtatttctccaccacggttagtattttggactgcatagtttttcattgtgagggactactccatgcattgcaggattttgggaagcatccctgtcttctgtccattagagggccctagtctctagatcatgctatcttctgaaggacaaaattgtccccagtagaaacccacctctgtatacgaaaaagtctaatatgacttgaaagtagactaagttaaacatatatactataaaccctagagcaactgctaaaataacaaaacaaagagttaataggccaacagagaagataaaattgaatattagaaaatattcaacccaaagaaagcatgaaaagagttaaaagggaacaaagaacagacaggatacatagaaaacaaacaggatgatagattttaactgaatcatatcaaaaatcatattaaatgtacatggtttaaacacccaattaaagtcagagattgtcagaatggattaaaaaagcaataccaaaactacatgctgcctgaaagaaatgcactttaaatataaatacagaaatagattaaacattagggtggaaaaaagcatacgccatgctaacactagtcaaacgaaaaagctgcagtggctgtatcaacatcagacaaagaagatttcagagcaaaaatactatcagggatgaagaacggcatttcataaagataaagggtcgacctatcagaaggacataacactcaaacgtttatgacccttaataagggaacttaaaaatatatggagtaaaactgatagaactataatgaaaaacagacaaatctacattatactcagacatttcaatactcctctttccataattgataaaacaagtacacagaaagtagcaacatggcagatatgaacattctcaccaacttgacctgtgtgacacctgtagaagtgtccacggaaaaggtctcatttttctcaagtacacatgggacattcaccaagataccccaggctatgaaatacgtcttttacacttatgcatgtagtttggaaatcactggataagctcatgaaagtttccaaaaagttctgcagtaaaataaaacacagtaagaacaacaactaacccccaaaccaaaactgttccactttgtttaatgtagttcaggaccttgcccttcatccccaatctgaaatacctgcagaaaatgatgtgccactgccagaagtcaaagagcttggaggaattagaaattaggcaaaacaaggtcaaatttcaatcactgaatagcctgacattggatgtcagcatttccccgacgcaaataaaataat

SEQ ID NO: 33539 - DNA, 1694 bp, Bovine  19866880873214
tgggggacactgttcagcccatagcaagggtcttggcacatcagtgggagtgacatgtttgggccatctgtaagagaggggctaactgaaggcagagaggcgtttccatctttaacttgggaagatggtgcactttgctccatttcccgggagctgctaactcggcctgagctgcagaagtggaagagttactagtttgcctccaggatggaatctggcctcccatgaggaccggagcacttggcatgttctcctggtttcagccactataaataacccctccttcctgccgcgttaataggaggagacgagggtgtggggtcccggctgtgcgctcatcccatccatgctgtttcaatttcctgccttccccagctctccttgcttccagtggggagaccctgggggcgggccgagcaggacttcagtcctggaagccagctgctccgtctcggctgcactccgcctgccaaacgcttgggcagctgttaaagtggggtcagcctggcatttctgtgctcttcagggggctcccaccatggggcctgagcggactttggggaaatgcttttggtctaatatgccgtggtgtgtgggctggtgggagagctgcagggaaacagtgagggcagcccctcctttgtcctgtgtgagtgacttgtgtagatagagattgttactaggggcgtgtgccttccttgggtacctgttgatctgcagtcccgagtgtctccctgggcggctttttctttgtcactgtaaacatacaagacctcattcttgttcacaatgagctgagtccagccaagcatccatcttttccttctgaattcacttccatctattttttttaatggtaacaaaagactatcacagtgctgttagctgaataatgacccccaaagatgtctgcatcctgatccctggaactgtgaatgcagtttaaaaggcactttatggatgtgattaagtcaaggatcctgaaatatcctggagtgtcctggtggcctggcttttaagagctgagaagcaaaagaaaatagactctcaagttgtatctcttgaggtgttcagtttattaaatgaacagtggaaactatgtcaaaacgatatgtaaggaggagcttattgcctgaatttttacaatgaaggatactgtttgtgttaaactctccctgtcaccccagcacacacagggcctcaccttgttgactcacagcctcttcacagtgtaaggaccagatctttactctctttttcatccttcctccttgcttacctatagtgctgaccagggttcaaagtcttgggcaactctgccatccaggcccccaagtcccctcatgtgaccaggagggggtatttgggggctattagtagtttgggatgacctcggggacacctgctcttgcagtagggcatcatgcttcctggagttgcttgctgggcagtgcagggatgatgatgtgggatctggtgagaagacagcccagcttggagagtagcaggctctgggcatcttgtccttcctggactctgcctgccagggggaggctgcactcatgagctcccgggctgcacagctgcaatatgtaatcctgcagacgccgtgcagtgtgtctactgggagaagacctgggcaagggtactgggctggctgatctgggtggacagggaggggcaccctcgaatgt

SEQ ID NO: 33540 - DNA, 2941 bp, Bovine  19866880875457
ttacatgctcttcaaggtttaattcagctcaacgtgacacccagttctctgagtgtttgagggtgcccagtggcaaggaggttgatgggcagggtgttcagggtccggccccccagatggcttttggggaaacattgagatgtgttagccatccctctccagcacaccttaagccatcccctgctcagaatggagttgcaaacagtcctggcaggtatgaaaatgaagaagttagctagtggccagcaggagggcacatgcctcgtctgcaggggcagccccgcacatcccgccacccagtggcgcccaaccttccgtttgaaaaggagtcagagatgccactgtcccaccccgcctcccaaatctcccaggctttaaaggctgctacccaatccaagtgactttagagcaaaagccccctgcagcctttggggcccctctgcccatgggctgcactaggtgaccctgggtctggagctgagagtgagggtgtgcaaggaacggtgtgtgctggttcctccaagaaggccaggagacagccagaaagcccctggcaggcttgttgggtgccctagatctgaccccagctctgttatctgctgcactcaccatttgcctttcacaagtccccaggatcccgctccctctgcaagaaagcgggacatgatgaggctgcctccagagccctcctctaagggccgcatggagaaccaatgccccgtaaacagtaggatagccctccgcatgccattcacaccaacagaactccaactagtagacgcccgtttgtgtgtgtgtgtgtgtgtgtgctgagtcgctcagtcacgtccaactctttgcaaccccatgggctgccaggcacctctgtccatggagatgctccaggcaagaatacccatgaagttgtgcaaaaacctcacagctctctgaacttgggctgctggaagcttctggaagcagtagtagtcttggagggttgagacccaaatgccaggtagtgaacctggagcggacatggtgacttgcagaactgctcatctcagagcatacagtctgggctcagtcccagcctcccaaggcacctgagccagctccggtcccaccatgggtatctgcttcccctactcttctctaaaactggacaggacgatgtgagaggaccacctgtggaggagctgaggatgggcaggggtcttgacaccttgcattccccaaaaggaagccagagctctgatgggattacaggtacaagagctgggcagcccccgtggttgtgagcatgccctcctcactctgagggcccgaggtgaccctctgcagcaatgcctagaaagggtccttaacatgtgcaagggtccagaagcagcttttaccccagaaacagttatcacctcacagcaccagccactggagagtgacctccccagcccttgggagaaagtagacagctctgggctttctagagaaactgcccctgcacggggatatttttagctccaccaccccatacatccattccaggggtgttaacgtcaccagtgaaattaaccatccaccttggccaggcaaaggtggctccagccgggggtgtggggcgggggaacggaaagtgtctcactaaaactctggactcaggtttccctgcaagttggtccgaccataatctcttgtcaaaagtagtaacaggttttcttcaccctgtggcaaatcatctcaatgaaaaatacaccatcatttaaaagaaaataaaaggaaaaatcaacacatgcacgtattctgctgacaaagcaatatttgttggttttaggcatcattttacctatcgcttggctatatattatttgagaacttttttcccggtaactacatttttacagttttaaagttttttcccatgaatatatacacatttttacattaattatataaactccatctttcttgattacttaatggaaacatggaaccatctgaagttgctcagctgtgtccaactctttgcaactccaaggacagtaacctaccaggatcctctgtccatgagattttccaggcaagagcactggagagggttgccatttccttctccagggcatcttcccaacccagggatcaaacccgagtctctggaattgcaggcagacgctttaccatctgagccaccagggaagcgattgattacttaatactcttccataaatattttcttctattttaaatgtgttaatgtttaagtctagccttagccaatcaaactctaaaattgggcatttggctgtttctgatgctttgtgtacctgccaatatttgtagagctgttggcctcgctaaagccactttatatcagataaccctaagtgaggttaccagacagactggagtctgagggaccggccaggcaggcccaggtgccacctcctcggccacgtggctctaggacagtctcaggtctcgccctggctcccgcggagcctgccagcgtcctccggctccctgctgtgtctctcctcttcacaggagctcccacctccccctcggttcactctgaccttctcattctctccttcctgccccagggaatttcctattttcttaaaattatggaacatttcaaatgtatacacaagttcagaagacagtgtaacaaatacccaaccccaaaaatcttgcttcatatactccaactcatttctccatacactgcattactcagaaataagtcccagatgtcacatcatttcattcttaagtattagcgtgcatgcgtgctaagtcacttcagtcatatccaactctttgcaacgctatggactgtcgcctgccaggctcctctgtctgtgggattctccaggcaagaatactgggatgggttgccacgccctcctcgaggggatcttcatgaccaagggatcaaacgcgcatctcttagcatctcttgcgt

SEQ ID NO: 33541 - DNA, 1687 bp, Bovine  19866880901687
ggggatcagtgtgaggccttcctactgtgtgcacaccctgtactgggtcagtgagggagcttcagtgtgggcaggtgttccttgccaccttagggcatcagctcacacaatgccaggcaggccttgctgtgagcatcatcctgatctgacagatgaagaatctgcagcccagagaggtcatgtgacttgcttaggtgacactgtgcataactggggacatgggtcctgggactcagacagtctgggtccagggtgggttcctgaccatgcacaaccctgcttctttcttgggcttgcactgctgtatgacgaccttgtgggacctcagctcatcctgcttccatgtgagccctgcttccagacatagtcagtaatgggcagagtcagcacttactgccccaaagctcagaattcctgtttagggctcaagaatggcctggatccctagggtctcagccccagatgcttaggacatggctcagttttctctgtgtttgtttgtttgtttttttaaatcagagaactatttctccagcccaatactgctcacatcttcctgcttgtctgtttttgatcatgggctctgcatgttttcctcatatccccccaactcccaactttaattagagagcacaattgactcacagcctcgttcctggcatcgactcccctggcactccctgcacttgtgtctcggctctttccagagagaatgacccgaggatatgagggatggcttagagctcaggtaatcagtgggatggacctctgaggacaggagaggatgatgccacccccagaaccacaaaagctgcacaagagacgacgtctgaccctggagaaagctcttcccaactgctccgaagcaggcaaggctcagaacaggatgtgatgagaacactaaattccagtggaaatgacagaaggatgtcgataaacggtagatatttgtcccaattgaggcctaacgcagaagcttgacacaaatggcgccttagcgacttgcacaaaataaaatggaatgaaatcttgaaagcaaaggaaaaatacgtaaaacatactcagttccgtgacttaggttgccatgcattttctacaaggttggatgtaggttttgtgagcaggagtcaccagggggttgggttgaacacaggaagtgattctcccttgaaaatcttactagaaaaatctcctggggaaatctcaccacaaagcccacttgccagtccggccacgattggcaggcatttgctggtgactgaggtggataaagaatctgcctgccagtgtaggagatgtgggttcagtccctgggttggtaagatcccctggagaagtaaatggcaatccactccagtattcttgcctgggaaatcctacggacagaggagcctggagggctacagtccctggggtcgcaaaagaatcagacacgacttagccacaaacaacaacatcaaaaaggaggatgggactgagggctctttcaggagtgagaccactactgtgacatcaatagaagtcaggaaaacagaaaagttgagtggaggagtcactgactttcccacaggttagtaacccaaacgaagctattttttgtcatgttgctgcttcgttaccatcattgttcccatgaatttttgtgaccatcctgtgtaaacagattttgtatatagctttctcctca

SEQ ID NO: 33542 - DNA, 1660 bp, Bovine  19866880937762
tccttttctgtgacattttctattggcttgtaaatatataataatccaattacagaggacttccctaatgactggcctgtgatgagttttttccttataaataagctatcaataaccagatgtctatttaaaaattagaatgagcaaagtcatcataaatcaaaacaccccataccttggacatgcacagcctggaagttaccacagtatcttgggccaagtttgttgataacttccagagtttccattgagatggcttcttcaaagaagtacgtggggcccagacgccatattagtaatgacttttgtttccaaactcgaggggtagcaatatatccataaacatccacaaatgaggatggatccatcgaaaggaatggtcctggcaaggcttgaatgtacaacatctgttcaaacaaaaaggtgggggagaggggtagatgggatgtatttaatctcagaattaatcaaataaatacataaacccaaaaatgatatacattattcatctctcaaagtaaaacctttattcagaaacattacaaagataactctcaaagctgagaaacaccgcataaagcagtttataaaaaaaattctgtgtgtatgcactctcagttgtgtccaactcttttatgaccccaaggactgtagcccaccaagctcctctgtccacgggatttcccaggcaagaatagtggagtgggttgctatttcctcctccaggggatcttcccaacccaaggattgaacctgagtctcctgtgtctcctgcaatagcagacaggttctttatcaccagcacctcctgggaagccatgtgggagtaaaaacctgacattgtgcctttggaaataagtgtgataaaaaatataaagtgccactgaaaggttcatctctttttccagtcatttcacaaagaactttaaagtccaatgttggcacattaattaagttttacatactaaatatagctacagactagaaaggaagaaataaactgtccctatttgcaaatggcacgtccatgtagaaatttccaaggaatccacaaaaaaacaaactaataagtgaattcatcaaagtcacaggatatatgatcaacacataaaaataaattgcattctatagactaacaaagaacatgcagaaactacaattgctcacaagaaaaataaatactttcttgttctgcaaaatcgcatgtgaaagaggatgaaagaaagctatagattaggagaaattatttataaaattacatatccagcaaaggaccattatctaaaatatttagataaaactcttaaaagtcaatagtaaaacagtaaacaatccaattagaagtgagtgaaacatatacactgctgctgctgctaagtctcttcagtcgtgtctgattctgtgcgaccccatagacagcagcccaccaggctcccccgtccctgggattctccaggcaagagcactggagcgggttgccatttccttctccagtgcatcaaagtgaaaagtcaaagtgaggtcgctcagttgtgtccgactcttatcaaccccatggactgcagcctaccaggctcctccgtccatgggattttccaggcaggagtcctggagtggggtgccactgccttctccgaacatatacacagacatcactaaa

SEQ ID NO: 33543 - DNA, 2366 bp, Bovine  19866880944746
ttctttagtttccttttcccgcaaatccaacacatttaattgttgttagcacattgttttctaacttcatttttaaaaatctcgatatatcaaaaatctggttccatatcaacagaacttagttgacaccagggctgcaatgaatggttgtatgggttgtgcacaaaggcacatggccagagtggcaaaaggaagctgaaacccagcctttgtcccactgttcagcgtagccgtgcagttccgggacagcgtctgctcaaaggggacacgcggtgctgtgtggactagtggtgacctgagtgggtgtagtttgtggtgactgcgtgatacctgacaggaaggatgagccgtcccctcctcgtgctgatacttggattgttttattttgctctgctataaacaggatggtggaaaacgttgtttagtgactatctgtgcatttattttagggtttccttggagtaagtaactagcactgaaaatggtgagtcggaggatgaaaatgacatgcatatatgtcaacacaggtagatacactggcatttctcaccactgagttcagtcccagaccatgccatacttggctgtagaggccagggcttacaactctgatcgtggtactaagtttctgagcaggatctgaggggttgcgtttagatactggcttttctcttttctggctaggctatacagctgtgattacagggctaatgatgctttaaacaaacaatataatgactgtcatcagtgacagcaggaatttcctatgggagagcttgaacaggagggtcaccagcagctggccagccccaggggtgctcctggcaaaggtgggtaccaccaagctgaggtcggctcacttacaggtgaccttccagataggctgtgccttggtttccgttccaaggtctgatctgtatcctgtagccaaaccctgccctaaggaggcactgggacagcaaggcacaggctctttaaaccagacctactttgcctttcaaatctccaaacagccctctgaggcccttggttctacttcaaaggttctcaaactctttaatacacaggcagttgctaagcaaaggctattttgctccaataagcaatgcagagctctgctctaaatatgtcccccatcgatgtgtcatattcactgctgcccaggcagatgagcttctgcccttgaaccaacccagatcgtcctcctcctgtctccacatcctgagcgtgacaactttccagggcatgaaagttcttagaaatcactagcaaagcaataatttgtttagtgctgtggtgacatgcaaggtggaagccgtgcgggaggaagtcttgtggtggcctaagtcatcttctggtgctgccagctcctgcattgttggggtcccctgtcctcagcttcctcttctgtaaaatgggaatcatcatcatatagctttgtcaggtggctaaatattaaatgtggtaatgcatatggaaactcctttgtcaagtgctatgggcacattagttattggatggaatgctgagagagcagaccaaaggataacaaatatctgggctaccgacactcctatatacaccattcaggtgcccttggtcaggtccctctcccatcctcctaatccactattccaagccttcacctgctcactgctcaagggaagcagagccagcttttcctctacttcttcagtgagatagcacattcctgtttgacaaaagctgctctgcgtccaagttcccccaagagttctgttctcctgctgcacatcttcaaagtatcatattaggaaaaagactgggcttttgccttaaatgtaaaattagtcaaatttgtcagcattttatgtcatttgcagtgctcataatgattattacttataaatgtgcataaacatgtaacagcaatattaaggaaaattttgtaaacaaaaaaagagagaaagaaagaaatcaccctattcccactactccaaaacattaactggggttttaaaattatattgttttcatagttttgagtctttgttgataaacacttttctattttattgaactatgagacacatagaaaaaagtgttcaagtcacaaatatacagatttaagcattttcatggactgaacttgtgaccactgcccagcttaaagaatacaacattaatggctctccagaagcacccccagcttcaggccccattctagtctctagcaccttctaccctcacagtagacaatttcctggcagctgacatacatcggctttctacattgtacttttatgtatatgaaataacgtgtacacgcttctttctgtttttttttttttttcactccaaactatggatgatccatgtcatttcat

SEQ ID NO: 33544 - DNA, 767 bp, Bovine  19866880946824
attgaaatggagttatttttaagacttttaattaactgaggttctgatttgagtggtgttatttattatctcttttcagaggtttctacttattggaataaatagtcaacctaaaagtttccagtgttggatgtgtagagaacctctacaagtctgtctgcttaagtcactgggtctgtatgtcacagttgatcatgcagctctaatgcgggtctttgtgccgtaacgcagtgaagaggctctcttggaaagcagcagtgaagtgacttcacgtgatttggagaagactctgcgggcatcacttgggatactggttgccagctttctcagctgggtaccccagggttcttgatgatactgcatttctttttctgttgttgggaatttttcttaattattatcagaactcaagaagatctatagtttttgctcttttaagagaaataatacttggaaacttgaatttatgtaattggaggattattggtcttttgagaaatgaatctgctttaattatgaaatatttgctaaactttataaatacaattctatataactgatgggcttgctgaaaaattttttccttttagatagtctgaagaggatgccaaatgaaagaatcccccactcaagtcagactcaggagccagactgttcatggagccaggatgtcagtggcagtgaggaggggacaatcaagcaggagaaggatggcgacatggacctggggcagagcctcccctcttgttcctctgctaatggaccct

SEQ ID NO: 33545 - DNA, 4753 bp, Bovine  19866880965234
aaacactgactctggagcctgggtccggctcagaatcctggatcccagtgaatctgattcagaatccactgcgatcttttcaggcaggcagctcttctaccccctatttacagataagaaacctaaacacaaagtatttaacctgtccaagatgattcaagtgccatgtggcagatccacaatttgaagcccagtggcttagctggggaccgtgatccaaactgtttgggagtaataatagtgccccccccgccacccgccacaagcattgttgagaaaagaacacggagcgcggcgcctggcacagagcaattaatcacgcagtgcacatgggcttggtgttactgtctgcaccatcttcaggttaggaggcagctcacgattcacctcctctgagcgccttctcagaggcgggtgtggagttcttcaagccctgggaactaagactgtgtttgtaggaaagcctcagggcagccaggcagaccgggcccaaggtgtccccagaggtcagggaaatcctgctgttcttaactctatgcagctaaacctctttcccctctttcctgggagattagtcctggtttaaaaaaaaaaaaaaaagcttggtagacctcctcctattcccctgggcatcctctcctcctgtcgacagactggcccaggagagagcctgggagttgaggctcaccccacctccaaattttcattctcctttaactgcgtttctttcttttttaatctagttggtttttaattgcacatatcagcaaccattgaataatgattttatctatattctaaatttagggcagttaaatgcaaagcaaaatgcagacactttctggcgtcttaattgaatgaaggtcacagctataacaacatttaattgagctatttttcattatcatattttaatgactttgcactgacagttcgcctgcttctgaggaaagagcatgatggagtcgtttatttccctatttagttattgtttgacaacatcagcttcgattaagaccctgctttatagaacattaatcatatttgaatgagcaaggggtataaatgtaaacacatttcccttcccgccagcaaagccatgtccccacacggaggctcactaaacaaatgcttcacaaccatcgtctgtttgcataacagccaacaatagcccgaacaacaatccccggctttaactgtcaccgcccctatctcacccttgcacctttcagggagaagttatgatcctgcacttctgaatgctcaataattgtgtcatttatctcaatttgcagttcagtctttaggcagctattggcaagctggcattaaaaaaagaaaggataaacagcatcctggccaaaggagattttcatttccaaataataatcagtttaatttgcccgcatatgaccaatgattcatgttcagatttaataatcaggatcacataatctgattataggggaaataatttgtttacaacccccaatttactgctcagaattccattatctctcttcagccattggtttttaagagatactaacatgacccaggggaaccgaaagcaaactattatatttcctacaattagatctttgcatagtcttaaccccaagcccctacataaaaaagaacagaaacagcatggaggaaatcccataaataaaatgaatatataattgtgctcaaagaatagctctcccggagaggcggcgctgcgactgtattcctcctgcattcgggcacatctgctgggctcgacgggcttgtgcacttaaatgtaatcaccatggagcttctaaaaagaaatcctgcttagagacggtcaccgcgggccacactaggctcagaggcagcccttcgatgctgccgtttaaagatttttaaattgcccatgttcttcacatccacttcactgaaagagtccacacactggagaaaagttggacatgatgcaatttctggaaagcagatcctaccctgttcccatatgaaaacagagttctctgcaattgaccggccttaccccagagcggtcagaactgctttgagaatagcatctcagctctttttttttttttccaaagcaaggaaatggatgtgcattgatgtaatttagtaccttagagacgcggacaaattagtgtagaacattatcactagttaattatgaatgaccgattaatcaacctaatctaatattccacattatgttgatgttattaaagtgcatcatgaaaatgacagatagtcttcatttgctttctttggccaaatgtgcactctgcagtcatgatgtcaaaaaaaaaaaaagtttgccagttttaatattagagagttaaataattaaaacgaaggtttacctgcactctggcttctgtgaggttgattttcatggctagctcttctctggtaaagacatcagggtagtgtgtttgggcaaaaactgcctccagagcttctagctggtaaaaggaaaaaatatttactggtgagaggttgcggctaggtgagaggaaacagaggcatatttcaaattttctatgagtggtgaggaagtcatttcacagatcaaataggggaggaagaggaagaaaagagctctttgaaaagatcccacagaattcaaatttcaaccgtgatgacttaggagcgaagactcactaacaaccttagggctacgccaagaggtaggagagaggagctaaaatgtatatatgcctctacatttaaagtgcagcctgcggggctttcactatagggcttggaacagcagaagcaacttgcacaagccctcactgcgtcagctccatggaagccgcccaggctttctgctccagggtgctctgggagaaggacaagtttaagggccctggaaacactatgtcaaggctccagttgtagcccttccactgatggacaacgataccgtctacaattccctcaacctcttgggctttctcgtctatctgctgggggtgagaatacctgacctgcctccctcagaaggttatttcgaggttgaaatgatattgctacatggctgatgtgaacatgtccccgagattatcagcctgacacaaatgggcaccagcatcactgcctcttcatttactatctaggatgacaacaaggtcctctgccctctctccaaacagattcctcgacacacaaattgttcaagaaaacagaaagatccggtttaacataattaagtcggcggccttattttaaaagacaaagaagagctgctcaaactctaagtgttttggaggcaggaagtggccggctctcagaagggggacatcatcacctgctgaagagtgaacgtggtccggttacggcgctgttttctccgcagaaatccatcgtcgaaatctcccgtggaatggttgccaaagggtgcagtgcctgcggtgagcaaactgggtcagtctgaacacagctccaccccacggtcctcacgcagagcccctgctacgcaccctcactgggagaccgtggcctgtcccctccagacggaacctcgtctggctaaaagggtttttctctgctcctccttgcatgtgctgtctctctctgtcccagtaatctctgactttaagctcaactacgcctatttcatagggtgatggcaaccttactcccctagacagccaagcccacttgtgaaattcgggaccctctgagtcaggaagggtcactgacttgagacggagccttcatcagctttctggctccagctgcatctctgcaccttcagctcatcccttctacttctgatcctttaatagaaacctcgaagtttcccttttgctcacctgttactttacttttccttgtttctataaacaataaggattaaaggctgggaaagggagaagaaagaaatctccaagagatttccccagcgctcctctcctagaacttcaaggcatgagcaagaaagaagtttataaatgaatattaataccattggtcacagctcatcggcgccatagtggatctgttatatagatgtcaattaataagaaatctgctctaatagtgactgtcctgaattccaatcagacttcaacagaaccattctcaaagggcatcccagcctctggccaggctcataaaagacccactgctcctgattctctgaaaagaaaggcattctttccacagttctccctggcagcctccaaagctcgtattaagccggaacagagtttggccccaaacgtgcattcagatcattttccaaatgtgcatcatttacttgacagtccacaaagactttttaataaaacaaatgagcaagttcccattagccaatgaatgctgtacctgccatgggctccggtctcagaaccactgcatgctcggcattaggagctgacaagtcacaccgcccaggcattatccctctgaaggacctcaggcccaaagtagcaaggtccttcgggcttttaaaaattctatgtactaaaaggagtccctcctactcattacgctactcccctcatcctatgccacgagacctccactctctggtgaagacttctcccctccattgtctcatccaaattgctttcttccttgaaatcctcaaaatatttttctctagctcattggaaacttcaaagagacagactctaaacagtcttattcccattattttgtgggaaaccaaattgtctccttttaaaacaaagcaccgacggtgaggagaagggtaacctttaagactctccaatca

SEQ ID NO: 33546 - DNA, 948 bp, Bovine  19866880971402
tgcatgaaagtgaaaagtgaaagtgaagtctctcagtcgtgtccgactctttacgacctcatggactgcagcctaccaggctcctcagtccatgggattttccaggcaagagtactggagtggagtgccattgccttctccaaacaaattcaacagagactttaaaaatggtccacattaaaaataaaatcttaaaaatgcctatcacattttctacactgattttccgacccacctgtgggtctgaagctgcaattcagggagcatcgctttgctaaatctctggagagaggaggctgtgctcccccacacctgctgttgggtgtctacgggcccaggcatggggaccaggcctttgggtttaggttctgcttccttctgtctgattttctgccttctccgggtgtgtgtgtctccttcacggactcaggtttggttccagaaccgaagagccaaatggaggaaaacggagagaggggcctctgaccaggagccaggagccaaggaacccatggcagaggtgacgcctccacccgtgagaaacctcaactccccgcccccgggggaccaggcccggagcaagaaggaggccctggaggcccagcagaggtgaggctggctgaccccgggcctgggggcgggggctggcgggaacgccgggtggagagctcaccctgtggttttctttctctgccagcctgggacgcactgtgggtcccacagggccgttcttcccctcttgcttgccgggaaccctcctgaatacagccacctacgcccaggccctatcacacgtcgcctccctgaaaggtgagtctggactcggctggcctgcgcctcctccccggggatcgtggagcttgttcttggtctggcccatccttgcgcctggggcgggtgcagctctgtttctccttctctcaggctccgccagggctccaacagcat

SEQ ID NO: 33547 - DNA, 978 bp, Bovine  19866880987131
gcaatggcaccccactccagtactcttgcctggaaaatcccatggacagaggagcctggtgggctgcagtccatggggctaagagtcggacacgactgagcgacttcactttcacttttcactttcatgcattggagaaggaaatggcaacccactccagtgttcttgcctggagaatcccagggacgggggagcttggtgggcttccgtctatggggttgcacaaagtcggacacgactgaagcgacttagcagcagcagcagcaaggtttacaaatgtttccagaatcccaaactcttaagaaacctgagataaaattagtcacagtagatgtaatttgcctttttatattgcttacaggtctctccttaatatcacttaggagtaggaattatgaagaaaaacaaacaccaccaaattatgcagattggacctttcaactctgttctttcaaaatctgtggactgatacctccaggcattcccatcctactcctgactatgtttaaagcaagaaaaccatttgatattaggaaaaaactaagaagtcggggtcctttcttcttattctattcatttcctattatttaaaaataaggttgcgtcttataataaagaaataagtaagaattaccttcaaaaaatgcccatgtctccttctttttctcaacggatgaatcttcagaagatttgagggaaatcactgtaagacaacaacaaaacaaaaacccgaaattgcatagcatgaagtgaagtagtttatgaacctggcccatctcagtccaaaagattatatcatatgggatacatggcacttacatttataaagtaattttcacatttgcaaaaaccacatttaattgtcacaactcacatgccaggggaaggtgcaatgacttacatgtaataagtaagagaccagagaagggaattaagtttttggtactcagttcggtagaagtcctacacaccccatat

SEQ ID NO: 33548 - DNA, 1566 bp, Bovine  19866881003349
ccccatccaccatggaggcataggtaggtttcatgtccccccctcagagacattcaaagacggagcaatcccaaccactggtgagtgtagaattgactgggtgttccaaccaggggtcttctgacccaggctttcctggacatcacctgcccacccccaccaggacagcctcaagctcctcccagcttccaagcacctctgacccccttgaggattcagcaggtcttttgctgggtatgatagcatttatgcatcgccagtcctcactgagcgtggctggaactccctgtggcctcctaccccttcgggagcactctgagggcctggagcacccttgcttccaccttgggccagagccggctccctgcctccagcccctccattagcctggaaaggtattgatcagttggcttctgcagctgagtgttttaatcccagtgtgtgaatctttaagaattaattagcaaagattgctcaggaaaaacaaagtgggcgcaagttttgataccgtctggtcacccaccattaatgttttcctcttaattatgaggctatttctggaagctggaggcatttcccctcatgttctattgcctcagatgggctcctccatccttctggtggccttccgtggcctcctgcttccgggtcctgcccagctgcctgtcccatccgcgtcctctgggaagcactcagagcctcagtttgcccaggccccttgcggctctgacccacggagccactttctgattcccaaggcctcatcctgcttttccttttgtttttgaacgtgctcacttctggggccttcacggatgccccaggctggctcaggtccccttactcctcctggatgctaacagctgtatgcttctctgcgttgggaagaaccctctgcatggaattccttactcactgcccatctcccaggagtcagggcccactgcagtccagggctgggaggtcctgacctgggtttgggagtgaaaggtctgtctggttcagtgtgctcttgccctgaatggggatccctggaaacgaaggaggcatgcccagtctccatggcccatcgtggaaccatctttgctttgttctagatcctctgcatgccttctgttttccatctctcagacctgtgcagctttgcaggtttgagtttcacccaaagtctaggtgctttcacgggaagaaaggaatgcccacaggtatgggataggaatgacaatgccctgtttacttgaagtttggcagctgcggcctctttactgagacgggaaaagggtattgaagaagagcaatttcaaggtggtttctaggtttgtgagccaggagcccgaggttaagtcacagaatgtcagaggaaggccgtagatcccagcgcaatgccagcagccactgggaacaggggccgctgcataacccagaccaactcacagttctctggcatcctgctcaggagaggactagagcctccatcctgttagggtttcacatgtctaatttctagcatttaacagccccggggaaggggcaaaagggccagggccattgacctggatttttctg

SEQ ID NO: 33549 - DNA, 1045 bp, Bovine  19866881012416
gagttggggaaaaaaagaggggaatcaactaaatgaacagttcttacctcaaagcaggttatgacacagaaaaattgaagagaacattaaaactccaggccaacagcttgcacctaacgaagctgcaaggaaacaatcttcttttccccaaaataccctaatttgtttaattctctgaaaggccattgcccacatcttttcccaaagcccatctgagaagcatggcgatggtggaattgctccaagggccttcagcacatccctgctacgctgctgcagcctcgatgcaaatttcctctctgcactccaggctggggattaagaaactcaagatggcctaagacatatggagaaaacagctcagaggctctgggagctcatgaaagggtccctgggatgcagaggaaaaaatcagaatccccaggaaataaaacaaattaggcaatttgactacctggtccatctgaagaaggtagaatggtttgggtaagaagctgaaagcacattatgaactcgagagttgagagttacgtgatatgaatacaagggtcctccaagaggcactgggaaggaggtgggaggagagagaatgaggggaaagtaggagcctgggaggagctcactgggctcactcactgggtgtagtgggagcaagaccatggacgtgtccacacgggtggcctagctctgtgctgggctctgggcagccacagacacgggaaacgtggcgcctgactgctgctgctccatctgccctctcatctagactgtgtgttctctgaggaacagggatgtcagaatcatttttgtttgcactacacacacagaaaatcctgttctatagcaggggctcaatgaatattgaataaatgaatggggtcagaaagtaacaaagagaagacaaagcctctgctgtaaggaagcgcccgatggcaacttcatggttgcccagggatcagatcagatgagatcagtcgctcagtcgtgtccgactctttgcgaccccatgaatcacagtatgccaggcctccctgtccatcaccaa

SEQ ID NO: 33550 - DNA, 1347 bp, Bovine  19866881037740
tgttctgcttacagaatacaatctattctatgaaacaagactggataccaatatactctgtgaaagaggaccaaaaccagcccactctgtaattaactaaagagattaaaaaaaaaagactttgggtgaccacaaatgtaaccacacttttcatcctggctaacgtgagtgaccactgctctttctccagtgacagtttaaaccctttccctttccttctgcttcctgattaaaagctttgaacatatacagataccaaattgtctctctgacagcaccccattcagaactgactgacctccgcttttttgaaccctccccaaaatcacctaaagtgagcccaaatcctgtcagttcctcctaacgccttattactccatggtaaggagggaaagaaggctcttgctacagcaagcttcataaatgtacctcttgttttgtactatatgcatgctcctagaagtatttgactggtgggcatggacagttcctaacacctaaaacaatacctaacatacattaggtattcaataaatatttaatgtggggaggaagaaaggaaagtgcgaggtaagaagaatcgttaacaattgaagtcaaaagttaactttacattttggaagacctttttttttaatgctcttgatgattccttctggttacctctgtgactaggcggcatggccatggggcaagcacagcttgggggaaacatctcaccttggctgagccgatgacctgtccatccaggtaggtgaagactgtacaattccttttcatttccttggtgacgaccacagccaggtggtgccactgaccacaagccagcagctggccacacctgacccgaagctggcgtcctgcagaaggctcagggtcatcctcgagttccatgacatctggacgagaacacaagaaccagacccagctgcagcgtcagggagcatcagccagccccaggggccccagtgccagcggagtgagcgccgagcctcccagagaatcctaacagcagcaggagctttcactgctggagcccttgctttgggccagacactgaggcaggcgctatcacgattcccaggttaccatcctgaggcacagcgaggcaaggaaggcaacttgcctaaggttacatagctggagttcaaacccaggagtcaggctgcagggtccacccatcactaggctgcctccagagggacacacatgggctggcaaagtcccagaagggaaggagcttaggcggctggactgtgtgtgaaggacaccaggccaaatcctgggccttccaaagtccatgtctcactctgaaaccgggcagaaaaaacaggcaggccataacac

SEQ ID NO: 33551 - DNA, 766 bp, Bovine  19866881071574
atgcaagaggatagagaaagagcagcctgtgaagtcaagacgaaaccaggagatgagtcacaaagatccaagagagaaggagagagccgccaactacctcggatgctgctgagaactctcgggaaaatgggacagagaggagactctgggcttagcaaccctaagtcagccatgaccttcaccaaagtcagaccagagtactagacaggggggaaggtgtatgcgggtggaaggcatcccagagtaggaagaaactggtaatgagacagtcactgagcagaatcagttaagggtggatggttcttttcagacattttggtactagaaggagcagaaaaacaggagtgattggaagaggatgggggtcaagggaagtgtttttagtaggagaggcaagtgcatggaaatgatccagtaagtgaaattgttagtgaggagagaggagacaaatggagggctgggattcttgcaaaggcaaaaggagatggagcacagagaatcagagacctttgactgatacagggaaactgaacctggcctgaggccagcagagccatgttgaggggggttctggaggcagaagagaatgtgtgatacagccttcatggggaagtgagaaagacaacctgctcaggaaacttgatgagattcatggactgtattgagatcatatttgagggccatacactttagcattattttgcaatcccccctctcccccacatacaacattgaggtgctgaggttcaggcaaggagaaggtggg

SEQ ID NO: 33552 - DNA, 2581 bp, Bovine  19866881100145
tttggggcttttgtctttgcagatgttggggccgctcaagtgttagcaacaggcaagcctgctagagctgaagctggtaggtggctgcccaatggattctggatgcagggctgaggggcaggaggaggaactcaagatgcatgggcaggtggggcatcctggtgcccgtttcctcccagtcatcatggcaccagggcagtgctgacccccagacctgtctgagtggctagcatggctttatcctgggggaatggtactgaatgagagcctgtcctcaaaggggacatgagtcatcagggccacctctgtccactctctctgagatgagcagccctgcactgcagccgtgagcccccagatagcaggcttttccctggccagtgcctccctccgcttgccccatcccaacctctctccaccccagagttcagctctccatgtatggtacaccttccatgtcatctcctctgggaagactgtcagtttccacatcagcccaccctgtcactcggcactcgagtgagctcttgtcttccgctgctgattgcaggccccccaggatggagtcaaggactcattcatttgccgtcagcacactcaccagagcaggcaatcgacatacacatggatgaaccgatgcagggataagtgaggatggctgcaagaagacagagaaaggagccaccagccacttgggaaagattcccacagctgaagggaccagggttggagttccagggagaggagatgcaccatgggtggaggggtagggaaggagcatgttcccaggaggctggaaaattaggctggcctcagtgggtcaggacttcccaggtggctcagtggtaaagaagctgcctgccaatgtaggagacacgggttcaacccctgggtcatgaagatatcatggaggaggaaatggcaacccactccagtgttcttgcctgggaaatcccatggacagaggagcctggtgggctacattccatgaagttgtaaaagagctggacacaactgagcaaccaaacatacaaacacgcagcaggttggactacgtaatgtgaaggtccaagtgtacgctttggacttcattctgatgtaaagggagctgtggaagacttttgctgggtgatggctgattaaagccccttgttcaattcctccctgccctccagatatcaaatatgccgtcatcgggactgctgtgggcatcgccatatcggccggcttcctggccctgaagttctgcatgatcaggaagcacatgtttgataacgattcctctgacctgagaagcacaaatgtgggcttcaacggtaaggaagcagtgatgctcagccctggctctgccctttcctgagataagacacgttctggccggttatctggtgtgaggctctgagggtaaaactgactatagagagaataaaaatcatggatcaaaaagaaatgcagtgacctctctgtgtctctgtctctctctgcttctgtctctgtacttttccacttaatcattcttgatattcttaagaatcagttttcttggagaaatggggaagggagctgagttggcttctgacagaaatttcttttcttttacccaaatgatgtgatgagatgaaatcaatccccggaagtggcgaggctgctcctggcacgggtgggtggcaggagctatggccagcactgatggcctgccaggttgcatttttccccgcataaatcgggcaagccctgcactgagtgatgctgagtgtctgctcatgacccgagcagagctgggcttatgagcgcccagcatgtttctccacaccctgttgcagctgtggagatctgcgtccttgggtagaagccgaacactcagtgagtttcagtagcaaaatacaacattgatttgcacccccttgtctctcaagaggggacctgcaaaatccatcgcccatatggctgcttaatgggatggtaatgcagtccccagaggacagggaggaaggactctcaccatgtctcttgaaaatgtgattattatctgtaaagatacccaaaaggggagacagggcaaggaggagactgcacttgggggcttccagtgtgtccaactgcatagggaacttaactggccatagttcacttgcattgattttgtatccctaggaataaggggaaagagaaaaacagtctcttcagcacactgagagacatcctagatctcctacgggtgagagggcgcagcatcctcagggagggagaaggggaagaacaaccggcagagggctggggggtctatttatagggaaacctcggtctcccccgggtgctgagctgggggttcggtgagggactgggtagagaagcttcaacggtgccaacggggagggggcagagtgctcagcccaacaaccctctcagtggcctcaaccccaggaacctctcagcatcacccgagtctgctgggctctgacccgctcctgctggcctggcaccgagagagtggcactaccatcaccatgcccccgtcctaacagcctgctttctctgtttagagaccattgcgctaaagaagagaacttcaaggtaaggt

SEQ ID NO: 33553 - DNA, 1349 bp, Bovine  19866881114025
acggtactgggcaggtcagatatggccctgctgggcggttaactctgcctgcagttggtctgcctgcctggacactgtccctccctcctgtccctctcatgtcacagggttttgttcaattcccacctctttcctcaaagtctttcaaaagcctcccaattagaagggctccctcccctctctgaagtcctggagcatttatttggtagctactggctctactgccttacgtgggtagacactgcattactatgtacttgaatccatccccgattcctatcgagggggctgctcaaggccaagggctccatcctttttgtcccttacacacccaggcctagcccaggtcctcaacttacagacactcaagaactctgaatggtcacctggctggaatgaaagcccaaggggcagacagaggctcaaagaagtcccacccttcttctgggaatgtaggcaagaaagcaagactctccacccagttcctgagaacagggctcgctttgggtttgaaaagtagtttccagaaggacaatttgaaaaatgtaagactgttgctggatttcttatgggaaagcttagaaactttcttaagagcagcagccagaaggataagatcagcttgaagatgaagaattctgggaccaagaaatcacatgaaggaggcagccaactacccttccagaggtgggcccatcccaaacccctacctgacaactctcccagcaactcagatcccggaaatgagcaccttccttgcccaccagtaaaacaccactgcttccctgcagctggccttccttcaactcaaaaaccttgccccccaccatgctcccagacatcctcggactccgggtctagtcagcctcacccagaaagtcagcatgccgtcagatgaattacacgggtacaaatgatgccttcagctgaccgcaggccaactgcaggatatgccattgggtcctggactggaaggaggcctgagcttcccacactatggcaaatggggatgaggtacacccctggagggagggaggccaatgggtgtgaggatgagatgagcatggagacgtgctgggcgctgctgctaacctttcatgaggaccgtcctggcctcagtccactcgctcctcccgtctgacgtcagcaggccgattggaggcaagcgttcatcctcgttggaagccattctgactatctttctcaactgagtgaacagatccccctcactgagacggcggaaattaatcacaacatccaagacaaagaactgtgggggaaacaggtcaaagacttcactcaaggcagcccgccttaaacgtcaggccttccctgagcctccatgtggg

SEQ ID NO: 33554 - DNA, 1255 bp, Bovine  19866881170285
cggggtgggggatcaaaggaaatggccacctactccagtattcttgcctggagaattccatggacggagaagtctggtgggctacagtccaccaagtccaccagggttgaaacaagttggacatggctgagcgactaaacaatagcaacaacagttcaggttctgtgggttcttggggttgtggaggggcttttgcagtttggaatatatctgtgcagggtgcagggccatgcagggttcagggagtgtatgcacatgtacttgtgagcctgcgataagaatgtcgaatttttatatcacttccaaattttcgaacaatgactatcttacgtcgttttgccacaacctggaaatgggtagtgctgatatcaatattcccattttacagatgaggaaactgagggccggggaggtgaaagtgacaccccagagtcagcccatcctgctgttagagcggagctgtgtctgtagttcgggcatcccgcctccaaaccgggtcttttccctccacttcactctgctcatgcatgttcttacagacttcagtggggacacccatctctatacccaacctgatcacaaatacccctgaaacctctctgtccctcaccctacacatgccacacactaggagaaaccaagttctctcctgctctttctctcccagctcctgtgttttagacatccactgttgctgttgccggagagggcgatggcaccccactccagtcctcttgcctggaagatcccatgggcggaggagcctggtgggctgcagtccatggggtccgaagagtcagacacaacagagcgacttcactttcacttttcacttccatgcactggagaaggaaatggcagcccactccagtgttcttgcctggagaattccagggacgggggagcctggtgggctgccgtctatggggtcacacagagtcggacacaactgaagcgacttagcagcagcagcagcagttgctgttgtcagacctcagacaaaggcgaatgaattgttgacccagctgacagaatttactacacaagtttttatagcatttctgggcagcaacagcagccaatgccatctttcttggcattactgtttattgaatatagacttacagtctttaaataatttgaatatagtgctttcaatatacagttctttcatcacacatatatttctttaaagcacaaaactataacttaaaatcaaaaggctataaatacacatgtacatagtgccataaat

SEQ ID NO: 33555 - DNA, 1957 bp, Bovine  19866881218203
cctgaactcttccagttgacccaatagaacattgccccagttacccaagagactttcaaaagagttcctgttgtcaatggatacttggcttctgccctcgctgagcactttgcagttcggggttcttgcgtagaactcaaactgattctgtaggcagtcagaagtcgtccgtttggggaggaaatgagggcaacgtcctcgtgttttgggaggcacctcccttctgggtctggggtggtgaaagcagcctcggcaccccttcccctgcccttgcaatacgcaacaatagcacggtggagagttttcagggctgggtgtcctctgggttcgcatgtctttagagaaggaggcgtttctttacacgcctctccctttccactagtagtgagtcatcagttttcctggggaggcagggcccgccaccacggctggtgagaaaggggggcgggagtgaagctcctgagaccccttgagtgacagcgccaccgaaaccggctcagccacagccgaggctgccggggcagaatggggcttccccgttgccacatctccaaattctccaagagatattggaataccagctttttagaagaaacctcccaatttttaaacactgataaggaattaaatattaatacaggatatgggctaaacaaaatgggctggggacccacccatttgtgatatgtgagttgaagctaggattggcaagtttcctttctggaacaccttggtcccagatgatcgagcaatgagaagcaacgtacggcttgtgagaaacggcttgttgtgttgtgtctcaagttgggatgggagctcacgaaagactgaggcccctttcccaaattctgggggtgagctgtctaaacagctcgaggcagcactggccagggcttatctgtacgggacccaggcacctccggtcatttacatacacagcccctattctccttatggccagagcccaggcggtcaggacacggctccatagcctggttgcccccccagtggcatcaccttggccaagcttgtcacttttctgctcctccctcctctgcctgctgaggtccagggacagagggcaaaagagcaatgaaccagtcttgccatcagcctccattagggctacatgtctcggtccagatccagggtgatgtcatcacctccacataccgtcatctcagttatgaagtcaggttacaggggaggagtctgttctcactgggtctctgtgtctcttgctctctccccctccctcccactccctctctacatgttggttttaggaacacgttgtatgggcctctttgcttgacggaccagtgttggctcttggcagtatctcagcagatgggtatctcttgccttcatggtagcagtgagcccggaaaccctctggggcacatgtcagctactgtcctagtcatgtggggctgggacaggaacccaggcacccagactccaaaggccaggtgagggccaggccacgcctggagcagccctcgggccctggtggactgagcccgttgcagaggctctgcatgacttcaggtgctctggtcatcagggtcaaaagtcacaggacacctgcacagcatccgcatgaacacgtacctgtgaggtgtagtcggccaggacccaggggaacactggatactgcatgtagtcattgtaggtcctcccagccagggtgttgaggtacatgaggtcttcgaagttgctgatgtctcttttctgccggaagagacaaaggggggataaagccaacacggctggttccctcctgagaaccacaggggtctaacttccagacctgcgcaggggcccaagctgtgcaggtggagcaaggcacatcgccacgctgctcccagtgaaccttgcgcctggagccggggcgactcggggaggccacgctaattccaagatgagctgaagcaaatacagtcaggaagcgaag

SEQ ID NO: 33556 - DNA, 1906 bp, Bovine  19866881234574
acccgtggttttaactttaaataagcattcccgtcctaatagaagccccctctaatgtctcctgcagctttgattttggaacacgtcacattcctcattaaagcaatcactgttaaaacataaagcaacacaggatttatttcttcattaaactgatgatccgtatatgaagccaattaacattatgagtctggtgaacatcaagtgtaaagaggttagagaaaattaaaagcagtcaccttggtctttagataaagaaagtacacttttaggttgtaaattatcagagtgtccaagcgggacagatcggtgaatttggttaattggaaaatacattttaccgcacaagaattaagaaaaaataaccttttcgttaccgaagctcttttttagaggggagggaaatggtagcaatacgtgttagtcacctctttccggtcccggcccggagggtcggagacaatccgaggaaaaaaagagccgtcatcaaagtttgctgtagcctttactttccgtgattgcttggttggttgtttattcgctgttttgccaacaggaacgagcccggcctcgaggctgggggagaggaacttcggggaaacgagaccgagggtcccgctggctctgagccccgctctgggtgagtgttttgcgggagcccggctaagcgtcccagcgggcagacagccaggctcgggtgcgggacgctgggaaggccggggagacggagagcggcagtgggacgcttcccggctggcgccgcggggcagaagctgggcgttgggctgaggaacggagagttcagcccctgctgcgagcactgagcgagcgtcccaagtaactttctcgtttgggacaagaagaggatggggatcgggtcccaacacccagaatttggcggggtgcgtcccgccgccgcggagcacagggccgcagaggggaccctgtgactggtcgcgtcctttagcctcccggtggaaacaggtgccgctgtccagggttctgaccgacagggaggctcggggagcgccccgcctgcagacccaggacaagcctgtccagcgcctaggacatctctgggccttgacaggaaactgcttcggccgatgtcaggaatggggacctgagatgggcttggacctagctggtttttggggccaacgcggcgctgggcgcctggttcctagggttcctacacagatactcaggtgctcctcggagcatcttgtggagctagcccagatgttttcctcacctcgtttcacaggcactcggctccgaagcgcgcagggtgcttacaggaggccgcttagggtaagtaggagtttgagggagcttttggcagacccaggcactcaagggggagactccgactcttgaaaagaactccagagagcacgggtgctctgaggaagacagagagagcgcgctgagcttcctggcctgagctgaaacagggtcgcttctcagggctctagccctttccggatggagtggaaatggctctctcactaccccaccagcccagcttgctattgcgcccgctgcccagacctgcaggcatgctccccgctggcgggtcgcctggactcctggaatcggtggccctggtgaagctggcgctgcgggctgtctccactcagaatccagccagcgtttccagtggtttcttccttgagatgaggtcggctttctgcgcctgggtgggctgagcccaggaggggcctctgaagtgtagcggcccgatttgtctctgaggaagccgtcctggttcttcttcctggcggttttcagagggccatccacgggtggtccagggccctggcagccaatctgccctccagttcgatgcaccttccttggggggtgggtgttgcatgtgtggggcccccaggccttctgcttc

SEQ ID NO: 33557 - DNA, 888 bp, Bovine  19866881245121
cttgctgaaattgtgaggaagagatacctaaagattttcggaaggaaggaatggtaaatggaaattaattataaacttgctgctatcacaaatttatgatgtgtaagaggccaatgcttttgtctttacttagtatgctgcctttgctttattgtattaaaggttaaaaaataaatagatgtagagtgcttcatggcttcgtttatgatctcaggcctcagccctatttttctcaaaagcttctccacaatgggttcccctactactgaggtttcaaggaaactcaccattaggctgggcatagattcctagccacacattattgggatgatgtactcagtaattaatgaagtatgacctggtaactgcagcctttatcttgagcgaccagaggatgctcaggttctttccagccacaacactttacaactcgctcaatccagtttctacgacactgaagtcttgtttctccaaccagactgcaagcttcttgctggtcaggacatccttcctagaaagctcaatgattcccacacagattgccctgcatgatgtaagagtctatgccagtgtcccaggaaggggatctgggactcaccagcatctgtctgatttctgagatgagggagtgcttttgtgggtagcagattttcccagaccaccaggaagagaagaaagatggaccacccttctacagccagtctgaacaatctcacatatgaagacagaaaaagacgctgagtacagaaggacaaagcatctcagtcagccctggaccagcaggtgggagccaaggagctgcatggttgcttcatctcaccgagactggtggatttttatgagaattcaccagctgtcatggatatgagggtagtggggcttccctca

SEQ ID NO: 33558 - DNA, 1016 bp, Bovine  19866881254034
aatagtgagacattgacatgcaagggcctgtcgcaggggcatagataacagagtcatgcccctagtgcccagcacaaggtctgaaggcaccctgggctctcgatgcctgtttactagtagatgaatgggtagataagtgagtggacacactgcctatctcttcagctgctgtcactgtggatccaaattccatggcataggtcttgcaggtagaactgactcactgatgatcaactgttgtctgagccaatttagagtttaagccaaaggctctcgtgaatctttatttcacgttccaggtggattccagtctactgtacagagaaagacactgtcttgcttctcacctgtacgtgatctttgtatagagacgcatatagttcttgtcctcttcgtctgtagttctcaatacacgacacaaagtcctggagaagagagaagacaagtcacagctagtaacaatcgtgattttagataagaacttcctgctctggccaagtgccagaggaagtagccgtcacaggacctgttggtcaaatcattcacagcctcatgaatacaggatacacgttcagattcacatacatgtttaagggttacttttacttctaactacattgaaccaggtagagcagataaatcttcctcccaagaataactagaaaagtagaacataatacttcaatcaaaagggaattctaaaaaatgttcaagtaacatatttatggaatagggcacccaacagtagtagaatacacaagcccccacaaaacatatactgagacaaaccacatgccagaccataacacaaacttcaacaaatgtataaaagttgaaatatgcaaaatgtattttctgatcataacagagtcaatctgaagtcagtaacaggaaatctccaaacacttggaaactaaacagtgtacttctaaataatccatggatcaaaaagtaagtctcaagggaaattttacaaaatatattgcattaaataaaactaaagtgaacatatcaaa

SEQ ID NO: 33559 - DNA, 2222 bp, Bovine  19866881270885
tttgattatcattgattacctagtaagtttacaagtcaatacctccgtggtcaaatatttcaacctgcaggatagaaatctgcccctcatagccttgaacttatcaggaattacaaagtaaaaatatttacctttgaaagtttattaactttttcagtccatttatttgtaattaggaatttcctaaatgatatccaagacttcagagtattaactaaagtttgcaaggttaaccatttatttcttctccatcatcaagttcaggggcctatcactataatacgaatggcaaagagaaaagtatatagtatatacgttatgaaccgggaaaacaggcagtatagatttttattagcccagtaagtacgcttttccctctttttaaaagacattacatataaaacacattaaagaaacaaaaattaaaaacttctttttaccattaagttccttcttggtatcccagagacatccatggtttcaggatcattgaccttaaaattacgatactaagaccattcaaataaaagccccagaatctacagcttgcaagagttcagaggaaatttacacagcccatgaagcaatgctggctcatgcagaacttggtttgactacacatctgaccactgctctttaggacataaacctagagacgactccaagttcatctgattccaaaggaggacagactataaaactgtgagaaaaaacgttatacaatttgccctggcacatgcacagaagggaccaagctcctctgaacacctctacgcacagagaccagttgtttggctgatatataactgcattctgggaagccacttctaccgatactatcttaataaagatgatctgggctataacccaacgtgccacactatttcattatggaaaaaggagatgcacatcgacagttaagtgattacagctgctgctcattattagcccacagctcactcctagctggattgtcaccactcgagagaacatgttttaatttttcaatcaaaactacacggcagggatgattttaggtttcccaggcatggcatattagaccccacgcaagtttcatggtaacaggaaaggaagggaagaaaagagatgggaaataacaaaatcccagaaatcatttaagaaaagaaagatagtcttagaaactatctggagcagcttggggcatttctcgtcaaaacccaaccaaagcgaatgagaaacgcagaggcgagccgagcaaacggcttgtttagagaaagcattttataaacggtgaattaatgatatgcctaggcaagaaaacactaaatgcccattttcaactttgacttttccattcagacggaatgttttcacatgaaatgtagcagaatttcagtatcggaagaaaaaaactctgcttcgacactttattgtagtaacaacagaacatttaatatttaaaaatccgccaatatattttccccttcctacaactgtgtaagtatttctaaaatatcctaaaactttaagtactgctcatgggatgtgttgatctgctaaattaatgagaagagtaaggaataaaagcaaagcaaaaaactctgaagattaaaataaaaagttctttacttaacagtttatggtttgtatttgacccactccaatattcttgcctggagaatcccgtggacagaggagcctggcgggctaccgtccataggatcgcaaagaatcggacacgactgaagcaacttaatccacaacacacacaacattccagaaaacatttctctgttgatgaaccagagtgtagacagtcacgttctgctgtggccgccttcaggcacactaacactcttgtaaaggggtcgtcaaatcgcatcctgtgactgcctggggtttctacaacctaagtgtctggtaaatatcttgctgttactcattaggtaaagcctattagaatccaaggagctgttggattatctgggtttaaaattaaatactctacataattcatcaagcattaattgatttacataattcatctaccattactgatttacagaaaaagtcaacttacagcttaaatatggaaatgctcactggatttcaagataaactatttcagtcctaccacaaagaacaagcatgtttaaatgtttattctttcagaagattaaagttttaatagtttatttgaattcctaaagaaaataaagattacaaccaaaaaacagttt

SEQ ID NO: 33560 - DNA, 1686 bp, Bovine  19866881270973
cttatggagctgaagttccactctttttaaagtgattgatagaatcgtggcaggagggatttcttcatcacgagtgaacttggtgatagagccctcttagggctaatttaaatggaagagcagggaatagttcacttgggctcattttccagtttttagaatgttactcttttctagcccaatccatttttaagctattgacccagctctcaccagacattcttcttgtggtttggtttattctggttatcacttaattctcccccaaaggaaaacacccggagatcatgagaacatgctgcagcctctgctgttggcaccccagagtctggccaagggtggggcgtcacagggacaggagaggccagggaggtacacaggcctgtgtactcgggccccacatccgaccatgtgaactggaggatgaggtctcctccgtacaaaggtgtaagagaagaagcttcaacagcttggcctaggaagcataaacaccctccaccagcgctggtgcgagtgtgaattagcgtcgccttgcgggagggcaatctggcactagatcagaatagaaaatgcccacatccttgacctacagttctacttctaggaatttagaagatttactacagatttacatatgtgttcaaagtgacctatgcacaaggactgtcactgcagcatcacttgtaatggtaaaacatttgcaaacaaatcaatagagggttgtagcacatccatgcgaactaatgatctgtacctttaaatagaagtgagacaactctgtaagaagtggtttggaaagcgctcctagatggcctattaaggaagacaactagatgcagaccagtagctgtatgaatatgctatttgtgtaaaaaaaaaaaaagataatatgtataaaaccaactatgtaggcacagaatctcttcggaagattatactgcaggagagacaaaactgcctctacctccttagagtctctatttaggctacaacattgagttgacagaagacagatcgagagaagtgcagacagattttattcttacaggtacatgggggcctgccaaggaaaatgaagctgcctaaggccctcaggatctgagcatgcctgctttccagcttcaccagccacactgacctctcttctgctcccagatctgcccttcctgcctctatgctctgagatggatattcctgttccatgaagtttcttctcccagccttgccatgactactcatttccacccttcaggtctcagagtttgtctgagatcatgtcccctccaagtttctctctgccttatatcgttatcaacctgttttttttttcttctttcaatgcatatcacagtttttgataatgtattggtgggtgtctcccccactggatttcaggtcccacgagggtagggttctcgtttatcttgtttgcccctcactctggctagctcccatttgcagtcgggtgtgaggactggtgcgccgggctgctttccaggttccaccactgctgccccatcgttgctcccaaaggtgagcagggagcctggcttcaaccccggctcttccatttacccacctttggtgagattcttatctctgcatcctttctttttcatctctaaatatggactagtaaaatttttcttttcccagttgtaaggattatgcgtaaaaggcttataa

SEQ ID NO: 33561 - DNA, 902 bp, Bovine  19866881286951
tacaaacgctatcacgcataatgattataaaagaaatccttccaaagattcaactttccccccatgaatagactttgtacttactgtaatgctcacctggtctcctgccagaacaaaatattttaatgtaaaatttaataaatggaactaaaggtattatgtctaatttaaaattccatattgtgtaaactattgatattaacataattgagtttgtaaacaatccatttgcagaagctaaccttagacactgtattgacccaaaatatctagtggggctcatctgcaaaacgaagcatcaatgcctggaattcattagcagtgttacatgtttaatttctcctgccctacagctccactgtctcgtaaaaatttccctttgatgtcccccctaaaagaattaaaggaatattgtaattgaaatgtcatcaataattcacaagaccctcctccacagcaatacatctgatgaaatattaattgagctccacagactgacagtctgcagaggagcacttgcctgtaatttgaaccacgagtcctgatcttgctgtagctcagacctgccaagaaggcaattatctggatggtcttgcccaatcccatttcgtctcccagaattcctcctgcctgctggcagtgcaattcccacagccacctaacacctgtctgctggtacctacaacaacaaacaccaacaagaaaaagaaaatggcaaatggtgggtaatacagatcataacgcaaagtactcatgaattaatcatttagcgaggttctagcaccagtcagagaagcatgccggatgtgtgttttacatgagtattatattcataaggtcatacattttgattacctaaagcataaaatcacacatttttctttacagaacattaacacatt

SEQ ID NO: 33562 - DNA, 1222 bp, Bovine  19866881333650
gccgagttatcaggaggcagaggcggaaaggctcctcctttgagatggcttccaatacggacctgcgctgggaactggaagccagcaagaacaacaccagctcagagccagaggacgcggagctgctggcgcccctggagtgctgcctgcaggagctgcgggacaccccggactggctggtcaccaccaactgcgggctgcggtgcgtggcctgctgccgggtcttccccaccctggaggcactgctggagcacgcccagtatggcatccaggagggcttcagctgccagatctttttcgaggagatgctggagagaaggagggcccgggaccaagggcaggaacaagagccagaggaggagcaagagagcgcttcggacagcagcaaaggtccaaggccccgcgtcaaggtgccttcgtcacagtcacagtcgcagaagcattgagccggaggtatgtgccctgccctgtcctcacctccggcacctcggtcgctcctttcccggccatcaggaccagagccaccagggcagggagaaaggaagagggccggggaaggaggcgagcggagtgtagagctgggagggccgtgaagacgtcggggaagtcaccctcccaaagggcacagcctttcaaccagaatccatttcaaactgtgaatcaagtgtttcttacagtgggtgcaaggcccgaaagcccgcaagcttgtggccaccgggatttctatttttgctggcgggtcaagcaggtcatgactcgcaggagagacaactacaaacaaaatttcagccctattttttcattgttaggaactcatcataggccctaattctatagcttattttattggaattaaacttgaataacccaaagtttaaggcaatggctaatggagtgaatcatgttattgggttggacccacaggatgctgccatttctgcaggttacccactggcacagacatcttgagaatggcaggttcccagggtagaggtggggctgactaagtcctgctgagcctgagctcagctacgccaactgttttaaatactgctgtgaaatttgcctctgccctttcatgtgttctttcaagaaaatactcggtgcccgctgtgtgttgggcatgctgatgggcatgcactccagctctcagtgagaggcagctagggcaggcaattgcaaagggaaggggagggctcccaggggaaggctcccaagctca

SEQ ID NO: 33563 - DNA, 1640 bp, Bovine  19866881360946
atcaacgtcctggaagatctttgatcatagaatgaaaacccactttatagagaggaggatctaagtggaaacaagtttccctgagaatgctttctcatatctaaggcacagctctgagattgggtgactctgttattccaggactcttcagattagaatccaactcaacctggcttgccaaaaaaaaaaaaaagaatattgggggctattaaccaggaagtctgaggtttacagcttcatgcctggcttgattcaggtgttgaacgatatcaagtgtccatggcgtccttgctatgagtctactgtactcatccaaagataacctggagaggtggttagtgcaaacactggacaatacctggccacctgcatttcctagtaattcctggggcatatatatctaaggtagtatttatttaccatcttctgtttctttttcctttcacagtgagacactatttggtgaaatgccctcagaacaggtaggaatattttcttcctttttccatgtaaagtctttgctattttactttcttttgatattaccaagaaattggttaaattcatatctttatctgaaggtctgcatattagtttacagattgacctaaaaacatgtattctgcatgcactcacatgtttccggatttcatattctggttctcactctcagaggggccagtgaacgtgtgactcatactggcccagcgtgcatgccggaggaggcttggcgcatgctcctggaggactgttccctggtgtgggaggactggcagatggactgaaccaccgggatgccttctgaccacaaacactgccgatccccttccaccaatgccttcttgtcctgtgccctactgtccagaatgtgtccattagtgatgggtgtgctgagaggctagccttttagctgatgggacacacccagcgggtaacaatggttatagtagatattgcaaactcaggagtatttagagacttgagacttttttttccagagaggatgggtaagatcaatttctccctgctcttcttccctgccaaaaagcataactatcagttctggaaataatataagagaccaacaaaggaggactctgaaaggtagtaagaagaaaattacgaaagacaaaggcaaaaaaaaaaaatcttaaagacaaccaaagagaaacaatttattacctacaaggaaacacagatttgaacgacagtgcatttttttcatctaaatccatgaagggcagaaagaagcagcacattttcccatacaaacagtaacaagagaggtggtagttaatatcaaataagaaatcacgtaagacgagaaatatgactaaagatgaagaaggaagttttttattataaaagatgaactcatcaggttgatatgacacattacctgggcctagctacagaacctcaacatatgtaaagcaaaaaacagaaaatagaaagattttcaattattctagaacaaaagctggaagtgtcagtgctccactctcaggaattgatagagtacctgggcacaaaatcaaccaggacgcagaagatgaagcaattttacctgacaaataagaatgatttgcccagtgagtgcacaaaatattcttctcaagtgtattaggaacattctctag

SEQ ID NO: 33564 - DNA, 1058 bp, Bovine  19866881582418
tgatagagtttgttaactgggaaactcacgtcaggagcacgtgggtggggagttctactgagattctcgagatgctttgggaccccaggagttatgggttttctcttagcaatccctttggaggtagaaggatagtcatatcatgacattttatgatgtgcctaatggggccaattgttcttcttatttacctgtgcccctctcaggtagggattgttgtttaagtcctgtggataaggaagctgaagcttggagagattaagagtggaagaatcgtccccccatccccgtcccatacccacatggagctaaatgccccgccttgggtttcataacagggagggatttaataaggagtccagtgcacgagtcaccctcccatatcatgaatatcagactatcatgcagaattctggtcattaaggcaggcagtgagctattcctctctccatctttcacctgtccaaacccctccattagagtcacaccctttgggcccagagatcagttggattgtggagccccagctgggaacagctcctaaactaagagtggccagcagtcagtatcaataacaggactgtttcatcttagactcattcttaatggttcataagcactttcacatccatgatcactttgatcttataagaagtggagtttcttcctcccattttacaggggaggaaactgaggcacagaggtaggggtgatttgccagagatcacacagatggccagcagtttgttctgtgtggtgtcagcaccagagtcttctcctctgcacttggtcccctgctaggggcagggctgaggtgcgggaagaagcaaacaggcgtctcctcagttcacagccctgctgagctgagctctagaaacagacaagtcccagggtagggaacagggatgggcagatggaggtagacacagggggatcagtctgcggacagacgggggccacacttaaggtcaggcacaagaacctgtgaaccttgtcttccaggggctgcccaaactccctgtgcccccactgcagcagaccctggccacctacctgcg

SEQ ID NO: 33565 - DNA, 1069 bp, Bovine  19866881609960
ttgcccagcaacaggtgcgcaggctgcctttcatggggactgctctgcctggcctggcctggtgtggcctggctctctgaacggatgggagctggcatgcagacacagcgcaccacatcttgcctccctgcggcatgcacatcactctagcctgccggccccgccatctgcttcagggaggcctgggctgggggcggtggggagacaactttctgcatggcggcttgcagttggatctaacaaagacgttggtgtctttggaagtccagctgcagacgatgaaactgcaagtgatttcggagaacaaggaagatttttagaactattttgagcgttcaggtgtttgtggtatttgaaaagctaagcccggatttggttaagtgtaggttcaacctgaagctgaaggtgaggattcagcctccggacaagcattgtttggcctggcccgagttttacaacctctgagcgaacatttataatgagagaggcgtttatataaaaggtaaaggaaaaggtgaaagatcaggcaactgcgggccagtatccagcctgagaaccgcatctggagccatactgtgtcacccgagggacactttggctctagcttgctggcaaaaaccatcctggagtcttagtcatttgtgctggcgtttccgatggctcagggtttaacctttgttttccctttgttttccgagaaagataggggaggtggttttagtgttctgagtagttccagcagggagatcgcctttctgcagcaaagggatgcttgaaaacagagggaaaaaccagcaactgggggtgctgcccaatccacagaaacctcaggtgttcctgagctttttctcctcctacaaggtgatactgtttaatgttcctgtggctttgagaatacaatagagcaggcctgatccgtgctaagcctgtgggacccacgtgagggtggctggtgcctgctggccagtgtccacagcccggagggcctgtgtgctttggcggtgcaactgagccttccagactggccagatgttttatgactctgtagccgtggctgcctgtggagagc

SEQ ID NO: 33566 - DNA, 789 bp, Bovine  19866881644329
gcacctctgtcattccagctccctggtactggtttaacactcacctgaccagtactgataatctgccttggatgtagctgaaatagcggagacagggactggggccacagggccgcctcctcagggaggtgatgaaacggattgaagcaggccttggggaggcaggtaggaaaggcagatttgatgtaagctggatattttttaagagcttccccaaatttaaatctttatgtgaaagctcctgaattttagatatcagcaactaactgaaaacagagaaaagcatctaggccaggtgatcagtgacatcccacttgcaggggatcgtctcacaggttgcggacatgggggccacagagacccactgcatgccccaaggagggctccttcgtgaaggcagcgtgagcatagaaggggtggaggtggccggcctctctggcctgcgcatcactctggctccttgagggaagaggctgtgtgtgcgcaccccggggagtggcggtagcccttcctcattctcttcctccctgttttccctgcagaggtctgtggagccctcaacgtcaccgtgtccccggggccccgtggttgactacctggagggggaaaatgccactcttctctgccacgtctcccagaagaggcgaaaggacagcttgctggctgtgcgctggttcttcgcgcgaccagactcccaggaagccctgatggttaagatgaccaagctccggatagtgcagtactaccgggaatttcagccgcagcgcctaccggcagaggctgcgcctc

SEQ ID NO: 33567 - DNA, 808 bp, Bovine  19866881680373
tggaatgaatttcttgccttaaattgagtcaatattaaatgtattttaagtatatcagtattttgatcaagagcagtttgttttgattgaattttaaatatgggtttaaattcatggcaataagtttttcttaataatgttaagattgtaaaactgttatatccaaagccatatcagaaagtcagtttttgctcaagttacagtagaatctcaaatgagttttagaaatatcaataactctaattgccaccaaaatactgtagctcttaaaattttatagctatagttattaaggcagctgattgttaaactgtagacatctacattagaacgtttacattgcatctcccttggtactcttgggcttgggggatgttaaaagaaacgaaaatgctcaggattgagaagcatatgaaggatattttaaaactgccagtcactctatattttgttatttcttgttgttgatctttgtagacagattgaaattgtaatggtaaccccttgagtgaagaaaaagattaggatttcttatcttattaatagcatggtttgatgattgatgatcagaataaagccccatatagtttacaaggggcttccctggtgtctcagtggtaaaggaaccgcaggaaatgcaggttccatccttgggttgggaagatcccctggagaggaaaatggcaacccactcgagaattcttgccaggaggacccaacggacagagaatcctacagtctgtggggactgcaaagagtaggacttagcaactgagcaacaacaccacccagtttacaacacagaaag

SEQ ID NO: 33568 - DNA, 1088 bp, Bovine  19866881803745
tggccttgtgttttatttttattctggccttgattaaagtgtttaaaattttatgatgctgccttttgtatttaatcatttcactgctgtttttttgtattcaccatttaccatttaaggaacaacagctgaagaagatcacggcaaaacaaaaacgactccaggccgtcctcggaggagcagaggtgcaagtggaactcggtctcggcgggctggaggaggaggatgctggtgaggtcctggggggtggggtctctgttccgaactgccgcctgatgcctctgctctgtggagggtgtctcttcagtcccagcctgggtgtttggacaaatacgtttatttgcttagtgtcaaaacaaacgcaggccattgtattctctacacctatagaacctagcctaaccctaactcgaaccctaacctgggtctaccagtctgactcgtttgtattttcctatctttctttagcagctctttgatgtttagatagagactgttcagagagagagaaactgtgagatggaacgaattagaagtctttgggggcttcagagaatgaaagtaaatttttaactcagcctaatagaggctcctggtgcccatttagtattatgtttaataaattagaaatcttaacattttgtataattaacttcataaaggcacctaacatcttgattgaattatgttttgttgacccagtatcatcagtcagcattcatagaattgcttttacaaatctttttggaacctatttgacaggctttctaaccatcaattctgttgttaaggcatcttaattcaggttatttagttcatggccatgattttgcttatatcactgccctggatgggtgtcttttggaaaaccttttgggaagatacgtaagctctgaaacgaaatgccttgagtgtcagtgtgtgtgtgtgtgtgtttagaaattgttggtagctgttcagttatttactagttgaaatacagatttaagcccttcaagcaaacattttgtgctggctccattcagtaagacaagagaattgtgaagactcaactgaggtgacggaaaaagatactagctgtgctgtga

SEQ ID NO: 33569 - DNA, 1215 bp, Bovine  19866880473657
ttttggcaagttgatattacaaaagaatttaagttaatggagcactaagatcaaaaggcaaagaggccttaaagggtatgatgtatcacaaagaaagttacatatcatggagatgggttgtgggtaagcatgaaatggtaagttgtaataggcctttgaatgctgtactgcacaggacatgattaagtgcttaaagtacatactgagaagaaagagatttgggctgagaaacattttgtggtcagtttatcataattcagtaaaagaaaggaactatacttacatttgtttataaagctctgtttcagagggatcaacaaatactaaagatgaagatcctttttttttttttttaattaaatgccaaagaataaaagctgcaataatccctctaaaacgtattagtgatgaacaatcccatggggttagactgagacaaatttgatagggttagaaaaatcgtagagaaaagaagctatatataaactgtgaggaacgcactagggaaaacgccttagaaaattaataaagattggcttggtttaaagatgataaacaaagactaatgcaagaggctaatgaattcagtcatgaagaaagtttatactaaagtgctctcaaaaagaattgctgctggcctggtttttattaagcatttttcccttaaattagagggaaaatataagtaacccattaataaaatttgcaatttatactgaattaggcgatactgtctctgttaataaaatgatggaaattctgataataataattactgtaagttggatatagaaggtcaaaatagtgtttaaaataagataagctatatgtttcccatttttaaacccacatagaagcagcaggtagcatttgagaaatgtctccatttccaggagatattcttggtttaagggttttaagaactgaatggtaggacctccctggtggtccagtagttgagaatccaccttgatatatagaggacataggtttgatccttagcctgggaagagtccacactgcagggcaagtaagcccatgtgccacagctaatgaagcctgcgtgcctagagcccatgttctacaacaagagaagccgcagcaatgaggatcccattcacctcaattacagagtagcccccactcgccacaactagaaaaaagcccatgcacagcagcaaagacccagcatagccataaataaccacttaattt

SEQ ID NO: 33570 - DNA, 2445 bp, Bovine  19866880625431
tgtgtggatttcttagtagtcccatgaaagtgaaagtgaacttgctcagtcgtgtccaactctttgcgaccctgtggactgtagcccaccaggctcctccgtccgtgggattctccaagcaggaatactggagtgggttgccattcccttctccaggggatcttcccaacccagggatcgaacccagggctcccccattgcaggcagaggctttaacctctgagccaccagggaagccgtaggtacgggtgattctttgcagcttttcaaacttggaggtgttttacttcttaccttgtattcatgctgaaatttagtatccattgaggaagggcattgaggtgcattgaggaagtaccaatgtattggtagaagtaccaagtctggtagaatacagacatacaaataatcaattgctatattacaattgctattataaagggatcagtaaataaaggcaatgggccatgggtaaggaggctcagaagtccaggcaaggcttcatgaaactgaaattggatgatagataaggcgtttgctagatcataaagggatgggtacatagagagcccttcctaagcacatggaacagaatgggcaaaccatggtatgagggagccccatgtttcatggggcatgtcagtatccctgaagcatagaattagcagaaatgatgtggcagatgagcctagacttggacaggtaagtaggaaccagatcaggaaaggccttgcatctcctgtaaaatagtttccattgtagcctgtaggttgtaggaagccactgaattcttttgaatagtgtattttgaaggttccaggctcgtttgcatatattgtaattcttatccagcatggggaccaagttcgacacagttctataaagaaaggttgcatttattttctctggcaatggttgaggcaactgcacattagctttttgttttctttgaggaaatttttttattgtgtttatatatatatatatacacacacatatatatgtatacacacacacattcatacatacatacatacatacatatttagagcttccctggtggctcagtggtagagaatctgcctgccagtgcaggagacgggttcaatccctgatctgggaagatcccacacgctgtggagctactaagttcatgtgccacaactaccgagcctatgctctggagcggggacccccaactactgagcccatgtgccacaacctattaatactgaagtcagtgcaccctccagtatctacagtccttttctcttctgcaggttttccacggagaggaatttgttcccttgcttggaggattggggctggtatgactggggatgggaagttagtctggctacttaaggaagggagcttgaagtcttgtgatcagtccatagatttatagttaatcaccttgaaaatacaatgaaacacgcccctttgttctcatctgggaatggtgtccccgagtccagagaccctcccatcaactatgttcgagaaccaactacctgtcttcagttgcagtagaacaggtcttaaatagatttttaaccagttctcccatatttagcttctatctataccctgtcttgagagatgcttaatgcctcttgttttgaaagtttttctggagcaccgcagtaccaataaactcacctcttaggcgctgctagtccttaatctcacaataggcacttagctttctactttacaaattttcattattatcactgcttctgccttcattggattattgggaaccaccatctctgctttttcctgtttgttttttagtgaagcattgtaaggaaattgtcaaatgtgttttcaatatctcaaatttattttgatgcaatgttttctaaagtgcagtatacatgtttttccttttttttcgggatataatttaattttccttcataattcagagtcattactatgaacacagactattacactggacaaggtaatgacctcagggactactgagaaattaaaggcagttaagcctgagattgatgtggcttttccataatttatgtgtgctttttacagtgcttctgtttcctcccttgttattatggttattagctatctctcctcacatgtaagtgggcctacctctaaaagcatctgtttcctaattttttgtttatgatgtgctgaagctcttggaattgtgtcaagtaagcttgacacaacaaagatcactgtgaaagtgattaggaatgttcccaagggaaaaccatagagtaatggggaaatgagatcaggaaggcaaggaagcaaggcaagggtgaaacatcaagcaaacctctgtggtaaactcaggcaagggcaactttggctcagttctgtggggaacctgggagacagtgcaggtccaacctaaaagctgttcctaacttgggcaaagagaaataaatacatatacccaac

SEQ ID NO: 33571 - DNA, 3083 bp, Bovine  19866880646252
ccccgatagtgagaaaggctgagggcaggaggagaagggggagacagagaatgagatggatggatggcatcaccgacttaatggacatgagcaaactcgaggagatagagaaaggacagcagggaagcctagtgtgctgcagttcatggagcagagtcggacacgactgagggactgaatgacaaagaagaaaatagcagtaaaacagaacgttaggggaaagaagagacagctgaacacaacagcacaataacctcctcccttcaagcagtttgggatctaagtgcttcagggtggggcttggaagccaggcaatctgctcatcttttaagtatgacaactgctctactcctctgaaacaagaacaggtaaagaacaacaagcattcacaaaatgtgcaccaaaaacttggggaaagaaatttaagactgctgtagaactcaagctagtccaagcaaatcagaaagcatctctggccacagaactctttcctcagaaggccagtatccacccagagccctagagaactgaggggaaagacatgcggccacggtggggaggagttgagccacggctttatgcacaacgtgaggagattatccaggaaggatgtgggagtccagttctggcttaacgctaacccaaatctgagaagtgcagcctggtatctagccaataaagaactaaacagggaataattctgcacaatcaagaggataaactccaaaactgatttgagggaacaggcctggcctcatttacatactaacaaggccaagatggccacctcttatttcacttttcaggtttcttgtgtccccactactgactactgggcttcccagggagcactagtggtaaggaatctgcctgccagtgtgggacacgcaagagacatgggtttgttccctgggtggggaagatcccccagagaaggaaatgacaacctgctccagtattctcacctggaaaattccgtggacagaggaccctggcgagctacagtccattaggttacaaagtcgaacatgactgagtgactgagcccagcacaaatgactaccaccccctaacctcatcgtatgcatactgtggatattgtgatttaaaaaccttggttcagagtccaaaaaacgagagcagttgggggagaatttgcagttgatttggggaagacgatacaaagcagaatctgagttgctgtgggttaaaaccctgaggtctaccagaggaaggatatacataaatcacaaaaaatatgtaaaaaggaactacgaacttatattaaggatttaagtgacagaaagttatttaaactagaagaatatataaacaaaaccaaacagagtcaggaggaatacactgggttgatccatataaaatcgctattttcacagatccaaaaaagtgcagtgtcagcaattttataaggttcgcatgtactttgcatcgaaaaattcacggaaactgcactggagagcaccagaatgaagaggaatttcagacccaatattaaggaagcacctctgacaaacagagcaaccagtgtgcaaacagaacagggtaatcccctctcaagaggtttctgtgttaagttgcttctaagatcccttctcttgcccacttagtctaagcaatttctggtggattcatttccatctgtagtaagagtcgagaagacaggtgactatgaaacaaatgtatcctgaaaagaaaatgggacaagagaagttcaggaaggcaacagtgaccatttccaacccattcagccccctctctgcagaacccagggatcatcctgctctgaccacagtgagatcttcaggcaggggaaaaaatgagtcctataaacaaatgctataaatttaaaagaaggtttaggaccaggaaaaagcaataaagagatctggaaaggaaggcttcactgatgcaaagagacttgacctgcagaactgtgacttaggtagcttgggacacagagcagagagcacaccaggggctgaagcccaagaagcagtccagcagagctggacagaacgtatgtaagtgagcagagagtctggggtgatgagttagagaaagggtggtgcggccaagactagggacacggaccatcttgattgccaagctcaggctggcactgtaagtctaagtatggtttacagacaaaacgtaagactgaagtcataagtgaagggacagttcatgtcttcatgcacaagttgtaagtattataatgttagggactcagacaaagaaaaaagcaaagctatgttttgatttcagtactgcttcattttttccgttattcaggtcagattctgctacattttgttcttaatggtttataaactgtattcaaaatgccttattatttttattacaacaatttttttacactctacgatcacaaatgttattagtccatgttcacctagcaattcctctctaatgaaaacacctaccttggctcaaatgtgagaaaagcagtaaacattttgggggcatttactggctaggcagtggtggcatttcaaggggctggatggaaggagtactccacccagggtgcaggcaataatggggtatcttgtctgcagagaatttaaaaacagtaataaactgacgaaagtcagtctgctttttattatcactctgcactggcaattctaaaccattctagccctccctgctgggactgatggctcccatctcagccatctctcctgggcccaccaccagtactagcgctcagcatcataggaagtgttttacatgaactctcttttacccctcattttacagacagggaaagagaggctcgggagacagaggtaaatagagaatgagggtttaccccaggcagcctgattcccagggctgcatgtttaacctacaatctactccactcagggaaaaatgagcaaaacagcagaaatccccagttcagctcagctgagagtcaatagccgagtctcaatgtcgtgtttcattagcctgccgcctaccttttcatcagtgaatcaacaactgactgcctatagctcagagaacacttcttacttactaattcattgcccatt

SEQ ID NO: 33572 - DNA, 1672 bp, Bovine  19866880681870
acttgagtgccagatattgtatataaaattttttagagttaaatttattgataagtctatactgtcttcccaaagagagatctgatatctcttttggcaagttgttaagggatttaacaatctggggtcactttaatacaattttagaaactgaaattatttcagattaggtttccgtctctgcaggatctgcttcatttctggttcactactgaagctgtggtactataataaagaagaaaagaagataagaaagagaagaactaacactgaatggagagggtcccaactcaaagcagaaggattctaccatttcttacttttcttaataggccctgctctccaacattttgagaaaccacaggagcctaaattgaatacactatcatccagagaagaattaaatttgttgagagtcagttagcactactgacttgagaacagtctagcccattccaagatccacagcttaatctgggagttctcctatcagccactcaacttggttacatacctaaggcttggtctccttatctcagctttggcaatacaaccagtgtaaccctgcttttttcaaagatgtgtattcattcctctgattttacatcataggttattttttctttgttttcttcttcacgtgtatgtgtgtttgggggatctttgggatttttctgtcttcctgcaagctcagtgatgcaataaaaatatcttaacacaagatttatggagaattttcttatcatatggtggaaagtccagagcaaaggtttctgccttctttcttccaagttatcattttgtgagggttttaaagaagataacaaagaaccctgggttttaacgagagcccaggtgattctaatgaaagtggcacaaagaccactttgagaaacactttgtttgactaagtaaacatcaaaacttgcatttagttgctgcactttgccaaacctaccaaggtttcctatataaactcaactcttgttttgaaagagtggatcaattcagatctacagggtcttgtgaggcaaagttaaatcagaaagcagcagtgatacacgtgtttttaaaccacttctggttttaagcaatctagttataaatattcctgcagagtaaaagagaatgaagtgcaatatggcctaaaagtgtgacaacagcaatcgtcaaactttcttttcaccttcaaagcaatgaaataactgctgcttaggagcaaaagcccatcgctgtggtttaccttaagcacctcctggtgaggagaaagaataaaaaatcaagcaaatgtccctattcttcttcagtatccaaagacaacagacagaagatccacaaactttgtcagttctttaattttttctttactatgccttaatccttgttgcttatatattttatattacagtactgtggtgtgtatctgttaattccatactcttaatttattctcacccttcctttctcacacacatacttcccctttgctaaccataagtttgttttctatgtctgtgagtctgtttttctgttgtaaataaatcaatttatattgctttttagagttcacactatgtcttattttttaaataatttcccctttttaattatataagaaaggagccttctcttatgcttctctttcttttttaagaaaaaattcttcccttta

SEQ ID NO: 33573 - DNA, 1771 bp, Bovine  19866880682010
ttcccaacagtggtcaagcttttgtgcacacagaccacctagacaagcccattgctcttaaactcacacccccagacaccctccttttggggaatacatcgaacattctgaggcttaattacctcccctctgcagtgagcccctcacctccctggagcccctacccccacccggagctgcataccaataagctattcagctcatattggctttccaaaaatatggccgcattaaggtgtgaaatgttcatgggatcgaggggtgcagggctatttctccagtggagttaggacttggcactggtactgtgtttattaggaggccaacactattcagctacagccctgaggttggtggggaggccaggctggctacccagggtagctgtggccttgggcagggcttcaggcgagtgagtccccaggtctttctgactgctactgtttctgaaagaacattctgaatagtcagcttgaccagaaagaatatagcatcccttctgcagtcaggcagagggcctcttcattcctaagaatctccttagtgctctctcatgtccagtctgtacgcaaatagtacacacagtccccggctggacaagggctcatgggcctaatactgataagtaagggcctgctctgtacctagatttatggggacaccaagaagtttaagacctgtccctgccttcaaggtactgatgatctaactagggaaaaggacacatgtctgaaaagaaattagcagtcaggatgcatagggtttaagagtcccctgagtgacatatgtgagggatacaagttcccttataagttttctcaggaaaaggaaaagataccaccattaagaagaaggggagggaagtaaaaacccctgcccgagaggaatcctgatggagatctgctgtgtgctagaggtggtaactgatggacagaggagcctggctggtgacagtccatggggtcagatacaactgagcacctttcactttcagaagtggtaaggacctctcaaagtggaaaaaacaggacttgggtctttactgcaaaaagcgcgagtgtgtgtgtgcatgcgtgcacgtgaacacgtgtgtgttcactcagtcatgtctttgcgactccatggactatagcccagccagctcctctgcccataggattttttaggcaagaacactggagcagattgccatttcctactacaggggatcttcccgacccagggatcgcacctgattctcttaggtctcctgcaccagcaggtgggttctttaccactgtgccacctggaagcccaaaaagctcatagtaggtgttcaattcacattggcttttgaataccctgaaaacaacgattgttctcattagcgcttcaattcttggcaagtacttttgatcttctaatatgccctttgttttatagaataatattaacactaataacaattaattgagaaattatatcaggccctgtgctaagcacttaattatctcactgaatcttaaaatgactcaaaaagggaagtacctttatgattcctttcgaggaataataatgaggaagcgagtctcagagtgggacttgcccgagggagtgagggctgggatgtaaccagatctctctgcctccatagttcatcctatacagtctgcccctccagatctaggaagcagaggtcagaggaattaggaaccatactgaaggacacacagcaattgggggtgatcgagggagggcctctggcttcaggccatgctgccttctgcactcc

SEQ ID NO: 33574 - DNA, 1078 bp, Bovine  19866880695341
cgtgtttcttttttcgtttgtatttatttaaatttgttttgtcttaaatacctgacaagtttaggtaatcttaaaaaattttttaatacttacttaaaaaaaaaaactaaaaaacgagtttggacacttagattttgcagatactcagtactcactgatttcactgttgacaatttgagttgacacatactggtcacaaggtaaaaatacgatcactgcaagtatctgggttaaaagtatctggttttatctacctaaaaaagtagataaaactgtgtgaaaacatcacagtccaggagactgccagacctttctctctcccatgactccagaattggagttatctcttgaaaactggaagggtacccttgacagatttgcaggaccaatactttgcagatattgtagaaataatatttttagtagagttatctagagtaagaatagaggatgcttgtagctggcagttaacagcactgagataggtgggtacacagacgccttttactgtatggaagacatagtaccaaaaccatgattgtgccagaaaaatgatgattaccatatctatatttggttgaaataggtttgtttttgttttgttttttgtaattgttaaataacatggtttggtgaagtgtttgactagccacgtctcatatgttgttttataactttttatgcagttacaggtttacaaagttgttggcttttcaaaacaaagttttaatcaggtatttctagtctaaatgggtatcttaacagtttaatcttaatgagatgataatttacttattgcagctagttactaaattagtgtatgtgtatacactatatgtcatattttcaaatgctcagtggactgataattatttcttcaaaggagagatgaattcttagccttgcttttagctattgttaaaaaattagctcctttttctttaaattaatatagttgagaaagtgtatatactgttgtttatttgtttgtttaccctcactaaactgagattctctagagatcttatcttcatacttagctctaaataaaagtcttggcatgtaaaaatttgctgca

SEQ ID NO: 33575 - DNA, 952 bp, Bovine  19866880706325
acacacgacggtacacaagactagcccctcattccccatctcacaggaattcaggaccaatgaaaaggaaagaagaaagagtacttgaagaaagaattactctgcagacaacattagagtcatgtactggtggcctgcaaggatgagggcagctgataattttacaaaatattttaacatggacggcatctaaagaaaatgtaaagacatgtggaatgtatcttacttatgtaagatataacaattttttctaattgcattagaggttggcacaaatgactttccataattgaaaacataaaatattttttccaagaaagatgtactcaatgatacaaaatccaagtataagaataacaggtagatttgctgctaagatgtaatctgtcaataatgggtctgaaaaattactgaaagtacattgcaaagacgagtacaaaatgcttgattaaaactcaaactctaggtaaactatatccaagaattacggagtctcacatttttaactgtccggatgttcactgaagtgcacatataaattttgatagtcatattctgtattttagtatttatgattattaatcccttcagtcagcctgcactctctaatccattagaattttcccaaacgtgggtttagccaatatgcagaactggttttctttaggttgagtccttttgtgtgatggtaggcacttaacacgccatggataattctgggttttgttatttttgaagcaaacttcttttgttatatacataatacatggatacacgttccttgtagaaaccaaaatatgattcagaagcctaaagtccactctgtgggatgctcttcttgtgcctgccccagctgcccttccacttaaacacagtcaggttcagacgatggagcaccaaccaccctgggagtcagaacagcaggggctttgacagaagccacacagcgggg

SEQ ID NO: 33576 - DNA, 1236 bp, Bovine  19866880752253
aatcaacataagcctggtaattattctatttggaaaatatacccatcagcccaggattagtttcaatatgtttataaaattcattaacagaatattacaagtaggaaaactaggaaaacaaaagcaattaattatcctcatgctaaatgattgctgtaccgaagatgcatcagactttaaagggatatgtgtaatctcatgacaggcttatctgaagcatttccttccacagtcatttttaaaaagaatgctctccttcacactattcttttttaaaaaaactaatttctctttcatttacttaaggttggggtggactagcttttgaaacttccctaagaaaaatcagttgccttaatcattatcactcaaaagcaaacaagtgcctacacatgcatgtgggactctgttgcgtatggaactctggtgcttttaaacaaagaccaaaccactaacgccttcaggaggtgtgcagaaacaaatgctgtagtgcacttccccacctctattgaaacccttgcctcaccagccaagattttgttcaacttaatgtgtttcgtattttataatacgtaattttcattttctaaaagagaaatgatattctgaatgtttttctaaactatgtaactatgcaagtgaatgcagatgtgtgcacacatatgcatatatgtatatacacatatatatacatactgtgtagatatacagatatattaatagggtgtgttcttcattctcttcccctgttaaaaaaaataaaagctaatatttattgcatgcaaacctgccagatactgtgtgaggtatttacattatttcaacaaactcagcgaggtgttcttatggttccaaacttattaaggaggaaactgcagcccagaaaggttaaataatggaccccaaggagtccacagctgcaagcggcagagctcagattccgtgttaggaggccgacctcagagcctgccttcttctcccgagtgagtctctaaattaggaacagtaactagagcaggatgggatacacacataagtcaagggcaagggtcattctggaagtgggaagcaagaggtaagtttataacagggatggatattagaggaagaagccactcaaggtcttttattgtcagaggagatgaagaggagaccattggcaattctctacttaattcaaaatgacttttacagaagattggctttcaggagttatttagaactgaaggaaaaagg

SEQ ID NO: 33577 - DNA, 2238 bp, Bovine  19866880757838
gtgatggacagggaggcctgctgctgctgctgctaagttgcttcagtcgtgtccgagtctgtgcgagcccataggcggcagcccaccaggatccgccgtccctgggattctccaggcaagaacactggagtgggtttccatttccttctccaatgcatgaaagtgaaatgtgaagagtgaagtcgctcagtcgtgtccgacttttagccaccccatggactgcagcctaccaggctcttctagccatgggattttccaggcaagagtactcgagtggggtgccattgccttctccgacagggagctttgaggggcccttgaacaaagtttccaacaccaggggcctctggagagggtaggggagagggcttcctggctccacagcggtgacaaggggttggctcctgatttcctgtggaaagggtctaggcctcagccccagtcaagctggttaataacctcatctgagataactgaggcccttctgaagcatcccagtggcacctgggcaatgcacatgcctgggcctccatgtcagctggacccacctgtggggagcctgccccttgccactgcagtgtccactctgttctaggatggactcgctgcagaagcaggacctccggaggcccaagatccatgggtcagtccgggtgtccccctaccagccacccacgctggcctcgctgcagcgcttactgtgggtccgtcgggctgccatgttgaaccacatcaatgaagtctggcccaacctcttcctgggagacgcgtaagtacgagccacggtgggggctggggggagcagaaggggacccttgcccggagcctgtgaggagcagagttggcaccctctttgcctccgaccatctcttttcacatatttatttccttttacactgttactactttggggaactagaacatatccaagaaagtgcacaaagcctcagtttcagaccccaggtcaagaaataagacattacttgtgccccggaagcctccactgaacccttctcggcataaccttttcccctgtagataaccactgagtactgaaatagttatttccttgcttttctttacagtttcaccacttgtgttagttttgcccagcttttaaagtgataggaatcgaggcatgttgggtattttgtacctggcgtcgtctgctcaaaattgggagatgccagcagtatgtgtagcatacagttcattgctatatattattcatttgcatgtaaataccacagtttatccactctgtttgaattgtttccactttggggctattataaacagaaattctaaaagcattctagtacatgtaccctgggaaccacacatgtttctctaggatatatatatagacacagtgtgcaatatgagtcattttccctaaaagttgtcttaaaatctagaacatatggatgaatatatgtggatgttataagttttctttaatatttagaaaatatagatcaatatcttattaacaatatgacaaatatgtatctcccctacatgcacagataaccagttataaaatccttgacttaaaaaaaaaatgcatacacacatacatacataaatgctttttcacagttcttttttttacaaaaatggtatcattttataatctcattttgtaatctgctttatataggaaactttttaaatggaaccacacaacatactttaaatgcacttttaagcgacattctattttgttatcctgttcttttcataggttctcaggatagtaccaacaccttttcttgctcccctgcatctatctgccacattttagtgggtgtgcggtatttcattcagctgtatcaatagtcagtctcctcttacaggctatttagtgattctccctgccccccaattttctctatcttaaatgtcactagatacagtttacatttgtctgtgagcacatttggaattctttaagttcctaggaggctggggcaagtgcgtgtttttgaggcttctaatgcatgtggctgaactgccctccagaaaagttggcctgagtgaaatggagccccttcatttctgaatcagaccagttcactgattccaggttctacccttggaagaggtcagcagaggaggccaaggggtgaattccagcacagccggggcagactcagtgagctctaccccacctcctcctgtgtccctccaggtacgcagcccgggacaagaacaagttgacccagctgggcatca

SEQ ID NO: 33578 - DNA, 1189 bp, Bovine  19866880804541
aaatgtattgctgctcactattgtactctaggaaattgagaccccatctctagcagtgtcaccagctcacaaagccattaccctgaatgaaccggcagaattacattccattctgtgaggctcatgctcattagcaccaaaagaggcaattatttgtgattaaagccagaggaagtgttatttaaaaggattttcagctttctgaaattctgcctataatcttgtgcagtacagagcagaaacagggatttttctgtttagaaaaacaattctataggtagcctatccttggagcctctctagtagaaataaatatcttgttttgtttatttcccttgtctgttagggaaattactatggaaatgtttgtatttagaggttgcccaagtaatactttttatacacattgtatctgctgagtctcctcgatgaaaatcggaatactactttaaagtatgcataaaataatgtttaaagaaagttggttgtttatttcctcctttgtttatattagattggatgtgtaaatacagtattaaggctgcatttggagattttattcaaactatccgggtaacaggaagaccaggtatcttatgatagtaatcacttctgaccatgtgaaaatctgttgctaggaactgtgtgcttcttcattaccagagttaaactgaaagaaggaaaacacagcaaatcatgtaatcttcataaggtacatcagatgcaaaaccaaaatgtaaatatactcaaggaaaaccacgaagtgacatgttgagtctaaatctatattattagatgttgaaatatgaaattttgggtgtaaaaaataactatatagcagtgttgggctgatttgtataatttattgacattgaaagatggtattcttctttgaagtattttaattgattatttttatattttcagatgatatttctagtcattaattcattaccttagtcttactcttctttcttgatctagttatcccacgaaaggtcgtcttaccagaagttcaccattttattttacagccccagttgtaatgtgttctacaggcaaatccagttgttttattttggagctttttgtggccactgttcacaagttgtccctaataattttgggtatgcctcgcagccgtttgagccttgaattttggatagcatttgcatgcttacagagtaag

SEQ ID NO: 33579 - DNA, 1056 bp, Bovine  19866880848460
gaatactggctgctgtagggctactttaaaaatcaatgatgcaaaaatgatgtgagcttcttaagacatttaactgggataaactgtctgatcctaataataggaacaaggcaacagttaagtctgcatttaaataaatttttcatattaaatgtaaaaacactttattccttttaactgagggaaaatttagctgttcaattatctgaattatacttatctgctacccttccaaagatctttatctgagccaaaaacttgcatgtggtgtttaagccaaaataaaattttgccgccaagttataatgttctgaaaactgaattttggtgtctaactgaactgcagaaaaataacttactgggtataatcaataattactctgaaaaatatttggtaatatacttcttaggtaaatatccatttgtatactttcaagagctttaaattatagaaattgattatatatagtcttaaaacacaacagatatattctctaagaattatttaagctaacgtctatctatctagggcttcccaagtgactctaaggtaaagaatccgcctgccaatgcaggagacacaaaagacatgggttcaatccctgggtcaggaaatgacaacccactccagtattactgtctgaaaaattccaaggacagaggagcctggtaggctacagtccacagggttgtaaagagtcgtacatgatagagtgactgagctcactatctatctatcagtgtgtagctaaacatacccattcacatacatgaaatgcatttatatgtacacactctttttcatcagaatgttttctagctctaagaggttctaactaaagagtattggagggtatttgggagaaactctaaaaaacatagtatggactagttcatacacagatgctttcttagattaaggggcccctgggtgtattcctacatgaagatttattgttattgatcttacagttaagtgtgtaatggggaaggagacagtgatcatttaaataaacattctgaggtacactgtagccagggtttttccaaaccggg

SEQ ID NO: 33580 - DNA, 1224 bp, Bovine  19866880848779
tgtctctactcatgagttatttatttgtagggtatctctttttccagagaattaatagcaggaattcaggttgtcccatgaaacacttcccttattgtatttgccgccacatcatgtaatactacaaaccaaaagctgagaaagcacctgataaaccccacaccatgcagcaaaattagggagtgtggggaatctgcatctctcagttggatttaatgatctattgttaggccaagaaacctgtttccctgatcagcatgtgaaacaatagaggataaaatggtgtgtaagcagaaagtctccccttgtaagctgcaaattacctaaaggttttatttctaattatggtcatataattgcagacactttaaggagaagagcctgtttgttctccctggtgtgagcaactctgatccaagctctcctgaagccagcagccaagtggcagtggcacaggtccaggagtcctggagaaggacagacggacagctatcctaaaaaagagctcctgatgtcacccagcaatgagacgtgagagcctgataacgctcccatcctcactcaggtgttacgtgtataaagtgaaagggctcacaacattaagtagatattttttcactgggtagtggtcagcaccatgcttgatctcccattctctcattttctgaccaggccttcccaaggccttccttcttagcataaattggcttcccctaagaattagttctccatttggtttggttaagaaaataatcatatttcattaaattctcaaaacttgttacagaagatttctgaaagcctgttgacacgcactgtagtaaagaaatttaaggcctagaatctggaatggactccctgcgtttgagccccagctctcccgttttctggttgtgtgaacgtagccaagaatttgactcctcctttaggttctacatctgtaaaatgggaataacaaaagttgcatgaattaacgagaccacatatataaagtactacagcatgtagtgactgcttggaagacactgagttgctgttgtatttggtataggcattttggccactcaacattttttcagcacctgcttcttatttcagttgtacaagagcacagagtctctatccactgtgccatagaaaattcaaagaaggagaacatatgacctgtgcttttggaaggtttacaaattacagggaaaaaagcatacacgcacgattcaagaa

SEQ ID NO: 33581 - DNA, 1040 bp, Bovine  19866880886098
tacattcccgctagtggtatacaagtgttcccatttctcccatcctcttcagtgcttgctatttctctctctctctcttttttttgataactatctatcctaagggggctgaagtggtatcccattgtggtttcgatggggttgcaaagagtcggacacaactgagctgaactgaatgttatttatgttgagcgtgtttttacgtgctttttggtgatttgtatttctcctttggtgagatgtcaatttaagtgtttttcagactatatagaatttaattgatagcaataataatataactactactaacacccattcatttgacaattttttatttgacttcatctgtgccagagcttactctaggcatcagagatacagcacaaggaaaaatcaacaaaaattcatcctctcaaggagctgacatttaaaataaatgagtaaaaaatagaatgtattagggcttccctggtggctcagacagtaaagaatctgcctgcaatatgggagaccaaggttccatcactgggtcggaaagatcccctggagaagcgaatggcaacccattccagtattcttgcctggagaatcccatggacaaaggagcctggtgggctacagttcatgggggttgcaaagaattggacacgactgagcgtataacacacacacacacacacacacacccacccacacacacacccacatgctcccctttgctttacaccatctaagttaagaattcaagtcccaaaagaatcagattatctatagattccaaatgtatcatgaagaaatgtctaaattcctagtcagattgattcagaccatcaaagctaagctcctaaagggaaatctattcaactatctgttgggtccttttctaagatggtatctgctaaaatgctccggtaaagagcaaacttgtatgtttttctagttaagttgttttttttttttttgaacacccagtctgcctgcatgcctgtctgtctttttccttcctacctaacttccttccttgttttcttttagaagtg

SEQ ID NO: 33582 - DNA, 942 bp, Bovine  19866880918935
tagcagcaatccagtgcagaccccaccccttatgtctctggttacttgggagtttgtaaggatgagaattccagatggctgtggcccacagaaggcacttagaccccgacaaccgggcagctcatctcaagccccgtttttctgctgcttacagggctggtcctcaggctcccatcccttcccaccttcaggtgcttgaaggtcagagcccagctctggagttaaggagcctgggctatgaactgacccttgttggcacttccctgctgaatgcactgatgcctcttgggcgctggggcctcattcatggaaagtccctattttacataggaggaagctgaaggtcagagagaataattggttaagtgatgctcaaagttgtatggtcactaaggaacaaggctagggtttcagtcccattcttatgccttcaggtccacccccagccttcgcattacccactttgaggactccagagtggttgctaacccatctttctctacaggggagcctgctgtagctgttccatgtctgcctataggccctgggattttcctccttacccctgtgactcaggccagtgctgcaggtcaggcctcaccgcggtggggtggctcgtatcaggagtcagctggctgagggaatccgagaccctgcagagctgggatgtcagtggcaccagaacctgggcctggtgctgggctgggaaggagtgcctctcttggctaactggccctggccccttcaaccagtaactagggaaggtacaaactgggaagaacttctttgttctgtggttggcggtgccaggaccaggaagagaaatgggcacccaggaggccactggcttggccaggctcacccagcgggcagtgggagggcagggcggaagcgaagacccggctttccctttcatcccactgtgacctctcagggcaggca

SEQ ID NO: 33583 - DNA, 1023 bp, Bovine  19866880938393
ctacatgaatcagacgccccagtaccctatgcagatgcagatgggcatgatggggacccagccatatgcccagcagccaatgcagaccccgccccacagtaacatgatgtacacggcccccggacaccatggctacatgaacacaggcatgtccaaacagtctctcaatgggtcctacatgagacggtaggcaacatgggctgtcacaaaacccctgggcatctctcggattgatctgcacaaataccttctaagagtacgatttcaaaaccagcaattggtgtgaatgcaaaaacatttgttggcaccatttattattaaaaaaaaaaaaaaagctgtatgcagcagaaagccttataaagttgtttttctttttatcttttttttttcctttttcttttttggtacctttgtttctgttacttttatatgaaattctctgcaaaggaaggcctctctttggactacatatggaggcagccactagctgtgactgcttccattaaacaatgtggatatcaagccccgccccaccccaaattatctgttttaatactgaacctagagcatttttttttctcccctgtccactccatgtaaatgccttgaccgttttcagttcttgtatatttcgttgaggtgacacttcagcatgccgctaatgtctttgttagtgacagtgcatttggtagtactgtacgagtgttgtgctaacagtaagccatttcttaagttttttgccttgattagggtgccctaatttgagggtttaaaaaaaaaactatatttttgttaattataaaactgtaaagagctataaaagctattcccatttggttagtcaaaagggttttattgctaaatgtttggtgtaaagttgagacccttttccattttggtgacagatttctttggggaaaaaaaggcagctttctgttttataaatgcagacttctgtttattgaatgaagcatatctcagtgtttatctgtcaggttttaaacatttcatatagtccaaata

SEQ ID NO: 33584 - DNA, 1609 bp, Bovine  19866880961474
ccttgctttgagaaactatttccaggaataatcaaaattgggatccctcgttaatcctgactccatgtcagatttttcagtggtacagcttgtgtttgattaaaggtttcccttgccagtgaagaagggctaaagctgaatttagaaatataattttgacaccatgatttgactttatgtaaaaaaaaatttttatggaatttaggattaacataagcacatgactctatacaaagtagataaccagggacctaccatatagcacaggaaactatgctctatgtcttataataatctataagggaaagaatctgaaaaaaaatgtatatatgtatattcttttatataactgaatcacggtactgtacacctaaaactaacaatattgtaaatcaagtatacttcaattaaaaaaactttatattttatatatatatatatatatatatatatatttttttttttttttttaactagggaaaaaatcaccaaatactgtaaacaagtagcaggactcagaaagatatttttgtgtgtcttctattttgggattctttataaataatcatattttataagaaataaccacatctgtattttttcactgtgctggccaaatagaacagtctgggctggaagctacttgtgacttttgatttatgatttccacttcatctgacttgcctccagggcctggctgtttcctggggctcctctacctctctgtccctctctccccacattcactggctggtggccctcctgtactctcacagcctcagcagtcactgaggactcgaatctacatgtctcatccttcctgagctttgccttctttgataaaatggaactgtaacaagagggtgaagatgcttcaaaaacaaacacttaacctggattcttttgctttctaaggtggaggatggaaggagcatcattcatttcagcaggaaacttgagtatctaagtggacccccttgagcctgcagagattggccaggtagccatgtccaggagtgagagccacagaataggcctcccgattaaccaaaaaacaccattgaaggatccttttgatggggaaaaggtgagtcctaaagcatatttcagaaagtgatggagtgaacaaaaagctaaattattctgtacaagaaagcaaggggagttctgagcctctagaacatcccccagagcgggtgtgaggggactgctgtaggctgtgggaggcagggcttgggagccaggtgaggagcatccagggcacacagccacaggattcctcagaacagggatccccatgctaaactctgtggttgcagagtcggacatggctgagtgactgaatagcaactgactatatcagtcttcccagtggctcagtgctaaagagtcctcctccaatgctggagacgtgggtttcatccatgggtcaggaagaccccctggagaaggaaatggcacctcactccagtattcttgcctgggagatgccaggggcagaggaacctggcaggctacagtctatgggatcgcaaaagagttggacatgactcagcgactaaacaaccactggctctgtcagccctctcgttgtcaccctaaacttcag

SEQ ID NO: 33585 - DNA, 1191 bp, Bovine  19866881036797
gacatgccaagccaaagaaatagtccaacttaagggatggaggctggagataattaaagccgttcaggaaatgaatctcctgtgtgccaagcactgtcctgggtactgatgctgcagcaatgagcaggtagtcaaggtccctctggaaagcaaataaatgaatggtccatttcagatagcagtaagctgtgcagaatcactgtggtcctgctttaggtaaggtggtcagggaaggtccctgccgggagatggcattgaaactaagacaaccaggtgataggggcctgggcaagggaagagggggaaggaacgtgttttcttcaggcagaggcaacagcaagtgccaagaacagaagggagacttgcgtggctgtaatcgcgagggtggtagtggcacaagaggaaaccgaaagcgggggctgggtcacggtggaccctggaggtcatggggagagtctggattttatgctcggtatggtaggatgccacatgctacagaggcgtttaaggaaggggtgagtgttgtttactttttaaagatcggtgtggctgatgcatggagatggattgaaaggaagcaaaaaatagaagtggggatctcttttggaggtgtcacagtcatgtggtcaagggaggaaggtggttggactgaggcacagcagacttgttgatggattggaaataggggcaggaaggaagggactggtttgggcagagcataagatgtgagaggagaggagagaaaggtctggagagggagtgtgggatctgaccatggagtgcttacaagtcagaatgtgcctttgggggttaagaagagctttttgcgtttgaaagaggtttttctgtttgaggcgggtgggtcccatctgagatttgagatgacatctccctcaacagtgcaaagtccagttctgcagcttagggaagaggtgacaaggtctggaaccgtaacaataagagaccaaaaagtggcagtgtgctccagctgagggctcatctcaaggccattggtaagaggatctggacagaagtgagcatattgaatgccagcatggaccaacaccctgcacctccatgcagcagaaacacatgccaagggccccgcatctatcactggtttcctggggctttttgttggtcttgagaggagccacagtgagcttttagaaacgtgcaaacagcccatgg

SEQ ID NO: 33586 - DNA, 1874 bp, Bovine  19866881104575
tcaatctttcccagcatcagtcttttctaatgagttggctctttgcatcaggtggccaaagtagtggagcttcaacttcagcatcagtccttctgataaatattcaggattgatttcctttaggattgactggtgtgatctccttgcagtccaagggactctcaagagtcttctcccaacaccacagttcaaaagcatcaattctttggtggtcagccttctttatggtccagttttcatatccatacgtgactaccgaaaaaccatggcttattaggaggttttccctccatccttttcccaatccctgactttggccaggatgcttcatgtctcagggctcagtgtttcttctttttctgtttctatttctaactttacttcttccgtttcttctcccttacctttattatttaaaagcacaaatgatgtcaccctacttgtgttctctgcagagtctgccgtatacatcaacaatattcagtaaatattggctacattaacacatcttcagagctttttctttcactgtccccaactttgctactgagccttctttctaccacggggctcttctgccacattctcccaagttttgcttgtagagtcaaaggccttgccatgtcttcagtttccctgccctgcttcttcagaagaaaagggagcctttttgccatttgctggtgggggactggccttttcagcaaggatggtggggtgtgggggtgagaagtggaagcagtggcctgaggagctggctgatgtgtggagacttgtcctccaccaggcttgagaggtggggaaattggggattctggtgaggattagctttgctggatcatcagcagcatcttcagcctctttccctttctaactagccaccaagttgtgcagattgattttccctttgacatgggggcttcacaagcacttctggaatgaatgaatgagctatctcttgcagaactgaagtgtgaaataagtcagtaaacatgccaaaaggaggccggaggctatggaaaccgatgtagattggctcaaaatgtcatgaaaatgaaaaagttgagggacaaggcctttctagggagaatgctggtccccctgcccctaggtgcttctgcttcagtccgcctcaccttcatctagtagcctcctgaagtgtctcctctcaggcccacttccccaaaactgctttaatcggaccttctgttgcctcaagccctcctgggtgacctgtgttctgccaaaaaaaaaaaaagaaaaaagtttcatatgccttagctcctccccttccaccttcttactgtgagagcatctactgcccacgcagactggccatccagccagagtgggatcttctccctcataccaggacaccctccttggtctcatctttgcttctgaggctctgttttgtagtatctggcttcccctcccctacctccatcggagtagatcatagtgcttgagtgtggtgggtgccccgggtccactgcttgattccacactgccacacttcctagatgtgtgacttagggcagggttcttaacctctctgaggtttcagtttcctcctgtgcaaaatggatgtaataatggtacctacctcttaagtcactgggtaaatgaaatgcaacaatgcatgtgtgtgcctggcacacagaaagtgctcaaagtggttattactgttatcccccgggttctttcttacctctgaattcctggagtactgtctaggccactcatctggcacttaattgtctacttattgatgatatcttttataagccattcatatcgtttatcttttgtatgtgtgtgttcaacttcccaattagattttaagctcctctagggctgaaccagatggcttc

SEQ ID NO: 33587 - DNA, 2579 bp, Bovine  19866881142969
agatatatgtactgtctcttatcttttcttctcatgtatgctcttaaattctaaactcgagattctcagtcctcttttatagttacagtgtttctctagttgttctcctattactattcaaaatgtttttgtgatgtattgggattttcttcagtgtttgaggttctctaacactgaactgaactgaacgtgtccttttattttcatgcatcagaccaattgctactatatttatatgggttctcatataattttttttaatgaggaaagtattgagcagcatcaggattttattattccttactctaaaatataacatttatttaataatgagatgaaaatacaggctttatgagatataattcctgtgtcaaaaagctgtaagtgcttctactgttttgtgacaccctgaatgatgtctgctttctttgtgttaaatctaatagtaaatgatcccaaggactatcataaaatcccctgtcattagctctagaaatgccttgatgagtaacttgcttgatgggataaaagcttcagtaaactgatgtccccacctgagtgattaattccaaaatattatttgtctaacacattgttgtcaatgacaactgaataagaacttttaggagcagttggctgtccaacgatcgcaaatttcaaggctatgcaaattgtgccagttcagcccagctcttttctctattatcatatcaattgagtcagttcatagtagacaaagcaaggttatgggaaccacctagagcatcatgcaccatttaacatcaatgcagcatacaagaacatctgcaacttcaatcttattaacagtggagagaatggaaggcaataaacagctttcttcaccatttaattgcaaaatagtatttcctaatgtttgcattgtttatcaacaggaacttcatccaataattgtataattatggttgcctagattacatagggcaaccctcatgcatcttgtcatttatcacagagaggtctgaattcaatctgaatttgaacacacaattcaagactaataatgtaagtcctttgaaatgtgagttgtataatatagataatttgtgcagtaggagaatggcagtttatgatttttcagtcactttggggattaagttaacacagaaaagactgaaaggcagtgaaaaatgaggggaagccactagttagattctaacatagatccattgaacatgaaagtaggttatgttctttagaattaatcacgagtaattagatgtttgctttaggccaaaattgggctgaattaaaacagaattattatgctgaggtcttcctctcagtctctatacttaaagggagaaatggcagaaaactacaagtatactgagaaaaaaactatggtggccaaagttagaaattgtaaatgcagaggaagacttgacatatctgttcagtcttcgcctttgttgctttttgaagccatataacatcactatccctaatgagcaaaatttgagtgtttgtagcaagcaaccaagtgcattcttcaagctctgcggaagcagggagtttcttttggcacacactgcaaaatagccaagaaaaatgagaggaaataatataagtccggtaacagttattggtgtggtcagtgggagttgtctcataataaaacacgagcaggaaaatgtgaaaaataagaggtacatttgaagtaagtcaggcaagggactggtctgaaaagtttatatcttttaaacaagaaaatctcatatttttacttagatttattttgtatatgaggaaaaccagaagcctattcatgaaattaggtctgaaacatttcaatatttagaatattttctccccctgataagtctgtatttatacctttaatattcttcattcatcttctatcacttctttttaaagattgcaagaggaagaaaaaaaaattgctatagtgaagtatccacagagtagaagaatatatagagtttttgtcccattttttggttggtctgggtatagtgaacataactgaagctttcttaacatgacagttgacctatcatttcctccacctgagggattccaagaacggatgtgctggaggtaatgctttgacctgtaattacataacattatgcctagaaacttttttttttttttaaagttttaagtagttacaacctctgctataaactttgaaaaagttctagctctgaagaatgagagtggagattttatacgcatgcatatatatatagatatacatgcatatccatatatatatgtctctcacttaaaatacctcagggaaaacatctgtctatgctggggctttgtgtaaatatgtagtgccaattcatgacacttgcacacctttcctttaaagaacttatatgcaaacattattcaggaaccttttctaggggctatttatcaaaactgctatgataataactctatcataatgagtcctggtctctgtttagggagtaatcgataaactaaaaattaatgttccataattcacattacaatgcacatgtgattatttgagatgaggcaaaccctgtgcatttatttca

SEQ ID NO: 33588 - DNA, 830 bp, Bovine  19866881148141
caaaagcattgccaagtttataccctataacacagtagtatttgcttgcctgttcttgccagtaagaaacaggctatgacagagataatggctaccattcaatatccactttcccttcttcagtagtaacagttctaaaatcaattagaagaggtgatgaattcaactataacactgcatttctcatcattccttgcagctaggagtggctaagagactaagttttgtacagtaagatggaaagtggaagtctagaagatttctgggaaggctacttatcaatgaaagagacaacagcttggaggaagtcttctttacctttctttcttccagcctacaactcagacatgacagttaaagctctggcagtcaccatgactacaaagtgtccttgaggatgcaagccaagtgttaggacaagagagcagaaagccagaagaatcatggatttttgataactccataaaattattaaacacctgacgtgaagtacctattttcagacttctcttacgacagagaataaatcattgcttgtttattaaactatagccaccataaagttcctgttattagtagccaaatctaatcccaacccccacacataaaacttaaaagagcaatccattttgaggaagagtttgagcaatggtcactttttttaaaaggcatttaacacatcagatcagatcagtcgctcagtcgcgtccgactctttgtgaccccatgaatcgcagcatgccaggcctccctttccatcaccaactcccggagttcactcagactcacgttcatgagtcaggatgtcatccagccatctcatcctctgt

SEQ ID NO: 33589 - DNA, 948 bp, Bovine  19866881152146
gccttgatggcagatggcaagttacccccgagaggtgataccaatctatgctaccaggaatatttgaatatccattgtcccaaactcttcctttaactctttttttgcttgcttgttttttccttttgaggtttcatattttacttctctgatcaatacagagaatcctctgccgtcaccagtgctggttccttcatcaaggaaaagagaacttggtaatagcttgttgcagctttcattttgcttctccctggactgggaaaggacagtgttctctctggtggcccgtttctctctcccatgggccctgagtaggttgcccgctgagcttgtgaacacagtgggcagagcagagttcccacggcacacaaacacacctatgtcaatatgacaatgaacttgagagggcttaattggtctatggaaacaggaagcttacattttaaaaattattggcagttgcatcttacttagcatcactctggtaaatgtactagatgggagaattgcttaggagatgtcttaggtgagagcttgctgcttctctgactttgtcaaggatgacagtgatgactggggagttgggcagctccagtaaaatcgtgggctctgttcttcccaccaggcagagaggtggccactgggtgcactggcagatctttgaggatgaacataccaccacatcgatgcctgtttactaacagcggggcagaactgggcctattagcttgcttcccagttgggagaatgggcagtgtaatgaaaagaaccaaggcttcgtggtcagaccatcctgtcttgaaatcttatgactgtcactagttgtttaactgcccttgggctagttagaaaaatattgaatgtgtaactgtgtaaagtggcggtttagtcactcagtcatgtctgagtctttgcgacctatggactgtagccgcctggctcctctgt

SEQ ID NO: 33590 - DNA, 1704 bp, Bovine  19866881178611
tgaacttgcccaacaaggtagggttggatttggctgtgagagacagaaaaatctaaaagagaagttaatctctgttttgtgtagatgcaacttagaggtggcaaggaggttccagggtcaactgggactcaggcttctcctccgccgtgctgtcttcctcatcttgtggtgtcttctcactgaacaggatgactgcctgaactccagccatcacaccttccatccagttttcaggaaaaaggaagggacaaaatgtaacctccttcctttaaggaaacttcttcaaagtttcataggctattgtactcggatccttctgatcaacacttagtcacatggccacacttgagcctggaaatagtctatattccagaggataatatgtttattgagaaatcagttctatcattaaacttaaaagagagactggatattgactcagcaccatcactgtgttgtttacagataaagaaactaaaactcaatgagatgaatgacctgctggaggtaacacagccaggaagaggtggagcttggatcttctgtccctgggccctttggagcaggtagggctctgaagatacactctgccggtttcctaggtggtgaggagaactatgggtatgtacatgattcccttcccaggccccaggaacacccagcgcccaggtcctgccagccaagcagctttgtgcctgcaagccctggcagcctctctgggtgcagatccatcaccccggcaccaaccatgccctgggcctgactccatccatccctctaatactgcatcgactgtgctcgggcacgttcctcaggcagcctcaagagcgctgaataattcaggtctgtgtaatgggataatgaattcactgacaactcagtgtggtcttggtacttacatttcaagaaatactgactccccaggcccgctctgcaggctggagacgtacacacgccaagaaactgttgcctttacctgcctcgtggggttcaggcctgattgagtggatgccctactttggtctcactcactgttcaactgcttgggcgagtggggaatctggggggcagggggcctgtctggttggaactgtggggcgaggtggaagtggaatcacagaagctcagacatgcagagccggaaaggaccctttggttctgcacacccatcttatgaaccgggaaaatgaggttatgacagggacaggcctctgctcctgcacgctgcgctctgtggctgggaacgccgggaatggatcaggaatctggggaggagatctgctttttttccttcctaactctctggtttcctcgtccctcagctgtagagagttgttgttaatgactcccagctgccccttctgtggagatgggacctcagcctaacaagagccgtttctggaaggcccggcctctctgcacgacctggacagactgtggccatgaccggctgatgtggtgccaaaggccaccccgagcctcaaggtaggatgaacgctgatgcttttaagggtccagaacccttggagggccgggctgtggctcagccccagctgagaccctgttctggcctagcttttactgctcccctgtccggcttccctcactcccctgttcctcagagcctcttcccgtccccaccaactcccaccctacatgccccccattgctataaatcatctgaatgggaatgccagactcagg

SEQ ID NO: 33591 - DNA, 1274 bp, Bovine  19866881198856
cttaatttcacatttgtctccacccaaaaagttgtcgcttgaatcttattttccttaaatttagtacaattttaaattgctttcctgggaaattaagcgcacatcattattggggtgctttccttcacctacccagagttcttacaccaagtatagtactcagggaattaccaccaatctccaccctctatcctctgtccacattggctctgctgagatccctagccgttagctatggaagttcagcggctctgctgcttcctctgcatgaaagttttagctaaggttggtagctttagtagcttatatttaattttctctgttggatatttcctgttgacccttcaagattgactttttactctttcccttccctattttgtgcccaaggatccttagaaaattgctgagtattggtagcatggagagaaaaggtccttgtgaggccctgaattttttaaaatatggttttaaatccctgggagccccaagatcaggtgaaagtagaggagttcaaaaagaagagggggcaggttagagcctggaaagtcaaatgatgggtcttagaatatagcctaactccaggaacattactgtatcctttctatgggcttgttgagttctatactattcccagctaactgaaggagagagttaaatattttaacaattcaagattgctgattatgagactggcgatttttaaacaagtgatcatatcaacaataaagcataaatcttgtcttaataaggcaccacttgtaattctatttttcagattaatgaatatgattaaaaataagataaaaactttagaaaatggttaactaaaatccaaattggatgtgaaataaaggccaaattgttattttcagtcatgtggtgcatatttccatatgttctaaaaatccttaagaacttggcataaagttctgctaaaataatttctgcttcttaaatgacaggtgtcccatcttttattgtagtgttaactcagaatccatacagtatgaaaatgcatagtacaaaagataaatttgtaagcatttgcctcagtgtactacagtgtacattcacttgcagcctatttctacatccttactctccttcacctggcctccttatgtctttactttcaccttcttttcattttaaccaccatcacttctctatcagatggttcttgtttctacttctgaatacatttaaatgccattcatgcagtcataaattcttattaaatttatgtttaaacctaggggattcagcagtca

SEQ ID NO: 33592 - DNA, 1196 bp, Bovine  19866881291072
cctgggactcctctctgggacagtcccctcccctgggacaagagggtcaagctgctcttggagacatgacctcagagatgtgcagcaagggcccaggcccaatctatcaccacggggctataattaggtttgttaacatacagtcgagtgtagtcttgttgactaggaacttaatcacgttactattgagttcctgtacgcattgctccgggtgactgttttacttgtagagttatagccaagcccaacgggaggaaattagctttggacacaagtttggaggggggttctttttcctcctgactttgtctccctctccccacttccatgtgaaaatatttagcaaacagtgacaatgatgaaaaacagtaggaaacaaaatgttctacattagtataaaacatgaaaaatgcagcaaggacccttagcggtacaacatgtgttatgctggctggcagtccattagctctgatagacatttcacttacctaagtcaaatataacagtctagtattcattaatataagaaggggctgtggaatcagagctaccatctggctgggccgacagaataatctacaactcatgattaggtctaaggagtggggtttcactttaatctttctcattgctcgaaatttccatctgcgcagttcggcacatcatttttcttcaagacaaatgtgctgtttttcatgttccaaaattagatcagaagaaaacgattaatcatgtcacggcctgggaaaggaaacaaagctccgatattcagctctccccctcacccctccccacccgccgctccccgggcccccggacggttgcaagtttccctttttttcccccaacctctgggttttcagcacaacttttggagacccaccgctagcggagagaagggtgggactgaagggagagggcgccgccggctggacttgaccggagagcaggaggcgagcggggcgggacctgggcccctagtcggggtgctcctcggcccccttcctgtgaccgccaggggagggggcgttgtgcgggtctgcacctatggccccgggagccgcagagcccgggcgctgggcgctgccatggacccagagtgacaaaaagggctgcgcggctgcctcccccctctgtcccctcccacggccgccacagccctgtctgtcagccggctcgcaagtcataacaaatcc

SEQ ID NO: 33593 - DNA, 1072 bp, Bovine  19866881413267
cctttgacattttctttctcttcacatttgacagcttccaagttctgccaagtacattttataagcacaatgcctatacagtcttgtcattcttacccacagaaacctaggtcaggcctgtattatctcttgcctagattactgctatagtctcttaaatgtgtatttgaatgcatccttaaacccaatcattagatccaccttcctaaatatcaactctaattagcctttgttcaaaaagctacctactgcctcctgataaagtactgataaaagttccaaagcctgactttcaaaggtcctccataaagtgtccctactttttctttctagcctgatcttttactattcccttgtacatgtaccagatgccactcaaactagaatacttgttactctctgaacatgcctcaggcttttttgccttcatgctactttgcacatgtaggcactaaatgaattagaatacccttcaaccacccttgtcaaaatcctaccaatccctccagggttagttcaaccatcttcttaatggaagccttcttgaattgttcatggtctttccttcccatctccagaagtggctttctgcactgcagaaaagttttgctaaaattgtaaaggtttctttttttggcagttatgtacagactggaaatagttatttgtatagacagcttatctatcttactagattataaattcttggcacagaaacttctttactttatctcctcaaaacatctagtatattgctctgcccagaacagataataaatctttgttgatttaccaaatgataaggacagagcactcacctacattaagcaaagaagaactacctctacattaaatcaatgacttgatttgttgtgcttcatacttctgttttagagatcttggtgctctgtatgtttctctgttatttcttacactgctttacaatttatttacctggtgtattttctctcctagcttatgagtttcttaagaactaatttttatatcgtatcttagaattatgcctcacacagagtatgaattaaataaatgagagctggaatgagttaag

SEQ ID NO: 33594 - DNA, 1261 bp, Bovine  19866881549477
ctctttattttaaagtttgtaaccttagtcacatctgcaatgcccttttaccattttatataatatactcatatgttctagggattagggcgtaggcatctttgtgggattcttatgtttatcaaagttttttttttcatctctttattttctacacaggatattttggaatcatcatgtcccttgaagaagaagacaattccatccttttggaaaaaataaaactactgcccacatcatgccccaaactcgcaatagacatcatgctttcagcttattatcataaagctgtttgattctggcatcaggctcatttggtggatttaatatttgagatcaccaaatattgacacaccattaagtggcacttgattagaaagctcgctgctgtctaaatttttccaaggccgtgatctgcaagatgcagaggaaactctgatgtagatggtgggcagagttggggatggcattcttagtgatgacaggaaaatccttaaaggcacaaattatccaagacatgaatgtaatttatatatgcaagctgattttagataatttaattattgcttagcaaatgtaaatggagtatttaaaatctttcacacatatttaaaaaaaaatcctgcagtcaaaaaattccctctaatatatttttattacctatagcatttgttctgcgttaacaattgagtaaatattcatggaaaacttcatatgtaggggtagtcatataatgagcaccactatgctctcctatctacctttggcccatactttgcaccaagctgtgtttctctgaaacagcactgtccaacagaaatagaatgccagccacatatgtaatttttcacagctttttttgagacataatttacataccataaagttcacatgttaaagcagatgatttaatgtttttcagtatatttatagagttgtgcaatcatcacataatctaattttagaactttttcatcatgtccaacagaaaagttgtacccataagcagtcacttcccattctcccctacacagaggcctagtccactgttaatctactttcagtctccagagaatttcctattcttgactttccatacagatgggatcatatagtatgtggtgctctgtgatggctcttgcacttagtataatatttttaaggttcattaatattgtagcatccatcagtacttaatccctttttatggctgaataatattccagtgtgttattatagcatattgtttatccatgatcag

SEQ ID NO: 33595 - DNA, 1111 bp, Bovine  19866881622124
cccatgacatcccctgctttaattagtttagtttattgaactcaaatgaaaattttctttgataatagagaatcttatagcacatgttaatgttattattctgaacatcaatccttattgtagttccaaacgtataagtgctttcatgaaaggcagaataaatggaatgatggcaagtacactgcattaggactcaaagggtccactgtttgagtctggttttggctcagctactttactcaacaaatacttattaagagcttatcatctgtcaggacctttgttagagagggagaatacagatgtgaataggacaaataaaatccgtgctctcacaggatctacattctagtcaggatagataatatataaataacacaaaaatgaagaagataatttgaaataacaataaattacattaaggaaacaaacaggatgaaaagtatgactggggaagagagttaatttagatgggtgctactttctcactgaggaggtgatgtttgaattgagactacagtagcaagaagtagccacatcaggggtagaatactcaatatagaggacctgggctataaaaagcttggttaccctccatgtgtggtattttgttatatcagctcaaatggactgaaatatacatattaaatgataattatcatattaaatattatattaaatatcacatacacattaaaatatgataaatgtagaagttgtcattttacactgggagaagaaagtttgttcaacaaattgtgatgcaactatttagtaacattctggaaaaaatacaaacttgtagaattatttttctatatcccatagttcatatataagttccctacctgaagtgtgctttatctacctttggattggagaagcccacttatccttaaattttaaatttcaagaccccccccccccccaccttccccttctctctcttgctgagcaactcatccttataattaggtgagattgatcaagacaggcatccatgacaagggggcttggagccatagtgggccaaagtgatattagaggtgaagtagagatgaagaggcggtgatcaagaccatttccaagagaaagaaatgtaaaaacaaaa

SEQ ID NO: 33596 - DNA, 743 bp, Bovine  19866881728204
ggtgttgtttgccgtgtctggcagtgactgcttgctgcttttaagccttttccgccaatttgaacccttcagcatggttgacttaactcccatctcaaaaagcttccagtttactgtaagggtggtccaaacatatacatggcttatcaagttggtgttcttagtaaatttggagacttggtcttcatctctctgaaataggagcaagttgtgctttgtttagttctcctgggatacagtaatgttgtttagtctttcagttatttccaacacttctgcgaccccatggattgtagcctgacaggctcctcagatttcccaggcaagaatactggagtgggttgccatttccttctcctcgacccagggattaaacccatttctcctgcttggcaggcggattctttaccgctgagccacccgggacgctctgtgatgtgaagatcatggaataaaacaagctaatggcagttttgtccgacatgctgtgagtggttgaatgcttcatggtggtaactctccttaatgtttgtttgctctgaagtggaattctacagaaaataaaagggaaccaatattcctctttctgcaggctctaatgctcttctgggacctttgacatggcatcatgaggtagttctagatctttcaactaggaagactcattttgaggccaaaacatgatgatagctatctggcatttgttgatcaagaatatccacattgtcatgtgcatatttaag

SEQ ID NO: 33597 - DNA, 1530 bp, Bovine  19866881742111
ttttggctatgaaaactttctatgcttccttatgtggaggaaaagtaaaaagctgccatttctgcattcttctagccaacacaaactattgccacaaatacttataattacctgaaaaaggcaaatactcagctacataagtactttttacaccatcaaaaatattcagccaacaagaaacatgctcattaaatgtttatattttgattactacaaagcaaacctagtttttggaaaccttacatcagtgtttccaaacaaagcttttaacagtataaagccacaacagctttccagtcttagtctttttacctacaatatagcatcaccaccccaaaggacagggaattatgatttattcacttcaactcatggagtttacacacattgatgtatataattttatatcacttattacatatatatagctccatttaaaatgatttttctatattttaatacatatagacagccagatggcttcatcctacatactacatacatatcttttccccaaggtattctctgactaaattacttcaaccctgaatatccaacaagtacatgctatgaactctgcaacaattacaatgtaaaaagtatgagaggctcatctcatacaaaataaggccagattccttctgtcattttatttctatttcactttctcatttttctaacagcttaccaccagtgggttccaagtcactcccatccttttagccttgttcttcagtagagtttcatttcatacactgctcaaaatgatctctctcatatttttttttttttctgtcttgtatcacctccaatctggctaacaatctgttctttatatcctcaatttaactaacaaacaggctttgatgccggtgtttcagctgctagaaaatatgagttgtcgtacaagaaagctccctagaagtctttgaacctgctgtggcaatgccctaaaagcatgacacattgccctgctgtacttcatcaggtcagggcatgccctttaattctctactgctacatacagttagaggcccatatttagttaacactatgaacacctgcactaaagaggtatattagaagatgataaaaggcttcaggacaacatagtatttttgttgtaccacaggacctacagggaacaggaaacttttaatgaagaatatgacagctatagatttcatacaaatatacagaatgaagaaattagtaaacatttcagaatactttcagctttaatcaataattaatatgaatcaactatcagttaaagggacttctgtttctgaccaagatgcagtaagagaaaccagatttacttttccacctgaaacagccaaaatatagacaaaatatatggagagaaaaccagtttcaaaacagtgggcacaagacagcaaggagacccttgagaggaggaaacaaggtgagccccactgcccctgccatgagtgagcggtgtaggatataatctgggtgaggcccagcagactacggagggcgaggaagtaaagtctaggggaatca

SEQ ID NO: 33598 - DNA, 744 bp, Bovine  19866881896476
agtttcagagccaacaaagcatgtcaactgtaatgccgtctttacttggctgtgacagtttgcatttgtgaaatgtttaatctgaattaccctgtactgctgtagaggaaattgttagtaacatcaaaagtcagactgttgctacaagtgaccagtgagaaaggaaagaggttgagggatttttccttctcttttaatagctttgaatgactgaaattactatggaaataggttttggtgcccctctcacttattcctcacccccagcaaagaccaccaacttcaagtaactaaaatgtggcctattattttgcattaagttgaattaaaacatctgtgcaatctataagccataattcagcttcccccaaagttaattttttagactatggttctaccttatattagccaaggactttttctctgtgtactccatgtttatgcataaagaagttttgtacctaatatggaaggagagggagtactatgttaattttgctgttatttcagctctgtttcaatctgaactactaggttgtctgaactagtgaagcattgttaccagttagtaataccatctttaaaaggttcaattttaataattttttattcaaagaatctatgacttgttaggacaattgaagtatttctgatatgaaacaaaagaagtggagactggtacttaatgggggaagcaaaattagcttgggctaagatgggcatgttttgttctatgaattctac

SEQ ID NO: 33599 - DNA, 1446 bp, Bovine  19866880362266
atgacaccacccttatggcagaaagtgaagaactaaagagcctcttgatgaaagtgaaagaggagagtgaaaaagttggcttaaagctcaacatgcagaaaactaagatcacggcatccagtcccatcacttcatgggaaatagatggggaaacagtggaaacagcgtcagactttatttctttgggctccaaaaccactgcagatgatgactgcatccatgaaaataaaagacacttactccttggaaggcaagttatgaccaacctagatagcatattaaaaagcagagacattactttgtcaacaaaggtccgtctagtcaaggctatggtttttccagtggacatgtatggatgtaagacttggactataaagaaagctgagcaccgaaaaatggatgcttttgaactgtggtattggagaagactcttgagagtcccttggactgcaggagatccaaccagtccatcctataggagatcagatcagtcctgggtgttgattggtaggactgatattgaagctgaaactccaatactttggccacctgatgcaaagagctgactcatttgaaaagaccctgatgctgggaaagattgaggacaggaggagaaggggacaacagaggatgagatggttggatggcatcactgactcaatagacatgggtttaggtggactccaggagttggtgatggacagagaggcctggcgtgctgcgattcatggggtcgcaaagagtcggacaccactgagcgactgaacctgactgactgactgactgactgactgactagaacctcctgaatgttttaaaaatacttttgatgtgaaagaaagcagttacaaaggacaacattttgtgtgactccatttatatgaaatgtccagagtaggaaaatctactatgatagaaagtaaattagttactgcctacagagtaaggaaatgaaatggaggggataaaattgactgctaatgagtatgtatttcttttcaggatgacaaaactgttccaaaattagattgtagtgctagttatataactctgtgaatagacaaataatcagtgaattgtataccataaatgagtgaattttattgtacatgaattatatctcagtaaagatgtttaaagaaagactgaatcagagctaaaatttccaattatattactacacatttatgtttccattaatgtgagaaataattgctactatgtggtttgttgttcctttacaccttgatttgatgctaccattaattgaaatgaattctacaatgtataatactgtcaaatatataattgctatttctaaacctccatttgttcctaaaatgtaaataaatttgtcctaagatttattaaatgattaaggatggttatatgaaataataatgagtattttgctttactttttcaatgtaatatttaagtacaaaa

SEQ ID NO: 33600 - DNA, 3842 bp, Bovine  19866880706642
gtgtttgttgagaattgaagggtcaaaaccaacttgctagaaagataatcactcctacttcacctcagttttgcacaatattcatcctctgtatttctttttaactttcattttgtttcaagtttgaaaggccaaaaaaatgtgccagcagtgttcaatgcagagagaaccatagccagagcatcagccaagctgagacagatgtaatggattgtggccctgaggaagcaaaatcattcagggtgcagagaatctgcagagtgcaaagccaggatcttcaactggatacaagttgtgagaaatgagaaaacagtaacaaacactagaaaagaaaaagaaaaaacaaaacaaaacaccttttacagcatttctgtggtaacttcagtcttaattcatattaaacagtgaatggtatatctttaacaggaaccgactgcaaacagtattgtctgttgacatttattcctaagaatcgttcctaactgaaattcttgaagaatctttcttttcatgcaggttataaaatttgatctcctgacgggttttgtttctggttagcttcagaaagttaatttggagaacattaaatggtagaggaacttagacaactactcattaagttttattttctgtctctttctcctaaagcataatggatgataagatatattcaagatgatgtttactaatttacattttcccttttctattcttttgcctttaacagttatatttcttgttgtggttaattctatgaatagaatttatgtcctatgtcttaaagttatagtttctaaaactattttaattttatttttaagtaaattactctatctcttgaatagatacattttctgcaaactagcccaaaaaagtacagtattatttaaggtaatgttccagcatttttctttataagatagtaaactcaacttatttttaagacccttaatgaaaaatgctattaaattcctatgttaaaagaaaaaattggctttaattctgtatttttatcaagtaagaggaatgaaagagaacattatgtgggtaagaaaagtcagttaatgaatgtatgtaaaaatacaaacaaccaaacacacaaatagaatatttgataactagatataaagattaatatgaaatatatatatatgaagttaaacaaggaaaaagttttgaaagaaaaagaaaagaaggaaagaaaaaaagccttcatacaattgtaaatagtcttcatcatggtcaaatttcagcacattcctcacttgaaactgtgctattaatacttgactcaggataattttatctcttcttaatattttgaatgtgcttggaagtgaatgtgttagttgctcagccatgtctgactctttgctcctccatggcctatacctgtgaggttcctctgtccttggaattctccaggcaggaatactggagtgggttgccatgcccttctccagggtatcttgctgatgcagggattgaacacaagtcttttgcattgtaggcaggttctttaccatctgagccaccagacctgccttggctaacataaaatcgttcactttgcgtttcaaaatagcatttctctctttgttaatttcggtgctgccaccagtcttgtcacatgagttttgcggtttctctgaccactctatgtaacttctggataatattatcttggttgttcatgaaaataaatccaggagcaattctgaaactgacatctgcagctcttgaaactgaatctggccctctgtaacctgacatcaaattaatatttgggagacagttctggggtgaagtagaaaagaggaatatttttagaaaaagggagccagagcaggctaaaggcctcaaggctctatgtccaaacctgaagtggattgtgaggttttataatttcttgatattcttctgactggttgatggtgaggtaattgggagtcagtgtcatcaatcttctggttctagctaatctggggtctacagtacttatgggtatctacatgtgggcagtataccattaggttcttcctcctgatggaggcttcattatctgcaaacactcaaagatattttgtatattccttgatgggaccctctgccagaggctgcactattgtttctcttaactattcatcccttgtctacaacccctcccttctctaattagcaagtgtttaaacctgatctttggaattcagggaaggtcaaggaggttcaatgaagtctatttcctgtaattaagaaactagggacacaggaaggcttttgtgcccaggagctctacagggttcatgtatggtgttactctcacatcataagagcagtccttagaagacatcatcatctgcaagtcacttagtgctcattttagctcctgcacacacagtctcatgttcctgatttaaattcagacacttacctttccttccctgaaatctcatgtcatgacttacctgaatctcttatggggttggtggtgatgacatgtcagagagccttaaccaaagagatcaacaggagacccagactagcaatttcaatccttgcaatagcaagcaaaaatttgcaaactactgcttcagatttaagcacaaagcaaagttttttaaagcgtagatggctggacagcaccaccaatgcaatgaacatgaacttgggcaaattcagaaatggtgagggacagggaggcctggcatgctgcagtccatggggtcacaaagagtcagacatgactgagtgactgaagaacaatagtactctcaaagggagagtgggctatttctgtgaggttaaaccagcccccccccccatacaggtacaggcttaaggatgtttataaggagttattctgtgagaagtcaggggtgatcatgtgtgacaggcgattgctatttgactgactgtcttgaggccataaaaagttattattgtgcatgccctcacctttcatttgttaagaaatgcccatggtggtggtggagggaaccaggtgcagattttataatactgttgttattatgagtttgggttttttagaggtgttagaggtttgttagacagactatatatctgtctagtctgggcatgagctacttagtacaaaattcagacttaaattgaagaagatagagaaaatcagtaggccattcagatataactgctaggtagttagaataggagaaaggactccaaaatggaggtggctaaaagacaaaaaaagggaaaaagcccatgaaaatggaacaaaagaatatcagtggacttgagtgagaacttcaagtgaaacaaatgcacccccttcttggctagcccaatttgcctagggcagactcagaggaaggagataaaacataaaaagaggctgctgactcctttggggtcagccccaccctcatgcctcaagggtgtactttcctttgcttgcctaataaaactctgagttatatcactggtgtgccttttcaaatctttgctgtggtgagacagaacctaggaaattacatactccctagacataacctaaatcaaatcccttataattatatagtagaagtcacaaataaattccaagggataagatctgataaagagtgtgtctgaagaactatggacaggggttcgtgacattgtacaagaggcagtaaccaaaaccatccccaagaacaagaaatgcaagaaggcaaagtggttgtctgaggagggctaacaaatagctgagaaaagaagtgaaaggcaaaggaggaaaggaaagatatacccaactgaatgcagagtttcaaagaagagcaaagagagttacgaaagccttttaaaagtgaacaatgccaaga

SEQ ID NO: 33601 - DNA, 1761 bp, Bovine  19866880707602
ctgagttttgtatataaactgttcgatgatttcaatctctggagaccttcaataatggcataggaataataaaaacatttttcaatattacaatgtgaacgcaatcaatggcactggaagcagatgttccaaattgtctttgaagcacagtgatgggaaattctctggggaaggacatttatttatccaatggaaaactttatacaaaacatttatactgtttagccagacaaaacataacatttgttaaaactttgccagagaatgtaattaaatgccaagttatttctttcattcaagagattacataatttacttcaagtagatataatcttctaaattctcagagcttaaagctctcaaataaatcacatgaacctactgggtgatagcatacattgctatgcatgccttctaatttgcttaagtcatgtctgactctttgttaccctatgaactatagcccaccaggctccgccatccatggtattctccaggtgagaatactggagtgggttgccatgccctcctccagggggatcgtcccaacccagggattgaatccaagtgccttatgtctcctgcattggcagacagttcctttaccaatagtgccacctagaaggaacctcatacattgcaatgaaaagccttaaatcagtcacacatacccagtgggtgataatacacaatattttgctatgaaaagagcaaatttaggtaagctacagtctgaaaaacatgaggtcagattgaggttttctcctaaataactgtgtgaacttaaactacttacttaactctttgaatttctgttttttcctctaaaaagagaacaaactacattccttgaaggatttttaaaaggagaagaaggaatatttcatatatagttgatagtttatgcatgatagttactcaggaatcttgaaaacactagcagtacagaaaaggtattgaatatactcattagaattatctaaattttatctgtttcctgtatgatctctaattcctccaagatcagctatttatttttgtatttatgtaattcatgatatatataacttctaaaatcaatctcatttggcaaaatagtttaatctacatcaaaatactgggcccttgacaaaaacccataaagagttgcagaaaattattttttaatgaagataaaaacagttctctgataacacatacagttattttaaagacatgattaaggaggaaatttcacaagaaaccttaaatatgggcatttattatttaaatgatttaccaagtgttttatctttgatcttcagtcttacagaaccaaacacacaatttgtctacactgagaattctttcctaaggagaaagcttacattaaccaagcttgtaaggaattttaagaaatccggtattgtgttagaatgttgaaatattaactgacagtaagaataactgctacaggacttaaaaaattatttgaaattcatatgaatggggcaacaggtctttaaaagtatatactaatacaaagagaatcatcattagccagttaagtcatttacgacaagcaactagtctcagtgacacccgaagacttcaatgtctccatcagtctcactttagaggtaattttggacataggtcctgaacactcaaatactcacatcattaagtttctgtcccccaaaggagaattattacatgggcatcaacaaatttgtatgcatacttctacccgtatgtttttaagattgcaaactctatttt

SEQ ID NO: 33602 - DNA, 2680 bp, Bovine  19866880711082
agaaggaaagtgaatagagaagagatggaaacaatcttgtgtgcatatgtgctaatttgcttcagtcatgtccacctctttgtgaccgtatggatcattgctctccaggctcctctgtccatgggattctccaggcaagaatactagagtgagttgccatgctctcctccaggagatcttcctgacccagggattgaacacgtgtctcttatgtctcctgcattggcagtcttgtcctttaccactagtgccccctgggaagcacaagattaaatgttggagcttacttagcaaatatattgagtacaattatgagaacatcataaagattggggaaacataaatagtgaatgaaataaattattttttcatatttatggactgaagcattagtgctcctttatatttactaaaaattcaaaataaatatgaattttgttgttttgtacaaaatattaccaccccactgacatcctatagtttatgtatgaatagatgaacaaaaaaatgtctgtatagttttaagtaaaatggcattaatttataccatcaatgacaaactgtggccttggaaggtgacatattatctaagcccttaccagtggtaacacatgtaaactccaggaaaaaaaagtatatatatacatcaatatatgtagaatatatttgaaattttgtatataagtgtgtacatatgcattaacaactttactaagatataattgacatacatgtgcatgaccacattcaatttcaggacattttcatcaccctcaaataaaccctctagtactcacctccccaactcctgccaaccttagacaaccactaatctgttttccatctctaaatttttaattaagatatattctaaggtttttcccctcaatgtgaatattgtcttcatggggggaaaatagtttcaacagaattaaaatgatttaaattatatctataaaatagattaggcagaaagggagacatagggaaaacctggcaattagcatctcagtatgctgtccattatactaataagtacaccattcagaaacctaaataaaggagaaaattgctttctgtaaattggaccactgtaagcacacacagacatgcagttaatacaaagatggaaggatgtattcattaggcatttttgtgctataaaataaggtctatttttactcagagacattaatggaaaactgtttgatgcaactttttgtacacaaaagaaatattagaacttgtgaaaaatgacagtttttcatttttccatattttaaaatatataacaactgaattttaagtgattaccttatcaaattattacacaaaacagcataatacaataataatatacttttttcatggatataagtcattcttcttcataaatgtctatgtttcactcctaaacgttatcttgagtgattatctaccttggcatagatacttgtcctcatctagctgctaagctcagtcaacatatttgctctgctaagaaaatggaaataaacacatatcattatggtccacctctctgtcgatgatcatgctataaattcattttcatcctctcccagtcatccaagctaaaacctagaatggtctgtggcaggcattactactctttacctctttttagcaaaaaaaaaaatatataattttgctcacagttcttggttaaagcaaattacctggacagatctcactttaaaacacacgctgtttgtctttgccagacaatgtcttagtgtcagtatttgattttttacgttcctttttcttgcatcattgcatttccttaaaattttaaaagaaagttgtcaatactttacaccaccaccccctgtcaaatacactgaagtttgattgacattgcactgaatcaaaagacttatttgaagagaaatgacaattgtaacaaagtttagaaggccaacccaggaacatgtcatattctttcatttctctagatattttataatgatttatccatttctgtgtagaggttttatataacttttagctgatttatttataagtgtttctgttgttattgaacttttacatgtaaaaatgtgcacaagtgcatgctcagttgctcagtttctcagttgtgtccgctctttgcatctcaatggactgtagactgtcaggctcttctgtccatggaatttttcaggcagcaacactggagtgggttgtcatttccaaaaaaaagcattttctaaatctctcttgctgatatatagaaacaaaattgatttttgttgattgaagttgttttgagcaatcttgctaaattcctgaataattcaaatagtaggactgcatatttatagatttgcttcatgtatagtcattagatcttcaaatactcctttttcatgtttttacctattttttttcctcaattaattttggcctgaaaataatgggaaatggtatttctcctatgaattaggcctccagcttaaacaagagatggcacaagcagtgagaagagatttggtctgaaacttatagttcagctatagctcaggacagctatatgatactagggaagtcatttcagctttatacttactttcttcatccataaaataatgttagttaaagagatttctcaattataacattacaaattttgatctataactctttgtcagaagatttt

SEQ ID NO: 33603 - DNA, 962 bp, Bovine  19866880897161
gaagaagcaacgatctcatgtgcagtattccccagagcatgtcttacttttctatcactttggtcttcgttgcactgatggggcagcttcacacagttctttgctttatgaaaagtgcagagggtaattgggtgcaaggaaatgaaagaattcatttcaaggctatgctcaaactacttagcattgaattccaccaatgagaaatctgctagttgaaaacaaacttgcactcggcaaaatggatgagttctttgtggtccatgatagaattcaatattggcactggaatttcatgaaaaaaacaaaaacaaaaacaaaaaaaactttatatttcaggcaagtcaggggaactgttctatttagcctaaacaatatacagtaaaattataacagccagaatcaaaacataagtatatgtcaacttgtcaataattaatatgtaataactacatgtggatcatcttttatgtgtatgaattggctatgagagattatgtatctttcctcttagataatgaacagaagcacaatgcaaaaaaaacagcaattcctgtttagataattgctttcctatcacaaatatactgttaataccagtagaagggcaagtcaatctaagaaagaagaaaacctcataattaagagaaggatatagtggtaaatcattttaatttatttgaaagagaggtactaattgcctttttcaaactctcatcaaatgtctctgattgtcatagactaaagactttatggactaaagttaatttcctgaggattaaaccaaaagatttaatgtcatttgttccatatcatctattaaaataattcaatttttaaagaatctcatcttaaactgaaatccaaatgaagacaatatttggcaggtcacataatggatagtgcaagtttacattttcagaagtaacacaagtagacttacccttggagaaatttacacagtt

SEQ ID NO: 33604 - DNA, 1695 bp, Bovine  19866880947497
gacaaagctaggtttggcaaactatcaattcaatagatcctagaggggagggctacttactttccattgctccctgggccttttaaaaaactgttatagtgaaacgatccaaggaatgtttcctttgggtcacagttactaagctttaaagctattatttttaaaaaggaatgataaactacaggaaattatttataggctaagattgtccttctctgtaatttgtgacttgctcccctgacctgaaggttggttggttgtcttgggtcttttaaaagatacggatgaatgaatttttgagctaagaatcatattatggtaagcatctttctccttgaatacttttcattctgctctcagctctctaattcaggaaatattagattagaaacactagaaattctcaaaggttatagctgcatatgtgaagaaaaatgatcttaaagatagctaaggactaagccacatatcaaaactaacactagcactgctctgaggagcaaaatggctccccccacactctatagagcaagccatataactcacaggggagacatgatcaaggaaatcacatgtatcatggacatagcactccaaaatgtccttttaggattgccctggaaatgtgtattgtaggaatctattcttgagagttaagtcatagaaaaatatagattttgcctcttaaatttaaaaaacataatttataatatttacacatttacaatgtgtttttgtttatttcatgtttttattacatatttttaaaatttattttctttatatatatttatacagctccaatgctcaaattgctaaactagcaactagggcatctgaaaaaagatcactcatttatggaacatatattccaatgagaaagataaaaaaattagaaaagaattataattactatgataagttcccagggaaaagtaacagagaaacacatacatggacatctaatataggctattgtattcaagcaaagcttcaaagtagatataaagtttgaactaagacttgaatagtgaattgtatttagttaaatgaagaaacaagaaaaatggctcaggaaaagaatatattcaaactgaacctgaccttaggctcaactttgagatttggtagttgatttgataacatgcctagtcacatggctttcatctttcctgatttctttcttaatgcttatttattttattatagcaacactggtgtgcatactacctcttatatatcccccaaaatcctattactcttctcttcccaatgccattgctttacttgggacaatatgatttcttttttgggattaccaactaacatctagaggatgtctctgtcctatgctatgagttcctggttcctctaccttcttcctcttgggttcacccttcacactgaagctagtaaaaatatttttaaaacatatagtgaccttagctctccagtgggtaaaatgccacatcactgatatattcgtttaaaatttgaagaccttagtacaaagatcttggtcatattttttgaccaccagaaaactttgagcactttttctacttttgggggagttaataagtaaaaaaaaaaagaaaagaaaaaaaattaacataagtttactgaatttttaattgagttatacttgatttatactacggggttagtttcgggggtacagcacaataaattcat

SEQ ID NO: 33605 - DNA, 1274 bp, Bovine  19866880955760
tttcctataggaaataatactcatgaagatccaaactcagttttttagacaatttcggggagggtagtaaaggctttaaatcatatagataagttggaaagggagtcaaatagaaactgatgaagaatagaggaggaggtgagaagaaaaggattcatgagaacactagagagcactttgttgattcagagactggtcaaccagagaatagcacatgtggcaaccaggcttccagttaacctgcctcagaatagaagcatgacctcatctgctggatgaaaagattccagccagaagctaatggtttatggagacactgctatgtgctgcgtagtttatagaggttaactctttaatgcttcccattttttctttctacccacctccagacacatacactttacatctatggaagtagaggctctgatatactgaataccagtccaaatgtctctgggtcagaaatggagcaagcccccaaatgcagttgaacatgacttcaatgatcctgttagtttctatagcacacagaatccatgactccaggtaagtttaaaagccaatacccacagggagtataaaagagaaaatcctggcaaagtatgctcatatgctctggatcagctgcttcatctttagaaaaaaaaaaatattccacattctgtttcaaagccaaaaaattctcagcccctgaggcttctgctgtgcttcttgatctgttcatcatattgctgcactgaatcaggaaagaatctcagcaactgacaacaatgtgtgtgatatttttctgtaatttaaaaatcatacatctcaatagatgtatgaaaaatatatgaaaatagaaaatagatggaaattagagagtttatattgtctacagtaaaaatttatcatctaatattaaagcatgcttcatattttaaaagttgatttttcatccaggtcagggcacaaaagtaatcacttaatttccagtgcttcagttgactttcccttaactaccttgattatgtcgccttcaatatttgttcagagctgaaatttcagggtaaatttatttttttttaaaggctaggagttaattttctggtaaactttcactgatatttttaattttgtattttagacattttccctctattattttagaagtgtgtgaattacaagttgaactcagaatgaaataatgaacagagtcctaattaagaacttgcactcaggaatcagaataaattgaaattcaagctccaccgatcattagctgtgtaattttg

SEQ ID NO: 33606 - DNA, 2158 bp, Bovine  19866880974789
tttttgcctcctgcacacatgttatttttgggcacatagacattaaggattgttacgtcttccttgagttttgaccccttaatcatgatataatggcccttttaatccttgataacttttcttatcttgaagtctactctttagttaaaatagctacacctgctttttaaaattaatattattgtggtatatttttcttcacttatttttactctatttgtgtttttttaaagcagcatatatttatatcttgtttattgattgacactgacatatcttttaattcataaatttggaccattgactttaaagtaactatattttggaattattgagttaatgtgtataatatttgtgactgctttctcttgatggctcttgtgttttgtttctaatttgtcttccacttttttctgtcttttttgtttttaattgagcatttcatatgattttattttctctcctttcttagtatataagtttctttttttttttttattttacttttttcagtggttacataaaagtctgtataatacattttcagccaattcaggtctactttcaaataactgtacagcatgtcatgagtaatgtgagtactttataataacaaaataatgaaaattcttcccaattgtcttttgtatcattttgtccctcattttactatataaatataacatacgttttatatttctgatgcttgctctattgcttcagtttgtcttttttgctttttgtatgtcttgcaactttttattgatagttggatatgatgcactgggtaaaaggaactgttgtaaatagggcttcagtaatgttgtggtgaagtgtgaatggaggggaagtgttctgtgtcttattgttaggtctcagtctgttagtgaaccaatacctctggactatggactttattagggcttctcagagttttctctcccctcttaggtagaacaggatgactagagtggggtgctgctgctgctaagtcacttcagtcatgtccgactctgtgcgatcccatagacggcagcccaccaggctccgccgtccctgggattctccaggcaagaacactggagtgggtagagtgggctagagttgggcatctcctttctcccacatgaaaggctggagggggctgggtttaggtgcttcccttccccccaggctcattaggccctgataattgcccagcaggttggctctggttaactaattttccctgacagcaggccttgttgagaaggacacattctgtaatccaaagttgttcttttctacccactcccatagaagaatgaggaaaattttgtccaatatttattgtgagaacctggttaagctcctagaggtaaatctcaggatttcaggggtgcctctatgactgggtcctcctggattattttttaactcctagacttgtccacactaaacctctagtaatttttcagttgaggttgccattaaggttttcctgcaccagcctggtccccacagtagtttttgcttatcaagcactacttggtaagccacagtcacttgtctgtctctctaatactgggagccatggtttgcctgtgctcttccccatctaatggattcaagaagggatgttgatttttcagtcagttcagctttttacttgttagtgggacacagtggtgactttcaagctccttacctgcaaaactagaaactagtaactgggccatgtcttttccttactccttccttcttctaagaatgcagatatgatgtcttgatcatgagtagttaaccaagaccatgaaacaaaaaccatatagaagatggggggagatacaacagatagaaagaaacttggttcccaataccagggaggccattctagcctgcatttcctgattccagacttctagaacatgagaaaaaaacaaactttatttgcattcagctactgtttatcttcaggttttgcatcactcagaactgaaccatatcttaaatgttacaccaaggaggaagaaagtctgtatttcaaatcttgatttctaggagatgttgatgatatgaacatgatatacaaagttatcacaactagaatatggcttcaggaagagaaaatagacatcttatggtaatttctgaagtcctggcaggactttgaggattt

SEQ ID NO: 33607 - DNA, 2077 bp, Bovine  19866881061787
tgactgtcctttatgctctagttacatatacattccatatgttacaaacatcacaagacagtgttttaatttttgctttaaatgttgcagtgtacactttttaaatcataagaaaaaaattgtcttgtctacttgccttttatgttttcattcttgctggatgatctgagtattcttctgcagtcatctcctttcaaccagaagaattctctttagctgatttaccaacagatattcttagtttcttattatctgaaaatgctttgtttcaccttcatccttaaagaaggattttgctgagtatagaatttggggttgacagtttttgccatactctttcaggatttttattgaaccactcctttcgccctccataatttctgatggaaaggcagcaattattttgattgccatttccctatatgtaatgtgtccttttttttttttttttcaggcatcttttaagattgtctcattattcattactttctagaaatttgaatatcatgtaccctagcgtgactttcttcatttttatcctggttgaggttttctgagcttcttgaatctgtaaattggtttcaccaatttgggaaaaatttagactgttattttcaaatatccttttcctgacttatcttctttctcttattcttctgctgcttcaatgataccttttgatattattccacagattcttgaggttctattcatttattttgtttttcttttttcttctcctgataggataatttatattgatttgttgttaagttgacttctctttcctctatcatctccattttactgtaatgtccattcaatcagtaatatttttaaattttagatattttattttccacctctaggcatgccactaggcttttatatagtttctgtttctctgctgagatttcatacatttttatttattttgatcatatatttctttgccttcttgagcagagttaatagtaactgcttcatagtattgtctgccagattatcaagtggttcatccaggggtcagtcttcactgactgtcttttctcttaagaatgggtcaattttccctagttcttttcatacagagaaatttttcattgtatcttcttggtggcttccctgggggctcagaaggtaaagaatcctcctgcaatgtgggagacctgggttcgatccctgggttgggaagataccctggagaagggaccagctacccactccagtattctggcctggagaattccattgactgtatagttcatgggttcccaaagagtcagatatgactaaacgacttttactttcactttgttaggtaatgaaatgtgttttaaaatcttaagtaattatattaaaatttatttaggaacaaacataaatatctttaccaaataaagatgtttcataattacaaaaaaatagaagttagtatttatttaaaaattaacacagatttgacaaagatatacatataaatttgtgaggcagttgctagaatatttacatatttgttactaatatttaacaataaaattggatcatctctgtaattgtgggaacaactagagcctccttccatctaataatagtaaaacatcattgtctttcctctaaacatacaaattcaattaaggttgtgtttaatttaaatatcagtgtggttttttttttaagccaaataaatccaattcattttaaagagcaatttatgtgctgggtaataagaatgacacattggctcctcaggtgaggcacaaagataaagacagctatatttaatttttaagagatgtgacataataactgaccttaaatagaaaatttttgtgattatataaatcaaagagcttcaaagatatgacttaaaacctctgggtaacaaattttctaagagttatattactgaagtggaaaaaagcaaagccccccaggcaatgagattaagtaaaggacattttgtgtacatcctaatgcttaatttcaagaggcagtgccatgtaacagaggcaccactctttcaatgaaccaaagagcctttcactattttactatttccaagtactatttcata

SEQ ID NO: 33608 - DNA, 1810 bp, Bovine  19866881155115
tatatttcagtggaaaatttccgctttagaaaccttattatattaaaaataatcctgttgaatctaaaatctcttagatttattcatgtaggtggtttttaaatgttgtaccacaatgaacttgacaaccatatagactggaattgagaaatatagaacaatattatatctgatttgttcaattcatctatgtcataccatttggttttagtactattatttcaaagatatttgagacaaggtcatttttttaaattagttcataattctttgactcacaaatcatagaattaaatagtctgctctatttctttacatatataaataaataaatatctctataaatttattttatttgaaagcattacgaaaacaatataatttttattgaaatcgtgatgttcatgagacaaataaaaatatagcttcaaatgttcattgggatgcacatacatacatttataagaatttgatagtttctagttccctttagggttcataagacaaattaaaatgctataacaccactttttaaatatataacctcaatacaggacttctcctgatgattcagacggtaaagaatctgcctgaaatgcaggataccagggtgtgatctctgggttggaaagatccagtggagaagggaatggtaacccactcttgtattcctgcctggagaattccatggacagcggagcctggcaggccatagtccatagggccggaaagagtcagacatgactgacactttctaaatatcatggttatttatcaaaataattgtcagaaaaatcaactgctgctgctgctgctaagtcacttcagtcgtgtccgacttttaatgaccccatggactgcagcctacgaggctcctccgtctatgggattttccaggcaagagtactggagtggggtgccattgccttctccatacggtcaactaatctcttgcaaaaaaaaaaaaaaggcaaaaatatacagtgggtaaaatacatttgattcaataagtggtttggtgaaatcttcacaaccctatataaaattagaacattttctcacaccatacacaaaataaattcaaaatggatgaaagtccaggacatgagactggaaatcataaaactcctagagaaaattgctgcataatcaatacactcatttatagaaggcttagaaacattttttttaatttgtcaacataggcaaagtaaagaaaagcaaaaataaacaaatagaacataattatataaaatcttttaccacagtaaatggaactatcaaaaaaaaaaaagagagagaagacaacttactgaatgggagaaactatttgcaaatgagatgtatgataagtggttaatattcaaaatatataaatagctcatacaagtcaatatcaaaggaacaaagaacttgatttaggaaattaatatacctataaaacaaaaacagacttatagacatagaaaacagatttatagttgttaatggggaggtggggtagcagagggaaaggaatagaagtttgggattagcagaggcagcctattatatataggatgaataagcaccaaggtcctattgtatagcataggcccccgttttcagtatcccgtgacaaaccacaatgaaaaagaatgtgaaaaataatatatatatatatatatatatatatacatgctgctgctgctgctgataagtcgcttcagttgtgtccgactctgtgaccccatagacggcagcccaccaggctcccccgtccatgggattctccaggcaagaacactggagcgggtgccatttccttctc

SEQ ID NO: 33609 - DNA, 1471 bp, Bovine  19866881236616
ttaatgggaagaaactcttaatgaattgtggtaaccctactaggtgaaatctgtaacaacgtggtgctgacattgttgctgaattttatgacaaagttaccagattgaaaatcagtcatgtgtgcccagaaaatttacacagctctttgcccaacacaaaagaggcaagtcattttttaacacttggatatgatttcttgctctgccttggactggttttccgaccttgggcaagccagttatcttctctataaactcagttttttctgttcaaacaattaacaagaaacagattgcataatttctaaagtttcattcaggtttattatttctctgactggataaagacatctttcagaagggttctataaaataaacatacttttcacatatcgttatttaacataaatgtgcttgcttcattgctgtttataacaatacttataaattttaaaaagtggtaattttgagggttacagatgacagttatgggagatttatgcatagcacaacatgagataaaatatacccttttactattgacagctatattttaataaaaaatggtgatgaaattccctctgtctttactgtttcttcaagtcttcattttaattgaaaaataattgacctcaaaaaattctcttatgttattgccactaattaagttttaagatctgatttatctctaatatcaaagagtggaaaatttaatactccacagaaactgtaatttaattcttcatggctgtaatgcaattcataaaattaaatgttgccagtccatgaagattaaaaaaaattttttgagtttatttgtattttttaaataccttatacatttatttaaaactgatccaatgtataaactactatcttcttaaattagtgatatcatagatatttgaatgatagtcaacactaataaaatcatacattctgaatttttaatataaacattgataaagcagatttatttaaggcacacatgcttactgaacagcaataagacctttactaataaaaaaaatcactttcctacctagcaaggtattaaaaactaatatacaatgattttattttccaaggcctgggataataaaaaagaagcatgatgaaattctagaatcaaaatgttgatttaaatataaaattcattcattaattcatgaatttgtgatctttattcatgatttggataccctcttttattgattccctggttgttgttgttttaatatatatttcaaatcaagctgagaagcttggtaaattccatcatatactttctttttatttatttattttaattggaggctaattacagtgttgtagtggtttttgccatacattgattatcatgagctgtgaccatcatttaacataaaaacagttctgattactctacctccaattcatgtgacttctcagccctcactgttagagatcatttccctaaacttttataaat

SEQ ID NO: 33610 - DNA, 821 bp, Bovine  19866882082982
caaagagggtggctattttgatttacatttttgtaaagtaattttggtaggagcaatgcaggacaggatccaggtaaaaatctctataccagttaaaatgcattattgtactccatggaaaaaacaagggactgaattagggcatggagtttcaaataaagaggtgccaaaggtaaagctacttagcagattaaacagaaagaaaatggagaacattttaatgtgcaaggagagtagctaggaagaaattaaaattctgttttgagttaatggcagaatattttttttctttcgtaaatataagtaagagaagcagattttatgacacattatgagctcagcgttatttaaatttaaatcacaggaatttggggggtgggtggggcatgatctaattgaagaaaagatgaaaagagtaaatctgaccaggagcaagccaggtgcttgggtacaatgcctagaaataaaagctaatcactaaaaattagtcatttataatgtgtagacaacttatgttcctctctacagattaaaataaactatttagagtaatttttcttctattctttatgaactgaaagggtttttgttctgatctttcagaagataatacaatctagcctttggagctgtctaaaatatagttgagggttatttttagtcaacacattagacacattgctgtagtttgcatttctcatcaaagaaaatgaataggcagtaaatataaagtacaaaaactgccatggaaaagaagattaataaggaaggattgtcatttactttcaaatccaaggcacattttaaaggtcctcaaaact

SEQ ID NO: 33611 - DNA, 1409 bp, Bovine  19866880395287
atctgatatgtataactaggacatgtcctgggaattctccatggtaaatcatattaaaatagattttaaacatttctgttttataaagactgacttgggcagacctgctgcagcattcattttggaaggatgcttttgctagaaatgatcaggactcaagcactgaggattccaacgtcaggtagtacaagctgatctttgtgtggggggcatggttattaagcacttggcccattgctatgattgcagcctcagtgatgtggatttctgtgcttttcatagtagaaaatctggcatttgtttaattaagggttgcttaaagagtttagtcacgacattttgtgtgcttgactttgctcattctctggtcagttgtttattctccaggcagggttttagtcctgtggtcattagtcctgttcacctggactcccaccttgtcagcacatggtaggatctcatttccctctttgaaattaggtgcagtcctgtgacttgctgtggctgatgaaatgtgagcagaagtgatgtgttatttctgggtagaaactcaaagagccagggtgtgatttgctacctttctttctcctgatgaggtgatgatcaggaagaaaatgtccagatggagttgccttcaggctgggtctttagtgaccatgatgagcacagcattcctgcctgcctgtggtggctgtgtgcacgagtgagacataaagctaggagagtctaagtcactagtatttttggatcatgttagcacagcataacctagctcatcctgactaatatacttcattttattattaagtcttcttagcctgggacacttacaaaagtgatggtgttttgaaaagaacaaggtgaaaagtagatgagccaaagtccagataatcgactcctcctctctccacttcattcagtgataatggttgtttgattcttaattttaatcttgtcaattcagtgtactggatagagaaatctgaattctatataaggtctctctcaaactttggtttctgcgacccactgagctcagctgtttccacacttcaggctctatgaagagtacagaaactgggcgtgggtccttgtctatcagtgtcagcaagtcctcggccaccttgcaccttagtatgccatcttccttctgatctgtatgccttttctttcttactggccttgcaaggactttttttttagcatggtaatgaatgaggtaatgaaggagtggggcacgactgagcaactgaactcagtgtatgaggggtgatgacaatgaacactattgcctggtttctgattttaggatgcattcagccttcctgcattaagtacaatgggcttccctgatggtgctagtggtaaagaacctgcctgccagtgcaggagatgcaagagccatgggg

SEQ ID NO: 33612 - DNA, 1314 bp, Bovine  19866880472617
tcaggcagaatgtttacctaggcagagaaccattgatggtgcttggtcatgcttcccctgccaacccagatttctttcaggtccagttgtcatccagctgaggtggcctgcatacagatatccttgcagagaagggactgtgtcccaccccatctgtgagatgctgctcagggacagcacgtttacctgctaagccacctacagcctccgccttccctccctaagagtggttcaccaagcaagcacatagcacttactctgggagaaaatattccttgtgatatttttagcatccacatgagaatttgcagggcaagtacaattaacttttttctcctcagaactcaaagggatttgtactttcttagtgaatacaacataacctcacacagtaagattggcagagattcagtttccaaagttgagttaacagtaaaccgccaagtcaggtagttcctgaaaacagtcaaatctggatgtgttgccttaaaatttaaagaaaattgtagagtcagtttgctgtagggaaatccccaagtgaggttcctttagagtcgtttattttttagaaagcaccatgatctttactgatgttctgatagcatcttgatcggctgggcagtattgggaggaaatgtgttaaggacttttgactgtgctgaattagctagcaagatgattcaagggaaataaatgcccctcataactgaccatgaatactggccaggcatcactggaagagaaaggaggttccaccagtgcagaatgagtgacacaaactgtgtggccaggggagggggcccagaagccatggctcatgtgggaagagactgggctcagatggctggtctttaggagagggaatccactctgctgctgctcagagaggtgagcgcctaaatcccatgagggacttgtgaagaatgaactgggcagaatgctaagaggacttgtgcacagcagggagaagttctttgatgcttaaaggttgggggggaggagctggttccctggaagatggcagcttgtagacagaccctgggcagcttcagccagtgcctgaggaacgtgagataaggagggcctacgtgggcaacacgcaaaggagcaggaggctctaacggactgttttcttgcatgatttcagtagaatgtaagggcagagtgctccattgcttctgcctcctttactccctgtgaatcagaaggactgcagtggggctatgccaagcttggggtcaagcacttctgcctcttggagaccccaggccccaccattcaccttctatagctattgaactccagctctacaga

SEQ ID NO: 33613 - DNA, 4490 bp, Bovine  19866880475921
ctcctctttactgtggaaagccaacccatgtggtttgggtgggtctataagtcccctcctcacctattccctcatgggtggggtgtggcagtaggtatgtccattctcttggctgccagtgattggtccccaaatcagcacttaacccaagcagagccaatcagagttcctctatgagacttgattgaggacttccctggtggtccagtggttaagacttcaccttccaatatatggggtcaagttcggtccctggtctgggagctaaaatcccacatgcctcccacgtggccaagaaaaaaacaaaacataaaacagaatcaatattgtaacaaagtcaataaagattttaaaaatgacccacatcaaaaaaatctcacaaaaaatagatatattactattgagggagccggcctatttttatctaggatacaataggatcagtaggggcctttgtaatcaagagccacaggtggtcacaaaaatgcaagagtctgattgagaattcagcctgtacagaggactgagggcaagagagctgggaaagagagagacagaggtaggacgaagccttgtaacacctatatccatctgtgcccgagaagaccaacacctggatttcctagtataatagtcaatacattccagttctgtgtcattttgtttgagccaggcttttgtcacattcaactcagtctgaagcttggcttctatcaagtctgtcccactttgtgaatggaggaagaaacattttttttcttggggaagaaagggtatttgtggttagaatcacagactcacaccactccaggcagctaagatataggtacgtgtcttcatcatcaattccctctgcctctaccctggagtgaaatgcaattggagcctttactctggaaggctctggcggtgttctaagatgctcagtgttctcatgttcgctcttcactgctccctcatgaagggaatggagataagggactgatggggactgatgtgggagaagccctagattctcttccccgtaacaccactgggctgctactgggaaggagacactgggtggaccccagtccacctcaacaaacacattcagaaagagagaggtttagacacggccttgagaagatcttggtggggatggtggtccatatacatgaagttgaatgtcctcctcagaatattcatctatgaaatgtccactgtgctgcctctccaatgtcacagagttgcccgtaaccagcagaactgcaagtgtagtgctctctgacaagaacaaattgcaactgacttaatttctccaagcttctttgatagagaagtggttacatgattacaggggaactaaggctgtcttatgaagtggagcttgattaggttactgttgtggtttccagctctggggactggggagacaagctattgactgaggggtctggctttgcaaatgagcaaaccaaagcttttaatttaggctggatctaaaagaagttcagatcgctaagaacttaagaggtataactaaagtacaataaataacacatacagtataccatttggtcacttttgacatatgtttacacccttgaagccatcatgacaatcaagataacaaatatttctatcccttccccctgccagagtttcctgatatctcttcccagcttccctcccaatccccaggaaaccagtgatctcttcttgtcactatagatttgtttccttttctagacttgctattaataataagagtatccaagtagagccaaggatattgagtaggtggcggggagaatgggggcagggggaagggtgtgggacagccaaggtaaaaaagtttatgatcctggtaactaagtttatactgaagcataagaaatgctaatacctcaaaacaatggcgcaatctagcagaaatggctaactagctctgggggcaattaccattatcactgatttatttatttggaattttaaaataattttaaaatatttataattttgataagtgctatatagaatgttgaaaaacattctttatacttgtaaattctatacagagctgatgaactaatatttcttaaaatcatttcctatagaactattttccttaagatctgattagaaattcatctgcttcccacaatcacctggggtcaaataataaatgcaaatgtccaagttccagagatactgaattaagtgtctcttgttggatttagaaaacatgcattttagcaagcttcagatatatcactgatttttttaaaagataaattctcatctttcagagttgaagtagctgtggtcccatctaaaggcagataaatggactacagacatcctaaattgtcatccaggtctgattaaaccataaaaagttttagtgttttacataaacatactttgaagagtagcttatcaagtgaacatttaaatgtctgagcctaagttccactttgagattatgaacagaaaaagcctttgtgttaagaaagatcagcaacaagctgatcctctgatgtagacttaggctgatcctctgatgtaaacttaggtctcttcacacacctgttcccatgtgcttacctggctgctaacttgggcctggcaagagagtaagtaagtaacatgatcccctactatcctgaagtaagctacctttggggcatcattttaggcccagagagagtaaaaagtcatcattaaaaactgataagatttatacttacaaatgaatcatgctcatttccccccacgcatcttctctcaggccattaaaacttgatagatacaattctattgttgaacaaatatcatctcccctatcttgtgactcttcaatatttcagtgctacgggtgatcaatatgtgctacctgaaaagtcattttgtttatctttcataaaaccacattgcaattacattagaaattaatgtcaaatgaattggaaatcaattcatgaggggaggtggtggggcaccggggaaagtacactgaaatcatttaaaggtgggaaatcatcctcactgtgtttttctcacattgtgaactaaatgtgtttgcacattccctccagcaggtccctaaacaaatgccatatttgttttttttcctaacctaaccctaatgtttagcacatagtaaaagctatataaatgtctatgaaatgaaggaatgaatgatccagagttactactgttaaacattcatatttctagctttttccttaaagaaggtaaaggcctaaaatatctttgtgaatttatctttttcctttaagttcattattcccttcaagtttaactccatgaattggattattggattaaaattgtcaatatctttttatcttccttatatattttaaatatttttaaaagtgaaaaagaagtgaaattgtcacactgtttgaagatgacatgatactgtatattaaaaaaatcctaaagaaaattctaagttttttagtggtccaaaaaactattagaacccatcaatgaattcagtaagttgcagaatacaaaattactatacagaaacctgttgcatttctgtatactaacaacgagctatcagaaaaagaaattaagaaaacagtcccctttgtgaggtgctaataggaaaagagtgagagcttgacacctgagatggaaacattttgatggaaaattcaacagtcttgaatccccaaattcccttgaacttccctggttggcaaaagcaaacccctccctctgcagagggggtggtgttccctcacctggagatcatgttgactcgaattggtgcttcacaaagagatactaattctcttccagatctgcccagcctgaaggagttgggaagactggatgacaaatgtcatcatgaatccctgtgagcacccatgactaaggaccaaacagaactccttttccccaatgccttggtgctgtgcaagacctaggattttggggccacctagagggtggggtttcccaggaaggactgaggttgtttttcttgtagcccagcagaatcaggacttgagtgagaaatcagagtcatggaatatacagcaagttctagttcttgaattctttatttcgtaaggtgaagcttatacttatcatgcacccaagggcattaaacttcccctctcttgtccctactccactccaccttttttccttatagatgggctgagacaggtgagctgaccacaatgctctatctgatttgcactaactcgtggacttccctggtggtccattggttaagattccacactttcactgcaggggacataggattgattgtcgttagggaagttctacatgccacatagtgtggccgagagaaaaaaaacagtgaagaagtatggtttgcagtaactcctatgtgctccctccccaccgctccaactctccctgtcctgaatagccatgtgctcagcaaagcaaggtggacgaagaagcccaacaccgtagcagagagaggctatcct

SEQ ID NO: 33614 - DNA, 1519 bp, Bovine  19866880577901
atggcagataagcactggagggcgttctgtgaaggagcagtggacctgggatgggtaccccacaacacgtctgacattgacaagtccttatccaagctacttccccaccactctcatggccctggaggccctgaggaacttctgttacagccaaattgcatcctgacccctcactgacttgcaggtggcagcagctctagggaggagggtacaaggttgccggaggtgctggtggggtctggggaaccacagctggtcctgagacgcctcgtcctgctttttgagtcattaaaggccaagaaatactttcccatggaatagtatccagtccaacacagatttggtggcctcatcagggctgaaagtccaggggctctgcttctgttgactgtgagaccctcccattctgagcccatctgtgtaataaagtttggtcccagaagatgaattagaatgagtcagaggatggagatgaaagggggttggcactttattcctgttagattggccagaccaagatgggctagcagccctgagacagaggaacaaacaagtggcttcttggctggggtgaaagaggtgttggggaggaactcaagagagatggtggtggacttccctggtggtccagtggttgggaatctgcttgccaatacagggaacgtgggttcagtccctggtccaggaagatcctacgtgctgcagggtagccgggcccgtgtgccataactactagagcccgcaagctgcagctgctgaaaaaaaagagagagcatgaggtgggtgctgccctgggctactgggtgtgaagggtgaagcccagggcaggtcctctcattcaagtgactgaaagggctgacataaagggaggggtaggctgtggatggatgggactggggtttcatcccgaggcttccagagacatgcatagggtaggagagctgatggctttgcagtgcaacaaggtaccctcaaatgtaggaggctctgacttagcggacagggcctgaggagggccagaaccaggcaggtcgttgatagatgttaactgaatatctgctgtgcgctggatccatgcaaggaactgggcagcctgcctgtctgtgctgctcaccttttggggaagccgctgtggttggaccaagaattaagctagcccttgcttaattccaggcccttgcttaattaagcccttgcttgctgctgctgcttttaagtcacttcagtcgtgtccgactctgtgcaaccccatagacagcagcccaccaggctcccccgtccctgggataggcaagaacactggagtgggttgccatttccttctccaatgcgtgaaaagtgaaaagtgaaagtgaagtcgctcagttgtgtccgaccctcagcgaccccatggactgcagccttccaggctcctccgtccatgggattctccaggcaagagtactggagtggggtgccattgccttctccaagcccttgcttaattccaggcaattcacaggtactgaaagtggcccaa

SEQ ID NO: 33615 - DNA, 1797 bp, Bovine  19866880590718
ttgataggaaaaaaaaatctgtctcagttcaaatatgatttccaaggaccctagagatgaacgagcctccctctgaacctcacgaagagctagaaagagccgaggggaaccccacctcatgccctctttacagatgagacagtcaggccccggacagggacagggctgtccgtatgccactcagctactgagctgctgaattactttattcctagagaaagactctgatgctgaggaaagtgtgacttgtttagctcctgcggcagttgggtctgtgtctccaacagcaaaagtgaaaataaaccacatctcttgctgggtcatcatcttaaaccactgctaaaagaggactcaacactgctcctgattctttcttcctgttacatacttccatgaaaatcgacacatagtcacttcttagactgttgctgtcagctctcaagtattcttagcgctgaccattgcctgctagagggtttccaaatgcagtagctgggcagctcctgtcctttatagtcacagtagagggtgtttagtggatctgcaaactctttctgagttagtaatttgctcagtaatcatcttttaatatctttacaatatgttgaacctaaacagcaaacacagtaccaaaaattagtttaaagaaagctttctcttactaaattaagtcctgccccttccctctccgtttgctacaaaggaggtacagaaaactgcactgtctggggcaagcagaatcagagaaaagaaagtgaaacacctttctccttatcctgttgcccaggtaccccctggctccccaggagtcacccgccttccccagcccaatggtagagaagagggtcaggcctggagacagaagggagggacagagaggcagcctgcgtacctttccgagcctgctggatgtacctggccagcagcgcgcccagctgtgctcggggctcgtcgtccaccctcggcaccgccctcagctgcctccgaggcgcctcctccgcctgctgcgcccgagggcccgtggggtccgcgtgaggcatcggctgcgccagggcgcccgccgccaggaccgccatcagcaagcacaggcacacgccgcggttcatggctgcggggagcagagggaaggggacgtgaacgaaaaggtggggcatccgtgggctcttgaggagggtcggacacccaaggtacagagaaggtggctcagcccaaaggcgcggggctccggatccgctaggcaggtgccagcattagggagccggtgaccgcagcacgcgcgttcggacgcaccgcgttcctctttggggtgaaccgcagtcggggcccgggagtggtgtgggggacggagagagaccctgtcctctgccctgtttagcagaaggaatgtcttctgttttcctttagtttgaggaagtgttacagcgttgtctctcttctcctaactggaaaaacaagagattaaagacaggtgaaaattatccgaaagggactactctgtaggaaaaataagaaccttgaagaaaagaggcaccttaccagagagctcagacgcttcaaacagggaaataaatggtgaaaaactgagaagcacggcttaaaatatgagaccaatacataaacgccgtatttttcaagtttcctcaaggtgctaatgggaattggcaatgaacaactatgtaaaacgcaggcagggttttaaaaaaatcagagatctgcgctcagtcctccggcgtccgccaagcaccgctgcgttttagatccgcgcagataaaacactggaggttctatcccccaaac

SEQ ID NO: 33616 - DNA, 996 bp, Bovine  19866880595140
ctgagaagcgaggggacttggcggtcccatgcagccttggtggatctgagctaagaacacttaacaggttaccttgtaaagcaggtgctggcgcttcaagtgggtcagaggctgaggttatgggtaaagaatttggagggtgcattctcttagaatctgaagtatttgaggacagaaaggcatgctgccttctggaagagttttttgttttaaatcactctgagactatgacaccaatatttcttacctccctaaaacaagtgaggtaggctgctgtccttctaaaaatgaaactccactgtcatggaattaaaacactggctgctttgtttggaaatgtgagaaggaagggatttttcttgttgagtaggatcaagttagctcttttaggaatataaattccagactagtgtttccttaaaaactgatattttgatgtgtttattctggaactgttagcacatcccattctgggctctttttaatgggctctgggtaattactggggcctcccttctcagccagtacactgagccattgaggaagacagctggtcgcttattagccaccagcgggtggcccctgacccctcctccttgaagatgatgtgaggcacaattagagagccctggaaggggcataagtggttgctggggcataaataatgcaatctaccctgtctgtctgtgaatgtgatgaggcccagctgatttgatgttcagaagtcagaacctcatattctgggtccagcatgttcaggctctgtgaccttagggaaattcttagcccatgagcctctatttttccatctgtagaataagactgtgtagtgtgtttgtgcaataaagaaggtgatgcacagaaaggtttgccttattcttgctgtgtaaaggagctctgagcctgttcctttggagctggtgaatttcaatgtattatcctcttcttcctccttctgctccaagcctctctgcctctactgggggaagacttaag

SEQ ID NO: 33617 - DNA, 1248 bp, Bovine  19866880619496
actggagcatgccaaattccatttcttaaacagggagctctgtatttctacaaattatgggctcattagcctgtgttgagtgacagtagaatttctttttttttttttattaagaaaatcagaaagcaaggatccagtgcactttgatagtcatcagcaattgagtcttgatgttctatacacatttttgtagtcttagttcctatatttaatgggatttttaaatggggaaagccaaaaatccccaaagctacttaatattttttttttaattaattttattttatttttaaaccttacataattgtattagttttgccaaatatcaaaatgaatccgccacaggtatacatgtgttccccatcctgaaccctcctccctcctccctcaatggacacgcttttgcatctttattactgagtttttgaattcacacttttttttggtatacaattattcttataatccattggaaatgtacattttaagatcagtatgttcacattagggcttccctgaaggctcagatgataaagaatccacctgcaatgcagaagatatgagtttgatccctgggtcaggaagatcccctggggaaggaaatggcaacccactctagtattcttgtctggagaattccatggacagagaagcctgacaggctgtacagtccatggggttgcagagtcagacacgactgagcgagtaagcacataaccatcattcttaatgtctatattttaaattatttattattttattcctctgaataagttccattgttttcttatgtatttcccaggtgtgatatttaggtgtttcttaatagattcaaaggttttaagaactttttttctcagtgtgaatgctgtgtgtttttataggtccgtctcacccatgaaattaaacacaagaacattgtaacttttcatgaatggtatgaaaccagcaatcatctctggctagttgtggaactctgcacaggtaggagccaagaagtgctacgattatagtcaccgtgtattgctttgaaaaaatacgtgatgtaggttttgttatttttcacttttccttctattatgaatagaagcatactattgactacattaacttgaacatctgttgtttgatatattagggacaggaaaaaagcaaaggtgtttggtaagaggaagagatgcagtttagggttaactttattttggtataaaataatactaaatcatcttcataaaatttagacataat

SEQ ID NO: 33618 - DNA, 1837 bp, Bovine  19866880628015
gctcagacagtaaagaatccacctgcaatgggtgaaacctgggtttgatccctgggttgagcagatcccctggaggagggcatggcaacccacttcagtgtcttgccatggagaatccctgtggacagaggagcctggtaagctacagtctgtgggtttgcaaagtgtcagacatgaatgagagactaaggaaagcacagtgatgcttagttttctgtttcattttatctgcaggtcctcttgccttgaattcagttgagatcaaagaaaaaaaaaagttaaactcctatttactaaaaaaatcaattaaatcaattttcttatttatctttaaactatcttgagtacgtctggaggtgtaggtccgccccggtctagaccaggggatctgccgggcctgaggccgagttccaccctggcttcccgggatgtcggtggctttcgtaccggactagctgagagggaaggcagaagtcaatcaggagactatccagcggctcctggaggagaatgaccagctgatccgctgtatcgtggaatatcagaacaaaggccgggcgaatgagttcgtccagtaccagcatgtgttacacagaaatctcatttatttggctaccatcgcagatgccaacccaaccagggcttcaaaagcaatggaatagtcttccagttggctgttgtgaggagtaattgaatgtgatctatttcctatgaaatggatttttgccagctcaactgcttagaatgtgaatggaacctctgtggctcttctaaaaatgtgaaaatgtaaagaaagctactaacttaaccatattctcagtataaatacttaataattaagtggattccctcaattaagttgactccaagtgtcctccatcctgaaataagtgtgtttggataacagagatataatgggcatcttcaagtcaacctttttagtttcaatctgaagaggaaactgagcaggtattgggcgatcagcagaaattggtgagactttccactgagacactgccaaatggacgtgtgactgtttctccctcctgccagtttgtggtggtggacccctgactgctgttttcatgttgccttgaaataaagcttgcctttccacaaaagcctgatattaaggtatagaaattttcatgtaatgtcttccacttggtttttgaggaaaagtgtaaggagctaaaaatacatgtaacaccccccacagtcattgctaataaaaaaatagtaattcttaagtatcatccaacatcatctactaatagaagatgtgatgccaaaggaagagtatctttttcttttctatccttttaaggttattagctaggcctctataacaaaagacagattaacagaagaaaagcatatgcatttatttaatatgtttacatgacatgggagccttcataaggaaacaaaagacccaaagaaacagttaaacctgagcatttttatatatgaagttcgatgaaaagtataaagttttagaaaaatgtgatgggacataagggtatgaactaagtgtaggaaactgggggaaatttagcaaggcctttttgttcaaaatctctgtccctctgggtgtgggagggcacctctcatctgagagtcacatgacctgctttatgggagaaggtctgagagtccctctaggatctgctgtttctcaaattcctcccttaaaatattcactatgccaaggagctgtattttggagtggcatgtcctgaattctgtgatgttcaattttcttctcttcccacaaaatgtgattttgttgatgtgtctgaaacaggatcccaacaaaattcacaccctgcatttt

SEQ ID NO: 33619 - DNA, 2674 bp, Bovine  19866880707347
caagagggttgttcaaaaaccaactccagccagtggaagcatctctcacctgttcaagtcccatctctttttttgaatcaagacccctattgattcatagccagcacagaatagagagacctggacccactttaagttgctttcgtattggtcatgaaagattcttaggccctgcctcaaccagctgaagttcagggcactaccgcaggctctaaggccaagtctgttggctttttgcccccaaatttgccggtagaacatgttctttcacagaatggagttactgaaccctgtggtagcccttatgcccctggaaatggtctcaggaaccatgtatgcatcacagccacactgtaacagccgaaatgataaaacttgaacagaaccacatgcttgatgtggtccatttcccttggatgcctccaagaagtgatagaagttagcaccatctgacgagaggatttgtgtggccttggcagggttgggggaagggtctgtttgactggatttcaggcttcccagagcttctggtgaaagggaaaacggtctcccacaacatggtggtgtgacccccctcagccattttctctgtggtgcgaggtgccaggatgagtggaaagtatctcacaggagggaggcgagttgggccagctcggagggagcagccaccccaaggagcaccttcaactatgaataattctccacaggtcatgtgaggaggacgacgaagcagccccaggccctgttgagctgagagcagatgtagggcagagagtgagcccacaggcaaggcagggggtgagcacaccaccagcagggcctgcctggcagggccctgtgaaggagctgtgtgtgcacgtgtggccgccactaacccgcaacgtgggcgtggatgtgtctctgtggttgtgcctggctaattcggccttgacagcagatacccctaacctgtctaaacaccccagtcaagccaagtgccaacactaatacaggtctaaccaaggttcttaccagaaggggatctctaaattttagcttgtctccatctcccttcctgcctctggagaacctggcttccccatcccccagctttatgtttgaagagattgtgttgaaaagcaatggacagagcttccccttgggagaggctggtgccctggcactcttctgatggcagctgtaggactcaacactgcacccctgccttcttctctaagtccttatggcctcatcagggatgaaaaagcctgagaagtaagtagcaggagaaggctttttgcctgagtttgaaagaatggcagcctgaaacaaaaatggaaaatctctctagaagtggttctgtgaccaagtacagattttttccaccctcgattgcttgtagatcagttttgtggaaatccacctatgccttttgaagacccaccttttaagcttcaggatctgctgtggtttctaatcccatgttcctctgagtgctccccacccaccagcatccccactcctaagcttgtgtgagacgggcctattctgggttccttaccatgtatagactgaccagcagtgaggtcacttgagtgtggagccaaatgatgctgcaacttgtacttggcttttgacctgtcctcccacaggaggagtccctgctctactcattctggggatctgccccagagcctgtccccttcctcccctttccctaagttggtgctttgtccagggtatgtggcccgtcccttgccaggctggggagagagggctctatccccgagttactggggaccacccagctgcctgttcccaggggcacccgaagcccctgctgcgtccttaggtaggtgccagggcaggtcttatgagaccgtcagaagggatgtttctgtgcccctcagttgctcatccagcaacagcttaggggctctgtgcctggggtcggggggtgcctcactccatccctgtagcagttgtgaaaagagggacccttctggtttccaggcagacagcaatgcatttcccactgctgcccttttgttacactttctgccttgattctccttactgctgaatcccagcttctagaatctagtgggccctcagtcatatataagtggacagaagaatctctccactttccctttagtaaccaggtttcaccacccagtgggcctttttctaggtggctctttagatgaagatctgatgatacatgacatgtatcatctgtccccctatctccactcatcaaagtggacttcagcacccgcaggaagagtactgaagggcagcagggtgcagaggaaacagcactgtagtgggagtcaggagcctgggatctgctgctgacttgatgtgcaccttcaagcctcagtctccccattgcccgggggccctctccacctgcttcagccacacccagaatcaactcataccgcagagccctggttaacatcttacctcaaggaaatgggtactgggaaggagtgcagaaatttgaggaaattggtagagacagagcgcctctctgctgcagggcttcctgtcttatctttggggtcactcagacttgggttcgaatccaggatcttccactgagtagctgagtgtgatgttgagtaagtcacctaatctgagccaaatttcctcacttgcaaagccaacagttgtactcaccctctag

SEQ ID NO: 33620 - DNA, 875 bp, Bovine  19866880714624
ttaaaattgatcagacagtgtatattcattgaacaaaaaatttttataatggggaaaatcagacatttgagaggaaaagaaagtactgtagccaaccaagatttgacagcatacattttcttatactttcatttctcttgcctttttatcctttgagaagattcttaaaattctaggtatgctgccttattattattattattttcagtgacttaactaaaaaagtgtgtgtaatggcagtgaacagaaactacaatctaaacatttgctcattaactcataatgtatagtagtctgatgtgatatgtaaccaacaaaggtttcaaatgtagaaacatgaaaggttccttaattatctgaagtgaattagtaaaaagtattctctggaattttgttttgaagtctcttaactcagttttttccattgagatttttgtttttgtacctctagtaactgctcctgggtattcagatttttatatttatgtatgtactccagatacattattatctttttgagaaggatgttagttgacttagccagtttctaggaatataaaaggaaatataatattttgtttctaactattattcacactgtgatgttacaaatattagggacctgagcagattcccacttcaaccacagtgcttttcttaagcatagttcatctctacatacatatcctatgtgaaagaaaatttagagccctcctttttaaaaagctttcttgctttgcataaaacttgaaagtatttaatttcaaagttatattgatattaaaacatagattcagtcttgtcttaaaagtgtattacaatttatttcttgccatttttgtgtaaaatttacagaaagagtgttacaccgtgcg

SEQ ID NO: 33621 - DNA, 1310 bp, Bovine  19866880765359
atgtaaacaaaatttatctatgttatacctataaaccactttttaagttaattcaccctgtgctgaccctcttaaaaaaaaaactcaccaaagtcacatttagactgaaaagctgatacagatgtttaagtggttccttggagacaactgccaattacttaaaactaccgatactgaatctactggtttattgcatcactcaacgtaaaagaccaaaatcattccatgttggtcttccagtaatgtgctttctgactgggctcccagattctgctgtccaaagtgctgaactggagattctgcagtaactctcacacaaaactgagaccagatgtccagcaacttcgtgcttcccactgcaccagtgaaaaaaatcttggtttgaaggatcagtctgctttggttgaaaggaacttcgaggatggaaacttgaggtgaagccaagaagtaaaaggggaaacgccgatgaccctcaaaggaaaatcaaaggatccgtccatcccatggcctcagcctcacactccgcagtcagactgcttgtcctgaagctgcctcgtcagtatctgatgagaagacaggaaagccactcctatgtggaagaggatttgccagaggttcctcagcccatgcaggtacacgttgcccaggcaaatgaagagcagcatcagcaccaccttcatagtcctggctggactgtagaacaggtacagataacactgaaatgacaccagaagagggaggcccatcagagatagcaagatggccgaggtcagacgccaggtccactgatagtacctgccctgcagtggcgtttcatacacgttggcttagtaaactgaaatttgttacagtggagcttggactcactggatcagttgttgtcaatcagtggatgaaagtggggatttggaagagataagaaagtgaaatagaaggttacaggaggaatgagaacacagccctcttgaaagaaattaagaaatacagacagacatgtccaggctgtgctgtacataaagaagagatgtgggtcgggggcagacagccaggtggggataccctaacaagagcaactggcctaaaggaacttttcctttgggggagttataacaggtgagaaagttggtgagagaaagctgtgcttttactatgttagtttttcctgagttacaactacataggggaccactgttccctagacagcctccctattacatcttcagaagcatctctgactcagggaaaggtcttccagaatgatgcttcctgtagggctatcacacagaaagaggacattcttgctctgcaaa

SEQ ID NO: 33622 - DNA, 1365 bp, Bovine  19866880912805
tagcacatttaaggatgaagtagttgccaaaaatctaagtaatcaagataaacagtattttagttcagtatttctaaaaaaaaaaaagtaaactaatgcaaagaaatctttaaaaaaaataaaaaatttaaataaagacagaattggtattactgagttttgttttgcctgatgccctaatatggttcggccagctgtactgttgtgggcctgaagatgagccgggggagtctctaagacctgagaaccataggcttgaccttggctgtatgacataaaaagtatgaaggtgaaagaacaaggttgatgaagactaaattgattctgttaatgcttttagtgctttgtgaatagaaacaactcttatttttggaaaggattctcagtatattaaacatttcaacaaaagagaataatgtataaaagtacttatgatagtccttaaaataccacaattattatttaaagttttgtggattttgccgtattaacttacagcaggcatggcattggtgttttaaatcgaaacaggaagctgtcaaggcttagataacttattcatggcattaacaaggtataatttggtgtgtaacagtgttgaacagtaggaaaagttaatgattgcccacctttcagctaatcatgtgattgctgttgatataattacctggtaggcagggatagaatcatgtaatttgctagcctggcgctgcatacttacaaacattcgtgctgttgtgtgtccccaagcgcggtttctgaaatgtggccctctttgtctttttctgctgaagaagccccatgtatcatgttcatttggctctttgttatggtcaggatgtgttgcttggactgagagagataccagatttttcagcttctcttccaattgctatggatactgtgtcagtgctattgaggtctccttttgtcaatttcagataggtttccccttgggcgctgaaatccatgtccatcctgatattaaggggccatttgttcaagtgcgagagggcttttgaaagtgtaccgtgatgagaattagtttcaaaaaattataccagagagggttaaaacttgctgaacttgtaaagcctcacttctttgctcacccccagcacccacctttctgattttgctgtttcgggaaagtcaagctggcttagagtctccctgtcccagagagtgatttgccagggctcctaaaggggcctgtaccctggcaggaaagcccacttggtggcatcctggttgttccttggatgtggaatggtttcttattaggagtcccatttccttagtaggcttttcagatctttttatttgcctctggtgttagttttggcaagatgcatatttcaggga

SEQ ID NO: 33623 - DNA, 3122 bp, Bovine  19866880996644
catgcagatctgcgaccagtgcggcaagcgcttcctgctagagagcgagctgctgctgcaccggcagacagactgcgaacgcaacatccaggtgggcctccaaggggcctgcagggggcagccatccaggctgagccaggccggaactgggccctgggcacccagtgtcctgctgcctgtgttgtctgcacagtctgcagagagcaggctcagccccccaccccccaaccccgccccagggacagtgggaccagccccagcccaagggtgagcccagagtggtgagagctcaggggatgacgtcagggagagcttcctggaggaggcagatagagctgggcttccgcaagagtgcagaaaggattggaacaaacaggacccttgccagagaggcagaggggagcagggactcaggagaatgagaggagagagttgtctgagcatgtgaggctgggggacagccagctctgaggagggatgagtcagtgtttttggactgctgcaaggccagcagggcccccaggtatatagtttggtagattgagcagtgcaggaaagcacagaggggaggaggggttttcccggaagggggcgccattttccacttattgcaagggctgagtggagcaaggggcagccaggcgggaggaaacccctgcattcagctctttggaggtaccagctggcctgggcatggggaagagggactggatgagcagttcgggaagtgcagggggcccaacaggaaggctgctggggccaaacaggggatctgggctgactgccaagcattgagccagcctgcatctgggccagcctggcctttcagggtgaagacggcacaaggccagccaagtgattttttgccttctctggctgagagtgaggttgaggggcagtaggtaggcgatgctaattgcctgaactaattgctaattggagaaagtgttacctgagggttacctggattcctgccccaccctcaggcacatgctcccacctgcctgcctgctggcctgccctgtgactctccacatgcacacccccgagcttccctcctgaaagggaaagacgcttgtacttctaccctgggtaccctgacccaatttctgcctaagccctggcctactgcaggggtaagggcccaggagacgaggaggaggggagtgtggtccccagggttcccactaccatctcgtgtccaaaaggcccttgcacctcctgcagtcccccagccctttggaacctgttcccttggggatctatctctgtggtgtcaaggtatgggccccagcaggggaggcagcagaaataatgtctcagctttgccagaacttgttatccgaggggctcccccttgaactgtagcctcctcacccactgtggcccttcagccagttatgtgtctctcctctgtagaaagatgtcttgttgaaatgagcacagaggagggacttcgtggaagaggtggcccatgaccctagtgagttcaggatgaggagggagggccccaggctgcaaccctgggcgggtgggcaggtgggtaacattagggatttaccacccctgactcagaatatcaaacgtagctggtccttggccaccaagatctctctctcgagcacagttcaggtggggaaactgaggcctagagaggcagtgacttgtcctaggtcacatggtcctgacccagggcctaaagtcttttcattccacagtgtgtgacatgtggcaaagcttttaagaagctctggtccctccacgagcacaataaaattgtgcacggctacgcagaaaagaagttctcctgtgaaatttgtgagaagaagttctacaccatggctcacgtgcgcaagcatatggttggtaagtctaggcctgtggcggaacgggcccaaggtccaagctgggccagctgctgggtgtgctaggaagtctttcacatccagggacaatataaagggatgagaaagcaccaagtagctgggaggtggggcagggacagtggatggggcagtggggccgaggagggggtagggctagtctggggccagggctgccatgtacggttgggcacgttgcacatggcacaagggctcatgacaggagggcaggtggagaccagaatccagctagcacactgctacccaggctggcagcccaacatggggctaggtccacaagagcaccttctgctaaattacacagagtgcttactgtgtgggctgacacagcccctgtctcagtctgaggacagctatgcccctgacagggcttcagacttctctgaatgcaaccctcctcccaggagtcatacctggacacaagtgtgtcttgggccacttcgctgccttgggcatggctgtccctcccctctaggtgggcctggctgagagtctggctgttgtctgggtggccctcctttctttgcccacttgggggctggagctctccccactgtctagccagggagacagtgagccctggccagagatgccctttctctaccagacagtactggaggcttccgatatgaactgactgggagctgggaacctggggtgtaggtatcagccaggagcatgctaggtaacccaggattggtggtccttcctgggcttggattccccagctctgaactgtgaggggggccctccgtgtctccagatgcttcctcccacatcttccttggagtttgttttggcagggagtgcagataactccttctggatggcaggggacccaaggctgaggcctttacaggtgccatcctctgtaaagcccagccaccttggagacccaggaccactcttcctgtttttatagaagaggatgctgaaactcactgaggctcacagcagccatacagagaaccagtggctaggccaggatttgagccgaggctaaggaaccatgaaggcctctgtgcttgtctgagcagacagagacctagcggggggtgtgggagggagggacagggagggagggggaaggacctcgcctgggggacagaggccacggggcaggtcccagggtagatggtgccccaggaggtgggttcaaggctcagcgtggggtcggtccagcaggggtcccctgggagaagccagatggtccctgag

SEQ ID NO: 33624 - DNA, 1641 bp, Bovine  19866881072256
tgacctttaggcccttggcgtagtctcttagctctgctgggctagggaactgggtgggtgtgggtgggggaaggctgtagaccccagtggcctagagccaggggttggcacacttctccctaaagagccagagagtaaatgtttcaggtttgttggttctgtggtctttgttgttgtagttgacagcagccacagacagtaccttaaggaatgggtgtagctctgttccagtggaatttttatttatgaaatcagacaggggactgaattttcagtggaccatggtttggtagactcctggtcgacaccttcatgccctgatctatatcaggatgtcaacttaacaagagagaaatatccctttttagttgagaagccaaataaataaattgaaagggcttctggtgggtctagtaataccccacccactcagcattgttaagccacgaacagttggtccatatggttggattctccaggcagccagagcttattgtttttaagcatgagctcttatttcacttgacccgttttcagtagaaatggctagaagggtattagaaattccttgggctttgctagaatggtgggaaaggtgattaaccttttaggtagagtcagatgcatcttttatgaacactgtttggtagaagatttggagatgtgtccaaagatggtagatgtgcctagtgccctttttaaacattctttgtggttacattttttgtgtgtgagtaaccgcttcattgagatagaattcacataccatataattcacccatttatagcatataatttgatggtttttagtatgttcacagggttgtgcagtcatcaccacagtcaattttggaacattttcatcgccctaaaaagacactccatgccctatagctgtcacccaccaatgcactcacatgtcccccagtgggactgcatttttaatgagctttcaggaagtcacttcttggtttctgctgtccttgtttttctttgctcatccctggccttggagagcagaacaagatatcttcttgagcagtcatctgtgctattcaagtgcacgcttaacagaaactttaactgctcatggtacttgtgtatcataccaacgtcacctgataagataacttaaaattttttcctttattatatttatcaaagctttatatttctttatttgtattctgctttgtaaaaagttatcttctgtaattttctattaatgcattttgaatttatgtttgtgttggtttgaaacctggttcaagtaacatggaattgtttcatgcttaggttttattgttttgtctatttgcttattatcaggctgtagtgaactgtttagggatgagtttgaagtcttttaatatccacatgatctcatgtggtgttttgaaaaactaaccattgttcatttataaacagaatttcctgttcaggaagttaatttagattaacaataaaacagttgactgcattgaatggtagaggcactgtaggtattttgggatcacaaaattttgttctattaataaagtctctgtgatctggcacataattctttatctcaaagtttatcacctatgctaactgacttccattgtcccctggtaaagggctgactttgggaaggagaag

SEQ ID NO: 33625 - DNA, 965 bp, Bovine  19866881107335
aaccctgctttagagttctttctgacctttcctcccccttttggggcaaggattagtgtatccgtgaccattattattgggtttatgggcagcagcttagcaaccatttcatggcactcggctgtctcgtttggtctttgctcttagcgctcctcctgcctgttcttctctctcctgtaccccatcccccatcttccgcctcgcccctctcctatttttctcccatttctctccgtcttgtcccctccccatggcctctcctgcgggtccctccctcatcccctcttccctccccacttctctcctggccccttcttttctctccctagtcccttcctcctgacccctgccctcccccttcacccttggcttggaaatcctttgttcctgtgacccagcccccctcttctgccccaagcccccagccctgtcagcgaatccagctttaggtggatgttgtctttggctttttgcctgtagatttctccaacttgagaccccatgtcctattttctccatggaggtggggagtaaaggggatcccagcattcatgagctcagataggctgtgtctgcaggacgtggccatttctgagctaatccctggctttgctccttgctgtccccggttctcacgatggcctgtttagggagaaggagccctgctccctctgtccccaggggactgggatgtggaagaggacaatgctttgacctcttagggctcttgatgacttgatggacagccttcttcctggccctttaaaataactttggttagcaggaggcagtatagtttaaataaagcaaaatgatgattgtgatcatagtttaatattttgaaaatggaatctcgaatgttcgttgccctccggttgtggttccttgtcctgatctccggaagtggattgctttgggatggaaagggtggcccgtgaccagctagttctcttcacttgttggag

SEQ ID NO: 33626 - DNA, 884 bp, Bovine  19866881181254
aataaggtcaacatgtactgctggactttgcagatggcagaggccagggagtttattactgaggtcagtcccaccttctcaataacattctggaaggcagtaggtgaatggcgggtgattctacacaaggcctgcagcgagaagaaaacagacacgttagaagactgcaatggcacaagccaacccccagaaagagagcaaatacttctgtgaaaaggagaaaaaggtgcttaacttgctcctccatcacttatcttggcataagtaatttgaacaatttagacacatttaaaacaataatccaacttccaataaaaatttaagttgggaaacacagggcagagagggaagtgggaagggggtttaggatggagaggacatgtgtatacctatggctgattcataccgatgcatggcaaaaaccatcacaatattgaaaggtacttatccttcaattaaaatagaaaattaataaattttaaaaatttaagtcataaaacattagaaaatcctacaagtatcatgtacgttatgctgctgctgctaagtcacttcagtcgtgtctgactctgtgcaaccccacagacggcagcccaccaggctcctctgtccctgggattctccaggcaagaatactggagtgggttgccatttccttctcctatgtacattatgagttaactgaaatgataaaaagtttttctgtatagactcatcaattattttaagcaatgaaaacattaagataagccttctatacgtagacactaagttaaaggctgaagaaattgtcataaaagtaaatatttaatatttattgtttagtatgtgaagaacacgatctgagaatatctaaagcctatctcacttaattctcccaaata

SEQ ID NO: 33627 - DNA, 1019 bp, Bovine  19866881183722
tttgccccttctgcaggaatggggcgcccacctgtacccaaccgtgtcagtggaagagcaacgaggagctcttccccccaccagccaggaaggcatcagagaaggtggtggaagcctggcttcccacccctgcccagcaggaaggaggagctctgccgcatccctggggtgtcagcagaagcccacagggcaatctgggtttccacaccaacaggggaggaacaaagcaacgccatccttcctctgccagttcagtgtcagaggagacccgccaaaacgggagatttcaattaaacccagagtcttaaaacataacacccaaaatatacggttgatacagagcttccatttaacaagatgacagagttctggagctctgtttcacaacaatgcaaatatacttaacactactaactacacgtaagaatggttaagaataaattttatgttttttaccacaattttaaaattttaagtaacaatactaattaaatgcaaaagattatttctcaattaacaggtaattattcaatcattaagatatatgaaatattagttaaacataaaataaatataaaatcatttaattaatgcatattattttactacctttgtgaaataccatgttttaaactcaatcaatccatacctgtgtgaagaaaaataaactgcgaaactctcagcctctcttaccacaatttacacagcaaaactactcaaatggtactctttctaatacaatgataacaaccttcagtgacttggtaaattaaatatcaaaaattagatacacaaactatacgttccgtgaggctcaaatttcttagcagaatcgaaatcagactaataaaagccaagaactggtttactctctattttgatttttaagatcaagtttactatgtaaacataacaattattaaccatagaaattttcagctttataaaaaatcaaatttaacacactgcatttcatggataagaaccacgacaagcactatattttaagtggccccatt

SEQ ID NO: 33628 - DNA, 1148 bp, Bovine  19866881236412
catgtgggttgttgcgaaagctgaactaagtcttttactcttaaaagaattgtttgttagagtccttagttatgaggaattactagcaagttattatttggcccctaaatggctggtgtcaaaaaattcttatgctctggctctaaatccatttgctttcacttcttcctcctcagaatgaaagccacgctacctcacggtgtttggactacaaatcatttccttgccattgatttaaaataaaacaaccctgagatttttctggagatgaaagccttctttcagtgcacaccctttttctccaatggagaaacaaagacatagtcctgaagtggcctggaggcagcctcttaagatctcttaagcaaatggcatatgttatgaaataccatgtgtatgactgtgtgtgtgtggattaaaaaaaaaaatctgtcacctcggttttcatggtttggaaactagttgcagagacttagaatttaggccatttggggaagaggaggctgggccattatgaaattatcagttaatttaagactgtttaataattaatattaagaactgctttggaaaggacccactgggtctgtgcagaacgtggggtctagatcctagggctctttctggcggtttatatatcactctctgtgctgctgatccacttcggtttgctgaccggatatgaagccagacccctttccactccagcgccttgccctcagcaacacccccgagtgtgcacgtgcggatgtgcacgcacacatgcacacacactatgcagtgtcaagactttgcagtaattagtagacccctgtcccctcaccccacacagcttggggcttttctctggaatcaaacccagtaaggctgaacctggccagactttgtctggcagacttgtagcatcagtagtgacatggtcatttttatttcttgcagttttatgtgctgaacgagttggccagatgactaaaacatataatgacatagatgctgtaactcggcttcttgaggaggtaagtgattcggggaaaggcaaagagtcatttatacttgactgattataatttatattgcttaaagcagacattactatttttcttggtgaagaatgtcagaaattgagccctctcaaagtagattcaggg

SEQ ID NO: 33629 - DNA, 1201 bp, Bovine  19866881303011
aaaacggattagtcagtcgccaggggcgggaaggaagagcatgagatagagggaagtgggtatggctataaagggcaataagggtgatccttgtggtgatgacactgttctgttcattaactatctcaacatcgacattctgactgtgatactgcctgacagttcttcaagatgtcaccatcagggaaaattagatgaagtaccatatatacccagcatctctctgcactatttattacaactgaatgtgaatctacaattacctcaaaatcaaattttaattttttcaagttaacctcattctaaattcaaaacccagatccaactttctgtttcccaatattcatagcagggacatatagctctgttccattttatcatccactggccatttggtatcagtaaacatcacaggaaattaaaacattttaatgctacagacccttaaagatataaaactgtctgaactgcctccagcataacagaaactgctttgaaactgagtgcattatagacagacaaacatcatatgacctatgctagaaaagtcacagcagcccaacatctcacttgcaaaacttaaccttggacaccattttacaatgcacaacaaataagtttccctgcgatattactgtatagattttcaactcattccgtaaaaatttcaagaaacattaatattaaaaaggaaaactataagaataaacacataaatgactaacatcaagcaggaaaaataactttattgatgtaagcatgacactaaaatatgccaatactaaacagaacaaaaaccgtaaacaagattgtttagttcttccaactcagaaatccaagtaataggtggatattgttcttaggcatgtttctcctatagtgtataaaaatttatctggccttttaacaatgaagctaaaatagatttttttaatgggatggatattcatgtattatgctactattttatgtattttttggaaaatctaaggaaaatgaggagaatggaagggtgtcttacttctaggattattatgctttaaggcatatctacacaatcactgattctattaccctaaaagaaactatgcttctgtaactatagccatgactggttgcttgattacttcaaataacaattattatttataattataaataataataattattataataacaaccagatacaataatagga

SEQ ID NO: 33630 - DNA, 2470 bp, Bovine  19866881320320
atgtgatttttatgttttaaatgtttgtggaaaaaaatcgaagaataataatattttgtgatatgtgaaaattgtatgaaattcaaatttcagtgtccattaaattttactggaacacagccatatccatttgttcactattttcttgggccgtttttatgctatagcagcaggattgaggagttgcagagagtttgtatgtggtgctgtcattggtatatatgctgttcagtgcactacacatcacagtgtattatatttcaaatttcattgataaaacatttgtgaaaacttgttttctttttgttacataatcatctttaattttcttcttggcctagaaatcctaaaatactttctcttcgacttttaagaaaaagtttgctgacccctattatctggtattttttttaagtagtttataccactgtcttgtatttatggttgaatatcattggtgagtttatttggtcattgcttctctttggttacataatatctttggaagttatatcctgcagaataattttgaatcataattggtaaatagttgtgtcataacaaagatagcaagttgatctatttcattagaatgcttgagatttgatcagtcacttgggagctaaaattaatgtgctaagaatgcaagatatgcaatatgaaaggataagaaacagggactgacagccttatagagcttgccatcttactgaatttgccagcagttaagttctttatcggagaaggcaatggcacccccactccagtactcttgcctggaaaatcccatggatggaggaggctggtgcactgcagtccatggggtcgctaggagttggacacaactgagcgacttcactttcacttttcactttcatgcattggagaaggaaatggcaacccactccagtgtttttgcctggagaatcccagggacaaggggagcctggtgggctgccgtctatggagttgcacagagtcggacacgactgatgcgacttagcagcagcagcaagctcattaccacttatactttgtttagcagaagctggattctacacttgctctaattcatttgttctcatgttcagctgcacttcagtgtaatttggcaagcttttaaaaataccagtttctgggccatacaacagagtaaattggaatgttgtggggaaggaggtggagagtggcaacgttggatcagccatgtaaaagataccagatgaacattaattcatgctgaacagttagaggcaggtcatttggttcagtgatgtgttcttcatgaggaaaatgaggtaaacagttgtctaccaagagtaccggcttctttcattgtgagaatcaaatgatatcatgaatatgaaataaccgaaaaaactataatatactttttagttaaggttttcttatagtggcattgtatgtttatctggagccagattcctggctgggaaaaccctgttatatcatggttgtaaaagtcatgtttcattcctctatgtgacgttggacaacattcttaactgtaatcttaaaattctttatttttaaaaaggagttgataatagtacctacctcatagtattgttatgagaattaaatgaactaataatgcctttaatgatatctgttaacatttatttaaaggatttttttgatgagaacctacttatagcacaggaaactcactcagtattttctgtaatggcctatctgggaaaagaatttcaaaaaagagtggatatatgtatatataaataactgattcactttgctgtacacctgagactagcaaaacattgtaaatcatctgtactccaataaagatttaaaaaataacagaggatttgcttagaaaattaggtcatgtggagtgcctcattctataaaagtgttagatctaagtgaactgttattgtattaaaggaacataaattctccgtttacacactgagaaaactgcctagcatttgtttatttttaattttcaatcttcttttccaggaaaattcctgatgttacacccactgtaagtgaccagaaaccatctgtgtcaaagtctggacggaagattaaaggaaggggcacaattgtatgtgtgttaaaacttaatttttttcaaattagttatctgagcagtaaaatgtttttacctgtaggcaaatcctagctttaatcttaggcatagtccaaagtctgtccagggagctagttgtattctcttaaattaatatgtagctatgcgaaggcactgctgttagatcagtgtttattgctatgtttgaatgggtttaaatattgaaatgaatgtgaaatagtatgttcagaaatcttagtatattgaataagctaatgagtataaccattaggacttctaagggaaagtttatgtgtgattacaggtgaatatctgcctttcctatttcttttagttgatttaactttataccatcattaggtacttcag

SEQ ID NO: 33631 - DNA, 590 bp, Bovine  19866881887636
ccctctgcgggcccagccctgcactgggctgtaggggacatgggagggtgagagaccttaggccttgattccatgggatggtcaaaaagccccaggctagggttgaagagtgaggtcagagtgggaagggcacagtgggttggaataatcagggcaggctgtctgcaggaggagctggagttgggaactaaccaaataagatgtggaaagacaggggagggtaggcatggcaagaccaaggcttgaactgtctcatgaggtgggggacagaagttgctggagaggggaccccactgaaaccagtctgcccctagactgagaagcctccagcaatgggagaatgtggtgccagtggtggtcccaagatccctggttcatccatggaaaatttgagtggtcagagctcaggggtgggagagccagagggttgctggtgaggcctggaagctctgtgaccctgagaggctgtaagtgttgccagagtatgcctttagggccagaacttggtggggctttgagagctcagaaggtgggtctcaccatagctatcagtgagagaagaattatgccaattgtcataatgtctgctt

SEQ ID NO: 33632 - DNA, 1624 bp, Bovine  19866880347345
ctcccaggtgacaaggacagaatcatgtaaactcacctgatgcaccttcaagtgggttcaggagctgccctgcctttcaccaagaaggaagcttccaaacaggaaggaggagaatctgtccatcttccaatgggagggtcccaggagaggtgcagctaaaaatgggatcaggctccctggagaagtgagaaaagtcgtgccgtcgtatttcagggctggtaattggaactccattaggaccagtctacttccacctgtgtgcgcatgtgtgtgtttgggggcgggaggggtgggagggtgtggggagtggaaagccagggaatcaggagaggaactaaaaacaagattgaggtgaaggtgagtgagggagagagggaagagagaaccaagcaaaagctggagaaagaaaagcaggaactcgtggagcgaaagcagaaactccagtatctgttactgtcccttatttacacccttgcttggcttggctacacattttgctatacaaaatggaaatttcaggccatcctagaggtggcgatttgagctaaacaaagatattcttagtgcacagtatgagatggagaaaagcgttccagtctctgttcttaagttggcttgctaattctctctgtgcccccttctcccgggtgtgagaaggaacagtgacattaaccttcacaccgcctcttggaaacccttaaagcctccaaagatggcctttggtttctctgaaaaaggcattatgttaaatgccaagactcaacaccttagtaaggacagggaagtgtgacttttggattttaacatcaacctattatggaacagaaagcataaaaagtacttcttaggtgttcattagggttactcctctatttgctcacactgagcgccgacaccacagtgcctgggcccaccccttgcctggaatccagcgcgtctgtaatgaggttgggatagcccatcacacgccacggcatccatggcgtggagggagcccaggtactgctctctgcccctgccagggctagccatgacactatcacccacattgctgtgttccagatctctccacgcctcaagggctccgattcaagacgatcacagagaccaccgtggaggtgcagtgggagcccttctcattctccttcgatgggtgggagatcagcttcattccaaaggtaacccccacctgtcagatggccaaacagcctgatgtggcatacccacaccctcgacttaggattggggcagcaaaaaagccaccctcccccccccccacacacacaatctctgtctctctctccatgccattaaggacacaagggggcacttggcgggctacagaacatttctttcacaaaggcgtggtaatgactgattaacaagaatggccccaagcctggtacccaggccttggatgacaggagaatgagggagcagccatggcccagctctctgctcaaaaagctttacatttttagcaagctgcaacttcagtgagtctgaaaacctagactttcaaaaagttggggcttctctctaggacacaagaaaagctaaagccaatcagtctcatagtcaacccacagcttcattctgtgcaggcagaggccccagaagtcag

SEQ ID NO: 33633 - DNA, 3103 bp, Bovine  19866880348558
aattaatacttatcagtcatttagataaagtagttttttgagttttttaatgttataaacacactattagtcatcatttttaatagaaaaatgatgatcatatttataatcaatataaaatatgtacaaatgccagacatgaacatctttaaaatttctccttcctggaaaggatctactttaaacatgcctcaactgtctggcaggcagttttgtcctcactgtgttaaattatcatggatttcttagttaatttttacatttccatgtaagctttaagatttatatttttccagttctagaaaaattcttctggtattctcatctgaattaccctatatttattagttaattttggaaccagtggtattaagatagttcatcttactatagttacatgggatatctttttgtttgtttggattattttctatctttcaaagagatttttagttttagttttttttgcttaggttttaggtctttctggttaatttttttctgtttctataattttgttgttatttttttccattcctttaactactgtttgctgagagtaaaaaacaaaaaactgttgatatttgaatatttgtattatatctaggcattgttcttattaaatctggtaactttttattaccagatagcctttgggctatctgtttatatttggtagtagccaaaaatgatgattgtatttttttcttttgtaatgattttttacattctcttttgttaaaaggcatgttatatgatacaattataggtacttttcccatgtatttcctttagttgaatcagctttagtggttttctgttcatgatatccccttttgaagaatagttttgtgggtttttaaaagttttttggccttgctacatgccttgcaggatcttacttccctgagcaggaattgaacccaggcctttgacagtagaagtgcagagtcctaaccattggactgccagggaattccctgaagaatagcattcattaaattcaaatcatttatttaactgtttcttagttaagagcaaattcagtatattatcaggtgccttttcagcatcatgttatataatcatatggtttaatttgttgagatatgcttatacattttctgataccttatttgtgtttctagagtaaacctaaaaatttaggtttagcattaatgtggaattcttttgataaattgctagactttttggcttatatttttaatacctgtaaacataaattggtctataatcctctgtctcctttttaaccatttttaacatctgtattttataactttcaggtatgtaagtcttgaacttcttttgttaaatttactcctaaatgttttattactgaatggcattgttgtcttaattttatttttggattgttggttgcgaggcttcagaaatacaatcagttttttgcatattgattttgcatcctgtaatcttggtactcatgttttgttttgttttttcatagttttaaggtgaatttcttgagattttctatatttaggattgtatcatctgtgaataagaataattttaattcttcttttactatgttaatgcttttttgctttattgtatgaattaaaagctcttatataatactgaatgaaactggcagaaaggatttctttatcttgggggaaagtattcattcacaatgaagtgtgatgttagctgtgagtttttgtagataccctttatcaggttaagtttccttctattcctagttgtgaaaagtatgtattattatattattagatattgtctaaggtttttctacctatattgagatgatcttgtgatttatgttatttattataataatatgaggtgggtggggtgttgttttttatgttatttattataataatatgaagtgggggagttgttgttttaatgttaaagcaactttccattcctgggaaaaatccgtcttgatcacattgtgaaattctttttacttgttgctggatttagtttgctaaagtactattggcctcatagaatgacttggaaattgtttcctcatttgcttactgaatgagtttgttaaggattattattatttcttctttaaatacttggcagagtgtatcagtgaaaccctctggacttggacttttctttgtggaaaaattttatattacctagttcagtttctttactttttataagtctattcagattgtctatttcttcttgaagttctttttggtagtcattgcctttctaggaacttgtaaatttaatttttctaattagtgggcgtaaagttgttcataacattctcttgtgatctaattcctttaaatttcctcttcctttagtgttctgtagtttcagttgtaatattccttctttcattcttgattggtcatttctgtcttctgtcttttttcttcttcgttgttctagctaaatatttgttaccttcttcaaagtgcatgtatgtgtgtgtgtttatgttgggttgtgtgtggtgggtggtgcttcaggggccagaacaccacacattcccactgtttttaatgttcttatgcaaatttgattattagaagagttggagatatgcaaactgaaccttctagaatgactcttaactcactctcagtatacgtaagctaggagaactgttctttctttcttggccattggaactgttgtgatcaacgtttgttgagatcgagaatgtgatgccatggctgtaatcaaaggatcaaaaattcactgtaattgccacagagccgcagactctgtagcagacactgtaattgccacagtattgcatctgttccagagaacatccacatctttacagtgatgcttgcaacagatatttccaacgcagaatgaccacagaattccaacctttcaaatcatacataagtgcatcccattgtgaaatctgattcacatctagaagcatagctacatgagaatctgggcaatatagtttttactttccatcttccattggctgtaaattctataaggtgctgggaacggatactaaatgtcatctgccccatccttcataatgctgaatagttgatgtgagttaaggacttacttttcctgg

SEQ ID NO: 33634 - DNA, 1686 bp, Bovine  19866880391081
aaccgctggagggatgggattcgtggaactttttaatgttactgtctgattggggaaaaagaaaaccagaacatcactgtagaaacaagcaaagagctgccgcaaagaagagaggattaggctattcattaattccacaggaagggctaagaccttgggagaggttagtgagaggcagattctagccccaagtagcatatcctgcctcaagacatggtgagctccgtcactggaggtgttcaagaaacaacctttctaaaatatcagacaaatttcaaaatgaaaaataaatttgaggagactccaaatccaattgagatttttttaatggagttgaaggaatggatggataagtgtggaaacggagggagacttgagcacagggatttcttgttattttttcagagttccaagtctctgtcctctggttcttcccaactttcagaaagcatggggctccagaaggattaagacagtgtgcccatgccagggccctgagggaagatgaactgagggaagactggggcctcttaagcatctgtgaatctgtcaagaaaaaaaaaaaggtcacccaagagataagaaaaatactccaaatcattcccagactgaatatttaacaaaattgggttttgattttttttaataaggcatcagtggctctttttaagcaacaaagagactgttttatgcaaatttcccctcagggctttcattaagatgttaacatctttcttgtcacaatatctactttagtacaatgaatcataggacttctctattctcttgctgagatatctttgtaagataaactctctggactgagagcaaggcctttttctttttttaagtgaaaaagttgagagttctaaggaaagggttgggagacagaagattaaatgtaaaaaaaaaaagaaaaaatggcctctggtgtgggcgacactcctctagtgtgggctactgggcacaaaagctgttttgtcctccatatcttgtaggcaagactccagcatccatgaccttccctgacttccaaagggcagatttgaatagttcctagtcaaggaaggagcagccaagaaaccacctgaaccaagatttaaagggaccagagaagatcatcaaggtcaggaaaggagatgagcgtgctctgcacacatcctatcttgtcatcagcctcacccttgaactattgctataaaagtaaacttagtgaaagtgtccgtcactcagtcctgtaaggctgtttgtgaccccatggactgtagcccaccaggctcctgtgtccctggaatcaggaaagaatactggagtgggtagccattcccttctccagggatcctccccacccagggattgaactcggtctcgtgcattgcaggcagattctttatcgtcttagccaccagggaggccctcatcaaatccttccaagagaggacacagagttttcgagggtggaagtcagctatgtccccttttgcctggcaaagctataaagctatttttttatgtttcacccgaaactctgtctctgagattcaattcagcactggtgcacagaggtgaagcttttgacatcaagaccagcggggaaatctggacaccattctgatgaagaaaatgggctggcttgcactgaggtcaggttcaactcccacggacatcaagacttgtgtctctgag

SEQ ID NO: 33635 - DNA, 939 bp, Bovine  19866880396449
tttccccttccttcactatctcccagagtttgctcagactcatgtccattgagtcaatgatgccatccaaccagctcatcctctgtcgcccccatctcctcctgccctcaatctttcccagcatcagggtcttgtccaatgaattggctcttcccagaagcccactaggctcctctgtccatggaatttcccaggcaagaatactggagtgggttgccatttcctcctccagtggatcttcccaacccagggatcaaacccacgtctcctgcactggcaggcagattccttaccactgagccacctgggatgccctcgtgtcccccttggagggaaagaaatggaagtaagggattagattgaataggagtctggtgataagaaagcaaatcatagaaaagcacatatcctgagtaagtggttccaccttccctgaagttctgagtggatggtaaaaaaagaaaaagaaaaatgtttgcatgccccaggagtatttgcaaatccaagccactagctagtctatttcaaccccctcagcttgttgtacccactgttctcacagatcccatttatcctccagaagagaggacaaagaggaagtcataaacccgctctcaaatggtgcttttaaaagggctctttgagaagattccataatgacctgttgtcccttaatctatggctcggttctgggactggattttgaaagtataaatgtgattaaagattgcttggtttggcactgaactcattggcaacccttggttcttcacatttgtctttgaaataacagcttcactgtgcagagagctgctggcttcccaggtgggagggcataggtgctgggtgtcttacatactccatgagtagtggagtggggatctggtagatgaagggtagggggattaaactattactggggattttgctttgcatttt

SEQ ID NO: 33636 - DNA, 1601 bp, Bovine  19866880454545
gagagtctgagggcatgaaacagcgcaacctgtgtgaacaggaccaagagtagtgagcagtcacgttggcctagctccctggggctctgggcaggggtgtggcgacagagttgctcacagggacagacagagcactgtgagatcccaaggccaacaggcagaggcttttctccacatctccatattaaaagggagacacagagtggacgttaaaagggggacagattcccagccttggaaataataataatttttttttaaatgtttatttctcctagccttttccaggtaccagcaggcctgtcctcaaccctggggccatgtgagaaacaggaacaaaatcccagcttccagtcacatgacaatttgccctggatggtggcaacccactccagtattcttgcctgggaaattccattggcagaaggggtcccaaagagttaggcacgactgagcacagatgcaggaaggcagacaccctacagagaggacagagcacttttcttagcctttccctgtgcctcatttcctaaaaatcagatttctgtaatatcagacaagagaggcccctttttaaataagccacatttctggatcctattttaaataagccactccccaaatccatatgtcagaattatgttaccagaggagggatctttatagtatttggataaaacccatccatgaaatctcattctgaatgttatctgggaaaaagagaccaaagagatatagggataaagggatacagtggaaatcaaaggcatctcaagaatttgtatttattcctgaagaggctgaatgcaaagctatgttctagcttaaatgagcataattcactgattgcttaagacctctgggtacattgacaaccatctgaacacagatttaatcactgctgtgttgtgggaatgaagaactgccacgggtgaaatttaaaagtgggttattaagcaagagaaatgttggcaacattagtaatcggtgcaattaccaaaaacatgacctaaagccagtagcatcttctccccgctaatgatcccagcagtgatctctgccaggcagcagtaaggcacatcagggtggagtaagagcccaaggggtccgtatctcacctcacgtgtgaaatgtacaagagtctccattgcccaggatttcagttcagttcagttcagttcagtcgctcagtcatgtccgactctttgccaccccattaactgtagcactccaggcctccctgaccatcaccaactcctggagtttacccaaactcatgtccattgagtcactgaaggcatctaaccatctcatcctctgttgtccccttctcctcctgccttcaatctttcccaacatcagggtcttttcaaatgagtcagctcttcgcatcaggtggccaaaatattgcagtttcagctttgacatcagtccttccaatgaacacccaggactgatttcctttaggatggactgattggatctccttgcagttcaagggactctcaagagtcttctccaacaccacagttcaaaagcatcaattcttcggtgctcagctttctttatagtccaactctcacatccatacatgactactg

SEQ ID NO: 33637 - DNA, 793 bp, Bovine  19866880490293
cacacacacactcttccagaggccagcccatccacttggccgctcccaccgccccaggcttctggagcgggaggtctgagatcagctgggccaccccaggatgggaggaagggaaaagggaggagagaacgctgcatcagacccaaaatcaagtctttaaatatacactgctgaatagctgggctaagcatcagccagggtgacatgacaacactctccaaatatttagaatgtgtgagtcctcaggaaggggaattgtttttttttgtctgaaatgaggaggtggggctgggggagcggctgctgacgagcaatggcacaggattcagaaggagaaggaactcgaatgtcggcccagaacccttttctctggctctgcctcagtttctccctcgtaaagtcggggctgaatgttctctgaggtcagcccaactctggaaaaaaattaaggcttttacatctgacatccaggtgccacctgtccctcaggggaaacagagaaaagaatggtccctgaggaatccccattgccccgagggttccagacctcaggtgtcacagccaccactgaagtgtttcctgtttttcctggctctcctacggcacaggctgtgtgagctggaatgttacctaggactgcaggtgagggaattcacctaaagagggagcaggtaggatggggagatggtgagagctttccgtaagggtttcgtcctggttctggaaaggccattgcctaaagcccagttttccgaactgagacccactgatcgcaagcccagggccccagcct

SEQ ID NO: 33638 - DNA, 2106 bp, Bovine  19866880570946
ttgtacagtgaccctcaatctaatattctttcaactttatcttaatggctttcccaactaagaagaaattttaacatggagtgagagcctggactcctcatgcaccagtgggagaacagtagtgcagggcttaggagggagcttgtggggcaaaaatgcagaatctgggccccatagacccatggagttactctgcactttcacgggatccccaagtgactcctctacatattaaagtaggagaagcactgatcccaggaccttcaggcctgtctcccaattccaagactgtgacttcacttgccagactagaggctccagaacacaggtatctggcagtcaatctacagtgcagcacagtgagctctctgtaacacaaaagatgtgaaatcaattttgtttactgacagcctgattaaacactcctaccccttaattatttttgtcttctaaaaatggcaagtcaagcggctcaccttccagggaaattttcaaaggaagacacactaggggtgactccaaatcaccctttgcggctattacatcttccatgtgcgctaaatggcccggcactgggaccccacggtgcaggtcaggaggcgcccgcggtgagaagaataaatacaggtgcctcacagaccctgttctcagcgccactccacccactgacgccagcacagtggctcaggcgattctcagactgacgtgccacctctggggtgtcacccagccagctttctttgtactctaaagaaagggagtccctggaaacactgatttgaggacccttgagcaccatccttcctccagatcagcagactggaagaagggcatctttggcaaaagaccgggcagcctggaccgagcctcttggtagatgaggggggcgggaaacgaaaacagagagggaggcggtgtctggctagctcatgctgaattgaggtaaagggtcagaaatacacttgctataatcctacctctaggcacagcaggtgcgtgcgcacgcagagtgcttactgaaaaagagcttccaggaaaaaaaaaaaatcctatatgaatggcagcgtgtgcgccgcagtcccggaagatttcgggtttgaatttggatgcacctgcccaatacacacagataaacatctggagccgttaaatgttctgcatttcagggctgttctggatcaatcccaaatgagggtgtcgcttttttctttcttcttgggagtaaaaacacgcttgaaagatgtagactcctttggatctgctctcatttaaaaagcacagttatccctaaagtgttcagttctctaccacagacagtttcctgctcaaatatagtaattcaaaatatacatccagaattcttagcatctgctctgtacagagcaacatattttgacattccaggaaagtttttttaaaaaaataaggcaggaaaggaaaaaaaaaaaggaaaaaggaaggaaagaagagaggattaaaatatatattctctgagaataatttcctctctgaaaggctaataatatatcaactttaatatttacattgacaggttcttatttggctaattgacagtctctgtatttttagtagagggccattggcaaaagtaggtgaaaacaattagtaatgcattcattatagatcaacttactgaaaaaggttaatagctccttgttttgaatgagatgtctactaaagcttctgtgatatgtgtttttcctttgtacagtgcaatttaaaaagttagtcaatgaaagaataattgaatgttcacgtttgtatggaaatttcttgagtgtctacaggaatgtttgaatttcatttaccctgcctttcactcaggttgataatgtctaggctcagttaacacttggctttctgatcattttaattaaggtacaaataataatccttcaccaaagatatcggacagaaccatttcttaaactacaataaaccacccaatagaaaaaagcaacagataggaacaggcaacacacaaaaagagaaaattcagctggctaataaacatatgaaaagacagtccctctcgcgtccgattctgtgcgaccccatagacagcagcccaccaggctcccccgt

SEQ ID NO: 33639 - DNA, 1257 bp, Bovine  19866880664528
cccccacccccaaccacccacacacatatactttctttattccaaaggggagctggaccaaagcccagaagaggttccatgaaccttttttttaattctcctgagtcatccagcatatctcttcttaagcttaataataagaagaggaaagaaaattcagcttgaggaaggagcaaaccatcagcgggaggcagtgcttatttcccgtgccatggaggtgagcaggcagcagcctagcacttctggatgaaatgcctgaagtgactgcggggcaggcagccccaagggcacccccagaagacaagtggggaagtgtcagggcccaaggttcccataggccaggcggaaagggatagtgcccttaaacaacagtggtattaagagggtttgactgcaatctagaaagcagtgaaaagatatctttaaaatccatcttatgccctaccatcaaaaaccaaattatctggtatcaagagcaactaattagatagaaagtacagacaagcaaaggggtgggcggtagagtgagaaatccagggcagaaagaacatgccagtcaacaggtgggacagagaaagagcaggttaaacagaatgtacaaaaagggcccaggagagaaaacaaggtgtttgaacagagctgggctgtgggatgggggtggaaacagcactggcttccttagcaagcgtggctgggggcgtcagctctcctggcagatcagctgacagggacccccgagccttcaggatgatggactgcgtcctctgtttctccagctctgggactctgtgccttggggaagggctgtctcagggccacagtatcccgtgatgggagacacgagtgtgacactcccgacactccccttgggaatggaagtagaaatgacagttataaaaaatgaaaaaaaaattatttttgtttctctcccaccccaagtccctatgtctaacaattggatcacccatttctcaaacatgctggaagccaggtgtcttctcagttctgaggcttggagagtggacgaaatatgcaacctgaagctagatttttaagtctgctcctccaaagagctcacattccaaatctgtcactaactattttttgtcttataaattgcttatgttgtaagaggctcagggctccaaacaagtgaagagagcactgcgtatgtaattcaggcagagccccaagccaggagcttgccactcttaactgagagaacacaggggctctgagcattactatgtgtacgtt

SEQ ID NO: 33640 - DNA, 1019 bp, Bovine  19866880698277
tggtttcttttgcggaggagagcacatgtcttaagacaggaaattaccctggtgattgatgtctagaaaatgcaattaggtcctagttaagcattctccaaggggcacccttccagtgtggcattccaagtttggtgatcacttaatgaccatgcatttgggtcctccgggtaatgaagcatttgtctctgtcaggctttgagcaacggaacttccagtgcccttatgatgcagaagaggtggggatggaaggtagagcagggaagaggcagagcatatgctggataggggacctcagaacaagaacagccagcttggccaaggacgtgccatggttatgggcttccctggcagctccatggtaaagaatccacctgccaaggtagaagatgtgagttttatccctgggtcaggaagatcccctggagaaggaaatggcaacccactccagtattcttgcctgggaaatcccatggacagaggaacctggttggttacagtacatggggtcacagaagagtcagacacaacttagcaactaaacaacaactaccgagtgaggttgcaacatgagttgaggggcaccggttgccttcaatggctgtaattctataatatttgtatttgctaatcaattcactgcttggaatttttttttttttcaattttttgaccaggagggccccctacagtggaagtacagagtcttaatcactggaacaccagagaagtccctggaatattattctttaattccattaccctggggactttggaggaataaataaagtgaccctgcccctgcccttgaggtatttgcactgtagtagggaagatcaaacacaccttatcaaccttccaggcaacaaatttccatttggctcgggtgtggggggaagggcacacaaacacaggaggtagtgcattcaatatggacccactggggcaactgaggcaaggtaaagacggtcaggtacatcctgcttttctgaactcaaatcggctctgccacttaaaag

SEQ ID NO: 33641 - DNA, 1357 bp, Bovine  19866880707387
gtcccctaaggcaccacttcttttccaactgtattgtacttgttatggacacatgttatcttccggactagactgaatgtttcttgtggacagaattctcatcagatgaatcttttggcacccagcacactgtcttacaattcttacagaactcaggagacattgtctgaaagaacaggaattgatgtgaagaacagtataacatggaagggtcatcagtgatggagttaaggttcaaactgaactccaggacttgtatctgctaggcagacaagcataagttaacctctttgcaaccctcttttctcatctgtaaaattgaaatagtactaattaacaattttgtgagattttcctaaggtaagtgaggtattatacttagagggattgtgaacatttcaaacacactgcagccaattatggagaaggcaatggcaccccactccagtactcgtgcctggcaaatcctatggatggaagagcctggtaggctgcagtccatgggctcactaagattcagacatgactgagcgacttcactttcacctctcactttcatgcattggagaaggaaatggcaacccactccagtgttcttgcctggagaatcccagggatgggggagcctggtgggctgccgtctctggggtcgcacagagtcggccacgactgaagtgacttagcagcagcagcagccaattaactaaaactgattgctgtagagctcagtcagctctatagtcagagaaaagatggcagaagccctcatcccagccacgatgcctccctgggaagtgccaaggagctttgctgtctgcacaagctttcccttaggtaacagctcactctgaagttttagaagcctttgtcattcctattttcaagaaatcttctgaagtcttattactctcttacaagtgaatctaatcagtaaactttctgagagtacacagtgctatggaaatgtactgtatgataaagatgacactagagatcagtggggagatggtagattgcttagaagatggtgctgaaaaaccagccaatttcaggaacttatttaactcagacatttgctgcagatatctttctggagaaaaacacaaccgggttcctttaagtgagcatcacatacatagcacaatgtgcacagattaaagaagcaaatgctgtgattgacagaaggttagtagaagaagatgcaagagaatcactttgtgaccttggggtggggagagactgcttaaatgaaacttcaaaagcctaaagcataatgtaaaaaaagttgaatttgattgaaaactaaggatttatggacaatgtggataaatttgacagatgatatggaaggaaatat

SEQ ID NO: 33642 - DNA, 2233 bp, Bovine  19866880764194
atagaatactgctgctgctgctgctgctaagtcgcttcagtcatgtcctactctgtgcgaccccatagacatcagcccaccaggcttccccgtccctgggattctccaagcaagaacactggagtgggttgccatttccttcttcaatgcatgaaagtgaaaagtgaaagggaagtcgctcagtcgtgtccgtctttagcgaccccatggactgcagcctatcaggctcctttccaggcaagagtactggagtggggtaccattgccttctccccatggatattacctttctcaattttcacaaaatgttaaaagctaccatgttcctcatcttagagtcagggaaacagagattcaggaaggttaagtgagctcaccaagagtgtagagctgggcagaaccaggatcaaagctcaagtccactgtcttcagaactgatacaatttctccctgactctgtgtcctcctgcctatgggtggttggctcaagcttgggatggattctcatccctgaataacctcattcagagcttggggttcgcatttcccctgagttgcgcctctcagccccaatgcaagaactaaacacacctctaaccaagcctgcattggggtgcccaggtctcctggtgcccagtccccctaccctgggataaacctgtctcttggcttggtgggccactgtgtcaggaacatcgagggtcggttctaaggcactgcacagccctcttgctcctttggctgatattctgccactgtctccatctctgacctcacagcagggtaggcttaagctacactgaacttccctttggctccagccaatactactgcatcccttgaaatcttctggtggtcctggctgccccagtgttcaatttatgtcctcacagctgaacaagaaccctaagtaggagcaaattgagctttactgcattttcctaccatattcctcccagctggaccaagcatttgagaatccatcacaggaattttattttgcatggtggcagattcgagttaaaagaagtggcccacaagtgaatgggtagttttaactgtggcccagataatccacaaagtggataaaccacaaagtgaatgaggcttttatgggtacatgagaattgacaccaccttgtgagatcggatgaaggaaaatccatttaagaaaactcacttgcatggagctggattcttttctcatcctgaaagagttagatgtggctttgttgaaaatacagaagaactccccaaaggagtggtagtggaagaattgacagcactaagcccccgagagaaatggtgactgatctgatcttatttttaaactcatctttgtgattcaaaccaaccttgtgagagctatgattctccagtctttgcatctctctagccaccaggaacttgcgtagtttctgagtgatgctcagcacaacatggtaatttagtacacagagttcctgggtatgaatcttggctttgccatttattatgtgtcttctggcactttaaacaatctctttgtgtcttaattttttcatctgtaaaatggggacaataatagtacctccctcaaaaggtagttgtatagatttagtaagtttctgtgtgtggagtacttagatcaattgcctggcaatcatgtttataaagtagatgttagtgattatcatgctacaaaaaaatagacatgaaactatttttggctctatctggtgacttaggaaactcaggctgttagagcctaacatgctggtagccgatttccagtaaccactccatggttgctacttggcaggcttggtcaggccagtggctgagcttaactccagggaggagacctagtgcttcaaaaatgaaagagctgtttaccctttctagcaggcttttgcctttggcaaatagtccccttagcaacatttgaccttaagaacttagcaggaaaagggtaaaacatttcaaggaacaggagctgggtctcctcccaggtgtcatgtcacagcagggcaaggggatgtcaggtgggaccccctggccactctgtcaaatgtagctgcctaaggtccccaggaacctgcctgggaagtgtggaagctgtagaaggacgtgtgtgtgtgcagagagagagagaaaactctgaactggtccagtctcctccactccagctgcagtgaagaggtactggtggagcagagagagctgggaggtgacccctatggagttggaggga

SEQ ID NO: 33643 - DNA, 1068 bp, Bovine  19866880820011
agttcttgcttaatggagggctttaggaaatttattcctgtttacacataattcctcacctgtaaatactttcatccatgtggattctagatcatttcataaattaataacttggccatatggaagctcccaaaataaccagagtgcccagtgagtctgattatcacagactatgccccatctcataaactagcattgtgaaaggagtgtcctcagaatatggcaacaggaaaggggaatatttcagagtgggtggagctctgggaagtccgctgagttagagaggggtcccttgcctaaggggtcccttgactcttcgctttcttccatcttaaggacagtgaaatgctgtctccattattaccattgactttgttccagcctcggggtaagattcagctttcatcccaaacttgaccttttctggtttccactcttctccccttcaacccatgttgtcaactgtgatcgactcaagacatcacctctctcggaaagcagaggagcacgacccatttggcaattctttggcctaaattcactttccctcctatatctcttcccgcctcctactagctggctggaccgcccttgccaacggccccgcggagcccccctccctacctgctgagcagtcagggccctggaagccctcttcacagaggcacagcccctcctggcagtgtcctcggccgctgcaggcatttggacaccgccgctggccgcagtcctcaccgacgtagccttcctggcacaggcaggtaccgttggcacagatccccttccccgaacagtccccggggcacctcagctcgctgcagtcctcgcccgtgtaggcctcttcgcagacgcattccccgtccacgcacagcccccgggagctgcagtcggttgggcaccggagttctgagcagtcgtccccgctgtactcgctgtcacagacgcactggccgtccacacacacgccccgactggagcagcccagggggcagtagggctccgagcagttcttgccaaaccagccttgatcgcagatgcacccacaggactccaggctaaagttgccat

SEQ ID NO: 33644 - DNA, 3144 bp, Bovine  19866880861266
atgcttcctattcctctccttcccccatctaactaactgctcatccttcacagctcagctccagggtcacttaaaaggtttcccagaatttgtctcatttggtgactgtttgctgtgatctttttaggattctacgcgtatctccggccctaggctttatcatgcaataactagagtggttaatttatctgtccagcatgaatcaaacaaacttattaaacgaacaccatagcagtacttgcttggcatccttctcggcacttggccttggggataggaagtcaagtaagttatgtccttgtttaattttgccacttcatgcaccccctccccccatggcctgaaaggatactatactgacattggttaacatagatcttccttatagatcttttcacatcttcccagggaacctggtgggaagctggttaaaaaaaaaaaaaaaaaaaaaaagcccacttacagaagccaccagcttcccaggcattgaagacccatgtccatggacacctgtgtctttcctgtattccccaactccactgaaaaagtgaactcactgaggaaggagagtttgaacacctggactttgtcctcagtttcagattgtttatagttttggttataaggaggaagaggtgagaaaacccaagaaatatttctcttctcaaagactacccccagtcttggtgtctcagaatgaatgtgttggacatctctctggacatgtgggccatttctccctattaaaatgcaattcctgacacctctttcatccttgggcaagtcttgagatattagaccctagagaggtaagagcttgaacccaagatagtaagacacagtccttttctcattacagactgaatcaaatgggtagaaggtactgttttgggtgagagaagctgggcacaaaagggaacacactttctgctcatggggatctgctgataataactactgaatatgaagtgcctaccagaggccgggctttcatctgagtggaggtttttatatttaatagctccttgttgttctagtctgttgaggggaaaaggaacgcatgggttaagcaacttgttcaagtcacaggctagcaaatagcagagataggacatgaagtcaggaagtctggccctgaagatgagctgacttctcccagagaggtcaagagtcattcataagtgttagtagttaggatgtgggtgaggctagatatccaagttccggattggattggggagaggcttgtaagaagctctgtgagtgcgtgtgcacgcacatgcatgcacagccccgtgttttggtggagggggcaggggctgaaacttccagcttgccagagaagatggggccaggtcctctgaggttttaatgactgtaattttctcagactggagaaaggctgagatggagtgaacagagcgcctgcattctctagtccctccagttaacatggatagatatcaattcaacagcctgtgaaaaccaaagatgaatgaagacagacatcaaattccctgcttgccacagcagttgctgtgctgaaccgatgtaccattccctgactcatcccccccaaattaggttaatgtatttcagactggctaagcgctgtagagagtccctatgccgaatcccctggggaaggaccatacttagatcttagaggcatattaacagacagctgcagaccagggcacttttttttttcccctctgtgtgaagaggtgccagatttctcaggcactggtgtaatcacccagattccctctccccatctgctcagtgccctccctcccctgcggagactggctgtaagctccagaactctacctgtggccgcactctctgggcagcagttgctggtacattggtcccgcagcacagacacctccctctccagcatctcaattcggctcagcagctcctgtagcacctgggccgagctggcacacgggcaggccttcttggggaggttgatcctgtgcgtgaaggtgacctggctctcgtggtctgaggtctggcccgtgtactccgtcagcacctcgtcttcggtgctcacctcatgctcggccgaggcctccagccctgaggagcagaggctatccaggggcacgttgatgttgtacacgtggttgaagaccaccggctgctccttgccagatgcgttgtagctggcagcgcctccttcctcctccaccgctggtctctggacccttcccatggtgacctccagctgacactccgagggctcgagcaaggagcccagaaggatcaggttgatgccaatgagcacgttcttcaagaccactgtctccctgtctgcccccatcctctcagtagagctccgggttcaagactagcctgcagcagaaagcatggaatatgcaagagaaaccaggggatgaacgagatggcctctgagacctgcccctgggcacagtgcagtgcacagtcccacaaaactaaaggatagcagtgaagctttttaaggggatgtttgggaagtgactaccagggtcatgaaagcccagggccttttgtcttctagagaaatccctgagaatggacgctgcttctgcagtaaggcattttgattttccaaaaggtttatctagaacgtatgagtctggcccctcattgggcaggtggttccaacaaagaggacctgcaaggactcgagacaggggctctgtggttaggagaactcagagcttcatttcacttctgggtgagaattaggatgctgggtaccatgaagacaggcataccctcatatttccccagatgtgtattaggatggggccccgccagccacttcaaaataacttgtaaactcaaatacaagttgactttagaataaccaagcaggcagataatcttgttccaggtaattgtgggttgttaataatccttgggtacatttgtgattatctggaactgtgtaagctgaacttttttttaatcttctcattagtacagtcccagtgcttcgtgaccgcagggtgcctttcttccgaggtcctgtttgaattgctaaaataatgaattagctcctctgctggttacctagtcaccaagaaccaggaagcatgataaatttactacaatgcaaatcagttttacagaaattatatttctttt

SEQ ID NO: 33645 - DNA, 1105 bp, Bovine  19866880938605
tgcagttggtatcaaatgcagaaatgctgaaaatgtttaggctaaagcctgtaagttaaacactgatttgggctccctccttccaaactctcagggttactaggaccttcatggttccttgcagggacaaatcagtgaaaatttttgaggaatgaggctagaaaaaggcaggagacaaattacttttgtttattccctgatttctttacccgtctccctacctgctttcccctcccagtgggcagaggggctcagaggactgtggctataatctcagctctcttggctactttgggggatttacagggaaatcagtacttggcaacttgtatttttcactgcctggcccgaactccagacatgagcccctttctcttatttgaacaacattcatatgtaaggaatagatgtcctgggagagatctctgcatcctggtcctctcccatgttggggctgcttgggcagcagtgacatctctgtgttagacgcagcagacatcatggcttacaaaaaatgtcagccagggaagtgctgccctgccaaccctctgtccccacccgtgccctctctgttgctgaactcacaccacggccacacagagcaaggtttagaatccatacgagctaccgttaacacacagacttccctttcctatcattccaacctcaaagacactccaggccctaggaattcccagctaccctaagcaagtcaccgtgatcttgaaggagctgttacctggggctcggcagctggaacccaccccagtggtctctagactgttgttctgagaaatcacaaacaccaaatcctccagtccctccaaatttgagtttgttgttttaacctttaacagccttttcaggtaaaaaataacaaagatcgatttactcactttgtagctacactgtgcctggaaaagcatttacttaaagactagaaagactagatggaagaaaggaaaaaaacaagaacacatggagtacatactcctcaggtgttaagtgagctaaaataaaaataaatacagacagaggaagggagaggacaaaccaacttcccccatccttccatggcactgtagctcaaagactggaatctctg

SEQ ID NO: 33646 - DNA, 763 bp, Bovine  19866881032141
tgagaggctctcactgctcccaaaccagcctgcagcctgacccactgtgcttccaccacttgctgtgggaaggagaaagcatgatctcatagagctcagactatattcctttacacattcgttcagggcctgtggaaccaaagacactcgagcagccacagataaaatgataccatctgataagcagcaaagaggaaaacttattatccacacagctgcatctgatggcccaaaggcagaaatggatcagatgggggacattcttgattgatttgtaaaaataatagaaccgagtgtcacatggaggccatctacctgactagactcatagggctgcacctgctgttctcctcagcaccactgtacctctgcgcttctgtcccttcaagcttgaagccagttccctgcctttgtccctgtagtcacccattggcaggatgtctgtactgtccagtgtggtctttttgttgtttctttgtttgctttcgggggtggacggtggtgtgctgcatggcatatgggatcttagttccccaataagggatggaccccatgcttctggctttggaagtgcagtatcctgaccaatggacctccaaggaagtccctgttgatgtggccttcttgaaagccagcctcacccaggcaaagagatgtgtgtctgggacaattttttgaaagagacctgttgctagtctgtctgcctgggagtatccatattcttttccactaatatttattgagtgcctactatgtgtcacgt

SEQ ID NO: 33647 - DNA, 1404 bp, Bovine  19866881035500
tagatgtttttctggaactctcttgctttttccatgatccagtggatgtggcaatttggtctctggttcctctgccttttctaaaaccagcttgaacatcaggaagttcacggttcacatattgctgaagcctggcttggagaattttgagcattactttactagcgtgtgagatgagtacaattgtgtggtagtttgagctggatatataatccttcagtagaattttgaccttaaatatttgctacttccttgcaaagctctgagattgaatgaaagaaaactaatgatgtaaagcgaactctctgaagaggaaaaaaataacaataaataacagttttctttagaaacccacattatacctccaagttttttgaaatggagatgtggcagttgagatggaaagggaaacacaaactccttattttaaagccataaacatatttcttccctccccgtctctgtttcaggtggccgtatcatcattactgcacagaccaggtctctttgggcattaggattaaagaacgtgtggaaaagagaaaacaccgaggacgccatcactaaaggtaccgttttctgtgaacctttaaccatccatcattacaatggccagtctgaggctttcagttgtgactgcgtatgtgtattcccgggatttgagactctttgtcactgcaacaacagcctcagggacagactccctgccatgaggtggtcaagagcaccagctcccctgggctttatgctacctcagaaaaagctggagaaactgggcaccaaggttctgacatcttaggggatatttcagaaatgcatttcaaacatagttggtcataaaagtgtgcgactgcacacagcccctccaagaggctagacttgctccccaacctagccatgcatactttgagcctgcaggaatcagtgctaaattattcaccagcctgactctaaaattttggagttccaaaacctctaataaagtattatgaaagaatatccatctctttatctctatccataactatttatatagcttagaggaaaaatctgtcgttttatttcttttaatttaaaagctttcctaattcctttttcataccacatatatatgtctaaagaattttcaggttgaaataataacctctaaaaaatggtccatgggagaaggctctcaggattcacagagttgacaggcacgatgaatatttcgctcctttaataacttttcttggcactcagacttggtactccgaactggaaacttttcaaagaggggtggcttttttttttttttttattatacaaaacaatgacaatatacccacttgccttctctcctctattcgttcacaaaactgctaaggtttgttcaggaaaaactcatttcattcctcagattca

SEQ ID NO: 33648 - DNA, 1149 bp, Bovine  19866881077180
ctctctctctgtctctaaatacctatatacacaaacacatgatgcggttccagccattcttacccactcaggtgtctgcatgtccctacaatatggtttttcctactgccaaagtttttaacatgttcctctctgcagtgtcagccagaagaactgctactgggagtgtgtgagatgaccccgagggggccaaggacacgtttgctgctggccatcagcagtttattgttcaggtaataaatgtgctgccctccccttccaggctccctcgctgatagctccaggactgtagggcttccctcacacttattttgattactgctgcctgtcacattgtttcttcttcttgaccttggtgcctgtcagaccattcacaccccctaactgtctttacctgccacttgtccgtcttcaccgaaagcctggtttctctgattactcaggccctaacagcttctcgtggagttacttgactcttctcagaagtgaaggagtgctgtgtggccttctttgccactggacttgatgaaggttgtcggctgtgagtcggatcatagaccgtcctctccagagggccaccttagggagcttttagagaggggtcatggcctaagtgggggggaagctgccttgaagacaacatctttctgactttcctgcattttcatttactggctttctgagcttgagcaagccatgtggctgctctcagtctcagtgttcttatctgttaagtgggaattatttatagtaagaatcaagtctatgtaaaaatactgctatgtccaaacgaatcttctaggtagagctctcagctttttagaggggtttaagaattgtgtgctggcctccccggtggctcagcggtaaagaatccacctgcaatgcaggagccacaggagatgtgggtttaatccctgggtcaggaagatcccctggagaagggaatggcaacccactccaggattcttgcctggaaaaccccatggacagaggagtctggtgggctacagttcatagggttgcaaagagtcggatacaactgaagtgacttagcacacacgcaagaattgtgtgctacatagagaacacacctgggctgccaagggggaagagaagcaggggagggaggattggagttggcattag

SEQ ID NO: 33649 - DNA, 1704 bp, Bovine  19866881089949
caattgctggagttacaaagaagatcaaagtctatgaatatggcacagtcattcaggatgcggtggatattcattaccctgaaaatgaaatgacctgcaattccaaaatcaggtatttacattatttacttggcataatgtagtgtgtatgtagcagtatctgtgattagtttgtttgttatttttaccttttcatgtgacatcttattcgttcgagataaacattattaattatatatagaagatacatcagaatatcttttttatagatattgatcactttttccctgtgggggttagtagtttttctatttttctatttgccaaatgaaaatcttctttcattcaatcaaataaatgtctctactgtagatgatgtttcatggattactatatgcccagtgaatagtatctcaaagtctggaatttttcctctagcatgcacatatctctaactattgtaattgtttataattttaagaattcttttcacaagaatggtatgtgtctttttgtgagggcataatgtttaagtttcatgtattaagggttagagtttatagcgagtgctttttaaacctggagtactgttcaaactgcagaaactagacccaacttctgatctgcccccacaaaatctaaaaggaatgctagaatcttcatgtttaaaacaaacttcctaagctattttcataggcactggcttcaaagggagtgacatcaagaaactaatagtaaatttgtttaaaacttcgaacattttctagtcattcttatcccttttttatttggatgaatgacacataatatatatggtcactttaataatgttaataatatagcaagtactgtagtctttatttgtataactttcttttctgtttcctaattcatataaaaatggtagactgatataactggtgctcatcattgagaatgtataatggttatctacttagtttatatactttattcctaagtgaaaagaatgcagcatgagtgagacataattttattgaattcttcagtggcaggcattatcataagttctgtgtcttatgcagaccatcattaccctgttttatacacaagaaagctgaagcacagaaagggttcattaacttgttgatggttgtacagctcgtctctggagtagccaagattcaaacagaatcttgctcttaaccgtatcatgctactaatttgtaaaatagaggctctaatagtaatacctatttcataggattatacgggggaataaatccacatgatgcactcagcacaatacttgacccatatcaagaattcataataaatgttaccataatgaaaatatggattagagggtttaccttgtctgtcttgacagatataaagcaatgtggtagtattttatgcaccttggaataaagagaaggaaactgttcaaatctggaaacaatggacttggggctgaaaggggggggatgtaagcttccctgaaacccatttggagcacaccagttgtgaaagtgaactgaattacccaaagccacaactagtaagttgcagatctggaatttaagctcaggtctgactaaatccaaggctcttgactgttccatgtaatttctcccagaaattctaataagtacatctaaagttgcaaataaactcttcaaagcctaaaatgtagcacgagtacagctagaagacagcaaaaag

SEQ ID NO: 33650 - DNA, 1295 bp, Bovine  19866881130826
tttaaattaatgattgtgtgtaaagtatgggtagtgctttctatgacacttcttgactgtatgataatagtgttattggtcttatactttagatattcctgagtatattgggaaagcaggagtaatacactgtattccatgaaaataatcccaaaggattccatgaaagcttaagtgcatttaaaaaaaaaatcaatttctaggttttttcttcctgtggtaaaacactcgtgtgtgtgtggtatgtgcatgcctgtacgctgtcaaaattcagacccagtcacacagctggtagtagcccgtttctcacaaaagggaccatattgcttataatcctactgccaaacaatgagtattttttaaggccacttgcctcattctttcgggtccaaatgaaatctccaagcaacacaaatgaaccacagtgtccaggaaaatagagataagtccattaatagaaacaaacattaggtttgtttgagtaaaaagaaatcaaagatacatgttagctatttcctgatgaattaatgacatgatttaggagaggaaggtggcttcagagatgcttgggaacctgggagaactgagtggatggctgatattgggaggaactgatacttagacacacttatgtggtgatgcctccagtcccagggcatgggcttttggatttgttttgtcttccctgcagaggtcaaaaattgaactgggccagctacactatcttttcctgttctcttcatgtccaaggacacccatctaagagaatattggccccgattcaaggtcatgggcagaatgaaactcatgggccccaaagtggtcaacttatgaacttaaccttattcccaaagttgccttttgttgttgttcagtcactcagttgtgtctggctttttgggaccccatgaactgcagcatgccaggattctctgtccttcaccatctctcagaacttgctcaaactcatgtccattgagtccgtgatgccatccaaccgtcttgtcatgtcactcccttctcctcctgccttcaatctttctcagcatcagggtcttttctaatgagtcagccctttgcatcaggtggctgaagtattggaacttcagcttcagcatcagtccttccaatgaatattcaggggttgatttctttgggattgactggtttgatctccttgcagtcccagggactctcaagagttttctcaaacaccacagctcgaaagcatcaaaagcttagccttctttatggtccaaagttccctaaccagtggaattaactagacagaaatt

SEQ ID NO: 33651 - DNA, 2067 bp, Bovine  19866881172844
atgggaggttctgaatactcgaagttccttcttggcctccttttgacaccccacatatcttcccccaccctgatcccgacttttgagggccaggctgcgctgccttctagcaccttttcccctgacaactctttacctgggaggaccaatgcgggtcaccgcctcccgcaggcactcccagactaccacttgggggatctgttcactggacatatttctttccatccctgtaaaatacacctgcagccaaacgggagccttgccctccaaagggtctggtcaagagaagtggcagaaatccctgtacagacatcacccttccgatgaggcccctttaaagttgaaaagctaataaaactttttttcctagatgaaatgtcctattgatcacaactgctgtatcagttgcctaagatgtcaacagcaccatggaagtctgggaaatgatcatgttgacttaaaactgccccatacgatagcacatatcaacccttagtgaagccttaaaaaaaaaagggggtggggagttgaaaaacagcttaaaggaggcaaacacagcatctgctgtattaactcagaatagtcctagcctctctcacactcgctaattccacagttgctttttttttaccttaacattttatttaattgcaaccactgtgtatgtactgctttatgattctgccattttcataaagtaccattttcttacatctctgcagagtcttcctaattatcattacagtgaccacacagcacagcatcttttagcctgagttcaaatccctgccttagccagcctgctgtgggtgcctgcaggccaccgctcctgtcctattccctgatcacatctccatgtgactgacccttatatctcgtcccttgttctgtcttctggcacctgtgctcttaaccatacttcatccctgcctcttggggcagagacagggtgtcatagcctttatgacactgtccatgggggaccccaagaacagctgtttgagatgttacctttgccaacaaccaccactgctcatggagcaaggctaccatgagtcatccaggggctgggcacctggtttacgttattgcagggaattctcaagacaaccatgcgatagccacacatagctctactttacagatgagaaaagtggagcccagaaaggttcagcaagttatccacgatgacacagccattacaagacagagcagggcttgaaatgcaggtttgatcacttctaagtttatgcctctgccagtgctctacggagcatgttccaggagacgtgatctggctcactggatatttgagcacttgtgaaaatgaacctcagtaaaacagagctgcagcagaccttgctgactttgtacctctcccttccaggcttagagacgtgtgtttttcctcttatggtgtgtgaaagacattcctctcaacccaccgtacagatggaactgttgaggcacagacacaggaagctgatagaccagagaggagttgaagaccagcactcagaccccacaggcccagagaacaggtggaaggtcaaggtgagcatggggtcattggggagaggatgccgacggtgggcaggcctgtctgcggttcagcccctgggcactctaggcaccagagtcaaattgtcctcttcctgccctgtgtcaggaatgccctccacttgggctggaccccacccatcaccgacccctctgcaggcccagctcacacagccctccgccccgtcttctcctgacccaacccacccacagcaatcacacgctcctctgaactcctctgcaattataatttcaataattcatttggcaattaatcatatcctgccttgcaacatctcttctatcccgtgttgagctgttatttagaagtgcaattgtttaagttcccatgagcagcatatgctgccttgctaatctagtcgggctttttggttgtttatttcccggcagtcaatcaaaccaggaggagacgctggagacccacactgagggggtgagctgggatcctcactgagagggcgatggaggcacagagtcaggacactc

SEQ ID NO: 33652 - DNA, 1066 bp, Bovine  19866881210767
ctcccctggggaatcccatggacagaaaaagtctggcaggatacagtccatagggtcgcaaagagttagacatgactgaagcgaattagtatgcaggtccttgtattggggaaacctctgtacctaagtcatggacaagaaaagggtcctaacagatgtttagttgagtaaacagttgaacaaatgaatgagttctcaaagcccaccaggcctattgcctgtccgtctgtcatctctggcagagccctagtagaaggtgtgaaataaaattcatattttatggtgagacaagaaaactttctctgccctttggtctgctctctccccatgctgtgcattgtgtatctgcaggatgcattgatccaaccacccccatgagcaggaaaacctgctcaatcataaacagcagcattctcctagcatcaagaagacaactccttcaagataacattccttcttgatcttgtatggggtcacgtaacctaccatgatgacccttaaatctggatcatgtagactgtcagtaatacgtcatttgatgtacagtcctgtctcaaaaaagatttatataactgtgctttgacttctaatgagaagaacagttttctgagatgctctttctttcagggttgtaatccttaaatttggctcaaataaaatttcccatttcttccttagatggactgattaattttttgtcgactaagataaaggcactcagtgctcacaccccaaagccaaggaattaacatcactctacatctcctgaattgatgcaaacaatgacaagcaatttcttcataattacaaagtgcttctaatgagatagcttattcttacttttaaaataacttctacatggcattgggccaaaccctttacttaaccaaatcatcatatatattaatcacacacacacacatacacgatttttaaaatgccctttttcaactgcattaattaaaggccttattcagaattaatttatcttaccagaattatgtctaatgcttttgtcctcatgcaggcaaaaatgcattctctcttcacccttgctaattcattt

SEQ ID NO: 33653 - DNA, 1879 bp, Bovine  19866881234987
tgtgaaacgaggatgataatacatgtcttagaacattgctgtggggatttaaagtgacacatgtatcccaggaaaatagaatcccagaactccaggatccaggcatttgtaaggacacagagagaacagcttttcttttcctttcctttctacttatggaacagtgatcttagaccagatgtgtgatctggtgctcgtgcaagaaaaattgctatttcaaagctttgatgattctttgtgttgtttgggagtagagcccagggcggaagctcacataaagagccctctgtggttgttgaaggcaatgtacaggggagtgaggcagagcaccaaggggacccggaaataccctgtgtaataacacaagagaacatgtctgtttcccggccctggaatgcagaggaaagagataagggaaggctcacaaggggagactgagatcacagacgcgtggagggttagcaagagaggctgtctggcctgatgtgtgatatttcacttcagtctgctctccgatcggtgactgcctccatgaacacagactttcgggaaaagctttctgtcagtgctgtgtggaggcctaaggagaaggggccatgtccactcaacactggaaaaggagagaggacagcatctcaggaggtggatggtgaaagaggccaagaaatgagcggataacaggagtctgaagagttgcctccacctgggaaattctggaaaagataactagatttctctaacttagtatggctaggtagaagctcagattgttacactgggggaagctgagccaggaagctcgtagagttggggatattctggttatgtacataaagaactcgacccacagatgacttcccttcattggtgacttctcttacacggcattctagtaacttgctaagggaaataaagcttggcctgacaactgccattcatacccaggtctaagtctaaggtcttcagttttacaccattcagcctttccttcaagtactgtatatttgtgacttttttttttttttttttagaattctagagctaaattaaagacacagtggcagcttatagctaagttgaatggtgactcactctaggtcaccagaggcaaggcagggcattcttagggctggctgaggactgcccaagtacactttcacttgaggtcaagtctccagtgattagcaggctctaaaatccttctctgttccagctattttaaaatcttgtttatatgctaatcttactccatccttaactgaccttctatcatctgtcaggtaaataagtgaccataatgggaaaataacccagaaatgtaaatgaaaaaagacagagtgtgagtgagcagaaaccagcttagcagaaacataaattcctgttcagagccaccttgtctagtatctaagctcacacctttattttttatttactctggcatgagaaggttttcttgcattagtaatgatactgttaatgttttataggatgtgttaatagaagtcacggtcacactgaaatctttcttcattagatggaatactcttagacttattgccacgtcccctaagtttaagccagactactttctacccctaccaaggactggagaattctctgagtgtgtttaactcccttcctgctgttaacatacactattctatgtccctaaagaggtttcagaaaagtcctcaaccttcttgtcttaactgacacccgggatctcctcaaaatctcaacttcctctgcaatccccactcacagaggctgctcatccttcgatattccatgctgcaacctcccaggaaaatagttgcacttctcctgacttttacctcacatttcaaggttaattccttcacttgtgctcttaattctg

SEQ ID NO: 33654 - DNA, 826 bp, Bovine  19866881249715
ccccgatcagggatcaaacctgggcctcctgccatgggagcacggagtcttagccactagaccaccagagaagtccctgtgaccatatttttagaactaaggttgaattggtttgacaaatacaattatggtacaacacaaaagaatggttgaaagtgaaaacatcacagaaaatacataataccgatggtcatggtcaccatgaggcaaccagaaccttttctaccatctgcagagaggtttgactgcacaaatgactcagcacatttctctcctgccccccacatggtgatgatgtttgctccacgatagcctcaatcttactgagacttgaacccaatgggaacaacagcagaatcagaacaacagccctggtggagctcaaaggctgagttctcaacactggggccacaagaaggagtcaatacttcctggaggattggggagggggttgcagtttagtttttgagacacaccagtcacttgggtttctggacatggaatattgagcccgaggagttgcaggcaggttcttcacttgccagggagaaagctgaaaagtagagctcaagcctcacaagtcacattctccttttctgtttctgttttcttgagatggatgtagaatttctgagttgatctggggtttagagggcctccgaagcccagtggccctgacctagctgtagattccataagcccgggaacctgtaataggcccaggtaaattgaagttgtgtattggcaacaaaggattctgggaggaggcaggagagaaccaagcccgtgctgttgccaggtgaccttggggacaagcatgcatttg

SEQ ID NO: 33655 - DNA, 1770 bp, Bovine  19866881297839
ttattctggctcaagagtacatgttcttaaccactacacagattacccctctaaccgtagagcctgggctagggtacagcagggaacttgagaagatgttgaatgtttggaataactgctctaagtaaggagacagagaaagttcactagggagatgggaaaagattgctatccacactgagagcacaggagaggctggagagctggggctggtagagcaatggagctttccaaatcagagctttcaaggctggccatatttctagaatgttatgggaccagtctccctagtggctgttttctttgtggtgctttaaaacagaactacagagcctttatgcttgacgggttctattgccaatacttaagaggttggaggcattaaaaaagacaacaccaaaactgtaagaaatatcaagattctggaaacttacagcattcttcagggaattatcctgtttttgcctcttctcttgtgttagtaactggaaggcctgatagttctctgctctaattttccgtgtatgaaggcagacctcatcaaaccttctctctccttcagtccactgaatttttacaccagcaacttaaaaatgtcagaggtatattttttccagacaaaattttgctcagtatcctaatatataaaatatacaatggcagcattttatgggtataagcttatttaataaattcatacttataccttttcttaattattacaaagtcagtcgaaaaggacatcgaatctattctgatgaacacggaatttgaaaataacgatactggttgatgtttgcagtgttatacaagactcagcgtccaattgatttctgtaatccattttggatatacagtatcaagaaaatcctgattcaaacagacaagtagcttaccttgctatctcaagattctcttcaatcaaactgatccaaaagcattagggaggatttgtaggacttttttgtttcaaagttaaattaccaacaactgacaacaaactcacttccttattgtcaatataaaagtcattcagtagacattccacatttaacaataaatgcttagtctataaattttatgacagtaatgagacaaaaaagtgttctgattttcttgttattgcgtattaattatgactcagaacaggttgaataaatgtgtctgaaccttgttcatagctatatgaaagagctcagagaagaaccaaccacctagcagacacaaaaatcaatgtttgttgaatgaatgaatgaccaaactgaacttgcttgatctctcacagagtactggattatatatacatttttatttttactttttgatttttcatttgtgcatatttgagttttaaaaagatcagtacagagctacagacatcgtaatcaatgactcattgacaagtccttcaaatatatccccagatctgtcagtagacaattttctccaaggtctgcatgaaaacaagtcaatgtgacagaacaaagttaacccattggttggctgtcctcactataaaattagcacagagcatgtttgagattgtgttgagtcttattagcagcttccctcatagctcagttggtaaagaatttgcctgcaatgtgggagacctgggttcgatccctgggttgggaagatcccctgaagaagagaaaggccgcccattccagtattctggcctggagtattccatggactgtacagtccatgggggtggcaaagagttggccacaactgagcacctttcactttcactgagtcttacta

SEQ ID NO: 33656 - DNA, 808 bp, Bovine  19866881309603
ctttgtaaatttcataaaggttaccatgggaatccccattatcacctgctgccaagtcctccagccccacctgtggtgatggagcccacgatgggctcagaggtcactgtgccatggactgccaccagattcacaatgtactcggtagctggctgcaggcccatcaggacagcatgcctcttggtggcatccagggagacctccatcatttcttcctcttcatcccgtgggctgtagttgagaatgagtctgtctgccggaggggatgggtcactccaggtaatgttcacgctggaggaggtcacgtgagaaaagtgcaaatgggagatggggcggaagcctgaaaacagaggaaatgaatggttctggaatccacataaagtggtgggaccactggggtaaaggagatatctgaccaaagaggtctgctttccctgctagtaaggacttacacctgcacttgttaaccaccacgctgctatctcatccactctcctttctccaagccagatactgtaaaatgaatgccctcagcagcataaaaacagcatcacctcgtgtgaattattcataatactgatggaggatttaaaacttatatcctggaaggaattgaacacgatcccatggatcctctgaatgcccactgacttagtgaaggcagaaaatgaacagaattaactactctgaccagcctataggaaaccggacataatttcaggcatgcaggtagccttgttcatctctccccttcgcctccagccattctctcttaggcttcccagatgactcaatggtaaagagtctg

SEQ ID NO: 33657 - DNA, 1569 bp, Bovine  19866881331517
aactggggtgcaaagggatgaaatgacttctccagatcacatagctagtgaatagtgggggtggttttggaatgaaagccatctgactccagagcttgtgttatttaccaatatatttacaatatatacacacttcagaagcaacagcgtctgaaataaacagaagatagcacatagctctcattatttttgtttatgatatagtgtttagattgttataataattttatatgtggctcgagtttttcaaattatttacaactatggatgccaaactggaaattattattactgatgagaatcctctaagaaaactaattctcttggtgatttgaatagtttcacgtatacaaaactaactgtaaatctcaaaattggaaactgtttggcttcaatatcagtttatttatttattttttttttcaatatcagtttagaggacactttattctatttcagtatgaaaagcagactgttgcctagtgtctaaatcagggctaagaggcagccagcaatctgatgacctgaactgtcataatgcactcagctaataaaaactcaggaagccgttgacattttcttcagaattacaaaatttcttacctaacgtggcttacttttttctgactttggatcaaaagtgaatggagcaagaccaagacgggatgtgaaggttaacagagaatggtttctgtccttgtggagtttctggttcctcaaagtgagggggagggagaggaaagaccatccagttccggggtcggggagggaggagtaagtgctgagacctgggtagatgcagagtaataaataagcacattaaaaaagacagtcacctgatctttgagaactggagtacttcttgaggaatgtggcttctaagctgaggcttgaggaatgagcagttatttcagcaaaggggagggaggggaaattaagcagaaggcacagcatgtgcaagctgggaggtgagagcaccatgtgaaactttcaaggtaagcgttacccttctatttataaatggggaaactgcacctaaggacacatatctagtaggtgtaaaacccagattaaatgtgcatctgttggactctttgtgaagctccacgttgtcttctgtcattccggggaagcgcacacacaatttcactaagatgcttatagtaactgagtactgtggtggcatctataaggaagctggaagtgtgatccattactattcaatgagaaggccacaagaaggcactagtcagtactgaaaaaggaggaaattcagaatgacagaactgtttctggttggatgtgagattactaaatgtatagataagtaggaatatttcatagacacagagacattagaaacttgtgtttgaaagagaggagaaaagcaggaatgcaggcagcagcagatgagatggttagatagcaacaccagctcagtgaacatgaatttgagcaaattctaggaggtaacggaggacagggaagcctggcatgctataggccatggagccacaaaaagtcagacacaactaagcgactgaacaataacaaggaatacagaaagga

SEQ ID NO: 33658 - DNA, 1075 bp, Bovine  19866881417208
ttttttttcatggagttcagcaggggcaacatactgttaccaacattcaatcattcctgctaacatcatctgtctcgctttcacttcctttctccctcagacttttagtggactctgtctatgcaccgggcatcaggtttacagaaataattcttgtccaggttggagaaaaagctatgaaaaccaggtgacacagattaaattgttaatggtgtgtgaataagttggccaggtatttctcttgtcagagacccaagggaaggttagagctgtggagagaggcaggattgggccaaaagagggaaaggatgcaggaagagcttccccaaaaagcttgcaacttggggacttccctgtggtccagtggttaagaatccttgtttccttgcagaggatgtgggttcgatccctagtcagggaactaagatcccgcatactacactgcaaggtcaaaaaataaataaaagtaaatgaaataaaaagaaacttgcaacttggctgaaatctaatccaataggagacattgcataagaaaatcctcttaaaaaatgttcttagtccttccagtcccccagattgtgataacaaggaagatgtgggctgacggaggatgaaattttcagcagccatggaataagaggctcagaaatgggggccattgctccttgaggccagggagggggagagagcccgagaacaccagatgatggtggggtagatgggggatgtgatgccctcagtcttgcccacgcctgccccgccaggcacaaaggtcaattgctcctacaggcaaggaaggctgcttgggtgttattgtttccggtggccatgggttgtgtttatttatttactggtttattttgccagtcaaactccagtttattgacaggactcagccagcctctggtcttttccaccccaaccgaccgcagcacagagaaataattagttgctgcggtgtcgggaacggatgtccaactgacatctccccttcaccagagtcaaattcagcggtttcccagcctgctgaaaattaccagcttcatgctgccttcctctccccgctgcctacctg

SEQ ID NO: 33659 - DNA, 1450 bp, Bovine  19866881499885
tggcacccatgaggtggactgagactggcctaaatggatgactccccaggcaataccatgtaatgagcagctctcaaacacagagcatgcttgatttctgtgtggggaaacataaatctttttgtatcgaaattgatttttttgtttttctaaaataaacgttcagggattcaaatgtggataatgctaactctcttcccagtaatctacaggcctccgtggactgtaatggttcaaaatgaatagatctattgtttgattgacgctctcctgcagcctgggtgggcacagcgtcacatgggagcaggaacaatgggatgattactgaggactcctgtggttaattccggctctatagagttaattcagtctgaagcgcacatgatcagttccatctgtatcggtgcaactgggtttgggggagtttttattaaaaattctcaaatcagttctgtacaagagaattacctccttaccactccatatctcctgccaagtacttgataaaatgtgttctacaaatgtagataagaagtcatgataagaagactcactcctgctgaatattggaattatctggctgatgcggccggcaaacgtgaaaaccgggacaaatctccactggagaattttcaaactgttagaggtcatccttcgtcttggggcaaagtttgaaggggaaaatgagagacacttcagttttacccacgtgctggtgaacccaggctgctcaaaattggatgacttccaaatatgtcaggtctaatcaagacctctgagttggcgctggcctctgaatcagcccccttgagctaggatgggcttcctgcaggatgaaccttcttgcatacctttagcttcagcaggcaggtgatctcttgttttctgtggatacgtcgtgtcaactgaagaataaggctaggatcctagccagccacgccagcaccttcagaagggcagaggagtaactgagcaggaagtagtgactgtgctaagagtagtgactataggggatcggcaggggagcgttcatttgcctttgagagagtgaggagggctgggcaacctagaacagctgtggcaatcttttcatttattcatttatttttattaaactgtttttttggccaagctgggtcttggttgctgtgagggcttttctctagttgcagtgagctggggctactctgtagttgtgatgggcaggcttctcattgtggtggcttctctagctgtggagcacgggctctagggctcggggaattcagtagttgtggcacatgagcttgggagttgtgctttccaggctccagagcataggctcaatagtcgtggagcacgggcttggttgctctgaggcatgtgggatcttcccggaccaggaatcaaacctgcgtctcctgcgttggcaggggattcttaccacgggctaccagaaaagcccaggaac

SEQ ID NO: 33660 - DNA, 1459 bp, Bovine  19866881548728
aaaaagaaaaaatagactgtgttacctttatataaaattatgtgtacacacatatgtgtataacaaactcgaattaaaggttttaattaagaaatttcaaaaatcaaaaattgagtttttctaaataaacaaaccaaagaagacatatgactttgatatctccattcccacacaactgttcctcacagctaggcaggccctgtatggatcttttgatatgtattattttttatgttttcttaaaatagattttccttattagaggtaaactgctttacaatgttgttttggtttctgccataagctatgatagttagccataattatatatatatatatcccctccctcctgaaccttctcagaaaagaaatacttactagagcaatactttgcagatttaaaatacaggagacacaaaaaaggtataaaaagtagaaaagagtcactgtcatgatgcatgttttagcatattcattaaatatgaaatttgaaaatataaaatttgagttccaaattttgtcatttaaccagctagtcagacatcaagagaatcattgtaactttgggtctcagtttccagatctgacataaatagattaaattaatatcacaggttgaggaaaacttatgaaaatactatcagttttgtcatataaggacaaggagaaatttaaaatgagagacttattcttctctgttgaaaataaggataaagaccttcttccctctgaatatttactttagaaaattcaagttatttctgtctctttgaaatacatgtaaattgtcactaaaggtaaacaatccaccagccagctttaaaacccaacaatatccttctcaattgtcctgagaactatttctttgaaatagaaccattgagaaagattgcatccatatctcccagcttctgggagagagtaggagtcagacttcagcaggtacttcctttcaagatataaaactacttcctgtcacagagacgcactgtttatttttcttttggatgaagccaattaactaaagcagatgaatatcccaactaccaaagactttaggatgcacaatgtgtgaccaagagtactactgagccctcttagttgagaactaattatttttcatattgagaaaatgaaataggttgtatctgctcagctgtgcactcgataaaaggatgagggtcctttctctctttgcaaacttttagcattttgtctgtgatgcacatcacgttctggtttagtgtttattcaataataaaaataagttttctttctcttctatctttggggagatgttttctggcttgggaagacatctaattatattttccccaaagtagtcacttaatctctctaaaacaggagagagataaggagacagagaatccgatagtgctaataatcacaactgtcatttgttcagcacatgcctccaaggaagtgtgagatggaaggc

SEQ ID NO: 33661 - DNA, 2498 bp, Bovine  19866880365704
aacttctagttgagcccaccctcataaaataaaatctctctcccaaaatgatgtaactccactaaaaattgaaattcagattaaaatgccacagaaatgttttcttttttcagcctcatagagatttagcctgctgtgagctctgcactttgcttagactaaatcttaaatgttttctcatgtgttgacttgtagccacggaaaatatgggactgtcatttaaacttcctgtgctccagtagaggccccttctgagaaatttcttcctggtgggaatttttgccagctttccgcctggcctctcttcagtctcgctataatggattcactcactctggaccatggtactacattctagaaaagcggaaacaaacgtcgagcctaatcagcatgggttctggactgacggcagcatgttcgggcagttttgagtaaaaccagggagctgcatagactgaatctcacagtcacactgacaggacctagactggcgttctggttcggacacctggagcaagtcggcctgtctgcctctttcctcgtcctcacacaagcatgatggtgtagctaggggttctgtgagatctgaacagcgtccataaagtatctagtgaggaggcactcagcacacgcttaccgatcaggaatgatatttccagaactggagtgttcatgctctccttttaccctcagtgggtctgtccaggtgtcataaatctctccctcctgcttcagcgttcatctttgaggggccactaaggccctgccttgccgagggccaggtggtcaaactgtaagatcaaggatgcagggactcagggggcaggggtatcaaggacctccccttaagtgacggctctgtgttttcccttgcaggccccccggatcccagcatctacgtggaacccatcactgaagagcgggccgcgagaacgctgtaccgcatcgagctgttgcggaaggtgcgggagcaggtgctcacgtgtcctcagctgcacgagcgcctgcagctctgcaggcccagcctgtacctgcccgtctggtgggagtgtgggaagcacgaccgcgacctgctgatcggcaccgccaagcacggcctgaaccgcaccgactactacgtcatgaccgacccccagctgtccttcctggatgcctacaggaactacgcccagcacaaaagactcgacccccaggccccagagagtctctgttgcctctaccagaccaactccaaactgtatgagtctctggcctatacgcacatgagccggacttccgagtcccttgaaaacgaacccgagaacctcatgaaaatcgaagctggagacgatcaccttggtccgcccaggggcagcttatctgacatgacctgtgaaagcttcatctctaaaactcaagatgtcctttcccttacccatgacgagagtctgctgcctgggtccttggagaccatgatgtacgggaagaaggcgctaagccaggagccaggcccttttcagggcagcacgggtgccagtactgagtccaggcaagacaccgcggccatctccgcaggcagagacggaaactgccagccccggggccacgaggcaaaaatagcctcagacccctcttttatggaaactttagaagcaggagtagctcagatgaacattaaaaatgagaaacacctgttgatatctctttcaaaggaaggggaactcggctgcagcgaggcaggaccaagacctgagagaatcgggcagctggaccccaactgctttgcctccccttccttggacccagggaatgagagcgggttcgttgacatgtgcaacctgagtgtctgtgactccagaagaaacgtgtcatcagaccagcagctaatcgacttactagaaagcaaaagcttagaaagcaaattggttttgggtccgaaccacagcgacgaggaggacgacgaggacgaaaacgaggaggaaagtctcgagctggccgcaggcaggcgggaaaggctggcagcgtcgcctctcagcgagcccaccacccgcatggcagggggagcagagcctggccggcttcctcacagaggaagccaagaaagggagcacggaggccagaagccagccttctggaccacagggccctttccttcccacagcctgtcagtgtcactgcaaacacgtggagaggtgggcacgcggcctcgagaaggacgagtttgaagtggagaaaccccaggcttaccccccagaccccttcacaagcaaagccaataatgtcacagtgaggggcgagcccactgctgtcccacctgagctgctccaggtgaagcaggaactgctgaaggaaccctggaaagagagcacagaagggaaccaaggtctccctccgtatcctgaagggagtgagctcaagccggaagacatggattatgagagtaaagaggagttcgataaagacgggaactgccagagtcaaggtaccgtgtgtgggaccttgtgtcctggatgagccag

SEQ ID NO: 33662 - DNA, 1200 bp, Bovine  19866880640746
cctgcaggttcctctcgaggctgtccacgcgggccctgatgaaggccagctgcccgcagcagctgcccccgccagccacactcaggccctgcagccgggtacccagctgtgagagctcccggcgcagggccagctctcggccatcgaggctctggtgcagcctccggctggccgcttggccctcctcacactgctgccgcacctcctgcacatgcagatcgcacgcgctctggacgccctgcagcttctgctcgaagccgtccagcaggctgccccagagccggtgcagccgtcggtccacgtactcgtccagcagcgccagggaggtgaggggggacgggggcgcctcccgcagccgctgcaggtgagcctcgtggccgagggctagcccgtgcactttgtccagcagctgcaccttggtccggagtgtgttgctcacctcggtcaccttgctcaggatctcatccaggggcgggctgagcggttttccagctctgtctcgggggctcacgaagccctcggggatgaccccaaagcccacgggggtggcaggagccctgggtccaccagtcatcctactggggtcgtcacgcctagccaccaggccgctgagggtaccatatgcttgtgccaggcgctggacgtcaccctccaggcgttccagccgttcaccaaacagccccgggcctttccttcctgggaaagaggaggtgagaaccccaggagtatcactggcctggctcactcagcttgtcctatggcccagatgccgagagattttctgttctaagccgaccttgctgggcatggctccccgccaacagctgtggcaggggggctctggggggctcgccctcatgcccagagtgagatgcaccctcccccacccggctcgggctccgccagcctgggtcagtccccagaagcctgatcaccttggtgggggtctccgtgggcagactcaccatgggggcttggggccactctgctggaaggaaggggcctggggcccgggcccacctgcccagagggactctgggtctcaggctccggctgaggtggtgtggccccgtggtccgtgaggtgctcgggacagccttctccagcgaggccagggcaacaacgccaggcaaggtccgtcaccatcttgtagcccaccttgtatctgggtctgagcaccgagcggtacctgggccgggg

SEQ ID NO: 33663 - DNA, 1999 bp, Bovine  19866880652884
gtgctgctacggggacgcccttgcagaactcggtggaggagctcttcagtctgctcaacttcctggagccatcacagttcccttcagagactgctttcttggaggagtttggagatctgaagacagaggagcaggtaaataggggcctgaaggattggaggagtcaaggtgatcgctaccttcaccatcaagggaaaaacaaagtcaccatggggacaggagttagccagttttcacacccctggtaaaatgagcaccgcctcctttatttaatttatgtggaggaggatcaactgatcattagcagtttctatccaaacaataaatgaatcggcatccaaaatacctaatctccagcctcttgctttcactaatctcatgtataaataactttagtgattttgttcatcgtctgccctcagggccatgcttccctcctcctctgcttccttcatccttcacccctcctcctgcaacatgtttccaggctcattttcttgaggaacagaaggcaggtgtacattagagtagttggtcggtccagttttatccagatcaactcaatttcctgttttcaaagatgtggtcctgagtcttgcttattggactcaaagctgtttcgaaacaaaccaacattaataaatatctatctatggtgggtagaaatctcgactggacattacagaaataaggcagacaggtgtaagggtcacaagaggaacaatgaacagagctgaggacttaaaaggcaagaaaggtcacatctgtttaggactttggaacaactacatggagagagtacaatttgaaaataaactttaaagggtgggtaagttttcattaggcagagatagagatgataatgactactttgcatggggaaaaaaagcaatcagcagcagccatggaatttattcagtggtaggggatcatctggctgagctggggatgaagtgtggagtatgaagccggaggagttccgcactgtattgtgggaacatcttgaaagacaggttgaaggatttgatgggcattagagaagcaacacaaggctttgatcgtggcaacgacacaattagttctgctaaattaatttagcggtggcgtgagagtgggtctgggcagagaatttgggaatggagaaagtttgggaatttcactaacagatgtcgagagtacatgctgtggttccaatctgtttgtttctacttcagcgacgagtcagactttgagagcagtgagtaatcaaacttcattccccttcttgacgtttgcagtatctattgaactttgcaaagccaactccagccctctctccgtttttggaccgttagaaatgcttcctcttctcccgttgcacttatcttgtggtatgcgttttctcttcttcctagacaatgacctccttgaggacaaggcccacatctcctcccaagttgtgtttgttgtattgaccagcacagtgtctggcatatagtatactctaaatgattcaaggtacaaaccaggtgaagggcgaacgctgaacccagcatgtggcagacttggcatttgtccctgtcttttcacaagtccctagctgtgtctttcccctttgggttcttacgtagtaattccttatccctgtggggattacatacctaagttccatggttgctaaaataaagcgttcattaaatggattagattgaagattggggtttgttggggaaaagccacaaaaatggccccaaatgtctatatattttaaatcctagtaaatagaagttttagaaagcatctggttacaaagtaaagcctattccttgttgtttaaaacctgctcaagtaactcctttaaatcaaactctctagaaatcactttatttcagcaggaagcattggcacaacccacagcttatttgtgcagaatctacccttttgaaatttttgaacagctctttataacttgatctttcgtacttgcctcttactttcccaccagcataatctcacggtc

SEQ ID NO: 33664 - DNA, 994 bp, Bovine  19866880820422
aatgaggagtgcaattgcaaacccaagtgtcctccctgcccactgaagatagccaaggatttgaaggggtgagttcttttatagcttctgacccatcattcaaacctcttctaagaatctgcatcttcagagtggcacacagaataggcatacagccagaaaatctcaacagtttgcatttagagaagtaggagcccagccgatgagggtcaaagaataaagactttccttgtcactgccccccgccccggccctgccccacgtggacgctgcagagaaggccctataccttggcgaaagtggatcctttcccctcagactggatggtgatggtatgtgtcctcctctgcaggatctggtctatgtcttcttcacagaacttggagccttcgtcctcttcatccatcaaggcgccgtaggcacctttccggagcaagtcctctacctccatctttgagagctgctgtacctggatgggtcaccaaaggctactcacgaagtgggaaatgcacaggaggaaaacggcctcaactctgaccttcaggacttagcgcccagttcctccactcattgtgcatgtcagaagaagaaagacatggacaacgagctttagaaaatgaaaacccaaagacacacaggaggatgatggggagggcgggcagacgatcctctacagggagccctggaataaaacccagcccaggacccaacggccctaacattcctcaggatgttggttattatcaaatgtcacaaactgttaaaactaggcaccaccggagagaatatgtttaaggtttattttatgttttagtttgagtctgtatctttaaaaacctccagatggaccaaactgagctaaagaataatgatttattcattattaaataaaaacaatagtattggaaatgatgtcatttcttaactaaagaaaggataccatgccaaggtgtgatctgctcaattgcttgctgaaaacaggaaatggggagtt

SEQ ID NO: 33665 - DNA, 749 bp, Bovine  19866880823021
ggataaataggaaagggtggtttactatggtttgtgggatgatggcttttttcttaaccttttcttaggattttttttccttctagttttctgccttaaacatgagttacttttgtaatttttgatgtcatcgtagaaaatttttaaactcacctccaccagcagaatgccctggtctgaaatcttacttaaatatgacccaagaaagaggaccattctctccccaaattaccctgcttcccacgcaatgtttccctgttacgaagcactacaccaatcaagtcccacgccacatagcaaggtcacaaaaccaacttggttaatatgtttatcattacatagaagcactgtactctccagcaactttgataccgtctttccaaggcagcaatagaagggttcttttcatgaatttcctaacactcttctactactatgccgcttctggatttttccactgtgtgtctcttagaaacaaattaagcccgaataagtttgttccagctaatgaagtgcgctcttggctctttccccgtggttgagaattatccggcaaaataccaattgttttaggacgcgttttctcttagttttgaaatatcgcaattcgaagttactgcaaataaagcacatcaaaataacagcatacaagagaatcggtaaatggaaactattgtaaccctttttaaaactgaggctgtacgaaggtctcatgaataaatacactatacgtccacatgacacatata

SEQ ID NO: 33666 - DNA, 1717 bp, Bovine  19866880846142
tccgacatgcacgagaggctctttttaggaccccgaaagcttcttggttggcttaggaagttgcttttacatgcagaaaattttatctgaattgtgatgtgctcagtgaagaaagtgagcagagggatttgtgaacaaaggaaggatcctcagccaacgagtttggagagagaggaggttaacggatttgaggttaaaggataaagagaaaacaaataatttaaagcacagcaggattttgtaagaagattttgttaagtataagcactttgcccagtatccttataggcttgtcctaagcattggtttccataaagaaggtaaatattaaatgaatgcagtcacaggagaggcagggctcataccatagttttcacaggcagcaggagacacccaggagaaatttaagatgtgctctcatgggacgcagctctgctttgtaaatgtgatggtggcaggaagacaaacggaaagacaaaagtatgtcctgcctggtagcccttgtcccaggtgaatcagggtcacgacattgagtctgttctagaacccaaggtacaaggtgaaattaattctacctgaaaactagcaaagagggttttctttgggcattcaagctctgcgtggtttagaccaccagctggctaggaacatgtgggtcaacacccatcagctttccctatcatggcaagtaatgaacaaaaagcttccttgcttggccttccatactcttatctcgcttttgtgggggtacatgcaatcttgatttttgtttctttgaattaacaggatctctctcttgtctaaacagctggtttgattctcctattctttctcttctcaaagaggaagattgtgcttattggcctctcacctaggtccgaccatctatcttgccaccttctccgatccagctcgtaacccggcagctgcgttctcccgccgtgtgtaaagctctgcctttgcttctgtcatcctcagggaaaccccctgtcaggtgtcttcaagttccatgttgtcattacaacatttgagatgatcctggcagactgcccagagctgaagaagattcactggagctgtgtgatcatcgatgaagcccacaggttgaagaacaggaactgcaagcttctggagggcctgaagctcatggccctggtgagagttggcgagctctttctgtaaacacaggcccctcctgttcacggtggaggaagcgttctctagccatctgcatgcagcctgcttctgcacagtctgtttaccctagattttcttcttgtcctttgtacctccgatggtgcaggaatcaaatttttgttgttgttataaactgggtcggcaatttgaccttttccacagattgactcccagagggacccaggggcatcttaagtaccatggcatttgtgaccaggaaatgtgttgttttggcttgtttccaggtccctgaatgatctggtaccaaaaatgatagccttgaacatcactgccttggcgcagtgaccagtctatggctagcaggccctccagaatgggaatgagtgagtgggtgctttagctaacatggaattgctgctggactcaggggtaaaaggaaggttgatctgtttgttgatgttatcactcgatgttgtcataaaagcaaaaacaaacttgcccccaaattgagcccaagaggcccttggcgtcactttcccacccaaacctgctgtcttgg

SEQ ID NO: 33667 - DNA, 700 bp, Bovine  19866880881982
taagcagcacaatgttgatccacagtagatgctccacaaattattgaaaatttctgagacttaatgatactaatgaattttagaatgagttgccagtagcttttctttttctgtttatcccaaaagactttgagttatggcgaggatgaaattattccattctttaccggctctgttttctttggcaagttgcttaacatcctgtgttttggtttctttatctatacaatgggaataataacagtacctaactcataagattattacgatgactcagaaaaataatgtaataaatgttgcttgctgcattctagttcctcagttattattaacagtgcatgtgagaagggcaagtttttaacagtaaggttttagatgctaaggtctttcagtaggaaggtgtttactatctgaaaaccatctatctgaggatggataaatataactacttctgtattaaataaggaagtaacctttactcagaatattaacaacagaatgggagcagagctaattaatttctgccttgttggcagtaatgcagtgttggatgcttgctctgttcccaggggcatagtgatcaatacagaagcagatttcccagatcagccttccccaggaccaaaggcgcttcatcttacagatgattggtagttacagttgacccttggaacaacatgggggtttcaacagcacaggt

SEQ ID NO: 33668 - DNA, 756 bp, Bovine  19866880892621
ttgactcccacatcaagctttttcatgtaatttctccagccttttgctctgtgtctgcatagaaagtagctaggagcaggggcccttgtgcctatgttaacaatcaggaaataagcacagaacaatccaggtcatagcattacatcgcagcagtggatcagtgatgagcgtgtaagaactgatttcgtgtctctctctgggtcagggttatccagctaatgaatagaacacttaataggaataataatttgaagtagtacaagcaagtagttaaaagtagtccttgcaaaacttctttgacgtgataggattacattgctttacagtgggtctcctgggactgccctgtggtccagtagctaagacttgacgctcccagtgcaggggtgcaggttccatccctggtcacggaactaaatcccgcgtgtcacagctagaaagcccacattttacaatgaaaatcaaagatctcgtgtgctgcaactaagacccagtgtggtcaaatgaatatttacagtgggtttcccttccttggcgattttatggttgctttggtagttaaagcactctaaggggttttatttactcctagtagccattcagcccaggtcactaacttatttcgggtgttggtctgacttctacctggtacctaaagggcagtagtttttatcttcacaaggctctttttatcctcatgaagggtacattcaagaaggagtttatatgtggtgaaacataagctagaatctgaat

SEQ ID NO: 33669 - DNA, 896 bp, Bovine  19866880903803
cagtttatttaactgagataaggaagcaaagaaaagaaaataacctgacttgatatcaatattacttgaaaacagaatttcagcaacccctaaaccctaaaatatcttcaattttgttaatacaaaatattccacataagtcaggcttaagaattgggtaaaatatgtaaatatgtggacaaggactagagtagtacacaaaaaccactattaccaccatactgccatccaaaacagaaacagcaacatagaatatcagtgaagacagaacagaattcgtaacagcaaatcctttttaactttagagatcatgcagagtcaaagggtcagaaagaactagaggaagacgttccccttgagaatggttttaaaaagagaaatcccctctatttccaaactaggatggatcagccaacgcatctactgtttctgaggaacaccacttagcaatcaaggtaacacagaaatgcaggtgtttcaggagttctctcaccattgatgagatatgggtggttgcagcatttccgcagctccatcattgtgttgagtagattcggcatgttagtatgacctgcccctttggaaagaaaggagaaattcttctccaaaatagcccggtagtatttcttctgaatgttggttagctctacttcaataatggtctcctgtttgggtgccaggttcttttcaacatcttctttgagtcttctcagcatcattggtttgagaatggcctgtagcttttgaacctgtaaccaacagaggaaaaaataataacatgaagacaaacattctcacattagatggaaacatggatatcaatgacagtagatatctactctagtacaaattttttcattctgcattagtgtcacatcagacaacttcctacctgt

SEQ ID NO: 33670 - DNA, 708 bp, Bovine  19866880906011
gggtagatgtctttgggctccggaggggactccccttctggctggatgctgctgagggggccacggggaaataaacggtcactgacaggacaggtaccctgggcagggcatggaagcctggacatcaccgaggaagtaaagcaacgaaagcccagagaggtcaaggacctggcccagggtcacacagcattgccagaggaaactgagcttgaagcccaggtggcgtgcccacaccctcagccccgtacataccctgggggctccggccttggcttttccagcagggatggctcactctcagcgcccgcctccagctcctctgaactagaatcggctgccaccgtgccctccttccgcttggttttcctcctgcgccgtttcttcttccgcccactggaggccatgccagcgatgctggcgtcaggctcgctggtggtgcccagctgggagtccgaagggaaccctgccaggcccccccaagggatgggtgacgtgcataggcggggaggcacgtcttcctgtggagcaaagcaggggcagggctaagcgggtgggaaaacaggcctggaggctggacggggcggcggtcgcatggccctgtgacttgctggcttccgagctcctcacggaggtaaggcagccccaaaccccaggccctgcccacagggtcaccagtgaaagatgcgctcacttcatcgctctccagct

SEQ ID NO: 33671 - DNA, 1289 bp, Bovine  19866880910295
taccaagtaccctgtaggatcaagaaaggtgcagcagaacctgtgtccttggggatcccaccacccagctggggaaaaggaacacggaacctgaagatgagaaggtgagtgagctgcggctcagcacagggaaggagcactcccaggaaacacacagacagaggtggaactggggtggggcatgcattccgagtcctcgggtcacaggaggagatgctgtgaccccgagggcagagggcaggagcagagaacttcaagagggcccagccacacttaaaacatcccaggtaacatggatgagtgggaaggagaatggaaatgaacaaaacccagcatcctttcccaccagtggcattctgaaatacacctgagaagagaaagaagtccccgaagcacagcgatgtggaccagcacagaagagggagggatggacacactgccacctcgcacctgagtggttctggagtgtctgggcctgtccgtctttggtgggcgtgatcagctcccagatgaagctcttgatcttctcgtcccctttgtagtgcttgacgcagtacaccagcagggcccggcagatcatctccatgtccttctcgttcagatgccacttgaaccgcccgtgcgtcaggatgtccttccaccggccccagctgagagtggaccccagaagggcgttagaaagaggaagggccagttgtgccctcgacacggcggggcacacaggagccaagagcgtgtcttgacccctggtggggcctattaacctccctgagggctttgtctcctgaaaaaccttggaggcctgcccactgcagcccaccaaaaatgactgaggggacctggacactggacacagagagcttcgtacggccgctagaatgttaagtaggaatgccagtatctggagtgaggagtaaatctggaattaagacagagtccagctgcagtgctggaaagcgatggggagctcccagaagctaaaccctcagcttctaccagcgccagagcccggcacgcatcatgcggtaacgctaacatctgctgcactgattcctgtacgtccttggggggaaaaggccggaaatcagtaccaggcagcaaatgattcccagagatgtgctgtggcaaacacacgagagaatcacggtacgtccgtaaaatggcggcagagcatactgactgaggggccctcgggcagaaagctcagttctctctttctctaacagaccctccctctgcccagaccccataggggagggggagagacacgctggacacatctcgactga

SEQ ID NO: 33672 - DNA, 1822 bp, Bovine  19866880958286
tttgtgccttccactggcgccactacccttttgtctttcatggaagagagaaacgcacccattcggtggctccctttgccacaaccatgaccacttctctggtctctatcatttcatgcttctcgccccctccgcctaggcctcttccggaagctcggctaagcccctgcacactcatctatgcggcctggacgttgtacctacttcaatcatcttccctcccgcctggatgctccaactgcttctgactgtctcagggcaaggcattttcttccccctcttgcccactgccctgtacataagtcacttcctgaccgtgacactggacaactagaaagaggttactaaggggacggcagaatcctcctgttaggagaagctggactaagtagcctctggcgatcctacagaagaactggcaaggctggatgctggttactgaatcaaaagggtgtaagcagggattgtctgctgggtctgtgagcccaggagagttcaacactcatctgaggacaagagcagacagtgacgtgtgctcaatcccaagggaggtgatggggtcagagatggaaggtagggcagctaacacttctgggagcctcacagtggggctgggggcagctgccttcgcagtgttacctccaactctgcaaactgggtgccaccacctcctttgttcacatgtctctcttttttttcactttctcattgaggtcaagtaccttgcccaaagacatacagcgagtcgatggcagagccagtattcaaaccctggttttagtccaaggccattctcttcctcatgttcagaaatagaaaaattcaagatactgaaagaatggaggggaacctaatacgcttttccacgtcatgcttttttccactaatgtttgtcagaggtaaaattcctcgcataggaagtgctcaaatagaggaaaacagccacatgctaaggacaggatattggcttgggtcacggggctgatcttgatctgtttggttagttctagttcgaagtgaatttttactaaaattggaaattccagttttaatagaatttcccaggtacccattaggtcattttaaatacagttaacatttctcaagctttgtctatgtggcaagcatgttttaagtagattacatgtagcatctcattaaagaactaaggctcaggagtgaatcatggtttgagctggtaggagtttatggccctatatctgtgaaatgtttaatgaaataaaatatgcttaatgttgtaccttctcactctttgcttcagtgtccagttcagctattttagcccacttctgccaaaagtttgggtcatctaaggaaatatccgttctgtttcctgaagccacaaagctagcctgtgaagaagaaagaaccaataaaccatatctgaacacaataaaacaccctgtgatctccaatgcaccagagacacaagtatatgctccatctgcattcaaaatcaaaacctctaacagagctgccaaaatgttaaatggaaatctcaaagctattctttttaaattttctttcaaacactgggtgaggaaattacaatttcaacctacaggatcattttttataacttaaactcagaagcaggaggacaagcccgtgggagacaatggcaagcatatgtccagctgcccgtgcaagggttgattcttacaacttccctggacgtggtttctctttcagttcaccaggtcccaagtgtccatgctgggacaggccatggctgggcagtatgaggtctgcagagatgagttatgcctcttaagtgcaaaatgtccctggaaaagccctc

SEQ ID NO: 33673 - DNA, 1104 bp, Bovine  19866881007832
tctaggtgatcccatccgtctcatggttttaaacactggctatatgtgtcttgcctgccatatttatttatcctgggctccccaggtggtgctagtgataaagaagctgcctgtcaatgtaggagatgcaacagatgcaggttctatccctgggtcagaaagatctcctggaggaaggcatggcaatcccctccagagttcttgcctagagaatcccacgacagaggagcctgatggactactgtccatatggtcgcaacgagtcagacgtgactgaagcaccgtaactcgcatgtgtgcatgttgtccggactgccatagttatttaatccagcttagaaccccataattatagactcctttatccaactgttatttgtcatcagcacctgactatttcataaatatttcacacttcagatgtccacaaaccaaactcttagtctctcagccaagccaccaaccctaccccttcaaactacagttttcttacaattgaattaaaaagaactctatccctctggatgttcagtctcaaaatcctgtaattcccaactcctctctttttgtgccacataccctatctcatcagccaagatatcctgttgagtttacctttgaagtatgttcagaacccagccatttctcaccacctccactgcttctaccctggtctaaaccaccttcatctctcacccagattattcccagtcatctcttaagtaatcactttgttacccagcctgtcctactggtctattctcaacacaactatcagaatggccccttcatttaagtcatccttttgcttaaactgcttttctttcaacttgggagtaaaacctaaagtctcccaaaggtcttcagaagcccacggaatgcgtccccagcctctcacctcctctgtcacctttcaggtgtccttgtctgtccctcatacacaccaggcacgtttccaccttcaggactctgctattccgtctgcctgaaatcctcttcttcctacatgactccctcactcctttacttcctttagttcttggatcatacattacctttgtgaagccaacactgatcaccctatctaaaattgcaaccttcatt

SEQ ID NO: 33674 - DNA, 639 bp, Bovine  19866881273955
ctggaggggatgaactggcttctttttaactggtataacaggtgtggaaccagaaccagtcctgtcttcagggctgatctttctaccaaatgtttgtgccaggagggagatggtgggcttagccagcatagcgggacagtagcagaggggtggaggagtgcagtggagccatcagttcagtgggtgatctctgtacatcaggagtaccaggacttctgtttttcatgtcagatttggtttggtttgctttctctgaccagagagtaatgatctttagatgtcatcaacattgttcttttttttcctttgtcagtctaaccagaaggttgggttcaatctaagtgaaacaaaaccccaaagatcctttaaaactgtgtttttatctcccaagtcttgaacacaaattggctctaagggagaatgaatctgcattctagtcccaactccactatctgtttgtgagccgtggatggcctcgacttatcgttttcaaccctgtgcttcagtccctgtcagaatctacatgaagcacatgacatctgagaaagatgggttaacatcttttaagatgttattaacattctagggtgccccccagcattgatgttaaagaccacatggcatggaacacataccaag

SEQ ID NO: 33675 - DNA, 1053 bp, Bovine  19866881437151
cccttattgtctaaaagatgcctcctgggcctctctctgtgttgtttctttactgtgtcacctcaatgacatttaattttacaggagagatttcacataaaaagctctccctcaatcccacgtgcagattaccatcccagaaacatcgaaactacctgctgaccctcatggaccggacgtacttgctcctctgccagtcaggatacttgggagtcactaacccaagtatataggcagtgaaagggggtctcggatctgactccccagacgtcacaacttattcatcactgtgatgttaggagccgacactttcctacagtgaagatcacaggacttaaggtatagtaagttgatcttatcctaaatggccccttgtgggagcagagcccagataaactgctgcggttgtcagaggaaacagcactttgaaatatcagaattcaagtccaagagacgctgcctcaactcaagggagaaaactcctaccaatgtctcacgcccattttggtgcatcttcagaaatctcaatttgggtgggccactcatttccccaaattttccttcccatcttggcaaaagaaatccatccctgactttcccagcatctgggattatgaacgtgtcctcatgcagactggcttattagcaccccgagccatcaacgcatcacctacaaggcgagagaggccctcggagcctcatctactttggatcacacttcccctctccacgttccctctcactgcagcctgataccatgcgactctcctggaaggaagccaacactgctaaaccgctgggagattgttagtctaaggaccaggatgctagataaagagccttgtggtcacccactaacatggggaaagcccagcctaggtctgggtgcgagggaagcaggctggagacagggagagaggagtaccgggatgagcgtcagcgagaccccaccccgcagccgcagtgcccgctcgggctcctggcacagtggtacctggctgtctgcagactcagtggactcctcggggctccgcagggatgggttcggcaggc

SEQ ID NO: 33676 - DNA, 1172 bp, Bovine  19866881486949
gttttccctttaatatggaattaggaatcttcccaggacaatgcctagatgtctgattttttccatcattcttgcctggaactccatgagccctttcaaacccaagtctttcttcaaaccacggaaaaatttctttctcgttttaaaattatggcttctcctccatgtgttgcttttttccttctaggctttgtattattcccatatgatgtctcctgggtcttcctccgccaagggcttgggttttccttgcatgctttctgatgctatttttgctttgcgttttgcattctctcttccattcgatttcccaggtctccatcctctcctccaattcatttgaaatttaaaatcatgtttcttacttcaggaaagtattttctttcacatttgattttttttttaatgcttgcattgtttttttttcttcctgttgctgttcagttgtggcttgaccctcccgtggttctgagtgaattgcaggctcttactcctggctgttggtttcctttgcgtgcttactgttttccatttgtctcccctcaaccccgaacttcaatatacattttattaagttccacatcttccccagctttattgagatataatcgacagataaaaactacgtatagttaaggtgtacagcgtgatgttttgatatataaattccttgtgaaacaatgatcacaatcaagctaattaacacattcatcagctcacatagttttttgatggcggtggtggtgagaacacttaagaatgctctcttggggcttccctggtggctcagtggtaaagaatccgcctgccaatacaggatccctgatcagggaagatcccatgtgcctcggagcaacaaagcccacacctgcaactgttgagcctgtgctctgctgcaggagaagctagcccaataagaagcccacgcaccgagactagagaaaagcctgcacagcagcgaagacccagcacagccaaaaataaacgaaagaaataacactattaaaaaaagagcaactcagtgtatttcaagtacataatgaagtattattcattatattaatatttctgtcatttggtctccagaacttattcagttgttccgcataactgaaactgtgcacccctccgccaacatcttccctttgccctccagcccatggcagtgaaag

SEQ ID NO: 33677 - DNA, 698 bp, Bovine  19866881789357
gagtgatcagcataagcaggaaagggggtcccagctggacctggaggagaaaagggccagaggtgtggataaaaccaagcactgggtgtattggagccctggagtggagaaggacatgtgagtggaagatttcagagttggagcaattaattactggacagaacaggcacccgggttttgccacggacatacatagcccaagtgaagtgaactcagtgaaggaggccaagtaactgaggcttgagagttgtttgggtcatccctgtggttatccaagccatcaaaaggatggcaggacgtttgaggtacagagaaggaaggcatgccacgtcttgggtgaatggcgttccagcaaatgagaagagggttgatggccaccctggaggagcctcagaagactggggtatttttcctgagagcagtggcagagcagtgacctgaaagctttgttggttgtgggtctctctggaagcagtcagccttggctcaggttcactgtgcttctgaaggcatcctgattccaagtgagcagcatggtgacatgtagtattgtatttctgtacctggcgtggaaatcatctgagggtctgcgttaaaaattcagcttccagggctccactccaggcccactgaattagaatttctaggagagaggactgagattgtatattttaacactctactctccacacacatac

SEQ ID NO: 33678 - DNA, 968 bp, Bovine  19866880422333
tgcttaccatttagaaaactttctctaggacaaacttcagggacttaaaaaatgttttccattcattttcttttatttatttatttttaaaaagtacacatgtaattccccaaagaggataaccgtttggaggaaaattactttcaactgtggttcttttagtcataattgcctcggttttgctcctaggagattgctgttttcagctctgtgcattttctggattagaaaagcaatagattttctcctattgctctacatcacacaatgaattaacaccttcaattttgttttcctgtgctttgttattataatgtaataagccatttggcacaccatgtttccttcattctgttgtttggctgaaaaacccacttgccaagcaatgtgcccatgatctgccttagtctttaggttgatggtgtgattctgatttgtttcaaaatgatgctcaggatggcaggatatttggtgatgatgtgagatttgcttgagagatcattttcctttaggctttaggatacgaaaggagggagactgaagcagatggggaggttaagagaatgaagaagacctagatgtacaaggtgggatggacctcactcaggaaattaacagtgatatgaatgctggagtgacttcatggggaacagggagatactatcttccttctagaattttctctgggaggagattcaaatgttaaacctttgttttggtagagggggaggaaggaagtggaaaagcagaaagtattttctcctggctcactgttgcttacttggagaacacttactgtgagaacatctttatactctgcttctctggtgactcagatggtaaggaatttgcctacagtgccagagacctgggtttgatccctgggtcaggaagatcccctggaggagaaaatagcaacccactccagtattcttgccggagaattccaggacagaggagccggcagg

SEQ ID NO: 33679 - DNA, 1625 bp, Bovine  19866880456338
ttagcgatgcttaatcccaccttatccctcaggcagtcctctttcaaagaacctcacgtttactaaactccactctctgtgcaagtgtaaatcccctccctcctgcagcctgcctcgcagcgaagcactccagaggtcccattccatcctctgatccgcttcaatactgcgggatcctgctttcctctgtcagataaaagcccaggctcgcaacagcacactctgttggtaccgccatccagtaaacaccctcactcctggcagggagacgcgcggcccagcccccgtgggggaaatcagggcttggcgtgggaaaatgttaggtcctgctcccaggagtctcttccagagatacatgggccaagatacagaaggagattcacgtggctgctccctgtagcaacgactgtgatggcagagacaaagacattccccaaattggaagcaaccttctaccctgagtgggcttccctgatggctaagctggtaaagaatccacctacaatgcgggagacctgtgtttgatccctgggttgggaagattccctggagaagggaaaggctgcccactccagtattgtggcctggagaattccatggactgtatagtccctggggtcgcaaagaccgagtgactttcactttcgttttcatggtcaagttcaagatggcagatccacattctccaaaatgttaattttttgcttgaaagcttcatttttcattattaatagacattgcaggttgtttgccttgaaacaacaggcttattttatccatgttcaggaaagggtctagcagatacccacgcataagtaattatagtccttgaggcttttaagtaaaaacaagcagctggttcagctcatggctcagccacacgagggcgctgctgcacctgctgtcacacgaggcaggcgtgtcaccaggaccccagtcttatcacaggaaggttagaaaggcgtatagccccgtggttgagtcttaatacaatgaatttttatcagttcatcaaggacagtcttagctgaagctggtgtgtgcccgtggtgagggatacttgctaaaatgccagcagtttctcccactaccggttttgcacatcactgcagatgaaaaggagagggtgacaacttagtattatttgaaaatagtttgacctgatgggtccccaggaggccttcaggaccccaggggtgtgtacagcacactttgagggtcagtgcaggaagtcatggcccagtatttaagactgccttcagtatttaagactaaagagctttttctaacctcgtgcaaaaaaaaaaaaaaagccaggcttcccggagccactggcaggatttgaaggtgggaaagcgattcttggtttaataccaagaactgcgtgctttccccgcccctggtgttttcccaggtaaagcgtggggtttgatatatctgagggaaagacaaagaagggctgtttttggagccagcatcaggaacctgggatgtgctcccaagagcctaaccatgcggttttctcgagagaacagttgctttccgaatgcgctgacaccatgcacgtgcttcctgtgttctaacccacctgtttgccttcctttcctaggagagaaggtgcacat

SEQ ID NO: 33680 - DNA, 949 bp, Bovine  19866880707847
gatctctttacagtagtaagaaaagtcctttacgggtttatccttaagaggaaaacctactgatgattctcttcttccttgccaccaagagataatgtaattatgtaaatttctcacagtgacccactgactgatgagcaatggatgtggaattcttaaataggaagtaaataaactgactcaaagctgtgatggtataaagtctacgtgagcttgctcatacaagattcagaatatctccctttggcatacttcacatgtctgaaaatatgctgcaattttcagggacaggaaattagttcaagtactttaaaaaaaaaaaaaatttgtacttatatattctttttcatattcttttccactgtggtttgttacaggatactgaatagagttccctgtgctatacagtaggaccttgtttatccagcctatagatataaagttagcctctgaaaatccctaacagtccatggggtcacaaagggtcagacacaactgagccactaaagtgaataactaaaggccattccttccgtcctcaaccctcccacccccttggcaactataagtctgttctctatgtctgtgtagctcatgtacttttatgaaaagatcgatctattcaaaggcaggtagtgtcctgaagttctaattgttttagagaaaagggggcaatcgtctctcttttggaatgctgaatgacctcgattggtactgtaatccccacagagcttttgaacagatgaatggaaattaccacatttctcccagcttagacataaccaaaatcccttcttggagtcatcagtaaggaatttgcttcataactgaacctgtggtttctgggctctctgccaatggcaggaatgaataaggactaggataaacacaagcaagaataaaggaaggtgttttgcatctgaatttatgtctctctcttaatctctat

SEQ ID NO: 33681 - DNA, 3956 bp, Bovine  19866880719773
taaataacctgttaactgtgatatttttctgatctgattatttttaattatttaaaaaaatattatttatttatttggctgtgttgggtcttataaatagttgttgccacaactatgtggggtctaggagggatcaaacccaggcccactgcactgagaacacagaggctgagccactgggccaccagggaagccctgattgattaatttacgattcaggtgattctgcctcaaaagtgtgttttccatggatgcatttaccactgaacccaacaatcccactggtagaacttcgtcatagacagggctgcttatgaacgagaagacgtctacacaccgtggccctctcggccctgttcataacagcagcagcccagggtgctcagccttgcacgagttaccaagcaaggcatgtgcacacagcaagttctcccgtccatggaaaaggaggaggcagacacctctttaggtactaaagtcactcccaaaaggtacgaatgagtgacaaagttggggcaaaatccgctcccttttaggtaggaagatggaaagaggagtgaacagggagcacaggcttgcacgtgccgcacacagcaccagggcgcagaaacgagtaacgaacacaaagcgtgacccaagtgtggcggacgggctgtgggaaccagacttctcaacttacacttcttcagttttatttttgaaccatgtgaaacatctaaaaataagttttaatatttgatatttctttccttatttagaaacgaagttctgaatgtgggggtcgctgaaatggggtgtaaaagttttgtgaagtgaagtgaagtgaagtcgctcagtcgtgtccgactctttgtgaccccatggactgtagcccatcaggctcctccctacatgggattctccaagcaagagtactggagtgggttgccatttccttcttcaggggattttcctgacccagggatcgaaccccggtctcccgcattccaggcagacgctttaacctctccagacacaggtactgctgcttctatcagattagatcaggacctgctgcaacagacacagcctggggctttgcagatcctttccgctctccatgccacttgcagctcagctatcaggttgctgttgctcttgttcagtcttaagttgtgtctctttgtgaccccacggactgtagcatgccaggcttccctgtcctttaccatcccccggagcttgctcaaactcatgtccactgagtcagtgatgccatccaaccgtctcaccctctgtcgttcccttctcctcctgccctcaatctttcccagcatcacagtcttttccaatgagctggctctttgcatcaggtggccaaagtattggagcttcagcttcaccatcagtccttccaatggatatttaaggatgatctcctttccattgatttgatctccttgctgtctaagagactctcaagagtcttctccagcgccataattcgaaagcatcaattctttggcacttagtcttcatggtccaactctcatgtccatacatgattactggaagggccataactgactagacagaacctctgttggcaaagtgagtctctgcgtttcagtcacagctttttttttggtcatagattttagctctaccctatctaccaggatctacagtcaaatctttcaaaattctgttaatgtttcagcttgaggcacacaaaataatcacaaaaccatctcatgcttctcagaacagagaaagaaacacaggggtcaaagccaaacggacctcagttttcccggcacacgctgttttaccaggtgtcctcagagccgcgacccagtaaacaccatcaggaaacaagtgctgactgactctggctgaaacgtacatgtacatccccctgcatgggcagtgtttattcatcttcaaaatatttaatgaaaacccgtgcaccaaacacatcatctccctggaacctttcacagcttcaggagatgagaattagagcgaacacatttaaaagagaaactccagcctgtctaatgaatggcaaaatctgacatgtgcgtatgtcataggggaggcagttagaacagagtccacagggaggcaggaagcagtcaccctgcctggccctgggtcatcctgagcaagacacacaattttccctggtgatctctgctccctgactatgtctcctgccctaaacactgtgtcatggtcgtctgtgggaaggtggctcgctgattcattgtttatggcttcgctatatatataattttgtgatcatctaatatagatggtgtcaataccttcttaggtctttttcctgttttaataaacaccttaatgtgaagatggagtatgaaaatacttccaacatgaagcattcaacatagtcatggccacttgtgtggctccgtaattacatgctgcacagaaaacacgccttaatcacaggtcttgggccgatcccttcaccctagatccaccctggggctcagaggagggactaagtctttgttcttggggcaactctctgttcctcagtttttcttcccacagggatttatattagcagctattcaaacagaccaaaaagtgctctttttccaagctaatttaaaaaaaaaattatatagatcctcccattatatatttttaaaggatgtgtgggcagatacaggtttgaacggctatgcattcggtgtgcctggggtggctatgttttctgattaatagggacaattctggtactaagcaaatgcctaaatacagcagaaccacaaaaagactcaactaaaatttttaaaatcactaaagcctgatgggtttagacttcccaggggtcttcccaggtggcactaggggtaaagaacccacctgctaattcaggaaacaaaatgagataagggttcagtccctgagtcaggaagacccccaggaggagggaacggccacccactctagtgttcctgcctggagaaccccatggactgaggagggaatggccacgcactctagtgttcctgcctggagaaccccatggactgaggagcctcacaggctatacacagcatctcaaagagtcagacaggactgatgtaacttactgggacagcctttttaatgtcttatcttacactttcctaaaaggtgtaggtcatctaaaaggcataagcagtcatatgtggtggactagattcatccttgaggcagcagatttcacgatgtagggaagaggatatttgggttgaacaaacgttaagcccagctgtctcaaaacccttggggaaatgtaagaggcctgggtcccagagctctatctttccttgcctacatttctggtgaaggcagagaagcaaaggacgaggccttggccctgtgagcagagttcaggcttcctctcaggagtgggtgtctcttggccaggtgggctgccccgggaactgggaaggtggtctggatcggggtgaggaccctttagttcagttcagtcgctcagtcgtgtctgactctttgtgaccccatggacgcaaaggcacgccagggaggacagggatggacagggcttcctttccatcaccaactcccggagcctactcaaactcatgtccatcgagtcggtgatgccatccaaccatctcaccctctgtcgtccccttctcctcctgccttcgatcttttccagcatcagagtcttttccaatgagtcagttctttgcatcaggtggccaaagtattagagtttcagcttcagtatcagtccttccaatgaatattcaggactgaaccttagcaactgcttatattctgagcaggggaaccactttaatatatctaccctctgagctggcgctcaccaaacccagatgatgggcaccaggcgaggcctggggttcctgagacagcacacactggcagcctctgagtcctcctcttccgccctgcaaacctgt

SEQ ID NO: 33682 - DNA, 889 bp, Bovine  19866880755346
ccaggctcctctgtccatggggattctgtcatgccctcctccaggggacagtcccaaccaactgagaccaccaggaaagccccaaagatacaggctgcaggttggtgatggtggtttagtcactaagtcatgtctgattcttgtgaccccatggcctgtagcctaccaggctcctaaactgttagaggagaaaaatcaatgagtgacagtaaattatatgatccttttcaaattcaaggacaaaaagaaaaattaaggtttagtgtcactgtccccaaacaagaaaaaacccgactatattcattagtttttaacatgaatccatataaaatgcttaactgcagatataatcagatatcactcagaattcagtgtcaactagagcctaacacagtatatgcttgattaaatatttcttatatgaataaatgaaataataagttatatttaaacatttttcttgtgctactaatgaaaacgcttttactaatgatgattaattttagactattggaaagtcattcttataatcacatacctggaaagaatatattagcatcattgcaccattctcaaataaatttaactgctttattgtttaagggccataagcttatcttttgcattagagactgataatttgaagcattctaaatagtcatttgcataaaaacattaaaattttattcctggataaaggtagcaaattgtgtttttgaagtacagtacctggtatttagtgatcatgttttccagcccttcaattttagaatcttgcagtactgagtatgtcttgaaggttgtaaagatatccattatcttggcaagacgtctgtggaaagtttcaaattttccaaaaatatacatctcactgaattcaaattgtttt

SEQ ID NO: 33683 - DNA, 1280 bp, Bovine  19866880767401
tgctctctcggctggaggagctccggacatcctcgccaagaaggagttgccccaggatttggagggggcgcggaacatgatcgaggagcattcccagctgaagaagaaggtgattaaggcccccatagaggacctggacctagagggacagaagctgctgcagaggattcagagcagcgagagctttcccaaaaagaactcgggctcaggcaacgcagacctgcagagcctcttacccaaggtgtctgccatgctggaccggctgcactcgacgcggcagcatctgcatcagatgtggcacgtgcgcaagctgaagctggaccagtgctttcagctgaggctgttcgagcaggatgctgagaaggtagcggatggggccgggggtgctacagtgcttcctgaagggaggctgcctgagtcgctgggtctgagcacccgaggctggtttggttgggagaaagggcggaaaaaaagggctggggagaggcgagccactcacatggcctcggttagagagcagcagtgtcagttcggagatctcccttccgtctgctttccagcgtttctcatcgcgcatgagagcctcttctagaaacttaaagtggttaattactgatggtttggtttagattgcctgtaagatagacatgaatattttcaattaaaagggtgaaaactttatagaatatcttattgaaagcagtaatgatgcatgtacttttgtaatacttgctcttccacccagaaaagccagcggaaaaacacccttcagacccattattgaatttgttttcacaataaaaggcgaataatgaattaagaataataacttctgggaaacaacaggcaatacttagttacggtttcctgtcaaaccagcaggtcagagtgagctcttgaatgtcttagcaacgtgaaaacaggacacttacttagaggaaagggttgcaagccgtgaatgtgggtgaattgatctgtgttgaactgagctcactgaatccttttcaaggacaggaaaatgttttataaagttaagaaagcctattgaagtctttgatataaagggatcttttgaaaggtgacagtccagcactattatcccatattattatttggtaagcttctaacctctatttgtttaaggtgacccttgcatagcacgggggttggggggtgttgacactcacgcagttgaaaatccacaaactgtgctctctgcctctaaaacaaaggagttgctgaatgactcacccggggatgagaggctgaaacagtttggt

SEQ ID NO: 33684 - DNA, 723 bp, Bovine  19866880989473
gtcggacacgactgagtgaccgaacacgactgtcgccaccaccaccaacagagttaagtctgagaggtgcacgccaccccacagtcactgtgtggttccacacggcgcttagacctgaacttgctctgcagagcacagcgcatctttctctcaacgggcatcacccttccagggccccgaggcctcttctgcgctcagccctcccttgcccccctactcacttgagagtcccgtcagggttctccatgatgactgcgctggtgtgccccaggacgaagcccggaatccagccctcggctgcggggcactggtcagtggcggctcggaacaccagaaacatgttctgttgattgctggccagaatttgaacgacctctccttgatagacgtttatctcatcctccttcactgccgtgtagtcgtgtgtcaccaacatggtggagatgttgctaccgctgctgctttcactctgcagggggagagacggacagaaaggcagagcggaactgaaagggggtctgaggacgccaaagcgctcgtccgcgtgctgacaatcgagtaacggacaatcaagatttctctagaagcaatgtaaggataatctaaaacgacaagaccacagcgatggcgaaacactacttttggaagcttgattatttcaggtccatcttccttacaccgttaaagggacggctcgtccttctgttaatgccacgctgggtt

SEQ ID NO: 33685 - DNA, 1140 bp, Bovine  19866881002156
ttaggggggcagggattcctttcttcttctgcactgccctctgtaccgcgctctttgtcaccattagcacagcacgtggcacacagtgagagctcagtaagaggtggccacaaactatgccgtatttataagtgacagagcagtaaataacttctaagactctttccaattctatgatttcaacagttcaaggaaacaccagagtaagacaaagggggaaacttttcccacatttttaacctgattaaggggcccattcatgtgtcatccatgacgtgtgatagctttcccacaaaggacacccaagaatgtgaagaaaaacccaggaactccctccggaggtcagaccgtccagaccaaagctgacttgccacagccatgctgaggagggggtcagcagaggacagggctgtctcccaggctggtgtcaccctaaaggggttaggggcggtcaccagccccctgcggtggacatctgttaacatctgcctgcaccccgaggatccacgaagcagtctcggatcagggcccccaccgtctctgtgccactgctgcctcgggcaccacaccctcacgtcccagcccgggggggcaccccaccccaccccacctcccgaggaactcagcccttcccgcccagcacccaggagggaaagtgtcacaggagggaaacagggagcaagaatgtgattccatcgcggcagcgccttgctgggacccgtgttacaggggcctgttttcccgggaggggccagatggatggcgagcggccaggccctccgcactcacctggggatacaggccaggtaggagatgagcctccggaggtcctcctgccgtattctgtcatggttgctgcgggccggggaaggtgaggatgggacccccgcgcttgtctgtgccacctgcaaacaaacacatgcgcacgctcagacaccaaggggaggacgcagctcctgaggccctcgggcgcccagcatcaccaccgcccgcccggcccaaaagaccttcgagaggccagtgcccccgctccactgggaccagcgtcagggccacccgcacagggagggtgtcccagaaccctgtctccttccttcagggggtctgtttcctcccttcttcagttctatggttggagag

SEQ ID NO: 33686 - DNA, 1672 bp, Bovine  19866881016993
ccttacctgtccgccctgtacaccccgactctagccgtaaatggcatccgatagcttgtgaggccacagagctcctgtcctctgcactaatctggggaaatggatggcacagaaaatggtgagcttgtccccctcctccctgtctggccagtgctcccggctcctttgctttccttccttctttctttgaaccccatccgcacagtagagccatttttagtatcctgtttttggttcccgattccttgaaggattcattcactagcccttaagcctgtcactcttctgttgatctccgtctttccctccttagccagtagcctagccagcagttgaaaaaagagttagaatcctcccccatgcccagtcacctctttgagaaacattctgatgggacatggctgcagattaaaaccagactctgtctgctttccacatgtatcccagacaggtcttatttagtgtttcatgtcagaatattgtaaattttaaaagatggctttaaataaatgcaaacaaagacaaactcgtggtcttttggtctggaattacttttaaaaagaggctgagcttgcaggagaattttccgtctgtccagtgactaacatgaggcatccccctcccccctctctttttctcaacttcctctctaggcctcttctcggttattagtccgccccaccagctccgaaacgccgagcgcagccgagctttgtcagtgcaatcgaggaactcgtgaaaagcaagatggtaagatttcctaggggctcaggcctcagggctggacgtggctcatggagcattggggtgcgggggtggaggggggggtgacctcacaggtgggtctctagtctgcaggacagatcctcaggttcataattggcttgaagactcacaggacttagcgaagccacggttgcagttcattcctgtgaaaggatggaggtgaaggtcagccagggaagatgtacaggagcaggtccgggacgctcacgttcaggccacccttgtcctttccccatggagttacgtgcccagtgctagcctctcccagcgtcgcactgtgtgtgatgatacctgcagggtaacaccaacaagggccaccaccgcccaccccacccccccaaccccactctccagcctcggtggtcagagtttttatttgggctccatcacatacacaaggttgacccctcacatggctcaccccatcccctgctcctctggagatcaagatagcacatgacccaaagcccccaccagaagtcactcagtgagtatatagattgtctatctgaggccagaacccccaggtagacagacttcatcaggcaggacattccaggggcttagagggacctcccaggagccatggtcagccctttcctgacccacatggtctgcagtgctggcatcgtcatagccagtgtggtcagtcccattctcgtgggtcgttggtatcgcaggtgccactgggggtctctggctgcctctgcgatccttcactggggtctgcagtgtaggagggagaagggtttgtgttgctgtgtcagggctttattctcttagtgacccattgtccctagtgggtcagcatggcttcatttaataaaagccccaaatcggatgttgattctttgaagttaggtatgcattgtttctgactgattca

SEQ ID NO: 33687 - DNA, 917 bp, Bovine  19866881041690
cagttttaaatatttaatgaatacagtggtagtctccatggaaggtatcttgagggtagaatttttgtgatttttagtaattcaggagctgttgcctcttacccgatggatgttctcaggggtgatagctctggcagggttggtcctgatgaagaacacacacaccccagtaagagcaacatcttttccctcggtcacaaacaccttgggttttttcatctttccagaaacagagtttactcctcctggagagccaagttgccctacaaatgaaaaggattttagtcccacaaatgctatatactacgtccacgtggtcatctcttagaatgaggcttccctgttaaaatactgtcatgttgactcatcctggtgacctacaagctccatcccttggaccacctctagcctgaaccctaaaggaatctcaaaggatctgttttatatagtgatcattttgagacagacaaaaatactgaatccctgtgctgtacacctgaaatgaatctaatattgtaagtcagttatacttcaataaaaaataaagaataaaaagtaaatgaaaggatctgcttaattccagaccacaagttcacttcaaaattggtgctccagggaaaaacagaaatggaagaaataggaatgagagttctgctgctgctgctgctaagtcgcttcagttgtgtccaactctgtgcaaccccatggactgcagcctatcaggctcctccatccatgggattttccaggcaagagtactggagtggggtgccattgccttctccaataagagagttcagtccagagcaaattcttgctggagctgcaagtcatccttgatggggccatcaaggggccaatgagaaagggtgaaggaggagacagcatctactggtaaatgttgtgcatcagggctt

SEQ ID NO: 33688 - DNA, 653 bp, Bovine  19866881129228
ctgggtgtacagagcacgttgaaggagacccttgcaaattcgcactgtgggtggggaggacaccaacttcagataataagattgtccttaaggtacgtccactgaagctggggaatgcgctctgtgacacattcaccatatctgttacacgtgtgccttttcctgttgttgaaacaggttgtcgtgtccttctttttgttcccttggtggcccctaagcttggtgatcaccacagaaagaacagtaagatgaaccccgtgtggtattctagtggtgcagtatcttgagctaaacttctgctgcctacaaaagatcacatggagaaaggtctttctcatcttctccatgcttctggtcttatagagtatttttttttaagcgagtatttatccagggtgattgtttaagagatatagcaagttgaggtacaaaaggagggagctatgaaccagtagctcccattgtacacttgacctctggtttccagaggaaaataggcatcgctgcatctgtgagggccttttgacactttcaaggctgaacgtgcccagaatctctatggggtcctagaccctttggctttctagtttggaagcagagaagggcggggggcataatcaggtacagggtttggtatgttatcgtttgaaagt

SEQ ID NO: 33689 - DNA, 1712 bp, Bovine  19866881153465
aatgtttttatggtaaaggacaccacacctttttctcctgctcagactcctctaatggcttcctggtgcacccaaacaagtacccttagtttacaagctctgtaaggacctggcctttgccaactctactttctggcctcagtcactccactacagtcatcctggggactttctgttcctcaacagtgacacaccactagatttttttttttaatgcacactggggttgcactaaatgaattttgtaaaaaagaaaaatgcattttgtaatgaacccaagatgggaaaaaaattaaagttccataccttcatgttactgaagttcttcttgtatgtgtctcgtttctggaaaagagcagctgcaaagggtgaaacttgtagacccatctgtgacatgcactcggtttctctaaataaggttagtatctgaggatcaaagtttacaaacagttcccctgtgccaggagccttcaccaataaagaagcctcaagtcctacgtgaatttcttcagtctgtgaggaaagagcaacattactattattagagagttcagtgcatataacggggtatcaaactcacccttttctgggaataaagatcattgtgtgtcctttcatgggtttgagcttcgcaaactaaggacaatggggtctcttactcttttcctaacttcacttttaggtgggaaaagaaagccttaaaactcttggtggtaacgtacagttagttcaacaaaatggttggtcatgaatctgttgtatttggtaagtggatactgcagtagagatgacttctcaaaagtcactttgctccctgacaccttcatgccaactcagttatttttcctaataaaagtttcaagaaacctacttaactcagttttcatttatctagaaaagcaatgaaaaacactacagagacatctgttattgattcagacatcaaaagttgaactaggaaagtgagataccattttagaggccttgttaggctgaattttatcctccaaaatacttcctgccaatctaccaagaaatacaagtgttggtagggtatgaaatataattggattaacccagtatgaccaaataaaaattaaaactttgcttaacatgcatgctggtgtttatggacacttaatggagaaaaaaggagcttagtggaaaaacaaaaaaagaaataccaatcaaccaggtaaagaaagcaataaacaagatcttcttccttaggagtttataaattaaataaaaataagtttctgttacctggctttatgacttttttccaaaattaaaaactattatccttcatgaacatattatactctttgactgattacttgcagtcaaccaaccctgtcttataaaatagacacaaagtcaactttccacaggagtaaaactgcccaaggtagtagaggattccccatggatctgacagtggcagcatcatcgtagcgttaagtcagactcacttgttgaagccacgccctgtggtagagaacctcaaactccaggaggaccttggccaccctgttgtaactgcgaatcactggcttcgcttccgcagtccggagcacggacgggtgcttctgaaaaagctgcattggttgctgaatcctgtggaagagctgccgggcccacagaatcttcccagcaatgggaggctggtctcgagccaaaggtgggtcgtttttctggctttgtataca

SEQ ID NO: 33690 - DNA, 1250 bp, Bovine  19866881348381
gagttcatgatggacagggaggcctggtgtgctgcggtccatggggtcgcagagagtcagatacgactgagcgactgaactgactgaactctgatcagggcaacctagcctttgggactcactgccttttaaggtgaaagaaacttttttcattcaggtactggtgtcctgccttaccctcatttgcaagcagggaaaagaagttctaataaataggacctattattaaccttcctactgaattcctaataagaaatttaagaaacaacaaagagagttggaaaaagtaatgcatctggctaatggggaaaaaaaagacaaagaaatccaattcaattctctaaccgcctctccctcccacctccttcacctcaaattccctcagcatacccacaaaagtacactttataaattctgcttaaaatatgtttattaagccacataaattcagatacactgatggcaaaacaaattttgacataaaaaatgggtttaatgtggactgactcatctctcacttgggattctcatgcatattcattgagaaaaggaaaaaaaaagagagatgcaaattcccaagggaaagaggacagacatgcccctctgggagggaatcgctgctggagaccccgggaaccggaggaggtaccagcccacgcctggcagcatctccgccctggattcactctgagctcagacagtggcgccagcaaggctgaggagtgctccagcgggggcatggaccctcacgaactcggaagacactccaactgcgggagcccaatgctaccatcccacctgggtctcccactgacactccaggggctgagacctgctcggggtgggggggggggtgtgcagcaggagcagccatgatccgtggggtctctacctgctcgtttgtggggtccgcaataagaaactgaggtggaggtgggaggactggatgggggaggaggtgctggagtaggggagggtaagctctccggaaagctgacttccttagacttgcccggtggctccaatcagagagggctaagacccaaagcttttaagccatgcaggctggggaacctgttttcctttctctgatcccctaattgctcaggccctgatggcgaggaaaagaggcagtatctctccaccgggaagcccagggaacattttttcccaattagtatagaaatgcaaatgcaagtacagaaatgcaaacagacaggcaggaaggacatttacatgtaggtgtgggg

SEQ ID NO: 33691 - DNA, 1326 bp, Bovine  19866881373806
agcagtccgtgcagtccacccagagcaacggggtaagagcgcccggccgcctgcgcccgcctctgtcccgcggctcttctaaacctcccgcctggccgccgctgtcctcgtactaactccgggctccaccagctcctcctcggcattccgcgccctggactcggcagggaatgcccgctaacctgctcccggcggacggcgcgccccgggtctctactaactcgctccttgctttgtgtccgctaacaactgggaacgcagaccattaaccttccgaatgaatgcagcatctctgagcttttcacatcttccgaccagccgagtatcttggaacttcctctctctctcgccgcccctgctttcctcgcacttttttgtttttttaaagaggggtccgtgtcctgccgtctacctcctgtgtaaactgaaacctgtatacactctttaagctttctactcatcgcttggttgtgcccttttatgccttaaattaatctttgcagcgtttttgactcatttgctgggaaaaaaaaacaaactcaagaaatgtccaacagcagctcaaagcaaactcagctggcacaatgaggggaaggaatctctccagtggaaaagtttgcccttccccaccaccacctgaaaacaaaaacaaaaacaaatgcacacgattcactggaagagagactgctttaagggcctctggatgctgggctctggccggcggctgggtgcggaggctcaggcaggctggagtggggcgccaggctctgtccagcagggggcgctgtggggcctcgccggtcactgcgttctcagccccagggttgcggtggtgggtcttccccctctcgtcctgcggcttcctcactgtcgggtttcctacaggggctgatgaatccgatccgtaacacctccctaaaagcatgcggtgagggaatagaactgttctcatgagtgtatgtttgatccttttataaatttttaaatacatttcccctgaaagggtctgttgtctctctttatccaaaaaaaaaaaaaaagctatttggcttttgcatgcttctctctttcctctggactcttcattaatgccttgttggagttgatttggccttattctcacctccagtttttcattgtgtatattgttcacctcaatctttctgtgtaattgaggaagaaattgagaaatggttctttgtacgtttattagcctttcagccttactctcaaaaagaagtgatcagggcaggcatcctctgctgtggccatcaccactgtcctggttgtggtacctgtatgtgtcctgcagagtagcatggcccc

SEQ ID NO: 33692 - DNA, 948 bp, Bovine  19866881486776
ttgcccccctaagctacccccatatagaaatcctggatggggagaaacagatagacggaacttgacaattggtaatgggggattccgtggtgattggaatctgtccaaggtgattccatgcggtgtcaagcttggtaaagtgaagaataactcaacaggaatggaagaatctagagaaggagtgcatgttggagaaaagaatactaaagaaatggaaataaagctctgattctttgctttccctgttggtctttacatcttgaaaacgtgaaggtcaatatgcttatgcttggtcattcagttgtgtctgaccctttgcaaccctctggactgtagcctgccaggctcctctgtccatgggattctccaggcaagaatactggcatgggttgccatttcctcctccaggggatcttcctgacccaaggattgagccagtgactccagcattggcaggcatatttttaccactgagccacctgggaagcccaagaatactggcgtgggtagcctaccccttctccaggggatcttcctgaccaaggtcagtatatgtgagaccaagaacatccagtatctttctctttatttctaaattcataaaagaaagaaaaaactcacagttaaaagaaagataactaatcatatgtggattaaataattactttagctgtcttccctcaaaaaaatttttgaaaacttaaattaagtggtgcagaatgttggctttgctaagattgctgtgagttcaaaatgtgcagcaaaagctaaaaaagatgcataagttttcttcagcttcatctgccaaagtggaagggacaaacactagtaaaatcccaaaggacaatacagaaaactgatgcatttagagtaaagcatccactaaacagaacacccaagttccacaggtatagattggaagaatagagatctcagtgttaatgctca

SEQ ID NO: 33693 - DNA, 1574 bp, Bovine  19866881562737
attgaaattgctgtcagtaatctgtgagcagagcaacaccccatccagagacccgtaagtttgtaatttcacctaacgggtctttaattgaagagcagtgtggctaattatgtggttcggtatagcagagagtcagaagattggagttttaatcagcctgggggatctgaatgacctctgcttatgtatctacttcttaattcctcatctgtctaaggagcaccctaggtaagattgtcttgtagctcttgcaggttcagaactgtgacttggtagctgtctagcatcttctgggccccagtgcagcaggggttgtcggcggaaggacgccgcccttccttggtttggtccggttcctgggcctgtgtcaggcctctctttctcgggagtgatcccaggttgtcttttttcatcccggtagatgtttgactggatcacacacaacaagggcctgtttctgaacagctacactgagattgggaccagccaccctcatgccatggagctccagacccagcacaaccactttgccatgaactgcatggtaagatgccggggtgcaggggtgtcggggcgcaggggtgtcctgccgctgagcgaactttagcagacgggggagggtatttacacggctccttcccagcacgctgcctggagctcgtgtagggccttctgacgatccgatgtagcagctgacctccagtgtgggagattctctgtggcagcagtgtgcaggtagcttgtttttaagtttgtaagcaaacagaagtgaaaacaagcaagccaaccaaccagtgaaacttgaaccagttcacctggccaggcccacatgcatggttttgatgctggtctctgaactatccctctcaggagcccacggggctcttttcagaggctgagtcacgtaaaccagcccgctgttcatttgctggcagcccttcatgatgaggatgtaagccagcctgccgcccttctcagaggcatcttccagttctcctaaaacgtgagccttcctcccaagttaagtggagggccgggggtctgacatcagtctttcctgcagtcctgtggctctctggatgcccttggcctgttgtggatacgattggggttgctctaagattgcagtgcaaaatcccccgaaagaacccaacagtgaattttaaataacagtcttagtgtagttttggaattaatgtaacaaaaataaagctatacgttgttctgtaggacatagggttccttctgtagagagttactctagaaatacttactttagagacagttctggtgtggactttgagccagacctatggaagttagctaggcctctttgcctggtaatgtgtgtctaaagagcattgaaacgatacagagaggcggtcgttatttaaattagttcagtaagaggccatttcattagaattcagtccacaaagtgcttcactttggaagttaccaaaaaaagattcagcaattaaaatttatgtaataagcactatcccaaaagtctgatactcttcttgagtttgaggtaagagaattttggggtcagagattgagcctgggtgtag

SEQ ID NO: 33694 - DNA, 1406 bp, Bovine  19866880405053
agctgatgaaaaagctgtaactttggtattccttaaaggcattaactcttgtaattgggcagctctcttctgggaccctcaaagctctgcctttggagttgctatgacagtattcctccctgaggatgtgaacattgcaagccaggggtgttccagagtctgcccagcgtgactctcatttcctcgccctaggagcttcataggctgctgggagctctgctgctgctgctgctgctaagttgcttcagtcgtgtcctactctgtgcgaccccatagatggcagcccaccaggctcccccatccctggaattctccaggcaagaacactggagtgggttaccattaggaacactcactgctgccccctgcttgcaagctcttctccagagcatctgacccactcagtgtggccagagctgagtcctgtgaccctgggtttagttccacctcagctgagctctcagtgggttatttttgttgtcattgtttagttgctaagtcatgtccgactcttgtggccccatggactgtagtcctccaggcttctctgtccatgggatctcccaggcaagaatactggagtaggtcgccatttcctcctccaggggggtcttcctgacccagggatcaaactcaggtctcctgcattggcaggcgaattctttaccactgagctgcctggggacctaaacatcttagtaaacagctaagaaatgctggttattttgtctagttaatacttgcttcaattgtgttccattgcctaataaagaattatgagggcttccctggtggtccagtggttaagactctgtgctcccaaagcagggggaaagagttccatcctaggtcaggaaactaagatcaggtatctcgcatgtcgcacagcacagcaaaaaaaaaaaaaaaaaaggatggtcttccaaaatgtattattgaaatgcaataatacatttgatttggtttttggtttgatttttattccactcattgagaggcgaaggaagtggaaaatcaagctgatttcccaaaacattcatcctcccagcttttgaatcctttgtcctggactcatctctgccttgtcaatgtctctctctctctctttttttaaatgtcacctagaatgacatgcactctcaatgtggtttgaattgccggctaatcacaatttcttttcctatcttgttgagataagacgagtctcacctgtctgcagggcttgcatttccttcagggcattgacttctctccagagcttttccacttgagtcttcaggtctccatccttctctgaggattttttagagtggggtgggataggatgaataaaacaacatatgattaaaataaagtacaaataaaacaaaataagataaagtttagggatacagaacataagccga

SEQ ID NO: 33695 - DNA, 2068 bp, Bovine  19866880420892
aaataatcatcacaagaaagcaaaggacgagggacttccctggcggagcagtgggtaagaatcctcctgccaacgcaggggacgtgggttccacccctggcccaggaggatcccacacgccacgggccaaggaagcctgtgcaccgcaactactgtgcccctgcacgagagcccatgagctgcgactcatgaagccctcgcaccctagagtctgcgctcagcagcaagagataccaccgaaatgagaagcccacacgcagcaatgacgagtaaccctgctcgccaccagagaaagcctgtgctaacagtgaagacacagcgcgaccaaaaataaatttaaaaaaaaaagggaagaaagtgattgatgaggatgaccatctctgtgcctggcattctgccagccatctcacctgcacaacatctaactccatcaggtacagtaaataaggcttcccattttaaaggtgataagactaaggctcaggaagagtaaggttggttatgactcccaccactttggagtaagcccgatttgtactcaagggggcctgattccagagctcatttcctacctgaaccagtggctggagaagaggaggagaaccagagaaggctggatgcggcctggggaggtgagctgggtctctgcaggtggatgaacagagggtcttgggtgggggaaaagaaggaattgcccagcaggtaccgggtaaagacaagagtcaagccctgggccttggacgagcaccaggggtacaacctggcatccctccagcccatctctgatagcctcttaacaatctgctcacacttcagggacccgcatggcttcccacctccaggggacttgttctcctgccagagtaagacactgaatagctgcctgtattcaacctgacatccacagatatttaagagtctaattcgatcgttacattttttctgtagacacaaaggaaccgcaggcttccggcacctcggggctccctctcgcattcaccgtgcccatttaagcgtgctggggagggatacacacgaagcagggccgtttaactaaagatgctgtacaatggggctacttcgctgcctgacagtgcaggaaaccttggtggatcctaacaccagccaagagatgccggccaccggggctgcggtggcgtccaacttgctcatgaatatggtggctgaacagatgggcgatggctccagcagccaagggtctatcaactgagctcagaaaagccaaatccccctcagtgccaggcttgggagacgctccattaaggagactctcgttgttacaacagtgaaggatataaactcaacagccagcccactttttcccccgcccccttctcactggaaggctcgtcatgtaggtgatgctataagctctgaaacttcccgtgtgcctcaggtggctggctggcagaaatgcacctttgcaggccaggtgaggtttgtggggtgggcgagatgtggcctggaaacccattccctaacctttcaccaggcctgaaatttactgtgaacggaattcctaaaaatccatgttggcctctgatttaaaaccactaaatccgagtccctgagattacctccattgtcctaagtacatcactgtgacaacatatgcgaactgcacgacctcagagacgagcgcggacaacctccacgtgaggaatgcgccgaaggtggctgtccttggacccacaccactgaggctttagggtcaggctgaggcactgggagaacgctaccatctcaccagcgggctgccgctgtgcccggctcccgtcgtggtggacgacagcagcaacagtaccgggaccctgatttcacacaggcgacaaaactgcgatctgtgttcacttgggacgcgcgtgtcgtctccagctgatggaatttaaggaggaagttatctgcaaatgtacggaaatgagtatgtttttctgaaagacaaaatactactcagccgtaagaaagatgaaataatgccatttgcagcaagacgaatggacctagagatgatcatactaagtcaaataccatatgacgtcactgatag

SEQ ID NO: 33696 - DNA, 695 bp, Bovine  19866880451729
atgaagcagatcaggattagggaagagtaagccacggctccctcccaacctgccgttggtgttgaacagacctctgactccatgttggttttgttttcccctggcaaatcaaggcgtctccccagggctgtgcacagtgaagttttcaagacgtgcaaagacaaccatattccaaatcagagcgggtgggaccctgaacgggggagcatggacagcccaggggtccctgaaaaaccgagcccggatcacctaaatccagtctaacctctaaatcaggtttcggatcacagatttgtttactttcatttggtgataattgttcacagcagaacatatcagaaaattctataaaaggaaccacagccaggaaatagtaaataattaatcaccctccctcccagcctcttgcatctctgttgatataaatgaccgtataattccaaacccaattatcactacttagccgttccattttgtagttaaaatcccacaaaattaaagtgcatcaattgttaatggtaatagaccagacaagggattaaagattattttaatgtttatttcctgtcaagagatcttctggcaggaaacactgcagacaaaaggcgggtacactcagatgagattcatatatttaaatcttctaacttctgaaaacattatggatataattacttgtttaatttactcgttcc

SEQ ID NO: 33697 - DNA, 2019 bp, Bovine  19866880580902
tgttatatctgtcgggtcctttaactataacactgattttacgagagtggaagttaagaggcttacatagtttgtgggggcttctcaggtggtgctagtggtaaagaacctgcctgccacagcaggagatacaggagacttaggttcaatccctgggtcgggaagatgccctagaagagaacatggcaactcattccgtattcttgcctggataatgctatggacagaggagcctggtgggctatagttcaaagaatccgacacaaatgaagcgacttagcatgctcacacattgtctgtgatcatttgtgagccatcagatctaggttacctaacaaccaagttgctataggttttagtatactgaaaaagttctcagataatcacagccttgtgcttgatttttccctcctgagaatttagctagttgttttcctacaccaggagaatactgcgaggaaagtaataactaaagcactttgaatccttcttaataaatgaatatgacttagaacacagaagtgcaagtattaacacaaagactcggtgaggtattatttaaagtcagctgtaactactatacgaaaagtgattccacgtgttaacgttcaatgagtatagagaaaagtcttttgagtctcactcaaaatgtccttaagtgcagtggtccccaagctttttggcaccaggaactggttttgcagaagacaatttttctgtgggccagtgcggggaggggtgggcgatggtttcaggatgatttaaacccatttcctttattgtgcactttatttctgttattattacatgagctcacctcagatcgccaggcgttagatctttggaagttggggacccctgtttatatgtgtttcaactgtttttgatgacgtttagatccaaatgaaaaaaaaagtgtagatttaggtgtacaatctacatatgattaattacatgaaacaatcagtgaagaaatgacaatttccaaataccatgagaattaaggtttaaaatgtttcgggaattattttaattttcacaaaatatattggtcatttcaattttaaatttcactatttaagcataattgaatggattactttatattttcacaaaataggcatttgcaaatataattatgtaaagtttaaaaataaaataaaattaaaaaaaaaaaaaaagcgaagagaataaaaaaaaaaaggaaagaaagaaaaaacagcagcccagccaactaagtggcagcatatgttgggaccacccgtgtccagaatctttcgcgtcgtcttaagagcacgccagttgccagctctgaggggacacaatgactgatacacagcagtcaacctttttttttcccttgaagaaagattgaaagaaaaacaaaatattttgccgccgagacatgggtggtacctggtaacttcaggcgcagtgcaggtgtcacctgaaaagcgactcctggggagcagcactttccccatttaatcagactgcaccaggtcgtatttatagccctggtgaggttggcccattgttacacgatgaaattgtgatgttcagcagtttataccttgggagctggaagcgtttctccatggtgaatttgtaatattaattggccatgtcagttcgtgacaaatgtagtgacatctatttcaagtatttcagctttatggggctgaaaaagtgacatgcgcttgagataagaaatctcacaaaagatcttcacgctcgctccgccgcacctccagaacatgttctcagagatgcagagagcctccagtttttggggggctgttccctcccctcagctctgggctgaggaggggcccgggggaacggggtggacgcagcgttcagtctcctgagatgctgatcgggagtctggcgtggacttgcctgctgagaccaccataggtttgttctgggtccctgaggcttagaggcctcgcccctcagtaacaggaaggtgtgcccttgtcaccgcgtgtggtggttctcgaccaggggccgtgt

SEQ ID NO: 33698 - DNA, 1598 bp, Bovine  19866880600811
gatttcttacagctcaggtttcagtggctcgagaccatttcaccctccacccgcataccaccaatgtccaaacttttgactcaataggtctgggacgaggcctgagaatttctttctctaacaagctgctgtgtgatgctgaagcagctggcctcaggactactgggagaacttcaaggttccacccaagggcatcttgtcatatatctccacgtcaacttttgcttcctggaagaaaacaattgacatctcaacgtaattttcttgatcttgtttgatacaatttggtgattttttttctttttttgagggattttacattttcctggtgggtggttttggttctttggaaatgactcccatatgggggagtactttgtttaattagctaatttaaaacaatgtggcttttcttttttcctctgttgaaactgggtcatttaaattaattcttggatttataatacatataattagttccaaacaatatacaactctatgctctgtttgggagtatcttgattacacaaatgagaaaataactgaaaagcacgatggcgagaaaagtcaacattaaaaaaaaatcccgtttctgatattttggggaccattaggctatgagttgtgtaacacctaaccaaaagtgcttgctgtatttttaacggttcagccatagctcagagtagagtctgaactatttgttgttggctgttgttatattctgttccaaggttcataatttgaaaatcgactttggggactttttcctcggtctattaaaatgattcatgttgcattcaacataaattgtgcattcgcagaggagggtgagagcccgtattcacggcgtaataactaaagtgaattttgtacgagccgcagtttgtggcagcgatgtggtatcatttgtcttaatttttctttggcattacattaggcgagtgcatttacatttccaggtatggctaaccactttaaaaaactttgtttttatagcctgagtaaagggagaatcaaatctgcatgtttatgtgatgtaacatcaaataatgccattttactgtctggaggacttggggattttacattccatttacccgacttcacaaagggaacttgggctgatatgcaaagtacatgaaatatttaccatcagtggatcaggccaggcttctaagagaaaaaaagaagggcaagggagctaaaacccttctgccgttgctgtgttttccttttaccagaactataactaatatcttaagtggattactcactgaaaattcaaatgcatcttaaataaaaccgaactccaaataagttaaaactttaggtcacatttgcagaacagagtaaacatttgaaaatttaatgcttatatatgtatctgatatccacacagacatatatacacacatacctacacaaacatgtatgcctcctgctaatgaaatatttactccaaagaactgagatggattatcttatatttccattaatgtcacttaagatccatatgtttgtgtatagactcacgtgtttgttttgtttttttccagaggccttctataaatgatacactggatttctcattacagttt

SEQ ID NO: 33699 - DNA, 1967 bp, Bovine  19866880627626
cgtgggttcagcctctgctggacctgggtattcagatgtcatgaagtttttttcttcccctgtggggctcagcttttccctgtatagatgtagaagcatcctccattgatgatggtaaagcgagatgcaacttttgtcaaaacctggagttgaccagttgactagcattggtcttgttggctaagggaagggggtcgggattcttggttcagcctgcaggaatgtttgcacagtataggtcatatgccatcacgagatgccaaaacacatggattgggaccgaggatacgactgtctccctcaggaattagggtgcttcatgggaagggcaaatgaatgccagccaggcacacgcagaccatgttgaagagctcacttcacagtctggctcacctctctttccaccttggagactggctggttactctgatttcttctgcctttctccacatttatgggcttcccaggtggctcaggggtacagagcccacctgccagtgccagagacaagagagacttgggttcgatccctaggtcggaaagaccccctgcagactttctgcacaaatacatcattacacaaatcacaggattgtagaataatggtcccttttcaacatgtaatcagatactttgcagagcacctttggatctgttagggaaggagataaatttcagcctgcctttttggcctaatttgcattgcattaaaccttccctgcttccattctctaagagcaggcctattcctccccatttaaaaaatcatagctatatttcctctgtgctcactaagctctagtccccaaaccagcccttagaatgtcacctcccttctgcctcaaaataatcacaagtgaacctcaggatcacctgtctgctaagtggaagatcctggctttaaaccctagatccaaaacagaaagttctagaacatagaccaaacatgtattggctaaggctggtgacatgaaaccaagtttttcctgctttagggaaatcccaactattttcctctccaactctataaagacctagagatttttttttaaaactgctgtttttctaaagagcaacattagtagtcactttggcagaaatttcacatgaacagtgagcttttcttctccatttgctttagcgcagtcttttccattgttcatccagcttcttggaccctcctatccgcacaccgcacttattcacccaggacaggtgtgtggcaccttggagaagatgaaggctgagagaagatcatcagacaggaagtatgttgaaagatgcctgaataaattaccacctcccaggagcggtatgaaaaatggctatttctgtaggacgccagagcacctttttcctctcaaattcacgcgtacccccgtgcgaaggccgggggcgacggggagtctgttcctaggctgtggggagttttctgagaattcagtgcccttgtggtcgggaggcactgtgggtggtccagccagtctccctgcacaggctgcttgtgggaagagttttcatcacagtctttttcctggacagctttggggtaaacggttacgggtcactaaatggtcttgctaatgagagactgagtatacaaatggacaatggccaggccgtatctgatcatagacctctgacctgcagcctctgcagccatcagccagaaatggtcaggacttggtcagtaacacccagcattgctaatttctgtccttacttccaacttcaggaccagctagagaaaaccagatatgctcccaaaccaagcccctaggatgtcatgctcctagctgttctgccccccgcttccccaggctgacagcctccaatcataacacactgaagccttcccttttcctattagaaaatgtgccctcttccttgtctgcctctgagcctctgcccaacgcccccgatggtagctgactcccctgctagaacaagctttgactagaaggccc

SEQ ID NO: 33700 - DNA, 1069 bp, Bovine  19866880693053
tgaatatctgaatccttattttatttatgtatttattgaatcccccctccacaccacccaccacttctgccccccaaccccttgtccaagaatcatctttccctttaaaaactccctagatgccccagcattttcccccactaaaagcgatgtatttctcactgtgagacccgatcgggccgtgcagagtcctcgcttcctcccatgctcacccaacccgaaataattgtctgtatgttccttttattgtcacctctgaaacaagatgaagaaaccagtggtttgctttagaaggcattaacttctttatcacattaatactgactcgtatcttatttcccacttgcagtaagaaaaaccattcaaatcttttccctcacaggacaatatctttaatagcttctgtgtgtttcctatttttggctgtttctgtataaacagacttaatctaatagcatgctgaaccatctaacttggcagaaattcagaaaatcactcatttctatggcaagccaggatgccaagaagggggagggggggagccctcacttttattgcagaaagatttctcttaaagttgtctttcatgaacataatatgtctatcatttgaaattctccaacaccctgactggaaattatttattgcagaaagacacaatggcgaacgagaaactattactccgtgcgcaatttctgtcttcatttcctttccctaagaagcaggagcacatgaactccgttgtgaatgctggtgtggtcatggaggatggtgcccacctctcggcttgtgcgctgagccatttccaccccctgaatccaaaagttgagaacatcacagccccgtgcaacgcccacctggtggcctggcccaacccagagttctccccccgtcctggaacaagagcctgttctgggagaaagcatccttgctgtcattctaggtgagctctcgccacacacacagcacccattctgatttgttgacagtcacacgtcgcagatcctgagtggtctaagaagtcccgggtcccactcctgagcactgctggagaatctcacacgtcctg

SEQ ID NO: 33701 - DNA, 1120 bp, Bovine  19866880707920
tatatttgttgaatgaagacagacacccttctaccaataaaaaaaagcacttccaagctcacttatagacagctggtattgtctgtaatttgcagggagagagaggaggcagcaggatgcatactccctatttcttgattttgtaaaggcctaatcagatatgatgaggctatgggctctactgggtcttcccatttgcattattgatctaaaaaaatataacttacacaggcaaattctgaatgcaaattatcagaattggtgcagacacacgtgaggagctacaagcacgactgtacaagcccctgccttatactgctgcaacacgcgacatgggagcgcacaggacgtgctgcagaagctgtggcgctgcaactgtgccctcaagatgggatctgagagtcggagctttcaagtccccttattcaacagcacgcagtttaaatgacagatttttcttctggagttagaaggccaaatgactgcaactatggatataaaactacataggcagttgaatgtaaaataaaaggcaaaactaagaatgggggggaaaccactgcataaggggagtggaacttgggcaacttcccctttattctttttctttcatacagttgcgacatcttttgaagatgaagcactctcttccccatctcagccatcaattacgggatgctgagtctctcgggaggcattattaacagggcaggaagtggaggtagcagttttacaccagccagacttggaaaaggaaagctacaaatccggctgcaaagatgcagacagacactgaagcatttcagcaagtgtgataatgtggatggcctaggggcacagacccaataatcagaggagagctgaactggagctgatggaagttgcagaccctgccacaaagagtccgagaacaaagaaggtggccaggaaattcctgactgagccactctccttcatgaccctcaagggctgggctctccacagacacttttgctgccttgggttcaggagcagggacttagaccatgggcagggagaccaggaaagaaccaccaggtagaggcatgggccaaaggcaggcacagaagagttcaaaaggacaaaaatggtgcttcttcca

SEQ ID NO: 33702 - DNA, 1359 bp, Bovine  19866880784563
ataaaggggaattgatactcttgattgacaaagtcgaagggccgcttacccagtaatgactcaatggcaaaggctaccactcaggagaaatcccccactgatccgagtgggcgagaagcaaagagccgtcactttcagaaaaggagcagggggttggggaccaaggacagacagacaggaaaatctcggatcagcaatcccaaaatatcttgctgctgaatttggcatagagactctcctagctggggctatttctgtttgcttcttaagtctgcagagatttatgacagcaggagaaagcagagtaggaactgctgcctttaactctgccctctctgtgtttgtgtaattatgcaggcaaggtgcacattcccagaaactggggccctgggggcagctcagaaatgaggatggtctctgtgcctctggcgagctgtgtagctctgcttgtgatattcatgattgttcctttaaaagatgctgctaaggtgcttgtcaatagaaggatgagcaagggaggacctgacccaagcctccctgtggaaagaaagttgttcagtgttagttgttcagtcatatccggcatgaccccatggactgcaggctgccaggctcctctgtccgtgggattctccaggcaagaatgctggagtgggttgccattcccttctccagggtatcttcccgacccaggagtcgaacccgggtctcctgcattgcaggcaggttctttaccgtttgagccaccagggaagtccctacttgcaggacctgagcattttaactagacccagtgttcagtccgatccactaactgcgcttccagtgactaaacaaggggatggagcgctttgccattctgcagctctcacctgaaggaacattgctggcccttaaaggagcaatgtctgctcgcaggtttgacttctataaccaaattgggtcagtggcgtgttctcaccctcagggcccccaggaatgacaccagcctgtacccagcttctcatccacagaatccatctcctcccttcccttcctcccactgcaccactgaccttcaaaaggatgtgatgacagcaatgcgtggcgaatttttggcttatttcaacctccatgcattgcccggctctctgctcagcctccactggggactatgagtggcagtggcagtcacccccggctggccaccccgccctacaaaacctcctccatctctggggctctcacttggcgtccggttcaaaccagggccctcctattccccacacagtcaactgactctgctgagcctcagtttcctcatccatcaaatgggtataactggccctgagtctcaggactgacacgaggtctcatgag

SEQ ID NO: 33703 - DNA, 905 bp, Bovine  19866880785522
tgtgctactcgctaatgctttcctgctattttgaacttgtttaaacctctttaaggcatccctgtggctcagacagtaaagaatctgcctgcaatgcagaagaccgtctacaacgcaggagacatgggttcaatccctgggttgggaagatccccctggaggagggcatggcaacccactaacccactccagtattctttcctggagaatcccatggacagagaagcctggcgggccacagtccatagggtctcaaagaggcgggcacaactgagtgaccagcacaggcacacacacacacacacccctttaggttatggccttagacagccaggaacatccattccttctcttacctcagagagtttgtgtgcaacaacttgagatacacagagtaacaaacatccttaaagtctgatgagctaatttccattatagcatcttaaagaggagtgatagaaaccactgctgagaaattgccgtaattgattattgtatataaagtacactgacaatcctcctttctaacccacactctttaatgagctattttagtgctggttctgctaaatgcttggaatttataatgccctggaaactcatcaatttctaagggtgcaatcaatgactgactattaggggaaaagcaccaacaacaaacatgcaagatacaagacgatgaaatgagagcagaaagcttcacccttggtgatccctcatgtcactaccatatgttttattccaagcctttctgcgtatgttttggtccagagcctcaactcctttggtctttacttgtgtgtatgcatgcatgtgcgtgtgctcagccatgtctgactctttgcaaccctgtggactgaagcccgccagcttcctcttaccatgggatttcccaggcaaggata

SEQ ID NO: 33704 - DNA, 928 bp, Bovine  19866880837253
tgaaggtgactggcttcctccacaatcctgagtgcatgcctcactgagaaaacgcggtgctcctggctctataaggtcttggcccttatagaggctaagcccttatataaggctctataaatcttggcccttctctctggcattgagtagctgcctcctcatttataatcactgcacccacctcatgctggatggaaactgaaggctgccctacagagcagtgtgacaggcatctcggctgaaaccttgtccaaggggctggcgcgtttacagcactgtcaagtcatctcttctgccatttctccatcaggggtcttgggaaatcataagttttcacatggaggatataacacggtgagctgaaatatgtgtgacatgagatggagtgtttgatttgggatgtagaaattccttttattgttatacagtgatgttttatttatttgattgtgtcggaaaatgggctatttcacagaagcgaagcttacagatagctcaagttttcccatttcagctctgaaacgatttttcactctcatttaatggcaatcttcccaaaatatatctcacacttcagccttcttaatagaagacacagatattattattattgaatatgtactttttacttggcacaatgcctgactctcatcagttttcccaacaaccctgtgatacgggtgctctcataactcccatttcacagatgaggaaactgaggcttagagaggttgcataaccgacccagggttacccagggagaagtcagtggaattgagactttattcagccacattattggagaacattttggttactaaatggccctaagaactactaaacatcgaaacaggatggttggaagtctacacacacatttcagaagggtgtccatgactctgagcatcccttggctgttttctaaaag

SEQ ID NO: 33705 - DNA, 1581 bp, Bovine  19866880863981
caggatttgagtgttctgggattgttgaagccctaggggacagcgtttaaaggatttgaggtaatgttttgacttctggactgaaaggggtgatatttatctggaatctattgaaataatacaagattaaacaaaacattatgcaaaatgcatttgaaatcatctgtaacatgtcttcttgttatttgctttttaaaatttatttcaattgaaggataattgcccgatagtagtgtgttgatttctgccatacgagtgaatcagccgtgggcacacatatgtccccaactcctgaacctcccccagcctcgccccacccctcacagagcatggcctggagccccccgtgccgtcagcggctcccatcagctatctgtttcacacacgatattcataagtgataggactttcccagtgtctcatgcctttctcagggaccatcttgttacaactcctcgcaacagtctggtgaagtggccaggggaaaccttaacatcccctttattcactttatagctattaaaaagatttttaaaaagaaaaatgtttttttaaaaagattaaaatgaatacaactatggatttggccatgggttaaccaagcgtacacccctcctctctctactcgtggctcccatttcgccatcacatcaggctcagaagttaattacaaaatgcaaaggttggtgagaaatagcctctgtttcttctaatcacttataagtcattatttcagacattgagaaagggcatttttggatgaaaaatttaaagacaaagggtagagttatctgacaataagacagaattggctatgggttggtggcttggggagtaagacaagtctacaaagggttattatataattctgtttttgtacatgtacataactcccaataacaaaatttttaatcactaaaatatcctatttaccattaccatataaatcaaataggatctggtctatgaaaactgaaaaacctatgggcaaatcaactatacaaaattgtggtagttgagagcaagaaaagccattggaaatcaggcataagagctctcattaaactttagtgcttccccacggagagacaaagagacctcacacttgagaatccatcataaccagaaacatgggcaagttactgtttttcagccccatcacaaccctgcaacgtaaagattattatccccttagagatgaagttcagaagggtttggtagttttccatgcggtcagaatgagagcaagtagaaggtgaacctgaattcaaaccactagagagttttgattcttcctacagtcccacaatctttacccctcctccccacctgcaaatgctgcattggatggttaatacaggaagaaaaatcctgtaaaaggcaatgccaaaatcccctcggaatcgattttgagcctgctgcttggtctcagtgcctcagagcctcagtatactttgaaaatatcaatatgctccaaattcattatgatgaatgtctggacccctcaaccagctcatctgtctttttgtcagtggtttccagataacacggcagaaaaacgttcagagagaagtaattgtg

SEQ ID NO: 33706 - DNA, 767 bp, Bovine  19866880892764
acatgcgcacacacagtagaatcagagaggagaggtgagacagatacagtgcagaccagagggaaagctggcggcgtcctgtgtgcttgggtccagtggtgcgtgtggttccacactgtgaacaaacagacatgatccctgggctgcttcctctggcagctgcagggggaggccagtgaccttggtttgcatctgactctcgccgtcaccgcctgcagcgtgtgccatcagggacacctatgcttgtctcagtttcttctcccggatgggggagagccatttgaggacgagaagctgtgacgcttaccaagtccccagcaagagcattgtagagccgcttctcaactgctctttcccctgccttattaatgcccatcctttaacctgtcctcggcttaatctcctggcatccttggggcctttttaaccccacaaactaaacaaagccatgtgcatatgcatgtgcatccattcacatcaccccacgcagcactgcaaagtcaggccccaagatttccctaggcgcttattctcagatcggctcctgcttctgtatctgccggagcaaggtctgacctctctccatgttacctgactcctgacagcgcggatggaggagggaccccagggctgacttactgtcttttggcttgtttatgtcagctgaaacacggctcaccctgtccaccctgccctggtacaaaactcctgtgccaaatctcagtcctggccatgactcatcattttctgatctgatcaaccatggc

SEQ ID NO: 33707 - DNA, 966 bp, Bovine  19866881033809
tcattcgagaaagacaaggattattatcactgtgactatcgtgatgagaatggaacggctgctcgggaaaggatacggccgctcccgaacgcgttctgtcttttgagtgcacagagctgatgctgttagcacgctgcctctcattgtcaaaccagtaaaatctatctggaacaggacaagacgataaagtgtgagcgcaaaaatgcaaaaggaacaagtgactcccacagtcctccatgctccgacaaaagagggattctgttcgtgtgattagttcaaaacagtgtattaagcccagaggaatcgtttttaaagtaagactctaattttaggaagccgaggaaaggctgcattttaataggatatttcattgtaccccacatacaaaactattgtttgcctgactctataatttattgttagacagacacggcgctattaactgtggcaaaatgaaacacgggacgattccactaataaaacaatcagttcacaaggcaaagcacagctcggctgtttaaacagagcagaatacccctgagtagagatctacatagtctactattcccagttggaatttcacctttctctactctttcatggagaaaaatcattgaaacagtctggtaacaataccgttactgtctccttaacttaatcctttgttcctcccaaagaaaagactgccgctgattatgaatattccgtgctacaatttccatcaattaatatactaccgtgttcttagtacggtattaatagcttcttgatttacattagagagtatatattttacaccatgggtgaagctcttttctaacggctttaacagaaaatacttacataaaaagaacttacaatttggaaaatggaggtgggagggtatggataatttctgggaaagaatatattctattctccttccgggtttttttttttcctcctctctgctggggaattcctgtc

SEQ ID NO: 33708 - DNA, 1757 bp, Bovine  19866881057679
cgcggttgatgatgtttctttgtgagctatgtccattcgtagagatgatcactgtggttctcctgaatctcacgtgcgtggcagagttcataaggatgaatgtgttggggttaatgtgagcctcagagatggtttctctggagtttggaaagatctcttagatggtgtgtctcagtggtggattctgtagagaagcactcactctcagccttggcatcccagtgaaccttcatgtcaatcactgtgagatgctccgtaggtcatgtactactaacattatctgaaatgccaaaatggcggaggctttactcttttcagtaagttgccacaaattcgtgatacttcccagagtaatggtgtccttgttcatttgtgttctgatatattttcttgagtggcagggaggcagatggagattgtactagcacagtgggaatggcactttaacctaagtctacccatgagagcggttgcttgtaggaatgtcacctgtaaggcatgttttgacaagggaagaaataaaggaaattaaaattgctgccctggagctcaggaatggcagagatttctttcatggtttggatggatctcagtaccagtcacatcatatgtactgccaacctgccccagggcaagcactgtgttcccctaggtgtcttggggttggaggagaactccaacctttgagaatgagaggtacttgtgctcagtcactagtcatgtcttgactggaaaattccatggacagagagtgagatgttactcactaattcagtgactgtgcattgaatacatactacgtcttgggctctatggggatagagattaaaaagagagggtctggatacactgtccagtagggcgtgagaggttcttggggttgaggattctgttgttttatgaactcagagatgaactcttaggttgcgtatatcttaaagatttttttcattggtggttctactaaggttgtttttttttgtttttaatcttggctttctacaactaccaaaaccttatatactgtacaactcatttctggttttcctttccaagaagacaaggaatgcctttaagaagaatatcttcaatcactttagcaaattggccaatgtcttttgaccatgagtaaagatacaataaaagttaaatatcccccagaaaagaaatggatttcagtgccagtgaatctgttaacagcaagcaagccatttagaacgctggtatttatgagctcggtgtgctcggcacgtaacgtgtgagacctgttttccttttatcagcctcagtgccaggctttacagtggagctggattcagttctgctgagagtctgtgtcgaaacatcggcattgacgttgtttggttatatgttttgattttttgtttttcatttgagtttgttcttcttggaaccaagagaaatgtatcagggacctgggtctcacaaaagagaaaaaaacgtcttgggaaataacagaagttcttaccatgccttattctgggctcacagacacgaaaggactaaactctgaactaaactaaaggacagtaagaaaaaaaatgtgaaacaggaaggaactgggggaggggacaacgagggtagataactaatggggcatataatgcaggctttgatgtcttatagctttgctgaagcttcttggcttcctaagagtgggttgtgcaaagggagaaaaatgatcagccatgtgcacttgtgttcacttgaggagataaaccagtcaccaggaaaac

SEQ ID NO: 33709 - DNA, 1852 bp, Bovine  19866881151284
cactgggattcaaaaaaaccttgaataatcatgtgtaaaaataaatactgtatgtggagtaagtgttatggatcatatttatgatgaaatatgtatgtctttccaagggtaggaccttcatgattaatttataacgtacactccttaccttacatgtaagtaacagaatagtaattttcttcttcctggagaattgttacccatggaagggggaaaaaaaaaaaaaacgataagcttttctcaaaacagcagaatgcccttcagagagaactggaaaaaaagtattagagaaaagccaaaaaaaaaaaaaaaaaaggattgtcggttctggtgatggtggaaaaatgacgtgcgagcagaagtgcccgacgctgagcttcatctgttttgtcatgttatgacagaaatcattacaagtgtgataggtttatttataaagactcgcttctatattcaaagtacatctattccagcattcctcattttgagccaggccgtggatcaagatgaaagaaaaattaaattgtatattgaaaagctgttaattgagctgtgctgtctttagcgggaaagcgtgggcttcgggcagtcgatcctgccgaggatttttaatgcactgcgtcgggaggccgtcagcctgcgttggagaatgcaaacagggctaatgacaaagccccgaaaacttcagtggtttctgccggtctctttggaaggcgagagtgtgcccttacccacacgtagaagcctgcagacgtacgttcacgatgggacaaaaccctgtagcttcttgcctttgggtcaccaaaacctgtttcctgtggagtcatttgggggcctgtttaaagtttttaatgtccgcccttataaaattattgtaagagattgctccccttttcctaataactgtataagagattttccccctcttcctaatcagtgtaaattcagttgcatttcagaggatggccagatagtatttcatcatctctaatatccatttaaaaatgttaggtctccccagttataattctcgaaagtagcttatcagtggtttaacatgttatctcccttctctaaggcagtgttaatttccttttgttgttaatctatcccgctaccaaatttactatatttatagttaaagattctgttaagacctacgtgatttaagtacatctgggataaagtggccttggctttaactatggagcaaattttctttattttgttctcttcactgataaatccatagtaactggaggcagcttccagaattgtgggcaatttgagcctctaaagtttgattaaagacacttcagttacttagtaggactaggaagctcgaggactagaaggaatttatttggggttctggttctggtgctgacctggctcagtggaggagagtgggttaacatgagctccacccagtgctctcagtcttccctgagtctggggcgggcgttacttctcaggaaggcagtgatggaaccagttggctcttttcagagccattgcgtgggacacacacatacagcaaggggtccctgaacatggacatggctttgaagggctttttttcatttattcattcacttgctcactcatgccttcatcagatgcgtgtgctgatcacagcttctgtctgggttttggatgaaggctctgttagtgaggtgacttgagcagagagacatgcgtggagtgcaaggtggagccgtgcagacaggtggtcacacaggtctcctggcgtctgagacgccctcgtggcctctcttgtcaccttcacgtctccccttgtgaagcacaggcagtggcgccctggaagtggaaggaaataggcagctcgaca

SEQ ID NO: 33710 - DNA, 2172 bp, Bovine  19866881160282
caaaggtttgaaaatcaactatgttatttctctgagcctccatttcctgccctgtggaataagcataacctaccttacagagatgagaagatgaaatgacataatatgctataaaatgtttagcacagcaaccaaaatattataagtggtctataaattaaagatcattattgtcatcaatagctgggccaaattgaagtttatagggtgaagaatttcaaatagtcacatagaaacatccacaaatcttctcttggatttcgatttctaaagccatgattacatcacatggtggttttgcttccatacaagccttggggccaaagacagagccttattgaagtataatctgtgccttttattatcctaggtattttatagtaaacattttaaagcactctgagaaggctccatcagactgccaagggacaaaaaaaaaaaaaatacatacctaacctattgccaaaaaattcaatagctgagcatacctgtacaaagctatgttatgatgcatttgatgggggagaggtcacttaatatcagcaatttttattaaaatgtttatgacagaaagccattcactgagcaactgattcttcatcggtcatgtgaggaagtaggggtctaagactccctagttccccggtggtctgccttccactgcttcctaagactaaacatgaaaaaaccagctactgaaaaacaaataggccattccactctccttaaactcctaactaaagttcattttcacaagccaaatttaaaaatcaattaataaattaccactgccaaagaatgttaaaaagcccagaggcacctaagaagagcttagaagcaacaacaaagcattaagcctgagataaatgggcttgctaggagtttactgcagtgttgacttaggatcccggagcagaaattctcttccctctacttaccagtgcgttgtgtaataggagcagcattaattttaacctaatcatgaatcaatcatgaaatcctgatgcttgttttccctggcaacagaacactgcaattagcaaccttgaataggagtgctttctggatgggcaaggtgagggcaaccttctgcagtacattctttcctaacccgccagagcaagggggctaggctgaaataccactgcggagttaaaaactcccacccctccagtcatccatcctgtgacgtcgccttcaatctttcaggaccggtcagagtggggtttctcgatcttgctgcaactgacattttgtcaagggggctttcctgtgcattggagaatgtctagcagtgtccctgggctcgattccttagacgccagtccagtaccatcttccctccctccgctaccccctccccaagatgtaaggaccacttcaggtcagcaagggggtctgaagccatgagcacccacttgcccgaccacgcctgctccgctctccccctaccctctcctcccactcttggttgagcggggccctccctaggggtgctctgagctccatccctctgccctagtgcagacccaggagcgtatgctcacaactagggccttgtgtgccggtgcagaaatcctattacagaagcgccttcatcaaaatcacagaagccagaccacctgctgcatgccggagggagatctgatgatacatgcgctctggaaggcaaaatggaacgtcccaaccaaatgatacatcgcatgcagacgattttcatatctccagtaagaagggaaagagttatacttttcttccctcagagctttttcttaaagcagtgatcagcttcctgaaacttctggtaagtctcaagctgggatgccctgtgtcagagtccacccaactagggacaagaaagaggaactggaagacgtgttgtctgcacactttgtgatgggttccagacagtgaagggcctggcccagcacaccacagccccatgcccgtgggtcctaggggtagagaatgtatttaagatagcaaacgaagcaactgacagagaaatctcaaaaatatacaagcagttcatgcagctcaataccagaaaaataaatgacccaatcaaaaaatgggccaaagaactaaacagacatttctccaaagacatacagatggctaacaaacacatgaatagatgctcagcatcactcattatcagagaaatgcaaa

SEQ ID NO: 33711 - DNA, 683 bp, Bovine  19866881235432
tggtgccttctttgatcctccccctccagtttccttttctccaatttcatacttctttccagtgatttttggcctctgcgcagtttcgctatcggaggccagcatgattaaacagacgccaggagtttgtgttgccctgtgatgctgtttctgaaatgtttattctgtgaacactgattttcgtataaaccaccggacatgttggtttttccttgtgaggcggaaggtactgttttcccagcagcaatagggagaactttgaacctggggttccgaaccattcagaagctgaaacccataaactctgccctcctgactacactgagagaagtgtgtgccttgaatgacggtgggacacatgttctcatgtgccccgaggacctgctggacggcaggcgccaccctcgagggcttagtttctgtgtctcgtcccactgaaggtcactgtggagcttgctgtccttagacgtctgctctcagaacaagccactcaccctcggtgggcctcggtttccttctctgtaaaatgagtcactaaactgagatatcatgtcccaggacttgtggattttaccgtgtagtttgaatggaaatttttttcaaaaaggagacccatgctggttcatatgctttgtgctgaaaactctggatgaaagacaaatctaccactgtagactatcgcc

SEQ ID NO: 33712 - DNA, 1752 bp, Bovine  19866881355250
caagaagaagtagctttaacatctgccttaaaaaaaaaaatcataaagacagctgagttgagttcagttgctcagtcgtgtctgactctttgcgaccctgtggactgcagcacgttaaaaccaaacggaaggccaatgtgactgcatcaagaactatgccacgtgaaaggcaagataggaagccacgggccagcccagggggtactgaattgcaagcccatgcttccaacaggacaggggaggacgagctttaaaggaatcggaagtggacctgatgcagaactccactgagcttggaaaacccgcccacaggatgaggggaaaggaatgtcagcttggtctgagacacctgagcgccagacaagcctaaggagcccaggactgaaatctctttggtgcccaggtctttaaaggtcatagcgagctcttggctaagattaatgtgaagtcttcccccatatcggggaggagacaccacacaggtcctgcttcctgcgtcagagcagagtcagaaaagtttcagaaatattaggagagtcatgggctgcagcagtggttctgctactgcaaagacccgagaggagcctagggcaccaccactcaagacacagactgacccaggaaatgatggtcaggcggaggctgggcctccctgactcccagtccagtgctcagccccagcccactgctcagctactcagagcaacaccacgcttccacgtctatcaaggaagaaaccaaaggtctctcctgcccacaccaagaagtggattctcctctccgtggctgtgatgggctcaggcgacaggacaaagcaactgaaaaaagagcttctctgactaatagagacattgtacgtttaaaaacattttgactacgattacatagatgcaagctttacaaataatacttcgggtattaacggcgttgcctagagtctgaccaagagattagaattacgtgtcacttttctggagggtaacctgatgtcacagaccagcggtattcaaagatactcgtgctttgacccgggtgctgctcttccaagaactgatcttaagaaaataagagatccaaaaagaagtacgtgcaggccagcttcagagtgcttccaacagcgataatatatagaagcaacctagcatatgagaatttaagactggttaaatactctgacctctatgcaggggattactggattccacctcgtcccatacagagccactcggaacacgggcatgctcttgggagtctgctgaactgagacacctaggcgctgctgtgcttttagccagacacactctgccgaggtccacctcccaaacctctatcactggtggattcacacttcttgtacccactcccggtacctctgagaccaccttcttcttcattccatttctggttatcactactccttaatgtcagctcaaatgcctgtttgattatgagtcggtgactgaacggtaacaacatttgaagcttagaaggcagactgcagaattctgccgctaattgagaggctccgtgtgtatttttcataataacgagatattgagggctttctcacaaagtgaagaaaaccaatgactcacaatattaagaacagagtgcagtgactagcggatccactgaaaatataatcttccccggggattttcagccggctgccacagtgcagcactgggtgatgtattgcaaatgtatatttcaagtttttaggctgacgagaactagcttctcaacaattta

SEQ ID NO: 33713 - DNA, 1669 bp, Bovine  19866881414904
cattctatgttaaggcctcaggaaatattagaggctttgtgggacaactgctcaactgtccactgtaatgtgaacacagttcagttcagttgtgtccaactctttgcgaccccatgaatcgcagcacgccaggcctccctgtccatcaccaactcccggagtcacgtccatcgagtcagtgatgccatccagccatctcatcctctgtcgtccccttctcttcctgcccccaatccctcccagcatcagagtcttttccaatgagtctctacagcatcggaccttgtttctatcaccagtcacatccacagctgggtattgtttttgctttggctccatccctttattctttctggagttatttatccactgatctccagtagcgtattgggcacctactgacctggggagttcctccttcagtatcctatcattttgccttttcatactgttcatggggttctcaaggcaagaatactgaagtggtttgccattcccttctccagtggaccacattctgtcagatctctccaccatgacccgcccgtcagtcctgggcaattcccaaagggtgtgactgtatttcaataaaactttatttataagaaccagacttggtcgtgcctgcagttgcctgacctccgccctagcatatcatcacgggtgcacgccctttaggagagccctggcctgtgaaagagaagaacctgtttcacccacttctccaacgacacgatttagaagacagcaagcccgtgttctgttttctctgggggttgggggtggaggctggtgagctggcagaggatgggactgacaaccgctgtgtacagaggggaaataaaggcggaaaagcaggagcacatctgaaccgtatacatgtgtgtgtacgcacgcgtgcgcgcacacacacgcacacgcacgcaccgagaaaccgctgcaaccgccataccaccgtgggtggacctgcactcagtgcgtcagattaaacgcttcctctgccccaactaccagcgattcaaggggccaaccggcagccataagaacgcattaacctttgtgccaaaccaattccaagtccccttccagcacgaagaggcagtaactggcaccccatgcgcgggaggaggggcgccctctgctacacttagcatcctctgcacctggatgtctgaacgcccgctcctccacagtgaccttctgaccaccggagagcctggaaactgacgtcctaaggccgttcccctccagccttagagcctgcggtgggggcggacagaggtccaagctcacagctactgccaggaccgtcttcaaaagttacatcggcatttgctctgtgcctatggggctgtggggcttcgccttccggaggccctggacgggtgatttcacacagaaacacaagaggcgtggccgatgggttgagtcagatcagcactggagacgtgccccaagacccagcccttcctgagcccttctttcaacttcaggctgggggcgctggggcttctttctaagaaatggggttctcagaagacaaaactgttttccggctcagaagcaccaggcggaacagagggctgaggcggccgctggctgtgcctgggggtggcgggacaggggctgggggcgcaggggccccggacagagtcacttaggtagcagg

SEQ ID NO: 33714 - DNA, 710 bp, Bovine  19866881530383
acacaaaacaaagataacgcagctattttgcaggaagcttccttgtcgaccacatgtgtgtgtgtgcgcgcgtgtgtgtgcgtgttttaatgtgatggtgagctttattttctcatatgtacatcatatattgtaatacgaaatagatattgactgcagctggtgtggatatccacatgtattgacctcagaggtaaatattgactgagacaaaggtaaaatcgatgcttaccttgagggataataaatctggatatctattgaaataagaagtcaataggcacattgttacaaacacccgtggttatagtcacttgagcaaatttgtagagcgggcgggcagcggctgttttgcagaaacgagaggcagcagtggaagcccgcggaggccgcactgaccggccgctttccctttactcccctttcctctgtcgccagccagcatgggaccaggtatgccaccccaccctaccctgtcaaaggagcacctcagcctccgttttcaggaggcggttactgaattaggagtctgcattgtggctcagctggcaaagaatctgcccgcaatgcaggagacccgggttcgatccctgggtcaggaagatcccctggagaagcgaatggctatccacttcagtattcatgcctagagaactccacacagagtcagacatgcctgagtatgcatgcaaacacttattggggggggg

SEQ ID NO: 33715 - DNA, 825 bp, Bovine  19866881751155
taccactgagctgatgactattattagccctccctctaaatgaataccccctgttctttaagaaggggcttccttgatagctcagttggtaaaagaatccacctgcaatgccggagaccctggtctgattcctgggttgggaagatccccctggaggagggataggctactcaactccagtattcttggggttccctggtggctcagctggtaaagaatcctcctgcaatgcgggagacctgggcctatacagtccatggggtcgcaaagagtcagacacgactgagagaaattctttaagagagaagcgcaaggaccatcccggtgctctttagaacaaacatcttacctcttcacttcctgcacatagtctgcgtttctgtcgaagaggtgggtcacggagtccttgatagcttcgtgcttgaaagtagaagctgttccaaagacagtcacgttggggacagtggagcacagctgagccacagcttggccctagaagtgaaatataacagacaagtcacatagaagagctaccacccgacagctaagcttgctgggcaaaaagcaggatttctcggccttgacactgttgaccttttttttggctggattggtcttcgttggagggggctgaactgtgcattgtgagatgtttagcaggatccctggcctccacctacacggtaccagcagcatgccccaagctgtgacaaccaaaagtatctccagtcaacatcgctcgttattagatgcaaatcaaaactacagcgagataccacctcacacggtcagaatgcccatcatcagaaaatccacaaacacatg

SEQ ID NO: 33716 - DNA, 1097 bp, Bovine  19866881894074
caaagagttgtacatgactgagcaactttcactagcatagaatacaactgctgaccccttagggttgccaaatttagcaaataaaaatgcaggatgcccatcgaaacctgaatctcagagaaacaaagaaatgtttgggttttttttaattgaaactgtatctcacatttaactgggcaacctgttgttttttcttttctttttgatcatgtggaatgcagggatcttagttccccaaccaggaatcagactcgcaccccgtgcagtagaaaagcagagccttatccactgggccaccagggaagtccccagcctgtatttttcagtctgggcgccctataacccttgtagtaagctatgggaagaaaacattgcagcttctgtgtacatgttttaaaatcttatcccatatgtaaatgtacagttcttggggggtttgttcagaatttaattttactgctagtggtgcacgatcaaagcagtctggagaccactgggaggaaaaactcccacccgtatgaccaatccgggtttctggcatgacctcaggtgaagcctggtcggagggaaggatgcagattccagctctggctggtcccgttgtttaaacaccctgggctctgtgcccttgtgtggataatggtctgtctctagttgatggggtgcttgtagaaacccgtccgtgtttgtgtcccagtgccggccagagcccacggagtgtggtgggcgcgccacgagtgtcctcttcccaaggagtgtggtgggtgcgccacgagtgtcctcttccccgtggctccgtggagactggcctgcaggggtgggaggacagagggccccagcacgctgggcagagctcccccgcgccggaccctctcccgctcgcgtccttctggctgcagcagtgactcacgtggggttaggctgtttgtgtctgtgctctgtgctgtggtttcggttcacatggggttgggggacgcagttttgttttcactttggtcggttgtgtgagtttccacccttcacctcttcagtagctgacgttcttgtgaaactctgtggggattcatggaaatgtccagtcagtactgtcgggttcc

SEQ ID NO: 33717 - DNA, 731 bp, Bovine  19866881900456
tgtgtgtgtgtgtgtgtgtgtgtgcgtcctaaactttcatcaggttgcctgtcgcccgtgatgctgtgttgattgagtaaaactaattcatagtctacagccactcgccttggatacttgcttctaggccatttaaatggttggtatacaggttctcatttttctcagccttccatttccatattaattctcaatcaatcactgacggccagctgtcaacaggcaccgttttttggtgggacttgatgatgtatagcccttgtttccagattcctcgcatctcgtggcatgaaacactgctctgagcaagtcctaatgcatttgggtgcagcccctctgagccttctaatggtaggcctggtgcaggtgctgaaaggaggcgtgtctttaaagggccaggacgtggaatcacggcttggtggacgatgttttagcatatctgtgtctgggtatgcacccagcaacaggcaagtttaaaggccgttttgtcaggatgtggcctttgattccaaaagtttgggaacaaaagatctatgtcttctcagtaggtaatggataaaggagtgattagttgtaaattatttgccattagcctgctttaatattgatatgacactaattttgacttcgagaagtttcccttttgtcaagaatggtgatggtggtggtggtgatggttatggtgatggaggtggtgatgatggtgatgaaggtggtggtggtaatgatgg

SEQ ID NO: 33718 - DNA, 1268 bp, Bovine  19866881944534
atcccattcacacaaactcttgcatacttttgcaaatggacggcatatgaaagttaattttgagtccttaaaaaacgatgcattgggttcattttgtggcaagttatcacattaccaatgtatccataaaatgtccccttaatagaaaagaaaaagtgcatctacaaggtgagatttgcgattttcctgagaaggggcccatgttccaggtgaggcaccaggggacacttgcccgtgagaggcacagaggaccccccaggttaactgcaaggtggatggagctgtgagccaagcaaactctcgagttttagctctctcctcccagtgttgctattgttgttgttaattaaggctaattatgtgatttaataaataaaccaaaagggccttgatttccaaaggtgtgatattctatcacagcttcaagtgatgctgcattttaaaaaattaattagtatcttgtgagatcggccacacattattgagtaagtaacagcagctaagtgaagcagatgaaatattggtaagcaatgcagcccacagtataagtatgtgaagggggtcagaggttaatccctattgattttctgagtctgcgtacagcaccgctgggagaggccggttctgttggcaatcagctagcacaaatacattataaatcttactgtccaccttcactgatcagtgtcacttacttccttcactaaagaccattaagaaactactggaaaaaaaatacccagatgaggggagaaaggaaagcattttcaaagtctcccatgtcagagagtgcttttggagatggaggacttgcccgaaaacagaggtagtcttcctggggtccagtctcgctcactgaaggagacatgcatgaacacagagtagttttgaagtgcctttaaagccaaataaaaaatgggagaaggagctttcatatcagggtgcatgaaaaaaaaaaatgtagtacaacacagtcactgacatggatgagcaccatctccaacctggctctgaaaaaatttggtctcagcaaaaccttgaagctagtgaagagtaagcttcagggcccctcacaaccgggggccccttccaagattctgcatcacatgttttcagttcagttcagtcgctcagtcgtgtcagactctttgcgaccccatggactgcagcacaccaggcctccctgtccatcaccaactcctggagcttactcaaactcatgtccattgagttggtgatgccatccaaccatctcatcctctgggtcc

SEQ ID NO: 33719 - DNA, 1125 bp, Bovine  19866881987886
cagtcacacttgaaactgacatcccaaaattgaaaatgcagttcttctgtttcataggtcttaggaattgtctcaggaattaaatcataaacgtaagggtcagggaacaagtgacctatcccttctgtagatgtgacatcttaatacagtatgagcacatagtaggtgcccaataatgtctctgctgcttgattgacagatgtatttttttctccctttcccatctctgaactgtttttacagttttatgtacagctgcacatttattatctggagacaaatctgaggctgcagcatatcacccaaggtgtgtataacatttacaataaagttgaagatagatggctaaaaaggaaccctaatcatctctgatattattaattcctctagtttgagttctcagagagcccaagaaaattttcttttaatctctatgggctttctgtcccatagatgaagttatagagctggcctgagaagtaattttgtaaactcatttaccaaaggggatgggggagactcactgtagtcatccttcagaggtttgcaagtaataagcatgctctgttctcttcaagcccagaagagctgtgtgggcttgataaatagccaagcttggcccaagtgcagcttctaaaatgctgtctgtaaatactgctgaagagaccatcaaaacgttggtgggtgttgctgatgagtgactgtgggtgcttttgttagcaaacagggcagctgcccctccccactctgtgaatgactagcctgctgcaggggctgtaattcctttgctttcctggtgcctgtcttaaccaatatgacgtctttgattttttttaatcaaatcaaattcattagttatttttggctatgctggttcttcactgttgcacgggcttttctctaagtgtggtactcagacttctcatttcagtggtttctcttgttgtggaacacagactctagggcacacgggcttcagtggttgcagctcctggactctagagcacaggctcaatagttgtggtgcaagggcttatttgcaccgaggcatatgggatctttgagcagggttcaaaccgaatctcctgcatgataggtaattcttaccactagccaccagggaag

SEQ ID NO: 33720 - DNA, 3777 bp, Bovine  19866880347846
agaccagagaggaggttgtttaagtatcactagatcagagatgacagcagcccaggccagagggtggctgtgcagagtgagataagtgggtaaatctgagatattttggagatggaaatgatgtaccttgatgtgggagtgagggagacagaggagctcaaggagagctcacgggtttctggcttgagccacctggtgggcaatgatgccactttctggaatggcgaaggcttggagggggagagttccatcccaggcatgtgaattttgagatgcctttgagacagtcctatctggagcttgactgatgttgtaagttctgggggtcattggcatatttatggtgtttaaggccaggggactgtgtaggttttcctagggagaggctagcatgagaggaggccctaagaatgtgcctgccctcctggaagtgcatggtaagggtttgcaggtgttgttatggcacaccaggagtcaaaggagatttttgagaaagaagatgtggacaggtgtgccagatgctgccaatagcatttggtgaggagaggcaggtgaccactggatttgggaaagtggcggatgttggtgacctcctcaacagcaattttgatgcagtgatgatgacagaaacctgatcagagggaattccctggcagtccaatggtcaggactccgtgccttcattgtcaagggcctgggtttgatccctggcctgggaactaaaatcccacaagctgcatagccacaaagaaagaaagaaagaaagaaagaaacctgatcagaatcgtggccacgggctcagtttctccagccacagccgaaagactccttacaatgtgggaagagacctttctctaagtgccaggctcttctgaacaacctagctggctcaccctcttagagaagatgactctggcgctgccaagaggaactttgcttcttcagcattcttcatcgagggattcttagaacagcccgaggagtgcctaagaggttcgccaggctgcctgtgccggatctcctgtctgtgctggttggggctgcgacttctcctgtggccagccaggatgtggtctttgctttcccagggtggtatctgcagaggtgagaaatcctgccctccttctttttaagtaagattagcctggtattctggggacagctgtcctcctcagggccctttcaggggatatcttagaagacccagagacctacaaatggctccattgtcctagggtgtctgaggtgagtaagcgtagcgaccaccattagcaccctcccacctagagaagaactaggacattgaattaagcaccaaagaacagtaagatcctcaagtggttgttcttgttcagtcactcagttgtgtccaactctttgtgaccccatggactgcagcacgccaggcttctctgtccttcactatctcctggaatttgctcaaactcatgtccattgagtggatgatgccatccaaccatctcatcctttgtcacccccttctcctcctgccatcagtctttccaagcatcagggtcttttctaatgagtcagttctttgcatcaggtggccaaaggattggagcttcagcttcagcatcagtccttccaatgaatactcagggttgatttcctttaggatttactggtttgatctccttgctgtctaagggactctcaagagtcttctccaacacaacagttcaaaagcatcaattctttggtgctcagccttctttatggtccagctttcatatccatacaggactactggaaaaaccatagctttgactgtgtggacctttgtcagcaatgtgacatctctgctttttaatgtgctgtctaggtttgttataactttttttccaaggagctagcgtctttaatttcatggctgcagtcactgtttgcactgattttggagcccaagaaataaagtttgactcatatggagtgagaaggaaatttggggagagctgctcgcacctggcccaggatgcattgtacttgtccagcaggatccttcagagcacgggaattctccatcactcagcctttgttgggcttggggtgcttaagaaaagactccctggatgtgttcttcagaggggctggagttgcagccctggcttcagatccttatcttggcagttgtgagagcttgactgggttttttaacatcacacaacctctgtgcttcttgtaaaaatcaggacagttacaactgcgaggaagcttggtcccttattccccaggacttccgaggtgctccattgctaggtactcagcacccaggatgctgagttaaaccttgggctgtgcgggctgtgaggtggagggccagcccccaaggctggcaggagccatcatggaaggcagcttggaggaggtgtccgagctgagcttgaaggaggagcaagcaggcctgttctagaaggtggcccttctggttctctcgggggttatgtgtgtctcaaaaaggaggggcaggcaagggagaatcagcttataaaacctttgtgcatttagccaaggagtctgattttcttagaagacaacaaggagccgcgatgtgtttaaggcaggagacccagtactgttggtgctttagaaaagaagatccctttggccgctgtgcacacaatgggtcagaggagagaggggctggagacgggggtgtcctaggggcccactgtgatggggcctgagatcaggagtgccaagccagagggtgtgaggggtgaggccggttcccagaactagctggatgtggacagtgagggaatgggaggaggcaggtggacactgcagtctctgacctgttgactgcctggctgacaaagtcattactacctgggagatgggagcaggaggtctgggcatagtgttaatgttagtctcttcagtcgggtctgactctttgtgaccccatggactgtagcccaccaggctcctctgtccctggattctccaggcaagaatactggagtgggttgctatgctcttctccagggaatcttcccgactcagggattgaacccgggtcccctgcattgcagacagattctttatcgtctgagtcaccagggaagccccagtctgggcatagaggaaaggtgttggggttttgaacttatttgttgggaagcctttggaacaggcaagtggaaatgtatacgtgggagtttgggagagaggtcaaggcttgagattgagattatgggattaagtgaaataaagctgtgaggaagagcctctgggcacagaggcacacagtaaacattagtcccttcaaagagcttgtaagctcatttggggagacaaggctcacacgtgtggaaacatttaatatgaagaggaggccctgcttaattaagtgttgtaaggattaaactgcctgctgtgggtgttcagaggaagggagctgtgtggctggaagagccatgttaggttatgtggagtggggatcctgcagctgtgggggaaggaagcttccagaacggggcagaaggggaaaccagactggacatggatgtcccagaagagagcgatgtcctgctcggagcacaggcgccagtggagggaggagtgtgtgtgtgtgtgtgtgtgtgtgtgtgtgtgtgtgtgtgtaactagagctctgaaatgttctggggagacactgggaagatagggactcctgcagcccttcccagcctcccacctgtcagttcctaattccagcagactccaaacttgttgctcaataagaggaagaaacagaggcaggtgaagagt

SEQ ID NO: 33721 - DNA, 2459 bp, Bovine  19866880387903
cagcctaccaggctcctccatccatgggattttccaggcaacagtactggagtggggtgccattgctttctccccccagagggccctggtaaagcttaaataacctactgcgcacacagctctgggagcagcgcctgccacacagtaaaccatcacacattaaccactgtctttatcagtctcatcatcatgggaatggactgtgcgggccacacaggcccacatctggttgcaagaggcagcctcgtcttgttagcagagtcctactccaggtgaaggcacagaccgccaggagcatcttcaccacgtgttcagctgtctcccattgtgtgcacttgaatgtgtggtttatgggggctagcttggcgtgtgctttgtgcctcatggtgtaatgactttgccgggaactgactgcaaacacagaaccacaatcatgcttcattgatgcctctttgttggaaatcaaagaacaggtgagcaaagtttccagacaactgaaactgatgttcttttttgttttttcttttcttttttccttctttccttttctttccttccttcttcctttctatcattctttatttctttctttctcatcctatcacttctttctttctttttttcccttccttcctttctttttttttctttcattctgttcttccttccttcctttctctctttctttttcttcttccttcctttctttccttcgatcatttgggtgaaagtaattccccatacatcctgacaccattatgactccatcatgactccatcattgttcagtgactggcagcagctcaggtgtagtggaaacgatgctggaccccaaatcaaaatgctctgcagtttggtcccctctggtcccatcacccagccactgtcacaaataaaaggtatcatgtctgtgaaagtgctaatagttgagtatttacagagggtccctggagaattctggaggcttcagagccatttactctacactaaatagccccgccccaccatgctgagctgtaattcttccaactctcccactgctgttagcttttctggttggagtgcccccagtgccttccaactctgcttctcttacagctctcctcaccctgtgaccaccacttcctatcaaccacacaatcctaacctatccatcactttccagccacttgtcctgtccccaggggtggcccacatgagtgcccagagaccctccagcaactcaggagctacctgcacagtccagacctcgaggggccgtccatctgttatctgaagccctcctcctgtctctcccagcagggtcaaggccactactcatagcaagtgttcaggatgaaaaaaacaggggaatttatttctttctgccacaaagaaagccattacaaagccactcagctaagaaggaagagttcaccaagcacacaaaccctgataagcatctccttgcttgcttagactttttccaccccttacacacaattctgaaactaggaaagtgactgggtcttcaagtaggtttaataatctccctgggacattattgggagataaggcttcaggccagagctcatggcagcctcaccatctgcggctgcacaggctgtgtttgtagcttgcttgctgtgggacatcagtcctcagaggaacctaggcctcctctcttggaaaccaggatcagactgggaaggagtcctgcccagactcccctacactctcagaggactgggggtctgaagcccctgggactgcaaaggctcctggagccctgctggggacctggcctgggctgaggtcaggctgatacaacaggctgcagccatccatctgcttggccagaaaaacatatcaaagccttcacagccaccgtgtcagcacctttatgctatgaggtgctctggggccccaaattcattttaattttcaatgtagagagtggtcattttactaaataggacgaaactccctgctttcagaaacagaatagacagagcacagattagtctttttggttattcacccaagtgattgttatggaagtgccatgaagatacggacttttgtgtctctgctccctgccatgtcctcggtgcctagaaccatgtctggcatctgcaagatgctcagaaaaacataagcaaggcaccttcccatgcagggctctgggcaccagaggacagatgggtagatttttctgttcctggcagagctcacggtccagcctgtgatgtttacactcgaatagaatgactccgcaacacaggctgcccactagggaactttttgagccacgacatctgtgttttaacatctgtcttccctttctctttgctagactgtcagttgtcacttaaattgcatagaattgtaaacaggatgtgaagttgagatcattctcaagaagggcaggtgtgggctagacagcacctctccatcacaacacagagccttgcatgcct

SEQ ID NO: 33722 - DNA, 1278 bp, Bovine  19866880408331
aaaaagttagacaggtcaagagtgatcttcttaaagaaggcctcttttgaaggaatttaaactatttatgttctggggctctgtgtccataaatatttctgaaacagaagcaagagagcagaaccatccagtttaagccatcccttctttgtcctctctaagctgtcaaaatctgcttttatgccttttcctcaagttcaatcatacaagactaaaaaccattcaaagtcttctctctctaaggaaataaggttcttcaggggttaataatgagtctatttgttaaatatttacgatattccaagcaccgcgctaagcacttgattatatttattcagtcttcaaagcaaccttgtaagtgggtgttgtcattattatcaatttgcagatggggaaaccaacgttcagaaagtcaatagtcagtaagtggcagagctgaaatgtaaaaccaagttgtcaatctaggaattataaaaataacaacaccggtaacccctatacaatactgcctctccgaggcaaagagaggattctagtatatgtaagaattcagatagcaacatcccccattgtgccttcatgaacagctgagcagacccaagcatagagcaagccagactggagaagacagtgtctttctgaaaaccagagagatcattacttggtgatgataccttttgtgtgtgtgtgtgtgttaccaacaaccacagtctgcttgcataaattgagtcatatttcaattggctcatttactgagaaaaacaagtccacctgccaatatgaataaagccagaaaggccacagaggagagaggggatggagagatattttctggtatttcaagaaaaacaaacaaacaaacacatatttattgagtttttttctcgttacaaaagtattctttcctagttgtgaaaccaattagaaaatacagaaaattatatagaagctaacatttgcaatcatgacacagcccagatacttaggtgaccacatgaccattatttaggaacagatgctttcggtcatgtaggcataaattcacactttaaaaaaatgcaaattttgtacacaatgttttgtagactctttttttcagtgaatgtatttgttgtgaacatttttccacctcattacattttcttcttaccccatcatttggaatggctacatagcattctgctgcacgaatgtgccataattagaacctcgtttctctgaaataaatcaagcacaggaagcactcttgcaggtcaagcacaaatgctttaaaaggtg

SEQ ID NO: 33723 - DNA, 1000 bp, Bovine  19866880437408
cccaacccctccgccttcccgcaaccctctcggacaaggacaatgtccactgcataaaggagcccagctagggtagccccaggctgaaaactatttatacacgtcctcagcatccagaggttaaattacagctggagatgtggcacagggccagccctgagttatttatatccatatcctcttggcagaccaagaagaacagggcattctagggggcctctctaagaaagacctacaggcacacagtttacaagacagcacaatcacaatcatccttcccatagccccgcaaccacaccctacacgcacacacacacacacacacagtctggaccatccttgcaatgactgtaaactgagaaagtagaaaccaaaagtttgttctaaaaaggaagtaggtcatggccactgaagggctggggtaagggaaattagccaaattccattgaatcattccaggagattctccaggctttccagactccacatcagaagcctttgaaaggaaaagcctctcctggtcctaagtccacagcactcaatgcccatgagacatgaaccagatgaaagtagaaggcagggttcccagggtgaaacttcaagatgagttggacccatggctcaagcaggaagcttccactctcagaggctccctccctctgaccccaagctgatcctggcccaaagagcaggggaaggatttagaaatgcttccaacaccctggggccccagcaggaaaatacccttgtttaaccaaagcttcttcaagcccttctgtttagttcttagtgacagtcataagacagcacagcagagtctgttaaatatcacacgggatgcacgaggcctgctgctaggggcagtgcacagcacatcaatgggcttgctttaatgtcgtgccaggtgaagggagtcttgtagagccccccacagcagtcctgggccaagattcactcaaacaaaagccttggcacagctgggccaagtcccagagctgaa

SEQ ID NO: 33724 - DNA, 1870 bp, Bovine  19866880585771
cgattcaggaaactcatccttagaattccatccatttagaaccaatcctaataccaaaatctgcatttggattcccctaagaaacagaactgataggatctctctatgtctatcccatttccctgtccatatctgcatctctatcgtcatctccatctccacaatcatctccatcttcccacccacatctgcatcttcatccatctatgtatgcgtgcatacacaaacaaacacaaacatacctagagagacatttattataaggaactggctcatattataagtgattatggagaccgagaatttccacaacctactgtgtacagactagagaccctgggaagctgatgggttagttcaaaggcctgggcactgaaggcaacaggagatcagtgttctagctcatgcagtcaggcaggggtgtgtgtgttggggggaaggatcggggggaaagagaatcttttcttcctctacctttttgttcaattcagtctacaaattcaaatgctgatctcttctggattagcaacctcacaggcacatacagaaatgacatcttaccagagatctgggcatcccctgatccagtcaagtcgacacataaaattaactatcacatcattcttctctaaaattcaagtgcacgtgggctaggatggttcagaatgctgcagaggcctgatggtttaagccaatgtgaattcttcactaagtgctgatggaattacccaggagaagaactcagtccttcaactcttttgttctccttaggaacaaagggacatgtgaaaggaggtgggggctgggagtggctgaaccctaccctgtcttctgacttccaggctcctcctactccactctgggaatttgccttttctgtcaactgtgagaagagctgtcatacttttttttttaggtggcctatgatgtggtcctgtgttggcagtccatggggtcacaaagcattggacgtggcttagtgattgaataacaacagcaaatgatgtggtcccttaagaaggaaggaaagatggtgtgatagactgcttttaacttgccttcttactgcttctccaggagcacacaaggcgctcctgacttcacccaacgttcattaaatgtcatgtcttctcttcttgaaatctacagaatgcaaccaaaccactcccctccataggctccattgtctcctctcttacacttggtcacactgttctttcacctggaaagtccctctctgcaacatccacaactcagcacctctgaaagcccagaaaagaaatgctgtgctttccatgaatccattcttgaaatgcgctctggggaaactaccatgacagtgtgtctatcctgtatattcacgggtctcattcctacctgctagactggatactaatcagggccggatggagcagagggaggaatcaaactcaagcgtcaagtccatgtgggtctgaatttcatccatgtcactattagctttgtgatcccaggagaatcattcagattctctaagcctctgtgtactcattaattaaaatgagaaaataattcctacttctcagggctgatgtgaggattagtttgatacatatttatgaaagagtctgccaaagaaaggttttcatagatgcctgtggaatgattaaataaattgatataaactatctggcatggatattaacaatttttcacttaccctgtagttaaaaattgcatttcggaatggtggtggtgaagaatatatggattcttttgagatgtcaaaatcccaagggatgagtcctaaggtgaggaaagaagttacctggggtaacactcctttcacactcatgcgtgacttacattcatatgatgatatctggcatgt

SEQ ID NO: 33725 - DNA, 801 bp, Bovine  19866880589752
ccctttactctaacacctagttacctgtctactctgaaatcctacagctctcagccctaccacaaatgtctttgtacttgagttagttgactgtgtgtaaatgtttgagcacgtccttgcgtgctcagtcatgcccaactctttgcaaccccatggactatagtccactaggctcctctgtccatgggatttcccaggcaagaagactggattgggttgccatttcctccttcaggggatcctcctgacccagggatcaaacccgtgtcgcctgtgtcccctgcattggcaggtaggttctttacaactagctccacctggaaatgtcggatacccacaaccaaatcgtaaatgccatgaaagcagggacttttcacacacatctgccctccctgcacagccctttgcatatagctgggttccatgcacatagtgaattgtgaatgtgacttggcaattacaagagtttcagggatggacgtgatatgccttactttggtttgggggccagaaggtacaggggtggtggtgttggaatcattgcaagttagaatgcaggggtcttagactttgtataacccaatggcctgcatttatacagactctctaacattgagtttgcccagcaataggattttcttactcccaccacatgagcagccaaactaaggcctggagcagtaaagcaatttggcccacgagtccagaacccacatctcctgtcacccagcccacgctttaaccactaaaccacagctgccactccaagaccttattaatagccatttctccccccagtca

SEQ ID NO: 33726 - DNA, 3191 bp, Bovine  19866880637992
gactttgcctttgccccgtgaaagccccctctactcctgggttttctagaatcaagcctggctcctttctgaccaatccccacctgactccatttcccttatcaacctgcagatcacctctcatttgtcatctttattagcttttaatctcccatcagtttagtgctgaggtttaagagtaggattagtggggggagtttaattggatgatcttccacggccccttgaacatcagattcagtaaaagtttatgaaaagataaaatcgccaagggttttatagccccagacagagcaagagactggggcgagaacaaggtgactatttttcaacctcatataatccgtgtttcgacttgattaaataaggaagtgagttttccgtctctttcccttcctccctctttttccttgggtaccatgagccttttctgccttctgtaagcaagaagcccctttctgccaggctctcatcgcctcttctttgattctttctgacaggaagactaatgaaacctgggtgcaccagaaaataacatttatttcatgcagaaatatgctgatccaccgctaaaggtggcagaaatgatgcatctgatgggaaagagaccagtcttcaggaggggaatgtgaggtccaggaggaagcaggaaggaaatttgaaccatcttgaacccaccttctccagccttctgtcctcaattcatgctgtatcacttcttacgagggttaggcaaccggacagtgagggtggggtgggcagcagaatcatttgtgaatatgttcatttattaactcagcaaacttttgttgcaggcgtgctatgtgtcagatgctgtgctaaaccctggggatatcaaggtgaataaagcgtgttctgctggcgggagggcatagtctgtggaggagatggacagtttgaaagggaattaattttgctttttacagccttagagatgggtcttgtgggcttcatggcatgacttgggatcttgcagcagacctaggctgtcagaccatgatgcagggttttgcacaataaaggaagaagtaactgggggttcctaaagggaatctgatgggcggagctaggggagggggcaggaagaggagccaaggagtggctattagtcggtggactccctgggggtgaagatgtaatggaaatttcctggtgtggatggcctaaggacattcagagtagtcaatactcattaatgccttgtggagatatttatttttttcttctgttcattcaataaaagtaaaagcccataatcatgggtgaccatgaagatgtagcttcccaggaattcatagaaatctaaagctgggttttggatttcccctggccacaaattggggtttaagccaatggtaagtaccaggagaccctcagtgatgtgtgatttacacagctgttactaactactaggtgcaagaaagacgatggtacaaatgaaaggcagcgcttgagggagtgaatgagcagtccatctgggaagggggtgtgctgggcgtcagaagggtcttgataaacagaatggggatagaggaagggcacaaagcaccttacaataagaaatagccaggagacaggaaatgatgacagtcatggaggttgggatacccgagggagttacaagggctgaagagagagttgaggctgctggatggggtgatggtggtagtggtgggggggaatcttggaagacctttgatgcctaataaaggagctcagatggtggtggttggtgctggaccctgaagagggtatgggggaatcagagctacatgttcatcttagagctatcaccctggctcagggtagatgataaactggaggggagtggggctggggccagggtggccaggccggggacaatagtccaggcccaagcataggtggtcacagtacacactgggagtggagaggatggaggcgtgttccaatggaaaatggaaaagcctttgtaattggttgaatgtcggggggaacacaaaggaagaagtttgtgtttccatggtctccagactgaatgccaaggtggtgagctgtgttattcttttgcgggaggtaagcaggaggatgttcagatgtgtttggacagatgacttgttgttgtgttgagatgtaggtatctgttaagcaggcagatgtgcttaaagctatgtagagggaggagatggtcctggaggatgtagagtggttaaaacgaaaaagggaagaagagataatgataaagggaagggaaggagaaaaaaaaagtgaccatggatttctgactttgtctctgacaaagttctaggacctgtctttttctactacctatggatggggatttttttttaaagtcttaactgtgacaacaaaggaggatgactccatgttgtcagcagacatatggggcaggggtggagatccaggtgcatgtgtgtgtgctaagtcactcagtgatgtctgattctgtgtgacctcaatggactgtagcccgcagggatcctctgtccatgggattctccaggcaagtatattggagtgggttgctgtgccctcctctaggggattttccctagccagggattggacccatgtctcttacatctccttcattggcaggcaggctcttttaccaccagcaccatctggaaagcccaggtaccttgctcttaatggtggggtctggtgaggtgcacacccacctgcttattcctgagtagaaccccatggccacagagtctgtgtgtggctcaaagtgagaatagcctggtatgagagctagatgtttgactgaagctgttagagtagaggtggattcaagctttgtggtgcttcaggctactgatcttttaagaaaaacaatacagaattttgtgaataaatttggatattgaactttggaacagatcatggacgtgagaagctttgaagcttaagctctgttagcttcatggtgagttcctcttgacttgggagacttccaagaagcccaggagaggctcatgggtgttgaatctgtgtgctgtgctatgctctgtgtgtgtgtatgtatgtgtgtgcatgtactgcattgatgtatgaggatgagctaggaaaagtgggaactcgggactgggtattttaaaaattgtgttctatccagcagggagctcacatgaagaagggtcctaagaatatgtgtcaggtcctta

SEQ ID NO: 33727 - DNA, 1106 bp, Bovine  19866880670266
ttgagtttgaatttctgctttcctattacagtgatatatctgtgagtctcagtttcctcatttgtaaaattggcatgaaaaggggcgatccaagcctgtaaaaataggcaaatatgtaataggtcatttatggacagtacactaagatctctgataaaataaccattaacagtatgtttagacttcacagccactctggagtagcatctacatcagagagttgtcttgaagattgtgtgtaacgataaatataaattgcctggcatggtgcaagtgccaataaatattaccaatcatgataattaccatgtttatctctgtgccctggtttgcatcctgggcaaagattttgctcctgtcctcaggtgatatctctgactataggcacctccccaagtttccctgtgatgctatgtgtcaggaggagtccttacacttgaggccttgatgggagcagatggacctgaagaagatggaccaggattcaggcatccagccaaccaactagaggcccagaggagggccctgcagggacatcagacaagtggttcagagggtgcaggggcaggcagggtccaggatcctgcagcagttgagagaggagtacaagtgaatgcaccccgcagttggtcctcgagtgttgattgtggccaaagggagatgaataggagaccagcaggtgaactctgctcctgattgccacatgttcccagatgctgtgattatttctcttccgggaaggggccgcagaagaaaatgcaatgcaagtcaatgtgggtggatgagcattctccaagaacagagagggcctgattctgcctgcaaatctatattctcaaaagcctctccccatccactctttaattagaatggagcacagccttgtggaggaggtgagcagagatgcttagagaagctgcaaaggctctctctggttctctgtatgagagtcagatccccaggggtgagggatgaagcaaagtttggaatgggggggaagttgtttgatgcatggaggcaatgagaaaaaaaatctattagtggtgcttttgagttccttagagaatggttcctgaggaagccaagtaaacaacttcctgatactg

SEQ ID NO: 33728 - DNA, 2297 bp, Bovine  19866880708095
aaattcactgggaggactgatgctgaagctgaagctccaatactttggccacctgaatgcaaaaagccacctcattgggagactctgatgctgggaaagattgagagcaggaagagaagtgggtgacagaggatgagatagttggatgccatcactgactcaatagacatgagtttgagcaaactccagaagattagtgaaggacagggaagcctgacatgctgcagtccatgggataacttagcgactgaacaacaacaacattactcactattagagaagtgcaaatcaaaaccagatcatgatatttttgagaagatgaagcaatataggtataaagcatagagctattcagtgctagggaactgtgagttttcctcttctttcttcaaagagaattttatttgaattttaaaggaaggagattttgagagcaaataatcatcctctagcagctactgagattgcagacctaacactcaggagcagaatccactgtatttgcaaatccaaaagtgagcaagtgtcagcaaatgcctcttttcttgctccctaaaaggtccctactatcccctaaccctgtgtcaactccactaacttctcactctgcatacttcctaagtaggatcagcatggagagagtgagtccaccaactcaatgcctttacccgctggtgctgccctcaggcctggcctaaagtagatgctcaataaacgtttgccaaattgaattttcttctccctggattaatcactggccgaagcaagtagctagcctccagcatggctccagtgtccacaaactttatgagtcatgtcttcaaaagccttgcagcagccacccccttcccttgcctctgacctctcctgcttcttcagcatgtttatggacataattacagcatgctattgatttcctgacaggcgccttgatgtaactattttacagaatcaagctaatttcatacattgaggtttttatgggctctggcagattcaacctaagtagtcacttcgtctcctctttgggcactcccgccccttctcagaacattgcttctcttggtccctccttccctgaagcccagctgagctgcttgcaatccacggtctctgtcttttccttgaggccccactctgatggtcttgtgagttgacagtcatgtcttgagaaaacagcaaggtctttgagatcccaagaagttatggcagtgcatctgggtgatgggggagtggaagatagaattcaattattcctctaattttttaaaaaaactttttatttcctactgaagtatagcaagtaagtacaagtgaagttgctcagtcatgtccaactctttacaatcccgtggactgtaacctaccaggctcctccatccatggaattttccaggcaagaatactggagtgggttgccatttccttctccaggggatcttcccaacccagggattgaacccaggtctcccacattgcaggcagatgctttaccatctgagccatggggaagctgatcaacaatgttgtgatagtttcaggtagacagcaaagggattcagctatccatgtacatgtatccattctcccccaaactctgcccacatccaggctgccacataactttgagcagagttccctgtgctatacagtaagacctttttggttatctattttaaatatagcagtgtgtacacatccatcccaaattccctaactatcccttcccctgttcctcccctctggaaaccataagttcattttctaagtctgtgagtctgcttctgttttgtaaataagttcatttgtatcatttctttttattggacttccctggtggctcagctcgtaaagaatccacctgcaatgctggagacctgggttcgatccctggattaggaagatccactggagaaggaaatggctacccactccagtattctggcctggagagttccatgaacagtccatggcattgccaagagttctctttagaccccccacataaaagggatggcattcaatatttccccttctctgtctgacttacttcactcagtatgacaaatctctaggtcaatgcctggtaggggtcactaagagtcagacacgacttcactttcactttcacttttcactttcatgcattagagaaggaaatggcaacccactccagtgttcttgcctggagaatcccagggacgggggagcctggtgggctgccgtctatggggtcacacagagtcggacatgactgatgtgacttaacagcagcagcagcaggtcaattcatgttg

SEQ ID NO: 33729 - DNA, 685 bp, Bovine  19866880782079
tgttgtgaaaaaaaggttacggatgatgtaacttgcaccattataggtataactacgctgtgcctaggtttaacttctgctgagcctcttagctttgagtgtgggaagaacccagtatcccagtatcctggaagtcatgttgtttgggggagggaggctaataatacctcgcttttgtcttctgcaatgctcctgacagcccctatgtgaagggtttggcttcccagcatcaggatgaagatgctgtctgtaggttgggaaagagagtgagctgtcacaagttaactgacccttgccatggccccatgctttggacatgcttagacatggctgagtccaggtctgttccaagctagcgcccatcctcacatgagagtttacactaccagaccctggtccacctttcacaagatcatgaagttcttctgatgggaccactgtctcctaagcttatgttaggtgtcaaggacgaaaaccctccatccaggagtgtttcctttgctcgactgctcgaaagtgcccaccaccagagccagtgggatattccaacgatgctctgcaccggccaagtgtaaaccttcaccaagagccagaggataccttcaaaagcagccccagactcctgaggttatggtagactggtgttattatccccatgtagagtaggaaatggcaacccactcca

SEQ ID NO: 33730 - DNA, 1599 bp, Bovine  19866880783812
tgtttctttattttctattcctgttttgtaaataagttaacttgtatcttctttttgattcaacatataagtgatatccacatgatatttgtttttctctgacttcacttagtatgataaactctaggtccatccttgtagctgcagatggcattatttcattctattttaatggctgagtaatattccattgtaggggttctcagatgactcagtgggtaaataatctacctggagatgcaggagatgtgggttcgatcactgggtcaggaagatcccctggaggagggcatggtgacccactccattattcttgcctggagaatcccatggacataggagcctggtgggccacagtccatggggtcacaaagtctgacatgactgcagtgactgagcacacacacagtattccatggtatctacataccgcatcttctttatccattcatctgatgacggacactaggttgcttccatgtattggctattgtaaatagtgctgctatgaacattggaatggatgttcatagccttttcgaatgcatagtctttgcatgttcatgtctttttgaattatagttttctctggatatgtgcccaggaatgggatttctggatcatatggtaattctatttttagttctttaaggaagctccatactgttctccacagtggctgaaccaatttacgttcccaccaacatgaagtaaaaatttttgattttttcccccatcattaaaaagatatgaaaatgcattcttagcttgaaggctgtacaaaaacagatgatgaactttgattggcttatgggctgtatcttgatgacccctgactagggcattggatgcggcagtgggagtgggggcagagctgaggctgtccactttgggcaagcctttcacagtgaaagagggagccatggaattttgtagagctgggagtgatatggctaaaactggattttcagggcaaagatcaccctccttgatgtagaagaagggaggggctgagtaattctgctttcttgctgaagccagaaagctgctggtgcgactaaaattcttattatgtactttagatttctctctcctctctttcccactggaatattttgcaatcatatagagagaatcttgtctccagaaattgctacccatcttacttgagctgtctccccctttagagtctctggtcacagaattgtagccaccttttctctgaatgactggaaattagacttccaaaagtctttgacacacgtctctctctctctgcaccactgttctctttctcggctgctctgaacagtgagaagacacatttactttcctctaagctcctatgtctctatccatggtttctatcatttccactactcagtaatttcttctaggttgatcagaattaagcctgagagagctgctgcctctgttagctcctaaaccttctgaggatgaaatcgtgaatgaggtgatttaagaggttatgaaatgctctgcttttagcagagtgagatttctgtgcatttgaatcattgctaatgagtcctgatcttctgctgggtttgtgagctaatttgtgtgtgtgtgtgtgtg

SEQ ID NO: 33731 - DNA, 1074 bp, Bovine  19866880792262
tggtaaagagtccacctgccaatgaaggagatgaagattcaacccctggtccaggaagatcccctggagaatagggatgggaacccattccagcattcttgcctgggaaatcccatgcacagaggagcctgtcgggctacagtccatggggctgcaaaagagtcggacatgacttagcaaatgaacaacaacagaagatggaatagatttcaagatccaaggattctcccccatgatagtggtgttccagacacagtagtagaagagatatgggagggaggggggtgtgagtgagagagacagaacgctagaattaggaacatcaggacagtccagctgtgttccctgcctcctgcctcctggggacatcatgaggtcaagggaaatcccaagcgacagtacaggagaggatccagaggaacagattgtgggtgcagctaggtgtggtgcctggagttgcaagggctgccacgtgagatatgtccaaaccacacaactacatacacagtgggtggagagaaaccccaggtcccagtgtgggctgtcagcgtggggcactgctgtcagcaagaacatggcctgaggtctggatacaggctgtagtccagcacctccactaacccgcatgtgaaactggaccatctcttcctgactccatagactcactttccccatcagtaggatagagactaggatgaggcagaggtgggattgcaaggctgatctgtagccccttcccatttgtacacccatcttcaacatcccctcattgccaggaaaaactgtcaccacagcagcaaacaagagagaggacagcaaaagccagccaagccttcatctgctcgctcactctaaacagaaatcacttaccctaaacggcaatcagtccccgatggcctcctttccaaacgcccgtgtatgacaatgagtgatttgtaacaacatccaatcaggcacacctaaccttcctgtaattgcctgtccttttcagcgttcttaaaagctttccagtggaaaagaacagaagctccttgtcagaaggaggctattatacagaggagagagacagccccc

SEQ ID NO: 33732 - DNA, 1213 bp, Bovine  19866880818868
gcatcaatccttcggcactcagcttaactttgtcctagcgctaaactcccaacataaaatctaccttagaattagcactaaggatttttacactgtggtcaatgaagccctttaacaggagatcatgccggggaatgtgagggtaagaaaaagtctagagaaggaaaagcagggtgagagggaagacatggctctacagcctctagctgccacttcaaccatgttcatctattataagcatgaagtttccacataaacttgtctttgaagaaaggattttgtgattaaaaagaaaaaactcagagccactctcctagaactttatataagatgttgaacaatacagtgagagtagcctcaacagcagttatacaaaagttgcagagtagtcttcaaatcactgtttcttttatcaacactagacgaaaactgaaggcataatattagatcaccattctctgaaaagacacttctatgggaagctaaagtaatgtattatggatgtgtgtctttctggtaacagaaatcacaaaagcaagaatgagcttagagaatccagaagaactgatggttactgtcctttgggataactctccaaggtccctgtcaggctgctttcaggagatttaacaggttaagtactccaagttaacagatatgttcaattattgagtgaaagggagccattgattttaagaaaaattgaagtgttattaaacacaaggagcccaatttgtatttttctacaaatagaaagtcccctagctcctctccaatgtgtcaaagtgcatgggcgtatacaaaagaatacacacacacttgcgtggaagtgggttgcagaatcatttaggcatatgtgctcagtcacttcagtcatgttcagctctttgcaacactatggactatagcccaccaggctcttccatgggattctccaggcaagaatactgggagtggccatgacctcctccaggggatcttcctgacccagggagtcgaatccacatcccctgcattgcaggaagattctttacccactgatccacctgggaaaccctagaatccttataagttcagtttagtcgctcagtcgtgtctgactctttgtgaccccatgaatcgcagcacaccaggcctccctgtccatcaccaactcccggagttcactcagactcacgtccatcggagtcagtgatgccatccagccatctca

SEQ ID NO: 33733 - DNA, 828 bp, Bovine  19866880839514
agaatggaggagggagagaaggtgagacgaagaccgaagaccggcagaagaaaatcagcccagcccaggggctggaggagagaactggggagggagacacggaggtggaggtgggggaaggaaagaagaggaagacctggctgggagtagtgggcgtgtggaggttgaactctgccagtcttcatacgccgatggatggaaggaagaaggaaaaaggagaggggtttgtttgtaagaaaagacttggagaggaagcagcttgatgagaaggccaagcagctcccaggctggagggaagttggaggtgacgtgtttgtgattggaaactgggtataggagcagctggcctcccattaataggctttctcccccacccaggtaaccttttccttcgaggctggccggcgctgtgtctcaggagagggcaactttgagttcgaaaccaggcaaggcaatgagatcttcctggccctggaagaggccatctctgcccagaagaacgctgcccctcctgggccccagacccagccagtcccagtccctgcggtgctgccccggccagagagcccgtatgcccgaccccacgactcgctgccaccaccgtcgcccactgtcccggtgcccacgccccggcagcagcgcggactagagggagagtatgcagtgcccttcgatgcagtggcccggagcctggggaagagcttgaggggcgtcctggctgttcctccccagctcccagctgaccctctgtacgacagcatcgaggatcacccgcccccacgacccgaccacatatacgatgagcctgaggggatggccgccttggcc

SEQ ID NO: 33734 - DNA, 1394 bp, Bovine  19866880844039
atggactgtagcctgccaggctcctctgtccatggaattctcctggcaagactactggagtgggttgccatttccttcttcaggggatcttcctcacccagggatcaaactctcatcttttccatgtctggcactggcaagcgggttctttaccactcatgacaccttgggcattgcccttcccccatcagcttgtaagtatcataaaaacaggagcgtgtattacatttctcggtctcagttcttcaaatctgctcctgtactaaatgtccccctagtctgttctgctgctcaaactgggggaggggtctttcctcctttaggggaatgggttctttttcatcatttctctctgaagcacttgtgccttgactgtactcctcaccatgcctcatctacacgtccatttctgcggtcgtccctcctcttcctggggtgttttcaggggcagttttctggaacgtggccgagtagacagttcagcacatccgcatgtgaaaatacatcttcaggctgaaagataagcatatagtcataaatgctgagcagatcttctcattgcagggacgcatacattgtagcataattaagaaggaaggcccgtccttgggaaagatttgcagaaaaggtttataattgcaaggacagagatttagttttaaggcttcttgacttctgtgataatctctagggcttctttatcaatttgtgcccagatgatgttgctcgccagtcaaaagcaattggcttatcagttcctgctggcatctcatggctgagcacaaccccgggtggggttaggtggagcattgctggtcagaaatggtgaattctgtttattataatatcccatgtggacttagagctccataattaattgacattcctggaagcatccccaagatggtgagtccaataccatggacatcttcttaattataggagttacactggttttgtgactgttgttttttaaggaaggaaaacatcctagagatgtgtttgcctcaggaaggctggaagctgttctttagttttgaaaatgagcagatcgtggatagtgaggtcgctgcctggtggcgggagaggcaagcagtggcctttgcagactgtgtggtgtctaagcaggtggcactgagggccaatgtcgcactcctctcctcttcacctaggacgcctgatgtgtgcagaggtgtgggatcctgtgacaccttttgtgggttcaccttttattgatttcaaaatcaggccagtatcagaatatctccacctggagtccttgatgcctggggagttttaggggcagtgcatgccttgacttttagggttcttaactccatcccaatgttcctcagtgagtgatgagggaattttgtgggtccctggcagtatct

SEQ ID NO: 33735 - DNA, 2004 bp, Bovine  19866880853832
tcccactggaggtttagggtttcaatatatgtactgtggggaaagacaattcagtctatggtagctgtcttcctcaaaattcaacagtatgtcagggtagtcatctaaaggggcttacacccccaagtctcatactgttttggaattgatagggtttggggaggtgactcagagtggggttggggtggcagggctccatgcatcccagggacctgtgctggacttacagaaggacttggcaggctgctggacctctgatagggtagcttctagattccaggagacagagctaagtgatgtgatcttgggagctctaagtctggcatggagggcgtggagctggtgcctttgaagaaatatgttggctgggacaatgggtgtcttagtgatgcccatgacaggctgaagtccagtacctctggcccctcttgtttgaatgtataacccccatcccccaggcctttagttagtatgatcttcacgagggagaggggcctccaaatcatgactaagattgattttttttttttttttggccgattttggagagtgggggcttgtcgtcatgtttagctggatttagacaaatgagtaatgtgacatttctggcaccagagtgttgcagaacaaagtcatacctgttatattgggttgtatcaaacatttttaatctctgtcaatctggtggatgaaactgtcttctcctctgccaccatcaaggggagaggaaacttgtccaagtagggctttcctggttagctcaggtgataaagaatctgcttgcagtgcaggagacatgggtttggttcataatcagggaagattccacatggagggtggcaactgagcccacgtgccacaacttctgagcttgtcctctggagcctggggactgcaacaacagagcccacacaccgcaactagagagtagcacccacttgccacaactagagaaaagcctgcaaagcaatgaagacctaacacagccaaaaaaaaaattttattcagctgccctgggtttagttgtggcctgtaggatctagtttcctgactagggattgaacttgggctccatgtgttgggagcatggcatcttagacactggaccaccagcaaaatcccagggatttttttatattttgtggctacaaattcattctttattattattattgtcacctgcttattattttttcttttttaaaaatttatttatttttaatggaaggatacttcctgcacagtattgctttggcttctaccaaacatcaacatgaatcagccacgggttacaaattcattcttgaatgcacatgtggccaccatctattcccagtccgtgggatatcttttcagttgctcctggagtctcttgttctgatcacaactttttatcttttcaatttaaattaaccctttcctttgctgggggaagccaaggatttctaggggacggcgataggagaaagaaagggtttgggttctgtgggatggggaggcttctggtgggaatgaggacatgcatgtgtctgggctggaaaagctccctcagggtgggggttgtagctgcatgatctcagagtccctgttagtgggtatgttagaggcctagtggaggggagaattacagaaaagctacacaggcttttctctagtcgcagcgagcgggcactcctctgtagttgcggtacatgggcttctctttgcggtggcttctcttgttgctactctaggctccaaaggacaggctcagaagttgtggcgcacgggcttagttgccccaccctatgtggaatcttccctgaccatgaactggacttgtgtctcctgcattgctagcagattcttaaccacctgggctatcagtagtaggttactgcccaaagatccttcccctgagggtgaccatataatttttcatttaatttgggagacttttgagggtgtaagggagcaccattaataatcacagtgggacagtggaagtaaacttggactgaccag

SEQ ID NO: 33736 - DNA, 761 bp, Bovine  19866880859151
gcacacagcctgtgtatttgtgtatatgtgtgaacatgtgggtatgagagagagcgagaggctttccaagagaaactgagtgggtggctgccactgacgtggtatatgtagacaaatacaaaacatcaagcaattactgcaatcaggcgcagggggtatcttcctgcgtcagcagagctgtctctgctcccccatgcctgctgctaaggagctagtgtgctcagggtctgcaaaggaggggctcagcctgggccaggagggcgctcttaaaagaggctccttgccgggggtggggggttggtgagagccctcctgccacagtgggattgcaacacccgaaaacactgactatacatacctgcattagccccatagtaatttgagccacatagtgaagcttgattcaagccccacctttctgatgcagatcctgttcttctgcccattggctctcctcttcataccctcctgttgtccccgtggatttctcgaagcatctggccagtgaaagagcccctggttcccccctgctcctcagtcagtagtgagagctctggaagaaggggttcattcagcatagtcaggatgtaacagaaccactgtctcctgtgatcagtaagggatgccaggggaagacacagctatccagcttccaccaaaagaccttttggccaattccaggagttctggatatgggtatatcatgactactgttgagtactatttgaatactgttaaaaacaaattctcagtatctgggt

SEQ ID NO: 33737 - DNA, 1083 bp, Bovine  19866880877427
ctaaagcactttattttaatgtaggtataattattatgctctgattggcagatgagcaagccagggtacagagagagacatccaaagaacttggccaagatcacccagcaaaggggaggggcctggatatgaacaaggccgtctgacttcgtagcctacacaggcatctctgtgattatagtgctgaggtggggctctatgacctggaagaaggtggttacctccccctcagtgttccaggcgtccatgtggcttccccagcccagcctctggcctctcccagcaccctctcccttgggagcccatcatcacaacttctacttcctgctctccctgaaccttcctccagctgaacaaccattctggcaattcaatcctgacgctagtgaattatgtttctccaaattgctacattaataagggccgtgtgttcctagaggatcattaattacagacacatttttatttcccactgaaatatggcctgtgtttctgctccatgcagctcaggcacaatcttgccaacgtgcctgtgtgttgcttttgacatctgtctctgactttcctggcaagcagtccttgcagttccctgctctcctcacctttttcctcttgacatgcgtctctttccccaagtgctgagaggaccccacccccattcaagtctggaagggtctgtgaaggtccctgttcctcaaccttttccaatcaaaaccagttgtggttactgctggggggagtataaaaaaacaggcgtacaagggtcaatcagatgatgacctgatgatgtcccttccctagctccaagactttctgggcaatatatcttattggatttaaggttactccaataattgggacattctgagtaaggtaggaagcacaaacttcctcaaactggatctactgagggacctcacttttaggcttgtcctcaaagccttgtaggactgaggcagtaaatgggtgggagcactcttatgcccccatctgctggacttgaagatcagtctggtactgtattcactctcttatgctccagggacaggatctcttatgtatataagccagaaacggaggcag

SEQ ID NO: 33738 - DNA, 1475 bp, Bovine  19866880914362
ggtcggggggacagggtctgtgcacagaacagcacagtcagctctgacaatcatcttgaataagtcattcagtggtctgatcagtgtcatcttgattgttttaagtgcacctaatctccagttccagggtggcttcatttccttgaggccagatcttgaaattttgtacgaaagatcagtttgtgttgtggttataatctggtcatcatgtggttaatttttttcaccagataggggtttcagtatctgcaagacaactcaaagaatatggctcagaatattatctgtagtctaggaggaggaatgaaaagttcttaactttgtttagtggctaaactattattgtgttctttgactgggttcctttacttctgcattttcgctcttttctgattaaattaactctttggctaaagttgtacagacaagatgcaggcagagaacttggggtgggatctgttctgggaatgcctcacagggccctgctcccttatacttctgcctccaaacctttcaaattcattggaacttacacttagttgtgagctgggctggtcacactgtggaaggtcctttcctggggatatgtgccagtatcacgactaccattactgacacaggtgcagccccggacgactgagggataacccatacatccccaggtcctggctggatgttctgcatcaggtggggcctcctcgggtgctcaagtcacacacatctctgcatcctggtgtcccacaccctctcttgtgttgcccgggggcagaacaagaaggcttgccctgcctgcgtgttcaggtaagctgcttcatggttgatttccaattcatccactctattcccttgctggagactaaacaccaaaacaattattgtttaatttcaagtgaaaggagcactaaaggagacatggtgtgaccttttctgtgtatgtatctatagatagagatatatagacattggaatttatttccccagggagagcagtggtaccgtgctgccagctgggtctgcgtttggagctgtgtttgtgtacagtgctatgtgtaatttatttccccagggaagagctgctaagatggcacatctaattcctgtagagatttcttttccttttttctttttttaaaaaataaaccaatccaccccttacccccagaggaaaaatgtctcctccatctagtggccttatatgactggtgtctttgagtttcacaatgccttggcagagggctaggactctggtccctgcagattctctgggatcccaagtcacacagcctctgtctgtcgtcatcttggacggggttgggggaagggactgcagaatgactgagaccaaggacacagagtgccagacttgccctgctttttctcgtctttcttctgtgggctctaagtgacagtttcattcacgcattggcttactcttccctggcactagctttggcctggagttaggaagcagcatc

SEQ ID NO: 33739 - DNA, 767 bp, Bovine  19866880939796
aatatggatatgaaggctggacctccagcagccacctttgaccttaaggtgactttgtaatggaacctaggcacagaacacagaacagaaatagttctgttgacactgtaggatatctaccagcccaggattcttgctcagctagatatagtcctaactagtaaagcatgtaacagacaagtcagatgggagtgagagctaatagcattctaaggagtgcacagtggaagcggagcaggatcgattgactctgcacaggcaggttaaaacaaaatcacagagaagatgtgtgaatgagtctttaaaatgaagtaggatttcctcttctgtacaagagggatggagtgttcctggtaggggaacagcatcaggcatggcaaggcatggcatggtttattcaaggaaggggcagtcccagtattgaggaatgctggtgaattccctgagggggaggggccttcccagggccaaccggcccctcccagccccagcctaaaaatgcagcctcatccccagcaccccctgctcacttttaagtaattactctcccagtgcatttttgtcttacagctgttccaccagctgttgtgactgttctcaccacaacctgtcaagtccatggggagcaggttgctgggtaggaagaggtgacaaactctaaggagggccattaaacacctgctgagccccagtgaaaaggtttaggaggataatatctaggccttgggccttgtaaagaaaactgctcttttcaaaagcacttaaag

SEQ ID NO: 33740 - DNA, 1929 bp, Bovine  19866880969672
acacaactgagcaactgagctcacacacacgctaagccttaggagggctgaacgtactgcttttatagattaggtgtctctgttgtttttgttatgacctgcgtttcagatagtaatgttttgttattagcattgtcacactggagctcagatccttggagaaaactgaaggtgacttgcttttgttttcttcttttggatcaaatgcctccctggctttttatttcctggagtttcacttctgagcactcaaaagtgttagcgttccttggatgcgagcaccgacaattacatctggagctgttctctcttaatagtctgccctccgtctgagaagtttatcagttctcttggagagtccccaccgtgcattagcatttgatatggatgtcacaatttgcaagcctttttatctttggaaaaagcagagcaaggaaagcaagccagatcacttggtcccccactcggagttgcaaactgattttatttgtgaaactggcttaatttaatcaccaggacgagtgatccaggtgatgttctcatgcaagctggtgacaggccagccttcctccttgctctcccaggcacacatgggaacaagctaaactcacgcacgctgtccttcctccacacacatctacccacaaaggagaaaatgccatctgtgcaatgcgtgcattcgtgctcagtcgtgtctgactcttttcaaccccatggactatagctcaccaggctcctctgtccaagggatttcccaagctagaatgcttgagtgggttgccatttccttctccaggggctcttcctgacccagcatcaaacccgtgtctcctgcttcacctgcactggcaggcagattctttaccactgtgccccctgggaagcacatccgggcagtcgtcctcagcacacactgtagtggggcactttatgtaagggacagagagcagaaatatggggacgacgtaagggcagccagagacacggcaccaggtaatttaacatgaatctcctatatgcttacagcgtcacatcattgacaaggtatttgtgggcacaccatatctttcagtctctcacatctcaagggcacacactgttacttctccttagactgtccccatctgtgcacctgccaacaccttaggccaacgtggccaacttctccttcccagagaaatctctgacaaccccatctacgttaggaacctcttaggacttccctggtggtccagtggttaatatccatgcttctgatgcagggagtactgattcaatccctgacccagaaactatgattccacatgtctcaacgtgaatacaaagtgaaaactttataaataaggaaataaataaattaggaacctctcctgccattattctccatcttaacactctatttgtttttatagcacctaattattttttgtgtttttatttacctcttgattacctgtctttcccactgaatgataaacttcttaaaagaaaagaatccagtctgttttgttcatctgggattaccagcccccaacgatgcctagcatacggtcagcactcaaatatgtgttgaataaatcaacttgattttcacaacaactctgcagctatagccattttgaaaataaagaaactgagatccctagaggttaggtgacttgcaagttgctaatagctagtaagtggcggagccaggattccaatctcattccatggcctgtttacaccacattctttgagatagtcattccctgtgatatgacttgacctctgaactccactatagctcccagcctcaggaaaaggagggagattttgatacacacacacacacacacacacacacatacacgcctttgacctaacccttagcttattagccacaaaggaccaggtgggaatttcactctatcatatgtgccataatca

SEQ ID NO: 33741 - DNA, 1635 bp, Bovine  19866881091038
gcttgagaggcaggcttccatctgagccggaggacgctgagcgcacgctgccttcctaggctatcctgcctcttatgtgtcatgataatgacttgaaagagccaataccatgagacacatttgaggggtgcacacatgaggtgcagttggagttccacaaaaatagttttcctgggcttgggagggagagggggcttcctggaggaggggtgctggatttgggttgtgttgttgtgtgtgtgctcatttgtgtccaacttgttgtgactctatccatgggattttccaggcaagaatactgaagtgggttgccatttcccgcccaggggatcttcctgacccagggatcaaacccacatctctcctgtattgcatgtggattctttacttgtagtgccacctaggaggccccttgagtctcatgaaagggtgcaattcaaacaagtgaagggaaggagatattttaggcaggaagaaggaaattatcagagacatcattttagagtaagatagagatgagagagagtgcgcatgctccttgtttgtgtgtgtgtgtgtgtttaactgcagcgggtatgaagaaaggacaaggttgcagtccatccaatatatcccctgccattttgttgggaggaggtctggcatgtgcatgtccagattcttattcagaggaccagcactgcagtagggagggcctgtgggcagatgggggcaaataagctggatgacagtgactcctctctgatcccaccatagacttgctgcgtgtgatttctgctccttttcctcgcctctctaaatgtaaagtgcctgcctggtgcagactgtgctccctagctttcttcagctgtcatggtattaagtgtaaaaaaaaaaaccaacatgcatttattttatgttatttacaaactgtaacattcagcctgaaaacaaattgagatttctgggcaaagaggcagcgtctgatgttggagtgagatttcttgtcgttctgagtcagtctgttcttgcagatgcctcagagaaggcggagccacctgcctggtggtgggagggaaggctatgtgggacagggggcgaggaacggggtacccagaaggcaagattggacagtaaagcctggagtgctgcgtttccaggatctggcttacccaggtcaggagagcaccatctggttgcaattaatgaacagcatgagcaatggtgatgctcctatcagagggcctgggatggaatgcagcctgtacccaataatgtgtgttgtgttctttggtgatgctccctgtgtctccgcccatctttccttcctaagagattctgacccactatctctggcacgactcaggtaacctcccatttctcatttggtgactataacccttttccccggtgggaagccaagaggggagaggaagaggagataggaggattcatgttgctacaaaattctatggctaaaatcccagagcaaatggtgtccatcgctccttttaggtgttacccatcttgagtcccaagctttcctgtgttgccatgaaccgtgacatccacctctacccaaactctgccccacccccagtcctccccactcatagaggtgggctcctgagcttgactcatctactcagtgcacat

SEQ ID NO: 33742 - DNA, 1252 bp, Bovine  19866881096100
tagttgggggtctcagcaggaaacagatggcacactcaagctggataattgaggagagtttaatgagagtactgttttaaaatatgtgggaagggattaggaaaaaccacaagggataacatgtatcacttccctagacctgaagaggttggggaaggagacactgagaaagcagaaaggaccactgtgtgagaaggtcctcttaacaaaatctgcaacaactggaggcaaccccacagggaacacatactcctagctcactctcctcccactcttacatcttctgttggttcatcccattggctaaacccaacctgaagccaaagggaaggggatcaggtaggtcaccctcccagcacagagcagggtagggtagagatggaaagaccagtaaaggatttccagccaggggaccaggatgcaagcatcacagatggtaagtgcaagggacatcaggggaagttgcagggttaggggccagttccgaggagacagggataggccgtggttcctagcagaagagtgggttctaagggaggagaaccctttggcttagacagcagagtcaagggcagatgccctgagcaaactcagacagctggaagtgagttgtcccccagggtcaggatagacttccatagggaatctaaaagtactcctttcctccccagctccaagatcacaaaatcccaggcttccttcctggaagggcaaacttgaacaaggccccacgaggccttagtagggtggagaaaatggataacagttgatatctgatactcccgtggtgaggtctgaggcaaagcaggagatgtgcttcatggtctaacacagaaggatacatggttctagtctctagatgaaacctgagagagtaaaggtctaatagaaatcagagtaacaactagaatagtcctgagtatgagtatggtaccttgcatgaggtcttcacgtagattgtcttaacaatgataagagggaacagaaggaagttggagagacaagtaacaagcacaatgaatatcaaatatgtgctagacattgtatacatggcatcacacactatatgtgttcacagttccattcttcccattatacagagaaggatactaaggatcaaaggggttaagcaatttgtccaagctggaaagtcatgaagtggaatgggaccaagacccaaactctgattctacatctctgtgtacttaccacactcatagagagagggccatgcaagtcagcatcagatagg

SEQ ID NO: 33743 - DNA, 909 bp, Bovine  19866881102293
ctctttgagttgggaaagttcgtaaatgtcagtccatgtgtgtgtccaagtggctgccctgaatggaggctcgtgtagacatgatacaccttcagggcaaaattcagagccttcacgccacacaccatcccctgcctccacccagacacacaattcaggctgtctgagcttctgactttgaacccagccccagagaagaatcaaggccttcagagtgaccccaggtctccccctgatgccatcctcctatataagccacgagaaggtggcctcaccaaaggccaggccctgtcagcttccgcaggctggactggctgggactcaggttctgatcttctttagagcaaacttcagacacgctgccagctgctcaacacagcctctggcgccttccctccaggcacggggcaaagagcactgaacggggctcccaggctacagggcctctcccagcccgactactcactggctgagggagccccactccatcacttaacccctctggccctcaagcttctctcagggaatccagatgaaaactactgccagcctgcttcacacagtcccgcgaggaggaaatgagatcaggctgtgaaatagcactttggaaacacagaactccacgcctatacctcgggtaattactgtagcttcaggagggtgccccgaagccacgtgcttggagggcccataaccccgggccagactcagtctgttccctgcaagggtctctcctacggccaggtagaacaacataatgactgggaaggtatccttgcctgaggtgaggaggctggccacccagcacctgcctagaccccaggttcttccactataaaatgagggccagattgcctcacctcaaaggcctcccccagttctctgtgctacaaggcatatagaagtaga

SEQ ID NO: 33744 - DNA, 1513 bp, Bovine  19866881112468
tacaacgatctcagggtcagggcaggctgtgcaggtggaaacttagaaacacagcgttgtttcttctgcacaaaaggagagagactagtataaggagccctcctgaccccaggttcagcatctcaacatctggccagtctgggggagctttgatggaagggaccatagttaagaagaagaatgcctgatatttgtatagaatattattaagtcctatacacaaaagccttttgcataaagtatttcgttcaattttcatagtaacccatgaagtagacattgttattcccattttagagatggaaagagtgaggtctggagcagcgaggtcacttgtcttggatggctctgcactggccctgggagttctggctaccaacccatctctcttatgctatgaatgctttgaacagctgttgttaatgcttctctaccactcattagtgggatggtcttgcgtgatccctcccctgctcctgggctttgcctttagttgaccccgagaggcctttccttggcctggggaacgtctgaacatccccctgggccctctcagagctccgtgccatcattccccggtgtgtcctacttaatgggaagtggagcagtttagaaacagcccagaaagcagagtgaggcagcccacatagtcccacagcccccactccaggtgcccagcgctggctctggcccaccggctggggataggagcccccgggaggtggcagtgatggtgaatgggccaggagaggcttccctcatttccacctagagttcattttggctgctggggctcaaggactggagacctggtagcttaagagatgctggggaagaaaaccgggggatttctggaacttcctctggggacactcagctcccagccagcactgaaaccagcttccagaaacagatttcttcttttttaagctactttttctccccacggtgacccacttttgtagctaaggccccaaaggcactccagtcacctctctgagtcattttcctgaagcatgggctccctagccagtccttactccctgcacggtggttgggaggcaggaacacccagcatcttctggggtgggggtggggggcccaggggcttagggtgcctggagccaccacttacttcctcaatctgaagccctggctgggttcctgagatgctaatgggaacgtctgctcctgagttctccatgactggcaggtgcgtttgggagatgaccatgggcgagaggggcacgacagacaaggaagtgatgggtcctgccagagaagcaccatccaaggcccattcaacatctccatattgactccctccctcaccatccagccttggaggacacagaggggctcgtgcagctgcggtgcagctgggggcttgggggcagggtgggagttgatggtaattcctatggcagcaggtggagagttcctgcttctagatgagaacagtggtggtgctagtagtgaaaaagaacgggcctgccaatgcagcagacctaag

SEQ ID NO: 33745 - DNA, 852 bp, Bovine  19866881235013
ctttgaccgagtccactgggctgctgctggtgatgagccttcgcgatggtccacactccaaagaggatggtgcccctggctctttgcagaaaagaggcctgggtgacacagagctatagagtctctgaggccagctttgaaaaaaaaaaaaaaacaagaagctcaaacatccccattagggtttctctcttgtttccccattaaatcagagagagaaaccagtgtaccgtgtcaattcttacttttaaaaactgggttcagcagccaagagcagatgagtgttggtaactggctaccctaaaggggctgttgaggggaccatttcccaggagagccatcccctgtttcctgttctctggggcaggtggctccagcctggccctgagcttcctagccccctgtccccatgggcatggcctccggccagcaggaggtggcctggccccacccagcagtggggtctccctggccctgtggctgggttgatcaaacagcaagagaagatcccggaccggagcaggctattagctcctctgaagagaactcccttaatcgcataaactaaccacactgtttattgtgcaaacttggactgaagcagcctcgcagaagggggttcataacaagggctgttaatatttatggctgacatcgcgggttcctcgagtcactataatgagcccattgcagcctgagtggctgcaaccttccagcagaggcaaagaggaggagaaggaagcagaggggagaccggatggtgcctgccttcctgatctgcacggcagggttccttccagtggtggaagtgtctgctgaacacctgctgtgtatgagacattcagccatgtgcta

SEQ ID NO: 33746 - DNA, 959 bp, Bovine  19866881299888
cctccagatgaatgaatggatcactccagcctgcaatcatgagtctggggcctgggctttggtgaacagtcagtggccctgacattgaccagaaatcaaatcacgagacctggaccatgtcttcacataggaagcctgaaagtttacctgcaacatggaaaggggaggctggagataatggggcatgggtccctcagctctggatatgctgattggatggaccatggcagcagctttgtccttgggcccctcccaactctgatccatggctttgtcaaatttcttcatgaaaggcaagatgaaggcctgttaggatgtttgcttagagagatctttctctctgtctggatggagaagcagggaccccattgcactggttgtcaagtgctacagagtggtcatactggaacctggaaacagaaatacatcctgctggccccagatgtcactttcctccaggattttatagtccaccacacatgcccatctcttctcccctcttatttctggaaagaaaaacattttaaaaaggcaatttgctgggtcaaagttagcaatgacttgttgaattcaacagatgctctcaagcatctataccactggaagccttgctgctgctgagtaacttcagtcgtgtccgactctgtgtgaccccagagatggcagcccaccaggttcccccatccctgggattctccaggcgagaatactggagtgggttgccatttccttctctgggaagccttgagtaacatgtaaatattcccagtagaggaaataaaggggtgaagaagataaagctacactagagaaacaagtcaatggagtcataagaacagggatcaccttagctccaccgggttgattattaacactcagatccttatccattcattaggttgacaagcactgtctagtgacagggtaattacccagtcctgggtaattagaaaagtaaa

SEQ ID NO: 33747 - DNA, 1250 bp, Bovine  19866881344152
tgtgtgtgtgtttgtgtgtgtgtgtgaagtggggttggggtggggaagaaggtgtccttttaccctcatagaggtttagttagcagctgtttttcaagggctttgaaggccaaaagctgtggaaagaagctgatttctaatcttatctgtcataacgcactcaaaacaccaatcacatgcctttcgtcttcccgtcttcactgttaatggccacgtctttctctctctctcggccacagactctctgctgcatctcctgccagctggagggactggagggggcccactggccccttcttttctccctccctgatcaggagaaaggaggtatgactgttctcctgggggcatgggacaggtgataagcggaaagctatagaccttgagccactatcgctttttgctttctggccttctgtttttctgtctgtaaaatgggcatgatcacacctgcctggccttcttcatggagttggtagaggaaagaaggagagaacaggcccagaaacatgagctgggagacagccccataggctcggcagatatgccctcttctcccatttccctttgccaccagggagtggtgggggcctgaggagtggagtccctgcccctgggtggatccttcaccctgcagggcaccccagctgccgtgctgtctggcccacagcttaactggcccctgcacgcccctctctgcctagccttgtaaattgcctgcgctgaattctgcacacacctcagtggaaggggaattatttgccagatatacggtgtctgtgagaagggcctcttatgagtcagtgttcaaatatgttaccagctcaataaacagaggtttgttgtaaattaagaaaaggaagcgaggtgcctgcaacagcccttgttcatctactgttttctattagcgacgctttccccttaagtagcacataattcccggtagctgctgggctggcagcttggaaggggggatgtaattacactgcagttgttaggtagttagagctacacaataaggtccatagagagaggcagggacagccctggggcggggggaaggggttggctgggctccccaacaggatcagataagatcacagttgcctgataatctcagggtgacgggaggagcagcctgggcacggcagagggcagatctagaaaacaaggctctgaccctcatcacaggaagaggtggatggtgagttcatggcacccgtgggaaccctgcaccagctaagggcagg

SEQ ID NO: 33748 - DNA, 1515 bp, Bovine  19866881385113
gaggagcctggtgggctatagtccacggggatccacaaaagagtcggaccccaacttagtgactaaacaaccaatggacctaatgatgatatataacctgtatcattaaacacttaattgatatattttctcctgaaagtctgaattcccatggaatgttcattgatcctaatgacaacattttgaaatattgtttaagcaaagtgaactgtgatttactttaatgcttgagaagtgcagtagagataacagctgaacctctttgtggctgtcctgctaggagcatgaggaaggcctgagtgcccatctgctagggttgctgttgaggtatttacttccttggataagattttggaagcaaatacttgctaacaccctttagcaaaaatcctcactaacatcctttccaactatatttttaaaattagaatctgaatatttatggaggtctttctgagaatgtacaaaaccctgagagtattataatgcatagtttaaaaaacgcactttgttatcttgccacgtatagagtagcatgggaactggtgtccaaatatcccacctagttgggatgttgcaagtcaaaatgctaaggatcactactctgtgcagagttagcagaatggagagggtaagtgactctcccagcttgactccccagatctgtagcagccttccagaggatctctggactctggctgctgttagctggcccatcttcttaaaatctgcaacctcgtaaatttgccagcaaaactgaacaagcacatgttgcccaatcctgactttaccatcggcaaggagaggcataaatccctttacatctgtgcctgaagctcttttgcacttggatcctttctgaaagtcactattggctctttgaaagaaaatatcttttctccatggtcttctccatctttaatagacatgtcatcccatgcactagtgaagatattttagaaaagaaccttcttctttgaggttggcattacctcagggaaaaggggtcttcttagatgatgtgactatagaaaaattcctatgtaaaacgcggctggtacctacctctcctgatgaacaatgctgcaaatcaggcagggcttttgcaatatatacatatggaatgaggtttatttatgagtgggaagaaacctataaagaagagttattaagtccaggaggaactgatttatgtcatagtaaaattcagactatagttcagccaaaggaatgacagtctctgacaggtgtccatgaataaattcaccttcttctaaagcattctcttctctttgctagccactggccaagttctttagttgacttgaggacttttcccttcctgcccttctcctcattttcctcttctccgtgatctttatagctccaggaggtaagaggaagagggtcacctgaccagcacccttgagaaagccttggggtttttcatcactccaggcagattttcagagcctgaaacccaagctgttttctcttcaggaatagtgaagtctg

SEQ ID NO: 33749 - DNA, 1397 bp, Bovine  19866881389911
tggtgttctttttgtgccttgattctcacctctctggaatgagaatgcaggttagggtgggaatgatggttaaaatctaggaggaagggagtctgccttcccactgtctgtcttgaaacacacatacgcacacacacacatgcaaaacctcggagagtgcgagaggccatttggagcgatttgaaatctggagcccttggctatttaatgtttccagcaatgaactacatgatgaaacagagagcacgctcattaatttcatagatgacacccagctgaggctggaggggcaccttggaggatccgattagaattcaaattgactccagtgggtcttagagaatggtcaggaaccagccaaatgagattctgggaggacaagggcaaagcgaggaaaaagcagccacacagatgatggggaggaatgacttgctgagccccagtcctgcctgaaaccgaaagacttccgtgacctctctgcctgattcattaaggctgacatctgcacacagcttacaatgatacaatgaacttgcactgttctttcctttgagcctttgtgacaccttccctgcccacccccacccccccccccagcccaggagagaggaattgttatgaataagttcacagggctttcgagatgttaaaaaatctgcctaaggccacacagctgataggtgtcaaagtcagatgcaaaccctgtgagcactttccggggctcctttgacatgaacagaaggtattggctgtgtcatcagacctaaggtacagtcccctgatccttccccctgcccccaggctgcctcccatcccctttcttgtgtcatgttctcctctgggtggccaagatcctaggggtgtatctgtgtaacccagttctaatcagcaccaattctgatcaaccgcctgaatgttggatgactttggaaccttggatgaatccaacttccctcacctggctggctgaaagctcttggagtgaattacataattaggaagaggatggagccactacagatccactgcgcaggccctccattctgcttggcaatagcttttatgtgtctctggtcagttcactctcctcaaggtcctcacctcattattggcctcattgttattattctgttgaagagaagatgagggttatgggacaaaactgctctcagcaactttcaacttgtctaagttgacatcacctctcccctgctttcctccaggctcagggcaagtggatgatgccgtccacttgcctctcctgtgctcatggccttcctggtcctcttttcccaacatgcactcccctgaggccctccccactttataagttccttcctcataggccttcaatatgttccagccaatcctggctcatgaaactttccctggatggg

SEQ ID NO: 33750 - DNA, 1802 bp, Bovine  19866881598159
cctctgtcggctgcttcgaggtgattagagctaagtatgggtctcagcaaaggcgctgtgtgccagctagcaaacttcaagggactgtgtgggcttgaaaactggacagtgtcatctgaactgaagaccagagggtaccaagcaaatagtctgcactttttaagattttatgactcacaactcaaagcaggctagagcggaggggaatggagccccagttgtggctaagattgaattttccattggcttggcaggatgtgggtttggaagaaattaaagagttagagggaagaaaactttctttatatctcatgttatatgtagagtaaaattcatctccaccaaatagaattgagctctgtcccacacacaacccaacctcactcggattatactttttggttaagttcctgcatgacagctggcagcatcccagttggttcagatcctgtgctgagcttccaaacagccctgaacagcccagcctggctggtcccagacattccaaggcagatctacctttaaaatgcatgcatgtgtgctcagtggtggccaactctttgtgatcccatggactgtagcccgccaggctcctctgtctgtggggtttcccaggcaagaataatactggagtgagttgccatttccttctccagggtatcttttcaacctggggatcaaacccaagtctcctgcactgcaggctttaccactgagccactggggaagcctgaaccatcgctagttagaagttagtatttcatgggttaatcccttactatattgtggctttataaggtcagagtctcaaagctttgtcatgaatgctatcccccaagcccctcagctctgagccggcactgaatgctcaaaagccaccattcctgcctcaaaattgcaaactagccctcgaacagctttgttttgtccctgtttttgtcatctgtaaggactgaatctgatatgagattacaaagtaataagactgacttttaaacacatcacagatcctatgaatccagatgagcgctggcttttcagtgatttcaccatgggaggctggccacacacgtattacagtgaggctgtcactccaggcaccaagactggaatttctctgtagaaattgcctgcggggacagttagacaattacagaggaacacagaaaatcagtcccaccactcggtggcactaatggctctcaagtgtggttcattgttcctgtgttaagcctccccagcccatgtcctcttccagggcgcgtgtcttagacatcactacgtagctccggcaatgtacagaatccagtatgcaggaagcacttcataaatgcttggtaaataaacagtgggctccttattggtccggggattattttttttccttccccctcttttttttccaccttctccactgttgttgttgttgttcagtcgctaaggcgtgtctgactctttgcgaccccatgcactatagcccaccgagctcctctgtccacaggattctccaggcaagaatactggagtgtattgctacttccttctccatgggaatcttccagacccagggattgaacatgtgtctcctgctttggcaggcggattctttaccactgagccacccgcgaagcctgtcttctccattaaatactcattatttatccatatcctctttttctggctgcagaagtcacaacaaaaaatactcaaagagggaactagaactgaccacagagcatagagggactgaggtttctatatccatgaaggataggctgggctaggctatgacatggcaacca

SEQ ID NO: 33751 - DNA, 1740 bp, Bovine  19866881637996
ctctataaatccaagacactgctttacaactgcttgcccaccatggcccacacttcgttggtagagggccatttctgcacatcagatcatcggtgatttacaggaggatggggggtacttttaactcagttcaggccttttaactcagttgcatgccaccaggcaaaataaatggaaggttctaaaaattaatgaaagatcgtgtgcatgaaaggatgcagtatacagtagacactcaataaaggcttgtttagtttcttcttggctgtcttttctttattggactgagagtccccagctgcacgaagtagcaggcatttcatcaatgtttgtacacaccctctctgtgggctaaatactgagcaaatcagctttttaaaataaatactacctccatttattttgcaaaagacttgctgacaagacacccagcagcatctgaaatttcatctagacaaagagggcagggacaaggagctctatttttcccattccgagcttcccactgcattcctcccacactcacgcaggcacacacatcccagcacatgtgcgccaccgcgataaggaggctttcaaacgcgcaattcatcaccttggccccggatggaaggagagtgtgtgtgtgtgtgtgtgtgagcgtgtgtgcatgcacgtgtgtcacactctcgcatgcacgcactcccaagggcctttgtagcccctcctctgacacaatggagtgaaagcacagagctcacaaagggagaggaaaaggaagggaagtgaagaaaagtgcccacttcggctgcctctgattctggctgctccatctgagcctgttaaccagttaacgatatgacaaagaacagcaggaaaggagagaagcttccagcctgtagccctgatgcaggagaaaacaaacattaatcacagcagtccctgtgggagcaggggtggtgccctgatgctctttacggggggattcatgaagtcacaaagtccacggaggcagccaggatgctaatatccttccccagaatcctccgggaccctcaggccagccctggctagtgagactcagccttaccaggcacccgtgcgcgtacacacacacagacaaacactctccagcccccacctcggcttcactcccagagctaaccactcactctttttggcggagttcttgggaaagtgggaattaaatgaatccacatttatggaaatccacgtggtgccaggcacttccattgggttacttagtgtaagcctcacaagagcactggggaaatatttttctggttattactccatgtgtagagatgctgaaaactaagatgcagagaaggggtgtggttttggtttccaggcacacccggctgggaagtggtgaatggagaattcaaatctaggtgggttattttttccttttattggatgcccaaactagtgttttttccttttacagcacaactggcattcactttcggccacagattcctggatcctgtatgatacaagagttctgggtaggctctaggaatctgcattttagtacaaaattcttttttcctttattttactatgatagcttcattaaggtgtgattgaactacgataaattgcatatgtttacaatttacatttgagaagttttagcatttgtatacaggcttcccaggtggcacagtgataaagaatccacctgctaatgcagaaggatcaatccctgggttgtgatccctggcctgggaagat

SEQ ID NO: 33752 - DNA, 795 bp, Bovine  19866881907154
tgcattggcaggcacattttttaccattagagtcacctcaaaagccctaaaaatgctagttacaagcccacaaaatagaataaacagaactgaatctgtttgggccatgtagtcttagctagttatctaactagttatgtttgacaacaattgtcttgatattcagatgtcagcagataaaggagttgtcacaaatttcccaagacccttctgaggagggaggaaggaagctggacccataggtgcccatcacagtgctgctgctgaattctgggtgtgtgtgtgtgctaagttgcttcagtcatgtctggctctttgcaaccctatgaactgaagccctccaggttcctcagtccatgggattatccaggcgtgaatactttagtgggttactgcgccctcttccaggggatattcccaatcccgaattgaacccgtgttgcttatgtctcttgcattggtaggtgagttctttaccattagcaccatctgggaagaccttttgggcagttgtggaccaggccagtctttggtctcttggaagaagggtgtatctcttccgtgtgtgagctgccaggatgcacagctcagaaaaccatacagaataataatagtaacattaaacacaatccttctgttggctgaagtgtgatcatttcccgtgtttttttcagtgaattaccttatttataatcacagaattatagattattgtgcaggaaagaatagtagagaacatctaattcaagctatgcttttcacagatgaggacactgaagccaggagacataaagt

SEQ ID NO: 33753 - DNA, 1461 bp, Bovine  19866880387113
tactttaccaagatattcagacttatacttggaaaactacagggaaatgaattcaaatgatttatatatagagatgtatttaaaggtgaaaaaacagttgagaaatactttcctatttcttctctctttcaaatgaattctaaggtaggttgctaccattaagtttattatgtgtaaaagatgatttaaataaagagaaaattatcaaactgaagtaatattatcagaaagatctttgctgattcattgtgatttttatatcatctttttcattctcaaaattgactataaacttttatattattttatattttaactgatgattaaatcaatatttagtgaaagtattttataaacaaactatctaaatattttatatataaaatatggatctgccatttaattaggtttgaaaggaataaaatgaaagggctcattctttttgttaagatatttattagtggactatataaacacttcaaagtattgtgttttaggtaacaacagagtaacactttatcactgtctcagtagaggagagaaaaatgaaacgaataaccttttcatgatcaatacctttgcaaaatactaattttccttcaaatgccataaatcatgtaaacagagtgcattatattgttgctttgtatcattcatctacttaattctatagttgttttttcatgagtgaattattttagtttattcatgatttatctctcacatatattcaataggacaaaaaagtttccatcaactagaacatattaatgacttccatttagcaacaaatttagaccataccgacagtcaaagcaaaaatgggaaatcactgagttatataatctgggaagtactcagaaagaattgtttttagagacattcatgtatactaccattaaaacaagaaacaaattaataattcaaatcttagataagatctatatcatttaaatcacacaatgttctttaaggaattatttcacttcattaatagtgaaatttatgtggaaatatacatatgatatagtaagacacagagataggttacaacatatgaaataaaagatggtaagtctctcaatgaaataattttataggggacttcaacatgtcttgaaattcgcctaactcaacactgaagattctaacaagagactaaattacaagttctgtaattttatttataaagcaaaaaatgttctttgaaagtagacctagagagagaaaactgatataaagtatatgccagacaattctacaccctaaaaagtagtaaataaatacacacaaaagtgagttgcagaatatatatacatacgtatttttttcctcatgaaagaacttaaaatggtcccacagtgtgacaaagaatctggaaaaatttggtgatgattttgttggagatattttaagagcatgtgaaaatttatgtctgaaaatgaatgtttattaaaacat

SEQ ID NO: 33754 - DNA, 740 bp, Bovine  19866880398428
tgcataatgagcgatatttataaaagccaattactgctaatatggatgaccttttggcaccaaataagctaataacctttgaaatggggactagattacatagtgctaaaacaaaacttaggtataatagaaactaggcccccatgcatacataaggatgaaggttattttctattttggctgcactcttaaagatctattaatttgatatgagatttgaattcaaaatcaatgccagctcattttcaaatagggaacattagaaaagaatgaaagcgccttcttcttacaaataatttctaatggagcaacattaaccttaacattaaataccatgattctgacattttcaaaatatttctttgctaaaggtcatataaattttatatctatagccaactataagattttaggggacttattgatccatatataataaatattaataatagtgatcaatcaggttgaaattcacttatttttttaagtaggccaaaatataatgtctccatatacttgattcacatttttttcatgtgctataaaaactaatctattttacctaatgctagtagagcaatagttcattttattaaggtactttcatttctgaatattgcactttaaattgtttattttctggtatatatgatttaatagccatgatgtaatagtgtaatagaaccacagaacctctgtgtaatatagcaggggaagtactaatacaatgtatactggaa

SEQ ID NO: 33755 - DNA, 2358 bp, Bovine  19866880523948
ttgtttttcctgattgtatagggcttcttcatccttgggtgcaaagaatataatcaatccgattttggtattgaccacaggggtgatgtccatgtgtagtatcatctcttgtgttgttggaagagggtgtttgctatgagcagtgtgttctcttggaaaaattttagcctttgcctgattcactctgtactccaaggccaacttgcctgttattccaggttctcttgatttcctacctttgcattccagtgcattccagtccctatgatgaaaaggacatctttttttgttttgtttttttggtattagttctaggaggtcttgtagatcttcatagagttgttcaacttctgcttctccggcattagtggatggggcatagacttggattgctgtgctgttgaatggtttgccttagaaactaatggagatcattctctcatttttgagactgtacctaagtattgcatttaggactcttttgttgactttgagggctactccacttctcctaagggatttttgcccagagtagtagatataacggtcatttgaattgtttgccctttcccatactttttagttcactgattcctaaaatgtcaatgttcactcacaccatcttctggttgaccacctccaatttatcttgattcatagacttaacattccaggttccaatgcagtattgttcttacagcatcagactttattttaccacctgacctatccacaactggcagttgtttctgctttggctcagcctctttctagtattatttctctcttcttccccagcagcatattggacaactaccaacctgggtggtttatctttcagtgtcatatctttttgccttttcacacgttcatgtgattctcagggcaagaataccaaaactgtttgccattcccttctccagcagaccacattttgtcaggccctgactagtagggacatgcccttcagtcactctacgtagctggatgacatgcccagtgccctgattgtcctactgctggtcctcattgagtgtataaaccttcaccagctgttggatattggtcaacatgctgcccgggggccaaggcagaggccctgctggagtcacagagaagggaatccagggaaggctggagctgatgttggagtatgcccatgagcagagggcacccagcctcttcgctgccattggccaccctggggccaatccgtcacccaggagtgtagggaaacagtttttctactacctcagaaatgtactattctaaggaaagctattctagacaaaatttaaactaataagtgaaaacttggccatgatgtacaaacaataaatccaatcccttgaagtaatctttcaaaagtcaaagatcttgcataataaatgaccagaaatgtttttctgtacttgcaaggcatctatcaacttgattcaaagagtttatatgaaaaatgatccaaaatcagatattgtctgtttttcatcttatgccctatcatgccttaacttctatttcattttgctctgaaacatttcactagaaataattcattctagcagcaactcactcggtaatctctgaatctgtactctatttaggatgtgtaatataaatgaagacaggaacacacccatatgaataaatctgttaattggtttatagatcgacagcccccaagtgtagatcacaaatctgtatgatattcctggacctacttccacattcagattcagaactggatgagagatgggtgtaattacgtggagccagatggctctcttgtgactacacatttacagaagcttttgcaggttgtttattccaacaaaatttggaataactcaacctcacatgaggtttttctgattttttaactgaaaaacagaggaagtactttgtttacttaaaataagacatccttgagcacagaacatgtatatttatagctatttcacatcaaatgctttctggaaaatgttaagttggactatacttttgtgcactgatttttctcatttttgatgatcattgcttagcacttgtgaatttatgctatgcaattaaactgaaatactgattattaagtgggatcaaattatacagtttttgaatgtgtagttaaacacaacagtcaacaagacttacacaatggttaagtcttaaatacatttgctattgaaatatataatgaagactcaaaataatctaaattgtctacaatttattctgaaatatattttctttggtgggagtttggagttaaatttcatttttctggttatttttggattatacttatcatttaaccataatcattatttttcattacatatgtagtaagggttcccttag

SEQ ID NO: 33756 - DNA, 1072 bp, Bovine  19866880619500
ctaaggtttttattctaatcttttgtatttaatgacacacactcgcagtcttgatttcctgtaggttttctgtataactcaacaggtgcaggatctgcatagtttgttccaattctaatgtagaatgggcacagcatggaggtgaggttttatttagaataaattttaccatcaaagagtctaattgaacagtccttatgctggcagaaatttttataaacgtgcaaggttttattatgatacagttgtatgtttgttctttgtcctttctgatttaacttgttaaaatgtcttagatttggactagttatactagatttaagtaaaatttttcattcctgagtgtgtgagcatgaacctgtgtgtttgtttatgtgctgcctatatgcactcaacccataaatgagactgggttttctagggacctaataaaattgggggcaagagcatacaaaaaagtaacaatcatgcaagagattgcatggttggaacattttgaggagtccaaaggaaaacaattctgtgtcttgaaatggataaggaagatcaatgaaaacggtaggctcctgtgtattgaactgaaaatgaaagttggaagacaaactctttctctcatgctagagctcagtcatgtctgattctatgtgaccctatagactatagcctgccaggcccctctgtccatggaatttttcagtcaagaatactggagttggttgcaatttccttctcaagggcatcttctgacccaggaatcaaacccaagtctcctgcattggcaggtggatttttttttaccagtgagccatctgggaagccccggaaagcaaagatgagcacaaatagatcccaggtagagaagaaatagaccaaagaagccatgggatgaatttacatgtcatctccatgtgccagcaaatagttttccatgagtgtcaaataactgaaggtcttcaagctctaagtcaactgatcctgatgctcctacctgcaacttatacacacaatttggtgacagaggaaaaaaattacttgtagagtgcacagcataggcaattatgtcagagaaact

SEQ ID NO: 33757 - DNA, 2079 bp, Bovine  19866880631073
ggatggaggagcctggtaggctgcagtccatggggttgcgaagactcggacacgaccgagcgacttcactttcactttccactttcatgcattggagaaggcaatggcaacccactccagtgttcttgcctggagaatcccagggacgggggagcctggtaggctgcagtccatggaatcgcacagagtcggacatgactgaagcgacttagcagcagcagcagcatatgtttatataagggatacatacagaaactatgctatataaggacattaattttaagtgtggtttttcatacagagtcagtcttcaggatctgtagaaaatgcacacatacatgtatccagtagatcttgggagatcatgcacacactgaccctgtgctatgatctgatattttcacattactcactctcttagccttagttgagaggaaacagattttaaaagatggaaacttatgtctgtttcagaaaccaaaattcagtttcagattatacaactatgcatttatagtgaacccaactcagcatgttaatcagggaaagaagaggaataaaatctagagcaaatgtactagtgagaaggacaaactggagtagcgtcctgaattaggaaaccctagtctaaataatagaagttgattcctggagatggagagatcaactgaggagagcaattaccccgtaccaagtagtagtattctgagattgaaataggagagttgatctagcattctatagaaacttaaacagtaattgaattgaaaaactttggtgtttatatctacttattatgtacacacatccaaatgacacagacacattaaaaaaaatggagaaatcatcatttgacttttgtaagcagagggtcaacctcacgcatagagttagacaaattctacagccttttggaaatttcatcttatcaagcagtaccatttctttgtcttcatctttgagaaatttatatctctcctagggtttgtattaccttgagatattttttatgggaaacatcagtgcagttctgtatctgaagaaaatgtgaaggtgctcattttttctaagatagtaatgttcttaactagcaccagtttgctggcaatgtgagcgatgtctagaaaacatacttcttccctcatggattctttggtttggtttcgtttttctgtcagccattaaaaaaattaaaaaaaatgtttaaatcctgatgattaaaataagaagcattttattgcatttgtctaaaatgatacaattatacacgtatgctattaacaaaaatctaaatttttctggtcagcaatcatgaattttcaggtattaactaccactggtacagaatcaaatataagtagtgggttttttgctaaacatctgttatcttactagaaaattttctacaaatagagttactttttgaaaccaaggaaaaaagtatagcattataaagataattttaactccaaattaacctttgtcaataaatgaaccaaagtttgttacccaaatgtttacatttatttcattgtgataaaacagtataacaataattataattaaaaaaagaagaaaaatattcaccatttcattactttaacacaactcaggattatactctaatctctgtccataactgtcctttattttcaaatactaaagatgtatatatttaatgacaaaattttcatatatattatttagaaggaaatgtggaaatgttcattatttagccagtttggtaaattttatgttaatagttgtttaatcatttcctttccattcttagtgaaaagatgcaatgcccttagaaaattataaatactgcccaagttgccttgcaagtgccacattttgcttctaaaatccagtctggattctgtattgacactggcaagcagctttaataaacattatctcccaggcagctgcaacttccacttcagttttagtcacagcagctctcctgattagccccccgcaggagctgccacaaggctcaacccaaatctgctcttcagagtcacagacatgcagaacacaaggccacggttatcaaaattcataaacgcaacg

SEQ ID NO: 33758 - DNA, 896 bp, Bovine  19866880714670
tgagatttatcatactgaatttctgaatactgaagacaaagaaatcttgaaaagcagttacagagaaactgagaagttatttacagggaaataccaattcaaatagcagtggacttcttgtgtgtgacattatggaggccagaaggaacagacctaaaaattttcaagcactgaaagaagaattatcaatagtgaattctatattaaatgtaactatccttcaggaatgaatagggaataaagacattttcagaagaaggaaaactaagagaagggtcctggttatttgtctctacctctgcccatcaaaatagaattcacagtgaaaataagacacagtgaatattcagacttttaaaattattaatactatgttagtaaaaaggaaggaacttaaaaaaagaaaaatccagttatgggtagctaagctttgcaaacaggtaaagataacatgggatgggcagctatgtgtcagagtgcagaaaatccaggataaccatggaatattcttctgaagtatcaatttcaatcagtgaaactaatttgaaacctccattatgtaattttcatggtagatcaattacttccacagagttagtggttcatgggctatgatgcataatattaatattacaaagttcaggtaactcctcaagggttgctcttatatggaaatggaatttataaattaactgtaattctgtccactgaaaaaatatttttattcagttcttaattagttatgagtcatgcacctctttcaagagacatcagctaaataactgatactcagaattaaaaattatggcactgtttcaataagaaaatattaaataatgtctctcgggaaattagataccattctgaactataataattgcttgctatttctttaa

SEQ ID NO: 33759 - DNA, 1730 bp, Bovine  19866880718702
ccaactttgacctattccggtgatataaactgaacaagtattacattttaatcagaaaaatactcagatcttagatattttttaaatcatttttatttaataaaaggaggaaattaacagccataaatattttacagttggagatattttaatgattatcaagccaattagcacaatttaatggtttatttacattagaaaagacataaataagtattttaaagttattgacctatccttttttgattaagcatgcaattatttctcaaataaatgaagatatgtcaggattgtaacacagaaggaaaatgaaataattatcgccccagcacgaaattatttcaaatgatgcttttagagttagaaagtagttctaagtgtatttcaaagttttgttacaaaatatcataaacaaggaaataatggtcaaaagcactgcctgtactgtgctttctttgtatattttaatgtgcttagaatgaaaactatttctgtttagctgatcaaagctgtttgggatttcttattaagatggcagagcttcacctgtgaatttttatagaagcctggggaaacgctcagcaggatctaactttttgttgtgggtaaaaaacattttctatctatggtgaaagtttgctctttatttggcagacagaatcccctggtgaggtgagctttagtagaaaaaaatacaataaaacatacatcttgagaatggaagacttcaaagtgaggaatgcacaattgaccatttatgcattatctgtgttatcaaaaataatgttctgcttttgaaatagatgatagacccttaaaagcatagctgttatatgaagcatttagctttgtttttactttaaaggaggatttatggatcttatacaatgttaaattcaaaactcctggttgcattcttcccactctattgtttaatgtgtatacagtattagccactatacaatccgatcatatatgtttggtacgataaaatttaagacatataaaagttcacaaacaagttaccaaagagatgctttcagattcaatggtggggttttttcggttttattttcaaaataaatgttttaaaaatgaatatattgtcagatgcttaaagaagtatgcgtactatagtcatggatgaatatatcccctctaattcatatgttgaagtcctaaccctcactacctcagaagaagtgaagtgaagtgaagtcgctcagttgtgtctgactctttgcgaccccatggactgtgtagcctaccaggctcctctgtccttgggattttccaggcaatagtactggagtggattgccatttccttctccagtggatcttcctgacccagggatagaacccaggtctcccgcgatgcagacagacgctttaccgtctgagccaccagcgaagtccaatctgatcttatttggaaacaaggtcattgcagatgtatttagtcaagatgaggtcgtagcagagtaaagggatgtcctaaccctacataactgatgtccttacaaaaaagggagatttggatacacaggcagggaggttactaggtgaaggctgaaattatgctgctataagccaagagagattgcagatagacatgcaaaagattcttccctaatgacttctggaggaagtatgcctctgctgacaacttgatctcagatggctagccttcagaacagtgaaacaatagatttatgagtttaagtcatt

SEQ ID NO: 33760 - DNA, 1659 bp, Bovine  19866880786749
ccatttagcttaattttattaatgaggattacattttctggaggtttttttttttttttccccctgttgctacagttgtgctaaatcagaagttattaaattacagggaatgaatggactgagaatattactgtgattctttagaaggacataccaaaagtggcagggtcgaataagttttactacaaccttttcattaaaactgatcattattcatttggaaatctgtaatactatgatctgttctcagcagtcattagtatagatttgtgaaggtcattttataatgtattatcaacttacattatatcttcagatgtgaagggagacataaaaaggaaaagaataatcacaattttcctagtgtgtcagagccatttttatttcaatattaggtcctgttttacagtgcctcttcagtcttaactctgagatgtccaatttggcttttaatcagggaaattttgcaatatataatttctcacataaatacttggtcattatactgagaaacagtataaaggatatatgctatataatctccttggggatattttaatatccattcttcctgtcagtaagatgttacagaaaagccaaagaaacatttttgtcaaccccaatacttagacagacatctaggttaagctctgctaaaacagtttctcttcatgagaggcttctttctctctctttttaagcaaaaaataatctatttgttagcaaatatgaaaaataaaatgtttccaggactgctaacttaaggtatgactggatccaggtgtccagataaatttctagtttttaattttctctagcacttgtctctactctctatgttcatttcattctttttcttcacatgaaaaataaaaatggctgcaggcagctcctacctcacattctgtaagcccagggaaaataattttcctttctttttttttttttctgaagtataattgacttacaatattgtgttattttcaggtgtacattatagtgattcaatatttgtatacattataaaaggatcaccaaaattagtcactgtctctgtcaattaaattataatattattgaatatatcccctacaagatacattgcatccccttgacatttgttttgtcatggaagtttgaactttttaatctccctcacctgtttcgctcattctctcacccctgtccctctggcaaccatcagtttgttctttgtatctatgaagagacttcactcttgtttctaatactaagtaacatctatataatacataagcagattcaatgagtgctgagaaaataaagtcattctttcaagaaaatgtagaattagagggtaggtttgtgttgtgttggatttttactatttaaaagaactgaagttgttgtaatctgagtgaaaagaacaagctgagttgtagaagttgatattactaacatacagtcaagtctgctaaaggtgggggggctgttaccagagaaacggagagttgaagaagactctccattggatctccattcttggtaaggacacaaagaagaatctgaggtcttactcatggcaaaacaagtttattaagtaaagaacagaaagaacacctcaagggagaggagagccaagccaaaagaggcattggccctgaagtagtgaggtactgg

SEQ ID NO: 33761 - DNA, 914 bp, Bovine  19866880797488
ttaacatatttcaaaacaattttaagtaatctcatggaacatatgcccacttaaaggcattcctatattttctttccttaacttgttccatagggaaaaattaccacacataatgccttgctggttcattaaaatgtgattattttgttaccaataagtaacatttgatggtttgcttatgctatttgtaagtaagttaataacagtgacagaacaagaagctgtagcaatatagcgtcttctaaaaaccatgtctggaaaaccaagcttcaagtctgagaaaactaccaaccaaggacaaattaataaatatatattcacctaaaatatttatataattggcatgtacttatacaaaaggactaattgataataattttataaagagattttatttctataataattccttcagaagcaagcatttatcagtgatgaactgtcagtaatatctgttcacattcaaagtggcttcaagggatacctggttaacagctagatggccctagcaaaaatcaaatcaaaatatgcagacagaacacaaatgtttctttaaaatagaaaataaaatataatgctgcctaataaaaaataaataaagatacttttgtaaaaataaatgaatgttatcctccccacaaaataggtgataattatcacctgtccttttccagtctctagaagaaaaagaaaaagtgttctcaaatacaactagaaatcagtaaagcctaattttccttaatttatatgcattaggaatactctgagaattctctgcatctcagctataaccctcaacaggatttaaacatgtacatatttacataaatctaaatagcattaggatggccagttaagaatagtttgaatatatggggtggtaaatttgcatataaaacataggaaaaaacaca

SEQ ID NO: 33762 - DNA, 2170 bp, Bovine  19866880800866
attgaagcctagcatcattctttccatgaatattcagggttgatttctttaggattgactgatttgatctccttgcagtccaagggactgtcaagtcttctccaacaccacagttcaaaagtatcaattcttcagtgctcagctttctttatggtccaactctcacatccatatgtgactacattgaccatacagaccttttatagtaaaatttgaaaattttactataaaattttcctgtagtaaataagaacctaagttgaaattatttatttatagtactcacttgtgaggatcttttaagagacatacagtcttatattcatttttaggatatctaattgtattcagttttaggcatgtattttagtcaagaacatgtattttaggatatgtatctaggcatgtattttaggatatgtaaatgtattcacattgtcatgctgagatggaccacgaaactgctttatttcctcaacttctcttagttcatgtatggtttttcagagatagtaagaaatatcaactcctattgcatacaaagaaaatggaaattcccaatatctgtagctatcaatttattttttctctctctgcttattttaactggcatttttaaatgtcaaatttcaaaactacacaggcagtaagatttttaaagttatttttgcgtgcaatatgcaatttccttatttttcttcaaattatacattcttcgccttggtgaaattataactttttgacagtcttatagttcctatttatgtcatgcttacatttacctgtgacagccaatagtccagtgacactaatacagatttccacaaaagattatgcatttatataatgctactcttagtggtgaacaatatgatttggcaattattataagactttgtatcttatagcaatggcctcactcagtttatcaacagattgtaacacaaagtaactgtataaaattttcatttctatgtgactatcaggagaaaataccaatacttggcaaaaattaactttgctttatcttccttgtataacacacatgatgtttcactgaaactttttatcttttgcagtttgtgaatacatggtttgatactcattataaatatatcttttctgaacatttcaacacctgggggtgaattatgataattaagtactatatcgttatgttcttacttttccttttcagcccctactgtgaaaattcaatttccagatgcttttgatgtttccagtttaaaggtgtgaaaagatctgccttttctaagctctcaggtttgtcatattggagattcattttatagtattctttcagtagtttcttatttctctaaccaaaataggacatgtatttttcaggggaaataatagattctttggcagggtggatttcattgaatggattttaatatttcaagttattctaaacagtacttttaagaagacaagaatatgaagtatagttaaaataacatttaatttgttgtctgaagacgtaataaatctcagctgtgtaatctgagtgactcattaataatgttgtcacattatttgatcatatggatacaaccctttcttggtagaaatgcagtgtacattaaatgagataactaatataatgtattatataaaccctacaatgctgtacaaggaattaaggtagtgttgctgttgttgcattgatcttgatttcctttacatatatattcctaggtttgatcctggatgtagaaaaatactatatagggtattttattgttgcaaaatggataaaggtaattatttgtagaggatcatagaaagacaaagaacatgattttaaaattaacttagaggggttagctaatttcctttattccttcctaactgacaggtcaaatttgttggtaaaatatttaataatcatgtatgctgctgctactgctaagtcgcttcagttgtgtccgactctgtgcaaccccatggactgcagcccaccaggctcctctgtccatgggattttccaggcaagagtactggagtggggtgccatcgccttctccgaatcatgtatatgtttgtgtatatatatgtgtgtgtgtgtgtgcatgtgtgtgtgtaatttttttccttgagtgtttatctgaatcttctaaaaagtcctttgcaaattattttgata

SEQ ID NO: 33763 - DNA, 1997 bp, Bovine  19866880844973
taaaagagtacatgaatgtccagtttaggtaattaattcatcacgtagtatgactaaaagtgaaagtgatcttattcacaatagcgattctgtgtatgaacatgaatatcatatgtatacacatgtgctttcacacatactacttttcacacacacacacacaaacacacatgtgcacacatacaacacaaaatatagtcttacccaagattttcagggtcaaaaactcgattcaggtcacagtcaatatatctggtgcacttcttcactgctcttgggttggtaataaatggttttacctccagccctgttctttgaatctcagtgctgttctccagccagtgcttaactagaaatactcctgttagttcattcccatgagttcctccaaagatagccaccttttttatagggtcttcagcaacatgacaagaagtcatttttgtgaagtaggtttatctgatttcggcaattcagaagagaggagatcaaagaaaacttaatttcttaggcaaagtttagaaacttaaatctaaatgagactttaacctaagtgcaaagtacagacttctcttgagtggagtatattttaattttctgttacaagttctgagctgtgtttattatagggatactcccttctttagccctgccctttaccatatttgggttaaaatatgcagagatcaactagagatgcagctgtttactttaacttctaactccctcaaatggtcggtagacctaaatgcaataataagttagcatctcacacttaagcgaaacttctgctttctctttagccagaatgttttctaacagtgttttcatgattatttgtggtagtaaaaatagattacacttttcttatcctcaaaaatataaaataaaagactggcctatagtatgcatcttattattcaatatttatatttctgcttaaaaccatttcttctctgaaatgagttcaggccctatttatcttctgagggcatctgaatttcagctctataaacagccaacggcagatcctcagagaactcctctggaaccactatcctttcttttttttattttcagtacattaaatttattcataaaaaatccttaaaaatgtacactttttcctttttaacctagtaaaacacaaaaccctcaattgaactggcatttataattcaaaatcaaattagcagaatattaaatacttaagaatcttttaaaaatataaagttacatgcaattttgtagaactgacataaaagaatggatcaaaaatgggagaatattccttcattcctaaaaagaaactacatccagtagaagctgtgaagatgcttgggtacacactttcttcagttgcactaccaaagcctgtctttgtgtatctaagaactttgtgcatgtgaacggcttcttacaacagcacgatggactggctggcgctcccctccctccaattacagtgtagtattataacactgacctttggcctccaaccagcatagtacatagtttttgagtgttgattaaagatacttactttgatttagaacctcaggacttttcagtaagtgagcctcttcagaacccatgactgtaaatgtcacctgcctcatttttggggcatcatctgtgctttggaaagtacggccaacccactcaggtgccacaggcccatccgctggatgagtggtcaagctgagcagggtcatggtttcccttacaacatttaagacacttcaacacatcagctatcagtgtgtagaactagtaaggcatcaaataagccaccacaaaagtaggaagagtgataatgacagggagtgaggagtgtgcaatcacagtgcctacttggcaagtgctcactggcaacactggagtgagtggacagatgcaagccttggtcagcctgtgctcagactggaacttgttaccaccatataactttaggcaaagttaccaccggctctgcacctccatacacagtgtgcagt

SEQ ID NO: 33764 - DNA, 2577 bp, Bovine  19866881197673
tttatagaggtaataaaatcttagaacaaagttgaaggaaacatcttaaaagttaaataacatttttgaaaaatacatagcttccagaaaattctaaaaaattattttcaaaatttttgtctcaagataatatacagataccttgcacatacaaataatttaaatattttactcaaatacatgcatttacatttattaagtaattaatgaaaactaattgaaggtatttttcaaaaacttcattctataataggacagagtaggagatattgctacagttctagcttaaaacatcagtcaatttgttagacatatccatcactttttagagctttataatactagagtgccttggaccacaaggagataaaaccagtcaattctaaaggaaatcaaccctgaatattcattggaaggactgatgctgaagctgaagcaccaatattttggctacctgatgtcaagagccaactcattggaaaagaccctgattctgggaaagattgagggcaggaggagatgagggtgacagagatgagatgggtggatggtatcactggattcagtggacatgagtttgagcaaactctgggagatactgaaggacagggaagcctggcatactgcagtccatggggtctcaaagagttggacataacttagcaaacaagcaacatcaactgagaaacagccttatcattcactagtgtttagcagatactacataaaatatagtattgccttatatgatgaaagcatctgttttcccctaaattccaatgagaaaatgatatttcaaaccttagcatttcagccatcactgcaggtaaggcagaataaccttacaataggatgatgagattagatatttcagagattaccaagtgaaactgaaggccagtaatccacagaataacatgcaggaaagcacagagaaaaaaattctggttatttcttatgaaggaattacataacttcttcttattctgggtatttcatttgattgaggatttcagatttacttttaggtgttttctaagcctgatatacaattattatatggttgtgatttaaccaatattaccctctcctcagcttaacattactttcgccaaacaaaattttatgatctcaaacaacttggtcagttccattccatacacacttctactgtattggagctactcacattaaaaaggtgtcacaccacagtgtagttttatgttaattttgaagtatacaatgaagtccttgaagtcaaagagcaagtcttggaaatacattgtttatataccttgctttaccagagatttattttttaactggtctgttcaacatcctttatataaaaactggttccagtatggatgataaattatgtggcccctccacttataaattctatatgcctaacaaccaccaggcagcacggtaaatgtgatcactcaatgattcatggaattaataaattaataaaaaaggaagtcaatgaatgaactgactccagttatccttaattttgtttttttagaagatattttggagtatacttttttaaaaacttgatcaatcactttgcatccacaacagaaaagaaaggagtaacagactaaactacattgtgttagaatgtgctaacattttcatatattacttgtgagaaaactacttctgcaatttatatggaaagttgtatatttttctgtttacttgtttctctgcctttctttcttctttctccctctctgtctctctttgattctttttagtggcttgttctttttcataattcttcatggtatcagtgcagacaggacttaaaagatctctatgcaatgcttctgttaagtataaaaatatttcatttatagctttcagtacttcttatctatttctttttgaaaaatttaatcatgaattatacataccagtacagcatgaaatattcaagtcatgttcttacatttcagttcagcctacaaaacaaagaaagactagtttaaacatagaaaagagagggtcttgtatagcaatatgacagtacaatttaatagcattattcccatagcagagcccagatgaaaagtctagcataaatagatttcataactcagtacaactcatatatgtcagtcagttaactgaaacagagacacggctttaagcatttaaaattacaagtaattttcaaaagccagagagaaacagtcttactgcaaaagtgaattattatacaaagccacaattaggcttattttatgaaacttgggaaattcatatagttttaggccaatgactgttttttgaatagtaacagaagatgcttctatcaatttgaataaataattgattgattgttaagtttgattctttacaattagaagtttcctatatttttctaaatctgaaaagagtaaagtcttctccatttactgaagaattctgttatatccatccaagaagtgtgagtgggctgagacctgacagtgggtcccagttactgttggcaagctcttccttagggaaaattcaatgcaattgcattttatttaggaaactgcttctcagaccaccaat

SEQ ID NO: 33765 - DNA, 1431 bp, Bovine  19866881348699
tcatgtagaagagttaaaaaaggaaaatgaatatcattctgtaccagaaaatatccatataatttttatatttcatgtgtattgaaattaccttctgaattttgaaatcacaatagcattcaaatactgtctgtgctttgagtgagtacaatactactaatattattgtagcctgtctttccactaataaatatccaattttaaatcatcactagtttagaaatagtataatgaataccaaccctatatgcctgtatatcctatactggcattctctacaatcagttcacagccctctacacaaaattattatgatttctgcaaagatactaacattacaagactatagtaaaatttcgctcacgtcttctttgaaatattgtcccaaagcatttctcatcagaaggagagagtttacagggataaataaaattgctttgaaatttagcttagatattttcatactgtagcttcttttttaaaacagcatacctttgggtatttagtaattccctgaattcatttcagttaaggagtaatgacaaagtaagtcaagctatggtgagacaacaatcaagatgaatgcttaaatgcaatttcctgagcttaagtcaattctcattaaagttgcagacactacacatataatattatatgtagaaaatttttatcaataacctaatgaaatatctattttagaataagttatatattgatataactacagatcaactttaatataatatataaatatatttttcatgagagagttatatgtattgaaatggtggaaccctatctgaattgttttttccttcagtacaactgaataaccagtttgtttaaaaaataattacaaattaactttaaaattaattccaattaatttggactcctaaagatagtgaaatggtcaatgtttaaaaattcaacacaaatcataccctattttctaacatcaaatatttcaatattatttaaatatctcgggccatttctgagggaatagaaaaactctggatccattttgacaatgtaaaaatcttactgaacattttttatttgatttcacctaaaattagacaaaattcaaaattataaaagttatgaacaaaagaacatacaggcactttcaaaaatcaaaaaaagaaataaaaatcagaattgcaaatggtatagcttcaaatagatacatcaaaattaggtataatttatagatctcttctgtctagcttttttcctgtggttagagaggagtgaggggaacaaaataatacaagtggagagttgagaatggaaatacattccttctgttgatgccagtacagggatttaacaggtcagtcaacagtggagagttatcagttttgctgcagaaattagacaacagatgttccataaattccagcactatagcaacaggggtgttaa

SEQ ID NO: 33766 - DNA, 1560 bp, Bovine  19866880379341
tccttggtgaaggcagaccccaccttgccctggccctcctgctactcttccttgcagttggcaaaaagaactccgggacagcacagtggcagagactggtcttctggagtcagacattcgtagatcaggatcacatctccacaacgagctggcttcacctttctgagcttcaggtctctcatccatgaaactgtggcaatggtgcccacttctcaagcttgatgtgaggattaaatgcagtaatcccaatcactgaggacataggaggtactcaataaatgatggcccttgctgtggtatttattatctgctctgattcttggagatggaagttttaaaagcacagaatgtggcaggcaacccctccccaagcatttggattgaacaaagagaaacgtgatcattttctggaagaacatccaggccagactatcaccacgcctggggcactgtaattcgtcaactgtctggactatgatgaaacacttaaaagaaaagatggctcagagctggaagtcagtggagcaaggcagggaaacttcacagttgggcagagaagggggaactctgaccatcaggaactgggtggcagtcagccatctgcccttctggggtttaaactcctatggaaaatgctggtcatttcataaagccatgggtggtcagatagcactgaatcccacccctcagcacagactccaggatccaggcgcccttgccaaggacacatagagggttgggggttatgctggcattagagcccggtgctcgggacactcgagtctactgctttgagctttgagggaatcatgactaatggtgttgcatttgccatgacagatgatacttctctagatttatttgtttatttgaactaaagtatcctttctgcagtcatcaggcagaactgtggaggaggctgggtctgtcctcagcctccctctgcagccttgccagtcctcctcccttctccccagaaaggagaactccgaggccgccccaccccagcccctcaccttgtttccatcatggggtccccacactctgtcatgtgatgggttgttgacttactttccacccagcttcccccactggactgtacacacccagaaggcaggaacaatggctgacatacccaggactatggtcccagtgcctcggaacagtggttggcacatagtaggtgctcaataaatatttgttccgtggatcagccaacaaactcacttatgctgaggtgacagggcctcatcatgcttcctccagtggtaggatataaaatttaagaacagatctttaggggaggaaggagcaagaccaggaggaggggactagggtgtgctgagcacttgctaaggcctgggcactgaactcggaaattagtacatgttattcatgatgatgactaaacatggtaggtcctcttgaccggttaagcctcacccaaagccacgagtctctgctgaagaaattcaggcatgggagaaagaaaaaagatttttcaatctgaaaatggaatcttcctggtgccccctgtaggctacctggcctgcccataga

SEQ ID NO: 33767 - DNA, 2492 bp, Bovine  19866880622354
tgaacccgcctctcttgcctctcctacattggcaggtggagtcttcaccacttgcgacacctgggaagtcccacctataatacagggttgtgaaatccacccaccaggtaacggtctgcattaatccgagacctgaaagtggtgaacgtagcatgtagcacacagaagatgatcaaggcatgtaaacttgaaatctcattgtcctctcaagcaaaacagccacccaagtggtccccatctttagaggatcaatttagtttcaacattcatttcatttcatgcatcacataattatcaagcaccttctctgtatattatatcagtggtacctgctgcagagatggggtggtttgatttgtagccctcagttacagagacagacaagacaggacctcagtgtctagagggggtaacggatgtgagtccagtagtgacacaattagttatctaatgaagatcaggtttaggaaaaggaaggggctatggtgctggagaagactcttgagagtcccttggactgcaaggagatcaaaccagttaatcctaaaggaaataaatcctgaatattcattggaaggactgatgctgaagctccaatactttggccacctgatgcgaagaacctgactcattggaaaagaccctgatgctgggaaagatagaggggaggaggaagatggggagacagaggatgagatggttgggtggcatcatcgactcaatggacacgaatttgaacaaactctgggagacagtgaaggacagggaagtctggcgtgctgcagtccatggggttacaaagagctggacacgacttagcgactgaacaacaaccacaagggaaggaaaagtctgtcttccctaaccagctcaacccaccaatatcaccttcctgtgcattccctatttactgtctggtcttgtttaaatgcttctaaagtgtcagagccatttcctagagctggctgttgccaaggacctgggatcttaggctgcctctgccctacttccacgctgtccaaacatgtggaatccaggatgaaatacgttctcagatcagcatttctctcctgggaatggcaactgggagatgtcacagacttaaagaagctgccttccaatttggaattccacagtacttagttgttaagaggcgatggctactggagggtggatagagagcagggctgggtagggggcttggtgtctgaaaacatggtcactgcatgtaatttttaaaaatcaattcctggggtgtgaattcttcctgagaaacaggtcttttcaacaccagcactaatttgtgctaaggaaaattagtttcattcttttgtcttcaagttcatcggatggcaatcccaaatgaatgtgcccatgggggtgggcgttggaaatgcagggcgcaggtttcagatagcaagtgtgagttacagagaagagaaaccccttcttgatgtagtgacagcatcatttgggtgggcatttccctggggttcctggctaacgtgggtgactcttgcctgttgccagcaaggcaggtgatttgcttgatggattgggactcatatttccaaatgtcacgtagagtcacagggcctcttgactgatgggggttggggttgggggtcccatgaaacttagcagatagccccacgtggcccccagtctcaagcccaccactgttctctatggcccttggagtaaagtcctaagtctatgacatcccagtatggggacagggtcctctgcttgtttaatttcctggatctcagcagacagtacaggctaatggatccttgagtgatggatggatggagtgcatgactcttcaggaaatgtgcctctgctgatcttgccagccccccagtaccacaccatcagccacctggcacttcattcagtcctttgactgtgctgtgctctgagactctcacctcttttagggcatgctcacctcttgaaggcaacacaggcatcccctgaagagcccaaaggcctgggggactcctagtgactcttgcaaggccagagggggcctcccctcctcccccaagcccaccctcaccattgagcaaggagagatgccctttctctgagctggtggggtctgcttgtctgtgaccgcctctggaccatgaccatagatggatgcaggaatgaaggaacagggcctggagctggggccctaaccctgcagccctgacctgggcattttcatccagactggaggcatgaatggatggatggacggaggggtgggagagacttacgtattccttggacgggtcaccgatgctgccgttggtggtcgggggcgcggtctcggctccctcaggcttctcctgctgcttcccctcctccttgggcaagccgccctgcccggggagggccacctcgcccacacctagggcctcactcttatattgcttcacaaactcttccatcactttcagctcgttctccaaaagtccgcggcagcgagaggggtcctg

SEQ ID NO: 33768 - DNA, 1402 bp, Bovine  19866880714711
caatgaataataaaaatgctgctccagatgcccaaacatctactccctctgatgcccaaactggaagctttgcccatgctgacagattagttagggacagaaagagctgttcatttaatggtaccactgtggagtctcagcacatcaaaggatgctaagagaaatagacagtcagcagaaggaataggtgaggattgtgaatataaacgctgtcgattttttttttcaggttcaagttttatcttgacttagcagccatcatgattaagcaaacatttttaagttcaactcatcttgagtgaaaccagctgccgtcattaggcaaacattagatttgggacatctgtcaatacaaaaatcatttgctctattgattgccacaccaatgtagaacaaagtctggaccgcctgagtctatcagaatcagcttgtttcatcctcacctcgagggctccctccccttcaaataccctgtccaccagacaaaatcctcagttcctgtgggtctctttccttctccccaaggactattatggtccagaaatgtagacctcacaccctttacttcagaaagtgttagtcgcttgggttgtgtccaactctttgcaaccccacagactataacctaccaggctcctctgtccgtgggattctccaggcaagaatactggagtggatagccatttccctctccaggggatctatgcaacccagggatcgaacctgggtctcctgcattacaggcagattgtttaccatctgagccaccaggaaagtccacttacttcagaagaggactctaactccagctggctcagttgtctttcttaaggggacaaacctagtgaacaccctcctggctattgaccagtgcagtgttacagctgttccatggactatttcaaggtcaaacactctcagtatctgaactgtaaccatgtgttgcctttgctcccactcctcgaagattatcccagaactgttctgcaaaggaaaattcctagacagaagctggcatcatgctttgcgttttcaaccccagccttcaatctagagttttgcaatcaagacttaagaggcttcctgggcaatgaggttagtgctgacgacaatgctcgtgggatcagctggcagagtggattctgcttgttcggtgcagactctcctagttacgggtctagatcccaaggaacactcctcaaagctgtggtatgattttcatgctacagaggaaccagatgtatagtattgggctgtggaaatctgacctccagccatttacagggaatttctgtcaactttgtaagagtctgcttcaactgaaaatggctacaaattctttactactccttccatcaagaggtgggtccactactatgctaagtaagacaagtcagagaaa

SEQ ID NO: 33769 - DNA, 1187 bp, Bovine  19866880723610
gcaggagccaagcactttcaacagctgccatcccactgattccttttcctaaattaggctccctggggcctcacaccggctggagcccagagacaaggaccctacgtgctccagaaagtaactaagtccatgatatcatcagtgacttgtcccaagaacaccgaagccccaggggcagagggccaagttcctcaaattaccattcttgtggcagattttggccttttgtccccatgggctcaagtctctgcaaggcgacacatgccaaacagcgcccgaaatagagctgagtgccgggacacaggctggcacccaggaaggggacacccattcaaggacacgagggaggcggcctctaacagccctgcccacctctccctccactgtcgtctgcagttgttttcttctgaatcagccaagcaaagtcaggggtgggagacgctcctccccaccaataggaggggggcaggagacaccctgagcggggcaggactggcgagtcttgggcctctgctcagtctcagttcccccagcagatgagcgagcgctctcaatgcggtaggcatcctgctacagctatccattctaccaatgggaaaggaaaggactaacaagccagcagatactctctcgcgtcgcactggaggcaactggagtccagagacgttcagcaacttggccagggtcacacaaggcctcagtgcaattcttaaacagaagtaggtccacgaggcccagaagcaccaaggaggccttctaccatccaacccaccggctctctcatctctggatcctcttttttcaaggaatcagaatgtgttgggaatcaaaattcctaaatacatagaaaatgtaaaatctctgggtgcctaaaggaggtgggtgggatctgaagagcttggggcttccagagacaaatttagctccttctcaaatttccgtcttgggatgactgtcaatctcgggaagatgagagaagagacggagacaggtaggggcaggagaagcaaagtgaagacactgccaaactgggcacaaagcctcagccaaacaaaccaactctacagaaatctgtgcatcaagtagcaattgcatatagttccatctaacacaccaggaggtatctgtggatgaaataacacaattctaggatttccttccaaattacctagtaggattaacagaag

SEQ ID NO: 33770 - DNA, 2008 bp, Bovine  19866880747511
cagctgtgtgagggaaggacgctttctggtctcactcagtcagtgtcgcatcttcagctcagggctccaccagttatagttctcagctcagtgtttgctgaatgcatgaatgaacagggaaaagagcaagaaactcagagacaaaaattccacttaggacaaacccagtgacgtggaggatgacaccaccatctcgctctgattgctgactcttatcctgtaatcagtcctctacagtcactataggaggcagtgtaataactaaaaggacacagtctggagctaaaagccctgagtttgaatttcaactctgctacttgctggagtgggaccctgcatgaagcccttgactgtcctaaatctctattttctcccacaggtataattagaattattaagaaataattagaatcatatcatggttgtcttgaagatcaagtaagatgacagttgtcagtctaagagttccagtgatatttatcagaccaagacattcttgaaggggaagcattcttttatttacgtgggtgtcctaagcacctagaacaaggactggtttaaggcagacgccccaaaactacttgatggatgaataaagtttctaaaaatccccagcatcacaaagcaatgaccttggggaaatcagatctttccattgttccaacctggaaaagataccctattttcagataccccattttcctccaaacagaagcaaaaggatcctagccatggagtgaggcttaagatgtaatgggtcggctccggccatatgagcctgaaggtgcccgatctcgtctgatctcggaagatgtaatggatcctatttcctccatcttccagaagaatcccaattataagagtctgtccaggtgtccagacaaaactgactatagatcccctgaaacctttggcttgagagtaggatttaaaaagtcagagtcagcctcttcagctggggacagaacaagttccagaggagcagggagcagctttctgcccatgacaggttctttactaggaaaaaggaaaaaaagacaaggccagagggcttcacagataaagaatccacctgtcaatgcaggagacataagagataggagtttgattcctgagtcgggaagatcccctggtagaaggcatggcaatccactccagtattcttgcctggagaatcccatggacaaaggaacctggtgggctttggtctatagggttgcaaagaatcagacacgactgaagcaacttagcaggtacaaaagacaaggccatccaagcagtagcttttgattcttacattctcagaaacagccacaatatctgcctccttgattgaaactggggccaaggataaaaataaggagaggggaagagggtcttatttggattcgtttttaaagctcataaaagtcaaatttttccatgaaatgataatttttcaagatggggcaaggagtgtggctgggaagagagtgggaaatgacttcactgggcaggcttctgcctagtttgcaaaggataaagcttgcctttgttgttctcctggcttctgttccccgtagctctgaagtataaaggcttctggcagaacatcccagtttcaacaccattgttcctaggatttgccactgaaagggctattcacatggaaacctctcccaggccaggcttccgttggctaccatttacttacaccctggcttaatcatgcagcccacctaggaagtttggacaaaccagaccagggatggcccttcgccatctctcctagtcccaccttgccaactgactgctgattaaaagccagaagccaacctccattcattccactgacatgttctgagcattgctcgtgtgctaggtgtcagagctacaggtaggggcaagtgagacaaacattgacaatagcagaaatccatgaaagaagaaaaagatcattcttcatgttgtaaaagaggagtaataaatagaaagccctttccagaatgtaaaaaggagccacaattag

SEQ ID NO: 33771 - DNA, 2106 bp, Bovine  19866880842100
tggtggtagcgcttggctactgaatgtgactgcactagaggtaccagtgactagctatctagaaagtggtcactgggaagtagctgcccaccatgtttctgggcccctttgcatctcaacagggtcatactcatcacttcctaaccaaaaaaaagaagtgatgacactacttgcagactttaaaagcttacttcctgcatatcctctatcttttcccctttctattggctggatgtcaatgcctgtgggacatcaaaagataggatgatctctgtcagcctggatccctgaatgactcagtggagcagagattctgctctcactctctgcactgccactgcaccatcacagattacatttggcatcactggaaactcaatttctattctattaagccactgagattgagtagttttctattactactgctaggattctgccacctactcataccgcaccttccagttcattcattcattcatttttttatttatgccagcataccatcgagagcccactgttaggctggcatagttccagacaacttggacaccttgggtgaggagggatagaaaataaaaaggtaaacacacaagagagctgacattggaatagcagtccatttgggctgttacaactgaatatcacagactaggtagattacagaaattcattaacaacagaaattcatttctcacattcttggaggggggaagtacaagactgaggtgccaatatggccacatcctgataaaggccttcatccagagctttctcactgtgttctcaaatggtggaaggacaggagctctgcgggatctcttactaagggcaccagtcccattgacgaaagccccaccctcatgatcgaatcaccccccagaggccacacttactaatactatcacctttggaggttaggatttcaacgtatgaatttggtgagacaggggtagggaagggacacaaacattcagaccatatgagaaggaaaaagcaaacatcacctgttagagaataacgaaggaggtgcctatttgatctaagacttgaggacataaagtagcaaaccatgtccatatcatgtatattaataggaaaacagcaaatgcaagctgaaggaagagcatatgcaagggcctggagttacaatatcactagcttattcttggaaccagagacgtgtgagctctaccagctaaaccaggataagaagcataaacccagacagttcctagtgaaccaggaggtatagtccactctaggagaaaaatatgatgaaagattcaaaaggagaggccatttcttttgtgtaagccattctcttacacagctttcaaaccgatgtgttttacacttctgaccttctgaccatcccagccactgggccaaggccaaggactgcttccgtgtagaaccaaagccttgctcgctttgcacagctccacactttggccatggctatctttggttagcactgactgaccccagaagaaagtgttttagtagctgcagcagcaagtacgattttagaacaccactcagaatcatctccttcaatcaatgaaaaaaatgttaatttctaatgtttttaaaactgggaaaagatctattgtcttgaatgtccctaagaatcttggccttagggtttcaagaaaccaataacatgcaaagtgctaagtaattttttaattaaataaataaataaaaggtaatcacgataagcctactatagaattttttttttttttttgtagtaggaaattgttatggttccagtttgggacctggggaccacatttgatatgaactctcctgcccttacatgaaatattgacttaatttctgttatcagttggaatatgttgctgtcttattcactgggaattaccctggctgaaaatatttgctatttttccttcttcagattctcctgtgtcaacagcctgagggataaactgtctgattcagttatagagaaaaatcactgtttttatttgatgcctttttccccccaaggggactagaaaaacattctcattgctattaacttgtttgtaagaaagaaggaggggccatttcactaaaaatctatcacacagtcca

SEQ ID NO: 33772 - DNA, 1471 bp, Bovine  19866880940982
gccttgaggtggattagatctgctttttcttgaagttggaaccaaatgagaagcgagggaggtgaaggcagagggagggcagctggcggcaggggccctctgggggaaggcttggaccctggagccagcctctcctggaaggtctctgctgggggaaattctaaacctcactcagccgcttgctggtaatttgtggctagactcgagcgtgtcagctgaaccagagccaacgtcactgtggtttcctgggtcacaatccctttgcactcgcagaaaacccaagtgcactgttctggccctttcagcacatactacatctgggcttcattgaggatttcacagagttagaagcacaaatccccgctcctccccaaaaagtggccaaaacccaaagacataatgagtgcaaaggatttgctcacccacacatacccctggccacccccaagcaaatccgagaacagggtgagcgctccccaccctcactctgaagatttggtttcagagttctctcccgccctcttttcttttctctcctcccttcaggtgccccttcccatggctcagttccacggctccctctctggccttcagtttcctcaactgtaaaatggaaatggtgacatctatctcccgggataatggatcaaatgaaataatggaaatgaagtgctttataaagtgcaaatcagggtcagtaaactcctgaccctgtagtctacaaactacaacacctgtttttgtgacacccttgaattaagaatggttttgatattttttaatggttgcaaaaaagtcaaagaataagattctaatacccaagaaaattatatgaaatcaaataataaataaagttctattggaacacaactacatccatttatttacatactgtccgtggctgctccagtacaatggcagagttgagtaattgtgagagagacctttagactcacaaagcctaaaatatttactattttgttctctacagaaaaagtttcccaatccctattgtaaaggactgaaaaaataataattcttgttatctctcttatcttctccattacaacttgctctcaggatgaagtctgccacactggaaggagatgaaggatctgcttcaccaatcaatgattattgaaaggaaggttgaatttatgccagtttccaaaggcattttcatttcagtgaaaagtttgagtcctaaaaggaaagcctctcaaatatagtgagatttcaagtaatagttggggaaatagattggagtgagggcttcaactgacagctaagcagccgcctattataatctgcaagtgcatacatccatacaatgactgcatgaggaacactcctacggtggaaaattctagcggcacctcttattaacttcagggtaccttgacttggttaattctaattaaattaaaaatggcttcttgctcgtaaccctacggtcctcaggaatctgcca

SEQ ID NO: 33773 - DNA, 1952 bp, Bovine  19866880948384
acagaggatgagatggctggatggcatcactgactcgatggacatgagtttgggtaaactccaggagttggtgatgaacagggaggcctggcgtgctgcgattcatggggtcgcaaagagtcagacacgactgagcgactgaactgaactgaaccagttactgataagagtctttttatcaccaccagcttttagattagtcttcctgcttcaaacctcacccagctccaatcaaatcttccttacatgtgaatctgttaaagactcttttctgctatgaagtcttcactggcttcccagcacttctagacaaatttgtactcttcagtatgacatttgagattcttcacacccagaccggaatcaagatttatcccctccctcacccctcagacaacatgtgctcaagccactacacaattctcagcattctggctcacagtagtcctctgatacaacttccctacctgaaatgttctgtgtggtaaacaccttaagtggctaaagccacttacttcaggaagtcttccctgatgtccagagtaagccattgcctcccatgggcttctaagacaagttctttgtaagtaactcaaatctgcagtatttgccacacattattacaattacttatttttctgatcagtctgtcgcctaaggctgtgggctccccagaaggcagggacagagccttactggtctgtttatcctagctcttggcaaattttgagatgagttggtgggtgataaatgaatgcacagaccctaccacctgaggactcagagtcttcatccttcatgcggcaggggccttgggtcatggctgggctgaagaaggatgcagggaaactgaccagacacctaaaagaggtgcttgcccgatgctcatgctgtgcttggggtccatggatagcctgaagctgtccctggggacagggcaaagggcagggtgaatatggactccacgtcccttccacatgtatcaaaaggcaaaggagggtgggcaaccccatgagtggcctccttcccatcttaccctcccccagccccaatccacgctgcagtccatcaatccccatccaggggaaaccccagagatgggaaaacctcagccctgctttgggccaccaaaccatagggcaggtgccaactgctccaacgagaatccccaccagagaccaatttcattctaaagcccttccccccacaagctcatctcgtctccacaaggctgagcagagccccgattggtactattatggacccattttacaagtggggatgtggtgcccagagaggcaagttgtatccaagctcacacagccagcaagaagccaagctaggggcgaaaatacaagtaccagggctgcacagcagccgctgactgcggtggcatcaggggatgccaggcccttgactcactcgtgaggcccagctcccacgcagccccctttaaggagtgctgggtcttccagcagggctccagtcttaattttagcttggaggcttgccactggacgcttcagccagcggcaggctgaagttatgcgggacagctgtcagccggcacgctgggtggggcctatttagccagcaggggcacaagtctgggacatttggtgtctgtgccccaggtcttttcagccccgctggccacacggctcccatctcctcccgtgggtcccctggctccacgatgatggccgaggagcacacagacctggaggcccagatcgtcaaggacattcacttcaaggagatcgatctggtgaaccgggaccctaagaacatcaacgaggacatagtgaaggtaggcttgagggcctgccctggtgctgcctgcccaagggtgtgggtttgggtgctagatgggagtgggctctgctccagggccattggcttccctgttcctccctggcttctccaaatacccgctccgaaaccagcttgta

SEQ ID NO: 33774 - DNA, 1230 bp, Bovine  19866880956263
aaatgtgaattccttgactttgttctacttggtgaatttctatgctatctcctgtctgcgccagttggtgaatgatgtacccgacagtgctctataaaaggtgcacttaataaatatatttttccatttattgctttgccctctttctttctcttgagaacagtgaccatatctggaggcttgcagacttcaggtcccttgctgagcttcccttgaatctgcataatctgtctgattgtgacacaggtgcatctgggctgtggcagatgccagggggcagggggtgttggtcagcaggagacctgatcccaatctcttggttcacaggttctctcatttatcagagttctgttggaagatgctctaagacccatacacaaacctcttgtatgatgtagccacacccagcatctaactctggacattatgggagtctagattgtcatcttgaaggaagcttaaggcatatcttttttcaaatggggcatgggagctacctgcagaatcacaaatgggtttgtggtcattcctggtctccactactgaatcacaacctgtgtcttaagcaagaatacctcatgagccagatgcagtgtatgagagtggaatgccacccccttctctggcccgttctcatcatacccctagtacgctgttctgactgctgcttttcagctggggtcacagaaggaatgactcccgtcatagtctggcccttagagaaggagagtgagcttgaaaaattggagtcagggtcaagttaggtcacagtaaatgccaagatggtcaaaaatctctgcataagccaagactccaagtctgaaatggttggcccaacaatgtgagagatgtctgaggggcaggcccttcgagggggtgtaaggggtactcgctttaaacctttcagcaggaggagcctaggctgtgagtccacttgagaatgtgcagggcccttgagcagagagcagtgggctggaaccacagcatgaatgtgactggctgtgcaccttttgacaagtctggcctctggacagtgactttcttgtttgcaaaaagtaagggatgacgatgagtgtttaagaacaaaatataccgatatctgcagcttctttaaaaatgcaaaagaaaggggagattggcagatgaaagatgagtaggaacgtgttgaaggcggagcagtaacacgtgaattctagagcctagagggggtagatagtgttcacagcagac

SEQ ID NO: 33775 - DNA, 2746 bp, Bovine  19866880983244
ctcgatagcctgcctcagaccaggtaccacccccgatccaacttctttggcccagagggaggctgactggtcagttccagtcacataccccaccaggtctgggtcacattactgtctccctttggcgttttccaatgttcctcacagcttccacctaattttttccctggcaggtaggaaccaagtgaccagtctgtgcatttcaatagtttctcctctcttggctgaacaacaaaaatgacttttaagaatcattccaaaccaagagcagggtaggtggttgggaaaagaagttcatgtttaattaacggaaactggctgtcttcaaatgatctcagtggtagaaacctcatttagcctaggtttagaacgggaacactcgggagattattaatgaagtttgcttttcatggccacagtgaaaacagagaggggagcgtaattgatgccatttagttaaaatgtggcaatttaatcactggaagattagttcggaggggagagagtggggacagggccagggcagaaccaacccagcaggcgtgtttaaacagtacacagcctaaagaatcatctgagctggctggctgcttggagatggagttggataaaacacatgactgaacacatgtaggttctatggaactcagaacccacaatcaatgcactaatttcagaagaatttccaaactggagccatcctgcatgagcctctactaggcatcaaacatcatcatgtggccacgtgagaaaagtaagcacgcaccgcgacgtagctttggtggggacagattctttgacccaattttcccactgagggacctgtgcccttactgactgctccccctccagttgcccctcgccatgatctctgagcagctggctcgtacttggtcttcagttgttgtttattcactaagtcgtgtccagttctttgtgaccccatggactgtagccagccaggctcctctgtccatgcgatttcccagggaagaatactgcagtgggttgtcatttcctcctccaggggatcttcctgacccagggatcgaacccacatctcctgcattggcaggaaggttctttaccactgagccaccagggaagtccctggtcttcagacctcaacctaaatgttacttcatcacagaggcctgactacaggaccaatttcccgatgtgatgtgaattctcagcatctcggtagctgatgtgtctgtggtctactggcacattcatagacttctttatggcctagcttaaggatgccccatatgacagagtactctccagttctggttgtcattgtgtggccagtgcctccaccagcaactggcactggtgaaagatgaatcgattatcaccagcatcccttagacattttgcccagacagggaccatagctgactccttgctcctctgcctccacatccctggacaatctcatgaatattggctccccaccttacagctatgggtgcttaggaaaacggttcatttctctgggctgcaatttcttcatctgaacagcaatggtcagaatagcatcaactaacagaattcctgggagggttacatggggtcaagaacacagaaaatgaaaggtccagctccagcatctcactcaactcttttaggattccagcattaatcacatagatctgtggatgtgtgtgtatcgacaggttgtgaattcttcaaggggagaaagatacgcagtttctctttgctttctaaagtcttgcattttgcctcaaacacagtaggtgcttagtaaacgttctgcattctgcaaattaaattggttgccattccaacctgacccaggcattcgaggggcttctgtactccttgatattcagctctccagagaaggcaaatccatatgactcgtgccttgagcaaaacattaagaagaaaggctgccagccatatgaaagtaatcttgccccacattctcacaccagatagaattgttttcagtcaaaagtctagtgtatgtgttctgcccttctaacccctgtttatcagggtgatcgcacagaaggagcaggaagtgacattgggtgggttgtcatctgggcctcatctctctctgaaatggatccatcttcacacccacttctcaagcagaggtctgttacccctcccccctgccaaaattgtccaaaaaacacaagacctaatgtcctagtcttttgctgcgtcaaattgcaaattcttcccttgtctagcctcaagggctctgtcaactttaagatcctgaccacagggtcacagagaagccagacgtgctaacaaaacatgatttgcttccctggtttctggtgtgtttgacaggagccttcaattcccagagtcccccagactctgaaaattcctgtcctggtccctaacttcaccactcaatggggcactgatcatttttccagacccctaaggtggctccagaatctcattccaagttctgactctgctttcctttcatccaacattatgaatatgcttcttttttaaaacatatttttcttggaaagatctgtatgtcctcactatggccttccagatttcactggagcataatatgccccttaaaaagtcaaccgccactgcctggaccgcttcgatgcagacgtgtaacagggaagcaacaagatctgctacgttgttccaagatggtactaggtgttgggggggtgggggtgggtgatggacatgtgatcccagacgtgccatctggaaacca

SEQ ID NO: 33776 - DNA, 1009 bp, Bovine  19866882061864
tcccgggcactggatggcacatgaggggcgttgacaagcttaagaaaacaaagggattgggagcaggcccctgaccttgagtagccgagggctatctcttcatcagcttgctgcttcctggtacactttaacatctaaaagtgaaggctttgtctttttaagttatgatttttttatgtctacctagccttttgagtggagaaggcaatggcaccccactccagtactcttgcctggaaaatcccatggatggaggaacctggtaggctgcagtctgtggggtcgctaagagtcggattgagcgacttccctttcacttttcactttcatgcattggagaaggaaatggcaacccactccagtgttcttgcctggagagtcccagggacgggggagccgggtgggctgccgtctatggggtcacgcagagtcggacacgactgaagcgacttagcagcagcagcagcagcctttggagaaacccaggtcatgggatgcaggccttttcatctccactgtttcctccattaagtataaaaaaaaaatgttggtataaaggcaaatatattaacaccctatagtaaagtattttattcaccctaaatgttaatttttttttcttaaaaaaaaaaaaattaaagcctgttcaaggtcccctgaaagtattgcttcgtgtgcctcatgggtaagtcagctttggagaaatgtacccgatagagggaggggtgactgatcagcctctggttacgatctgatttcctggtggagtagtccgccagcctcaaacacacggtagagcaactcacggggtgtccggtgggaggcgtgagaagatgccccatgtcactcagctgagcctctggcagagctaagctgcctttatgaagtgattgttttgctggttctgaggaattacaaaccttcaaagaccttgttggcaggccgggaaccacttctcctcaaggcatctttaaaatgcaaacctggtctctcagcagacccactgcat

SEQ ID NO: 33777 - DNA, 1954 bp, Bovine  19866880111810
tcatgtatggatgtgagagttggactataaataaagctgagtgctgaagaattgatgcttttgaattctggtgttggagaagactcttgagagtcccttggactgcaaggagatccaaccagtccatcctaaaggagatcagtcctgggtgttcattggaaggactgatgttgaagctgaaactccaatactttggccacctgatgcgaagagctgactcactggaaaagaccctgatgctgggaaagattgagggcaggaggagaaggggacaacagaggatgagatggttggatggcatcaccgactcgatggacatgggtttgggtgaactccagcagttggtgatggacagggaggcctggcgtgctacagttcatggggttgcaaagagttggacatgactgagcgactgaactgaactgaactgaactaatcctcggatttacttctcaaaaacttgtctggattttggatagccaagccatgcttttgagaaaaatgtaacaataaccaatattttcaaagaggattctggatggtactggccagatctgcggctggaccccttgctggtgagcctcactttttgggaagtggcaggcacgcaccatagtgcaggaagcttcatcattttcaaacataaagaaaatataaactctaagtgacctcgtaaattacatgcagtatgtttttaaacgcttgagaaaatgatcaattatatttaacaattatggacatgatgataaagttaatgtatgcagtttaaaaactgctgagtaacatggagagttctttttataattggcttgtaaaaatgattcctgggggactgtgacatttaggtagaaccccaggcatggcatttgttctctgtcatttccatgcattagacaaagtaatgaagacaaaccaaatggaaatagatttcatccaaaacaatcaatacaggcaaattaaataatctaatgtactggctaccaggctttgggattccacgaataggaaaattttcaaaagaggtttggaaacccacctagaactgcaggatttttattaaaacaaaagacatcttctatggaaattattccataaaaataagtaacaagggcaacctcaagacaatgcactgtttcccaagaaaggaccgtattttaacatttccattacagactgaaaattctggcagcaaccagcagaatatggtctagtcctataactgctagaatatagtttctggggaaagatgtgcttttcaaaaaagaagtcccttttcatgtgtttgttagccatcatcactcattatcagagaaatgcaaatcaaaaccactatgaggtaccatttcacaccagtcagaatggctgcgatccaaaagtctacaaataataaatgctggagagggtgtggagaaaagggaactctcttacactgttggtgggaatgcaaactagtacaaccactatggagaacagtgtggagattccttaaaaaactggaaatagaactgccttatgatccagcaatcccactgctgggcatacacactgaggaaaccagaagggaaagagacacgtgtacccccaatgttcataccagcactgtttataatagccaggacatggaagcaacctagatgcccatgagcagatgaatggataagaaagcagtggtacatatacacaatggagtattactcagccattaaaaagaatacatttgaatcagttctaatgaaatatcctatttttaatgacatttttcactatatttttatctgcagagaaaaatcagattacctctttaatgcatgcaggcactgctacatatactattttgaacaaatgagtgattctttttctccttagttcctcatctcttcttaaccaattctgctttcataggcacatgtttacctttttttctgaaaaggcagtcacgataagatgagcttca

SEQ ID NO: 33778 - DNA, 1068 bp, Bovine  19866880361576
tgtcctgtccctagagtcgtcatcatctcacaaacgtcaactaaaaaccacaccccaggctccctgctacacgagcggacaggacagggtgtggtggacgttctgtggccaccagcttggtatgagtcagattctgcattcagcaagcctgcccgtgtcatgtttgctgtggtctgcttctgtgcccgagttctcccccggggtgagatgtgtggatgtccctctgcatggagctttggagcatcttgcaacgcccgctggcagtgagagtaagcgtttgtccccatctgctcgctccagagtcgaacacgactgaagcgacttagcagcagcagcagcagctcgctccctgcgtctagttaacggcaactgaatggtcagctgctgattcactggatgctgtttagtttgttctgtcagctgtttattcatctgtaacttcctgttaagatgcagggtgtgctttttaaagaagccttgcacagcataagttttattttgggactggatgtgctaatatataaagaggatctccgggagttatttagccccatgagctattttctctgagcaaaattttgtggacactccctgggtgccaggcgtgcttcaggacaccgtggtgcagcagtgaatgagactgtctcagcctcagaagcttgccgtccactcctgcaagacgagcacaagcgtgagtgcagtgaagtgtggtacacgtgcaaggggtgcggggtgcagagcagggctggaaactcccaggaagcaaactgagggagtccccgcggcagaggctctgggagggaatttagcaacatttcagctgtgggtgatagtggtttgtgtagtcgcttagtcatttccaactctcgtgaccccatggactgtagcccaccaggctcctctgtccatgggatttccgaggcaagaatactgccatgggttgccatttccttctccaggggaccttcccgacacaaggactgaaccctgggtctcctgcatggcaggccgattctttaccgctgagccagcagggaagcctggtggtcacatacaaagatgtcacgt

SEQ ID NO: 33779 - DNA, 1095 bp, Bovine  19866880402339
acgagaaaaataacattgtaggtcatgttctcggtcttgagcagtcttgagcctcaataacagggctggaagaggctgccagcctgcagaggtgagggtcattcttaggaaggcgatgaccagcctcttggaagaggcctgagcacagcttctttgtgtcctccctcatcatgatgggtggcaggtgtctggctgggggcaggacccagcagacagccgtgggtcaccctcatcagctctgcaggactctggccctggatccttggcccctaaacagcagtttggcggagcttgcatcccactgatgccccgcagctctgatgctgtctgcctgactcctggtccctgcggcatctaactctgctttctaactttccttaaagccctcccgggacttctctaagagaaatgggggcttcaaatgtcaagaaagaggagaacaaggcacctctttttcctcctcttgtaaaaagaccctaccgttgatggtgccttttttaaaagcctgtctctcccctttcccttcttttccaaaaataggtcttgtgaaagtcagtgtgagctgcagcagcctcgcatatgtggcttcccatctgcagctcggtctgcacaatgcgccatatatttagctgcctaaatcgggactgttccgtgtgctgattcaagaggggctgggaagtcacatgggcgagcagggctgtttgttggtcaggactggctgctggatgctctcggctctcacccgcggatccagaagtgagagatatttggggacatcaagagagcagatggcccatgaaggcagctggcccaggcagtaattagtccagggaggtgatgggtcattttctgagcttggagcagaatttcgcacctgttgttgccattcaagttgcagagtgaggcttcgggtagaactggtagggctggaaactgtcagtgagtcaccacagctgagagacaacagctcggctttgcttccccagtgaaaggttcctagcaagaagatagaaggggagaggttctgtttggtttaagtttaaaagcagaggtactcaactcctttttcaatgaatgggttattcctttttaagt

SEQ ID NO: 33780 - DNA, 3376 bp, Bovine  19866880452874
atggactatgcaaatatatggttgaactaacatatatagtaataaactatattcatcattaataattaacaatatttggcttgatcaaatagttcagccatggatttgtcatgttcaaatgattagtctttgaacaactgtcccaaattatctcagaatatatttatgcccacaagctgtaaaacatatgtagtttgtggtctgggggctaatggtgcctgaaagtatctttccacagtaattggaaaaagcctcccatatttggctggctatttttaaacacagacaacctctcactccttccaaatcagatcgctttaaacttggaaaaaaagggctcttattcaggacatgtgtgtaccagctctacagcccagttccttcaaagtatctggatcgaaatagtgcccggaaaaagtgattaaagcagctatgagttttaaaaacgtcaaaaacagccatacagattttacagatgtatttaaaaacaaatgaacagaaactaattctacccaaagtacctggaaaaagaaaggagccaggaacagcattactctaaatattagagaaatgagcagtggagaggaaaagtatcgctgagctgagtcaaagccaagaggctgcctctggccaaggggctttcgatggctattttattcccgagttgtctctaaatccaaaaatgttcagtgaagccaatgcagcaggagggtgcggttctacgtggctgaggtgccacgtagaacaaggtgccgttggacgaggtgccaagagcagagcttgtggcctgcccaaggggggcgtcaggagcccacctcgagggtgagaagggccgctcctctctcttttcacctccccggcattcccagcacggtgcaaagcagagaaagtgctggagaaagagcaaaagtgatggggctcttgagaaaggcagctgaataaattaggacagaaagccttatatgaatccctgatagttctaggaccggagtggcttctgtgaaggaactgtagtgaagagaaagggaacagaggagttctagtaaaagaaacatggcccatctcttccaacagatattcacgactggagactgggtgactctgtgcgggtctaaacactgtacgaggacaggcctctgccaggcactgggcctagggccaccttctggggcgtctggagggcagcgggtttgagccagacctctgtgtcctctgactccaggacctgggatgggcaaccttccgtcttacgacagttctttcctctccttagaccgccgtgttgcccccgccctaggaaaggaacgtgaaagtcactcaatcatgtctgactcttttcgaccccatgggctaaactccttggaattctccaggccagaatactggagtgggtgagccgtttccttctccaggggggtcttcccaacccagggatcaaacccaggtctcccgcattgcaggcagattcttgaccaactgagccacaagggaagcctaagaataccagagtgggatcttcccaacccaggaactggaccggggtctcctgcgttttatttaggcacatcctccaccaactgagttctgagaggaaagaggaacgacctccctgggactaactaggaaagagtctgcaggcatggacgtgtcaggacacagccgagggccggcccagcctgacctcgtcctttctgtacgctcgttcactaagaaccagggcccacgagaagggaaagtttggacggaagtctgagcaaacagagggccaggaaaagctggcaaagcacagtaatgattacaagcacagacaagcagaaaacccagcgccagcttcccagaggtggccgcatctcccaacgtgtggagctagaaaatggaaaccctggaccggcggactttccagggagggcagggtcagagaatgaagagatacggcagagtgccagcccttattgaagattcacggagcaccttagcatagtaagtgttagtcgttcagttgtgtccgactctttgtgatcccctggactgcagcccaccaggctcctctgtccgtgaaattttccaagcaagaacactggagggggttgccatttctttctccaggggatcttccccgacccagggatcgaacccggatctctggcactgcaggccgattctttaccgactgagctaagagggaagccctcacatagtaaaggctctgacaagtcccacagcaaagaaacaggatttcctctttcattttgaactggctggacgatcgaaactttaaaccatgggtttgttaacattgcactgaacacagtagataaaacgttgtgctagggaataaaaacccaagctccccaacgggcatgcgatgccctgcaaggtcagccccctctgctgcctcaccagggagcccagccccctgcggctcatctttgcactgagcccacacagtcctcaagctgcataccgctggcctcagggtttcggggggtgtgttttgctgatggcaaacaccgtttctggctctcctcttccgcgttaagggtggtgtgagactcacgcggggcaggcagctgccagggatattctgtaacctcgagtggagccgtctacacctcggtccccagcaagatccaccctccacacggcttcccgacacagcatctcgcttagtcctcgcttctgttctgcaactgagacatcacttccgtcatcattttacagatgagagaaccaggatcacaaaacccaggggctcgcccaggatccctcatcagggcggtgggggggctgttgcagtggagtggctccctgggttggaaaccctcggccccccaggagctacttccttcacaactcaggatgctcctcgcccaacagggccctgccagcaccgcggcggctcccagacagtcctctgctgacgtggaagacagaggacagtctccgatggagggaagctccttcctgtccggtgcgcacgtccttctcacagcagctgcttttcccaattttccccttggctggaatagtttagtcttaaatgttttttttttcctctcactaaatgaaaaacaaacaaaaagcgtagtcacgtgagtgaacacatgcgaacgtgtttcttttagaagcaaatatttgtaataacaaagagctggaaaggatgaaacgtctttttttatacatcattttcactattttaaaagaagcaagtgactaagggaggagcctccaactgcagctggaaacactgagctcatgaaacctcggtctttctcagctgcccgtgtccttggcctgcccggagctccctggcagaaagcttgtccccccgtgcccagctggtacccatggactgtcctacggatggagcttaaga

SEQ ID NO: 33781 - DNA, 1314 bp, Bovine  19866880656428
agatttatggaacggaacaaaataattactgtacagttttaaaaatttttaaccattgctttaatgcactgcttcagttaaccaacatgatttcaatttattatgcaaatacaacaattattccattcgaaacattagaaagattgcatactttgtttccccagcacaattaatggtgttgaatgttccatttgtttgtttggttggtttttttttgacttgcttatttggtctttagtgacaatccatttaaagtaaaagtcttttaaagtggccgaataacatggtaacgtgtcttcactggtaatttagtactcgcatataatgagttagtactcgcatataatgagttaatccaagggatgtcattaaaaacagcacggtgcctgaattcccaagctgagatgtttttaatcacagaattacagtaattacataaatcctgggattttcatcagacggaaacatgcactaaacatgcactttaaactcgacaccgatacccaggtactgtgctaaagtataggctggagaatcctcaggccaagggagacattggagagaatgttaggtgttgcatcttaacggaaaattgggaaatcagctattttggtaacagtaatatcatacgaggcacatccccaggagcaggagagaaaaacccccggctgcggctgcaggacaaagggacgactactcagactcagtgaccctgctgttcgctgcattttcagcacacggagggtgcagaaggatcacctcctccttttccctggggcccagaagctactaattgcctagagttcttccggtccatcaatgagacagcccaccggtaaatgaggcgagaatctggatatctaggtctagtgaagactatgtgaaaataactttgttatcgcagggattttttttaagtattgaaatgacccagacacagtaccctcagggagctcgtttcagggaagtgatatgttgagtaagaagatgagtgcatctaggaaaatttattaaaatctcccaaaacaagaaatcttatttgattcatttattgttctttcttttttgtggctcagatgggcaggggagtcgagaaaaggggattgaggaagggagggggttgagagggtgaggaagagagggtcattgatgggtggaggaggaaggggtgcctgggaaagggggacagtgggtcagagccaggtggccctgcatttgtttggggggatggtgaagttgaggtacagagtgtgtgcgtgtgacaggccgtgtgggtcggctgggtattccggtagccgccaggacagggaatcc

SEQ ID NO: 33782 - DNA, 1605 bp, Bovine  19866880656746
gggcctgcctgcctccctgtccactctttgttcctccccatttaccccgagaagccgggcgggaagcagcccagtgaggtaggcgggcttttactgtagttactggggaatccacaccaggatagtgaggtgggtcctgctgccacaggtgccccccgggggcttttccagggaagggcctaggtgagaaggaccaccaggctgcctcccctgccacttcagggggtgtgagacaggccccagcgactcagtctttgatgtgaggcaggcgtgtcaagcttgtctttaccccgttgatgtgtggtcactggccccaccatagagacgacactgggctcaccagagagcataaactccggtggaaagtgaccccgtcctgtgaatgtagggtggagggaagagccctcactggcctctctgggtgctgggcagtggcctgctagaaggaaggggaccactctctgcatggcgttcacgcgctgtgtcctccgcttcacacctggaatgccccctttcttccctgccgcagtcctgggaagtgagcttcttgactaactctccaagcaaaaatgagagacgtggaagctcagagagaaaacggtcttgtccaggggtggcttgagagtgcggggctggagtgcgaacttaaatctgctccgttccaaggtgtgcttgggtgcccccggccccgtcctgcggactgttgctggtccccatggtcaaggttgccatcgctcttgcttctgaatatcttctctgcggtgtgggtaacaggctcttaggaacataacaagatgccttgtagtgctttattacctatcagctgctttctgtcaccccttgttctgggacagattctgaaagaaaagaagatggtgaccgaggattctgccgttttctccgccgagtatgtttagattatgcttcttttgattttataaacgggtgattggtggttggataagccgttagcagtactcactggcagtgtgccttacatctaggatttgtggcattagctagaattttataatggcgtaaaagaatttcatggaggaaataagagtatcaccatgttgtataaagctaacattagtagaataaatattaatccgaggttaaatgtttttagcctaagatttctcttaattcagtatccagactgagcctttctgtgttggtttttttttaaaaaaagagagagaaggaaaaaaacttctatttcagctcagtttgaaattctgatgtgaaaatcaccgtggccttgcagaagcgcagtgtgagtaataccgtgtccgtaacttcattccagaagccgggtaccactgcccagaaggcaggtggctatgtgcttccgagttcctggaacacaggtttctcagatgtcagctctggagggtgatcggttagtttgactaaacataagtcataaggacctaagtggatggaaaagctacagaggcaaacgatcttccaaaagcctcacagctgggggctggcagacaccgcttctgattttgtcatcatagataatgttgtctgtagttgccgtatttaagaaaaataaagttggccagctattacagtagccagctgtccggcttg

SEQ ID NO: 33783 - DNA, 1416 bp, Bovine  19866880707840
cggcggtgctcagctgggaggagcgtcaccgcgaccacgtcgggagcctcaagaggcagatcgcgcagctgcaggaggagctgcaagagcggagcgagcagctgagggccgcgcagcagctggcgggggagcccgcgggcgccccgggcagggcccaggccgacctgctggccttcctgcgctcgcaggtggacagggcggaggtgcacgccggcgtcaagcaggccaccgagtacgccgccgtgcccttcgacagcttccacgctgcacaaggtgtaccagctggagaccggcctgacccgccaccccgaggagaagcccgtgcgcaaagacaagcgggacgagctggtggaggccatccagtcggccgtggaggccctgaacagccccgctgagagcagccccgaccagcggccctacacggcctcggacttcattgaaggttggccggctcgccacgggggtgggaagtggtgggaggggcccggggtcccggtccaggcaggcccgggctgtggaggtctgcggtggctttggggatgagacagtcggctttgtgagagccgcattaaggacgagggaccacagtggctgtgacctgcaagacgactcagcgtggccagggaaggtgcagagtcaaggagggaacaaaggaagctgaggggaagctgaccaggcagcaccaccaggaacagactgacagtactgttgactgaagcaagcacaaatccaccatgagcccaggcctggactgatttagaccagttcagactggtttgaactggctggaacttgtttagaccaacttaaaaagcctctgacactggtttagacctgtttgagctggctgagactagtttagaccagtttaaaaagcctctgaggctggtttagacctgtttgaactggctgagacttgcttagaccagtataaaaagcctcagaccggtttgacctggttgaggccagttcgaaccagctgagaccaggtggaaatggcttagacccatttgaactggctgagaccagcttagaccagtttagattggtttagaccagtttgtaccatcttagactggttttatggcagcttagccaagagcggttttgagtgtgacaggcagttttcgttttatgacttcttacaggcacttctggagacagggtcctttcatcaggtcacagaacaataataactaatgtgtgccaggctggtctagctctgttttggagaaggaaatggcaccccaccgcactcttgcctggagaatcccagggacgggggagcctggtgggctgcggtctgtggggttgcacagagtcagacacgactgaagcgacttagcagtagcagcagcagcagcagcagctctgttttagcaagtttacacttacagtgaccccttggagggggtg

SEQ ID NO: 33784 - DNA, 1026 bp, Bovine  19866880714713
ccagcagttctgctgggacaggacagtagcatttcggtaggaagactgatggcggagggcaggtaagctgggatgaggctgaagccagaaatcgggggaaggcttgcaggctggggctgtggcttaggttagatgggtgggcacgggaagagggtggggggctcgtttcaaggtaagcgttacattcgtgagcccgcatgcagcacactctgttggctgctttcctaagccagcattgcatatcgcgttgcacaacactgaaacgcgcttgctttaaatagtcctcatgatgcttgccgttatcagctgggcagggcccaggacagcccactcggacgagcccgttcatggctgagctccagagctctggcctggccagctctgttctcagatgtattcctttatcaggaggacccgagggactctagctgagcccagcaatatggttggcagcctgaacctagttttttcttgttgttgttctgctttgatccggtttggtttttattatatcatgataatgttgtcaaatgattaccctgccagacaaaactatcaagaccattcacaagattgatttaatggcggcgtacttgaggttgaagagaatattgctttccagagtatataatgaaggttttaaagactgaacagatcaagcttgttctatggaaaaataatatgaaggaagtattaggcagggtccctagtagaatttagatttatgcaaatcttcagtgtcccataatccaaaattaacaaactcagaatgacacaaatttgttaaaatgtaatgcaaactaaacatcttaatgcatctttctagaattcaacagaatgttgacatctaaattcacattatgcaccacatttaatttccgcatgatgaaccaacgggcagaaatagatgagttgctgacacattgacttttttccaactcccaagaagaaaacaaaggttttcagagataagggaggagttcagcggtccattagtcttgtaaatccataattacacacacaaga

SEQ ID NO: 33785 - DNA, 1504 bp, Bovine  19866880749150
tgtataatgtagagaattttgaacctagggtgactatccgtattcgcatttatttcagcacatcttaggatgtgagttttccttctttcttgttcctgccttgggacctccgtgttccattctcaagccccaagcctcctgtggctggagtgcaatgattttgcgatccctgcagtgtcttcctgatgagaatcctctcgggagatggaggcaggggaagggtctcgcggttggcgtgtgaaaaagcatttctgtgctgagaactccgagcggcagacgaggaccacgccccggggtggaagctgcaggctcctttgttagcgctgtgacttcgagcctgctgacgtttacgagtagtggagtccttcaatgcccgcctatttttcttgtctgagatttcacccatcattcttactgactccactcatcatgttaactgcgatttagatgcttgtttctctggccccagactcccttgtcccgcctttgaacttggtgcagactctgtcgtgaccttggcatgtggtggtccctcctgccttggtggggtggggggaccgtgtcctcactcccatgacagaaactgaatgtccagtgctcttgggaccccggaccagtgggaccgagcaggagcagaaataaaggaaatgcatccttttctttctggacccacagctaccgctgggaggtggaatggtcacctctttgggggtgttggttggagtgaaattgtttgtctttctaaagcaatactgtattttaggatatagttgatttcgtagtgcttttcaaatattaacccgatatataagtttctgggggcagatcgtgagtaaatcttaaagcacaagctttcaggaataaaatttaagctcttcagagttgtcaacttgaggaggaaaaagaaatgagataatccttcagaaaggaagcgtcatgtggaagtgtgagttggcgtctgaatgtaggttaactttcttccccaggagtaactgtgaaaggatgcctcttcaccctcggcgtcctgaaaggacgtgtggtgaatcccgaggcagtcacatgggcattagcagcagcagcctctcagctcctgctcctctgggcaccatcccgggcactgggagcccaaagtgcaaacccagacagagcacagctcatggagtttgcattccaattggggaagagagtaaatataaatctgaaggagcagctcacacagcaagaggaaagatgggttcctttatcagggaaataaaggcactgtggctcagatggtcaagagtctgcctgcaatgaggcagaacctgggttcagtccctgggtcaggaaaatccgttccaatattcttacctggagaatcccatgcacagaggagcctggcgggtcacaaaacattggacaaaactgagcaactaacgtgcatacacaagtggagggcttctggggagaacacttcagtctgaaatacagtcatcagcatgagcgtcgtgctggggcggacagg

SEQ ID NO: 33786 - DNA, 3488 bp, Bovine  19866880929396
cacgccaggcctccctgtccatcaccaactccccaagtttgctcagactcatgtccatcaagtcggtgatgccatctaaccatctcatccacactggaaatctcaccatcactttgacgaagcccacacaccctagattcaaacattcaccaaatcctgtgtctttttcttaattttcaggcttttgcttatttattttcttacattccttagactactactcagactactgcaaaactcatggtagatttaaaatgaatatccacaaactacaacttaacaaattcttacaagagaactgtaaattgagcaacaaggttatttccatttgaccaataagaaatgggaggttcatcgaagtgaaacagcctgcccaggaccacgaagccagcagagaggatgacttgacctcctgtcttccggtcccaaatccccacagttacaccactccaccaatgtacactgaattttatgagagaaagggaagcttcaagacacccattaacaggtgtttcagacagctcttctccaggttattactgttgacagtattactattctacatttatatcctactatatgccaggcattgtgaatccacctacctatctattcttgatttttcacttaatgtcatttgcttctaaataggtgttattcattccattttatagttggaaaggttccctgatgctctgtaatttactcaaagtcacacccctagtaagtatctgaaataggatctgaacccagatatgactggctctgaaaccctggagagcctccaccctcagcaccaagcagggactcctttggagttaaaaaaaaaaaaacaactcaccatcacaactacttcaggaggctcaaagagaaaatgaaaactgactttctacagaaaaacttctaaaacatgagaggaaagtctgaagacatcactagagcaggaataatgaatcggcaggcagggacgcctcacctgatcccccagcacaagttcaccagatcaagagctttccctgtcaccagcttagctagcgccaagggactttaatattttacattatagtaaaataccttcagggaagtcccaggactcagcactttctctggcaggttcagttagtcactcagtcgtgtctgactctttgcaaccccatggacggtagcccgccaggctcctccgtccataggattctccaggctagaatactggagtgggtcgccatttccttctccaggggatcttcccaacccagggatcaaacctgggtctcctgcattgtaggcagtttctttaccgactgagccaccaggaaagccctccactgccgggacccaggctcagtccccgtggggaactaagacaccacaagcagcgtggcacggccaaaaaaagtattaattaattagttaaatacctgcaggttttacgtttgaatgtcaaaaaatatttgaaatttacttcaacaagtttctctaaacattgtttcatgcgaccttttcctagacagaaagacactaaagaaaaaggaaaactgaggaagaaaaaagcacttccaatgtcagcatctcatttgataaaggggggaaaagaggccggcagaaaaaccacagctccagctggagtggacggactgactgagcactccccaggcataacagctgcacacagatgtcatccacccctctgctgggctcctgggactctgagcgccatctgaaagaacaactgggatgccagacatcgaacgtacctgttacaccgaaaaagtaattttaaaacgcagctctgttgtgtatttcagagaaccaaaagagaagctcctgccatatggctgtatttgctgtccctcttttcctctctgtctgaaccgaagctcaacagaaataaacaacactcagccccgttcatgctcacagcagccgcacgtgtgccctgcaggcctcagatcaggactcaccaacgggagccacagtcctcaggggatgggctggcgaagaagcacccagacataaaggaacccatcggacacatataactgaaagtctctatttgtcccttctaatttgggagccatgtgactggattccacacagcaccgctgaccccatcagcccgggtgctccacagctggaccacaaagggagggatgctacgctttgctccttttccaaaatgtcacgttccgttcacggggtgagctccttcctgatgggcatgcagctctcaggccaacatcagtgttcaagcacctgagtgagctccttcctgatgggcatgcagctctcaggccaacatcagtgttcaagcacctgagaggatttaactattcctgccagagcgattccaggatcttaaggggccttttcagatccacctgataacacaaaggtgcataatcctttacaagacaaagagtcagcacacgcactctttatgtccttcccaacctgattctagagggttactgctttgaagtactttcttcgttgatgtgagtggagctcagtccccctctggccacaaagcctggctatacccaggcccgggcggcaatccagatagggcatggagctgggctggagtgccgcgcgtcctggccaccctccccagccaggctgcctcctacagggagcgaaacaacagagagcagtgtcatccactgttcagaaggagaaaccactgtcagaaaccaccgtgaaatcatcttggctgacagtaaaagcagacactgatacagaaaagtatttaaaaataaatctaggcaaggtcaagcaaaaatactgttgttttgagaccgaaataaatggtctctggagcctgaccgcctgggtggaaatcctgggcgtggcactgaccattcctgtgactgggcaatctactcaactgctctgagccttagtttccttatgtggaaaatcagaacactaatgcccctttctcttagcttattatgagaattaagaaccttttctttactaaagaaataaaacctacggcatacatacgatgcacacacacaagatggtgttcagagactacctaaagtcagcctgcaatattctctaacactttatgtatcaacatcaatacctcagcaggaacgggcttcgttcttttggttcaagtccagctggaatcaaagcagtgttagcagtgtagcttagtcttatcaggccctctcctttctgccttcttcagagttcactttatccaacagagtcagatccctcagtccgctcccaaggaaacaggagaggccagtgagtagagatggaaagttgggcacacacacttgtttcatgtaccacttttgctgtgttgttttatcacatttctgaataaattttgagtgtttttctccttgaagccttgactcccctgactaaggaaagccaattggggtgacggctgtgttgtcagcgtcctagtccagatttccttaacaggctcaatgcctctgtctacgccttacctctgcggaggg

SEQ ID NO: 33787 - DNA, 1268 bp, Bovine  19866881040921
tttcatcaccagtagagttcaagtctgtgcactgagattcttttaataacgttttcttatctattttctgtttccccaaatgaataggattaattgtgcctagccacaggattgtggtttcataggttcttattaagcataggtatgctgttttaataatattgagcagtccaacaggaacaagtgaattaatgctttctgtccttgtctctcttctgttagatggagtccattgcctcacctgtgcaatgatgcttcttaacacagatctccatggccatgtaagtgtaggggtgtggagctgtcttacagagagagagctccagaatttcctgggcttatctttgcttttgtgttcatacatgtttactctctgccttcttttatctcgttctctacatggcaggtaggtaaacataaatctttggaaaaagaaatagcttttttacatgctagcactgagcataattttaagtatgccccatgttgtctgcatgtctggagttctagctataatgcgcgcagtctgttatcttctttgtccactagatggcagactgagcttttacttttggttttggtttttggttagctatgagggttgatacagaattgcagaaagaggatgttaagttagatctgaaagtgttgattgtgttttcactaaatatagtagcaagtgttaagagctaagttttttaaacaccccttagcttacctggtcttttgcttgttgaaatatcaatatagtctacttaaagtataggatgaacttcttaaatttatgattgtaactatactttcacctttcacagaggtggaattttagcttttgcttaaattgttcatattagagaaaataagaaatgttgtagttaaatatagatcaatatagatcaaatatagatcaacatgtacacagcacaaaaaatatttcatagtcccacgtccatttattttgaagggaaaatcatgtttcttgtgatcagtctacatcatcccttgatttgccatatggtttttaccttacaactaagaaatcatattaaaagaactaaaactaagataatggccctaatttgttcttctgttccaaaaggtcacaccttattttaaacaagaaaaaggataactccttttcttgttctcctctttaagaaaggcaagtagagctgtatggggtccttaagatggactgagggggacaagcctcagtttaacagggcggtaaaatgtcttgggaaatgaaggtactgggattcccacag

SEQ ID NO: 33788 - DNA, 2045 bp, Bovine  19866881126780
agtgctgcttggatccctcaggttgattccatttaatttaaaaatatatttcaatttattaaaaaataagatgcgaaacagaacacactccaagatgtattcctgtttatcagtttttccgtactgtgtataccagatgctaactcacgtttccaagttacgtcgctttgcatatatgccttggaatcaagtctttcacgtcatttccttgtatatattcagacagctgtcaaatgtctcactgaataggaaggttgcggcttgcagtgcttgaaaagcagtaacagaagcagcaggtgtcctcgtcataaagccgtctaggcgaggacgctgcatttccagagcacatgagaatactctcaatacgaggtaaccaaaaccaagttcagaaggagactgaatcctggggtgataggactgttatccagaaatcctcgatttaaaattgtgtttgtcaggatgtcttcatttttctcagtgactgccattgtaataagaaaaggttgttaattggatcctatatagtaaatatatactgttgtttttactgcttcgtatactggggttctgcataagatgctgcttaaatttcatgcagctgggatcccagaaatctttctttatacatcaattttcctcttcaattttgacttcactctcattccccagagatgttctgaaagcatcttttccccccacagaaatcccacagtgcaggggaagtttccagctgaaaaaaatatttgctaactttaaatagatcatgtcttttttccttggggctccgtctcagagattgcactgcagcgatcctgttagttcagtcacaaggcaatttgttgttgtgcccagtataaatattttacttgctatttcatgagcgatatttggaaagggatacatatccttattttaacctgtttttgcatatgcagcaaccgagttgcatgtgtgggaaagaagctgggttaaattggattgcctctgtgtatgccagaacctctgtgggttctcgtgtgtaagcccagtggaggggaccccccggcagcgtgttgagcagcttgtgttgcagagggtgggggaggagccagtgaaagggtcacctgaggatgaatgagcgcctgatatgtgtgggaattgattcacacacacgggaatgtgctgttcagaaggagtcacgtgtctcttctcttctctttgtaggtgatcatggaggaagcactttactccccccgaatgtcacgaatgagtttccggagtatgggaccatggaggcaagtggagaaggcctgagagcctctctggagtttgatgccgagtctctgctgcgctgcccggggggcccgcagggggcccagccccttgctggccgtcactctgggcctgtcactgtcaccggaggaccaaaagatgtcagagggctcccatctcaaagtcacttcaaggaaccaagtttacaacccattgactctctgatttcagctctgaaggccacagaagccagaatagcttcaggaacgtcgcaggctacaaaggtactggatggggctgcggtttctacttttccagctcagcagggggggcaggagccagacaccgccagtcataaggcacggaaagcccacgcactgttccctgctggctgcgaaaagtcgcccgacatacctctttcagccaaagttccgactgaggaacatttttatttgagcatccaggaggatctgactgcactattaactggagagattcaagcagagccatccctaagagctagtaatggaagaaagggggctgtccacgtgcaagagccagctggtccagcatccttggtgggcagccccgcgacccccagctcggcgggcggtgctggtttgttgagagagaggaggtctgaccagagagagcaccccgggcaatgtgctccaggacgcccgggccagggcaagcatgtggcgtttcaaggggtggacacactgtggaccggaggggaggagagagagagccggcgccccgcggatgcctcagacaccaccgggaaggacagc

SEQ ID NO: 33789 - DNA, 1212 bp, Bovine  19866881145007
gcaggtccggtcggagacctgctccggaaggtacacaacctgatgccatttcccaatataattttgctagaaaataacataatcagaaaggcagcaatcgtccaattacatcgtctgtgccactgactgttacgcccagatttccccttccgtcagagtcctgtgactcaatccacgctactgtgcttaccaaataacttcttggaaagtaagagttgttgaaaaatgaaattcaaaacagcctgtaagttatcatatgcagagaaaagcagttccactgttccttaaccaataatcacgggaaggccaaacaaaagaaacaaacaaaaccatctatttaaatgtttccactttaattgtccacagactgaagagccataggaagaaccagcttcatttctataagtcgctttttctcagcagaggtctgggaacagaaggcaagagaatgggggagcaactgccacgtgatcttcttatgactgccctcggctcagcccctcaccgtcctcctattgtttcagacccctctcccaacaacctaaatcccagctccctagaagaaaaaaaaacaaggaaagcagactgatcctcacacatatacaaaactctaggtcacttctctgtgtgacgtaactgtaagtcaaaatgggcgagctttacattcagtttcaaatggtgaatctgctttatttgaattccaattaagtacttataactatatggaattccttacataatccctttagtatccttttagacactgcatttttgaaggaaaaatacacagtttccatctcttgagccaaacaacaatcccgctcccaccatttaagccaatagacatataaaataatgcttgctgacaaattagtcatccaatttcagattccaagacccagagaatctaaatacgagagccaaaatcctgcaacacacaatgctaactttgaggacatagaagcagagtggtggttaagaacactcgaatgccaagtttaaatctcagctctgtggcttatttagctgtgttaagtaacttctccagacttcagactggaagtaatgacagtactgaccacacggggctgtaatggggactagaggtaacctgtgttaaaacagcaactagatctcaataaactttagctgtgattgtaacaatgtatcatgcttgaaaatatcacataaaataagcattttcccaaaagt

SEQ ID NO: 33790 - DNA, 1923 bp, Bovine  19866881170202
tgtgtgtgtgaggccagcgtgactctgaccagcctggggagacctcctgacctgtccgtggagggaggcctctgcagttgtcccacatctgacgctgatcctggggccttaagaagagcatcatgctgggaggtgggagacgtgggctctggccctagttctgtttacattcacagtcttaacctcattccgcggcctttatttactctttgggaaaatgagattaaagtaattcacaaagtgtattttcaactccaaaaattcattacttggctctgtgttaaagtgttagttgctaagttgtgtctgactctttgcagccccatgggctcctctgtccatggaattcgccaggcaagaataccggagtaggtagccattcccttctccaggggatcttcccgatccagaattgaacccaggtctcctgcgttgcaggcagattctttaccagctgagccaccagggaagccttggctctatgaaatcatactaattctggctccttaggttagctctctgtgaccagttaggatcttctatataagagcagattgaaaagcaattaggagcctggagttggagcaggtagaggagctcccgggttgagcagccatgggtgccgctggctggatggaggctggatggaggcaggtggcttgagagaaccggtttcattctcccactgtctgccttggggctgtttccacagcctgacatcctgccctgtaattctgtggaggcagtaaccactggttacccttcctcagcctgagttgactgagaagaagcacttactttgaaacccaaatacgcctcttccaggaaggcgaatgcacagatggcagcagactataattcttttcttggctgcataagtgactgaagcttgcgtctcctccagccctcatcagagggtccttgtttctcaccggaacgcagaagtgggagccccagcagctggagtgaaaccagggtggaggaggtgcgcgtccacgggcccctctcctgactcagcgttcggcgtgtgaaaccagggtggaggaggtccgcgtccacgggcccctctcctgacttagcgtccagcgtgtgtctgtgtgtgtgtgtgttgcaggcctgtacgcagggccacgttcccgccctttggagctgaagcggcgtgcagggggctgtcctgagactgggctttctggtgcctgtgactcgctctgtgactctgggcatgtcccttattcctttctgagctgacctcatgtttcaaatgagggagttgggctagcagggtagtatttagggcttgttccagagccagtgtgtgccaggaacttgagatgcccctcttcatccacagggtgtgggagaggggcagtggagagaggcagcggagaggggcagctgagcggggcaggagggagcagccagcctgtgcagatgccccacgtctagcctggaacccaagcgggcaggagctgcctcctgacttttgtgcagcacaaagtcccagttaccgcagagcgccttacagtggacagtgcctctggtcagtgtgatggtttgggcatctatttatctaggcgtcatagcctgaggtaccctgttaggagctgagccgcccaggaacaggagaggcctcccagtctgaatggttccctcacggccatggcgcctttgaactctctgtcccttcacaaggagtgtctctgtccaggggtggcagagccgtttctgcccatccctctcgtcttgtttctttgtttttcctgcgacagaagcctcaggggctctcaccgcccggcccttgttaagtgtctgttcacattcaggttgaagacctgctagtgcctttgagccttgaagggaggtttagcaaggaacatctgtgctcctccaggggacctcctattcgatctgtaagccagcgca

SEQ ID NO: 33791 - DNA, 1497 bp, Bovine  19866881206957
gggtcgcaaagagtcaacatgacttagcaactaaacaacagtgacaaagataaagcactttctcaagccacataagcaacatgggcagaagcagaagatagcttcaaaggcatcacctttattatatgctactggtcatcctgctttaaaacaacattcttatctgtgctaaaccataacaaaatacatatcacagaagctcatttgaacaagactttaaaagtcatttagtccaaatgtttttttagctgaaccccttgttcaatatccagactaactgcccagttactgcttggacacctgcaggccaaggaatcacgtctcatctatggatacctccagctctagaaagactgactttcttattccaagatgtttgatgttcattcctaaaactgcttacatccacaattttgtggtcacgtagtttcattttaaccaaacagccttttaggcatctagcacatgtgtacagcaaaactcaacattttatattttgttttgtcaaacattttaaaggtaatagctaagaaagtattttatataccataaactgtatactcacacacaggattaaaaagtacaaatcatatttctttacttgataatgatataaatagtacattcatctcacattaatctcagagaagcaaagctatgtaagttttcttgccttcaatgcccaaaagtgtaaaatagaaacctacaaatgattatgactgtaccctgtaacatgtccattaaggactactgctatgcccacagagcagaactcgtatgtatggagaaaacctgcagagatgggcctgtgtgcctgagaaccccagggagctcaaagttctgggtatggtataaaaacaaaacgacgcttcattggaccaggcatcaaacgaccaggcacacacttctcactccttcctacctgagataccaggtgcttactggattacacaattgggcacaaaggcattctatgacctcctaagaagactctgaatttccaggtgtttaataaaatttctggggggaaaaacagttttattgagcaaaggacaagcgatgctggaagcaagtcttaaaaagaaaaagaaaaaaactacatccacatcctcaaactacctggaactatgcatgtttacagctatttacaaccgacaaaatgtagccagactcagcagctcttgatggggatagaaatataaaacatcatatgcaacttgatcaaaagaagaaatgaacagtgaaagactcttgaggaagtacatattaaacctgctaggaaaactgacggaagaatccagccttgagtactgaacccctcctcccacctgaccacccacccgcccagcactctcagttcagtcgctcagtcgtgtccgactctctgcgaccccatggactgcagcacaccaggcctccctgtccatcaccaactcccagagcatgctcaaacctcatgtccatagactcggtgatgccatccaaccacctcatcct

SEQ ID NO: 33792 - DNA, 1040 bp, Bovine  19866881210667
tttttttttttggtgctaaagatacagtttctattccatagtccttgtcaaagtactgcttctgagaatggtgggtaacctgttttaatcaactttattgtaggaaagggtggattgtaaaggaaagacaagacccatgaaatggaacttaaaaacctaaaccttattcttttagtctaaatgtagacccatgaagaggcactcctcattgaaaacagataaaacacccccagaactagactgctgccagcattctgttcaggatgcgaacggctgcctttacggcattgctgtgtccccacaccaaggtgcatcacagaacagccctgctgcacggcaaagtggcgaggggcggggcaccttagcctagttttaaaataattgctttgctctgtctccacttcaagagtctctctctaacaggaagagacagtgtcttctggggaaaaaaaatcccacttttattagctcttaattatagtgtcgctgttcccgatgttacacaatagcaaggatctctgcctgtactgccattatcaactattttcagtatgggtgactcagaataatgtctgcttcctcaaatttgacatgcaggactgaattttcaaaaccttcactgataggcgatgtgtaaatccctctaaagtgggtgaaaccccctaaccttctcaagacacttcccaggactctttacatccaaagcgcttaaaatgagattaaaaaatgtgaaacaaatatggctcccacactcttaaaaagcaatgaacatttccatatttcaaatagaaacaaatctcaggtgggtaaaatcactgaagaatctatactgcaaatgtgattaaaatatttcaaaattattaaagtgatacatccacacaattagcttcttttaattcacttctcccaactcttccaatccactttccaaaaggaaccactttttaacatttactgtgtctcagggtataatgcaggagatgcaggttctatctctgggttggggaagatcccctggaagaagggcatggcaacccatt

SEQ ID NO: 33793 - DNA, 1525 bp, Bovine  19866881358817
ccggggctggaccccagcacaccaacagcttgactgttcttggagcttttaaacaatgagttgattgtgggcaaacagaaggcaaggcacatgagagataattagcttctgtatctggtgctggctaataagtaaataattttcacataaacatagaaaccactaaatgttaactgcgtttatttttttttaatagttgtaaaatgtaataaaatgagattttcagaagcatcttggtgactgagtagaacagtgtaatttaaaaaacaattaagtcactgccgctcggctgtgttggaagatcccacctcacaattgtctgtcccaccggctgctggcgggtggagtgacctttcattaaagacgtttcctagtgtttcttctcgtggaagccagaagccaggaagagcaccctgcttagaaaagagagcgtttggttcatacagtctgctttggtttatttcaacaggtaagaaagtggtccccagttcccctgaggagaaaacgtgttttctgacttttatcaccagtctgaatgagtttgtttccttctctgttaaggtaaaaagtacattttctattcccaccagtgttcagttgctccactttggaaatactcttcagataaagtatccgtgtgcccatgtggtcagcagccccaagccacgccatccccttgatgaccgtctgctggccactccccacaggatcagcgtctgccatatccccggctgtgggtcacaatctgatgctctgaactgaaccaaggcagcaaaaagtatcttcttagaaaataccaaaatgtagctaacttgtgctctcttcataaggcttgcaaatgggtaattaaataagcagaatataactcataagccaaaaaaagtgcatttttaaataaaattaacagagatggttaaaactacaaccaaaaagatgagtagattacttctggttaatattggggggagatgatacaatagctacgagtttctttgttttctcatttttagtccatttggttttgtttactatattcacaaagatcaccatgagtgtatctttgaatttcacacggtctccttgccggcatcctgatctctcagctcccagaccccagagaagggctgatcacccctcagaccgggaggcatgtgctggccttccatcctaatgaactttttacaaagcttcccttccttcatgaatatttcaataagcgcagaacaacagcactcactttgctgtaaacacaatcacaacctccacgccttcaagctcacaatgagaccgtctctgttggtcgccatggtttggtgtgtttgggctgcttctgcagccaagtaggggggcatttgatgcttgttgcataagctatacaggcagaaagaaacccccctcgtccgttttactaaccagtcgaatgctttccttgcccttttggggcaatatttttccttgttgcaacggcaaaaaggaaagaaaaaaaaaataaagagtctccgcacccctgcttccctgcaggggc

SEQ ID NO: 33794 - DNA, 1359 bp, Bovine  19866881515960
acgtacaaatcttttccattactaacatagtgactatcattctaaacacattataatgccacataatgatcactaacagccccaactgaattatatttcaggaactaagagtgcatttgatggatacaaccatttctgtgcatctccactaccatggcaaccaattaaaataggttagcttaattaattagttgttggtaaagcactggggagatgaaaattgctattaatagatgcacagagtttggtattaatgctagtgtgataaacatcaaagcaaagtgcttatggctggaatagaccaattcattttcctctaacctccataatttcatcattgaattttatcaccttcttatttttaacaaattgtctagtctctcttttattcttctcttggccaaatctaaccaactcacgttatacactcaggcagaagagaaaattaacacacataacgataaccaaagttttctgatgaaaatgaaatatcttctgagggcagtgacaaagctcaaatgccactgctgagcctttcggtttccgatagctgagtgcagggtggagctcaccccgagtgggagcgggaggaatggtcacatcacctgccaggacttttcccaaaacggcacaagtggttgtttgcagacagcttgtcaacctctcctatctccccttgatgcttatgccattgaagtaaaagcagccatttgccatgcagatggagctattacacacaacaagctctccagactgtcaaaccgcaaagcagatgggccccgggtctgctctagattgaaattctggagctgccgttgttcctttcctacctgcctcctgccatgacctctccagcagctgagctatgatcgtggaatttagaaatgagaagaactgccattgccctctacttcagctccctgcattctaacaggtaagatatttcacaggtgagggaacacaaggcttagagtgagctgagctcccagggtgctgggctgggctctatctggatcgaggtcaggttatgtggctgggttgaagtcttctcctcaaggtagactgagaacaccttcagctatcttagcttaaaccagatccacgaatctcttgacctgacttgttcagtggctcagtcgtgaccgactctttctgaccccatggactgcagcccaccagcatcctctgtctgtggaattttccacacaggaatgctggagtgggtttccatttcctactccaggggaccttcctgactcagggacagaacccacatctcccgtgtctcctgcattggcaggcagattctttaacactgagccacctgggtatctggccccactcggctgggtctatcta

SEQ ID NO: 33795 - DNA, 955 bp, Bovine  19866880366019
attttctgatatgcagaactgtctgtattattacctgtttagaaccctgccatggctcctcagtacctagacaagcaaaccagatcttcttcaaagacttttcactccttttgcctctattctttactcacctctctacctcatcttgcatccttttgtgcaccctgataaccccacttatacaccttgctaattcatcctcttctttgctcaagttggatctacttctagaaatgcctttgcaacaaaaagttgtttgataagaaagcccaagaagtttttcctgaaccccatttgctgcccccaacccctaaggaggaaataacttcctcctagtcctgccctctggctgtctcataccaaattgtcacagttcttctcccttttttactgctgtacccccagcatctagcacaatgcctggcatgtagacagcaggtgctcaagacccaggctccctgagtctttctcactcagtccagagcttagtgtctgggcctcccccaccctctctcttaccaccctatcaatacttgtgactctcaacctcacctgcatttctctatttctccaactctgggagaagggccctggtcatcccaggactctgtttttcctggttcccacttctagttcctccaagcaacagtgaagcttggtttgtcgggaagtgttagccggtatccaaggtaacagaccgcaccactgcagctagaggcagggacagggaaaaaacgttcctcaccctggggaagaaattaccactttgttgcttgtaacaacctctccctgggcactctgcttttctccacccccacaaaagccaggaacaggatttggaactcttctctagttttagaacctctgggtcatcggaaaactatggtttaggccagtggagccctggtgcctgctgccttcctgtgcctaggaactaagacagacagcagaggac

SEQ ID NO: 33796 - DNA, 1311 bp, Bovine  19866880395844
ctctcctttttcctgcagttcccacattcatatcataagtctgtccataacatgaagtaaactctgtcacttcagcttcagaaataatgattgctgtttttcttgtgacctaatcacatgatactaattggtttctgaattctgaacaaccttcagattcctgcaaaagccctctttggctgtgacagactttttttaagatactagtctttatttgctaataccttatttagaatttttgccttgtatatttataagtgaggttgggataaaagttttcttttttggtgttttgtcaaattttggtgtaaaacgttttgcaaatgtcaatcactctgaaaaatgttaccttgttttctacaatacaggtggtttttacggcatttggatgactggatcttgaaagtttattaaaagaacttatctataaagccatctgggccatcagtctctttggttggcatgtccgattttctaacagaagtgaaagccagtttagccctcttctacctggtgcttgccccctccaatcacaataaccaggggccaaaccatcactcacggaggtgctccagcttctggctatgtggtgtggctgaagacggagaggaagggagagagtcaaaggtcacgtcgctcatgttgtcatctccggagttctctgagaggcgaagcagcagtgggggcctgctccctgagagggtcctcacccgggggctcccgcacttttcctctgtcccccttaagatggtcttggctgactgctggagaattaacagtgacatgcacatcacacaggcaccttttgggaacaaggggttcttcctgttgcctgttggtccctcaaaacctgaggccctttcagccacagaggccttagggactggcagaaaatctaaaaataatcagtgggggattaacccaaaggcctctaagaaggggcatctggaacaggagctcagagtgccagcactcccaaagcgatggccaccattcatggccctgagctgggggatggcctgtagaatcccaagctggtctttgccaacatggtcttatagctggtccacgtactgggggtggtaatgggggtacaacagggacacagagaggtgctcagtgagccaagttcaagcctcatttgtcaacacatcagacaaaccacataccacacaccccactcacttatctgtacacgcctggtcccctcactgtgggcaaaaatgggcccaagtcaagcagaccccaattcctctattagtggggatactcaggagggctgtgtacacggttcaaaaggggtaagggaca

SEQ ID NO: 33797 - DNA, 1750 bp, Bovine  19866880421593
gaaataaactacaagtgtcagatttttttccccttctctatacaaatttaaaaggtttctcttacaattctgtgttgccataaggacacctggctcctcctgaacttaactcttctcaaaccttgagctaaccaacgtgttttccttatggaaatgcttttcttaagctatgttaatgaactatgcatttaccctagattctgtctttcttcaagacggttcgcattaggactcagaaccggtaagggtcaacaaaccagtatgttttactgatacactgttctcctaacctatgttaacgaacctatatatttacttggaaacctatctttcttcaagattcatgtcatgttttacacccgggatgactcaccttgcgcccattatctcaaactgcatgttgtgggtgaggggcctggtgccaggctctgagttttgagacattccctttctctaattagcagcctgtagccacacaacatccggctgaacactagcaggggtgcactctttctgccccttctgatgtctctgtcagaagctttctctctcttttatactttaataaaattttattacacagaagctctgagcaatcaagcctgtcactgaccccgaatgaattcgtctcctccagaggccaagaatcctggcgtctttcacggctcagcaacaacctttcagaggcagccttcagggtgtcctgtcctggccccagccctccccctgcttcccccccacccactcagccctcgcagcagcccagagtgggtaccttgcctgtagagcgcagcagcataacgggacgtgttactggtggtctgggaagagcagaatgtctgcttgtccatcagcttcctagaagcacagggagaacgagggtcaaggggaaggaagctcaagcctggacctggaggcacagccccctgcaccccgacacctgaactccaacagccagagaccaaggccgcacgtgccgcaggaggggcgctgggatgaggaaactcaactgtggcccgagagacacgcagcagatgggagctccctctcccatcaagggcccagctttcctctcggcccagttagaacttggtcagaggagccatctcaggagggaagatgacttccctggggacgagcccgtgccaggcccagtcatgcaaagatgagccactggtggggagcccagctgtggggcacagggccctcggtgtcgctgaaggccgtggaaggctcatatttgaagaaagcgaagctcggcaccctcggggcccagggcactcacgaggaatacgtgctggtctcatcagcgcaggccccatccacgttcagcgcaatctgctcccctttgctgcggcaatagttgggattcagcgtgtcgatggccatctcaagttctacctggaggcaccaagcacccccaccagctatggggaccccgaggcacagcgctcaggggatgccccagccccaccacacccacctcctaacctcagtctcaggactgacaccatccctccccgaaggcccctggacttcagtccacacaaaggctacagacccacattccaagagaagggcctgagtgctttttttggagggggttcatgtagttttgcttgccgccacattccactccccaaagtctacattaggtacccacatgtaaacatcaagagcttttctcttttccttatttccaacttcctttcaaatgtcagcagaattggcaatgctggtgtagcttttt

SEQ ID NO: 33798 - DNA, 859 bp, Bovine  19866880563370
gagcaggctacctgggctttagcctgggttccagcctggccaagagcggcacttctgtcatcctgcttgacctccgcagaccccagtgggagctgtgcccagggaccgagttcatccaggtgcagtgatgagtcttgggggatgggcggggggggcagggtgggggtggaggtcagaggttggtgtctgatgtgtaaccagtcactggtagtgaatgaagagcacaggcttcagagtcagactccagctcccagctgggccgccacggccacagggccccacacctctgagcctcacgtcttcatccacagaaaggggacaccaacagtatctgcttcaccagagacttatggggagttgagacagtgcgtgtaaaactctgagcgcgttctctgtgacttagctccatagacggggctgatgatgatgaagacggacgcccagtggaatcatctagtaaatcctgccccacagcttgtccgggctctgcaggtgctgggcctggtggggtcagggggctggctctgggacctgccacagctgtaatgtctgattaccttgggcccagacctcctacctccgtgtctttctcctctgtttcaggctgatgtccgcaatgcagaagccctgcaccgtaccttcgaaggggtggactgtgttttccacgtggcctcctacggaatgtctggtgctgagcaggtgagacacccccccacacacagggcttaggtcctggctctgcccgcccccctaatccctgggtgttcattatgctcttcacctattccagggaggatttgggctatacccagcctacatttggcccatgagaccaagtgccagttctgccattttctag

SEQ ID NO: 33799 - DNA, 1370 bp, Bovine  19866880714893
tgccacggctgtaggccctctgcaaagctgagcaggttaaaactggggagcagggagaaaaagtgaggggtggagagaggaaaaagagattttttagcatgtgccagtctatactgagggcttcactgatggctcagtggtaaaaatccacctgcaatgcaggagacgtaggttcaatcgctgggtcaaaaagattctctggaggaggaaatggcaacccgctccagtatttttgcttgaaaaactccatagacagaggagcctggcaggctacagtgcatagggtcacaaagtcagacacgactgagcatgcacgcagtctattttgatcttgggggagtaacttccatggggacacatgcttatccctgaagaccctacagcaagccctgggccccctgcagaccaaccaagtttgagaaggtacacggtgaaaattctagatgcagacagatttaaatccgcactcagtaattgctacttactggttatatgaccttgggcaaatgccttaatctctaagcccttgtttccttttctgaagaatgaggataataacaggatcatggtgcaggctgaatgacctcatgcatgtaaagtgcttggcacaggaaacagctctataaatgcctgctcattttaatattaaggcaagaacgagtcccagcctggggtctgagtttccagctgtccctccggggtcaacccttctgggtagagagaaccagccacaccaaaacctcctcttgaaaaatccacaatccaaggcgaccctggtggttcctctgatctgcttgcaattgtcactgggcctgagacggatttctaaaaaccactttacttctacagtagaaggcagtgttccttcccgctattcagctgagcagttaggaaccctccaggccctttggaagcatgaagagggagtggtcttggccagggaagcatccagaactatcgcttggatcttcctgcccccatccacccgcacccctgcctcttacctgtcacagtgcttccgcagctgttcccatatcagcagggtaagctctgtcttcacctgctgcaggtaggggcccatggatcccgatgtgtccagcaggatgcacactttgctctccaaaatgacaccgaacagtcggcggctgcctgctccagggtgggtgggggcagaggccaggaaggagcgagggtggtttttcccactgcagctatcaaatacaccacacccaccacctgatcggatgtgaacccagggggagatagcctctgtggtgttgctagagtggtcatcgttcaaaggcagagcaggttggtggcctgggctttgggaggtcaaggtttcctctggactttgccggagataaact

SEQ ID NO: 33800 - DNA, 687 bp, Bovine  19866880748925
ttggttatataatactgtactataatcgtttataatacctttccacaaataatacataaaaaacaaacacaaaacataaagaaagcatttttaatcttatagtacattaccttaaagtacaacagctggcattgagtgaacagacaagaagagttactaactggagaaggaagaagagatgagacaaggtagagctgaaggattgtcagcagtaggagggcaagctgaaatttcacttagcctgaagttgatggaatacatgcacatctttgaaagttcacaacctgaaggttcgtatgtaggggactttctatattataaaataaagctatctgagatttcactttggtttctgagatttaaccttgtagcaccagccgtatgaagctttgggatgaaaaattaccatgtcctttcaaaaacagggaaaagttgcctggggtgaacaattatgaatatcttattatgttctgctctctgatttccagtgctgcttcttatgaccctctctcagttacgtgacttgtagtggcaatataactgagattcggagatactaatatgttctccctccctgtgatatctgtatagctaatatttgaaaaatatacttactgccgattgaacttcagtaagtctgcatcgaccatgtcagccagtgggcaaggttaaataagcaaaaagaag

SEQ ID NO: 33801 - DNA, 1317 bp, Bovine  19866880781703
tttcagacttgtcctgggcctgaagaggaggcgccttaggagcttcttcaggctgcagaggaagggtagaagtgctggcagcagcgccggcgccctccactttccctgttacagtttaccttgtctgagtaacatctgcttcgtttaaagaaatgctcctgctgtttacgggaagtttggatccctgccctagacagactgggattgcagagctagaaaacaagttctgagtagggacacattttatttcccgagacagtgcttccttgagacttggtgtgatctgtagctgcttttcttagagcactctttgatttctattttaactcctctattttcaaagacattacaaagttttagaggttttttaggatttttagaattaacaggacctagccaattgtataacatacaaactgacccccaagtatgaatctacttttaaatgcaaattaactgatatcacaaggaccactcttcctcttttctccagtgtctcttaaaaatctattatctagacctatttttgatactcattgttcagtttcatattgtaaatgcccccccccccaccatttgctttttctgctcagtgttattggctagtgttgtagtctgattctgttggcctgacatttttttaaactgatatacatgttttctattactccttcctattttgactttaatttttcacagtcatcttttattttcttatatttttcttcctgccttcgcaccttttattcctctccctgtccccactcttttgggtgtactgtttgcagcctcagagacagatgatgatatttggaggtgttttcttattttgttacctttgctttttaaccatgaatcatatagacgatgtctattttaatcatatactcttataagcattttgtaaattcagaaggctcttggtgccatgtcactgttctgtgtggatgttgggtgggagggcttgttttgtacacagtcatccatttttgtcctttttctcttttccaggttgctaggaagaggctcaatgtttgtgttttcaccagatcagtttcagagactgcttaaaattaatccagactggaaaacccatagacttcttgatttaggtgctggcgatggagaagtcacaaaaatcatgagccctcattttgaagaaatttatgccactgagctgtctgaaactatgatatggcagctgcagaagaagaaatacaggtatagtttttagacatgttttagagtatatttcttggttttagatgtttttcttcttagtattatttatttaaagtatacaaatcagaaacaatt

SEQ ID NO: 33802 - DNA, 1438 bp, Bovine  19866880827346
cagtgtcttacagctgaatacgaagaggctgtaggaaacctgctctgctcatccgacctgggagcatcacagctgcgtgtgctgtgcgttacacactggacacccttctgccccaagacacacacacacggcaaatcaaacccaggcccgagcccagcacgcaccagaaggtcacactgtggctgatttggattctctgctctaaccacctccggaaactgaaatgaaccctgctcttcccagaagcttctgcctgtgccctcctgccagtgccccgagcagacctggtctgccacctctgaatctgccgactcaccctcagttcccagaggagggcgtccactcctacccacccccactctaccccctccactcacccggtggttgtccagagggtcctggtctcgaggtgccatgttatcaaggtcgctgaacacaggccaatctgggcagggagaaaacagagcaaggcagcagttccacggctggaacaggtcacaaggtccatctaagctgccatcagacctctcttattttaaatttatatttatttttagggccacaccacatggcttgcaagatcttagttccccgaccagagatgaaacccaggccctcggcagtgaaagcgcagaatcctgcagaaagcaccaccgaaggcgccactgggccactagggagtttccaaaccttttttatttgacatttataaagtacaaaagcgggagaagaatgttgttggcacctgagaggccacagttcttctttgagaatttacccaaactctctacttgccagctgcctgtacttgtcctgatgagcaactagcttagctgctgcgctgccttggggtttccataaggtaaacagtgatacgattgtgtaatgtactggtcagccgtcaatgaggtgcagttgtgaatgaaaaaagaggcatttgtccatttggggtacaaatgggaggtagctacaaacgggagaagtcttagatggtttaaaacccaacaatttcctggcagattccagtctttatctcctgtcccaaacgcccactaaccaaatctggcttgtctgctgtttttatgccttttttaaataatctttcttttttttaatatgtatttatttatgtttggctgtgctgggtctgtggccgtggtctttctctagttgctacaagcgggggctactctctggttgtagagggagggcttctccctgcagtggtttctcttgctgtggagcatgacctgtagggcaatcaggcttcaatagttgtggtgtggggctcagcagtggcggctagcaggcccccagcgcgcaggctcagtacttgtggtgcacaggctcagctgccccggggcatgcgggatcttcctggacagggatcaaaccggcttcccctgcattgcaagggggctctcaaccacgggaccac

SEQ ID NO: 33803 - DNA, 1155 bp, Bovine  19866880903551
gcaatccagttgggcagccgaggccaatttttctgggagttcctgaagcgtccctcacttgcacagcccttccagagcaccacaccctcactgcatattcataaatttgtactctttttatctagaagaggattcccccaaactggatgcctgcctatgtggcagaaaagagggctagacttgggctaacccaagtgtctccccaccagaccatgagcaacgtgagggcagagactggatctgatgttttccaggctgtatccctgttgggtgtgggtgctcagaatttgttggatgatgactgtccaaggccctggagaagtgtcctttagaaggaagctgggcctcagaaacatacagctaaaagcgagaatcgctcatgtgcttcagggaggcagtaggggacacgcatgttggctgtgagcaggcccccagtacttacctgggagaggcgtcccattggccatgaggatcaactggtcagcgatggctttggttcgggagtagtggtccgtgtgctgttcaaggacagggagaatagagctaccagatggggtcagggacactgctgatcacaccacccagccctcctggccccagggctgcacttttgcttctgaccatatgggagttcacttctgggaccctcaccaggaaatggccaagccctgagccctactgccgctcctttccctctaggtgggagccacgaacagaggagagagttcagagcagtaacaatggagcttcccgtcagccacgtcgcctgcactgggacatcggctgcactgggatgtggatgctggatgcatgtcagatggactgtttacatggaatccttgtgctcacgtggcattttcacataatcgtctcatttccagctctccacatccccacagagtggtgttatcatgcccaggtgtagaaggagagcctccaagtgaagtgatctgctcagggtcccacagtagaaagttgctttgctggttcaaggccaggttggtgtgatttcaaagcccttgctggcatgactgaagtaggagagggcttgaaccatgctatttggggactctttgctcctgggtctcaccctcagttgtgaagttgaccctggctctgcccatccctacccttgaactgtgggtcccaggtccg

SEQ ID NO: 33804 - DNA, 1543 bp, Bovine  19866881049876
attttagatcctgttagtgggatgcacagcagttatgttcctgggtgagaagatggcattgactcagcctgggtcttggaacgccacctcagagaaaagaagtgtatctacactgacattccaccacccccaacctggtgcaaaggggaaggagcttccaaagaaaggtgggcttctggtcccagaggatggcatacactcagctccccaaactgggagcaggctgcttggggaacctgagccttgggggaagtggaacatctaccaggaggcactatctcagttaaggagatggggttgggagtcaaataatttacaaatagtaactgaaaaaaattttaaataaattagaataaattgaaatttttgtagactttcttaagacttgaatatgtttggggcagctcttcaggctatatacccctagacctccccccacagggtgacaggctcccacttccaccaatggggacccctcagcagagaatttgggaagccctggaccaagctccatcttagtctggagactctgctgacaccgcagagaggggggacagacctccagctctcatgctgatggctctagtcttcctttctggttgtctggaaagggtaactgcaaccactagttacaaagcatccaggtgaagagaccaaggctgagagagctgagggtcagggggctgagttgttagtactgtgccaccagaggtgttagcggaaacagcttgaacctggatctccatctcagctccactaggttgagctgtgtgcccttaggcaaatcacatctcttctctgagccttggctcctttatccataagacagggataataacagctctcacctcctagggctgcctggaggggaaaattccaggcttaccagagcatcagatgaaggcaccagacacatagcaaaacctctctgagagcgctatggaccttagctaatgactagaagaaagaaagagctatagctatcggcatgagggcatgtgggtccatgcacatctgtaaaatgggcacagtaggactctcgtgggagtcaaaggcgatcacatctatcagagctggttaaactctcatgggccatgcacataagtgttgcctctgttactggcctgtgagttttgtgagttcaggcaccatttcttggtcctcctgggattcttcacagcatccatcccaggacccagtgcagagcgagtggggagggggatgattctcaatagtgtttgttgaatgactagctgatctactgagagaataattaattgaatgagaaaactccaaggacctgcctatcccactcacctgtccaggtaggaccaggagatgtggacagcctttctatcccccttcctgctcatctaccccttcctaggcccctgactgcgctcccctgtgtcataggaggaggctctctgaggacatgtgtgctccggcccccagggatctacggccccgaagagcagaggcacctgccccgtgtggcggtacgttgttcccacctgaggccggaggcacgggggggaacccg

SEQ ID NO: 33805 - DNA, 2167 bp, Bovine  19866881286276
tgtcataaccaagtgtgtggggtaggaatagatgtgaaattccaacagttacaactgtgaatttggcctgtgaaagaatgaaggccacagtgtgaataaaagggtctctttgtcccattctcattacattatatgttcactcctaaacttctaatggatcttttgttaatttttcaaaaattgtatttattccgtcctaggtgttcattgaggcactaggactacagtgcctgtccacaggacagacaggatcctgctcatttactagggatctgttgactggaggtgctgcctcctggggcgcccactatagtgctaggcagtgggtgggccctcactagataattttgctgctgagtaaggtttgggagcaagtctgtcctcttaggctgataagcagatctagtgggattttatcaagtgcagacacatgtctgttcattttttaacatcctcattattaattttactgagagccttattggaacagagttgctaaaacagttttctgagatcctgtgctcagtcatagaactacaatttttttttttctttaacaatagaagcattacttaagtatattgaatctctttaccaaagtttgcttggggcattctttgtaaaaattaaaattgttgaaagtttctaacctcagaaggcagtggtctaccattcataccttgttagaaacatgtgaaactgtgcaggcagaagaagaaaacccattgcttttataaaacactttgaagagagtgtcttttgtcagagggctgagttgacaaagtaagaatactgactgtgatctctgtgagtaagatcctttctgggacagcaggagccttctctgtaggtaatgatggtgattgctttgaaatgtgcccctgagaacaaggtggaaagacttcagagactgggttttcttttagaccagctgctgttgtaattgtcatttggcgagctgtgcaagcttagaataaggatttgggtttctactgtaaagatcagcaaatgaaatcttagtttaaattaagacttctactttttaagatgagtacgttttccacatgagcaacgaatttgctgaatcactgtttggagggtcattaaaactgacaccgtcatttttcttgatgtttatattcagattttttgctttcccaattatagtaacatcggctacaggagttacacagaagcatcaccagatgacgcatttggttttgtaataggaaaaactttcagccttaacgttattgaatgaatgctagagactacagctaacatgggaatatgtcatcctctttaaagaaaaaaaactaaagaaaaatgtaatagcagtgaaatgtaaagatttcggaattctggaaggaagatcttttttaaaaatcacctgactactagagttaattttttacctagggcatagggctgagtagacttatctgtttaaagctaatagtttatattgttaaaatagattattgtcacttgcaaagactgattagtggaaggatattaaacatgaagttattgaaagttgcagttctcaagcctgcagtaaatctgtggtatttttagtgtttgcctacgccagttcaataggatttagaaaagacaacctcttaatgaaaatcctttttgtaaagtgagatgaacaggtgtataaggcttcaaaactatattgtttccttttcttttgtgtgttaagtaagaataaaggacattgaatattctctcattccctccacaaattatttagaaaaccttcttgggcttactgccagcttttggctccttttggtaatggaagccagatgctacacaacaggaaataaacttctttttttttttttttttaaagaccaagaaagacttttgtctttaaactaacagatgaagtaatatcctattatacagtgtgacttcacagatgctttcttgtagttgagacttgtttcgccagaattctatcctacacatccaatgaaatatttagaagactgagacttcaggttactgagccaggcttgggttttgtttaactcaaaataaggattgcgataaggacaagtctcaaattcttctctgttggatgtttactgcaagagtgctatacttggcgtctcttctgcggcagcaggaacaggaaaggtgctcccggctgaca

SEQ ID NO: 33806 - DNA, 839 bp, Bovine  19866881743208
gaagcacaaaatgctttaaaattttaaggaagacatgagctcttgaaataagggcccctaaggccaggctcctttgactcctgtggggataatgcaggtttccaagcaggtttccagcagtttactcaaggctgtaggctgctcacacaactgtcagaaactttaagagaatccaaatgtgtttgatggtgtcagatctcattattctccaaagcttctctccttctcttcagccaagaaaaaaaaaacttgctctggaatcttgaaaaattagttgctgaataaaagccacacaggctacataggcatctctggagccaatcattagtttcaaaggttattttttttttaaaagacacaatgcctaacaaaatactgatcaatttttatgagcactgtttgaaagccacgaacagcttttgagagcatacttgtagttctactgagaaaatatcctttgccagtttcctagttgtctatttccataatgagtcacagttttggggattttatcctagtattttcaccagttcctcatcattcttcatccactcttgagtagtttgttccaggactattttctggctgatttaaaatttctctgggttggtacagaggttcctttttggttttcaatatattttctaaatttaaaatatgatcatgtattacttttccaatcaggaaaatttccaatgaacattctaaaaagttagtttaaaacttgtacaagtgactccatttatgtaaagttcaaagataggctaaactaatacaagggtattagagtggtgcttagtgggggggtggtgactggaagagctgataatgtccttatt

SEQ ID NO: 33807 - DNA, 779 bp, Bovine  19866881914684
cccctgggccccagcacccccctttctctggcctctctcgcaggaccctcagctctgcatctgccctgtaactctggctgtgccgcccggccctcgggtaagacgggcgccccaggaccatggccgaggaagacctcatcttccgcctggaaggcgtggatggccgcccagcctcccgggctggtgattcagacacagacagcgacgatgatgaggagggttacttcatctgctccatcaccgatgaccccggggcacaccagaatgtcaacttcaaggttaataactgccacagcaacctagcaaaaagcgagcgctacggctccagcgggtccccggctggctccttccatttcaaggtgagtggtccctggtgccaccctctccaccccaggtgagccccagctcacctgccgtaaggattggagagttggggtcgctggctgaggtcgtttccagactcttgccagtgctctaaattctagatctgaggcagtgtctgttaagtgggaagatttcaatacaagttttttgtttgtttcaatcgttgaatcattgtttcaatacaagtttcattcctttccagcagtgttttccagtatctgcactgggcccattagtgtgggttgtgggaaccttggccagttttttaagacccagaatagaacagagtagaaaatattgggagagggaagagagagggaaaaaaatatcagctctgacagtcgtgataatattttagggacatgtatacatgcctttacacacacatgcgcagt

SEQ ID NO: 33808 - DNA, 4991 bp, Bovine  19866880420320
aacaaaacatttaatatggagactacatatataattttccaagtcatctaactcaagaggttaacactgatggatcatatattaagataaaatcgtctaaagaattcatcctgttctttttttccaatagaaaggtgaaatattcatttgtttaatttgttaatgctttagaattattctctaaacggggttggtgctgtttcatacattcatagtatctatcttactacacatgtaacattcactcctctcgttctttcagttcaagtagcaatgtttctttttttttttttttaagtagcaatgtttctaaggaaaaaatttccaactagatgccttacaaaatgacttttgtgcttctcttttcaaacgctgaggtaatcatgcaggaaaagcaaataaattattctcttttggggtgaaagcattcatatttgataagcaatttgaaagtcaaataagatgttacctaaacattttacattttttatggacttattttatttggtattctttccaggaaagatcattactaaaagaaatatacacatcagaaatatttatgacaaagtacagttacagataatttgtgttgctgctgctgctgctaagtcacttcagtcgtgtccgactctgtgcaaccccatagacggcagcccatcaggctccgccatccctgggattctccaggcaagaacactggagtgggttgccatttccttctctaatgcatgaaagttagagaaacagaagttttgggaagtgaatgtgaaacagaacctagtgataaaaagtttctaggcaagtagtgttaaagacgaaaaagtaaaaatgttttgttttatgtaaatatgggaccactactagaaatacaatctagaagatacaaagaagaaggggaaacaacaaattactcagagagaaaatatatatatcacaggaaatgtaccagtaaatctctgtttttagaatgtcatctgtatcttaatgtggcccctctggatggctgccaaatcagaactggactagaaatgtggtttggggatctaaagtttgtttcacattctttctccagccctaaaatttgtttctactacatttaaaacatcaactggcaattagttcagcatttcctaatgtatacagaggccccaggctctcgtggaatcttatgaaatggtttataacataccgcagtggagaaaaaggcaaactgacgatcgacctgcgcctccacccccacctttgactttgcaccctccttctggctagaactatatataaaagcaatgaaattctatttcagtgtgatggctgctgagaacaggggtgatacacagccacctcagagaatagccagggccaggttggacttcagagcattttgtcgggaggtataggatttacacctggggtgtaatcttggcacatatcaatgtgtatttattgtgcatccagtctgtgccaggtactaaaactagtctctatggaggatgcaaaaacgaatggaacacaattatgtcttcaagagggttgcaatccaactaggagatatgaatcatcgcaaccagctataataaaggtatgtctagtgtgaagctttgattgtctgatagattcatagccaacttcaaagaaaaacagctaaaaattgttacttattatatacatgttgcatctcaatatgctttgaagattggatctgaaaccaataccaaaatcccagaggctgtctggggcacaagctctgcccaagataggagtctgaaattgatgagtccctcaccagacagcctgatgaagttcacctttcaaaagttaacactactgaagttgaagaagtagagatagatgcttactgtcactgtgatgacagaaaagaagaaaaaggagcaagcagtgatgtgctacttgagttcgaatggggacggctagctgagcagatggctagagtttcttttgagcctgcagagtccagagcactgctatgtcctggatttagactccccaatgacttgactgtagagactgtggttctttctcttacttccctacagagcttcataatgtatttctatcaattaggggattgcctgaagcttctctggtggctcagctggttaaaaatctgcctgcactgtggaagacctgggttcgatccctgggttgggaagataccctggagatgagaatggctacccattctagtattcttgcctggagaatcccaaggacagaggagcctaggggactacagttgatggggtcgccaagagtcagacacgactgagagactcacctttcacttttccactgggtgtgcttattccttgaacactgaaaaaactctaacacacacacacacaaaacacagacgggttcagtgaaacacataggagcaggatcattctcaccttgtagtttctgacacaggacacctagaaggccccacagataatgaataaaagaagtggatgcagtataggacttcattggtggtccagcggttaagacgccactcttccagtgcaaggggtgcaggttcgattcttgatcagggaaacaagattctgagtagcatgggcaaaaagttaaaaaaaaaaaaaaagtggatatagtagtgagagctgagaagagtggaaattactctttgctaagtgaatcagagacaagcttttgtgaagattgtatcatctgagcagagacttgaagtcagaaggtgcctagttgggaatgagagagggatggctcctccaaacagtctctaaaagtgggacttttaaactgtttttaagttattatgttgtcatgaaagttgttaagggcaagatgaaaatgcattggagaggttgttgtttagtcgctgttgtgtctgactctttgagcccactaggctcctctgtccatgggatatcccacgcaagactactggagtgggttgccatttccttttccaggggatcttcccaaaccaggatcaaagcttcatctcctgtgttggcaggtggattctttgccactgagccgccagggaagcccactttgaagaggacagtaggaaaacagcatttaaagagttgtactgtttgaaggtacagtgggccctcagcaaccctggggattggttccaagacccgtgaagataacaaaacctgaggaagcttgagtcctttgtatacaagggcatagtatttgcttataacttacacatattcccccatatactttaaatcatctctagattactattaatatctaatacaatgtaaatgctatgcaaatagttgctggatatgtgacgaattcaagttttgctttggggaactttctgaatttttttttttccaaatattttcaatcccaggttagttaaatctgtgagtgcagaagtcatgcatatggagagcctactgtattcatctcataaaacgaaaacataggtgtcacacctgtctattcctcctccattagaacctgtttttgctaatgtttgaggattagggaggattcaaacatgaaaacaagaatttcaggaagcaaattcttagaggcaggaaaagtaaggaagtaatgaagtttagcttaaagtacctgaaggaggatactaatgggaaatgagactggaaaagtagattcagagttgaattttattctgcaggtatctgtgttataggctatatgaatttttttttggctgtgcctctcagtttagttccccaatcagggatcaaaccaggaccccctgcagtgcaagcttggcgtcctaactgctagaccaccagggaattctctatgatttctaaactagggagagatgtcagcattgtgcctcgagaggattaatctgataatagcatgtgaaagtggatttaaagagggaaaaatagtgggaggagagaggggcaaaagcccaggtgagaggtaatgtggattatcctcattgtaaaactatgtactttacagtgatattatttactaattgtgtaagtgtcttgcatttatatgctgctgttgctaagtcgcttcagtcgtgtccgactctgtgcgaccccatagacggcagcccagctggctcccccgttcctgggattctccaggcaagaacactgcattcctcattatttatttattacagctctttatggtaagtcaggaccacagcaatactacacatgtttctttaatttatagaaataggattgcatactagatgcaaaattccacaacagcttgtttcttcaacagcacataaggaaaaataaaaaccactccacacactgtttactattttgggtagagatgttactgaaacctaaccagccccaaattcttgttacgaagtaatgcttttttctcagctgctctatgaatctttagatttgaaagaaaactgaaagcaatctacctttggatgttgagttttatgttaatgtctcaatacataatattacaccttttaggatttttggattttatatactcgtgttttaccctatgaacgtatcatgcatcccagcagcctgtctctgaccatctgaaagcaagctcccaatgaatggttgtcaagtgttctacttgagaactatttgaaaaagatggcctgactctatattgataatggcatcaaaacttttccttccttctttttctttattttgcaggatttctccttttttcttagaaaaaaaaccagaccaatgattctcagtcttttctgagatgcaaatgattgaagataatcacattcatcatagactcccatgggaactagctgcaactcctactcaagaaagcacatgagaattcaagtcagcttgagaagcatgtgctcaagatgactctgaacatgacttaaatttcttaaagccaactcaagtatgaaatcttttaatatcagttacaaatgacttatagatattctcacagctaaatcatctcaacacctgcttagtgacagctgctagccttgatgacgccctcaccagcaagca

SEQ ID NO: 33809 - DNA, 1652 bp, Bovine  19866880489402
aacacaggagtgggttgccatttcctcctccaatgcatgaaagtgaaaagtgaaagtgaagtcgctcagtcgtgtctgactcttagcgacgccatggactgcagcctaccaggctcctccgtccatgggattttccaggcaagagaactggagtggggtgccattgccttctccagtttgttaaagggtacttaaacaaagttattgatttagctgtgccaggtcttagttgtggcacataaggtcttcagtcgtagcatgcaggatctttagttgcaacatgcaggatctagttccttgaccagggactgaacccaggcctcctgcattgagaatgaggagttctagccactggaccaccaggaaggtccgtaaagggtaattttttaaaagttaaaaatacaacacttgtacagatatgatatgaacaaagattttatttgactcattaattaatacagggccggtaagatattaaaaccacacacacatctcaaacaagaatgctgacatgaaatttctcatagaggcaaaattagttagtataatgcaaaattagttaatattctatagggtagcagttctcaaaagtttccatctcaggatccctttacactcttaaagcttatgcaacacctcaaggagcttttgtttatgtgggttagatctaccaatatttgccatgttagaaattaaaactgaggacatttaaaaacacaggagcataccaacaaacactcattccataagccatcagagcaatgacaagtaacattgcaagtcatgtagccccccaaaaggcaccagtatgcctgtgaggaaatgagagaaaaacaggcaaataatattaatatgaaaatggttttgatctaacagactccctgaaaccatcttgggcaactcccagatggacacagatgatgcatgagtgagctccactgctattgggcaatgaaatggaatgtctgaggttagattttccttattgggtagaaatcaattatatctctaccagataaaattcatttccatcatcatggacaaggatcatttgcatcactatgagtttcctacaacttctataaagctggaaaatagctttgttgattgagatctgtttaaggtgttcatcctggtagaagaagataatccctttgagatctactaggtaaagtccagaactccactggcgagacacttgattttgcctatttctgagtctttacaaaatttcccccgacatgagggagccatcctctggtctcccaggtgacagggtgttttggctctctgttctttttctggcttgttgttatggcataagtagcatcaccagcttcccttgggtctgtctctttggttctaaagagcttactgaggaagtaaaaagactgcagtagaaagatcatcataattctaattattctccaggcaatgtggaagagaaaaagcatgaggataaacatattgacatttgttcctgctacagcgtgattccaggaaaggcctcactggagcttgatattccaggtggtgtggtgttttcaacgtggacagagttgtcaggaggcagcactaggtggaactgtaaagtctgggtcacttcagtgtgtaagccatctctaccttgagtctcatcctgatacggacat

SEQ ID NO: 33810 - DNA, 2517 bp, Bovine  19866880495798
tgcttcctctctaaaagatgttattaggaaccactcactgatgagtgttttctcctgttttgcaaaatgctttcaaaaatgcatgaaaggacaaagttcaccagagcatctttttctaagtcagttatttaactttatgactaaaattattacatattataacttagcttcaaaatcttacaccaactggacaacttccccacagtaaacacgtatcacaggggtttgggtctttctgtttgttttttacctgaaacagcaagccatgaagttgtcctttaattaacttctttcttagtggctgaattgttgctataaagagaatgtataaccagcttaatatgacaatttgtaaactgcctccctttatgcatttcataaacttttaacagctttaaatctggggcctgaggaaaggagagagaaaacaatggcttttgagaatgatgttctcaagactcatcaaactgggaaagcagaagaacaaaacaggagggagcaactaaactattattgcccttgagtatttaaaattaaccttgatcaatgcaagtgaattatctcctacaagtgagtcaccgaattattcatgttaaaaagggaatacacctcagaggtcactccatccaaactcctacccatggggaaattgtctctttaataagcctctgctcaagctacaaggaaaggaagccctggaaacagagccccagagccccagaatcctacaagtaggtgtgatgacactgatgtccagaagactgaagtgcgtaactggctattcatggagctaagatcagactcaggacagtgctccattcactatcctcttttgtgaaattaaaaatatttgtctttctacttaactgaaaatttgcttcccagcaacttccaaattctcatctctgaaataatgaaagtgagaaaaacacctatttaacttttaagttaaatagtaacacatttcttatttgacaatccataccctttgaaaagtagccaagaaccagaaaataggctgaaatcattggaacaaccaaaatagatgttgatatccatgccctttattcatgtggcaagtcctatacttcactcaaatagtgggctcagaatttatacataattctcacaagcttgactgttttctcagcccacagatgattaaaaacaaaaattaaatgagggtaggaagctctgctagatggaggcatattaatagctgccacttaaaaaaaagtcactaagagccaggaaaattaacagcagatactctggtgtccaaaacacacagaaatctggtgtttcttattttaaagaccaacagttttatatctcagtagcctgaagaaattctgagccatagaaaataatgctaatacatgtgaaaagtacaaaatctaattataaacattttccagggaaaaaagcttgaaaacctccaatttgtggaaaattaccaatgtaaaatttattttatatgaattttttttggtaaaactaacatttttcaactaagcttgacagtgtttatgaggcccacaaggaggagaatatattttaaatctattttaacatatttaagtaattttaaagaattaaattctgaatacttagaactcaagtatagactcaattttttaaaaatccctgtgttcactatattaaggaataaggctctgttctcctaatcagttttctgaaggctctgttctcttaaccagtttccaacattatacttctgaagctgtatatctcaatacactgtctttgaatttctaaataagtttgtgtttcagaagaaataacgagttagtataagactgtctaaattgcccatctgcttccccatcaggcagtcttgggttttagaaacagtcaatctcaaaacattcaagctgtaaacctcatttcaacagatgttttgtgcaatgggtagcaacgattttcatatgtttcataaggcaaaacaagctggcttatgaccttaatttgcatgaatctttgcattcttctttatgtgtttggagttgaacctgccatgtctccaggacatttaggttttacatggaagcgagtaaaacaatggccactgtattccctgctgttgccatctgtgatgtaggatgagaccagttgtcttggatacattcagcctttgaaggaagctgaaataaaacaactttctaaatgattatgcactaagacattgcaattgattggctgttgaaaatcaagaccataatattgagccataataatgttagtcaacttcatagcatttctgaatgttctattaaattgtgcattaaaaatattaaagttctttgaaaaccacagactagaagaaaataattcacaacacatatatctgtcaaagttcttgtattcaaaatatataaagaaaagaaattctacaactcaataacaaaaggacaaaggacttaacttgaaaaagggcaaaagatttaggtagctcacaaagaagaaatacaacaaggccaatcaatccaaaaaata

SEQ ID NO: 33811 - DNA, 1170 bp, Bovine  19866880558796
tgcctacctgctaagttgctcagtcatgtccactctttgggaccctatggactgtggcccaccaggttcctctgatcaagggattctccaggcaagaatactggagtgggttgttgtgccctcctccagggcaccttcctgacccagggtctctttatgtctcctgcactggcaggcaggttctttaccgctagcaacacctgggaagcccttacccttttatattcatgcctttaaaacacaacaacaaaaaaacttttatcatcactttagtgggatttatgtctgggatgaagacaagaacatgtatcttttaactgggtattaaggataatattttcgatgtaaatttgttccttttttttttcctgctaggaaagccgggttagtaaagcagttgaagtgatgattcagcatgtagaaaatctgaagaggatgtatgccaaagagcatgctgaattagaagaactgaaacaggttcttttgcaaaatgaaaggtcttttaaccctcttgaagatgaaggtaatacaagtttaagataatagtatcagttacatttttctgacattctcctttttctttctctcttactaattcttattatacactgtctttagtacaacaccctttacgttaaggttgttttagaagaatataaaaagcatacaatatataaaataatacaagaagtaactcattcctgttatttatatagcccaaagtaagatgtcagcatacaaattaggagacaagtattttatggtagacaccaaaaattcattaaattgttgatatgagacagtcatatcaactcattgacccccgtgttgtcctacttagaaactggctcttttgccacacataaaacaaggccccatagtataaatgaaccactttcgccaacagtggttttgtatccctcgaagaaggaatgaccatggcagaataagctgatgagtgtcttggaaaatagtgagactactgagaccatggaaagtatctcaacagaaggcctatatatacctttactaattttattttaaatagataatataaatgttcataaacagaatgttcgttttaatgatatgttctctcttttgtaaaagtaataatgtttgggatctgatctgtaattttgggctcatttattcagcatacgttcattt

SEQ ID NO: 33812 - DNA, 667 bp, Bovine  19866880602093
ttaggatggatattatgaaattcaaaagagctatggagcaaactatctttgttttaaattatcgattttcagaaagttaggcaagttacacaataaaaattccaatataaaggtgttacaatctgagaatatgaaaatctaactgattaaaagggtaggcaacggaaagaggccaccccccgaaaagcagaataagtacagtctgcccttttagcttacctgtgtctttcagtcatagccaaagcaccatcctctatttcttcatatctgggcctttcatgcgaagcacggattaggttggccacacatgagaaaggagtcaattctagtcttggaattgctgtaaaactatccagatgcaaggcatctgcattagaagagaaaaaaataaaaatagaaattaatggttcaaaggcagatgccacaaaattcaaaatctttggagggactctccaaaaattccctctttggagatgagaccatttctgagacagcaaaaattcagttttattaatattttaacataatcccccatcccctaagatttcatgcctttcttctttcaaggaggagtgagggtggaggaggggaaacagaaagccttgcctagtaagcaactagaggtttcaacagcaacttgctgtcacaagcaaagtccagccagcca

SEQ ID NO: 33813 - DNA, 2671 bp, Bovine  19866880625768
accatatctcttacatcattacatctcttacatcttacctgcattggcaggcgggttctctacccatagcgccacctggaactacttctacacaccacccctccccaaactgctcatttcctctcttggatgccttcagcttaacatttactcattcttaaaggacactcatatatctaatagataacatttacatttacatgatataaacttctacagctctaattttgtgaaaagaagcaacaggaaagaaattctcagaaaaagaaaactgctggtcacgggagggtgcattcaacaaatcccactgaagacagacagatgtttttgtctctcttccactcatagaagatgctctcagatgatgtttcacaaagcaagtttctcatacttctctccaagtctctgcatcctctcatactttagatatatgacaacagcacgtttaacttcctccttgctgtcagttggaaaaaagtgattgggctcttattccagattccaattagaaggcaaagacttcctaatccaatagtgagataaacttcagcaccagaatgttgccagctgtttaacccctgttcagaattataaaactttacaggctggcatcttggcatcactattacctcagaggacaggggataaaaacacatcgctgtggtagattagccaccatgtcattcagtcttggcagttcggcttggtttcaaaagcacactaaaaaaaatgacgcgtctttgcaacagaatgtcaggaaagcacagtcctcagcagaatgttcaagactgcctgagaatgccttaggtgaagcaacatatgtcgctctgcatccttggcaggagatattcaaatgatatttgccccaaggacattctctcctttcaaggtcatagcacagctgtcaacaggagaacattctggacaaatctatcatctaccaacatgggaagaccatccaagtagtgaaagaaagcaatctgccagaaaacatttcctagcattccaagcacacaactggaaagtgcaaaggaacaaaaatatactagggagtcaggttccaacattgcattcacaagaaggtgtgtgactgtttccacccctgttgtaaagcactaccaacaggctggaggttttaaggcactaattcattttgctattttaaaattaaccccaaatatataaaaatgctaatttatgttcagaatataataatcagtgtcattaatttaagtctgtacaattatattctcaagcaaagaaatttcatgtttctgcataaaacaatgtaaatgaaacaagtaaatttttggtagatacatttactttgggacttgaagaaatactaaaaatagtccatgatctctaccacaatctttcagaccccaggctggggatcactgcaggtagtcctgaaaaatatcaagatagtaaagatttcttgagaattccctggcagtccagcgggtaggatcccacgctctcactgccaaggacttgggtacaaaccctccttggggaactaagatcacgcatgccatgtggccaaatatatgtgtgtgtgtgtgtgtgtgtgtgcacactgtatctgtgtgtatacaaatatatcaagatttttaaagtccagattcactgaacacacatttccataccccatgctggagtctcactatagttttcagccataacttgaaaaagattcattcttccaggataagaaactttagacttaggttccacaaactatcagtggagtccctcaaaatgtcatgggtgatcttcagcaagatacagacctttacttaatagcaagctattgcacatgctgattatttttgtaaaggtttccatttgatggtaattacctacctctgcagactgagcaagaatgagttcgcagtgtagcgattttactccttcagagtcgacacttttatgctctccactgacatttaattgcattccatttcttaaaaaaaaacaacagtagtctggtctggttaggtatgccttatgttttaagtcacaagaataagatttatttatcaccaaacggtaagcacttatgtgtgctgtataaggacgtcataaggtacgtaagactacagagagaaacagagggtagtctttgccctccaggtgctgcacacactagtgattctaggtcgttgcaaccaggtaagccatactttctttttaagaattggagccaatagttgaatttttaaatttttcactaaaaatctagatgtcttgcttttctttaaacaatcagaatacgtggtcacactgggtccatatattcttgatgtaacaactatctggagctaagcagagtaacaccccgtctttacctggctaaggtactttcgttttcacccccctaatataagcatgtgcgcttaccccactgactttactcattttgctgcttatggacttctggactagcatgttatacaaaatcagaatcaaatgataccacaaggtagagtgtgtcaggaaaaaggtaaaaacaacatgccatgcatgcactcagaaagattacttaatctcaagacatgagaaaagtaagggtgagtgagggaggttgatggaaaacgtgtgaaggaatctgtactcttaggagagaagctgagaaaacatcacaaagttacaggaggtaagaacg

SEQ ID NO: 33814 - DNA, 1832 bp, Bovine  19866880633259
atatttggtccttaaaacctaaactctttgtactttcttgactggctagttcctagtggggttgtgatattgggaaagtacttggcaaacccaaatgaaaggcaatgctattacttatattatgctacttacatttactgagttaatgaacccttgcctcctcaatattccaatggaatttctgtgtatatgtgtgagtggtggggtggcccctttctcttggctgactcagagttatggtttaaaaactacatttaaattacttaaagagagaagtgatcatcatttcatcttaatgtatgcagaacaataattctagatgatctaatgtcaatgtctcagcttacaaaccagtagaagcgtaagttgtcttcccaatggactcatggcaaatagctggtaactctatacagtctgtgaagaaagatctaacccaaacgttactaaggctgggaaccttacattccagtcactgtaacttttagtttacaaacacaaacagcaaaagccaggaaatgcaaatattaaatgtcttttagccctgggttttcaaagttgatattaatcatctatacaaatgtttcattcattaatgtaggtgagcgaagattgccatgagactattgtattagagtgtttcatttaactactccctagagaaacagtactttttaataaaacgttagattcatttaacactttggtccccctaagatcttcaaagactttatggatattggcttattaaagctcaccacagcttaggtacaagaagacctaggaagtatggccctcatttaagagatggagacaaagagaaccagaatgtgatgattcattaaggtctgacaataagcagatggcatatttcagagatgtttgggaacaaagagagagaagcctcaaagtttcctactccaggacactaagagtcccatccaaatatctgcctattgtgtcaccgccacaggttcaagagtttaaattggactgaggagtttgagaaggatgcttttccagaagaaatcctttccagtgtgattcttctgctccagaagataatgatagaagaaacctaagcccagcctgacgtgtcctcccaaataatgccacacatgtgctgtggggccatggtattctgcagatggagaggacacaattatgatggtgttaagcttctgataaaaagctttctatgctatttgttttgttctagtgttatttgtgcacatggcatcatggaaaatgaactccaaaatcagaaaaacaagccaaatcttgactatgccccctactggccacatgaaatggagttattgtaccccaagaaagttcagtttcctgatctgaaaaattgacacactgaaaactcacgtcacagcattattgtggggatcaaatgataaaatattagacatttttggaacttagtggactaaaaaaatgttatttttccttccaaaacaggagatgttctggggggcagggaggttggctgaggggaagtgagggaagaagtggttggaagtgctgtgtttttgtaactggctttgttgtttgcaaccgactccaaatttatctgggcaagatcctacatagaactctacttagttcaaaagtcaaaaactagtttagatcattagaaaagcaaagtaactcaacttgaaattttctttgttcgcattactaattgagagattatcatgaagccagtggtttggttcaactggagcttaaataaaggggaaattgtgtgccttttacccagggcttagtgtctaaaacccaaagtcaagttatgagatgcctcacacagtgatgaagccttaagt

SEQ ID NO: 33815 - DNA, 1835 bp, Bovine  19866880643848
tttaattggtaggtttaaaattagtattggtaggttttaaatgcctaattatcttcatataaatggcaccctatcatcctggtagtgttgtactcctgccttgcgctgtttattattttgcattacaattatcatgcaaagcagagaaggtgactttaagcagctcatttaaagtgctttttttttccttaagtgtaaaatctttgggaggctatttacatagatatttatcattgggtgttaaaaatcagtccaattataagtacacaaaagtttttattaggggtttaattttgaaatgtaaatggccattgtaaagtgcttgttgaaaatttcatttgtgcttgtatttttgtctgtggattaacaagccaccttgtattggaattaactacagagatgcacaaaacattcaaagatcacagaagctgtagggcaaaattgcctaaaggtgtgtggtgcgatcctgtctttggagctggacattagagatgctgtaagaaagtgctcctccagccacccaagccactagcaatggctgcaccagtgataggctccccctccatgttgcattctgttgccatggctatgatggccctaatattgtgtgctcacagcaaggttgcaattagtatttggatttagaagagaaacataatgatctcatattgaagaaacacttggttaatactattttggatctaggcattctttcaagttgttaacgagcagctctgttggtcagaaaaaaaaatccctcagccattctgtacctgcatcctcagtttctttccaaccaagttcacttacatgtgctctctgccaggttgcaaaaacacagtccttgcatacttttaaattgatagcaggcttttatatgttttccttcacaatgagtggtgatgaagccgcaatactttaatgatcaaatgaactgtatactgaagtgaagtgaagtccctcagtcatatctgactctttgtgaccccgtggactgtagcctaccaggcttctccgtccatgggattctccaggcaagaacactggagtgggttgccatttccttctccaggggatcttcccgaccctgggatcgaacccgggcctcccacattggaggcagacgctttaacctctgagccagcagggaagcccgaactgtatactaggtacccccaaaaatgcatccaagggatgaattgtaagaggtttagagtttgatccatgcacagtcaacttcatgacatacagctgttttgggtgaatttaaggtttttacttactcatgaaagaatctggagacaaaccaataggtaagaagtggattcatttaaagagaaacatactccatagagtgtgggccatctcagaagaagagggagagcctcaaaatatgacatggttggtttttaacagttgagtaattagacaggctaatgagtgggatgactatttcaattattttgaggaaggggtggtgatttccaggaattgggccattgccccttaaaattgagcttttatggtcagaactgtcatggcactggtgggtgtgttatttagtatgttatttagtatgtcttattgcaataagcataggtctacaggaagtggaatcttctgccatcttggacccagttggttctaatcagtctttgtcacatccgttggttctgtcgttcttttaaacattgttcccttcccccttccctcctttttcataactgtggatcaccagccaatgagaagggcttatcattttttgaagcagagattagtttctccatggtattcagtgatcatctagtctgggtctttttacttggttgtttatt

SEQ ID NO: 33816 - DNA, 1307 bp, Bovine  19866880715566
aactgagaattcccgcacacagtacccacaccatggctcacctttttatctgaaggcgcagttcagtacagtcctctgataactctctgtttgcttcctccaagttttccaatgccaatttcaatttattattttcctcttccaatttctgcttgttgaaatgcatgtctgctatataggtaatcaaatcaggcacctctctgcggggaaaaggatgaatgggcataaacttcaacatcactaatcccttccagtcaaagtaaggcttatggttaagcccaaacaagcttaaatattcctgtgaggacttccctgtcggtccagtagttaacaatccatctgtcagtgtaggggacacaggttcaatacctggtctgggaagattccacatgctgcagagaaaccaagccttgtaggccacaactgccgaagccctcccaggctaggccccgcatgccacaacttactgagttcttatgctgtaactactgaagcccactgcctagagcctttgctgtgtgaaagaaagaaaccaccacaacaaagaatagcctccaactgccacgactaggaaaaacccacatgcagcaatgaagatccagcacaaccaaaaataaacaaataaagaagattttctactttattttcattcatcctcataaacatagttcacatacacagtatttattcaagcacttattacaataacaccaaagatttttccaaaattgccagatatttagcatctgccacttgtgaaatcaacttttacagctttcatttcttcctcttcactttgctcccaacttctatctctatcgacactgaagagttcctacttctgcctgggttatggaaaatcctgaaataaattgacactggatgctttcaatcagaaatcttggccggtttcaacaggcctttaactaggaaataattcctagagttttatcattgtagcctgtagctcacaatttagtactcatggttcctagtattttctacagcttgttaatatttgtagctgtcacgcttgccctgacatttgatcctaaaccctttgagagtctgaactgtgtttttcaaagagtaccaggcctcctcttctttgccatcttttcctagactttagcataggttggctacacggttcctagtccacactttttgcacagataaacctgaagtggcaaagataaaataaggaaggacaggttcagtgcttcaattctgagcttccaaagcagagacttgggttcaatccctggtcggggaactaagatcccacaagccacatgttggctcag

SEQ ID NO: 33817 - DNA, 1091 bp, Bovine  19866880749054
ttgagtcttaagcaggtttggctgggaagaagcactgatttctgtttaagtgttctgtgtgaccctcccaactctcccctcttcagccccaaagggagaactttggaagcttgggtctgaattcctccagactccaccttctgtgtcttttccccttgccgggcctgctgtgtattactgtgctgtaataagtgatagctatgattacactgcctctgtggtaatgagcccttctccatgtgggtggtcctgggacaccagaaataccatccattgtatttttcgtgtcttaaaagttttgagtctttttcgtgccatccacatctccttttaacaagctaaatcttttctctaccttcttgaacatttggaatataattattataattgttttaatgttcatgtctgcaaattttatcatctgtgtcatttctgggactcttttccttgaatgattgtttttttcctcctcatcaggagctgtattttcctgccttttggcatacttattaggtttttattggatgctggatatggcaaatttttcttgttgcttattggatattgcagtaccactttaaatattcttaaactttccccccttgcagttaggttgcttgaaaatagtttgatgcttttgaggacccttttgagccttgttaggcaggaccagagcagcctttaggtcattactaggtgctgctcttctgctgtcttctctgtctgatgccttgcatattagggcatttttccactctggctggtgggaacacaaagtccttctagtcctgtgtgagtcccagggatggtcctgccagtttcttgaggtggtcctttcctttttttttaattttactgatttatttatggctctgcgggatcttcgttgctgcacaggcttttcacttgttgtggtgtgatggcttctattgcagtggcttctcttgttatggtacacgggctctaaagcgtgcaggcttcagtagttacggcacatggggctcagttgctctgaaacctggagggatcttcccaacacaggaatcgaacctgggtctcctgcatctcaggcagattcttaaccatctgag

SEQ ID NO: 33818 - DNA, 1867 bp, Bovine  19866880774689
actgtttgaactatattgcctttaactgatttatatttgttcttaaatactctatatgaccaaatttttttaaaaaacatttttttatatttcttacaaactgctatcaaattctaattaaagatatgttggggaagagtgtaatttcctcagttctgtctgccacagcaaagatttgaaacagctggccagtgtcatagctcagttacagttcagagttttatttggcaagcaaggaaagtacacccctgaggcgtgaaggcagactgaccccataggagtggcctcaatccatcctggcttcctccttttatatgtttgtctcttcccccttgagcttgccctatgaaaatcaggctagccaagaagggggtgtgtttgtttcacctgaagttctcacaccagtccacaaattttcttttgttccactttcacaggtttttcagtttgtcttttatttttttttttctttctaccaaaaaactaaatatgatttattttgtacttaacactttaacatttatgtattcgacatataacatataacatgtcatttccatttggttgatatgatatcaccatctttttagaattattactttaattcccagacactcttcaaataaatcattcctccaacaaactacaatcagagtatctctaatgacttggcagtccatggaaattaaagacaacatgaggtaaatatagacaaagtcagaatcaatcacaaattctagtaaagaagtttcataatatagaaacaaagaaggtacacttctatagaagctaaatgttcattcattccttactatgggccaggctgggggatgcaaagatctataaggcacaagaccctcagtcctgtagtgaagcctgcccacgaattaaacacaatctggagacagcaggggtggtcttgttgatgtaccaatggagcctggtgcagactgtgatatcaggaaggaggagagattctccctaagaggacttaggggacctggaagaaatgtaagggaaagaaatccagtttctctaagttttgatttataaacaacaacaacaacacacttttctgagaatggagatgtggcccgggaaatggtacctatgaaatgtactcagattagctttcaaacacaaagacactcattggttgagaagcagaacataacttatgctaaagaataaacattaaaaaaaaaaaattttgagtgaagccctaagggaggcactaagattatggaggaaaattctacaattatatggcttccataatcaactctctagagaaggtaaggaaaacttctaggagcaagtttagaaacgatcattggacgattgcgattcgtcttctctggcatgaggaaataatcgccctggtaacgcagatattatgaacaacagcacaactaaaatcaggtagccaaagacatttcccataattcaaatgcacagtctgtcccaagtgcacacgtcccgttcctgtccattcaggctaccgtgattgtccagtcgctctcttctcttccgtactacaagaaaagcaagaagacaggtttcagtgtaaaagctaacagcacaggaacagcttataaataaacttaatgatataaccaacgttgaacaaacggttcatttctgttttgtacattaaaagcaggttcatattgaaaataagactatgtataaagaaacagtcaaatacctgggaagaatcatagattgtataattattgttgagctcaaatttagagctggtataggttccttacatatgccttttcattgctattctgtatttagtttctcagatcatgtcccgttttcgcttgactcgcctctttagtactaatataacttcagt

SEQ ID NO: 33819 - DNA, 2844 bp, Bovine  19866880820491
caattaaaataacaagtgtactaaaactatccatttattgtttatttgaaactgaaaatcaaatttatatgtatatatgtgtacatacatacaccacacatttaggaggaaaaaatacatatatatatatataaaatacatatatatatatatatatgtgtgtgtaatctggcagccctagttagtggcatattttttatagttttgtcaaagtttccagtacactgaatgtcaaatcctaaccttttatctaagaataaactcacttattttgttctttggaggctagttattctcagaataagtgaactgcataaactaagaagaataaaagacattttcaaccaaagaccaatgactgaagatgaaagaatgaacaaaattcagtgattgtatcagaaacaatgaacatgagagcccggaatctacagtgccttggaggtgatgcagaagggaggagaaagttgtctaaagatctagataggaagaagggttgggaaataacttaaatgtgggaagagatagtggagggaagttttttttttttaaagcaaaagaaatttaaacatggaaaaaatgaaaagttgataaaactaaacagataaaaagcaaaagatgaagaaatagaatgaggattgaggaagtatgaggaatagcagacacacaaacatacatacaaggacaaaagcctgattcccgggatggtgccacaggagtaagttctagggaaggatcatgggctaagaataaaagtctttttaaaataaattaaaattatatacaatagattatctttcaacctttaagaagaaggaaattctgcaatgtgggacgacatgggcaaaccttgaggatattatgctatgtgaaataagcctgtcataaaaagataaatactgtatgaatcagctcatatgaggcatctgaaatagtcgaattcatagagtcagagtggaatggtggttgccagaggctgacgggaggaagaaaagaggggttactaatcaacaggtataaagtttcatttaagggagatgagtaagttctagacatctgtcaaacaacaaggtacctatcaatcatataattgatatgatcaacaattgataagatcaacaatactatattgcacacttagcaattagatctcttaccaaaatatactaaaatatgtttaccaaaatatataaaataaaaaatattatagatcatgaaaattatacactggagaataaaaatgtcaagttgataacattactacctgtatttgtatggtagctcttcctgaattctttcagacacttttttcccttctctaactacacagggaagaacacagtataccaaacatgtggcttgcctggtggctcagtggttaagaacccacctgtgtacaggagaccaaggttcgatccctgggccagaagattccctgaagcagaaaatggcaacccactcctgtattcttgcctgggaaatcccacggacagaggagcctggtgggctacagttcatggggtcacaaaagagtcagacacaacttagtgattaaacaacagcaacaacaaaatacacgggttgaataccaactgtcatctctggctttttgtggactgggagacttgtttttccttactataggaagtattgaggcatgagatgggcatagataagtaacacttttaactgatctacttcaaaatcctgtgacttttctccaacatcttagataactgcttgttggatagttttgtaagacaacaacttgtttccccaactagttctctgcctcgttcaatagcttcttggtcataccatactaacaaatcagaatttcttttaatttagaatatattgaaaacacattttgcttataattctcattcttgacatgtattttgtaaagtgtgtgaggggcagagggaggagaaatattattattttgtttctaaaactaatgaaaaacaaagaaaacctgccctgatggtccaagtttgttttcagttcaacttcaaagagggaaaacctgcttttctaggaacctgcaggagggctgctcaactgtcctgccttgaaaacttgtctgccacataaatcagttgtgttggcagagagcatttccctgaaagaaactaccattttcctcttgtcttccacttatctttaatgcataacatttaccaaacccagctagggtgaagaattctgggctacatacccttatacttatatacattattaattgtatgtccaaaaaagtaggactgaagtttttatggtaacctagagggtggttcctagaggcaaaccaaaaggctttgtcttgtctagttaatctttttggttagagacttagatgatgatattaaaaagttacttatcaaatttgcatttgagcatgattttgcgagttgagaaattccatgtatgatggagttaagagttaagatccacacaccaaaaaaagctccaacatgtgcgaagaagggtcaaatctaacaacatgaaacttaattgatataaatttggaacttaacacttgggtgtccctggccttcccttcaattccttgcctattccttcggttcccttcccatcccttctcttttgtcttctctccctctctctctctctctctctctctctcacatacacacacacacccctgcattcctgtcagctaaggaaagcctgacttattggtgacggtgtaacaaagatttatgaattttatttcaataaaaaccagcagtatgatttggctgctgagaaagctaatgcacctttgaatgtggtaatagacctataaaggtttgagtgaggaaagtgattgtcctgctccgg

SEQ ID NO: 33820 - DNA, 2553 bp, Bovine  19866880846539
cgttcagatagttacactttgatgtctcatagtctcataggtaacttcaaattcaacaagtcccacactgaactcaccatcccaacctctgccccctcttcatcaccatcaaagtaaaacaaaagttgttctgccaccactgttccttatcttagtaaaagaataccatctaatcctctttttaaacctgggtagttaatacagagctgttcgttttacttttattcttttaaaattatacagattattttctgccagagggcggtccactggttaggatgccacgttttcactgccatgggtgtgggttcagttcctggttggggaaataagattctgcaagctgcacagtgtgaccaaaaataaatgaataaaaaatttaattaaaatttaaaccacagagtattttgtagcaaatagaacttggaaaatattttgttccttccttttactaaatatcaaaaacaaagtccaatttttcccattgttgttatgactaggtctttttagagctgggactagaaacccagacctcctaacttttattctgataatttttctctaaaactcactgtgccatattaactcaattattttgaaacattcgagtaaagcagcagccaagtgattatgaatttgtcattatctctattattcctcagaatgatattactttgttgaaaacatcatttaaatatctaaaaagtaataaatatgaaattatttttgaaagtattagtttttaaatacatattttaaattttttacaatgttgtgttggcttctgccatctaacaacacaaatcagccataattatgcatacatatccgcttcccttgtggctcagctggtaaaaaatctgcctgcaatgcaggaggcctgggtttgatccctgggtaaagaagattcccctggagaagggaaaggctacccactccagtattctggcctggagaattccatgccctgtatactccatggtgttacaaagagtcagacacaactgagcgactttcactttcactctccctccctagcctctctccccttcccccatcccatccctctaggtcatcatagagcaccagactgggctccctgttgctacacaggaacttctcaccagctacccatcttacacctgatagtgtatatatgttgatgctactttcacagttcacacaaaataaattttttaaaagcttcagactgtcccgtagaaagtacctatcacttctactttttggtggggagggaggctgagtgagtgaaaaaaagaggaagaccctgatatctagtcagtgtgtatttatactagacatcctgttatggatgacctttatatgtattaacatttaatcttcagcccaatcctattaagtgataaaaataatttcactgttgatatactgagaccttacaaggctaagtaacttgcctaagataaacaacaggtctcagaattaaaccctaactggctgagctcctaagatgggttttgtttttttttttttctaagatgggtttttataagtacgccatgctgtaatgcaacaggcatctgcttggtcatgtgactctaatgtcttcagacctatagcatcacccatggcaataccttggattcttcttgaggtttgcccatatatagagagtaacattttcatcttgaatgactttttccatatttccactgtccagatctgctaaagtgctagcttgctgtaagaaaaaaagaaaacattattaagattagaggcctcacaaattatacaatttaggtaagttatttcatcagttaggtgttggattcccttcaatacttaaaaaagtaatttgggtaaaaataaggttcaataaaaataacaaagaattgttttaaataattctctaaatgatacaaatgcatttactcagttaaatgtgttcccccttttctactcagtttctcttaaggtgtctaaggatggttcagttcagttcagtcgctcagtcgtgtccgactctgtgactccatgaattgcagcacgccaggcttccctgtccatcaccaactcccggagtgctcctatattcccagatagctcttgcagattgcttttagattacccttttcaattttaacattatcatgacttctcattttaactgtatatcctaatcttaactttatccttaccttatgctactgcaaaagttagcctattcctgaacacaccaagtttacaaaatatacctatgagttctgtgttttactaatctaatacctgataatcaacataccatttaaggatattctttagaattctttaataaacactaaaatagattcatgcctcttgcttaagacattagttctttaaaaggacttaaataagtcaatatgtattcagctcctataatgtaaaaacttaaaagtactgggaattgaatttattgctatttgttttcaaagtaattgttctgtgagttccctggcagtggttaggacttcacgaagaggggcacagattcaatcccgggggagaactaagatcccacaagtcattcag

SEQ ID NO: 33821 - DNA, 904 bp, Bovine  19866880888132
tcccattagtgcttgaatttgggaagtcagatgaatcctgctgtcattgcttgtaaactcttccatctccccccaaatgatttctctgtcaaaaacaagctgcgttcgtaggctctgttttcctcctgttgagcaatctggagctcattctggctcttgtaagcttgtttgtggttgcagaggaaaatgaatatttctcacccaaatgttgtcatgtcatcatctctgtctggcaaccagagaagcagatgttctgttccttgacctcaggctagtggttacagatttgggtgttacatatgtttcacaaaactgcatttgcccacgcagggccactgttttcattgaactctatgcagtcttaggagaagggcatggcaacccatttcagtatttttgcctggaggatcccatggacaaaggagcctggtgggctacagtccatgaagtcacaaagagttggacgcgactgaatgacttagcacatggtcttagagcccagcaagctttaggagaggtccggtttggggacactagaattgtttgtttatatgtgtggggtgtatgtgtgcatacacatgtagatccatacatccatatatccagcttgcttgctattgcaaaacacgtgtttatcttgagatcaaagtagcccccaaaacattgccaaaaacaaattttcttcttttgaaacagtggttttcagcagatgattttttgactcaaaattcaaagaaatcatactgctataccctaacaaagaggattttttttttttaactcaaaaacatgtattacatatcactccaggccaggcatcttattgagttttggggacacaggagtaaacataaagtcttggcattccagaaagctgtgttgttgttggggacgtctcatgtgg

SEQ ID NO: 33822 - DNA, 1389 bp, Bovine  19866880910097
tttgcatttttaaaaagatcattctggctgtggtttggaaaatggaatgaataggtcatcagttctgtagtgattagagtagtctaaataagaagcgttgtccttgtctccaaacctattcttccatttttcagggccttatcctgctacaagtctaaacgggtccttgaaatacttgaggaaaagcagaacctaaattcatcatacatataaatctttcagtatccccaaagaccaggaatagtattttctatagtgtactttgcttaccatttttccttttgtatttgtatttatattcacagttccagcacgtcatgttttcaagacaataggaaaaaagggaaaggcattcttttaagcctgtaccacactattgattttctttgaaaggacaacaagtgtgtttattttatcactgtgagtctaaaaattaaccatgaaacatcattttctacttctaaactaagtgtaacaaagaaatgctttattgcaacttcatcaataattcaaatgcaacttaaaagaaactagggcagcacaaggaaaaaaagcacacttgttccataattgagtcgattaaatagtattgagtcccattgtcatattcatattgatgaaacaactttcataactgcagagactctaataagaaataagacctcagaattatgagacaatgtcatagacatttctgtattattttttttctactgtaaaatacaaatagcgaaagcaagcttttccttgtgtgcgataatgaagaaacagcttttgaaaggtgctcttattgggattttagtagttttcaaggctgtgcagtaatagcccaagctattttggaactgtgcatacattagtgttcttgtgcagcaagatacactaatgtgtgaaaaagtatacgatcgcaccttgtttaattttgcagtttttgtgcataatcccacagtaagctcttgtcaggatttgactgcacagaggagtagaaagtttagagcaggctacagattggggtcaggtgtaaatatccaactatgaaaataagaaattttaaaaattacatttttttgaaagatcaaaagagttcagtttatatgatatgtataaatcaacttatggtgagtttcgcccgtggaagcttcagaatatgcataaataaccttccgaatgaagatgtatatctgctttattttgtatttgcagagtgtgagtgaaaagtacggagtgtgatttttaaagacaatgatcacattataatttatgcattcatattaatgttgtttttcaaaattgtcacccagagaagcagaaccctgattccattgatgcccttgttcaaaacattttggaaaacttcctccccgaattgtcttttgaatcatttgcaag

SEQ ID NO: 33823 - DNA, 1078 bp, Bovine  19866880997308
atttgacttggatattctttgcatcgggtccttttcctatattctctactgctgccatacgtgattttcagtccctttccttccgtctctccctcctccctttcctcaccgtccctcctccctcctccacttagcatgagacagaccaggactcattactctctactcgctgggcccatagttatagcttattaagtgcctgggaagtttttacttcctgtgtgtattgttaccttgggaaaatgcaaaagaaaaagagtaaatttacaggtcttgatttcaacctatgacaaactcctcacatataatttgcaccccattaattaaaagtgtttttatcattgctttcaatgtggcctattaaaccataaagagaactacatgcaggagctagaattctcaaagggtgaagtacaagcaacaggaagagatgtcctgataaaaagacagagacgggcaatgcattcaggctagtgtgtgcaagggaaaacatctgagcattcaagaatggaaccatgggacttccctcatggtccagtggctaagactctgtgctccaattgtagggggctgggattccatccctggtcagggaactagatcccacatgccataactaagatcctgcacaccacaactaagacccagcacagccaaatgaataaatagatatttttttaaaaaatggatggaaccacactttgtagtacgcattatctttttctttaaagatacaatctttgcattcaagaacaaaatacatgtgtatgtatacatgtatgtgtatgcacatatacaagaccagcttagtgaataactaaactataccattgtactgttgcttcccttgtggctcagctggtaaagagtctgcctgaaatgcaggagacctgagttccatctccgggttgggaagatcccctggagaagggaaaggctacccactccagtattctggcctggagaattccatgaactgtatagtccatggggtcgcaaagagttggacacaactgagtgactttcactttcattgttgcacaggactccagacttagaagaatctgcactcggttta

SEQ ID NO: 33824 - DNA, 1105 bp, Bovine  19866881045471
tttgtttgtttgtattttccagtttgttctgtattttccagtctcctgtaaatgtattatcatactttcatacttttaaaaagaataaagaaaaaagcataaaaaaaaataaataaagtcatttatcaactaaatagtagaggccagagctcctactctttcatcaccatttaaatgatacacaactacacagcttccacagtctccttaaccagaataagttttttatactattaatactttgttgctcataggaactaaaatgtactggtatagctgcaaaatggtttttaaagtttggaaaggactttcttctctttttagcaatgaatgagaatggaggtttctcctcatccttgccaacattggctgttattttttttttttaatgtttgaggttttaaaacttctttgaacttatttttatttggaggacaattgctttacaagtgttggtttattctgtacaacaatatgaatcagtcataaacatacatatattctctccctcttgaacctccctcccacccccacctccatcccacccctctaggttgtcacagagcatttctgtaagtattctaactgactctgaatttcagtcactcttacccatcaactaggataggatgaggatataaaaggtaggatgaaggcaaaaagtaaagatgtgctatttctctgtttctcattcttagaaagtttatcatacaacagagatgacaaaaattgatggctccaaaagcaacataaatatttaacagaaaattaatcattacagatatatgaaaaaattccatgatctgatggcttctaaagatgtatctacaaattattttagctttctttttctgcaaagaaggcaaatttgcaatatctctatatactcacctttagatgttgaatcgactgcctattgctttcgtaactcagatgtcctgttttttcttgatctctgcaaaccccaaaaaaggctcgaggttaggcagatgggcaagatcctatatgccaagcattattttttccacattaaaataaaccctggaataaactaacaaccaaaggattattttcattgaaggaaaaaatctaaggtataaggaca

SEQ ID NO: 33825 - DNA, 683 bp, Bovine  19866881067353
cccgggagctgtcagaacacacacaaatcagcccccacagctcctgctcggggcattaccttcggagtttcttcctatgggtatgagactccggggaggcttgttctcgccttcctgcgccgtctccacggtcgcagacttagcagtcaaagcccagccgccaagccttgttgagacccctctaaacatcaatctccggttcttgggcattgggatttggggctttaggcacacaaaaccaaaccacttcaaccaccccagaggcagagatgagagcgcctcaaaactttttctccccctcacccacctccccaccggtcaaggagtaggtgggtgcggagtgccgtcggcggggacccgcgggcgcagagcggctcttcgggggagcagtggtctctttaaaaaccaaaccactcgccgctccagcctcggcgctgggcggacggcggctcgcctcccagaaggttccgcggacagccgcagacccccacgcgcgccctccgcgccggctttcccgcgtgcaaacgggagtggggggcgccaaggggcccaggtgatgcttccaggacagcgggtgaggttccagcgcagggaagaagttgacaaaggagacttgactaaacacgaatgcatatttatagacgcgagctccatcaagatctagagatagtctccttctccct

SEQ ID NO: 33826 - DNA, 2195 bp, Bovine  19866881163710
ctgctctgagtccgacacgactgaatacttactttacacataaaggcaacccactccagggttcttgcctagagaatcccagggacggaggagcctggtaggctgccgtctatggggttgcacagagttggacaggactgaagtgacttagcagcagcagtagtagcagctctaagtctgggcttcctgggtggcgctagtggtaaagaacccacccaccaatgcaggagacataaaagattcaggttctatccctgcgtcgggaagatcccctggaggagggcatggcaacccactccagtattcttgcctggagaatcccatggacagaggagcctggcaagctatagtccagagggtcaaaaagagtcggacacgactaaagggacttaacaaacccactctaagtccagggtcaagaaaagcttgttagggaggaggtggctgcttaggagcaatggtagaaagactagtcgtgcatatacttacattacaatagatgaaaaaagttaggagagagaaaatatgtgaggtgaggcaggggtgtggggtgcacagaacagagagtgggatgcaggtctcggcaatctccagcctagatgataactgagacacgtgacagattacatttctgctcatgccagaattttcatagtcagcacagaagtgctatataaagctttcccctcttctatattatagtccttttaagatttacggagcaccagctatagggagaacactgtgttagcagctgtcagagaaaacaggagcttatcatgtacttgaaattggacaaaatacatctgtgatttacattgaagggtgactacaaagcaacatagaaataagtgcaaattcattcagtaacgaaaactcactgtgtccatcatgtgctgctgctgcgaagtcgagtcagtcgtgtctgactctgtgcggccccaaagacggcaggctaccccatcagactaccccatcaggctaccccatccctgggattctccaggcaagaacactggagtggggtgccattgccttctccaatgcatgaaactgaaaagtgaaagtgacttcgctcactcgtgtccaactcttcgtgaccccgtggactgtagcccaccaggctcctccgtccatgggatttcccaggcaagagtactggagtggggtgccattgccttctagaatctccagggtgtggtatatcagaaggtgatgtgggtaaatttaaaagcagattttgttaagactacagagacttttgaggtattctgtctaaagaaggatttagattcacacagttcagaagcagggtaacatcagttattcaacattccatgcacttattgagtgtctattgtttttgtagtggtaagtaaagcagacaaaaaatccctccccttatggagcttatattctgataggagagagacaagaaagcaaaataaactgtatgttgtgttagaacaagtggtaaatgctctggttccttggtggctcagacggtaaagaatctgcctgcaatgcaggagacctgtgtttgatccctgggttggaaagatcccctggagaagggaatggctacccactctagtgttcctgcctggaggattccacggacagaggaatgtgttgggctacagtccatgggatcccaaagagtcggacatgactgagttgctaatacttaaaagagatgcagtaccaggtgatctttcgggaaattcattagaagacatttgaacaaagatttacaagtgttaaagaaggctttttggatatattgtattgtgcttagttgctcaattgcttctggctctttgtgaccccatggactgtagctctccaggctcctctgtcttattggagtggcttgtcatgccctcctccaggggatcttcccaacccagggattaaacccaggtttcccgcattacgggcggattctttaccagctgaaccaccacgcagtgtgttccagataaaaaggcagcaaaagtgcaaattccctgaagaagcctgcctgcattttcaaaaaagcagccaggaaccagcatgtatctttggaagtgaggaagacagattatttattggataagagcttagaaaggaaagggagtaagggtgtcaaataatttaaggccatggaggacgtggagaagatgtttgttctatgttaagcatgacggcagcca

SEQ ID NO: 33827 - DNA, 855 bp, Bovine  19866881170457
ttgagatgccaaatccctagctttgtttccagcaaaactatggtcggagcggcagcatttcctccccttctccagaaaccgagctgggaagtgggtaaaaactatttactacggaacgtgctacgacgcttctccacgccccacacccccacagggaaaggaccggcagcgaccgccccgccacctcactcgcgccgggccaactgcagctccgcggccgctgccaccgcccagccgagcccggggagactcccaagggctctttaaatacgatctataaatactacaggcgctcggcgcgcgcgtcacggcaaaaccggcctccgattggctgtcgtaaccccgctatttgcatagccggattgctcaaccgggcggcgacctcagccgagcgtgcccctcccccgcagcgggcgcgagggccgctcggggccggcgggcggggaccgctgggtggcggccgcgcggcttcgcgacgagtgcgaagcggtggtggcgacgtccagagtgacttgaactccggaacatctcgagtcttgagtcatgcggcggtcttccgggaggccggccgcctcccagaaggatcaactttgcgcacccgaaggccggcgcctttagaccgggtcattttgcttttcaaacacagaaagaaaaagtttgaagggtttcacccgaacagatgcgctgggtggctcgcggaggcatcacgtgagaccttggacacgcagccagagccctgtccaatgacttgcgtcttggggtgttcaaaaaaggcttttttgcatgatcactagtcagacctcgttagtttgaaaaccaaaccaggagtgttctggaaatgaaagaggtttaaag

SEQ ID NO: 33828 - DNA, 2214 bp, Bovine  19866881201576
acagagcagccttgttcattgtcagaagaggctataggagagcataaccccaaggaagtgagaatccctgggggcatgcctggaacctggctacatggcttgtactgtaaagccttccagataatttttgaatgttatcagaatgcaaaggcattactttcttttcaaacataatgcatttgtattatacattaaatatttttatattatatatatgtaatcattatatatttagtatgtaatatgatatacatttggagaaggcaatggcaccccactccagtactcttgcctggaaaatcccatggacggaggagcctggtgggctgtatagtccacggggtcgctaagagttggacacgactgagcgacttcattttcacttttcactttcatgcattggagaaggaaatggcaacccactccagtattcttgcctggagaatcccagagacaggggagcctggtgggctgccatctatgggggtcgcacagagttggacatgactgaagcgacttggcagtagcagcaaaatgatatacattatatattatatagtatattatatatgtgtgtgttcatgctcagtcatgtctgactctttgccaccccatgtgctgtagcccgccagcctcctctgtccagaggacttggcaagcatactggagtgagttgtcgtttcctcttccaagggatcttcccagatcaggggttgaattcacagctcctgcattggcatgtggattctttacccctaagccacctgggaatcccttgtatcttatatataatgtgaatcatattacatatatatgtaatacatatatgtaatattacgcatatatacacacaaatatgtaatctctccagcgaacagcaaaggcctggtgaaaatacatacctattttagattccaagacaattaatgatctattcattgagaatatgccattcgcctaaaattatgctaggaacatatgttaaggggatgtggcagaagtgacagagtcatctcagaattttatctcaaggatatctttgtaacattgtttaagaacgatgtcctctgctaaaagttaggcaaggaattcaaccccagtcctcagggttatgcctgtagctccaaattctttagagagaattccggttttctcctgatcctgaaagaaaacagaatgcctcctattagaaacagggacagtttgtccaaacatagggttcctaggtggctcagtggtaaagaatctgcctgccaatgagagagatacaagttcgatccctggaggtggaaatggcaacccattccagtattcttggatggagaatcccttggacagagggacctggtgagctatagtcagtggggttgcaaaaagttggacatgactaacacacacacattaatagcagatatagaatgatatgtcaccttctcacaaggaaatgtagattctggacatgctttgttttgagtgctggtatgcatccagcatgtagtagagacgttggaattttcctatttttctacatttgctcatgagagaaaaggaaggtacacatcaaactgttaacagagggcatataaacagttatctactccccacctttctcctcttatggaaacaagccacactccctgataaaccactgtcttcttgctcttgtcagttgttccaaatggaagctgccattttcttttcaattctatctcttgggctgcaggaattgcttaaccgtactgccctagagtccctggccaaagtgattagttcagagattagactgtgactcaaatcaaacaaatcaacgtgcttgctgagggttttttgtaactggctactgttaagaggagaaagacttcatctctttccattcacagatgattcttgaactgccagggcccaatttcattcccaatggaaaagaatctgtctatgggaacagaggcttccctggtggctcagatggtaaagaatctgcttgcaatgtgggagacccaggttccatcactgggtctggaagatcccctggagaaggaaatggcaaccaactctagtattcttgcctggagaatttcatggacagaggagcctagtgggctacagtccatagggtcacaaagagtccgacactactgagtacctaacactttcactttcagtacctatattcttgtaattggtgcagggaatgggcatgtgactcaaaccagg

SEQ ID NO: 33829 - DNA, 1557 bp, Bovine  19866881203971
aatacagaagcaatatgttattttttctttagcatattcatgtaatgcttatctcataagaaaacaattttcaccatcatatgccaatttttataactattctgcatatagtccatacaaaacaaatgttactatattgtttatttcaaacatttactttagccaaattataaaatcataaggttcccaaagaggcatcataaaattatacttaccaactgcttgacctcctactaaatcggtcattattttccatcccagccaactttaaagttcagacattaaggaaataataaaatacaaatttagtgaagtttatacttttgtgatatgaaaattaatttgcttctgactaagaacacttaggaatttgcttaccattcctgcatttccaatatttctgggcaaagaggcaatggtcactcttcgaagggaagatggctacccaaagggaagaaatgtacatttagaaaattctcaatattttatccttgtatgaaacactgatgggtattcttgtatgtacacatccatgtacttgaccattgctgagttaaacaggagacatattttcaaggtttttgttatggccaaatttcctttcagaaatattttgccaacttgtattcaactttctccaacactggataatcttttccagtcaagtaaggaatacagggttttctgtttaggtttatagtaactctgaacaccatttttctatgttgaataactgtgtatctgatctgagaaccacctgtttatgatttttgctcatattaattttgcaaaagatacttcttggcaaaaaacttttttattgttaatgcagccaaatcttttcctcacttttgctgccatttcttttatgcttggaaaaatttcctcaaatcaagaggagataaatatgcatctatttaagagctttcttttttcatggtttcatttttttccatttaacacatataagggtaagtatgacattttaatgaatggatgttttttataccttagccttgagatttacacaggaaaatgttatgtcatattttgtgactcttaaagttgaaataagtgggactacaggaaataaaaatatggtaaatataggaaaataaatgagaatttttatgtgaattcttttcttaaaccatcatccctaatttaattttataggttagctgaacatcaagcaaatcaaattgtggtccaggaatctgggttctaatcatggttctatcacgataggatcataactaaacatataatttctgtgaaagtgattttgttcatctgtgcaaaagatcaatttagatggaatgatttttaaactcacttgctcaaaaattctgtgaaatcctgatttttaaactgacaaaaactgctggttgactttcaatatcccattttccaaccccccccctcctttttttagtaacagacctcttgatttttcagttatacatacagcctccagaataaaagctctgttttcatcttgtttccaagcaaaaatgaaaaggggaaatgttagctgggacttctagggagtgtctt

SEQ ID NO: 33830 - DNA, 1412 bp, Bovine  19866881214158
ttcaaaagcatcagttcttcgttgctcagctttctttatagtctaactctcacatccaaacatgactactggaaaaaccatagctttgactagatggacctttgttggcaaagtaatatctctgctttttaatatgctgtgtaggttggtcatagcttttcttccaaggagcaagcatcttttaatttcatggctacagtcaccatctgcagtgattttggagcccaaaataataaattctgtcactgtttccattatttcccatctatttttcatgaagagatgggactggatgccattccctatatctatatatttgttctattccgtatatctatattccatttcctatatctatatatttacatctatatccagatatatattcctacagcatatttctgagtttacattagataaatgtaatataaaataatattagagattatccaaacaagttatttcactaattttatttatttctcctattgtttgacttatgacccattgtcctcctttctagaatgagtgtcattattattattgcctgaattgccttgttgcccctattcaaggtcttgattcaacacttttcaatcatctctctgatctaaaactataaagcaataattaaaagcctctgatgcatagcaacatctataaacaaacatggtttcttatctaaagtaaggttattttcatcagtgatgtaactagagtcccacactaacctatctgtttggacttcctaaagaagtcttcaatagattagaataaattcaccatgtatgtataatatagataatatctcctcttccataggaacttataatattagagcataatttgtgttttcaatatccatattcttcaataactaagaaacagttggatttcttctcaaagaaagacattaagatttatacagagatacaaaaatagcatccttgaagaattttaggaagccttctgaatcaaactctgactcaagaaagattatgtggataatgtaattatcttttcttcaccaaccatttaaattttttctccctttattaatagttattgcttgaacattgaacttcaaaacttaagatcaagtaggcttaagaatcatttgttacttaattatgaaatccttcatgactcacccaagtgagtcccacttggtggcttaattaatgtaaagcccttaattaatgtatgtaaaaaatagaagtatatatgtagatagataaaaaaggggttccttttaccaaaagagtccttcagtaacaatcagacgccagtaaactcttcatcaacacataagaagaaacatctgttcactgagatgttcccgggaaactcatctttagcagcccagtgggagagcagagcatggatttctactcaatcagtaaattttattt

SEQ ID NO: 33831 - DNA, 702 bp, Bovine  19866881230552
tcctgatttaatgtgcaaaggcatgattctgctagccatcagggtacagtggagatgcggctgataaagtgaaggaggaaaagtcaagacagaattctaagaaatggtatgcacttgttccagagcagctcccagtccaagaggaaagtaatgagaccgcctgtgccagatacatgtgacaggctgccaacacggcgtactgacagcgggcatcacaagaacgtccatgcacatcgcagtcagcccctgctaccacccatcaaacaacttcagctttcagtagccatgaagggcacccgggaatcccagcagacatccaaaatgagggcaggttctaacccagaatgggaatggacccgaaactgcagagaatacagtgtcggattcagcagaggggctctccaaacattcagtttgtcaatctttttaacaagtgacatggaagcaaccagcactcactatttggggaaaactatgccaaaagcctcacagtaagcagtccttatcctgggcacagattccctagagggggcactcatcagaggaatgtgtcaaaaattagctccctcttcctgcctcccatcctccctggattctgaagttgtcccagtgccagtttcccacagtacaatacacataaccacctaaaactcaggggcaagacaccagtgatctcattatcccaagatgctaaatcaatgt

SEQ ID NO: 33832 - DNA, 1533 bp, Bovine  19866881240118
attaaaagaatatgagatgatttacaatgatagataatcgtttcatgccactgaattttaaatcgacacctgggttaggcacggcgagtagaatgtgaagccaagcacattccaggaaacagtagtgttggcttttaatattcataaagtttttcaatcgaagctgtacaatatgttctatcgcaggtgacactttgggagattatgtcagatgatggaaaatcagcaggtgcgtgactatcagtgtgccaaaggaggtgggacataggtatgtcattcatttctaaaagaaggactgcaaaatgtatattcaaatgggatatacagaactgagttacaaaatgggaaatagccaggacataattgtctatagcaatttaatatcacgaagtaagcaatgttgaaatatgtggacaaagtcaccggtgtgtgtgtgtatgtgataatcattcaggcgtgtccaacctcgttgttaccccatggattgtagccctccaagctcttctgtccatggaattctccaggcaagaatactggagtggattgccattctcttctctagaggatcttccagacccagggactgaactcaggtctcctgcattgcaagcagattctttaccatctgagtcaccagggaagcccctatagggttgacatgcccatatttcagaagaactgaagctcatagggttgaaataatcgatacatctgagaagttcatgtatctgccaaagtgacaggggcagtgcttatcccagtagggcatgttacctccctcccccccctgcctttttttgttaccttttacagtctcaaaaactaaatgaccccagctcagccacacaaaggccgtggtcaagtgaatggtagtgtattcatttaatagcctgctattaaacctgatgattataaagtagaatggaagcagatacttttatatctcttctgatttggcttctgcccggattgtgatcaataagtcattcaaagaaagtctgctacaagaaagtcacttaagcttctttaacaaatttctctattattggacatctaaattttatgttaaagtcatctctaattctgtgtcctaaaattttggtaaaaacttatttttgttcacatgaaccataatgttcctggtaagggatggtcttccatgtgatcatttcaggaaaggacccagtctcctttctctaggagtgttaacatcatcttggactttgagattcttcactgggttttttgtatctcaccaacataaggaaaagagagcttgaaacatcactccaaagatatggaatatttaaggacaagaactttaagctgtttgtatcacttcttttttttaatttaatttttagttttatattgaagtataattgacttacaatattgtgttattccaggggtagagcaaagtgatttggttatacacaaacatataggaattctttttcagatcctttccgcatataggttattacagaatattgagtagtatcacttctgcccacattccattgcccagaa

SEQ ID NO: 33833 - DNA, 2101 bp, Bovine  19866881251511
ttactcttggcatattatccattgttttatttaatcatccaactcttttatttaactcaaattctctcattctctcaataaatttgctcagtgagcattatttgaatagtaaccagcaccaggcactggggtccatgttactgtctgagagacccttgggttgtttgggggtttaaacaacttgataggaatagaatcagctactgtgttcaaaccatagaattgtgtgggcttctgaaataggaactacactgcaattttctttgtatatccagttatattgtagacactcaattacatttttgtcaaattaaattggggcttcccagatggtattaagtggtaaaaaacccatctgccattgcaggagatataagagatatgggttcaatccctgggaggggaagattgcctggaggagagcatggcaacccctttagtattcttgcctggagaatcccatggatagaggaccctagtgggctacagtctatagggtcacaaagagtcaaacacaactgaagcaatttagcacgcatacacgcacaaattgaattgagtagaatccttgagtgttagacttggaaatgtagtgtctaagaggcttatagtggtgacctagagatcaccaaaagtagggtgatgaggcagatttctgggagtttcctacttgtatttcagctagagtggcctccctctttatctattggtcttctgtataagattgcattttttaaaaatgtagctactgctaaaaaatattagaaagccattgataattcatttgcttcaattataaatgagataaatctattttcagccatctacatcagttacaaattatgtaaatctttctaaatagatatagttcagataatgtcccctgcttgccctttctttctttcttttttctttttttggtagttggtttaaaaaagaaaagagggggcaacagcctaaaaataattttttcaagaaatgatgaagcaataaaagtacagaagcctttgaagattgctagcaagttatgtcagtgtctgtaatgtgaaactgcttgaggtctcttcagtgctgtgtgccctcacactgtgaatgaattcattaaaacaatgcagaattcatctggggcaggaaaataaggaaactaatttttaaatgactaaggactgacgataagcttctctgttaatttccctggcctaatggagaacacatacatatgctatcagctcatctctatcattaaaaagaagttagaaccagaaacatgtacaatcacatcaaggcttgtcaattaaaagacaacccaagaaagatgttttgaagattactgattttgtcagcttccatcaaaagtgagacgaaatccagagagcaaggctttggttaatggtgagatctttgttaaaaagcaaagaaaaaattgtttcctacaggtaaattgaccttggtatcatttaccttaaaagaatatttccaggtcatcaaacagatcatggatcatacactctaacttgtgaactctaggtatgagtcagcaagactaattcagaagtacaagggttaaatgtcttgaaaggtgtatttcacccttttgaagcaggaaattatagaaaacactcgaataagcatttttcttacaactaacattgtggaatattcttttaactttctgatggacttttgtcctcaattttcaaaacagtttcataaggcgtggctgggaataaatgctatttacacattccagaagcccatgaactttcttctctttacaaaatggccaactgaatattttgaactcatgcgtctatcaaaaatgtagaagaaataaatttctaagtcagctaaggccaagtgattgtttaaaaacgcaatacaaaaggaatgaaatgaaggcagtcttcctaatacctttggaaatgataggccaaccatgccattttagtataaaaagtcaggatgatgaaggaagaaggttgggcagcctaccaaaacagaggaggtagcagccaaaagcaagtattgttcttcttccattgacatagaaaggctgcaagaaggaaaaaacagcagtgaattaaggaagcaggatatatga

SEQ ID NO: 33834 - DNA, 1412 bp, Bovine  19866881619560
tgtctgtctaacacttggtagtgtatatatgtgaagtctttatgttggggtatagacagttatcaatgttgtgataatttcaggtagattgcagagagacacaagcatacttgtatccattttcccccaaatgcagtccctttcaggctgccacataaaattgaggagagttccctgtgagaaagagcatatttagaagtaagattacagaacgcaggaatgtaggtgataggagtgaatggttttgattcattcattcaacagttatattgagcacacactgtatgccagagactgtttcagatgcccgggaatagagtagtgagaaaagtgaccaggaaattggagaagtcagagcaaactggtatagaaggacagatttattcaatttaaatttgagaccatatcaaaaggtttaaaagtaaaagttacatatgacgtagaaaaggaggagaaatagaacatttttctcttacctgtatgtattctctttataacttggctgagaagttagtaatttctctttttaccgtaggtagtcaagtataatggtaataacactaaaaactaatgatatgttcacgagctctgtactgaacaaagaagcaaagggatgcaagcatgcatgtgatcagtcatgtccaactctttgcgagcccatggactatagcctgacaggctcctctgtccatggagttttctaggcaagaatactgtggattgccatgccctcctccaggggatcttcctgacccaaggatcgaatctttgtctcttgcttctcctggcaggcaggttctttaccacttgagccacctgggaagtgcagggatacatgagattctgaattaaaccacaaaccaagcaccgtatctcctccaaattgttaagtaacccaggaccatccctttggaatctaagaccacctcttttcttcttcaattattttgtgcctctgggcatgaaacctacagtttcaaaattattctcttacaagatggcaaattgatgctgtcagccaagctactaaattgtctgtttctctccaagaaaaataatttaagtaattactgaggaaaaagcatagaattgcaccatgttttacatttgatctctttgacgttacatggaaatatgatgtttcctcccaagtgctctgaaattgaaaaggagtgcaatagcaaccaaagaatcctcaaggttcttgccagttctttctctggggggggtagaattccttcttaaccacagatctgattttcatttaacttgtatatttctgtatatgagcaagaatctctgaggctgagccttcatcccaaatgcctaattagacatagttccctgggtcttaatgccgtacaaattacctcttgggggaaaacttttcaaatgacaaggttttagagttt

SEQ ID NO: 33835 - DNA, 840 bp, Bovine  19866881752110
ctcgagtgggttccctgccctcctctagaggatctttctgacccagggatcgaacccaggtctcctgcattggtgtcagtttctttaccacttagtgtcacatcattgctgacttaaaattaccactcctcaaagtattacaaaggtgaatttttaacacgaacctgggatttttctacactacatatcctttgaaccctgaccttctcggctgaaacatgcctggaacagatagaaaaagacccaaagcccaggatccaagtatcactgggaattccagcccaccgagaagtgtttacatctctgttccttgactagaaagcagctgaagggaactgacttggagcagtaactgcacgttttttaaatgctatcaaaagttgcacatagatccatgtttcaaacacctaaggagtgttcacacttttaggcaggtgtgtaagcctggggctctaacaaatcagggacaagggccatggaggtggctccggtggtcttgaacatgtctctctcagattaatttaaacattccttccacatctgtatggcttggcagcaagctgaaaatatgtttctgtcattccagtccttcaagagctgctatcttcccataagctgtaatgagtcccacagtcaaagatcgcacggtgtgcaaacttcccaacacctgcactcttcaaatcctgcctttgacttctgcaagagtatttgtcacttcattggcattgaataatacaaacattcttctgacctggaaagtttcaatcaaggacccaaaaaagaataaaagtaaaggaagctcagcctaagaggagaattaagaactttctccctttcaag

SEQ ID NO: 33836 - DNA, 2408 bp, Bovine  19866880675506
tgccttggtttagaacccctggcccgcctgtagatgacaggaaggaagaaattagtacatccccctgcctaaggcttgttcttctaggagatactttcaaagattaatggcctttttactttgtttcctcacctccttcccatctctcatctataaaagaactggcatctagcgccggataagatggttattttgagatgttagtctaccatcttcttggtcaactggctttccgaatacagtcataaaataaagaaaatttattttctttattggaaaataattggcttccctgaacacctcatctctgaatcattgacctgtcttgtggtgagcagagggagcttggatttggtaatacattggtgttattgggcgattggacttaggtgttggtggcaaggtacaaaggtgatttaagtaagggtccatttcttcacagacttaaccacagggaaaaaaagacctttcttcacccccttctcctaccatttacacatgcataaaacattttgcattcaaccttagagggctgttagattttgggaagaccgtttgtccatggatcttggggtaagaactaaagcagtaaagagtgaacccaaatagggtcagatactatgatcagataaggtggtgccttgaagcccagacagagagttctgactccatttatttaggtgtgtgggaattgttacgggatctcaagcaaggtaatgacaaggtaagagaggtgtctatggaaaaactagtcttgggttgggaaaagggttgggttggggaaaggggcttgagttggaaataagtggctaaaattaagaatggaagtgaaggtgatttgagagggctaataaatatatttttaaggaatatatcacaatttgatggtactttggatgtaaaacttgagtgaagagtaaaagatgactaaggtgtattttaataggcagggagaaaaatgagaaggaagagttggaattgttaccgagaaacagggtagttggagaggaaagattggtcgtggaataatgtttagctttgaacttaatgagttcgaggacacagaagttcagtgttttacaggaaattggaaatgcaggtgcaaaagtatgggactagaggagtcgtatattgaatgaatgtttccttatggagaacaagtgatttcagagtttggggagacaccagctgttgcaactggaggaagcaaaggagtcagcaaatgaatcagaagaaactataagaaacaaggaggagaaatagttgagtgtttgaaaagaacaagatagcagaaagtttagaggaataaggatgagcaaacttgatgacccaatgattgtccatgattttcacaaaaacattgttgacagtcttcaaagggccagtagtaatcttcaaattgcagtgtctttgtagtgatagatacgtaagagattgctaaagatatctagtaaaatatttattagtaaatggaggcaatagttgtataccacatttccaggaaagtggtctcaaaaggaatgagatgaataggttttaaacaaatatgcgtcagcagtggaagaaaagtatcctgtggagtagagataagagatgatagaggtttgaaatacacatggaagattgtgcctaaggggggatgtgaaggactatgggagatcaagaatatcagttgatggattgactttagaaagcaagtaaaaggacctctttccttatagttggaaggaagaatgttaggaaagtaaagtattgaatcaaaatatattttaacctctttaattatcaggcagggcaaaaatactcattgttgagtatggagtgagaaaataaaacagatataaatcattttctgatctttaatgcatggattgggctatttcacattactgtagtattaaatgcttaagggaaatgttttctcaaaaccagtcctttaagctagtagtctttctctcacttttgttgttcagttgctaagccttgtctgactctgccaccccgtggactacagcatgccagcctcctctgcccttcactgtctcctggagtttgctcagattcatgtccattgtgttagtgatgctatctaaccatctcatcctctgccacccccttctcctttagccttcaatctttcccagcattggggtcttttctgttaagttggctctttgcatcaggtggccaaaatattggagcttcagcttcagtatcagttcttccaatgcatattcagggttgatttgccttagggttgacccttttgatctccctgcagttcaagggactctgaaagttgtctccagcaccacagatcgattctttggcgctcagccttctttatggtccaactctcaattccgtacattactactgaaaacatagctttcactaaacggactttt

SEQ ID NO: 33837 - DNA, 1668 bp, Bovine  19866880709380
ttatggataaattcagattctaagattcacagtatattaaattgtgctgttggtcgtatgagatgctgaacaaatatcttaagtgggtggtgaattctagtttccttaacaggacttactgagtcgacataaaaaaagcaagcattagaaaagtggtttttccccccttaactgctctgcctttgtaactaagctttgtgtttaaagcttccactatttgagctaatggacctttcctaattacgttacagataatggggaaggtataagataagaaatttatttatatgtgtacccactgtgaacgtaatgcatatttcaggcaatgcttgccttctaagccactgctgttcttcacaaagggaaggatagtctgcctacacaaaaccagatagtctgtacagatatcttgcaggtgtggaatgtaattaagtcaggtttgaaagtatgaaactatccaactttggtttgtcctgagcaagaaaaattacttaatgcaaagtaaaaagactggtcccaggaaaagcaccactttataataagaagagtgaaaaacagaaagacactagaaagcaaaggaggcaaaaccacattaagattgatagttatcaaagaagtcataatgctcggcaaactccattattttcaacagattcttatttaaatgacatctgttaccaagccctcaaatgaaggtgtatgcaaatgattcactggactacctaaatacaatttctttcaaagtcctataccctaaattaactggaatcccaaattaaccagaaaaactactctaaaatctcaagaactcattattaatataagtgctccaagacaaagcagatctgacctatgcaaatatactggaaccttctagatgaagattattactgagggtgtaacatataaaacctaatttccaacttagaaaaaggcaactttaagaataaaacctatagtgaagaggtgctgtatatgcgactaggtaactcatccaaactttgcatgtgttggtagaactcacaacaaagtaagaatcaaactcactgtattgtatgagcatggcctagaacactctgcccagataaatttaactcagaagtccatgcactgtttacaaatggggagccattatattttcctcttgcaaggaattatgtttattatcatcctaacattttccatttacttttccacatctagcataaataaactaattgaacagtaagaatgaacattcacaaagcaaatatataatgtcccaatatatattgagaattataaacaataacagaaattggacgatagttctaaaaagaactttcaatcttcagatatttaagttttaaaatattcttttctttttttaaaaaaggaagattttggctttttactacaccacatagaacagagtgagtttacttgagtaaattaaaatgaagatttatagtgaagaaatggatagtttctaatctagaaaaacagatttcggataggaatcaaaccacttattcttaagagaaattaattttaatactagagagaataaatccattcttgccaccatcatctgttaacttagagaaatggcaaaatttacttataaaaacattacttctcttccccagtattttctctaaagatgatattcatttaactttacattat

SEQ ID NO: 33838 - DNA, 1512 bp, Bovine  19866880715878
tttacacctggttatgtaggaaacctcaaggtgcctgcagcatgaaaccatatccgttgttattttagtggtggtgacatgatagactgctagtgacagaaggaagaaagttaagctaatagaattaagaaacatggtataatttgttatccatttcagagttcatgaatgctacgtttatcctgtggcgtctctgtggcgaaatccacagaggttcttaatctgcgatgccaccaactcttgttttactttcacggcgccactgaatacatagaccttattccagcattaagtctttttccttacttcctaaaactctacccagataaattcctcattctccagtcaatagtttatactcagacttgcctacatgtttcattaatattgcttcctctccctagaatgccttcctttgccttgtgaaaattgtatccatccttcaaggcccaggtcaaagtcataccccgtccttaaaccgtttcctagctcagcagtcttacacatggggaggctggtgtacttcagcttctgccttttgcatattaccatcttgcatttgttgcagcttcttatggaaatcatctaaccaaattagaagttcccttagaggcaggaactttacttatctgtgtcccacatgtacttaccataatgcttagcccacctcaagtgcaatttcaatgccagatcaaataataaagctagatttttttttttccccaaaaaaacttcccaggatagaaaaatgaataaagttttttcactagggggaggaaggcatagagcggaagcaagtacattgtccttcaattcagacttggaatgctttgctttttatgtggatttcaccctagtgtaaattcacctctgcctttttacccataagagatttacctttgacttgttcctgaagtgaatattcaactctctattctttttgctctaagatttgtatttcttctcatttcttaatatctttgtttcagtagcttaatgtctgagtcagggtgcttttgaggcaggggtcagatcagtaccatatctacagaattatctttgcctgtgacataatttctggatgtgaactcattgttactgatgtttttttttacagtgtttgggtacccagaggtacctgagattgacgtcttaactctgtattattccacttttagagagtttaatgctgctttctcaaagcaataaaaacacgctgaatttgaagagccttgggcatgaaaaggctctagattataacctaagtactataccctactgttatttctgtcagtgaacagttgggataaggagtgttcatttattaactttcttattaaaattgtgtagagaaattattatgattatggtcctctcttccctgtcttacaaaatgatggctgttaactgattgcatttagagaatatgcctgctttagacttccctttttccctttcccctgcatttcaggatatcaatgcttacaaggtaagagcccacagaaaagttac

SEQ ID NO: 33839 - DNA, 818 bp, Bovine  19866880763707
aagaaacaggaaattaagatgtcagaagcatccatttatactaaaataaaagcatacacacaaccccaaagaagatgcatcccaagaaaaggtgattgacaggttccaggacccctggttgggcttactggtgaaggtagtagggcagtctgtagagactgcgagaagtggctgtttccacaaagccaaaatctcagtgaaaaatcacaagggatacagagaaacagggaaatcaaaggaccaatacaaagtgccagaaaccaactctaaagaagagcagacatatgcagttcctgaaaaagaattttaaaattatggtttaaagagtcttccctggtgcctcagtggtcaagaatctgcctgccaatgcaagacgctggttcaatccctgggtcaggaagttcccctggagaaggaaatggcaacctactccagtattcttgcctggagaatcccatggacagaggagcctggcaggctacagtccatagggtcacaaagagtcacacaactaagcaactgagcaacagaatttgggatagtgttgccatcttaacagtattaagtgttctgaattttctgatatgctataagacctgaaagaacataaatcagaattagaaaaactcagaaatgaagtgatagagctcaggaacatagtagagataaaagaaaaaataatttcagaatattaacctagaaagaaataagaaaaactccaatatattaatattaggacaaaaaatttttaataaaaaatttcaaatatgtaaaaagtatatgagaaagtaaataaactaataactttatatttattt

SEQ ID NO: 33840 - DNA, 3953 bp, Bovine  19866880782366
ggtggatggagtgactggggctgtcatcccccctcacccccagcttccaacctgccctgctgccccggccccagatgagggtatacacttggagcgggagttggcactggatgccaatgagtggccatgccaaaggagccagagccaggaggagccgcctcaggctgagggaggtttacagctgtagaaactataccccagttatcaaaaaacctgactcccagaacatgatgaatgttaatgacctcaaactcaggatgtccaaagctggacaaaaacacctgctacacttctggaaggagatggaaaaaagcccaacaggtagaactttatgcagagctccaggccatgaaatttgaggagctgaacttcttttaccaaaagatgactgattgatttaatcattcttccagagaaagtggatgcttgaatggaacctgtcccttgagaggtattgggcagggataccagggatccaaatcagctgcaggcctgggaaactgaaggacaaggacttttccagatttcttggaacaaagtggcagttcttctagctggtgggcaggggacaaggcctagtgttgcatgtccctacgggatgtatgatgttggtttgccatcctgtaagacacttttcagattcaatcagagtgtatcctgaggcttcaacagttagctgaataatatcatggcaacaaattcatctttttgcggtatataataaccagtgaaagaacaatggaatccacaaagtttatggtatatgaagtattaggggaagatgagttttccccactgaaggacaaagacagtcagaatggacaactctactactgcaaggcatgttttgatgtccctccatcattgttgggtcttcaatgcaagaggccatgtcatagatgaagttggctctcgcctcccagcaattccccacttgaagggtgccaatgatgcaccaatccaatgtaaaatctctcctcttatttcctatcctggagaaggaccaaaaagttatatgacagagagagaattccatgcacctttaatcactgatgagaatggagtccaagaagaatggtatatgagccagataccaagttctcccataataagaatacattttattttcggttgactgatcataaacctataggacctcatgtgaaatactcaagttttaatatccacaagctttcattttgcttgttgaatactcacaactactccatattccctaagatccaggtgactgaacttcagaaaacatttttataattctcaactgactgaaggtcttatttacatttttcaattgtataactttttttctaagctaaggaaaatattggccatctaagaaatttcctgcagtttacgtattgtcaggatgttttaacatctctttacttggagctgaaagcacttgttttggaagttgtacatagtgaaaatatgtgattgtacatgttgaaaggtttccatggtactataagtttattttaccaaaaataaaattaagaaaaaataataaaatgctgtccaaatgtacataagggctctttataaaggcagaagtataatgtataaaatgtcagatgaaagccattctactgaagttgatagtgggatccaagtgaattagttcccaggaaaaaaatgaaagaatctacactttgataaaagccagaaaatttgaaggcctgcctactcttgtgctgacaaattgcattaggtcattttgtatatacatatgactcagtggtgagtgagaaatataaaaaggggagaactgtactttgttcatcttattgcatctgaaagacaatgaggtaagcaaacaaatatactatagtctagtgatcatttctaagctagacttttaactaatagggatctatttccctttgtgggaaagtataagtatggcttccaaagccacagactttctagttggcttttaaatgtttttctgaatcataactagcttaaatgggaaaaaaaaaaaagaagtagacaatttccaagcattcacaagcctgagtaaataaatttcacactaactgaaggaagtgaaagctttttttattcctgtttttaactataagaaatatttttcctttctgagtagttgatgggatacccaatttccagaactgtgacaagacttgataaagtcatctgactcacagtgctactgagtgcaagtggaaactgctctatggaccacagaaatcaaacatttataaattcttggtaccagctctagaaaatcaggtgacaccagacactctttgcagtacacaatataaaggatcttccccttacatcacatatcagtgcccatttcctatatttatcaacaaggaataaattatgtacatgtttaattgccctagaaaataagaggttccggcagtaacctagaaggcagtaagacagaaagcgagagaagtcattcttgtaaataaagcacatagtatttcccatgtgatgagatggcatgccaagaaattactgcgtatttatctgtagaaaggactcaactccagattttctacagttttcactgagactgcttttgtttattttttcccacaaaggtaaacagtgtgctatcagaaaaacatgaactgtttggttcaaattagtggttttattgtcttcagataaatactcaagagtgaaattactggatcctatggtatctctgtttttcattttttgagggactcctatactgttttccatagtggctgcaccaatttacattcctaccagaagtgcatgattgttggtgatctgtatgtcttctttggaaaatgtatattcaggtcctcagcccattttttaatcagatcatttgggttttttttttttatgttgagttatatgagttccttatatattgtgaatattatctcttatcagacaaggcatttacaaatactttctcccattcggtaggttgtcttttttgttttgttgatagtttccttcactgtgcaaaagcttttaggtttgattagatcccatttgttcacgttagcttttgttttctttgccttaggagaacagatacaaaaaaatactaccatgatttatgttcgagagtgttccacccatgttttcttcaacaatgacacaagaagtttgtaatcaaattggggaaatgtaatttataagagcaccatttccagacatgtctctgagctttcacatgactgattatttcctccttctttaaaaattcttctcttagtttctgtcctacttcacatctttttttcatccgctttattatttaaggtgggttcctctttcctagccatgcctacaatattggcattcattgatatttggtctacggtccttttctcttcccttatggccactctttgcagccaaagctggagaagctctatacagtcagcaaaaacaagactaggagctgcggctcagatcatgaactccttattgccaaattcagacttaaagtgaagaaactagagggaaccactaaactattcagatatgacctaaatcaaatcccttatgattatacagtggaagtgacaaatagattcaaaggattagatctgatagacagagtgcctgaagaactatggacagaggttcgtgacattgtacaggaggcagtgatcaagaccatttccaagaaaaagaaacgcaaaaaggcaaaatggttgtctgaggaggccttacatgtagctgagaaaagaagagaagctaaaggcaaaggaaaaaaggaaagataaacccatttgaatgcagagtttcaaagaatagcaaggagagagaagaaagcctccctcagtggtcagtgcaaagaaatggaggaaaacaatagaatgggaaagactagatatctcttcaagaaaatcagagataccaaggaaatttttcatgcaaagatgggcacaataaaggagaaa

SEQ ID NO: 33841 - DNA, 1760 bp, Bovine  19866880832585
ctgttatttaaaaaaactataagcttttaaatcccatagtttgagttataggaagttggaaataagattttgaggaataattttcctattatcacagtccctaatactgctggtttattgtcgttggttatttatgctaaattcagttaaataaataggttaaaagaaatctaaagtggctttaagtgattagataaatcaaaagaataatataatcctcttcaaattaataaacagtaaagtgaacattaaaaataatatgcaataataatgatgaccatttatcccttgttttaaaagtatgccaagcacttttcatgtaatctgattttattctcacaattctgtgaggcattattcttttacactcattctacagatacagagacactaatggagaaaggcgaggtgacattcccagagcaaccagctctgccctgcttaaagggcttccactctgatcttgcatgtactttcccttccttctgtctgacatttataatgtgctatttgaaggctctgtaaccttcaggactgttggtattgatggtgttcaaccattcttcatagttgattttcctgcctcagactgcattgacacatttgtttagagcccagggaactacataggggagcctatattgcaaaaaacagtaggcttgaggacctgcagtcaccaagaaagcactgagcttgggccacaacccctaggacatgcagcacagagtccttgaggtgctggggagaggctgttaaacttatttttcattagctctgtcctcaaggatggtctgtggcaggggttggcaaactatagccaaatatgcctattagttttgcattgcctatgagctaaggatggtttttacattaaaaaaaaaaaacccaaataaaaatattttgcagcatgcaaaaattatttgcagttaaaatttcaatgtccattatttattgggtgctcatttgtcatgtattacctgtggctgcttatgtactagaacagctgaggtgaatagtagcaactaggaccatgtgacctgcaaatactaaatatttaccatatgatccttcacagagaaagtttgtcaatccccaatctaagtattaggccaatccctttaagcaactttctaagaaattcaattactgactgttttaaatttcccagttcatcactcaagagaagtagctccgtgtacagatttgaacacgactaattttattctttttttttctcctcagtggaattttggggaatgtcaggtacagttgctttagccactgtaggcctaaatttagattccttaagctttaaaccgaggatcaagttgataattgctaagtaagtctcatattttgtacttggtataggtctcatagaagtttagtgcttaaatgccttcataaaaataataaaatttctttttataacttttctatcttttaatttttaattttactgccagtcatatttgaaaagaacttaagttaccaatgattattgacattcctattatgaattgatattcctattatgaataatgaaatatcagtggctcagagatcatagtacttcttctaactctttgataaaaattgaattgtgagaagtttaaaaactactttattcctttgttttctacataacatacctgaatgacagtatcatagtactaaaagagctgggaaaagaaaagtagcagaaaggtgcaacaccagcaaactctaatctagctttacctctggtgtaataaggatat

SEQ ID NO: 33842 - DNA, 784 bp, Bovine  19866880953331
gagacttggatacttaatgagtacaacattgattccaaagtccatggacactcttcctctttttttcatttagtcatttatctaggcaatcaacaaaagttacatatcacagataagtaaacataataatactacaatgtaatgagttccgtaagggagatttgtaagagatacactgggaataagtcaagtaagcgattacctcttacttggggaagtcagagaagacttctgaaaggccacaaaactagaaccttatcctccaaaactagaagaatgtagagaagcaactcactcacatgaaaaaagaatttgagagaatgtggcattaaatcatatagtaatcaacagttaagtttgagactaagacagggtagaatatagctattaattggattataaaaaggataaattcaatatgagttaatatactagtgaaaatagtaagtggagaaaaagaatcccccccccaaaaaaaaaaaaattagaggacaatttaaagaagaaatgctctgcaaaacagtattttatttaaaatttccttcatttttacctgatgtcccctttctgttacaggatctgatcaccattattttgattgtttgttttaggtacttcttgaaaaaataaagtcattgaataactttccaatggcaatcccgctccctactcctgacaaatatcttcataatatcatttggctagaaaataaagatgttctcattgaattcttcaaggtaaagattctgtcttatattctagctcatgttcaatgataattatt

SEQ ID NO: 33843 - DNA, 2407 bp, Bovine  19866880128175
attgctttggctatttgaggttttttgtatttccatacaaattgtgaaattatttgttctagctctgtgaaaaataccattggtagcttgatagggattgcattgaatctatagattgctttgggtagtatactcattttcactatattgattcttccaaatccatgaacatggtatatttctccatctattagtgtcctctttgatttctttcaccagtgttttatagttttctatacatagatcttttgtttctttaggtagatatattcctaagtattttatgcttttcattgcaatagtgaatgggattgtttccttaatttctctttctattttctcattattagtgtataggaatgcaagggatttctgtgtgttgattttatatcctgaaactttactatattcattgattagctctagtatttttctggtggagtctttagggttttctatgtagaggatcatgtcatctgcaaatagtgagagttttacttcttcttttccaatttggattccttttattattttcattctttttctgctctgattgctgttgccaaaactatgttgaatagtagtggtgagagtgggcacccttgtcttgttcctgactttaggggaaatgctttcaatttttcaccattgaggataatgtttgctgtgggcttgtcatatatggcttttattatgttgaggtatgttccttctattcctgatttctggagggttttttttttttttatcataaatgaatgttgaattttgtcaaaggctttctctgcatctattgagataatcatatggtttttatctttcaatttgttaatgtggtgtgttacatagattgatttgtggatattgaagaatccttgcatccctgggataaagcccacttgttcacaatgtatgatttttttaatatgttgttggattctatttggtagaattttgttaatgatttttgcatctatgttcatcagtgatattggcctgtagttttctttttttgtggcatctttgtctggttttaaaattagagtgatggtggcctcatagaatgagtttggaagtttaccttcctctgcaattttctggaagagtttgagtaggataggtgttagctcttctctaaatttttggtagaattcagttattcagccttctgttcctgggcttttgtttgctggaagatttctgattataatttcaatttccatgcttgtgatgggtctgttaagattatctatttcttcctggtccagttttagaaagttgtacttttctaataatttgtccatttcttccacgttgtccgttttattggcatatagttgctgatagtagtctcttatgatgcttttaaacttaggtttaacttttatttttttatttaataatagtagcaattatattcttttctctacatatgctaaattttctcatattgataggcatcttaggaatttagtcaaattgttaatgtttatgaaacactatttgcatttaaaacattgtttataaagaagatgtatacatggcttccaacttttaacatctcattaatgaaatcagaaaactgaaaatattcatttccctaaagaaaaatacttatttctctgaaggactttcaccaatatttactgttatcaatgatgccatctgttttcagaatcattccttgaagcaagaattatgttttaattgaagccattattaaccatgtgcaaatgaaaaagctataaatttaaaaatatattgattacttacactccttttactgattatcaggagcaatcagatttgataccaagtgatgttaccaaatcatttatgtctgtttcagaaactgaatggcaagtatagatccatgtatttattaattttttactaattccttctgggagatatgatactttacaggtgtatacatatggttctttcaaatttctcttcctttttcaatatgttcatggtcaagttgacaatacattattttgggagatttattaattcccctgaattaatgatactgctccttaaatatcaatgaataatgttcttatagaacattatgaatacttcactgaaattaatgttttaggttgggtgaagatccgtgactgatttaacttcccctcggactcagggcttttcaggattgtttttcagtccctaagtcgtgagtgactccgcaatgccatggactgtagcatgccagactctgtccttcactatttcctggagtttgctctaattcattgccattgagtctgtgatactgtctaaccatctcatcctctattgtcctcttctccatttgccttcagtttttccaaggatcagggtcttttccaatgagttggctgctcgcatcaggggccaaagtacgaagtgtcagttt

SEQ ID NO: 33844 - DNA, 2985 bp, Bovine  19866880175412
tctttgcgaccccataaattgcagcactccaggcttccctgtccatcaccaactcccggagttcactcaaactcatgcccatcgagttggtgatgccatccagccatctcatcctctgtcatccccttctcctcctgcccccaatccctcccagcatcagagtcttttccaatgagtcaactctttgcatgaggtggccaaagtactggagtttcagctttagcatcattccttccaaagaaatcccagggctgatctccttcagaatggactggttggatctccttgcagtccaagggactctcgagagtcttccccaacaccacagttcaaaagcatcaattcttcggcactcagctttcttcacagtccaactctcacatccatacatgaccacaggaaaaaccatagccttgactagacggacctttgttggcaaagtgatgtctctgcttttgaatatgctatctaggttggttataactttcctttggtggggactatttgaatcaaattccaaacatgctttaaaatctagaagatgttcacagtcagtactttagaagccgttgtgaggcttcctttgcacaagggtgatgtcttcttctctcctttctctcttccttttctcccttctgtcttttttgttttgttttatttttagttgctttcagcatttgtagcttttttcttttgaatgtctttggtagtgcaactttcatcctttgtaagttggatttttatttggggagataatcaaaaggcgtatggagtcatacctgattaataaaataggtgagcactttggggaattctatttttgttaaaatataaggtagaactattagacaccgaagctgatcttgttgtaataaatctcatgaactgcctttaaagaaaatgtcaaaaggaactctacagaaaggtgttgagaaatggcagaattggaataactatataatttcataaaggtgactttgcagaataacatgatttgaatgtgtaagtcctattattttgtttcttgggggctttatccctttttttgttatatcctatacattaaatattatatcttttaattcaaaaagaatgttaattagtatattactgtatatgtgtggatatacttgcaccagatggcagaggtttcagcagatagaactaatagaatatgatacggcaaaccttttttcccctgtgtaattgaatggttgtatcatttgaaaatctgattatccccaaaacattgtttctgagaatctgaaaagcttggctctcagtaactgccagggcttattttatacaacttattttaccactaattcatcctccagctcacccttaatataagtagttaacttccccatctggaaaggggtaagcttctgctcctgtagctattattatgatactaaaagtgtggcttgtcagtgatcatgatgtaatactatagtaagtgaagtgaaagtcgctcagtcatgtccgactctttgtgaccccatggactgtatagtccatggaattctccaggccagaagactggagtgggtagcctttcccttctccaagggacaaattttaaataatgtggtacttgtcagcctcttgaattagattatctgctgcctctcctgtctcctccccccagatttaatgatgccagtttcatctttgtcacgtactcattgcagctccccaaatgctccacttaatccctccaaaatggttgttctcactgggatctgtctgtcttgttactgctgagtcagtgctggttctggggctaaagtttgttctcctgattcttgtccattgtctcctcttgtcatattttctcagctgccttaaatatgtcagacccaaggactagttacaaaaataccacaatgtgttatccagactaggcctttttttctttcaaatgagctttcaagcgcatcaatagtatgtgtaatagaaacaatatttagagtccttgggtgagaaaggaattacttccatgctagagtgttttacaactctgaccgtggaatctctttgtatagttcagagatttttgagtactttagaattcagttcaatgcgctatagccttctaaaacttatgaataaatttaggtgtttgtttttagaactgattttgagaattttttggtatttctcagagtaactagtgtcatattagggggcccctaagctaaattctcccaagactcgctgaattgcatgtctgtgtgaggcttttgttagagcatgtttttaacactttaaaataattatcaggctggatctggagacctttgaaaagtccttaaagttaattacatcttgagagacagcctctgttcagtcacttaattaagtactgtatcaattttacaggattcctttgttaacaaaaatcaatgtgcctgaagtacagtattctggtaatgtgtagttcattgtatgcagacatttctaaaggaagataatagtaataaccacacagttattaaagagaccaggccttttgctattgtatagctaaaatcggaaagcttatggtttgggttcggccaccaactgttgtgctaaattatttgagtcctttgcccctgtatcatttgatgctttgactttacattgttgatttggttccatgtcttctaaaaagatcccagaaccttttgtgcctattttaaggccagcagttaatgataatcggagctaacaagtgggtgcttataatacttaggtgccaggtattagcgtaaggtcttgacgtatgttccttaaacctctcaacaaaccagtgaggtagaaacttttattatcctcatcttacagatgaggaaaccaaagccatgagaggttacccagggtcatacactagcagtaaggagtggaattccgtaagtgtaggtaggtaggcagtagatagacagctgcaagaaggaaaggccctagaagtacagggcacgttgatgagtgagaagagtt

SEQ ID NO: 33845 - DNA, 859 bp, Bovine  19866880346708
tgtcctatgcataaagatcccaacagtactttttaaaataatcttagtgtaataagcatttaacttcccttagagccttagtaatttgcatgttattactaaaagcccacaggtaaaggaaaagtaggctcctaaattcattcggtacctgactatgatttatttcaagattatcttggacaaacaccctttgagaactcagaaaattaggaggtatgtttgatacatacttcctagtatctgttgccctcaaaggtgtggaggcaaagtagccactggaaaatcaatgtggtgttgactttcagattccccagagttatcttcacatatccttcaaaatgtattctcatcctcagcctctctaattttatgctgcttcctttgtgaagccttcctgctctgctgggaaaaaaataacgccatcctccctgtcctccccctgcccatagatagcactttcttcttcccttgttatagcatttttcacactgtgttagggttcacatttcagtctcccggcctcgttgtgatccccttgagtgccaggatagtgtgttattctagagcttggcgcacaggaagacctcagcgagcatttgttgactaaatctcgatgcaaggtcatccaagatatcctacacaacttttccatctgaacagtttggtctgtattgtggaaactaaaatagatgacacttacctgtaaagagaatcctagggagaagtctcatattattggcagaagacaacttgagaccgtctcatgtcctcccctacccctttttccccaaatcattctttttctaaatgtttatttttaattaagtaattaatctggctatgctgggtcttagttgca

SEQ ID NO: 33846 - DNA, 1398 bp, Bovine  19866880348341
tgaagcttggaaagttgtctatggggtctagaagcttcacccttcccttcgcacgttgtccagcgacagggcattgagctgctaggtggtgtggacccctggcccttaacttgacgtcatacgtatggctctgaagaatgcgatgctcagcccagcccgtggtgtacactgtagtcagcctgctgtgccttgtgaatattatatttttgccaagagcagccttccagaatgaggtgctagttaattccagttggacatttattcgttaataagtctgctgagcgctaaatactccatttgagagtattcgacaagagaaaactcagcaactattatgtagatctcttccatgaagcagtgtgaacttattttacttctggttttctatgaatgctttatacacccaaagatgatttttaactgagtagacattttatgttgttaaatggagaacacttctagtggagtactatggcttgctctgtctttcctccttttcttttttgaagataatattaaaagttaaatcctttatcctctctctctctcagggtagatttctggatagctagtagtgatggcatctgaaatagccattgaggggtgggtggtattcatttagtaacccgagcttttgcctgaagagcttctgcttaactcttctttgctgtttcaataggtctttatttggttttcttcctgctaggttgatgcatattagcttaagaacttttaaattgtgggggcagtaagaaaactttgaatgcctggggccctacacttctctcttagaagcagccagagggtttagtgtgtatctgttagcaggagagtcttctagaaggtccatttggtacctctcacacccacagctttgtgctatggtttggccctcctcctctcctgatgaatccatgccatgacccagtgtagctgaatctcatgtgctctgaaagccattggaaaggcacgtgttgcagcatcttcctgttgcctccacctcctccccagcatggctgcatgcagctccctctctggctgtacataaccgacctctgaagagaagttgctgccaagggttgcatcctcagtgaggacccttcgaataatggtgtccgggctagtagactggcagaagagtctgtagaaatgtttgggggaaaagcagtgtttgccagtacatagaactcatttgacactgtggaatatgatactgtggattagaaagtgctaaaaacataaaagaatctttatgaagttgtggtagccttgctggcttaagaagatgtgtccaggatgataaaatgtatccgtagcatcagcaactggcccctggtccagttacagatgtgactttgagagacaggaagttgtgataattccttctttgtgactttg

SEQ ID NO: 33847 - DNA, 1860 bp, Bovine  19866880442260
tacctggatcaccaattatcaaccagcaactaggctcgcttcatctatgctttcatccaggtccaaattactcaattttattttgaagcaaatttcagaaactgtgccaatatttcagtaagcatcactgaaagataaggactcattgttttaaacataattacaagactattcacagctcagaaattaactgtagttccagggcagatcaattaaactttacaaactacaatttcctcatctggaatatgaaaaaaaagtagcttaggtctgtaggttaaaaaagttagtaataatttaaattattatattctcttatcatttgatctattgtatgatgggttttattgacttttttaggtttaactctcatgcatttctagaatgaaacctctctggtatattgacattttaatatatttttggaagccagagggaagtaccttactttgtatttttgcatttattttataaattgaaatgaaattactgtctaaatctttaattcaccttctcatctgtttaataggttttatgagctcattgtgttaattttctttctttctctatgccctaaaatggttcagctattaccaaaatttacttgttaccaacacatctgaaatatgttcatgaaagcatctggacttgacatttgatggggtaactctttttcagtttcttcacctggttttatttcttttctttgctaaagtcagagtccaggttacatgctacttttataatctcttataggatattatgcattcatattgtacttgttttataatttttctgtatggtctttctttcccctagagtgtgaacctttcaaaagtaagagccatttctgacactcgatactcaacaaacgttgacccagtaagtgtgtgaataaattaatgtatacgtaaagcacctaatacactgactaatatagatatcagttgctctttttaattcatcaagaagaaaaaaaaaattcggtcataggctctggggatgaagaccataattccactgtgctctgtaaatcactctgttctattggggccttcacttatgatagtgtctgttgaggcaactgtcctcccagagtgcccagaatatgttagttacctgtgtttgagtttctttttctgcaattcattccctgtactaggcttctcaaggaatataaatgatgaataataccatgtactgcaattaaaagagacaaaatatttgaaaggataagtgaaaaacaaactttctcaaaatcataaattatatggtaatgccatcaagcattcttcgtgcagataggaaaaggataagctcagcaggtgatgatgataaagcttataaacattcatttttagcctgtaggagacttgtagaaatcataatatgcatgggactcagggtctttatctcttacaatgataatctgttttatagaaatttagtcaaaacttaataacaaaaccgtaaaaagaaaaacaattaaaaaccattaaaagaattatagatattgaataacaatagtgtcagagttttaaaccatataagcgctgaagtaagggggaaaaaaaggtacttagttttgatcatgaaattgtaaaatgtttcagatttctgttttagatctgaaaatgaatttatatacaccagaaggttttgtcagctttatggctcagtgtaaaaattaatcttggacaggcagggctgttcctcaaattcaactgtcctggaaggaaagcaagtttttcttcaatgaatgaatagaaacattttgcttctattcaatgtcaaaggctagctcaagtcctacactttgaaacatgtacgagttggatgaagttccaggtacctctctca

SEQ ID NO: 33848 - DNA, 1705 bp, Bovine  19866880546864
tttccaatgagtcagttcttcacatcaggtggccaaagtattggagtttcagattcagcatcagtccttccaatgaatattcaggactgatttcctttaggatggactggttggatctccttgcagtccaagggactctcaagagtctcttccaacaccacagttcaaaagcatcaattcttcggcactcagctttctttatagtccaactctcacatccatacatgactactagaaagaccatagtttgcctagatggaccttcgttggcaaagtaatgcctctgctttttaatatggtgtctaggttgatcatagcttttcttccaatgagcaagcgtcttttaatttaatggctgcagtcatcatctgtagtgattttggagcccaaaaaataaagtctctcactgtttccgttgtttcctcacctatttgccatgaaatgatgggaccagatgccatgatcatagtcttttgaactttgagttttaagtcaattttttcactcctctttcacttaaatgttagattataaagcaaataagagacctagtttgcaagcacaagtttccaagcatctctcatagctgttcaacataaagttctattgtgtcttataacaatgtgccatttgagatataatgactgcataggtgcatgcaaagggacgcatacacattgggggtacactgaccagaaaaccagatgcctgcctcatttctgatggcacttgcacttgtgctgcagcaagttcttgaggcatatcacttgaaagacttgaaacctgcattgatgcaatagatacaggccctaataacagaggagacggttattactaaactctactgagcctaaaattatgctgggaaaagatacaaacatgtatgagatgcataaagctgcattaagagaaactttttgtgtgaagctgaataccaagcatgacaaatgttgagtcccaagcctgccagaaaataaattagtatagacagaagagaatatactatcaggttgtacaatatggcagacatgcaaaaaattttttacaaatacctttaatcatgaaggattatttccatccctgacacctcctcaaccaaggcagtatgttccactggaactgatggagtgttctaaaattccttaaacctgcatcagccccctggagggtggcatgggtaagatccattttttaaggtgtatagagtacctggggaaggtggaaagggggtgtggcttgatggaaaaggaggagggaattctgtctggcatcggtgtatttgatatattctagaagccccagacctcactttttcttcattttgaaggcaaaaagatccagtctcttcttctgaatttgttattttggaaaggcataaacccagagctaaattaaagtctggaattatatttcaaaaatcatagacgaagaatttgcaactacttttctcaacattaaaaatcatggctaggttctaaactcatagaagtgactccactcttagtatattctttacctctaagagaaaaaaaaagtgactattttagcagcatctacagtttcatgcttgaaacagcacctaagctatattcatgaaccagaaaaggccttattactgttatacaattccatttgacatctactcagccacgaaagcagtttcattttcatgaggaatctgccagatggcataggcactgcatgg

SEQ ID NO: 33849 - DNA, 1242 bp, Bovine  19866880604535
ctctatagtgtccactaggttcctcaccactctgccctcacaaaccgtcaagcttaagccattgctgccctttccttacttagagaaggctggtcatgctccccccacccaccccttccttacagaagcatattatacgagttcacagaggaggaaaaatggacctcaccccgtggtctgaaacataaacctcactggccaatccaaacattcttcctagaaaatctcatttgagtattttttttcaaccctgtctttcatgttccaaagaggtctcctaccctgtcttctcaggagttcagactccaaacttatttctatggcttctaagcgatttacctagaggcaggcaccctaaccaaggagcaggccacttaggaagctgcaaagggcaacaggaagactcactgaatcagtggaaatgggaaagggatcttcccaggggccagaaagcacttcacagagtagagaaaaatggaggtatctggctctctgctcaactttaaatacagacatagccaaagattttttttttaaaggaacaagtatgtcaggatttacttagttaacagtctaaatgatgcagaaaagaagtccaggtgtatgtgtcacatgattcactcttcacatcatttaaccttttcagaaaatatttttccctcagtgttctttctatggaaaaaactgttcttccatgtattcaatgcacattcactgagagcctactatgactcaggatgccttaaaaacctaaggcagggaaccacaatttggaaggggtcaatttcagaccctactttatctacttactttgtgaactgaagttaaaaacctgatttttttttttctctcataaagctagtatggggagtgatataaataaaaattaccgcaagttggcagatagagcaatgtaatttgtatttaaattatgtcaacgaaaacaggtgagtcatgataacatttctataccatgtaatatgttttcctcagtatagtcagttaaacaagtttcaaaagagttttcattaacagatacaaccagtaggggtcattttagtgcaaaaattgcagcaaaagacttcctcatgaacaaaatgtatcaatttctatttgttagttatgataattatgtgcaaatttctgaataaaaatggaaactgagggaaacactggccattcagaaattttttgccaactaagagaaaaacaagagaatgtcagcatcctctagggtaatta

SEQ ID NO: 33850 - DNA, 766 bp, Bovine  19866880701894
gagtccggcccctgccgccctccccgcactagcgcagtgtggaaccgagggctgcactacgtccactcaagtccattttctgcaggcggaggagacgtgtctgcagctcacactccctgtgtgactcttgtattattttttccttgcgcttttccttcacccccttcctcctcctgcgcatataaatcagtttcagctccggaatatgtcagcccaggggaagttacagacggtggttactcatttatttgcctattgaaagtggtcaaaggctttctctcctgaatgaagggaggggtggggggccgggcggggggcttgcacctaggagtgaaaagttgtttctgtactattagtggctgctttttaagagcagatatccgcgtctttccagtagtgttgcttgtttttttgtgtgtgtttaataacgaggattgttctgctggtttctccagtgaagtattgtgcaccatggtgtctgatggaaggagaaggattgggttagcggagccctccttcttgggagaatcactgttgatgggtgttggccttcaaccctgcccgccggcctcggggtgcctggtcaggtttggggtctagagagacgcagtgagttccttttatttggctaatgccaaatagtgagcaccagtgaaacgcaggatccctgctcgggctgacgttggggccggtggtgctgttctggggcatcctggtgtgcgagcagagcgcacagccttactttggaggggcggaggagggacag

SEQ ID NO: 33851 - DNA, 3529 bp, Bovine  19866880715987
aagctctttacacttccggggctgacagcatgaaaaagtaaaacaaaatgagaggaaacataattgcctttaaatgaattttccttcactatctacatggcttgagctattctagggtgctgctatgctctctccagctccccatgccttctgctaacttctggggattccagacctctctgcatctacatggagtatttttacatgaaaacacaagatacacataaatgaataaatttataaattttcatcatccaagtgggattgagctaaaatatacattttacatctagcaaatgaagcaagtaagagcatgtttaatatttcaagagctttcttgaaacaaatttttaaacatgttggaataaatgtaaacaaatatataggaatgttaattttagatcataatttatgatactaatcatagtaactactctattgacggaattatatgtgaagctatgtggcacatacgtgtttctttcatattctcaacaccaatgctatgagggtcccatccccgggtcccatccctggtcccatcatagaaaactgagacttggagaagtcaattaaataatgcaggtaatctatagaagattatgcagtgctctaatttggattagaatccagattggtgaaaccactgttttgtttcttgaccactaaagcccaatgattcctcataaaggttctgtaagaatcttcaaagaaatttctttttttgtgtgtttgttttgttactattgttgttgttgttattttggccgcactgagcagcgtgggatcttatttgcctgatcatggatcgaatccatgcacctgaagcggaagtgcagagtcttaaaccctagacctctaggggagtccctaaagagatttctcagaaactgttcaagttcctaagtgcataactattctttgcctagacagtcactgaataaagttaaaactattttaagaatatcttctgctcaacttgtttataattcgtaattttacctgttcagatggaactttctagtcattaaatacatgatactttcatgaaatccagttgcttcatataccaagactgtaatatatagtctgtatatttaaaaatacacatggttttgtaatcacgtgtttggctaaatgcttaactaaaatttacagaatgtttacctgtgctttatttggataatcaatgtcatttaaaactattccacataataactatcctaatttaaaaggataaatgttctttaataaactgaaacaagtaattataaaaaggagatacatttttctccaacaggataataatgaccattgacagtcattagtgagtagctaatagccaaagggagcatgaaacaattattatgagaccatgaaattgatttataataaaaacaaatgatacacattggcaaattttaaaaaaaatgtcctttgatgtatttgaaaataatgattctttccaagtttataattctacattttcccttctctctaggacccattttttcaattctaccaaaattattttaaattcaaatcaaataaaatttacatgcttattaatatgactcatgcttgatgagaattaaaatttgggtttttcttgctgtcagtgaagtcctctgattttctcagttttgtaagattactgccaagtcatgcaactttgttaggaatgttatgctaagtatttacaggcatggagagtactatgcttgaatttttacacaatgtattgttctgtgtgtgtgtgtgtgtgtgtgtatacacgcactcagtcactcagtcatgtcccactctttgcaaccccatggactgtagcctggccaggctcttttgtccatggaattttctaggtaagaatactgaagcgggttgccatttcctttctccaggggatcttcccaacccagggattgcacccacgtctcttgcgtctccttcatgggcaggtggattctttaccactgagccacccgggaagctctgtattgttctgtaactttatttaacctgcaatgtcatgaagcttcatatttaatgccaagttttaattatgctgcacattttattttttcctttcaatgttcagttttcttctatttcataccttttaggtcaggcacacatgttatacttccagttgccgcctgggtgctgagtgcattgctatttggggactcacatggcatctgaccatctcatggagtccaggtggagagagaaataacttttgtgaggcaagatgctggaaggatgaaaatgttttaggtcagtcagtcagaggttgcagcaaagtgaggtgagaagaattccactcaaatatttctatattctctgtggaataaaaggtgatcttatggcttatggtgaagagctgggaaagcaagcttaaaagggatcacaacatcttagaacagctgccacagagaatgtggagggggctgactagggacaaaggaagtgatgataaggaatcttcaagcccccagacccatttagcctgcataagtttgcaatatggacagaatgtcacttcaggatgaatgctggtataactgcctctgggctgccaatgctgaactatgcccaaatattaatttggggggataaaaaagtgccattttctcattcccactactctattaaattagatatatataataagattctttttctataagactgaaagaaaatgtttgttaattttgaattttaaaataagtcatgacatatcaatgcaattgaatactatacatatttaaaggataaggatttcacagagatattaactatagttgcaaaaggtacatgcagcaagtcctcttttttgtgtgtgaaaaagttgtagttaaaacgtgccccagtctataggtgttaggtagaagtttataggctgcaactatgaaaattagaaatggcttcataacaccatattcctttgcttccaaggctgaatacctaactgtcctttaagtatatatgataaactcacagtatataaactacccacttaattatatcagatatcagtaggacgttggatggagtcatttgactaagtatatggatgtggcttggtgatttagatctgattagaaatgcagtacttggatgcaatctcaaaaacgacagaatgatctctgttcatttccaaggcaaaccattcaatatcatggtaatccaagcctatgccccaaccagtaatgctgaagaagctgaagttgaacggttttatgaagacctacaagaccttttagaactaacacccaaaaaagatgtccttttcattatgggggcctggaatgcaaaaataggaagtcaagaaacacctggagtaacagacaaatttggccttggaatacagaatgaagcagggcaaaggctaatagagttttgccaaaagaaaacactggtcatagcaaacaccctcttccaacaacacaagagaagactctacacatggacatcaccagatggtcaacaccaaaatcagatgattatattcttcgcagccaaagat

SEQ ID NO: 33852 - DNA, 1053 bp, Bovine  19866880735887
acccgtgggatgctgttactcctcgtcctggactaaattttgaggaacaagactctaaggggacttccagttctaagattacctgaatcattttcaggatttaaaaaacctttgaaccttcaggggaagacattcagctaccagactggagagaagtctgagtaggtggacacagtccacttcctgacagaccaaactttcaacttgagaggcaccacagcaaagttggcagctgtgcatcaagaccaaatgagacatgattaaaaaaaaatttttttttagttcctcttctctgtaggcagttgctattaaatgggactaatggtggtttaaggaaaagtgagagaaaaaggcaggccaaagcaagcactatacagaggtcgtctctttggaaacggaagctgtcagtctgggagctgggggtcctgcttttctaatccttctctactccagcagtcctgcagtgggaacacacgggcccttctgggctgattgaactcaccttattctgaagtccttcccctgacttccctgaggaattcttaaaacaggaatgaagggttttgttgcactattaaaaagaaaaagtattagatgcagataatcatattcttgacttgattaaattatggtgcatcttttaatatgacagactgaagaggctttcagaaactaggccaaattttctggagagttgccagtaatcacacggcatgaatacatatataagcaagatgttaatgctcaagaattttctttctcttctgtgaaggtaacagtagcgctgaagccatattcagtacaacccaagcagcagatggcaatttgcttaaattgcaagatggatttgaaattgggactgatgaaaatactagtgcctatagtagatgaaaaggagttgcttcatttcccaagatccttcaaatgtggaaattattactcagtgagtcagctaatttatcacgaggtatcagcactataaacacgaatccctctaacgttcctacctatgcagcataaattcctttagttgtgtaagcaaacacttcaatt

SEQ ID NO: 33853 - DNA, 2277 bp, Bovine  19866880746544
aggatacagaagggttacctgagtatgtgataacgatacaatttaatgactttcctttatagttaaaaaagtcttttagaatggaaatttaaaaaatatactcatttcaatagcagcattaatcatactctacttaggaataaactaacaaactaaaatgttaacaaaattgtataaagaaaaacattcactgaaggacaaataaaaagtgatgttcctgaggggaagatttactaacaagcatataaatccttcccaaattagtatttgcaattaacatgtttccaattctagtcccaatgctatctcctgggttcaattctacagttcctttgcatataattagctttctggcagaaagcagatggcacattcaaatggtgtaattgaggaaagtttaatgaagagataatttaccaaggttttggtagggtgatctgaaaaccacaggagatggtgaagccctcgggactcatattaccatactgagtcctaaacaaatgggcaaggggagggagtggagaacagagagttccaactccagctatgggagaggaccacccaaggagaagtgtggtgcactggacggaagccactgaggattgaggactgtggactgtagccctgctgggaaggagctgagtgaacaaatgccatcttcctttagtctactcttgctgcctctcattggccaaactcaaatggaagcaagaggcaagagattcagggtgaagcagtccaaagatgcccagctcccaagataaagaggcaagcgaacctggagaagcagatacagatgtccggttctgtgttaaagaatcatgcataatgaaaatattgatgactacatgtaagagaagaggattggtcctattccagatcttgaaattttcaacaaatgcacgattgagaaaaggaataggcaaacaaagaacagagtggaacagagatcccaaaataagcttgagaatgtatgcgaactagttatatgttagagattctattccgttacatagaggaaagaatgacttacctgataaagtttctaaccattgatttggaataaaagaaagttgatattcaactcatacaacaaaaataaattacagactaatgaaaaacctaactagaaaaaactataatgtatctgaagaaattatggtgggttatttcttataattatggttttgattgaatttcctaagtaagacatgtcacaaagaaaaaaatgtaatgaatttgagcagataaaaatagagtttggatcacaagaactagcaaacaaacagattcatgacagcaagaacatatctgtgacaacacacagaggattaattactataaaataaagctattccctgaaaatatgtaaaaaagtcataccattaaacagaaatgggtaaactgtatgtttgtatagatggtgtgagaagaggaaatataaataataaggatatgaatacatgttaaacctaatagaaaaatctagaacttgaaagcatcattatcagaatggaaaagttaagaaatattaggaacatctagtgatgatgagagtgtgcaaagacaagtgctttcctacttactgttggtaggagtgaaactactacatatttctacaaattatttttcaagtacctcttaaatttaaaatatgaatatagtttgttctctaattccacttggaaatgttaatgaattctataggaataaaataattaaactgtaaaggatatcttttctttccttccttcctatggccctctcttcctatcttacttccttcttgttaatgatttttaataaaaaacatgcatttaacatggtttagttattaataaatgtacttcagcaatggaaagctgtattgcagaaactatgagtgctttcaagcactcatagtttctcctatatttccaaactgcattgttttagcttgggaccacacagctaccactggccaatgaatatatagcaaaaggacagacctcagaggcaattggcaggagtgtgactcttcccaccttctcttcctttgccaagtgtgccttggaggccttgtttccatagatggcatagttacaacatggaggagagctgcctgacccatgttggatttacaccatcaagaagtaatctattgtgtgatgcacccgagattttggagtttatttgttatgacagatatgttaattttcctctaaagttctcaactgattggctaagtcccacccgcaatgtcaagagtaattgtctacttaaagtcaactgattgta

SEQ ID NO: 33854 - DNA, 1118 bp, Bovine  19866880804864
tgctagtagatgactgtatagactgaattgaattgtgtcttttcctactctgaagtatatactgaggtcctagcccccagtacgaatgttcactgtatctgaagacagggtctttaagtaattaaattaaaatgatgccattagaaggaaccctaattcaatataactggtatcctttgtaggaagagaaagatttggattcaaacaggtatagagggaagaccatgtgacgacagggagaaaacagccattttcaagccagggagagaagctttcggagaaaacaaccatgatggccccttgatgtcagccttccagcctccagaattgtgaaagacatttctgtttttgatgcctcccagtctgtggtattgtgttatggcaatcctaactaacagtgataaagagtagaagtttatctttcaaagccaatctctaaccaacagctaggataatgctttggctacacatctttaagataacttaaggataatgcttttgctatgcatctttaaataactttaaaatgaataatattaatttttgttagagtcaataaaataaaaatgtggtatttaataccaatttatagttccacatgaactttcaggtgctgctttactgaaggactattaatatagtaaaatgcatcctgatgtacaataagtaatgtgatgtggtcttatgtatgttattacacattctggtacaatctagaattcatttttaaaaaagagatcagaaaaacactgtttgaaatagatacaagccatggatgataaagttctttatgttacccacagatgttaaatggattgtatagtaatgtgaaagtgccaatcctatatttcaggttgaaaaagtcatttcgattttaaactcctattttttcttcctcaaaaatttttttaaactcccattcaccactgaattctcatgcttcatctcaatttcagccatgtattgtgaagttacacaaaagttcatttggctgattatgagacatcccaatttgagaagatatttttcagttaaaggaagctgaaacagattaattttaagattttgattattcaaaatgggtttggccttttatttaagaaatggttttactgaaa

SEQ ID NO: 33855 - DNA, 1288 bp, Bovine  19866880930436
acatccaaatttgtgtacatttgacttcaattcccatgaggagtcagactatcacctgtgttgacctaccttccagaagtttctacctctggaatcccaggaataatgtcccttgcttgtgatcaatctctaggtttctctaactttaatatattgcctttaaaaataaaataaacaaacataaaagcaagaccgtggcaatgattctcttttctttcgactacagtagctttctcacttctgtattttttttccatcacctgaccttggcttttcctcttaagtcctacaatgttatctgctacgttttaataatgtctttatacttgcatttgaacagaaatatagataacctcctctgcaagagtggaaagggccttttaacacagcccaatgatgacagcttgttggcaaatcccacggtagagtactggtgcctcgttggggtccaagaaacaatcatgttcaacagcgttgtatgttttattgttcttgaattttgctaatggaatatcaagcatatctgaaatgattttaccacttaatacttataattatagaaccttagggtatgaggtcctttggagatcatctaacctgacctcctacacaactataggaactgtccctacaacatccctggaagcgagtcatctcaacagctctttaaatgcttccagaaaatggtatgctcactccccactttccactgctaataatcagtgataattaatgtgactcttccccttctcaggacaaagaactatgattggagaaatgtttagttttctgattccaatgactggggaatattccactggtacctttggcttttcccttcaggattagagtggttaaaccaaaatgtttataagaagtataaatttgttccgcaaacagaagatttcaaaggcatctttgtttcttctctccttacactgctctgctattaattttgggttcattagtcaggattttcagatccacttggctgccaccttcctgcagccagaccatcttggatcaaaaggtcagcaggccattcccatctcacacctgccacaagatctgatttttcttttcccccacactgatcctagtcactttctgttaattcactaattttattgaccctgtaacacattctgggaatggtgggccattacagagcctatcacttcgagatgctttttctgacagctacagatgagaaacaacctccacacgacgcattctgcaccatttcagctgcttctttaccggtttaacacaaagaacatcttcttta

SEQ ID NO: 33856 - DNA, 2275 bp, Bovine  19866881045025
aagtagattacactgatatcctgcagtggcagaacatcaccctttgttttctcttgcttggatgttcctactatcttttgtgctcctcgtttcttccttggatctcttattctgttcctgtgatcacgccctttggatggtgcaggccttggcagcctcaggggaaatttgcgttgctgggacctgaatgaagttgctgctggtgttttgttctgtttttaacaaaatcctgactgaataagcactttcccaccaggttagccctatattcctatgtttcttgtaccgtgaaattgtcactgtgtaagtatcaggaatgtcaacctaatttagctgcgcagattagtttatatcaacatcctgaaggtctgaaagaatcagtgaagcatagcgtttttgagctggaagggatccccagtgcaggtctcaaggaattcaaggagtggttctggtgaagttgggcatcatgcctaaaaggaatctgatatattcagtgtctgctttcagttcccctttgatatccttttaaatgtgttggcacaggtatagacttgtggccttttaatccattcctgtgaaaaagtagtagagtgaggtgtgaatggcctggagaacacattggagctctgctatgtgtgggtaatgccaatgtatatccagacggagtgcttttgaaaactctgtactaccaagactgatccctgtgagggtggtctttgtactcagcaaaataaaaaaatgccttctgtaattaggcagaaatgcatggtggggcttgccttgaaatccctgaatttcaatggccaattctgggtctcctgccttactcacaatcctaaataccacttcatgcaagtctgtgtaaaattctttgattttgtgaattaaagcccaaccagcaactaacaatgtgactgaaacattttactacaggactatgatacctaaaggattgagagaacctttatatatatataaaggtttatttttatatatatatatatatatataaaggtttatatatatatatatatccacattcatatttgcttgcacatctgtgactgtattgtcacagttccataatgtcagtatataatgaagcagatatttgaacaagatgtaaagggctaaatcacccaggcacacttattttcaaataacttcttatgacccaaatctgttgagctttgctggacccataaattgcactggcatttagaaagaagacactgtgcccagaaatggtgcaatcacataaggtaggcccaggatataaaatatatttctattgcatcgggtgagcacaggctataggggagaaaataatgtactttcaaatctcttaccacatgatggagcaagacttgctttgagccatagaactgacccaagtccacatgtataactgacattaattttgcaacataaataaggcttacttcctttcttagggaactggaggataggaaatgagaaaagaatataccaaaaccttttgtttgttccttaaatatatataaatctgttgtataccagctatttgttatgctgttttataggcactggaggtactggaggagaaaattgacaaacattttctgcttccttgaaatttactttcaagtagaagaaaatcagaaatagacatactaaataaaccaaatctattgcatgatagaacaaactagagcaaaatgagggcttaggtagctgcatacttaagtaggatgattggatatttttctgagaagatgacatttaagcaaaatgtccatgaaggaagtgagccatgtggatatctgggggaaaggagtgtcaggaagagagaacaagtgcgaaagcctggagatgagagtgtgtctggacagttccagaaacagtaagaagctaggttatctggagggaagtgagaaagaggataagacctgaaagcaaatggtggggtatagtggggagtaggagagactagattttataactttgtaagctttgttttgactctgattgacatgggagccactgtagtgctttgagcagagaggttgacatgatcgcattttcatttggaaaactctggctgctgtgttgattggagtgtaatggggagtgataggcacagagagactggttattagcctaggcggtaatgccaggtcaagctgaatacaagaataatggaaatttttatactggcagagtagccaaagtcattgcaatatagacgtaaatatgtcaaaaagcaacactttgcctatttacaatagtacagagt

SEQ ID NO: 33857 - DNA, 3589 bp, Bovine  19866881066107
ctaaaattacattaagatataagaaaactctgaaattctatttttccttttactttattgttgcatgtgatgtgatgctattaatccatgctaaatcatacatatgtagcaggtgattttacatgtatgagaaatattccttttttttttaagtaacagaaatcattttaatatatacattttcactttggtcaattcaacaatgatttctaataagcatgcatatccatttagtttgcttcaaatatatttatttctcaacatgcagcaaccttccttatgagatagttgagttgaactatttattcttaaggagtaaaaatgtaccttgttctcaaagagttttatcaactttaaaattttcagtgagccttatgaggctgctcaatatggtagttttcccctgaaatttcctatttggaggatggcaaaacagtctaggatcttccccagtctactggtcgcttgtattcatatcacagcttggctggctaagaggtagaaacttaataatatgtagatagtattcaagcccagttgagtgagacagcttcatttttagaaaggaaaccaaatcatgaaaaccctcctaatagtatgatttgttccagggttcttttaagaagggacataatcctcattcacaggactctttatggccttctagagttttctgctccagccagtgttctctagccaggtgacttattgcacttgctgcagaattgaaggcattaagtctctgtctactttcataattggaggtggtgttagtcttctcatttctggccaaatggatcagaccacactttcaaccctggtggctgtacgtcttgttgaacaataccagctcgatttatggtttgttccttctttttctagtgctcccaccttcctgctgtgtgacccagactggatgtgtatgcgatgggagggagtgtgagccagtggctgagggcaccaaggggccacaggaagtacgggctcctcccaacgctgggaacacctctgtttctcaccagggtgtgtgatgaaatccggggcagcttttaagtctgtactctttcagccgcaataagggcccggagtagatggggtagaaggcgacgccgtcatcaggagatgaagccgccgaaaatgagagcagtgcgcaggttctgggaactggctccagccgggctacctggtttatcctagtgcctgggactctccaaacctggctcccgccggctgggccatgacccggctccagaaaccttcctaaatgaaatgtgacatgttggaagttctcattagcaagaaattatgagccaaggccaactttgaaaatggatggggaaaagcaggcagaaataaaagtctggttcaatctagagaggagccaagagtatagattaccaaatccaaggggtgtggtgctcttgattacaatctgagccagtctttaggtccaagagacctgccctgtggatgcaggacagggcacagctacagcaggcagaagtttttagtacaagtagaaacctataccagagctaggaatacaggtgggttttaaaagaggtgttcaaagccaggtccaagagccacgccaggaatttaggacctctaggtgaaattctgggccagacccagagggcgagtggattgggaaccagcagctggagtcccaagaagaagttaagccaggagactgggctatgtatgggaagaacaaatatatatgagagctcacttatcacaaaagaaaggagctgcaaaattccaccagcctctcactggttgaagggttagatagttctgcacctgcgggtgagggagttttagggcacacaattgtggaaaatggcacgggccctaattgctaacatctgcagatgcatctgagcacttattttgccaccagttgtaacatcccccaatattcagcaactgcaaatatgacctacatcccagaaatcaatctaaccatctatagtagatacactatgtctgggagcagggaattcacctccacaaagacccaactgagatgtgaaaacagaagagggccgtgtaggaggaggtaagtagaagatagcctctcaagactttgcttgtgcaaatgtgcaccagctatctcacactacctctactcacatgtctccctgtgtcaggttttcacaaattgcaggtaaagaggacatttaaattccgattcaacccgcaggcgtgtgccagagactgaaggcggtatttggtcttttagactaaaatggaaaagtaaatgcagatggagatgtatcctctgccaaccagagagcaacaagcaatatggtttccaaccaggcagaggcagcacttaagccatcatattaagaattccctgcataagaggagacaatacctcagcagatatgagtcctgattattatcaacgatagtcccctggcagagggtgtgaatgatttgcttctaaatgagatcaaatatttcacaagcacagttggaagaacctagctgtttatgaacaattaaatgtttggctagaaaaaaaaaaaaaaatagaaactttatttaggactgaagccagctatggtagtttgaaacaaacatagcgtgtttcattatggggatcaggaagcaacataaaatattttccaccaaatttgcctccaggtagttgtagtgaaattcagtcagcaattgcagtataatttgaaaagaaagaacaggagtccctttagcaattaaagacacatctcaaaagataaataaaatggagtcaactctgaaggtaatccatcttgcatgatgttgagagcagaaaaattaaagtagtggaggaaacaacccactctagctctttacaaaggagtttggttcagtgagggtgaagagtaggggaatgtgtggaaaggatgacaaagttataacaattgattatcaagcagaataaaaagcagaataagtgactggacactaaatagggaagagttaagggaaatcaataggtctacacacagatgaaaaaatacttatgaaattgataattactgctccagagatgaaacaggagaactaatttttataaggtttagacataatcagactacctataggcatcaaaacagaagttcatgcagtacacattgaatatcttgctccaagatccacaaaggggtacagtcacagtcccctgatgcccacaaacattcgtttcttaacagtatatggatataaagcagagatttgaaaccacagagttggggtttaaacatacttgtctaaattcccagttatgtcagtcagttcagttgagtctctgagtcgtgtccgactctttgcaaccccatgaatcgcagcacgccaggcctccctgtccatcaccaactcccggacttcactcagactcacgtgcatcaagtcagtgatgccatccagccatctcatcctctggtgtccccttctcctcctgcccccaatccctcccagcatcagagtcttttccaatgagtcaactcttcacatgaggtggccaaagtactggagtttcagccttagcatcagtccttccaaagaaatcccagggctgatctcctcagaatgg

SEQ ID NO: 33858 - DNA, 1301 bp, Bovine  19866881072509
ttcagactgcaggtgtggcatgccctcttattcagagcagttttatttctaaattcatgtgacaatttttttttttttttgattcaagattactacctattttcctctgtaaagcagctgttgcacagcagtactggcttcttgaagaaggttaatggtatcttgttgacataatggcagttatgccctatatgaaatggagcaaagtgacaatatataatgtgttcattcttggtcaattagagtttttcaacattaaggaggtgttagggtagcataggcttttaattatctggttccctgtttccattgcaaaagatactgagactatgaaaagcacttagtcattagaaagtgttgtaagtttatgatttattcatagatgacattcagactatctaaatgttaaaactcctttgccgaattagcacaagaattttgagaaaaatctttatttgactacaataaatattatattagatttgcttattatttccatctgtgaatgtaaatgctaaggacaaaaatacgtgtgcctagggttggaaaactgaaaaactaaccaatgaacaaatgattaatcataatttaaagttcattctagttaaacttcaacttgatcttgttacttttctgactttcctggtaaattttgaatagatgagtgtgggtaccattcatttctatgtctttagaatttaatgaagtaccagaatattatcagtagagaacagctatcttcctgttttttatctatctaagatatttcagacagccattctaaaaggcatctgaaaaggccatttcaaaaaatacctgaaaaactgataatttctttatggtttacaattaagtgttcagcatatttaatgatcacagggaacttgcattttttttttcagattggtacaactcactgtttctccatgactaatataataatgtacctaaatgagaaaatagaagaatattgccaaaaaattaaattagattatttaatttcttctgggacaactgccatcaattgtcatcaatttaaacatgggcttctttatataataaaccattgtaagcatgtattgacaaagattatagtttgagagatatgtgagaatacttattttagacccagatgattacattctttctctttcaatttaaattttatttctgaagcttaattatgaaaatatttgtgatttgaaaatagtgtgttaaataattagaggccataaatctcaatttatcacaagactgtcattcaatctaatgaaactgttttaggccttatacatagaaca

SEQ ID NO: 33859 - DNA, 1399 bp, Bovine  19866881123899
catgagagcagaaggctgcataggcaagctgacagtttctgcaggacatgatggagccattaagtttccactaggtgggaatttccagtgaaacaaaatatctagaacaatagcacaacaaatacccacttccaataatgtctttaagacatatgaaagttctatagcagaataatcatctagagacatagggggaaaaagttcaggtttgtttgggttagcattattaggcaagatatactgcagtttaaatgtttatctaataatgagtaagcctggtacactgggtcacacacataaaaaggataggggaactactctaggctcaaatcggagctagaaaattacctgtctcgacattattagtagctccaattatttaaggaagaaattctaagcacatagtttctcagggaagcagcaagcagtggaataagcacacacttaagagaggcaagttcaaatcctgtctctaccacttagcaacaatgtgacttcactgactacaaattttgggtaatactattggcttcattgactagagtcaaggtaacaggtgggaaacaactgatgtaattcatgctaatttatgtctcccttccttctccctttccctctgaagtcaaggctctttcaaaggcttccaaaggaatcgattatggcagcggtgagtcctgagctagactctattatgaggcatcccatatcattccttgttcatttcattcaagccaccatcattgcagcttccttccattttctgactctttagagatgaatttatgtgtcttcttgaaacacaaattgcttgagtcatgcttatgtcatgtcctgacagtcaggatcaaagtttcgtggagaagtgggaggttcttcagcaacagtacagaaaacacaacttcttagataggtttagttttatcattatccaaaatcattgaaaatatttcctcctctgtttcatttttcaaaacctcggtaaacaaagacctcttgttagtctcataacttgtacttgcacagaagaaatctaaataaatttctttaggatacactttgatggtcgagctccacaatgatttcataaaaatattagacatgaaagaattatcaaggatggactctctcagagagaatcaacattctgctcacttctgcaatttgcacttcaatatgattctcaggttatgcctgatttgggaggaatgaaaacaaccacactcagacacatggcacaaaggaagggcatctccctgcacagtttctcctcccacaaattctcgacagctggggatgcccaggagatggcagacaggccatcagggagctctttgctcaagtgctcattgaggccacttcatcttgtaactctttggacgtcctcttttcctggcacgtg

SEQ ID NO: 33860 - DNA, 838 bp, Bovine  19866881139694
attcgattcctcctttcctaacaccaacaaacagggctctggaaccaccaataattgaccaaaaaatgaaaaatgatggtgattcaatatgaatttaaaaaattaaaaagtaaagaagacatacatatgaatgtgatatcatcttgaaaatgtacacatcatatcttgattcattatcttctggctcattctcagctcaggcatttattcccagagccttccctgatcacacctccatctcaagccttgttccatgtctctcctctgtgcttctaacttccttatgtctctctctgtgagtgccctcaccacattgcactaaaaatgtccatttatatacctgtctctctgattagattggaaccttctagaaacaagaactttgactcacctgtcctctcatccccagcaccaacaaaatacgtgtatgcggtgtatgtgctcaggaagtttttatgaacaaattaccctctatcaggcaccaaacaatatgcaagatattttataattatttgggtatctaatgtaatagtataaatatttttaaattataggcattatcacatgtaattctagcaaaaaccttatgagatagggatgactgttgccagtttagaggggctgagtcatgcaatcagacaggatcaaaactggaactgaaagttaggggaaaggatttccaaagccgtgtccagcactctttcttactgcttgtatgagctattggcactacagaatgatgcattattcacttttttccccaaaataaaccatctgcttgttctctcccattaatatgtaatcaagaattagtaagatttgtttgcaataattttgt

SEQ ID NO: 33861 - DNA, 457 bp, Bovine  19866881188702
aggtgaagtgagatcctggaaatacagagagtggttgaggtgtggagggggaagagtgtggcctgtcttggtgagatttttgcttaggacagaacagtgattaaaatatacccctgttacatggacattaacttaataatcctgctaatatacaattacaaactgagataagtgctctgaagaaattttgagagcacttaagaaagagatgtgacctaaagtggagggtcaggaaagggttcccctgaggaaatgacatttaagcttaattttcaatcagaagtggcagttaattaaatgaagagagtggggaaaatgcatggcaatggcccatgctgctgctgctgctgctaagtcacttcagtcatgtccaactctgtgcaaccccatagacagcagcccaccagactccccagtccctgggattctccagcaagaacactggagtgggttgcca

SEQ ID NO: 33862 - DNA, 1225 bp, Bovine  19866881208211
ctcgctgtgaatttcttaaaaataagcactgtgctcacagcatttcatataaggaagaagaaaaaagggaatgataaactgagtgtgactaatgtacatgtagctcatgtttctctttagggattatgaaacctcttggagttttattcttctctgtccccacttgttcctgatggtgtgaagtcagtctgaccaattccaaagtaaaatatgcagtgcttcatttcctacattgctactttaaggtattatgttattatgaaatgagtacgtaaggatccaatttcacaagagtgactgaggcgatatgtgtgcattttaaaagcgtaatcaaggtaaaattgagttcattttccatgaaaatttcatgtacagctactgaaagaaatcatttctggcagaggcattttaagggcaaaaagttgtaggtgcaaataatctaaatggtaaatgtatttgctctctcatcttgaaggtaaatttcatgtttttagcactaaaaattcattagcactctctttcccctcctccttagctcaactggacatcagcaaacctttgcataaaattttgaaccatcaccattgcaaaggcttctttgattcactcccagttctgcttggttcaggattcatatagaggatttgcagattcctcccgcaaacaactttgagggctggaactcattcatctaaagatgctaactgtaaggcctctgtgccctatttttaacccacaagttcttaccatgaatccatacctcatttaaaggctttgtgtactgcatcttggcaatttgccaatgcacagtaaaactatctgtatgtgaaaataagtaaaggctgtcttgaattaagttgccagttctaaactacattctaatttcctgtgaaactgtaataaaaatcacacagtttacttttctcatctgtgaaataaattcatctgagaaattttttcctaataggatggagatactgaaatttataaaaggagtcacttctttgatgtactgaaaaccagaatacctgtcattataatctactgagtttcctgttaagataaatattaagtaaatcacactaaatgttggaacacccttctataaattgtaaagacacggtgttaaagacagtgactgtacatacttcttcattttcagtacatgtatttgaaatagcaatatgaataaaaaatttagttactattactaaaaattaagtga

SEQ ID NO: 33863 - DNA, 857 bp, Bovine  19866881279164
ccagatactggaatcagggtggggcctctcagtgctctttccccattagtctgtgaactctgaaaagttaaagttgtacagagtgtcaagtgcagaaaatgtaaaggatatattgttactataatgtcacaggaatatgatcatctgtttaaaactgcagtggccacgcacataaaaatgagagacggtcgcataacctttccagggactaaaagctcagttcatgtttactcagccgtggaaggtgattgtcctgtaggaatacagattatgaattgagagctcctcgctctgctcacaccaaacagccaaacatttattctaaatcacaatcagaaataccactgcagcaaaaccttaattacctaacaccctcaactccactctaaagcatatatagccatttccccacaaggaagagacctcagaggggtcactcacacctttccagtggctttaatgatctttggtgcagatattatctgaattcatttctattttagttctacacttaactaaattgtcattaagtctctgggtctgattatggaagtacttgtggaagacaggcattttattttagaaaagatctgaagaaaaataaaagaacaaaacaatcaaataagaagagagaaaaaacagaattaatgaattgaggtgttaatagttcttccctcctgggaatgttaccctccctgaatcttgacctctctggtacataaatacccacatgcttccggcaaggatgtctctttttaggaggccttcccttcactcctgtcgacctgggaactcccttcgtcatcctctccacctctgacccacgcttccattgccaggggagtcccgggcagagc

SEQ ID NO: 33864 - DNA, 1445 bp, Bovine  19866881302161
tttgatctcctggcaggctacagtccatggggttgtgacatgactgagcaactaacacttttcatgtaacatcaccagagaaatcctgtctcacagagaaaaatcagaatgtttaaaattaccaaaagctttgaagtccagtgccaggtacagcataagtgtccaattaatatttatagactgatgggggggagggaatatttatgtataaataagaatattgactataggaatacacagatgattttttcacacagtatttcaataccatgttcagtttggagcctgaaacttaagtgaatagagaacttggaatagttccagagaaaagcaatgaaaatgattaaagacttggaaaatggggcctataaatcatgagtacaggaactggggcttatttaacctgaaagaaaaagctacatgactgcaccagattcttatatctgaaagtgaaagatgggtgagatttgccatcacccgtccatacagcgctgcaagcagaaatccagaagtggcaaagatattttccaagtattagtattatttctgtgaacctctgtctcttttcttgtggtttttaaaacaaccaacagcggccctgggacaagctgggtgtgcattgattaaacccccaaacatgtatctagtgcccccgtgggccaggtgccttgctgggcattacggagagacaagagtagggtaatgtgtgactcctaacctcaggagtgtggaggattagtccaggagacaaccgtgtaaagacggttgctggatgtcagggaatctcctctacagatgatacacagtgtctttaagaaaggcacaggaaagttcacttgggaggctggggtgaaaaaaaaaaaaaaaaaacagagtttctttaccagggtcttaatgctgcaaatgagtttgttgagcagaagtaggcaggagagcacttaggacattctgtgtgaacagacatcaagcacaggaaaatccaggcatgtgagatggacacgtgagagcttgaaccagtcaggagggccggagcagataagggaaatgttatcacatccaatttgcagataaagaaactgagggtcagtgttctcagtgatttgggcaaggttatcagcaatcaagatcagagttgggacttgaactcacaagtcctgatctccagttgttactcctttagcaattctaaggtgccatggtgtgtcagataaatatttctttccattagagctgaaattattatcaacaaaaaattcatcttgttgagtaatttgagggggagatgatgtcatcatggtcatatggtgcaaagtcactggattctgtgtacacacacacacacacacacgttatttataaatagagtttcatctagccaaaatgtcatttactaatgaataatgcatctccgcttcatttgttcagttataccccacatagtaaag

SEQ ID NO: 33865 - DNA, 1808 bp, Bovine  19866881402103
cagccaatgtcatggggctcttgttgaaatttctgtcacatttggtatttatgaaaatgaactatgtccttgggaatttcaaaaggctctgaagcacaggcctgaggagggcaccagagggaggcagagcagagtgtattgctgtgaagttctgataggggtatttggattctaatgatagtgatgattctgtatggtaggaagttagaaagaatcagaatcagaacgaaaccctcatgaatcctccaatgtaggaaaaaaaaagaaaatctgattttgagtaaatttacctgtactgccagttaattctgagaaaagataggtttgaaatcttgtagtctttattttttagagacacacttaaacctgagaaaaggcaaacacgagcgatccacagtcttttgggcataggtgacactgagtccacctcatgtctgcgtggctgctctccgagatggctcttcacatcaggtggccgaagtattggagcttcagcttcagcaccagtcctttcaatgaatattcaagtttgattgactggtttgattgccttccagtccaagggactctcaagagtcttcaccaacattacaatttgaaagcatcatcctgcagtgcccagcttttttttatggtccaactctcacatccatatatgactactgtaaaaaccagttttgactctacagattttggtcagtaaagtgattccactgctttttaatatgctgtctacttttgccatagctttccttccaaggagcaagtgtctcttcatttcatggctgcagtcaccatccacagtgattctggagcccaagaaaataaaatctatcattgcttccactttttccccttctatttgacatgaagtgatgggctggataccatgatatcatactttttaatgttgatattcaaaccaactttttcattctactttttcaccctcatcaagaggttcttcagttcttcttcactgcctgccattagagcggtatcatctgcatatctgggtttactgatatttctccctgcaaacttgattccatcttgtgcttcagtttctcaggaaatagataaggcagtctggtatcccataagtttaagtatttttccacagtttgttgtgatccacaaagtcaaagtgtttagtgtaatcaatgaagcagaagtagatgttttactggaaattccttgctttctccatgatccaacaaatgttggcaatttgatctctggttcctctgccttttctaaaaccagcttgaacatctggaagttttggttcatgttctgctgaagcctagcttgaaggattttgagcataaacttgctagcatgtgaaatgagcacaattatatggtagtgtgaacattattaggcatttcccttctttgggattagaattaaaactgagtttttccagtcctataaccattgctgagttttccaaatttgctgacatattgagtgcagcactttaatggtatcatcttttaggatttgaaatagctcagctggaattccatcacttccactagctttgttcatagtaatgtttcctaagtcccacttgacttcacactccaggatgtctggctctaggtaagtgattacaacatcctggttatccaggttattaaaacaattttgcatagttctgtgtattcttgccacctcttcctaatctcttctgcctctgttaagtccttaccattctgtcatttatcatacccatccttgcatgaaatagtcccttagtatctccagttttcttaaagaggtctctagcctttcccattcta

SEQ ID NO: 33866 - DNA, 848 bp, Bovine  19866881433322
ccctcaaagatccagaggggtagactctgagatttttgagaataaggacctcacttagtcattcagaacatacatatcaaacactgagatgatggcccagataaatctcctcacctaatgattataccatccatgattttgctttaagagctggtaattttcactttataaatttacccttgagtttggggtcattacttttattttactgctttgtttaattttcattcagcagtattagatatgagaatcaatagcctgaaaaatttctttagagaaaaatgattctcagtaggaaaatgtggtttctagttagaagctcactgaactctcatgagtcattattacataaagtcccattagcaaatgtgaagacaataaaaatgtattattttagttctcatttttttcattagttctactaaggatctaaatcaatagctttaaattcttaattattttgaagttatgtggggtgagtgacccaatccttcatctactcattcccttcttcagttgctatagaggtcaaattatcaaggagcaaaaaagtaagttgtaggaaacctggctagcagcatatacatcattgaactatttaaaaatcaaacaagaataagagcatatataataggttttatagtctacaacagggagttggcaaaatttttcttaagtgtccagagagaaagcattttaggttttgtgagtcttgaagcctttgtgccaattatacaaatacactgttatagcacaaagcagccatatattatacaatatttgaacaaatgtagctccacttcaaaagaaaacacaccacttcatttatataagcaggggcaatcggg

SEQ ID NO: 33867 - DNA, 959 bp, Bovine  19866881455099
tttaaaaatctaagaaaatattgactcaaaatatccctgtaactacaatgaattaaaaataagagagacagagaaacatatgaaatatgacttatttaaatctggaatttgaaaatattcagatgatactccaagataaaatgagagtagcaaagtaatcctagctagagttttccttttttctttgttattcagctgtatgacaatataccatacatatccaattaagagttgctataatttagggggggaaatctcaaatggcttaaaacacataaatatgagactttcaccgttcaatttttctaaacctcaaaacattttttatctttttgttgattcacaaacctggacagtctcccaggtgaaacctgaaactagcccccatacaaggagggcaaggagaaacgaaaaagacacagcacttcagattggtagatggcaatactaataaacaagggaacttacataggaggcttgtcttgggagagagcgggatggatagatcattgaacatgcccaccagaatctcaaaggttaggggccttaactgggctcaatcacatatactgttcagtctcaacaatacagtgctctcaaggctgcatccttgaaaacaattcccactgcaggaaaaaaaagtggattctaaggacagggggtaaagagctcgcagttacctgggtccagatcaaagatcaatgggtactcatatcttctcgatgataatttcaatattcctgtaaaccaacaccaccttgagtttctcaaggaaaacataacgagatggaaacataagaacctatgtaaataaaaatcaaaatacaaaataatataaataatcttcttaccttttaaaaagtcataaactagtatgtttacttgaagacgaaaggatatcttatggtgccactatccttccttcactataggaagtacaacttacaatttatcaatat

SEQ ID NO: 33868 - DNA, 1511 bp, Bovine  19866881457569
tacagcatcaccaaaagagttgagaagtcatccttatattccaaatctttctttattataggacttcttttctctgaactccatttccaacatgctagctcataatgcttctaaatttcatctggggctaacacactcactcggagaaggcaatggcgacccactccagtactcttgcctggaaactcccatgggcggaggagcctggtaggctgcagtccatagggtcgttaagtcggacatgactgagcaacttcactttcacttttcactttcatgcattggagaaggaactggcaacccactccagtgttcttgcctggagaatcccagggacgggggagcctggtgggctgctgtctatggggtcgtgaaaagtcggacacgactgaagtgactcagcagcagcaacagcagcagcagcaacacactcactgcttacaaaaagctgatagcatttgtgagatatgggggaaaaatcaaaggagttgattaaattgacatagagaattatttctcttgagaaagtgatttctactgttcagttcgaatactgacagctttgtaagtctctatgtaatatcagcaataatctaaacattgtttttaaatgttgtaacataaaatgcctttttgagacctttcttttctatggaaaatataggatcccagatcctatattttatctcacatagatataatgaggattataatgaaataaggatttgctaactatgattttctgagaaatttgtctctattaaaagaaaatgtagtgaggtcatttcagaaaattctcagggtattcagatttggactatatggttgccataaaagagacagatacaaagcatggtgtgagtgttagaatcatctctcctatactgaaggagagcaatgtcaagggaggctttgcagagaaggtgacctgaatagatcataaaaggatgtggaggagtttgccaagtggaaaaggtgtgaagggcaatgatgtgtatacagaggaaagcactttgtataaaaacacagaagcattagacaatggtacttttggccaaatgaatggaaatttgatgagacactgggagaataactgaagatgaaggaattcagccacataagggacaaatcaaagaggttcttgtaatccatcttaaagattttaaaagtatttttgtaatcactttttgataaataaaaataatattaaatctgcatgaattttaaccttaggttgggatttataatgtcttacagaaacaactaactctattagagtctaaaacctagactccagaaaaagtatgaatgtatgtgcgtgctaagttgcttcaatcatgtccaactctttttgatcctatgaactgtaacccaccaggctcctctgtccctggatgctccaggcaaggataatgaagtgggttgccatgccctcctccaggggatcttcctggctcagggatcaaacaggtgtttcttaagtttcctgcattgggcatgtgggttcttta

SEQ ID NO: 33869 - DNA, 624 bp, Bovine  19866881490946
ggaaagagaaaaaagaagaaaaggccaagtggcctttcttttggacaataattggccagtggggtcagaggcttgttcaggccactccttatttgaaataatagagctttaatattcatgtaagagtgtttgcttgttttctctatagccaagagagaggggggttgaagtcagcctaaccggatcattatgagccaagttttaaagaaggaaaaactaaatacaatcctttataatcccaaaagctatcgtctgccatgttgaaagactgttcctattggctctgatctgagcagaaccataataggggaagttttataaaattgctcttgtactcagagcaggcagaaactttccctgagatcttcaaaatagatggtataattagcaatcattataactttgttaccactcatacaacaagatacacaggactgcttattaaaatgagtcttgacacaggctagtggtacacacacagccacaatacagagaggctctgtctacactgagctattcaaacagccaaatcttatatacaaggataaagagcaagggattttcaataagtgcaccaacaattcaatatctctaacatatctatttatctaggagagactgaag

SEQ ID NO: 33870 - DNA, 1291 bp, Bovine  19866881808546
cacatgtagagaaataatgagctttttccaagtatgactgccatgtttccattgtcaatagtatgagatatgatgctataattttccatcatctaacttatgccagcagttctgcattttgaaatacagagtaattattctctatacaggctcttcattttgtgttccatatgggattaactggaaataatattttaaaattttaggtatctggaaaagtaacaaagaaaatgaaataagatctgaaaagcagtttaatgcctttgagggaaaataaatgacagaaaaatttgaatactcaatgggaaggtaaagcttgtagaaaaatattgctgcagggtatacctaaatgagaaataataaattagggtattgaaataaaacattttttacaaagaacaactgcaaactggaaaatatttcatatttcccattatggttgagcctattgttttcaaagttactgatgagacttaaaacagactatcacttttcaaattatttaaatctgtataaccttggagctctaatccatttgcattttaccatctgctttgcatgcttcttaatttaatatgtatatctcagaattgattcaacttacaagctccttatgaggaagacatgtgctactactgattgcagagatgatgatattcaacagcctgtacaacataaatctgaaaggacagaatggaaagaacactagacaaagagtaaaattctattcagtgatatcataattacgaactcactttgtgaccttgaaaaacatatctaaaccctccaggcttctattttcatgtgtacaatggattagaccacctttataagacctttgccaactccagaattctcaaatatatcatcttattgagggaaggaatgatcatttcaattaagaaatagacatgagccactggctcttctcccctcctttaataattttatttaggaaagtgtttgcaaaagtttcaaatgaaaaattgcagtcttattacaaatataactagagataaatattaaaaacttaatatcaaagctcaaaactaataaaaatgagccataaaaaatgaaaattaaatatatcagtaattacaataactgtaaatataagtaaattcactgatgagaacctcttactaagagagagacttaccattcaatacaaaagcaaaacttaatccagctataagctaattttaggagacatccctatgatacaaaaatataaaaaaattgaaaagtaagaaatggaaaatatatatttaaacacctccaatggagggta

SEQ ID NO: 33871 - DNA, 1258 bp, Bovine  19866880465303
ctggagtggggtgccatttccttctccggggatcttctgacccagggatcaaacctgtgtctcctgcattggcaggcggattctttaccactagcacccctgagaaaccaaatgcagcccaccaggcccctccgtccatgggatttcccaggcaagagtactggagtggggtgccatcaccttctccaatgcatgaaagtgaaaagtgaaagtgaagtcgctcagccgtgttctgactcttagcgaccccatggactgcagcccaccaggctcctccgtccatgggatttcccaggcaagagtactggagtggggtgccatcgccttctccgcaaataccaaaaacagatgcaaaaaaacgtatctagcttttcactaattgcaatgaggacaataattttattacggctttttacttctgcatacaaaaaaaaaaagactaaaaaaaaaccacgtgtaagttttgagaatggttggctcttagtagacaggcccacaagtgaaacgagagacaccagtgttctgaagagacccccccattatggatggtagaggggagacatcgggagtcccttggtggatgattttattcattcctggaagggcccacttaccttcttgttagtgcttcctccagatttcacttcttggcgccttagaatatattttcatttttagagttggaatttaccttcaatttactcactttatttcacttttgctggtgcctcaccacccatacttttggagtcctgtttgctgatttggacttctcccaaagatgatcatctccagagatgtgccgggtacccaatgactatgtgattaagaagctggggtgttggccacgttacctgcagccactttctggaatcccttccacctctgttctttgtatcagtggcaaagcacattagccataaagtttgggtgtggattttaattcacatcagccataaaaagtagcctgtgagtaggtggagccactttattaaaaatattttataactacatcttcaaacagcttgatgaaaacttatttttattgggcacacatgtaacagcccacaactcctgctttcaataatttctgaaccctcagcttgaataaataaagaaaaaatgtcagtgatataaaatgacaagccaagcttaccaaaaggaaagtttaaaaataatcatgtctccaggctcagtgaaagataaaaatcaaataacgcagcttgtttcaaattgtccctctttcaacacacactgc

SEQ ID NO: 33872 - DNA, 1046 bp, Bovine  19866880700710
aggctgaggcgacgaggacacactctcagcacctgcccagccagccggacgtcagagccatcctccccgaccgcagcctgcgtgaacaggatgggagcatgccctgcctaaagcgtcaagctcccgtcctgccaggggacactcttcccgggcctcgcgcccacgggcattaacgctgagcagcaggtgagctcaggcctcggggcctcgagtccatggcaggcgggaagcctgcgttccagagcttacctggtggacgtgccggggatggggcggcccggtgtccaccaggacacaccagcagtagcccgtggacggatggcactgcaccggcttgtagaggccgccatgggcgcactcggggatgaccacgtttgtcgttcttgggctgcctggcctcctccagggccgactgctgttcctggtcgcacgaggacactgcagtgaggaggagacgggagtgagcgcctgggaaacagggcggggccggccagcagggtccccgcgctgctatggcggcagggtggacagcttccacaggggatctgatgtccctgggctcccaaggccatgggtaggacccggaccccagcgacagccatggccctctgctctgggtccccagatggagggaggggctggcagacacccagtccagggccactgagcacccccaggagggtcccaggtgaacatcccccaccgccgtgccctgcccgagggctgcctgaggccgaggctgcagcgtgtcagccccagaggctccgctgcagtgcttgccaaacaggccgcatgccccggagatcggtcaagaggaggaggagccgcgccagtcgggccagcgtcacgggcggtgcaaggcgagtgctgaagctcgcccgcaggaaagccgctgaacagtgaactgaacagctaaactcagaattctaagcacagcgtttcaatgcgtaggggcttctgtcttcctacgttaatagatcccgtttcttttttgcatttagatgtgaggtaacttagatctagggagtccctgggtcgggaagatc

SEQ ID NO: 33873 - DNA, 5001 bp, Bovine  19866880716044
ctactgtacaggttcagtaaatactaaatgcacaagtgaatgaacgggcagaagactcccaaactcaccgtcttaccaagttagatctctgtgaaagggtggacgtttagtcagaatcatgattcagaggagcctggattacaggagaggcttcagccaggaggccagtgttgggagtgacgacggggcagccccgaggcagttcagagctgggggctggccgcaaccaccccccaaaggctggtgtttgtcacacgcggctggagtccttccatacctgtgcgttcctgcagacacaggggaccagggaaggacagctcattctttcctctcgacttacttccgttgtcagacggtttcgtgacttgtcaggagccgcgtgacaagtgacaacgtgagaaacacgcgtgcgtgtatgtgagaaacacgcgtgcgtgtacatgagaagcacgcgtgcgtgtacgtgagaaacacgcgtgtgtgtacgtgttccagttcctcccggcaacttcggagcccttccgtcgagacgtgcaggtctaagcagcaggcagactttagagtcgcacggaggaccctggagagcctgaaccagccatcctgctttaggtgattcttattctgaacgtcatttcagagtccactttgcgttgctcttctacaaacttgggattgagaggaaatgctatttttagaccacaacaggagctgaggctgaaactgcagtgcttgggccacctgatgggaagagctgactcactggaaaagaccctgatgctgggaaagattgacggtgggaggagaaggggacgacagaggatgagatggctggatggcatcaccgactcaacggacatgagtttgagtgaactccgggagttggtgatggacagggaggcctggcgtgctgcggttcatgggggtcgcaaagagtcggacacgactgagtgactgaattgaactgaggaggaatggagttggttgacaccccaggcagggagggttaagatttcccaccgagcaggatcacagacatcctgagagataggtctggtgagagctccaacatcttcctgcaccaagaggcctcaggttcacagctcagtatcatccgacaaaaccctcattttccaacagacaccccctttgttatgatcaacactgaagtctccatccgttaacctggaaaatcgctaaaacggtacacatgaaaatttggtagagtttttggtactaaatcagcagcagctaggactttgtttctcatgcagtaagaattcttttcattttttggttttcctcaacacttctatttctccttcttaaaactaaaatatggtaccaagaaaagtttctgctttccttgttcttactgattattgacgcaatgagagatttctagagatttctgcctttaatggttaggttttgcctggaaagccttgtctgtctgagagggtcttccagcccaagttctatcttacacaggcttgcggttttagaataaagtgaagtaaatgagagcatctccagaaagcaacactgaagaattaaagcctctgtgtggattagtcgtcagctcagtttatgagcctttcccagaaaattggatgtggtgacagggcgagagaagtaacaccacgcgaacctccagggtcttaaattacctgaaggaaagaatctcaccccggccgagagcacagagcgagagccgcggctgaatcgaaggatttaggggctggagaccgagctgccaagccaaagtctgtgcagagccctgcggccggccgggcagcggtcagcagacagagccgctctgtgtctccgttggcagcacacctgcggtggggctgggcgccgcccttctctgaccccaggcaccctggcagggcagccgccgatggccccaagagccctgaggttccgtcgggatccgacttctgtctcaggcacgagtgcagcagcaggggcgcggcgtcgcgtggacggcggccccgcggattctccgggctcctggagcaaacggccggccgggggagactggtggagcgcggaccggggtgccggccgtgtccgttttcttggaagaagccgcggggatttggaagcagcgtctgggctcctactgtgttgcacatggcaggataaacatggccccgaaagagtctattagggataattaatcattctcgcccgagatggtttctggaagggctcctataccttcactgcaggaggaatttctaaatgcctagcagaggcaccatgcttttttgtttttaaaaccgttcaacaaggactgcttcttcagaaagcattttctatctaaatgcactgatggctggacctcaagaaatgatttaaatgtttttctcaaaaacaaggccagcatttttcaatgcaactgttttcgggcagaacacactgtgctttttgtggactgggccttgatacttacagagattttaaaagaaaatatttgggctgtggtttaagaatcaaacagtcttaagtatgtcaataatgagaggctggaactcttcctaaaaaaatatatactgactgccgaatgcagggccagcgtctggaagccaggctgtgccaagggccagcaccctcaccctgctctgctgcataggcggccagaggggtgggcacgggtgggctggtccatcgcgtggcaccatccccagagcgtggacacggccctaaggaagagcatcaccctgattcagctccgtgttgtccgtggagtgagctctgccatttcagactcttcctgtagggtgctgaaagtcactcagtcgtgtccgactctttgcaaacccatggactcatccatggaattctccaggccaggatactgttgggggtagcctttcccttctccaggggatcttcccaacccagggattgaacccaggtctcccgcactgcaggtagattctttaccagctgagccaccagggaagccctgcgcagagtgcatgtgggttaagacaccttgctatctgagagggacgactcatttttcctcctaacctggtggccaaaactgatagatccctctgctgtgtcacctctcacgggagccaggctggctggtctggcctcctcctgcttccagggccaggcccgcagccggctggcagaattggcgatctgacttggctcccctgggcctcccttttgtggagccgcttgcccaagggtcaaccccagctgctgctggccttctgggtctggggggaggggcaggcaccggatctgcaaacctgcagtatcttcagtttaatcagcatgcggtgattcagacagatccatacacaacattcccacaaaaccgggttctcccacaaagggggacttggtggcagttggcggccctcaccggtgtccgggaggagggtgtttggggaagtttggggtcagctcgtgagggcatgaccctcattgcaggaacagcctagtggctaggatgctcaggccacagatttgttataaaagacatctcgtctcgttaatcttcataacttacttttgaaccctggtttcaggatgggtgaaatgagatctgagttcagggaggtcacctgtgatctccacaggacgggcctgctcacgaggtgtcaggagggggaggtgcccacctggccggggtgtcaccgtgggcctgccatgtccgcaaagatggcctcgctcctgctcagccttgggcccagcaagcctgctcccgttccgtctccagactcttcagtccactcaggactccagttccttcatcagaacacaggcactcggagaagccgggccagggtcccagagccccgcttagggacatgcgtcagcacgcagttctgggtttcccttctttccctcccattctcaggaaaccttagcaagtcaaggcacagacacaactgttctgactcttctttatcttttgagccttgctttcaggatacagatttgacattcaaatgtcaggacttggcacatttccttgttaggcttgcttcaagaaaggaacgtgtgttggggggctgagaggaggtggggtgcagaagaggatgcatcgagatggatttaccagggggccccacacctgggttcacagatgcacgtctgggatagatgtgagtaacgggtacatgcacgctgcgaggacaaagagcctcatttacgactctcgtgtgagcagagcctctgagaccaacagcgaggcaggaaacccaggaagccaggccctgggacagcagcaactccggggaggccacaagcagctcgtcagctctgctcccctggggtcggcacgacccgctgggtgaagccaggcctcacagagaagaactgaccccgttcagcccaggggcaagtgcagaaaggtgggagtccccttgttccgcgacaaattgagataatcacgcaaacccccactgtgcttagaaccccctctgtgcttaaaacccccactgtgcttaaaacccccactgtgcttagaacccccactgtgcttagaacccccactgtgcttaaaacccccactgtgcttagaacccccactgtgctgccctccctgattcagcagttgtttcggaacatatcatcggccaaatgactcaattttccacttcagctttatttgtagatagattttaagataggtttccagtttatacaccaattctccttggagaagggaaaaaacggtgaagtgtattttatgaagaataccaactcccagcgactttgatgcgtgtgtgtatcaaaatagaaagctagttattttttttgtcctgcatttttaaaaacgaaaatcaatatttattctttatcaacatccagaagtcagcaagttgtgaaattatgtacaagttgagattgacaacattaactttgtattaataatataaataatataaaacaagggaagccgagtggtgtgagttgtacacccggatttcagctccaaaccttctgttgtgcgagcaaagtcagcag

SEQ ID NO: 33874 - DNA, 1933 bp, Bovine  19866880766816
catgtgggcctcatcagcacagggtttgaattccagctcctgggggaggaggcagggtaaactggaagcagagggcaagcgtgtttctgtgaagcacggggatatcacacactctgctcagaactctggaggaaatcgttcagtgggcccacgaggcctcctggggggctgtgatgggggtgggtgtggtcacgtatctgctaagcccctgcagaggagcagaggctaggagtcccttccctgtgaggaggggtatcctggggcaagctttacccagcatcgcaaacctgtggttctcacgtctctttaatcaggtgactcactgggacgcatcctgaaacagatgtgtattcttcacaaactcttttccttggggagtgactcagacaggctttcctggggaggcagggctctgggtggtggtctgtttcttctgtgaggttataagcgtctgccttggcacagcggggctggcccactgctcatctgagataagcagaagcaggaaaactgctgaagggaggggtgagacaaaggaagggctgggacctcaactcccggagacactgtgggttccgggaggttggtggacttcagggaaaacccatcagtattgctggaatttcacaaaaaataatgttaatttctgagcaacttccaaacttctgtgtcacgattcaactctgaatttccagcgcccatgatcggaatttggtggatttctctcaaaggtcgcatggtcacgtattccttacagcagccagaagggaggcgaggcgctccccaccacgttcctgggggggccatgacggtgtccagtgaacttgggggcctctaactccctgacccccaggtaccatctacaaattcttaggaagcacaaggcatgaagaatctccagcatggcccctggcttttgatgagtaaaagtcccagagaaacattgctgggagtctgtcccccatgacgctgccccgaggatacttccaggctgccttacgagagggtcagcagaactgtcgtgatggatcatcactgggtttgcaacattacaaaccaacttcattgcttggcttatgattccaactgtccactgtctgtgttccggtttatggagctcctcatggttaagtgaaggctgcgtttctcccctttcttctcggaggcccagagagggtccaggggagcagggctgtctgagccccagccctgtgggcgcctgcccttggctctcagtcccctggtctctggcggcggccacgtcgctgcaactcctggcaggaggaggctgaaacccccatttgctggcccacgtcccagggcggcaggaagtctcctagtgttcttttttattttcttaccagacaaaaattctttgactccagaatgatttccaggaattacagtatgagaacttagtatgtgagaaatgcttttctttttaaaaaataaaaataaaaccaaagcagaagaaaccagacggaacacaccacgtgtggccacggccaccttgcaacaaaaagcaattgtttctgatcctctccgagggaccttcaggggaggggctgctcctcaggggagaccaggggcaggcggtgctgggggacccggggaggcaggggggctgcggtctctcctgctgcgcccttcctggaggtccaagcatcctccagaagtggagtctctcgctcctgtcgctcggtaaaatcaaggaatggctcaggaaggcgtagggactccgggcggggctccagcagggcagggcctcggcgtctcctcaggcgggggctgaggaggaggcggggcctcagaattcggggcggggctccggcagggcagggcctcggcgtctcctcaggcggcggctgaggaggaggcggggcctcagcgtctccacaggaggaggcggggcctcagcgtcttccacgggagg

SEQ ID NO: 33875 - DNA, 1063 bp, Bovine  19866880910206
gcaggggtactggcaggtgggggtcctgggagatgggggttcccgggaggtggggagagtcaggggaaggaccctgatgcatacagggcttggacgtcacagatggaggacaggaagagatgcctcatctccaggaaaagccctctagagcagcctgggcagacgccatcctgcgctgatagaagccggtcagtgagatgccaagtggcagcaagagagcagcctggagacagcacagttgggggcaggcagacgggggagtaggtgtgagtctggcaggctgctgaccgggctgcaggtgctcagggcgaggccgtgctgggggtgggtgcagggtcaggcccacgggcaccacttaaaaggcttgatgccatcagaagtttccagtgtctaaggtgaagccctggcggggtctttgcaatggacagctcagtgacgcctggaagcagatcgctggggaaacagagggggtccgggagacccttctcagaagcttggtttgttcagggcagggtgctgggctcctggggctgtgaacagcgggcatgagaggagacaccagggctggcaggacatggtcgggaaaggaagctgcaggtgcgctgtttcccacggggggtccgaggccccggggaagaggggctggagggggatggtctcgtgagcggagacatgactcggacatcgtgtgctagttaacatggggcggagctcccccagccagcacagagcccgcggcgtctgcagccgcgggcgggcccactcaccgtccccgtcgatgtccacggagcaggcgtcaccctccccgttgttgtccgtgtcgatctgggccgggttgtgaacatacgggcagttgtcgcaccggtccccgacctcatctttgtcgtagtcgaactgacgggggttgaagagaagctggcagttgtcctagaaaaaaatcgagggaagaattccagcaacagcgtagagacgcttgctgggttactcataacaggactgggcacctccaagtcgtgtatttaaagcagatcaagataaccagggtagaaatacagccaggaag

SEQ ID NO: 33876 - DNA, 748 bp, Bovine  19866881093904
cacccgcatcaccacggggccagaggtgggctcctgtctgcctgggtcttccccacccccgggctgggctccctgggtgcgtcctggtaaaaacggtccgctcacagcatcatagcaaccctggagcaggacatgggacggcggggggaagtgagctggggctggtcctcacggggagttgctgactgttgctaacggcttgccaggtgagccgtcagccctgcgcctggcaaacggggaagaggaaagcagagaaaccatccaggcggtggagagagggcctgtcagagctgggtctctgtctctagtgtccctgaggagcgatggagagatctgattcacaggctgccaccgtgggcgtgtgcggactaccctgacccctcactaggagtttgctctgttgaatgatatcccaggactgttaattccgggagcttgaaaagcacttaaggagtgtcttcagaataaaattaagggcttgtacccacaggaagattctgggccacactgacacaagattccatcctgttgccaaggaatgtttgcatttttggaggtatcttccaaggagaaatcacattttacagcaagagggaagaatggaggacagaatccatgagacatttcaactttttctgtgattccctgttaactttcctagaaaaataaaatcaatacaggaagaatatgcatgaaagtagcccatagattaatgcataaagtgatatccaggttggccagcaagaag

SEQ ID NO: 33877 - DNA, 1229 bp, Bovine  19866881397162
cctcagggggaaggaggcccgcagacagctgcctctcgaggcctgatgtttgaaatcgaatttggcaagaggcttatgtggttactagcagttcaagatgccctgaggcaacatcacggggaggcagaatcttccacgcaagtcaacatgaggcaggcctaccctcaatagccctcacccagaactctggcgtgtgagtcatggacctttaaagctcctaacgcttacttgtcaaggtggagatcacagcagtactatgtccatggggttgtacttgtaaaggcggaaatcacagtattgttataaaatgaaatagactccacagagtgtgttatgtgatggactctcagcatcttacatttggtattttttctttttttgatgttttagcaaaaattatcccagaagtgcctcaaatggccatggagatgtctcactaagatgcagggtcctggcatctgggccagagatgcatcagttaaggcttcactcaaaaataaaaggttagagaaacactttatctggagcagaaatatctttcaagatttggcattccctgttcaacataaaacaaagtcatatcacaagtagccaaggctaaaatttggatttttttttgaaacaataaactacacagatatggaaagcaggtagctggcaggtctctttttcatgaaaaagaaaagatgccacacacggggaagggcggaagccttacttctagatttcctataggactaatggagtcggtgattctcagcctttggtttccttaaggatcatgtgagattctgttttcgaaacagcctgtctccaccctgcaggtcttgactccaaggaccagaaggggatgagaatccacattttttatcggacacagtgggtggttctgagggacctctgcctgactcacaccatgagaaactctgcaccaaatcacacacacagtcactgagaaaggccaattttgagaaaatgaatatatttcaaactccgtatgtattttctatgagcagatcaagctcagagaaaattattgtttctaatttagtcctccagcccaaagacaaggaaaaaagacataagcagaatttcattgaatgaactggaaatttccattcaatgttcttgaagagatgagaaagccttccttcctaatgagactgcaaatcgggatcctggcgacactcacatgtggtcaaggctctttgtctctgaaaggtcatccg

SEQ ID NO: 33878 - DNA, 782 bp, Bovine  19866881472693
tgcatttactgaatgccctgtaggccatgcaaataaagcactgtttagagagttcttaaaaatcatttaccgttttgtggtacctaactgcggccaaaatgaatcctgaaagtttgaactgtggacacacaagccacctttacacaacttcatatctccagttagagaagatacattaagattctcaaaggcagtggctaaaggtgctgatagataaagaatgaaaaataatgtggcaggctcttttatcatttcctgacaaattagtgtggctaatttaggtttaataaatgttgatgggatacttttccttctgtcagaggctcattttcccctcagtcaaggtagtccaatataaaactttttcacagcttataaaacacatctagtatatcaggaaagaatggatactttagggtatcagtgcaagtagaaaatacatttaaaataaataaaagcttcagatgaagttggggaatcaaagacacacagggtgaacctctcaaggtgggaaatgggtataaatgtggtgcttcaagcaactgaggcaaacaaggggacgtggtgatttgtcaggcgtgtctagaacaacaaactccccatcgcaaagcaagctggaagaaggagcaaggggcaagtgtaaagtgcaggataaagtgatgacgattgtgccggcaatcccagcaaacataaatggagctgtcttacctcgtataacagaattccttatcattgttttaagaaaaatttagttcaaaagaatgagggattacatagacatg

SEQ ID NO: 33879 - DNA, 656 bp, Bovine  19866882041695
ctaacttttccgcctccccagccgttcagcttagagtgcatttggcgcctctggagagacaagaatttttcctagacaaggtttttatggtttcattttgtagcatttaactacatgcttgatgaagaaaccacaaaacctcatgaacctacacgcaataatgtcagatgaaatcgctgattttgttctgggcttcaatattgccagatgacttcagtcaaaaccatgcaaattaacacaaaagctaacccgggcaccaaatacagggtttggagaccccaccgactggtgtgtggggttcctcctgccgccgcccgggacccggtgacacggccgcgctggcacccccttcccagagaggagccggtccccatgtggcccggtggagtcgcaggctgtgctgtgagattaaaggagatcttggttttgtaaatactcggagaagatgaaaacccagcatgcagccctcccaggcccagccagagtctcccacccaacacccccgcaaggctggcccaggtttctgggggtgaggccacaccggaggagccgccctgacactgctctcagatatgtggtggatgccttccaaagccacagcttcagtggaaaggtcacctttgagggtgaaagcttagcttgccgttcctgtgagg

SEQ ID NO: 33880 - DNA, 1085 bp, Bovine  19866880431135
caaagaagtgagaatgaatactctaaggaatatccttaccaagtgtgtatgggatgaagtttagggcagcgaccaaaatacattatttagctacaggcttcaatacgccaacgtggggaagcactgtgagtactgtctctgcaggggttggtgatgcaaagtctagggtttgggtggaaaaggaggtgctcatcagaggaagaccatgagagttctaaagaggtaggtggcaggcatcacccacagcaactcctgcattagagaggatagatttcattttttaaatagtaatcacaagcatagaggaggcatctgaacttccagaaaaaggtacttttcagcgtcccaaagtcaagaatttcggaattcttcagaaaagaaattgaggctctgttgtcttcaagtgtagaaggaggaaaaaacaaaacactttaccacacaatcttgcagcccagaaagctgcagctctttgccaagagaatgaagccaatctaggtgtaggaggaggtaagagagaaactgctttcaaacataaccttttaaaatttgaggataagcctctctaccaacaaaacaaaacaaaaacaaacctataaaaatagtctccagctttaaaaaatcagcaatataaccatgcatttaatcattcttttatgtagaaggctacttatttttgaaagagctaagtatgtttataatagtttaacatttttacaataaatacaaaatacagagctacattcatttcagaaaaaaaatttatgagttgttacacaaaatattttctaaaggaaataagttaggaagtagaacacttaaactagaagatatattaccgtccttcagagtataactatctttcctactcagtactgtacagcaatgaacaaaatgcagaagttcactgtgacctagtgaaggtaagggaagtgagtcattaaaaacaagaatcatatgcaactcagaggccaagtaactcaaacataattctcataaccagaccatagctgctgaagcaaacctgcaaatctacgtcatgacatgtaagaaacactaatatttctgacctttgatactctatccta

SEQ ID NO: 33881 - DNA, 2835 bp, Bovine  19866880474216
atctgcttctgtactgttaaggaacaatgacaatcatctgatctgtcaaatataaactaccttggcatattagtgatcattttgcattatgcccccaaaactttcacagtcaacatctacagcttccacatctcaaaccctttaactataatgtcttcaagaaaactacccggatctattgtctagagatggggagacttagggcaatgttactccatgtcatcttcaagtccacacatgtgagaaaaactacaaaaagtgaaaataggcatttaccaacttttagagcaatctgagattactgcacaatccacacgcgtgattctgtgttttatgaagaccctggcccatgatgtactggaaatgcaaacaactgttccttcaacacgagtaagagagtgctttagggcattctggtttgaaacagagagttaatttaatcgctcgttccacttaatgacaaaaaaggaccctagttatacaagtttgaatggcttttattaacttttgtgagaaaaactttctcagagtgaggcacttataataatgctctattggatctgaagcttatttcccaataccaggaagtaaacagtgccagtttgatgttatgtaattaccagttttactcctgaaaactgtcagagcacagaattaaatgaaataatgctgctgaaggggaaaagcgctaccaaagtcaccaagatgattcatctgataaaggctttgggttttaattctccatgaaattttgcattgagatcagacaccataattaaattctaaaactgaactcatgttacggtatcatcatgaaaattctaagttccagtttaacaacataccagcttagagaatccaatggtgaaaagtggaaaaacttccacattcagtgatagtcgctggccaagcagaccatataggataaagctgttaggaattttagtcttccttcttgaaggaaaagcaagtaaccaacttacgtctcatagaaacagaatgttaatcttatgagacattaattgacatctttgcaactcacgtttctcctggacatacaagtagccttccattgtccactggctgggtggcctgtaatcttgattggcagatttcatcctctgcatcaatcgctctacctcttgtcgagtactttcaaaattattcctcgtctttagtaaatagaaacaacaatttcattcagtgttttctaccagttttgaggaacacccagtctaaggtttcaaaactacaaatggtgcaaaggataaccttgactctttcaggactgttcaccatatccaccaccatctacattgaatcctatgctctaattttgatctgctttagtgaaacttttctgaatgaccttctgcatgtttctctttgaatctgtgtatgtgtgtatgctatttcccacttaacattatctagggaacaacttatagctttacaaatataagatattaattaaaataacattttatatcccataatacctaagataaaaaaaaagcagatacacaacaacttaatttgttttgagggttaaaataaattcacatagttttgatatatgtggcactaatcaagaaaaaggttcatcatttttattccgaacacctctttgaagaaatatcacttaccttgttttcccaaaatcctaacatagttatcagggaggtcaatgcataaattaacacataaaaatgaatagttttccaagttctaacatcttctattgtaggaagtaatttacttacaccatagcaagtttacttaagggaagatatagaaagtatatggcttttctctatgaaaatcaattttgcatttcaggtcatattatctcaacaatacacacttggaaacataagaataatcaccaacctgtgagacagtgatgattaccattttgttacggcccctaataaaagatctgaatctcaaagtaaagttaggaaagttttcttaattgccacttttgctgcttttccctttgaaacataaggatatgaattttttccaatactttacctgtctcttgttctcaaatctcaggaattttactgcaattgcatttaatatggaaataataaaaatactttgggtttataattttcccttttactatttactgagaaagcccaaatggattccatattgaaaaacaatggaatgaattgcatgtgaaattgattctgtgagaaaatctaggttaaataaaaagctaaatgcaaaacacaagtagaataaatgcaattacttatttctcgtgctacgctccaaacgcatatttctatttgctgaacatctttacaatagcaaaaatcaggtaaggagtgaaaggcatgctttttatagaaaattaagtgaaatcttcacaaactattttagctacagagtaccagacatggtttcagaaataactcttcatttacacaaaatcctcagcaattaagattttgttattggcatcatcgactcaatggacatgagtttgagcaaactcctggagatagtgaaaggacagggaagcctagtgtgctgcagtccaggaggctgcaaagagtccagacatgacttaccaaccgaacaacatatttgataatacagaaaggattggctaactttttaaagtgtaactggtattcagtacatgtaaatcagaattcgtataactgcaatcaaatattaaaagcatttactggacaactttacaaagtaaactgtcccagaaatagatagggtgtttttaaatacttctcctgaagctttaacacagcttttatggatgcttgaaagccacccatttaaatttatttttagaaaaca

SEQ ID NO: 33882 - DNA, 1097 bp, Bovine  19866880491325
tactgaagaagcgagatttcttacttatcaaatgtggccattaacctttctgtcaccatcagaattggcaagagctggcttttattatataggacctggagacagggtagcctgctttgcctgtggtgggacgctaaataactgggaaccaaaggatgatgccatgttagaacaccagaaacattttcccagctgtccatttttggaaaattctctggaaaaaacgctgaggttcagcatttcaaatttgagtatgcagacacatgcagctcgcctgagaacatttatgtactggccatctactgtatcagttcagcccgagcagcttgcaagtgctggtttctattatgtaggtcgcaacgacgatgtcaagtgcttttgttgtgatggtggcttaaggtgttgggaatctggagatgacccatgggtagaacacgccaaatggtttccaaggtgtgagttcttgatacgaatgaaagggcaggagtttgttagtgagattcaagccagatatcctcatcttcttgaacagctcttgtcaactgcaaatacttctggagatgaaaatgctgatccaccaattgttcattttggacctggagaaagttcttcagacgatgcagtcatgatgaatacacctgtggttaaagctgccttggaaatgggctttagtagaagcctggtaaagcggacagttcagagtaaaatcctaacaactggagagaattacaaaacagttaatgatattgtgtcggcacttcttaatgctgaagatgagaaaagagaagaagaaaaggaggaagagaaggaaagacaaactgaagaaacagcatcagatgatttgtcattacttcggaggaatagaatggctctctttcaacaggttgacgtgtgtgcttcctatcctggataatcttttaaaggccaatgtaattaataaacaggagcatgatattattaagcaaaaaacacagatacctttacaagcaagagaactgattgataccgttttagttaaaggaaatagtgctgccaacatcttcaaaaactgtcttaaggaaattgaccctacattatataagaacttgtttgtggaa

SEQ ID NO: 33883 - DNA, 1554 bp, Bovine  19866880528570
cacgcactggtgcacaagtctgcccgagtaaaaacagagagatgctggacatcttgataaagcacctggtcaagtaattctctgacttagattgctcacttacttgttcatctgttaaacttgagtatattcatgtcttttaaagggggtgatagagctataactttgctactgtaatcagagtccatttaattggttgaaaaatgatggcggcagtttgtttttaagatataatctatgtgtgtgtgtgtatctgtgtgtttatgacatgcaaataattatatccctgcaactgttgtaatgaaatgtcaacttaaaaatatgtgaaggagtatatagtcctttcccagttcttttagatgcatggtaagccctgaagtttgaagaccaggtctctgttttattagggtcaccaggttctaccaggtcaacatgccactggaacattagcttccttccccagattcctagtgtctttggtttctgaagatctttttgactcttatgtatttaaaagttttgataaatattgtattaatcaagtttcttcagagaacagaactaataggttgtcatatgtgtgtctgtgtatacatatgtatatatgtaagagagactggttagttccaaggaattggctgcacaattgtggaggctgatttcaaggcaggctggagacccagagaagttgatatcagggtccaaatccaggcagtctggaggcagaataccctcttcctcggggacctcagtctttttctcttaagaccctaaactaatgtttagatgaggcccacccaggtaatggatggtagtctgctttactcaaagcctactgatttaaatgttaatgtcatctaaaaatgccttcacagaaacatctagaattatgtttgaccaaatattggagtactgcagcctagcaaatttgacacttagcattagccataacagatctatcttgattcacacacacacatttaattcagaggtttcagttcagctaccatgctgctagaaacaaaaatccaaattcaggttttaaacttacttaagaatccccttatagtctcatttacaaatgggaacagtttttatcttaatgagtactgcaattcacaaatgattaatccttccttgtttgctacaagtagtaacccaatttatgctaatttgagccatgcatatttgaaactgtgctctatattaatcagtctcatcttaacttgcaggatttaagataatatgagttggccctccttgaaataagaaggaaatccactaggaatgatttcatttcaagttcattgttaacgattgcccttgtcggcatttagctaatgaacagggacacactatccttggtctgaattacatagtcttgaattatgtttttgagttgtgtgtccttttcttgaaacttaaccatacaacatttagtgggcattctcttgctacatttaagctaattttttagcaaagccttttaaaatacactttaaaagcttcatgagtgtcacataaaatatttttccttaattatccagaatgtta

SEQ ID NO: 33884 - DNA, 2586 bp, Bovine  19866880547622
gatttttagcatgtgcttatctatttcttagaaaaaatatatctgtatagtgttttacagtgtgcaaaggaattttatagacatctcatttaaaagcaaagctctgtgttgaaatattctctgctaggtaggtgaagacattgagcttcaaagaattgaagacagatactatgatcacaaagcattaccttttaaggaagtgacaaatcttttaaaactaagtgcaatattgctgttgactttttctacatgtatttgggtaactttaagaactatttgaaactggtccttagacctctacttacgagataaacaagcatgcatgttctggttcactccatgcttaccttttttcaaccaggtcatcatcattattattatttttttttttagaaattcttagtgataattatcctttaataaatgaacaacatacttcaaccaaaattccgaaatttgaccaagctaactgtagatcccctggctcaattaacgtgaatatagtagttctcccctcagcttaaattttgttgcataatttatagattttcccccttttctataatttctcgcattttgtgggaatttagataatatgaatttcttaccacgcataatttcaataatttacatgtcatttaggaacttgaaataactgtaataatggcttgtaaactattaaaatttcacaaaaaatcgaattctttttggacattgatccaaattcctaaaattattctttcctttgataaattatttataactctataatgtttcagcaagaagagtacatctttaaatcactgtcaccattaggaaatgtgtaaaatttgtgaagaacaaaaaaagtctgacaaataaaaacatttcttctatttcatatcatccacattggtctgatttaaatcttacttaaaggaaacaatttcatcgtgcagttctgctaaaactcaataaattcaggaagaatttcaaaatttaattatgaattctatgaataattttatatttactacaattgtttctctttatctagaacatggtccaactttaagtaatttttaacaaaaatactttgtgtctgtatctgtcttacctttaaataaagattatatggttatttatcttaaccttctgatacacaaggattaaaacatagagcaagatatttgaagtaggacaggcactaaggcatcaatttatcaaaaccacttagtaaatataataatggaaatattgagaatatatcctcaaaattccaaccattaaaaagcactcatttccaaggcacttggagccaccctgaggctacaaatcaagaaactttgacttttaaggatgtatattatactccctaatttcactttgagtaggattttaaaatatactttaatatgtatatattttaaaaggcactgtattctagtaatttttaagacctagaagctatcagtgaactgttcaatccaaagttacttctctatcaataaaagacccgtttttacaactacacagaccatgtcaattaactgcttgcacgaatctctgtctttctctatatataatttctagtaattaaatctgacttaaatatttagtaataaatttaatagggggaggagttgaatttcttttgatatttgatgaattcctgaacagaggctataatgttgggaaattgatgttatttatattttggattccccagaaaagtgactccccattccagaagctttttatacttctagtaagaattccaaagccaattcaccttcatgagacttaaacatacagcacatctattaataaggatgattttgtttcttcatttcttaaataaaaactattacaaaatatttaatatgtatgccaggaaaactaatttaatttggaaaaaaagtgacagaatgtcctttttttttctctttttttgaagagcactagtgcaagaaattgtttttcaaatttaatgaactactctgaacctctgtcttctctactgtaaaatggaactcaatatttaacttgcaaagattactgtaagaactagagataatatatgtaaaactccttcccaatacaaggcctgtgcatagcatctactcaagtagcagctaaaaggactggtaatatttatcaaatgcatattgattcctgatctaaataaacaggaattgatatcaacacagattaaaaagaagtagaagcagtgggattctatgaattaagaatgaatatatactcacaccgtactcttgcctggaaaatcccgtgaacagaggagcctggtgggctgcagtccatggggtccctaagagtcgggacgcgactgagcgatttcactttcacttttcactttcatgcactggagaaggaaatgggaacccactccagagttcttgcctggagaatcccggggagaggggagcccggtgggctgccgtctatggggttgcacaaagtcggacacgactgactcgacttagcagcagcagcagcagggatgtttggagaaggaaatggcaacccactccagtgttcttgcctggagaatcccagggacagaggagtctggtgggctgctgt

SEQ ID NO: 33885 - DNA, 2051 bp, Bovine  19866880660960
ctagtaggagaagatgagtgcacatccttgtactctgccatcttgtagacatctgcaaggttgagcagggaaactcaaatattctccacaaagcaggctcataaattcccagaatgccaactcaccatgcaatctctaggtcactttcagtgccactcatcaaagtatcagttgcttcattatagtttaaatctaagtatctaataattcagggatctgacatctaactttaaaataaagatagcttataggtgaaaaaattagtacaatttgtgctaaagtccactgggaaaaaattataagatgaagctagtttattcctggggctctgatactatcttcaaggacagaccttgacagatggtgttgtttcagggaattacatgcaaaaatgagactctaacaagaaataatatttctctatttctttggactcacagaactagttttaatattccttatataaaatcctaaaaataagggatacttcaccatgtttgtgagcttaaaaatctttgtctatttttttttttcactaacactgaaatatatattaataatgttcttttatagtattggcatggtgttatcctgctaatatttctcacctcagttaacctgttttcactttctaaaggaagcatattacactaccatatgtaaaatagatagccaatggaaattgactgtatgattcatgaaactcaaaccaaggctctgtaacaacctagaggaatggggaaatgtgtgatgtgggagggacaggacatatacccttgactaattcgtgttgatgtatggtagtaaccaaagcaatattgtaaaacaattatcattcaattaaaaataaattaaaacacacacacacacgtttgcattgcagaatagtaattatgataataacctaattctttccaaacacaattattttaccacaagagctgatgacttcctgcatgtgaaacttatatgaattttcatatcttctaatttgccttaactacactgaagtttgaatctcatgtaacaaaggaatgtttgtgaaacaagtccaaagccccactcacaattaaggggagagggtcaacacaagggcatgaatcccagaggcagggattactaggggccatttaagagttgactcaccaacaattcataaacaaagagtcccaaagccatacctatgatttacttacagagatgtaatattttccaatgaaatcattctgtctaaaatttaagagtatcttctctggtatttcaacttaactggacatgcaattcagcagctgtcctaagactctctcttctctttgccacatttaattatttgcttagctataaatatcttggcaaaaggtatttttcattccaaaattccatctggagacataaaaagaaaagctccccttttgtagtggcagtagaaaagctacattaaatagctacattaacccccatttattagactcaactcatatgtccccagcttgtgctaatgaaatactcctctcagatttgttctaccatgcatttctacactctcaaagataaatgaaaaattctatattactgattttacttttaaaagctgtcttggggattttacatttcatggagttctcatgcatatggttgagctggctcatataaatgagtatttgaattggtataaatggtatttgaattgactgttgcataaaacatgcttgttttaaaactacttgttttaaacttattatcaagaaagtgatttctatggagataagcctggaattttcttataataggataatccccaaactttatctgtctagttcatcatataaaccatggtagccaaggtaactcgggagctgggggttgtgtatgccaaaagtgcaggatcacctgtgagtaatcatgatctacatcactgtaaagacaaaactgtggaatcaagaaagcacagaatgtcacagctggaaattttagatcttctagcccaatcctgggtgtattattcaaagttttatgtgaagatttgatgtcttaagctcatcgccaaagat

SEQ ID NO: 33886 - DNA, 1632 bp, Bovine  19866880698286
tcgtcaggtgtgactgcttgagttcaatgttatgcattcaaggtggcagatatgaatccctgggagataacattaaatgaagtgtagagtgagggccgtttttcactgtaaagtcttcttttgaaatcagaataaaacttcaccaaatgacctcaacacgtatgagatgcctttgaatagaaaattgactttgtgactaatatggatatatgttcctcttaagtttctaacatgcaaaaatcacacatatgtgatgtgttcccacctattcacctttctgtatctcatatcatctgatgtataatagctgtgctcagtgggcttccctggtggctcaactgtaaagaatctgcctgcagtgcaggagacgtgggtttgacccctgggtcaagaagattctctggagaaagaaatggcaactcactccagtattcttgcctgggaaattccatggacagaggagcctggcgggctacagtccatggggtcacaaagagtcagacatgacttagcaactaaaccactaccaccagagtgacttctagaaaaatgagtattcctactggcacagacttctgtgaaggattagcatggatgatcacagtagccctgaaaggagggacctttaaagttgccctgatgctgcagtgtcagattgatttttaattttagttaacaaacataaatagtgcttattgtcagactctgttgtaaacgctttgcaagtgttatgttaattaatcctcagaagaaccctgtaaagtggttatgccactgtcgttcagtctttatagatgaggaaacagaggcccagaggagtttaaaaattttgcccaaggtcacataatgagtaaatggcaggacttggatttcaacccaggctgcctggctccagcgtctgcattcttagtctctgttaggttgcatcctaggcttttgcctcccagggattcacttcttattattctgggcttttctttattctctccatgaatagagaattattcttcttctggatttagttactctggactttgttcagactgaagtcaggactgaggagtctgtttaacatgaggtctcctataaatcacaaggttattcataaacaacttttcaggtgtattttcaacttttaaggagaatgtgttttttggtaaaagcacattccctgtctcctccacagtctgtgtagaataacatcagtgatactttctaatcaaagattcgatgctttcccctccatccccactagtaaccccagtagaattctttatttcttcttcttcttcttctttttttttttttttttttactataaatggtgcatttgtagtgaatagtaattctttgataaaaactttgggaaattgacttccagaaaatgcacaactagcaccaaaactttcttaaaggggcagatctcctttggaagcagaagagatctaatccctaaaacatttcttttgtagtctctttaaattttgtttaaatttgtcaagctggtattgaaaaaggttctggttaatatagcattagcagcaaagttatataaatacatgtggaaaatcttgagtatttcatggtatcttcaccttaggatttttttaaaactaaagtttttaaacttta

SEQ ID NO: 33887 - DNA, 1394 bp, Bovine  19866880716101
tatgcctgtggcgttccatgccgaggtcggatcttcatattttgtctgtttagtttaataacactcaagcataacagcaatcaggagcacactctgcttggtaaatccatagctataaagaaagcatgtacttcagaatttaagaaaaaagttgcttgttgcgcccagacctagtttgacatatttttgaaaagtgcttataattctccagatttccaggattaaaaccaggaaacacaaaatagaaatatatagatttggctgcagcttccctacaccttaggttgaattgtcttagacccttctttttaaaaaaagaggtagctagtcttagttgaataatctgagatttgttaactggctattctttgtgaatttttgcaaggtccagtgttcttgcctagagaatcccagggacgggggagcctggtgggctgccgtctatggggtcacacagagtcggacacgactgaagcgacttagcagtagcagcagcagtaaaaagtgaggcactgttaacccttggtaaataaaatgctcttgaattttacatcaacttcaggatgtattcacctcctttttaaactatcttgacttaacatgaagaattctatgtttgaaactctgaagtcctgagaaatatttttttctataactcctaaaaataattccaaattacatttttttctttagaaatgtgaaatagatatatcatgattgttttcttcctgattgagtttcatttgtgtgattgacactaataaaaatattctaacttaattcagttcattaaagaggtaaggatattttgcacaatgaagcatgatatagaagacttttaaactttctggagttttaaaataaaaattttaaaagtgtacataatttataatctgtgtgtacgtatgcattgattctccctgccccccttcatctaataagcccctcttttcctgttccatcttgtaaacatgagttgcttatggcttgcatactgaaaatgctgccaggaagtagggtgagcaaagcttcttttcccatgaccctcgctctaatgttgttccaagggttccgtacttagaaatgccttgataaccacattcattcctgacataccccacccccagcacactcaaagctgctgagtgccatctgacccagagtccagctgcagcttcttacagcactagtggggaaggcttttacctagagtagtgaatatctgtgaaggcattttgtgtgtgatatattgcatgtatatagaaaataaaaaaaaaaaaaatctgttgcttggtgtgatcctggaagctacaggttgactagtgtctgtttttttctctctaattttggactcactgaagctagtatgtatgtgtgtgcctgtacatcctttt

SEQ ID NO: 33888 - DNA, 1277 bp, Bovine  19866880853163
attgcagcccgagtatcttttgaaaaaagcaaatctcatcattctctccagggcttaaagtccttcagtggctcctcattgattaacggatagagtccaaactccttaatttgccacaccaggccaaccttattgactgccatatcttttaaccctgtaaacacatttcagtcaagctggattttgtgcttttttaaattttatttttatttttggccacgctaggtcttcattgctgcacacaggcttcctcttgttgcagtgagcaggggctactcttcttgcaggagtgtctctgttgtagagcacaggctttagaagttgctgcatgcaggctctagagtacaggctcagtagctgtggtgcacgtgttttgttgctctgtaaatttggaatgttcctggaccggggattgaacctgtgtcccctgcattggcaggtggatttcttaaccaacagaccaccaggggagtcctgtggatttgtttaaatttcactcatggactagcaagagagaccctcaggaggtcaagaggtccctatgagaagttttctatttcatgttttaattctgatcattatcttcaaaaacaatataagcacattttgaatcatctagagtagtgcttttccaactttaatgtgtccaggaatcacctagaggtctcataaaggggctgactttgagtcggtaagtcctgtgtggcccaaggcagttctaataagctcccaggtaatgccaatgttgctacactgtcgaccatattttgagtaataagggtctagaatgatcactttctaattgagtacgaccacaaaattgtcttgctgttattgattaatgaataaagaaggaaagcagatttaatatttttaatgacatattcgttacaaatgaagaccaagtgatgttgcaacttgtatgaataaagatctagcaatggttctagttaaaaaaaaaaaagatggaagaactgaatcatctttttatacagaatagggtataggcacgtcaatctcgagtcacagcaattaagacaactctgtcacagtaaaaagtattacttataccattcgattgatatttggaatgatattacttttgtatttttctttataattatataatatctataaacattagggtttatacttagttttatgtctacacttaagaaaaaaaacaatgtgactttagggtacaataggaattttatgagttctacatattattcaaatttgagaaacactggactaagctaagtcatacctctttg

SEQ ID NO: 33889 - DNA, 2647 bp, Bovine  19866880859095
ttcttcgtaacgttgcaagtgagaacttaaaattaactacaaatgaactgtttgtaaaccaaacctagaagtttctgaaaatttagtttaaaatacaatcacggacttccctggtggtccactgttaacaacctgccttccaacgtaggggacgtgggtttgatccctggtggaggaaataagaccccacaggccacagagcacagagtccacacgccacaagtagagcgcccgtgtaccacaactagggaggaggagcctgtgcactgctgcaaagattccacgtgctacaattgagacttgagacagccagagatactaaatatacactaataaataaataaaatacttcaatcattaggctgtaattcatgacttaaatcctgagctcaaatggttttcaggcaaatatttactatggaatacaaaggccctgctctcgtgacaccattataattcagaaagacaggcaaattaaacaaaaataaataagataatatcagataatgatagcccgttgtgaagaaaatggtaacagttgatgtgacaaaaaattatggcagcagagatctgaatttgagtggtaagcaaaaggctcagtgaagaagcacctcggggactgaggcatgagttataataactcccccctctctgtaatttccacccaaagatggggaggaagacttcaggcagggagaatagcaagggcaagcatctgaagacagaagtatgctggacatgttgatggaaggagaagaccagcacgactaaagcaaggggaaggcaacggagaatggcctaagatgaaagcagagtccagagcatgcaaggccttgaaaatcacagtatgaaatgtttatcgtatcccagaggatgagacggttggatggcatcaccgactcatggacatgagtttgagtaaactccgtgagttggtgatggacagggaggcctggtgtgctgcagtccatggggtctcaaagagccaagacacaactgagccgctgaactgaactgatacaagacacagaaataccgattgggattaaaatgacaaaggaatgcaaattatactcaaaatagaattcccatttgcactttgcatgcattactattgatgaaagtattgaacctgaggtttttaaagctactgtcactgcaaagtagagtgatctccactgagagttgaagggaagttctgcccctaagttgaactcaactcctgtacaaaccaaaaaagcaaaaacaacaaaaagagctatggaaaaaccctttggtattaactgccaagaacttcccatcagataaacccaaatactcttagcttttctctatggctacacagataaggttaaagcaactgcttcctagagtgaaagaaaggggggttttgtatctgaattaacctgagtggtgacctccatttatcacattcaatgtcatgtaattataaagtacgtgtctacatacacaaaagtgtatagccttgatttgccaagagactatatttcatggtatatctacaagttgaatctactttccatatgtcaaggttaaagcaaactgaaagcagtctagagctaagggcagccctgagatgatcacataccctatcgtcccattgaaaaggagcccaaagaggtaaaactgcacacatgttgaatagcacattcaagactaacgtagtgccttttacccattgaactcaaatgaactcatgcctatcctcactccatgattacttactaacactttaatacaaactggaggacaattttaagcactcttccacattatcaagaagcaattaggtacctcatcagagaaagacagcttcacacaaaaatataagaatcctaaaacatgaatgcttacgctgtctctcctttgtgtttttcttttattaaaccattccaactggcaacatatgagcaagataaagaaaaaaaagagggagaaagagaaagagaagcaaagagaaagtgaggctatattttctctttttgacatgttctaaaatcaacatatttaatcaaaaaagttttaagaaatcaggcattaaatattaaatgcttagtattgttattagcattacaaaaatagataattccaatgtatatagcttatttattgaatatcaaaggcctttagttatttgtgttcaaaagtgggaagtcatgagcagtttcttgagccactcgtgggaggaaatgctcatgggatggaggaacattttcaaactcagtctcgtctctgaaaattactgccctagaaagacgccgtgaatgacagaagtgtgacaggggcctccgatgagctgaaacagagaacaaagggcaagtgctgcatgactttactgttttaagaggttgtggactgtatgtttaatgcacatattcaatatatgcttttagaagttctttcctcttttctaatattattacttcataacaatgtaaaatttaaaggctagttcatagtttttacttctgatttaacctacaatccacaaggtaaaaactaaggcctctgggtcacgccacacacctagagttgacaggatgctccggcattgtacggtcttttaggagagatctgagaaaccattccagcccttagttgcttcttacatcttcaattcagttca

SEQ ID NO: 33890 - DNA, 1539 bp, Bovine  19866880927833
acatatgaggtggagggcttctgatgggtatgctgagcagacaactgggatccttttcagtttaacaggagggaagtatggtgcttggcatcacagctgactagagtgtgggctttatatcctgtgaatacaggctgctgacaaaaaccttgactctgtttttgcatacttctatatcctaagttgtctgaatagctactcttttcccttgccccagaggttgttttgactcttaatgctttatctctgctgtaagactcaacactgagaataaagttattatccaggatggaaatagaaatttttacatttttattgaaatggataggatcagcctgttgctgaaagttctcagctttagggagtttgaatacattcttagagattgttactttttttcactctgtcttatgactgctgtccaatattttaagatgtggataagcgagtgttctgatttttcagtgctgtgtaacaaaccaactccaatattagtggcttgaaactgcactgtgcatttcactcatgagcctgcagtttgggcagggttcagtgggactgttcctcactgttttgctcagtgtcccctagggtgattgtgaaggcagaggggagctgcagccatctgaaggctcactcacatctcctggttggtgctgaaactggcatggggttccttgggcatttctttctctattctgtctcttcatcatggtcctttagggaatagacgtcttacatgtacaatcaagttttccaaagttcatatcccaagtgaaaagaaagccagaaagaagctgtattgccctgctcgctgctttggctgcactgggcctctgttatggagtgtggggacttctctcgtggtggtgtgctgctcagtcgttgcttgcatggacttagctgccctccagcacccaggatctgagttccccgaccagggatcaaacctgtgtgtgttgcactagaagacagattctcaaccactggaccactggagaagtcccacgttgttttattttaaatgttaatgttctgtttaaagtttgttgagtataggaaactgtgttacagcacttaggcagttaaatgcaggaggactggaataaccttatttttagattgtctatacacgacatacttttttccttacagttttatttatataccataaaattcactcattttaactcaataattcaatattttgaaataaatttatacagtccatttgaacttaataattcagtgggttttattttattttattttttagtgaatttatacagttgtcatagacactagcataatccagttttagaatatttcattaccataataaaattcctcatttctatttacagttaatccgcagtcataggcaatcacttaatctactttctgtctttccaaattttctttattgggatatttcatgtaaatggaatcatatattgtatgtcatttgtttttggcttttttcacttagcatacgtttttgaggttcttccctgttataacatcaggagtacgtcactc

SEQ ID NO: 33891 - DNA, 1390 bp, Bovine  19866880980064
agattgttgggagcattatcagtccctcagatatacagtccatggggtcgctaagagttggacatgactgagtgacttcactttcacttttcactttcatgcattggagaaggaaatggcaacccactccagtattcttgcctggagaatcctggggacagaggagcctggtgggctgtcgtctatggggtcgcacagagtcagacgtgactgaagcgacttagcagcaacagcagcagatatgcagatgacaccacccttatggcagaaagtgaagaagagccaaagagtctcttgatgaaagtgaaagaggaaactgaaaaagttggcttaaaactcaacatttggaaaattaagatcatggcatctggacccatcacttcatagcaaaaagatggagaaacaatggaaacagtgagagactttgttttgaggggctccaaaatcactgcagatggtgactggagccaagaaattaaatgacagttgctccttggaagaaaaattatgaccagcttagacagcatattcaaaagcagagacattactttgccaacaaaggtctgtctagtgaaagttatggtttctccagtagtcatgtatggatgtgagagttgaactataaagaaagctgagcaccaaagaattgatgcttttgaactgtggtgttggagaaaactcttgatcatggggtcgcaatgagttggacatgactgagcgactgtactgaactgaactgtgttattttcatctttatctccattaattctctcctggatattttgtcagtgcatttgaagagtagttaacatgacaactgtccatgacaagacctaaaagttaaatcacatctgccaaaaaagaagtaaaaattaggttccatggcttctgtttcatatctgtaattctagtgccaacttagctgaggatattcaaaacttactagctagaggaattagaatgaaatataatttctctaatttattttatttgatgatcatccttttaaaaaacacatttttatggtttattttttatctctttgtttttgcagcttttatcattcctccagggtttatttactttttaccacgagggatatgaactcgcccaggaatttgcaccatataaacaacagctgcagttcaacttgcagaatgtaagactatacctgttctcactgcctctccttagttaatcagataatcccagggcaactgagttatagccaagctgaactttggagtctttcaaaaacttatctgagtacaataaagcctcattcatttagaaaaatcacttaataaatttattaactttttaaaataagagctaatctcatgtttgaaaaatatatactgccaaattttgtgaaaatgaaaatatctga

SEQ ID NO: 33892 - DNA, 1983 bp, Bovine  19866881007100
tgaaaaggacatcttttttaggtgttagttctagaaggtcttgtaggccttcatggaaccattcagcttcagcttcttcagcattactggttgggtcatggacttggattactgtgatattgaacagcttgccttggaaatgaacatagtaggtgtcatagcaggtatgattctcggtcccaaatgtcaaggggcaagaaatttattttttcattgcaagctccattccctctaataacagaaacttcatttttgtcagtttggtgttttctaaacttctttcctttgcttgcaactgagttccttggactcaattcggcttatttaatcaatatctgaagactcaccatgtgcaaaacactcaagaatataaaaaaaggtttgttttctttcacaaagaagtatgaagtcctgcactttgtccctttaaaaactttaccttgaatccatgaagaatatccttgaattcatgaagatatccaactttctcttgcataaaatgtcgcatggctttgctgcatggtgtgactttctaagtaccacatagaatgtgatgtgactaggactgcaaacttgtgtggtgcctcagcatgaaacacagtttattttttgatgttcattttactttttttgcattccaacagggatgctctcttatgtctatatatatataagagaatttcacaaatatgattgtgatttatgaagcttgccattgcagagaaaggaacatgcattaaaaataaagtcactcaggagtactatttctaggcattactctgtttattcccaagtctagctagtttttatgttctgtaaataacttccaatatttagtaaatgtactctgaatgcatgaatgaataaaagaataaagagaaaaagaaagtgatttgaaataacattttactttgttctttggtggtttaatggcaattgcctggcctccccacctactacctccacctccaccactaatgaaaagttggctgtctttcagagtatctgctcaaagttgattgtctgagatgcagaagtctcctctccctcttctgatctgttttccaggctagaccacctgcttggaacaccttcctggcttcagctctccagactgcttttcccattcttcagagagctcttgaaattgtgcagctcctgatgaaaacacaggaggtggctttccagaaagggaagtgtgctggaggatggccaggaatgattaatttaaagcctgaggtgaatagaaagaggcaccctggagatttgagggtattggagactgtggggggcaagtcagtgaaggtcttaaagcagaacaaaaggctctataacttaaccaaaaggtgacttggaatttcctgcatatgtcctgaaagcaatgtgggttattgtctgcttcaatttttatgtatgagaaatagcagcctggctggagctgctttctctcttgtgcttgttctttattatcccactgaccttataatttacatatatatataaaattatataaaataaacatattatttatgttatataaatatatattatatattgattatatattataaataaaaatataaaatatataaaattatatatatagattaggtctgaataaaagcatttctagtagctctactctcccttctttcccagcacagggaagcctggtgtgctgcagtccatgggggtgcaaagagtcagacatgactgagcaactgaacaacaaatctttccttaaaatctatgcattcatggctaaattgtatctgtttattcctaacccatgtgtctttatcttcctacaagaacatatgtgtattacaatgtcccaaatcatttggtctccaggcagaacctcacctccttgtcattgtttcacttactgaagatgtcactggttcatctacttttttcgttctccagttgctaaatttttccttcccttaaaagttcctctctagtcttacctactcccca

SEQ ID NO: 33893 - DNA, 1356 bp, Bovine  19866881030547
cgctgtgcctaagatttggatgtatgaactaaaggtttctgaggtagaagtgtgaattaccagttaacatcataatggaaatgagaggcatttaacaataaaatcagcaacaaaatttgagtatttaccattactgttattatttaatattgttctggaagacttaaacaatgtattgaaccatgaaggagagatgacagctacaactgttggaaaggagaaaataaggatattatttgagtatgatattgttgtatacaaaaaaaaaaaaaaaaaaagataatccaacaaaaactgttagatttaacaatattaataaatgagtacataaataaaatagagtatagccaagtggctgaatataagagaaaatgcaaacatcaatgactttttcttgtatcaatagtcaggagacaaaaagaaaaaaaaaaaagatgcagcatatgtgtagttgtaaacttaaactaaatatttgaggcaggaatgtacaataatgtcagatgctcttttgagcagatgctaagtcaaatgcataatccattaatatggctctaaaataagctgagaatgttctttaacttacctagttgttgttaccatattcttcaaaagaactagaagttttacatgtcctaaaactgttagtagcactcttttctatttagatatttgtttctagagttgcatatcaaaagaaatcactgtacagttcagaaatttatattataaagtgctagtgtcatctttttaaacataactgccatttataattatcttcttacagttcctttagaaggactaagaagtcaaaaccagtttgaagagatgagatcaagttacattagagagctcatcaaggcaattggtttgaggcaaaaaggagttgtccctagctcacagcgtttctatcagcttacaaaacttcttgataacttgcatgatataagtattttggtttttagaatatcagtgattattttctgaattctatatattactttagtgtgaagtacaagttttacttcatgtgtgttcgtcaaatttatgtttgtacttacactttaaaacagtacttgcatcatactgctcacaatttatattgtgcttttttcattttcagtataaatcactgaaatatccttttactagtatttgtgaaatttgagagtaatgtaatggttgataggaattgtgatacatattcttgagaatgctccaaaatgtttttgtcttaagttagaagatattttatgtaaactggaaaagcaaagatatggatgtggagaataagactctcataccattttgggtggagttataagtcagcaacaatgctaatggatactctagcagtgt

SEQ ID NO: 33894 - DNA, 3571 bp, Bovine  19866881061705
ataagtgactgtcccatgccctagatgtagcgggtagagttagaccacagcactttctggcttcctatttcaattcagaatgccttgttaaaggacaattcccctcgcaaaaggctaggagaaaacggcaaaactcgtgatatacttgtcataacactatggctctccttccttaataacctccttagagatctgtgtttcagatctgggaaacagtcttaacatataagctggttttcttagtttgaggagcatcaatctatttcaagaattttaaactctttttctatatattttttgcattaaaaaccctttggaaaatatggttaaggttataaattaccttctcacaaaaaagtatatacactcatatagctataattttgcataccaatttgtttcatttttgtaaatataatcagggagacaaaaggagctatatagaaagaacatagaacagctttttgtttttacctgtaagattcttcttttctctaaagtagctttgttatatgtgaaagataaaaatgtcacctgaatgatatgaaatgatacagataagattaacattaacaatcactttagtactgtttcaaccttgcaaactcttaaggaaaatatgggttcacaaaaacactaaaaatctgagttatgctttataaaggaaaacaattaaacctcacaacttttctttgaaatttacacagtacgacacgttataaatgtaaggctttgagaaaaacagtaaaaactcgtgacctcataatcatcacccccccaaaaaaacagacatagcacaaaatttaattttttaaagataaaaatggcattcactttttatgaaagagaagagatttcaccatccctgccaagatcttgggtaattgtgcagcaataacctcagacatcatttctggaaattcaacactcagtgcccaggactggataaatgtattcaagcaatacagatgaagttgtttgacaagctgttgttttaacaaatggataagaaacatgtaaggaaaataataaatttctaaactatgtaaacatcaaagcttatttttctaataatagaaatgcttcagatgttgttttttaccaaaatgaaaaaactctctccatttccagaataatatataaaatattacatacatatgatgaaacatactaatatatagaaagatttaaagaaatgaaagtattctgtaatcctattggataagcagtgtgaacatttggtatatttcaagtttttctgtttacacatactcaagtatatgcataatatatatatgcataataataataatatatatgcatatgtatttccataaatgaaattactttatagtctatttcttaatccagcttttcccacataacaataggcaaactcttctatgtcaatacaaacaacccaacctgattcattttaatctaacttttttttggccacaccatactgcatgcgggatcttaggttccccgaccagggatcaatcccacaccacctgcactggcagcacagagtcttaaccactgcgctgccaggaaagcatcattttaatttaattttaattctgtcaaaataatattttgcacatgtttttgaaagtcagatagtactgcaggacctacaggagcaaaaacacagatgcaaccactttgaattactttagtttgggtcatttgatatttacctctgtatttctaataaattatatttcccaaagtttacattattaagatcctattaaataaggatttagctttcttgtattatacacccatctcctcaactacacatactttctcttcttcctattctctatatagatatatctcaatgtttgactaaatcaatatctagcatttatattataaaaatttttattgtttcttgctggattacttttcctttcctatatgagttactttaattttgctagtgctaatcacctcatgtttttctgctttttttgtttgtttttttctatatttatcacaaagccatagtcaaattctctgacagaattgtaaaaacgtacttcagtatgttcatacaattagtaatatctcaaatctaactttttttttttcttggtgctagtaccctgaaaccctgtgcattagttactgtgctgggacacccctttgtgtctctcctgggttgaatctcatactcctttggcttacgccagggttctgttgtaagaaatcctgcagatgcccttgagaaaggctctatttgacgtaaggtctaggagaccttgaaagtctgaaaatactttcatgatgccatcatatttgtttgatgatttggctggtacaaaattctgtgaagatttttctttccttcaaaattctccattattttctgggttccagtatttttgttgagaagttctacaacattccgaatcctgatgatttgatgtgacttgcttcttttttcactggtatattttaggataccctctttattctgggtatgctgaaattttacaataatgtgccttggttcaattgggttgagtctgtatactgggcccttatgctcagaaaattcatatccttcagttctagcaacgtttcttttaagattacttatgcaatttcctctccttgattttctccaccctttcttttggagataactacgaactggaaaatgaagccctgtggattcatcccctaaatttgctatctctctaaattttcatatctttttcttttttgttacttttatctgagttttcctgagatttatattttctgagttttatatttatactgaatttttaatttatgccctcctttaattatccaaaggtattttctcactaaatgttctttttaaaatgtttgctagtctcttttcatggatgcaccatcattcttatttctgtgagtattttaatttttgatgctttcttctgttatctgcactggagctttttccttcaagttacatttttttttctgtttattttgttctctgccttacatttgagagactttatctaaatggctaataattcttggctgttcacattcagcagtgaggcctcatatttgatctaatgagcagagagatttttatgcctttattattttagtgtttctgaacacagtaatgataaaagtttgtatgcaatacatcttgactaagatgtattgctggattaatttccagaattgtattgtaattgtaatttccagaaccctatatatttatccagtttggtgttaggcatttctaaggtgttttttttttttttttccttcatgtttaagcagtgaggcatacatatcttaaatacttgcctaattatttaagataaaccctaaaaagtggggatttgaaagaatgcaacctttaactattaccacacgctgctagattatccatcagcattgttgctgacttataactccacccaaaatggtatgagagtcttattctccacgtccctatctttgcttttccagtttacataaaatattttctaacttaacattttggagcattttcaggaatatgtatcacaattcctatcaacaaatt

SEQ ID NO: 33895 - DNA, 1084 bp, Bovine  19866881088658
gtacacatgtctctttcaattctggtttcctcagtgtgtatgcccagtcagctgggttatccttttcactatcttattttttctgttaattcttccttcctatatattacacttcttttctttccaacacagtttgaagcaacagtttattactataactgaagtagcttgagcaatatgtgtatatgtgtatgcatttttattttaccttaatccaaaccacatgctctggtggctattgatgggcttattactgatgactctagatttaaatcatttgcatttctactaaattgtatttttctcctattttcttcatctacatagatactgttcctgatgccgaatacccagtgattgtccttgaaagtacagagaaatgtttgagtaaaacatttagttatgtgaaattattttaccaaagcctaaaagacaatctttccataagacttagatgtcatgaactctaactagagtgtggtgtttgatactgtggtgtttgataaattggctgcacgatttactatttgtccagaaagaaaatattttcagtaatttggccctggaataaaaattagagtcacctcaaagcaaaacctcaagtcatttataaattttaggatgtatcttcagaaaaacttcagaattttcttatgagtatttttcagtgtattttctcatttatttttctatcattacccagataaatttctgttgagtcactggtagccgatagaggtcagtcatgaataagtgcatcaagtcttagtaataaaactgattactatttatttcactgtcattttcataattccattggttttctcattgtttttttaaatagttggatgttacttccaaattggtttctgaaaactttttatccctcaatttcctcagccatggtggaagtgattgaattatttccacactatttgtagactgtagttttttaatctgaaagacttccagatgctttgaggagagcaatcatccatcattataaaatgcttattagctctgtgcccgtgtggcctgtgtggtctcattctacagtgtgcgcagttttccccccaacagatca

SEQ ID NO: 33896 - DNA, 1460 bp, Bovine  19866881176498
cgccttgttctatctgcgttttccgattttataatcagaatctagttataatgctgaagaaaatgttgcggcaaaacctgcatgtataatcctctgtaagggaagtgatttgtttcagaaaaaatgaattgcagaatagtaaggtgccacacagacatccgtgatggctcaagaatctgcctgcaatgtgggagatctggacagtggagcctggcgggctgtggtccgtgaggttgcaaagaatcggacacagctgagcgactgagcacacatacaacatactgtacggtagctgatcatctgtcagtttttccaacctttttcttttgttgctgaagagtatattcataaaagaagcaaacataagccctacttctctagaatttaaaaattttcatttgaaagtaatttacctacttgtaatttttacatggaatatggtggggaaaaaggttaggataagactaatagttaacactttgtagattattttatattatttattatagatttttgacatgcaatttttagatttttaatggtaaaagtctccatgcctaatggtatttctaaatatacatttatttatttggctgtgccaattctccattgcggcatgcaggatcttaggttgtggcctgtgaactcttagttgtggcctgtgggaatctcattccctgaccggggattgaacccaggctccccgcattgggagagcagagtctcagccaccggagcatcaagaaagttccccaaatggtatttttaaaatgtcaaaacttgacattttatatattgttgttttatgtaatttgggtgattatcaggtgcaatatattttgtgaaggatggggaactatcctgggatgattctcagtgttgggtggtatgaaaatattgggaagaaatgcacaatttacacacatttgttacatgaatagtactctcttgaaccttggctttattctggtaaaaagtggatagacacaaaatgacccctttcgtttgaaagtcagacacatttctcagtagtggaatttctgtatttccttgcacaaatctaaaaagccgtactgcttgctagtttatgaaagacatgccaaaagtattccctcatgtgtaaacatatactggagtttatccagatgaaagccccagcttcagttgtctctttagtacacaggaaaagtgatgatttaatttagaaaagtgatatgtgtttgtaaaatgtgaaatgagtattgtatagtgtatctcctttcgaatggaagctatgtaaattgattactttgctgcggtgagacttttttctttttcatttatttaattttcttattccttaagatgtttgaaagatatggcctcaaacaaaacaaatacaaaaggagtggtggtagtggtgggagggattagcaaggagaagcagattaaagtgagttgtgaaaacaatttaaatagtg

SEQ ID NO: 33897 - DNA, 1308 bp, Bovine  19866881178166
ctcttcatagactttcaaaatcactgttcattgtctgctctaagaaatatatgtctgatgaatatttccagggtaggtctgctaaagttagactgtaaaattgggtgcataccttccagattttatgtaggcatatatctgagtttttaacattctgtgcttggaacttgtgtcttatgccgttttcttgtgatttttttccttctcactaggcatcaccattttaggtctctaccgaataggaggagtgaattccaaagtgcagaaactcatgaataccacattttgtaagttttggctgaagcccgttacttaacttttacattattatagaaaagtaaaaccataggcttttttgagatatagattattgcttgtctttgagtattttcaagtcatatctaaaattaatatttgtattcatttttaatgtccattattatagatgatcatcagaatttgtaaaggggccctttttataatgttgaatttttcctcaagtattctttgattagcttgaggtacagtaagatttatgggtgctgggattcagatggcctgaactggactcttgattcagccagtttaaagttctgtggccttgggtaatttgcttaacccctctgtgccttcacctcctcgtttatagaggaggctcattgaattataagaatctgatatgtaaacccatataaagcactgagaagcacacccagcacttggtaagtgtgctgtgatgttagcaattagcaaacatctgatttaagaaactgcattccataagaaatctttgaggttcattgtcagaatgagctttgcaccaactcaggcaaacaacagtctgaaagttaactcgactggccttctaaaaaatacatgcctctctctttgatctacttttgtctgcgtccatcttcttaatggtgctcgtgatatttcgaattgcacagtttaaacatcttgcgttaattcttttcagctcccaagtccccccctgacatggacattgatattgaactgtgggataataagacaataacaagtggactgaaaaactacctcaggtgaggtgggcctgcctgctgccgctctgctgcggtctctcggtcgcccctgtgggctggcaccgtgggccgcagggagccccgtgggggtcctcttccctcctcagcacagctcgtgcacttgaggtggactggcagggtgggcacagtcacgttcagtgttctgggagttatacgtgcttgtttcaaacagtaaactttgccatagtttatgagtgctaaataatactttctgtttcatatt

SEQ ID NO: 33898 - DNA, 2121 bp, Bovine  19866881244378
cttacagaccatcagttacttggggccgataaaacctgtatgtccagagttaggcatgaaccagtatggccttaaaaacgtgaaaagaaaagaggctaagtgttgttttctttaataatttgtcctctctaccattagacaagatttgagaatttagggaagggggcattggtgataagttaaagggcagtagttcatagttgttgttcagccgctaagtcatgtctgactctttgtgactccatgctgtcctccactgtctccagagtttgctcaaattcatgtccattgagtcagcagtgctatctaaccatctcatcctctgctgtcctcttttccttctgccttcaatctttcccagcatcagggtcttttccaatgagtcggctctttgcatcagctggccaaaatattgaagcttcagcctcagtccttccaatgactattcagggttgatttccttcaggattgagtgacttgttctccttgaagttcatagtggcagtgatttaacatgtacgttacctaaatatcatatcgctgaagcaaagacaatctcaaagggctctgctcctcttcttggagttgattgcgttccaaggcagtgctccgggcacttgcctggaggctgcaccccggcttgtccacagccctgtgcagctgtggagcttggaagagtgttacaggactgctggattagccccaaaatgtcaacctcattttcaatttactggctcttgttgctttatgtcatgctgaccttacatgagtttgtttgctttctttctactcgcggagagatgggaaggcattactttaagcttttgaaagctaaagctggttgaacgctttaactgacaaaagacttacagagaaatgtgaattaagcagctaagaaagcttaccctctccattgctttaaagaaaattaaattatgaactgcagtgcgacatcagtatcatggtcaacatttagatatatataagcaaactatttaaatgatattgtaatcttttgaaattgctcttaatacatcaaatcctaatatatccaatttagcaagcataactttttctaaatgaaacctacttaaaatgttttcctcttgtcaattacatataaagcttaacacctctttctatgaaatctacttacctgtgaaggtttttgttgttgttatgaattatttatagaaagcagttgtttaaaacttttgccattaaacttttacgaacccccaccctcagaaagctagatttttaagtatctccccaccaaactgtattcctattaagaaataattgttttgttttcttcacattttttattcaaagacatatcaattagagttgctgagtagcataacaatcatatccacactgatttaatgggttttgtgcaactttcactgggtaaatgaaaaaatgtttttaaaatatgtaatagaaaaataatcaatgggcatctatcattgctttctctaagagctttaaaattcatgagaaacatcagaagttttatgtaaagttaatataatcataccatattctcatcaaaacagagatatgcagctctgcttattctctatagactaagaatagtatccaacatttacttaaaatggtgagtcctgtatttggtataactgagggtagaaagagatttttcaagtggcagtctttagaactcatcattgtaaccaatttagtttcttcttatgaactgagtacaatgtgcattttcactttttctgatgcatgtacatccacaagaaaagtcaggacattgagtttttttttttaagtttttcatgttgacatttgggataaaaataagaaaaatataaaaattcttcatattttgcaaggagtaaatacaacttacagaagtgaaatgggagaagtactgtaaacagtagcttttcccctttattattgagtgaacaattatgctgatgacacaaaacatgattgtctacaatgataacaatggtaaatgttagaaaaataatcacatactctccaatcatataaaatataaatatgctgagaagcttactttttgctttttaataaagatgcccattttctaacttgaggataaatagtttagaaaaaaat

SEQ ID NO: 33899 - DNA, 1261 bp, Bovine  19866881273600
cctcttaaggcaattgattttctttcaaagaccaacttgactctgaaaagtgattcagagtcctacttcacttgctgctgcagagagaaatctcaaccttcattttcctttaacacgggccagcgtgttcctgcctctgagtcgtctatgagctaattctacagatgctcagtgaggaattaaaccttttgctctaaaagtcatgggcatgaagcccctctccttcctcatggtgagtcatatattgtgacagtgctcgatatggtcccttttttgaaacaagctgcaaaagtgcttgttccaattgtgcttttgtttgaagttttaatctcacagatttgtgagaatggttcttttcccttcacattgattatgtgtggaagcaagtcatggccctatgctagcgctcaaatgacgctgctttgccctagaaatgtttccaacagataaaagtatttatgaacattgagaaaaccagggcatgtgctctgatcacgtggaatattcatttcaccagaaggtacatgtcagtcactacaagaagatcacatttgaaatgacaacagtgtttcagtaatgaaaccatagcctttcagagacttcatgaagataccacagaactgccacatccacaccttggaaacaggccaggtgggcaccctaatcactgctgacagtgggacaaggagggtgagactgatgagtccaagtcagtcagctcagctgttagatgaagatatccttgagtacaaaaccttgctgtgtttcacaggtgactcttgtaccatatctgctggcttataagcagtagtcggttaagtgaaggctttttgttttgtgtaaatgcctgagcagtgaaatgatctctgtatcgctctgaagtctgtgaggcatgagtaagtaccatttctccttgtttgacgggagtggttttacccttgtatgcgctctctgtgcctcacactgtgaatgggtataaccaggcatcccaacagtggctcacctgatggctgttccaggaagggtagagatttttttttttcaaagcaccttccaaactttgcaggttctcaaataggaaaagaaggcaaagagacaaagtgatttggggattatttcctgttctgtggtaatagcttttacttagtgtggcatgccccctaaaaatccatcatgatgtcaggaaactgaatctgctctgcagtcatgggaaataaaaccagctagcctcctcactcctggccttcttcaggtctgtgcg

SEQ ID NO: 33900 - DNA, 1062 bp, Bovine  19866881420478
ccaggaaagcttcatgcaggtggcaagaatgtgaatagctaacataatttttcagtctctggcctattcttttcataatattttatgaagcctagaataagttggtatgtttctccttacagagaaaatagctggtgggaatgtttccttaaatccatctattgaaagcccactgtgtattaagtattgtttttggaatattactctcactaaatcaaactcctgtcataccacctcggtatggtcagaatctataattgcaggtgtgtgtgctcagttgctcagtcacgtctgactctttgctaccccatggaccgtagcctgccaggctcctttcaccatggggatttcccaggcaagaataactgggagtgggttgcatttccttcagaggatcttcccaacccagggattgaacccaagtctcttgagtctcttgcattgacaggtggattctttaccactgcatcacgaaccagctgttatattcagtgttagtttgaacctcctaaatcagataatgcagtggtttttatttatgtggatattaaattaataaaatatggagcatcacacataatttattataagagaaaatatttgggtatcagaaatttgcatgtaataaagaatattttcagattttgcttaagcaaaattttcgaaaacagtggctcaagcagttacaaaatcagtagccattttgtataagaccctgtgatgagtgttggaagagtcattttgtatatgtggtgtgcccagggcctggtggagaaggtttgttttcatggtcgcttaaggcatttgtgggtcccatgcattggagattctaataactggcttctaatctctatattgttgttggggtacactgggcaacttggatctgcctgatttatgtcagaggtacctgttagactttgagagtggggcaggcaagtgagtgactctccattagccccttctcctaaaacacaatttacgtgataatactttgaattgttttattcttgccttataggattgttaattcctgtttttattctgggtatattgtgctta

SEQ ID NO: 33901 - DNA, 2575 bp, Bovine  19866881492709
atatgtaagcacctagtgattgaatgtgggaatgtctaggccatctgtcttttgtgacgttcatagaaaataccttctcataatgtgcacatagatatacttcaaccagtagggtagtgtagaagattcggatatagaagtgtatcaggtatatcattacagacggatatatgttatatatgtttatttggagatattaaaaactataaattttgagtactttctggacgtaaggcactgaactaagtgttttacattcattatcttcatccttaaaatcaagttgttaggtgatacagctggagatcagaatgtttaaatagcagttcataagctatggaactgtgttgaagtcagccattcttgattttaaatacatgtacttaagagttgtgctgcatatcttgttattcagactcattgtttgagttttcaccacttgagaaatatctctttgtttaagatcattaactttaaatacattaggtcatgctggtttctagcataaagcaaacattcgtaactgttggcctttattgttgctatttttccaagttacactaaagtgtccatgacactgtctttccttatgtgaactttaaaggcagaatccattatttattacctctgtaacatctggagaaatatatatgtgtgtgtttcaatgtatttggagtttcactagggcaaagaggatttagagagtgagaattaaaagtgagctactttgctactgttcccagtcatctctctgtagtaaaatgcctgcccagtgtatcttgatgaagccctgtccgagctcacaaaaaggaaggtaggtgatggatggcagaggtatctgtgctggctgtcaacgtcttgggaaggattttgagtattgatctactttatatgttttcacaatggaggattttaggtacttttttcaagaggtcatgtgattttcctacaaattggaaaatgacagaatcatggaaagcattatttagtttttatttttgtgaatactgtctttgtgtgttagattatggaatttaagaaataaagcttgactagagaataaccagtttagtgaaaataattgaaagtaaaacccatttattgaaattttaaaattgtgatataatgtcaaacttatttgaaattataagaataatataaggagctcctgtatatgctttaacctattttaaaatagtgacttatgagaaaaatagatttttctcttcatcttagcattttctaactatgtaataggtcatagtattatcacagcagtagaatgaatggtaattttgttaactggggctgcctccccccccctcaactttattggtatataattgacattatataagtttaaattgtataatatgttggtttgatgcatttatgtattgcaaaatgattaataccatgacattagctaatacctccatcttgcaacattattatttcctttggttgtgaaaacatttaagatcctatgtttaatgttaatgctttttaaagtgattttttaaaaaatcaagatttccttccagcatgttgctttccttagacatatgtcttctgtagccagtcactgcccctgacccagcttgaaccccctcacagtattcgtacagattgatttaaagatttatctgtttgaaagtttaagtgaaacccaatttggagtcctggactaaaacgccattgattgaaataaaatcagttactgttttagtgtggttggaaatattatgagaatatgcaggcaaagcccaagtgtaaggaatctaataaaatagggaaaaaataagcctgattttattttgcagctgtacaattataatattctagcggcaagatggaaagcttttatatggctcaattttcaaatgatgcttgaactgactacattaaaccagtataattaaaggtatcttaaaatttaatgtctgatgtgtagttaaattttagaatatgaagtttaaatatttaagatctcactatgtatacttgttttcacattagtcacattattgctaggatcaagtgaaataatttgtgaaaatttaattataaagtagaaaatgactatatgacatgtgtgaggtattttttatttcatttatagaagcaaaagggaacaaaaactgtttatttaagtaagtggaataagggaggtatcttttttttcaatattgcttgcatgaattatacagaatttaatgtaatttgtatgtttaatttcagattcaaaatgctaatgatgtattaattgcaccacttgagaaatttcgcaaagaacaaataggtgcagcaaaagtaagtgttacattttattattcttcatatattctcttgataattaaagataatagatgtaatttcagatgttaacatttttgaaattagaatgaccttttaaaaattctgtacgtcatttaaaatttttgcacagagcctattacaaagactggaattcttttaaacagaagaaagatattattctcctactgaatagagaaaaagtcagcataagtgagtttctcccatcccaacagtggtaggacattagcagttttaa

SEQ ID NO: 33902 - DNA, 1478 bp, Bovine  19866881752472
caggatggttgaaggcaacttatgaaggcaaaacaggactcgtcccagaaaattatgttgtcttcctctaatgctatttagtggacggcagtatcttcatggtatccatggtaacaagtaataagtgatatgattttatctgacacagatatgaggatcagcccattaaaatgaaaaataatccatttctagacagtttccaaagcagactatgtacctctattaacggaaagggaaaaaatgtttaaattgtttgccattctttttatcttgggctgatttcttattttgaaatagcttatccccatcccttgcttttttttttttttaataagtaactctccacaatgtttctcataacatttataaaaatctcaaatactgtgttaagtactatatcccagaaatttggaaaccagaaatctgctataagactttaagacctgccctttactgtctggtattttctgagaaaccttgaaatcattgctaaaaaaatgtaatttaaactgttcatttattattttttcttaaaaatatagtgcttttatatatgattgttttgctggtcctaaacatttcaaggaaataagggtttttttttaacataagtttatttgtatttgtttaccaagtagatgataatattcaaaagcaataccatatatggtgtctgtaaatgaaaccaagttaagtcatacactgattccgctgtaaacactctgtccaacgttccagatgccgtctatgggcttagagcagggatcagcagactacttctgcagaagcttgatagtgaatatttggggcttggcaggacctgttgtctccatcacactgtccatactaccactgtagcggaaagcagtcacagacaacacgcgaatgggtgtgactgtgtaccaatacagctttctttcaggacactgagatctgaaattgtgaatctgtcatgccataagatattaagcttctttgacttttaaaaaatcatttaaaaatagaaatttatagctgatgtgccacacaaaagcaggtggcaagccggatttgccttatgggtcatggtttgctgatcactggtttggaggatgtttaaaactgtctgtattactttgagattttatgaaattttattccattaacatataaatactgacaagtgatatgcacatatcctctgctagaatcattataatggtatcacaaatgtataattacaataataggaaaatgatacagcttaaattctacttgttattctgtaaagtgtccaaggattttattgatacccttttggctccaaatgataaagatgatgtattaagacagtggttggaacactatgccttctaaagtctatgattagttgagccataatcttaacataaaggtacaggatccttaaattattttgaaattatttcatcatctttagcaggaataaaatcatatataattttccattatgcctttcg

SEQ ID NO: 33903 - DNA, 1100 bp, Bovine  19866881830290
ttatttaagtaatggaaataaaaatcttttgcacgtatttttctaataaacgtgttcacaatttttaaacattgaaaagtcacaaaagttttctctctaaagaccttgatgacttaaaaagaacagccagtacttatctttcactttggccgtgaatctttataagcagttacattacatatacggacaccttggtggatggcctctcacattcctggcagcagagtcgtttgtggtgttggtttgccagcagcccacagaggttgtcaggggcaggttgaggctcacgaagtccgcctctttcttcccggtggtttcctgtgggagcccgtgtttgtccctgcatgccacagtccctgcaagcactgagtccttcttactgaaatgctggccaacaaagtttctcaaaagaaatcagtgagtgctcttttacctctgaagtcaatcagtcactgaatgtctcacacgggcagtgaacagtacaaactaagagtactttgtctgcggaagtgctgccgagtgcagtacctttatggcatgtagtttgcaatcttttttgtgagttaagatatgaatatggcagacgatgagacctacaaataagatgactgagccatcatctgcgagtcctagagctggaagttatcctaaagattattgaggctcgcctcctatcctaaagattattgaggctcacctccttttaaccgactagaagataaagatggtagaaagtaagtgactccccacctaatttgtggtatagatcatggagtagtaaatgttgacctaatttaggcacacattcaaatatatcaactgaaacttattgtgcttgggcattcaatagagtctaatgattcaaagtgacataaagtaaaggagtacataccggagaaaaagaaatctaagattgctaccatcacgagaagttgttaactgctgtaatcacaccttagtttctactcaagcttttgtaagaaaagctgttgcccagaagtgagttcatgtgacagtagtgagataataaacagacccaagccagagttctattaataaatctataagatttgtaaccagagacaatagaattaaccagg

SEQ ID NO: 33904 - DNA, 1375 bp, Bovine  19866880345737
ggttgtcgatttcctttaaaagggtatagttggtcaattatcactgttattaatattgggaatgccaactaatttcatgaagacgtgagaaaagttaaattttgcacttaatttttaaatgatttttcttaagcgtcatcctgtctttggagcttcagttctttgatttcatgcttaacaacattctatgagtcattctgcacttctgaagatagtttaggctaatagaaagtatttctcatgttatagatcaatagtatggcacattttattaacaactcacttttaactttttgaagatgaaattatattttatatatgtttatggaagtgaaacagtgggaataaatggttgtgttttatttttccaggaatatttagaaagccaaagtcagaaacctgtttctgctccactttctttggagcaagcattgttgccagctatacttccctcaaggtaagatttatcaccaaatggtcaataccaaaatcagattgattatattctttgcagctaaagatggagaagctctatacagtcagcacaaacaagactgggaactgactgtgcctcagatcatgaattccttattgccaaattcagacttaacgaaagtagggaaaaccactagaccattcaggtatgacctaaatcaaaattcttacgatgataaagtgcaagtgagaaatagattcaagggattagatctgaaagagtgcctgataaactatggatggaggttcttgacattgtagaggagacagggattaagaccatccccaagaaaaagaagtgcaaaaaagcaagatggctgtctgaggaggccttacaaatagctgtgcaaagaagagaagtgaaaaggaaagatatatccatttgaatgcagagttccaaagaatagtaaggagagataagaaagccttcctcagtgatcaatgcaaagaaatagaggaaaacaatagaatgggaaaaactagagatctcttcaagaatattagagataccaagggaacatttcatgcaaagatgggcacaataaaggacagaaatggtatggacctgacagaagcagaagatgttaagaagaggtggcaagaatacacagaagaactatacaaaaaagatcttcatgacccagataatcatgatggtgtgatcactgacctagagccagatattctggaatgtgatatcaagtgggccttatgaagtatcactatgaacaaagctagtggaggtgatggaattccagttgagctatttgaaatcctcaaagatgatgctgtgaaagtgatgcactcaatatgccagcaaattggaaaactcagcagggccacaggacggaaaaggtcagttttcattccaatcccaaag

SEQ ID NO: 33905 - DNA, 1176 bp, Bovine  19866880425619
tttctgggctcaaatcctgcagatggtgactgcagccatgaaattaaaagacacttactccttggaaggaaagttatgaccaacctagagagcatattgaaaaacagagacattactttgccaacaaaggtccgtgtactcaaggctatggtttttccagtggtcatgtatggatgtgagtgttggactataaagaaagctgagcacagaagaattgatgcttttgaactgtggtgttggagaagagtcttgagagtcccttggactgcaaggagatccaaccagtccatcctaaaggaaatcagtcctgggtgttcattggaaggactgatgttgaagcctgaaagtccagtactttgggcacctgatgtgaagaactgactcatttgaaaagaccctgattctgggaaagattgaaggcaggaggagaaggggacgacagaggatgacatggttggatggcataactgactcaatggatgtgagtttgaaccacctctgggagatggtggaggacagggaagcctggcgtgctgctgtccgtggggtcacgaagggtcagacatgactgagtgactgaacaacagcaaaaaggaattataggtcacctcctactcattttgctagtggcattgaccaggggtcaaggtcatgaactccactgggacgtgctgtagttcccaggtgtctctaatatccactgctctgtgtgcatggtgaactggagcaaatgaattatctgctgggataaagctgaccacatggaagtagttttgtttaattgagttagctgtactgtttggtctaatacgttgtgttgaaaaccttcccatgtctctgcttgcctttatttgctcaaaatatagcctatttattgttggtgcttagaataggttttactgtgatgtgaaatgatctctgtcacgttcactgtggtttagctcctactttgtaccctaagggggtaagtcagcggaagaccgctccctttgcctgggcgcactcaattaaaggatctctcgtaacttcataaattatttgtaattccaggcaacatcgaaactccaaacttcagaaacgaattccatccctactccccttgaaattacttaaaaacctaacgtctctccgcatgatcagcaagtctgctattcagttcaacttttcttttttcca

SEQ ID NO: 33906 - DNA, 836 bp, Bovine  19866880435067
tgaagcccacagaaacggagtgaggaggtgctttaaaagagacagccatacttaaagtgcctcttcccacagataagttttgccattattgattttgcacaacgtttttgttttgcaaagaaagtgctgagcaaaaccagtttttaggtatggtcattctggcttatttgactgtataattaaaagtccaattattttggctgaaggctagattctattcagtgatgtgatcaatattagagaactcaggataatgtaaaaaatctggtaaaaaattagtgtgaaatagtaaattcaaatctctgaagagctgaaattttttagtaattttaggagacctaaaaatcttttaaaagattaaaaaaaatttttttaatttaaaaaagataagaagaactctcctatatcttcataaaaatgaatgtgagtcagacctgagttaatgatctacacattagccaaggtctggatgtgagatgcaacatcagctatcctttcaagtaattgtatactcagaaatgtacctaattaactaacagatcagtctctggcattgacatttccaaggataaatcctaaaaggggaataagaagattgctggaaaggaggaatgcacaattatataatgttaaaaaaaatgcttagatcaagctctttgtaggcatgagccataatcttgtatacttgtgtgcttagattttttatttacttcttaagcaatttattattgttaatcatacaagtgggcttccctggtggctccgacaataaagatgctgccttcaatacgggagactgggtcaattttcttacaaaaatcaaacaaataattcta

SEQ ID NO: 33907 - DNA, 1585 bp, Bovine  19866880438143
tggctttatgattgccgctagcattggaagaggaagtgacccccaaagtcacaccttccatagctcactttgacaaaaatgtacactggtcatacccttgtttgcagtgacaagtcctatcccagagatgcatcagcattaacctcccttttgtctctgtaacagtccacataccaccatcccacaaaccaacagagcaaacagcccccaaaatgccacctttgcccagtctgtccccaggaagtgtctatcttctcaggtcacctctcatcttctgctctcaacaagcattggctaaagtggtgcttttcaaggtgtctccggatcagcaacatcagattcacctgcagaacttgttagaaatgcatattctcaggccacaccccagacttcctaaagcagactcgggggtgcggaccaacaatctgtgttatcaaagtcctcagaggactctaatggacactaagtttgagagcccctaggctatacatatctagatgcccgagaatgatgcttagcatcctaaagggtctgtcccattaaaaagtagaagagagaacagggttccatttcaactattacaaaagggaatacagaaatcattatatggccaatagattgggcaagaaaggatgctagaagactgtgggggcaggagcaagtaaaacagaggcaactagatgaaaagtcctgcccatctttctgggttattcctgaagcttcttaagcttcctctggcagagagcactgcaaaggcccagaaacctggaagagcaagaaatttgctctggctcagtcctggaagtaaagaagcagggaaaaatagaccataaatgtaaattagggcaaggtcatgaaaggctgagttcttttgcattgggcattttactccatagaaaacaaaaatccactaaagttgtttttggtatttagagaagaaagagttttattttgaacagataattctcatggaatttgtgtgatattcacatagcaatatctagtgcaattgtatttttttttttacctgtaacagcagagtgcatgcagctcactcacactgggtttggtctccactactcacatcagacccccatgtatccaccaataattacaattacaataattacaataatccaccacaattacacagtatccaccaatctctaatgtggaactgaggcatttaatgatcagtagaggagctgtggtgttggagaagactcttgagagtcccttggactgcaaggagatccaaccagtccattctgaaggcgatcagccctgggatttctttggaaggaatgatgctaaagctgaaactccagtattttgtccacctcatgtgaagtgttgactcattggaaaagactctgatgctgggagggattgggggcaggaggagaaggggacaacagaggatgagatggctggatggcatcaccgacttgatggacgtgagtctgagtgaactctgggagttggtgatggacagggaggcctggcatgctacgattcatggggtcgcaaagagtcggacacgactgagcaactgaactgaactgaactgaactgagaggagctg

SEQ ID NO: 33908 - DNA, 1998 bp, Bovine  19866880491699
agagtactatactttatttatatattttgggatgttttttatgtattacaatagagcacatgatttttttgaaaaagaataaaacatgtaaatgcacaaagacatctcttagttttttctgactcttgaagttgtacttgcagtgctcaaaaactccttctggcaagagtaagaactagaaacctcagaaagcatctgggtcttgaagttacaacatatgggtataaggaagtttagaataaacagaatagattgctgggtgtctccaaaggaaaattatgcattgtttggctcattcccctcagaattatctggttctagtctttcgttgcctctgagcaattttacaactctgtaagttatggataactaattgcatgtctatagaaaaagattattttgccctgctctcagattttgtcctagtagaaagggaaagtcccactcctccctctacctgctttcctgatctagcaagctgtctgtctttgtaattttcttttctttgtatatttcttacatcttaccagtttccttattagcgatgagctaaatattatctttaacacgtttattttatatatgaaagagagtcatcatgattttacatctttttaaaattagtctttaacatggcattgacgtcccagtggtaaccaggatcagagccagctgtgtcacctacagtgagttcccttgcttccctgtccccatccatccatctcatcaccctttcttctattacattctgtctctctcttgctcacatccttctgcccacatacagatggcgacatctgtaatgatgctccctggttatttctgggtgctggtatttgaggagttttgtagcctttttccacttgtctgctttgcttgaatcttttataacggacatttgccatttttataaatcaatgaagtatatgtgagcaaagtctgacacttgtccaaatttgtcaggtgcttctttctccattttttatatctttgatcttcagaaaaccagagcagtgagagatgtgagatattagtagagggcagttaactttactggagtacagattaaaagatgagcaaagtttctgaaagtctgcggtacatgcacaatgcctctggcatagggtgatcccaacctcgagacactcctaaagccagcccagcccctctgcccctgagttcctgctgtactacagcccctgtgaggcctttcctaggtggccagtactttgctggggcaggtttgactccctgtttcattcctaactgcaccatgaaaactggcacatccattttgtaagcgaatccattaaaggcactggagggaaaggcacccatctgacagggtgtgtgcagcacctccaggttttcgagggccattgtagatgcttctccctgctagatgccagtagcacactctccttctccactcctcggatgtgacaaccagaaatctctccagactttgccaaagtcctctggggagcagaattgtccccagttgagaatcattggtcttgtgcattgagcagctatctaatcaagctttgtgctaaattctagaatcagaatgttgtacataacatagccagggggccattcacctgcgggttatcctctcacagatcccaatctttgtagctagaaaaagtaggtaggacttgggttccacaggactctctttgaagaatactgttttgatgtagttccaagtagagccacatactcgatgctgctgtctggagaacaatgccaatgccacaaagaaagaaaaatcctttttgacaaccctgcagatctgcccttcaaagcagtgttcatgcatccttctgggctctgctcagaggattattatttgccagagttcacatgggtcaaatgccaatgatactaaaactctttacttaattagcacatcagattagccattcctctgcagcctaaagggcttcccaggtagatcagctggtaaagaatccacctgcaatacaggagctg

SEQ ID NO: 33909 - DNA, 1734 bp, Bovine  19866880548065
aatataaactgtcttatagttggtagaattggtgagtcaagcagcttaaatttacagtcatcttcttcttcttcttcttctgtattttcttgcttttgttctcaataaaaaactagatagtaagctttttgaggacaaggaatatgttttaaaaattaattcattttcatatttacaagtatttatttggcaactgctgtgtgccaggcactggagatgcaatggttacatatcataaagaaagatatcactatagttaaagaatatacagtttaacccaaggcaaactttgactgttggctgtctggctattttgttaataaagttttattggcacacagacatgcccatttatttactatgtctatgactgctttcaagctacaagacagagttgggtagctgcaagagagattgtatatcttgccaagcccataatatttacctgtagccttttatagaaagtttgctgacttccggcctagtcatgtaccttcccagtacctggtgaaggaaaagccatagtttttgccccactctacaaatactttaaggttagagcaacagattattcacagctgaaaagcatcaccattgttatgatagtaggaaataatccttagtggattatttttaatctttgcattttaaagactttgctgaaatttctagatgctgttgacatacgaacaattttcttgccttttttttggtggatcagtgtgaattctatacacctgtgcaactgtgcaagaagtttcaaagacgaaaatattctgatgcatgaggttggggggaaggattgaatagaaccttgattgctaccattccagaatgtgtcatctggttttctgctgctcttagtcttctctaaacacacttatgctgtgaatttttttcaactttttgttcataaatacttgaagagaagcaatgaactcagaagtcccttttaaccatttccttctcatttgtattgaacaacacaaatgtgtggctatgggattctctgggattgaggcacagttagaaggaagagggtaaaagccagtgtcgttggcatggtctggggtgtccatcctctgtgtagcatgtctgaataacacccagaatgacatttaaataggtgcaaggtgttctctctgattccttctgggtttaggatgtttgtcttgtttttagaactgtgtattgtactgagtattattaaaatttgaaaagaaaagaaatgcaactgattctccaaatgaatagttggtttttttaaattaaaattagaatgctagtgaaagaagctgtggcattccctaaagatgagggaaggacaatgttgtagatattctagggaaaaataaaggaaaaagaaataaacaaggattggtctaggcacattgtaggaaaagttgacaattctgattttgaattactcagtgtctaaaactggcttatacatactcttctggagcacaaacacaacatcttatgaatggaaatttacccagaacaaggtagacttatgaccacttatcgtctcaagttattctttagcatgattaattcaattcagaaggaatttattactttgtgttctaggtactgtgatcattctaaaaatatagtagtgatgcagttaataatttaattgccatacatagttagagtgggctgtaaaatccagtgaaaggtggaattactaagagatggaaataatacagaaaatactttgatattaga

SEQ ID NO: 33910 - DNA, 2581 bp, Bovine  19866880625010
aatcctgaacagttaccagctgatgacattgtcaacactgagcaatggtgaggcaatcagaaagtcttgctaagttgaggagatggagaaaagttgtgaactgactgtcttcccttgaccagtctctcctttacctcctccttctcttggcaccctggactattgggttaaagtctaagactaaacctttcccccatactatttgtctttactgagtttaaaagagaatctatgttcagaggaaatgcttgattttggaaactcagccagtagtgatgcagtgactctccagtgcttagagctctctctatcttctctctttttaacttcatagactagagttaggacttcagctcttcccttctgtacattaccagagagagcagttgttgccccaggagttgagctcgtgggctaaaatcaccagatagtcacagagtaaaatcacacagtataaagacaacacatgaagtgacacactaactaaaacagaatcatcaggatggatgacagtctgcagcctgtatctagagtaagagctcttaataaccacatgtgctgattaggtgtctgtctgctgcaccctctccatggcaattgactgcctggacttctgggtgcagccagccctggataccggtctctgttccgcattccccacctgatacccttaatacattgtcttagatttacaaccctttctggtgactctttgtccagacttgatatgtgtttgacctgtgcttgcccccgaatggcactctcagtacctgatgccaggaaagcaggttctcatcacctgccctgctttgttggggagtctagggcaaggttcttctccttctacttcttcctgtggcaccgtctggccttgttaccatccctcatcctccagtcttgagagacaacagtcttgtctgccaaggacatgagcttcttgtaaaccaggtcaatgccagctgcggtaaagcctatatctcactcactcaatcagaagccacatagcaacatggtaaataaaatgcattaattttgcctaaaacgagagctgctgctgctgctgctgctaagtcgcttcagtcgtgtccaactctgtgtgaccccacagacggcagcccaccaggctcccccatccccgggattctccaggcaagaacactggagtgggttggcatttccttctccaatgcatgaaagtgaaaagtgaaagtgaagtcgccccgtcgtgtctgactcttagcgacccatcgactgcagcccaccaggctcctccgtccatgggattttccaggcaagagtactggagtggggtgccattgccttctccaaaaggagagcaaatccctccaaatgccagaactgagcatcttcctagacacccttctggtggtcagagatcagtaaacccgagtcaagggtgagagtctcttcctattttctcagttttccttttcttcctttttgtctggtagctctgagtgcagaggctggtctggtgggttagcacaaaatatggggccatctggtcaccaaaagagtaaagtcacaacaaagcgttggaactggtagcagaggaaaaggggaagataggagggtaatctggggacaggcaggtggaatcagcaggggtgcagaaagtaagctttttttaatatacatgtctatttacttacttggctttgttggcctgtagttgtggcatgtggggtctagttccctgaacagggattgaacccatgccccttgcactgggatcaaggagtcttaaccactggaccaccagggaagtctcagtaagcattctttttataaaacttgaccttctaagaaattcagtcctggatacctcctcagctctaggctttaggaattggaattcattcttgagcaggctggtttcttttttcagaacttaagcagcgttcctttgatcaaatgatgtttcatgaatctttgaggtcttttacatgaagagtgggtcactgtgatgaagaaaagatgtttaaagaagtcagggaaaagatcactggtgggtacagtggtgaattacaggggtgagtgctggccattctttaaagcttgtcatgaattagttcttggaggtgctgcgagattggtgacatttccaaagagcataatttgaagttgattgggtctctcacgtcctttgaagataggctctgttcttaaaatgttaaaaaataaaacacagaggaacttacccagtgagagtggcaaaacagtctggctgctgacacgtccctctaacatctctcaggaagagcaatgtgtctgtttgaattggttttgagacgcagacagtgtgatggctaaattgtcatttggcaaattggataagtgtgtgatttttgcctcttgggaaagatgacatacatttttgtacatctaagacttgttttttaaaatcctcagtgcatttaaaatatcaaactggctgggctgctcagattgctttgtgctatgatccaccaggcactccagctcttggctacccagtctcacgatagattgtaacacaggcaggccacagctgttctagacttttctcttctctaaaggg

SEQ ID NO: 33911 - DNA, 1417 bp, Bovine  19866880628134
gccaatattttagtcacttcttttttctttctccccccagtagccttaagacctaaaattggttaattttagattttcatggaagacaaaaaagtcattccatagccccagctccttcttgtcccatgctctttcctccaaagcagaattatttggagttctcttgggtcttttctacctgtcactatgactgtgataccaatgatgagaaaactttggtatgtaccatgactacagtgtcagacaggttcatgtaagtgatctcactgactccttatagccagctctgaaaggcacacaaggcagctattgatactcttctattgcagctgagctcagagaggtgaaatcacagccatatcaactagtttaagacagggtttgcaagatcagatgccatccccagatttttttactactataccagtcaacaccttggtttgaaaacagcgtgttgtttcgtagcagcccacagtgtgtgtgcctcaagccaatattcatagaaggcctccagctaattcttcgtgtttagattaggttagaaacctaggccaatttaaatgaacaaatatctaagtgccttatgtgtgtctagcctggctatatggtggcattcagggttcagagagtagaatgcatatcacctatggatttagattctggatggacctgactcaaatcacagctcttctggggactttgaacaagctacttaaacattcaaaaccttactattaaatgagataatgtaaagtggcctgaaccttgaaagtgcttaatttatggtagcaatgttttatgtacatcatctctttcatccttacagcactctttatgcggtaaatactattctcatccccactttatagactgataagctgaattgattggccaatggttataccactgcattttgcctccaaacacagctggggctgttgaggcttcttgtgattaagacaggggctgtcctcctgtgctttttataggtgtacaactctgtggcgtgatttgggctagagagagggatctttgacattgagactcattcctgcccaattaaagtatactggttgggaatagagggtgaaggaaaagagcaatatttgccacattcacttactcctatttaccaaaagcatgctgatgctggtacaattggtccgtcgtatctgcagggttctgaatccacggattcaatgaaccgtggattggaaatattaaaaaacaaaagtccagaaagttccaaaaagctgaacttgaatttactgcactttggcaactatttacatagtatttacattatatttacaattatttacatagcatttacattgtattaggtattataagtaatcaagggataaagtatattgtaggttatatgcaaatgctagactttttatataagagactg

SEQ ID NO: 33912 - DNA, 2053 bp, Bovine  19866880661095
tttaaagattgaagctcattgcacatttcgtgccattgcttttttaaaattcattattttaaaaagaatttatagcttttcaaaattatttcttaaaatggtaactaattacctttaacgaactctatcaactattattttcatttttgcctcctctttcaatttgtattcatctacattgtcatactgatatggttgcaagcacaattcccatattattttctcactttatactttagtttaaacatcttcccatgtatccaaatctttctaattatcatttcaatgaatgaattatctttcatcatggttcatacaccataatttacttaacaatttccagagtgctgcacatagacattgcttccaatttttttcttgctggtattgataatgctgttaattaacatgcttatgcatactgcttttttccccctctaatgagttattgactcttacgggaggaaaaggagccatcatatgttttgaaactgactgctggagtccatgaaacaatatttacatcctttgaaatatggctatgtgtaagctgcagagttctctctggtttccagctagaaaggaagacttgggacccagttcttatctgctgtcccttttggagagacctgtgaaaactgtccagtggcacttgctgttcagttgctaagtcatgcccgactcttcatgactccatgaactgcagcaccaggcttccttatccttcactatctcccacagtttgctcaaaatgtccattgagtcggtgatgccatccgaccatctcatcctcagtgcacagtggcacttgggcaagcccatatattagcgttcctctttattttcttttaaacattgttacaggagtttgagggcaaagtagctagcttttatataattaagtccttataatgccagattctggaggcaagatagagtgaccccccctttcccacatcaatcctttacaagccagtgttttcctataatagtgctgcttaaataaccacccattcaatttaaaactcaattgcaaaccagagagcgccatttctgtttaaatgcagaacatcaggcagcaaataggacaccaaatcagaaaggactatgaacaacttcaaccgcatttagaaacatcatttttaacactgtggcaagtgttgccaatttcaggcccagggtagataagtccttaaagtctgtattgttttaaactaaacttcataaagggttcaatggttttcatcttttacgggaaatgagagttattacaaatgcaaaaaaattcaatttaaattaaatttcagccacacctgcaataatgctttaaaagggaagatggagtctgatgctatttaccaaagacatcaccaggcttgggcaactgagcaagtacagcctgaaaatgtctcacgaaacacaatttaggtcatttttattcattgtgctatgcagagtcacagacttcagaaaaacacactaataaaacatcatactctgcttaatggtctcccctcattcggcaccataatgataaatgaaatgccattagcataaggcaagtccatttcttgtagtctgtggagcccaggactgtgacagaattggaatgcagagaattgattgttcacagttcaaagaaaaaatgtaccgtgtttcctaactccatgccgaagcctacactgaagtccaagctctgagaaggctcgtgatccccaggctgtgaacacggagcgctcagactgaggtacgtggactggaatgttgcttcagaagatttttttcaaaagtagcatttgagaaagaccagaaaagcagaaagctggatgcttccaatagcctctcccttgctctgcaaggatcccttattcagttattctaaaaacatcttcagttacgttccattcttaccatgggccatgtactctgctgagccctggcaatacagatagataaaagatagacaagattctgctctcctggagcttacatcctaatgagaaagacattaggataaacaagtttaaaatgacacttttaaaatacttttcac

SEQ ID NO: 33913 - DNA, 1364 bp, Bovine  19866880683589
tttttttaaaaagaaaaattaattattttggctgtgttgggtcttcattgctgagtgggcttttctctagttgtagtgagcgggagccactctctagctgcagttcctgggcttctcattgcggtggcttctctcgctgcagaggatcagctctagggcatgcagtcttcagcagctgcagcacatgggctcagtagttgcagctcccaggctctagagcacaggctcaatagttgtgctgcctgagcttagctggtttgtggcacgtgggatcttcccggatcagggatcaaacgtgtgtctcctacattggcaggcagattctttaccactgagccaccagggaagccccactagtgagcttttttaatacaccacgtttatcaagtgtcgctctgaccttgtgagccaggcaaggcattatgtctcatagccacattctgcaggttaagaaactgagcctccaggtggtgaaagcccaaatgaatgtggcttattttaggtaaaatgttctttctgcattgtcttgtctaagatggctgtttcttggaggtataggagggatgaggaagtagtgaatcatctaaccctggcccttatctctctcattccactccaaattccaccttgctttgaagcaatgtcccgaggtacttggagcagaatgagactagtcaacccgcattgggttatttgcaatgtttttcagccttgacactatagaaattttatgtaaagtaattttttgtcggtggatggagatattgtatgatgtatagcagcatccctggcctctacccacgagacgccaatagaatccccactccagtcttgtgacaatcaaaaatttctccagacattgccaagtgtcccctagggagacaagttcacctgtgtttgagaaccactgagttattgtcacatacccattgttggggtggtttgtcttcatgacctgtaccacggataatcgatcatgttgagcatctcagaaaagagatgcaaatccttcaaggcatatgggaaagaaaagggatttgaacctcatgttccctttcactggaaagaggacacatgccttcactctgctgaagacaaaggaagataaatatgtcacccctctctgtggcaagagctcttctgatggctccgacttttacaacaaactgtaagcgctgccaagaaccacgcatcagcccgtttaaggaaaagatggcatatttgaacagcttgacactgtgaaggcataaattgttgggagagacaaatgtgagctggagagatttgtaaatgtggcagacagtaatcctggtatttcgcgttaattgtttttctcaggcaggagacctcctgtgatttacatt

SEQ ID NO: 33914 - DNA, 1428 bp, Bovine  19866880734871
ttgactaaccattaactgtcatcaatgctttatttaagtcaactttaggacttaggatataccttggagatttttgcaattataggtttctatatctagagtctgcaaattttgcatatgtagtacttgtcttccttctgctccaacaatattctaatttattagagaacaaaccgtctctttgtggggagccacagcttttatgctagtggcgtgtattgctcctgaccaccgttttcgttctttatttgagatgccaacaagatttcattgttccctgtacttggccatcctgccttgtctatggcttccagacctttgctgtgttatgtcactctgtgactgtggaccagacatgagtcataaaagcaggattgtactggagctattcttcagcatttcaggcttattactctgttttggacagtgatatactttgttttacagagttccaatgaatgattgtgtaaacagataatgttggtaaaatgagcttataagaaccattcattaagttacaccctgcagttggggagagctaaaattttcaaatgaaagaagtaatctatttctgtgtataatctatgtttacacggctttgtacctatgattcagaaaactgtcccaaatgaaaaagctatgatgatttatttattaagctaactgtatttttgttaacctttaatatattcaggaacagagtgaactggatgcttgaagtatttttctttttgagtttagagttttattgttataactgtcttttctatcatgcacatttcattcgtaattgatttagctggctacttttaaaaatgtcatgttcaagtttgaatttcagagcaaatgaacaaccattcatttcttccatcattcattcctctcttcctgccatcatcttcacacccactgcaagtgctttttattcctcccactccattgaaaagtttcaagatcaaggtcaaccattgtctatatgttgacaaaattaacagtcaagtctttgactttatcctacttgacctctaggcagcattacacatgcctagtcctgtccacctacttgaaacatgttcttttctagacttcaagataccattcttacctgtgttttcttgtattttcactgtcatctctcagtctacttgcttggctacacagtctttgctggttaccagacatttgaatagcagtacccaaggacttgctgtgactgtcttctctctctgtttacacccactccctagatgatctcaacttcttttacagcttaataccatctgttactgactcaaaattctgtccaatctagtcctctccctatgagcttgagccttatggatgcacaaagctacttaattcctctatttaatactacaaatagaattttgttgtctctccatcaaatttactaccctgttcagtctt

SEQ ID NO: 33915 - DNA, 1530 bp, Bovine  19866880756098
tagaatcacatcttcagctccctcccctggggttgttttgggaccaagacatacacagctcaagaaattaaactgcggataactaattcgcctcaatactgagcaagaaaaactgaaggaggttacctgaatcagaagtactgtctcctcagtttctgcggaggactgtcacccttctgggaagctggggggaatgcaagagccctgaagatataactcttagattggatagaccactccactgtttcagaaagctacacctggaacacccgttggagcctaagaatgaccattgtcttggggcagataacatgttataaatgcagaaagaatgctgattctataattactaacaacagctacagttattataccccttccactggagctcctcatgggctagaccttctgcagattttacctctactgttactgacagcactgttccaaagaagacactgctgctgctgagtcgcttcagtcgtgtccgactctgtgcgaccccatagacggcagcccagcaggctcccccgtccctgggattctccaggcaagaacactggagtgggttgccatttccttcttcaatgcatgaaagtaaaaagtcaaagtgaagtcgctcagtcatgtccgaccctcagcaaccccatggactgcagcccaccaggctcctccgtccatgggattttccagacaagagtactggagtggggtgccattgccttctccaaagaagacactagtatctccatgttactcctaggaaaactagaactaagttcaagtgatttgcccaaagtcacacaggtagtgaatggcagaagggagatttttctcaatccatatctgagtcttaaccccagggtgtttccagtgtgccaagcttcagatgaagaatcaagtatttatgccaattgtgatagccagcctccgtgatgaccccagggatcccagccgcctgagacttccaacctggcataatctcctcacacagcaccagggtgatctctgtgaccaatggcatatggcagaagcaatggtgtctcacttttgtaggttataaaaggtttggacttgcctcttgaattctctttctccatctctctctctctgtctctctctctcctcactctgtctctgtcccaccttttgctcttagagaatcaaactgtcgtattataaaccatcttatgaagagggctatggcagaggaactgaagcctctggccaacagacagagaggaaccaaggtgtgccaacaaccacatgggtgagtttggaagcagatgctccattgcccatcaatccttgatgtgactgccaacctgttcaacagcttgactgcaacctcattggagacagaatcaatcagctaagcagttcccaagctccttaatgtcaacagttgtgtgacataatgtttgtttgtcaagctgctaagtttgggggcaatttgttacacatattattaaatcaccagtatactaaatcaccagcgtactttcaaaaagatgataaaatatgtaattg

SEQ ID NO: 33916 - DNA, 4294 bp, Bovine  19866880774735
ctagatatgatttacttttatggtttacactgttcaggggagtaaagttgaagaaggaagacgtttgatgctaggagtaattatgttactagagaactgagccctaggggacctgcaggctcctctcttgatggggattcttgtatctgtcatttaaatatagtggaaattaaaagccaagaagtctcagttctgtactgaaggaaatagggccacaatgagacaagaattccctgaagtctaaggagatagaagtcatatgaaaaaaacatttttctctttccttcacaaacttgaggggcaagaagccaatagaggtaggttatagtactttgtagatagattttcttttctctttctcacgacagacctagtctcagaatgggtgtatggttggaaaaatttcatgacctaagtgcattttattgcttagttgaccctataacatcagaaatgttttaaaggaagtagtatggtgtagccaacaggagggcacggaggcctagtgtggtaagatgtcagacgacctttcattttgtatttaatggtttacattaactgagccaacagtctaacctgccaggtcttacactaagcacttaataaactgttttactatattactatagtgacctctgaaatgggtaccactgtttattatcaagcttcatggcataatcatagacaactagaccaatggactgaaataagagtccagaaacagaacaatgatgacaaagatgatacttcagtgtagtggggaaagcatggtcttttcaattaataagtcaattgaatatacccaaggaaaaaaaaatctgacccttaccttacatgatacacaaaaatcaatcctgagcagattgaaaagcaaaatatgaaagaatataatatgatctatggctagagaaagaatttttaagttggataaaatagcaccaataataaaggaaagaaatattaatctgattacattaaaattaagaaatctgttcttcaaaagataccattaaaagtataaataggcaaaggagaaagtgaaataaaatatttgtaataaactccaccaaagcaagtaggaaaatacagttaacccaatgggagcgggatgagtaaaagatgcctcaagatatttcaataaggaggattcccaaaggccaatacacatatcttgtttagtcttcagagaaatgcaaattaacatcacaactcagtaccatgacatacccacttgaagagctaaagtgaaaagacaaagtgttaacatggagcaactggtttacctcctatcagtggcacgaggaatttctaattgttccttatttatactaatacctgtctttgggagaccggttggggttcagcagctactaaggtagaaccctatggcccatcaattccatttcaatgtatacgccaatagaaaccagtatatatatctgcaacaaactactgccataggccacaacatgaatgagtttcaggaacacaagaagaagatggcagacccagagaatatataccacatgattctatttatacaaaacttcccaaacagacaaatgttaagtcaggatattgggtggaggtcagagattgagagggaccagagaaaactctgggggtgctggcaatagcctgtgttttatctatgtgctggttgcatggatgtgcacactttatgaaaattcactgaagtatgcacatgatttgtgtgcttttcagtatgtttattataaaaaggtataaacacaaagtattaggaccctatggataagtaaattatcatttatctcaaaaaaattaagactcttgaagggcagattatatctctatctacggtcttgtgttctgctaagtgttaagattagtgagtgagttcagtggattaagtacctggatcaaaagggaaggcagtatactgtgtttccctttagtggagcattacctcatgggtttcaattcatttgcaccatgtctatgagggcagtgattgattgccttggctaggatcaaaactgaccacttgagaaggctagtctctatcctagcagggcacacctgtacaattttcccttcttgttattccatcctttgagaagtttcaatatcacttatactgactctcccaggctatgacaggactctttccatcaataaaaaagttatatagaggataaatagacagaatacacttggaaaactcttagcgattgcctggtctttcatttcatttctctggctattcactttttgagacagggtgaaagaggagcaaaagcaaaaggaagaagcaaaaaaggaagataatgtatcaaatccatagagctaattaatgacagtaactcagacagtaacccaattcttgtgattgctagtgtgtgctctcttcactgcactgggtttctccatgatcttgtaacagttgttaatttccactatttgctgttcattcctattaaaactttacttttcactctgcaacacagtcttctccagatcagagattacaccttaacctgacttggggcctgatactcataggcttttccatagtcacctccagctgattaaattaaccacaagtactctacactctatccagattccattttatcaggccatgtaaggaagaaataatggcagcatggaataaaaagggatgactcttgggagtagagtttatgccaatctaggcagtcatggtcaggttaacagaccttaaattctccaggtctcccttaatccctgaacaaatgtaatctacttgacataactgaagaactctacactgaagaatttgacaaaaggcacttttgctggctcctacttcaatccttcacttacttggagctgaaaaatcaaaggagatgatattttcatgttattcaaatgcacattcattttccatcaaatttccattttttcccttaaatgggtgtattttattttttggctcattatttattatcatttcatttatttagaaaatggaaacttcaagcagtttgattaagagattaaataactggactttggacagctaaaaataatctaggtatgggttgcattaggtttcaaaatatttgaggttttgatcaaatctctaaacgcattattgccaaagagcctctccttcttttcaaattttaaacacatgtatgttttaaggaaaattcaattcagagttttcagaatcactgctaaagatacttgagctttctaaagagacttttctttaaaaagtaaaataagtcctccataagcaaaacttagaggttgaagaaattctaactaaaaaattctgtcatttaatcttcatgtcttaagcaacccctcaaaagccataaatatcaattcagtcaaataccttcaactttccccaagaaaagtttcacaagaaaccaatataatgtaaccatttatgagatgcatgtattttatgtctggtgcttgatttattttttgaaaacagctcttagatgaagaaatgattagttcttgagaggctgagcaacttgctcaatatttcaaaggaagaaaatgtcagagctgagatttcacaccaagtctgcctgactctgaagactgtcagctttcagtagaattatcatggactgtctttgagctggagcaaggtaagagataaaagataaatagcatgaaaacataaactttcactactttatcttggactgagaagaaaaaataaaagaggaaaaaaagaaaaagcaccattaaataaagccttcaaagcctgttttatatcatgaaagtttttagccttcagcatacctagccaggaccacctagtggtagctataaaatactgtctgggagctaacaactaattggcaaaattaagtaaatgaacagaaattaccacagcaataagtactatcgtttactaaaagcggcacaaaagtacatttttaagcacttaatggagaaaggatgccagaagaaggaagaaatgaatgtgggttaaaaatgattttcaggaaatgattgaacagggcttccttggtggctcagtggcaaagaatctgcccataatgcaggagatgcaagtttgatccctgggttgggaagatcccctggagaatgaaattgcaactcactcgagtattcttgcctgggaaattccatggacagaggagctggaaggctacagtccatggggtcacaagagttggatacaactgagcgacaaaacagctgccctcccccatcttgctggcacccaaaatagagcaaatttttctttcaaaaaagaaaaagaaatgattgaagt

SEQ ID NO: 33917 - DNA, 1188 bp, Bovine  19866880841589
ccctcagtgtatcgtaacgcatcagtcatgctaaatgacacacccacaagccatgaccataaagatcaaaaaactgggcaatgggccaattcctggaaatccccagctctttcccaaaataactggaatactcctcccactcattagcctatgaaattacacacctttatgaaaactgacaaccccataccctggtgcctctcttgccttcctagatggctcatgctctgtctatggagtgtgtttcctccctgaataaaccttctttcactttaatatggctgttcttggattctttcctgtgtgaagccaagaacccacattggatagccgtcccctcaaatgtgatgggatccagacatgagctgggatgtgaccatcctcttgcaccccactctctttcctgcaacaaagacagtacagggagaagctgctaggatcatcagatacggggaaaatgtttgagtatggatgaaaccggtaggaaagaaccagctcctcagtcagtagagccttgaattgctatgataaaagaaagtggcagagctcagtaaaattaaggtttaggggaaggttcttttgacagaggagataacagaggtccccagaatctaagatctgccaaagatgtgccattcccaacctctccagaagccatgaccaccccccaaccccatcatccaaagcattttgaaaagaagacaaactcaggcaaagttgaaatctggaagtcatagccccctgcaaacacaggccaggctttaatttcaaagagagttcaatctgtgggctaattggaaatgttaggtcaatgacttactctgcagaacctggccccagatgagaagaaacaaaacgttctctcattcttgaaaccaaaataagcctcttcatatttcaaaacaaaaccttatctaagtggatggtcaaaaaagttggcgatggtacaagaggccttctcttttctaccagaagtttcatgttctccaatgaggctatttctaccccaaagtacaaaaaggaaaatctccatttcttcccacatttgagtgtaaagcaaatctgaagtgccagatcctgccttcacttttaagctgttgattcactctaatggtgagctcagacaccctgcagcaaacaggaaatgagtaaatattgtcagccttttaaattgtgacttacttgttg

SEQ ID NO: 33918 - DNA, 1429 bp, Bovine  19866880893299
ctgtgccttagttttctcttctgtagctgggagtggttgccagataacccatgcaaatgacttttcacctagtgcctggcacacagcaatggttcaataaatattcattgtcctgagatcagagcaaagcacttctttcatttgaagagaagagtggggaagacaggatggaatcagaataccttgtgtcagaaagtagagtaatgaatctgaactttattttctgcttaaaaaaaggtgaaggattctgacaaggacgaaatcattgctaatttggtgtcattcctcatttcctgtggattgaaaagttggccttttacagaaagaacttgagtgtccccaagctactggataatttctctgttcctgattttacgtctaggagaactgtgattctctgaggggcttggatgaccacctttgctgaggccagtaaatggaggccaacctgttagtgaaaagcaaagcccagaaagcccaataaaaagaggaaggagcaataaataaacccactgcctagagaaaggtaaactacagaaatgaagaaatcccgaaagcagctccagctctgtcactaccaccactgtactgagagagatggctgcaatattctcagcctttttctacattaatgcttaaaaaatgcaacaatcaggtttgcagatgtgaaatttaggaggcagcctgtttcctgtgatcattggctggggaagctggcacttggcaaaattttgcaagtgggtaaagatgccagcctttatccaaagaatacatgagcaccaaactatgatagtcagtgagcattcttcatccattagtttagaataattcgatgctgtcctattatttctactacatgttgatatatcagattgtttacttattccaggcaatttatctctgttcttttgcccatctttccccagctcttcccccactattgctttcttcagaaggttgaaacccagaagataattgtcagaacaaacatagccccccaaaacctgtgtgagacgtctcaaaggccatgatcttggcaggtcatggcattaaaaggtacaagttggaaaacttctattagtcttgttaggacagtttttcccatttagggctctacttagaaaggtggaaaatttaagatgatgcaggaaaggatggtagagaaagaactgttcaaaggacagaagatggtttaaagcacagagaagcttagaaaccacataagacctcttaagttactaagtcttctgagaagaatgataaaggtaacttgctgtcaaggtaggagcagagtgatggaaacacaggatggatttggtggaatcatgaggagctgggctcccatctagaatccatcacctgtaactgcagaacatcagaggtgctactggcttctttggcccccaatttcatcatctataaacagaaa

SEQ ID NO: 33919 - DNA, 1225 bp, Bovine  19866880904379
gaacataagttataggaaaacctacctcaggttttaatccatatgcaaatgagcccttagtttttatatgcaggagaaggcaatggcaccccactccagtactcttgcctggaaaatcccatggacggacgaagcctggtgggctgcagtccatggggtcactgagagtcagacacgactgagcgtcttcactttcacttttcactttcatgcattggagaaggaaacggcaacccactccagtgtttttggctggagaatcccagtgacgggggagcctggtgggctgccgtctctggggtcgcacagagtcggacacgactgaaagcgacttagcagcagcattcatgaatgtggagcctctggcagctgaaactagtactttgatacatgccaatgcatgtagagctattagaaagaggctttgtgatagtcctgttgacacaacccagacattcttacctataccagagctcaactggagcacaaaaatatagaaacacaaacagcaaggggtaattcagtgattaaggaaattgcagcaagtgtgttggagataagcctcatttatctttgattccaaactttgaataatagacttatttagcaggtaagtgagaataaagcactgcaagctaatatttgccttgcatacatgcatgcacactcagtcatgtctgactctttgcaaccccatgggctatagcccaccaagctcctctgtacatggaatcttccaggcaagaatactggagtaggttgccatttctttcaccaggggatcttccagacctagggactgaacctacatctcttgtgtctcctgcattgacaggaaggcactttaccagctgagccaccagggaagcccttatatttgctttgagaaacacttaagtgcaggaaatatctcttttgccattttggaaaggttaaggcaatgaaatgctacagtcaaaggctctagaatcccacagagtttcatgtatcatgggacacattgtggccttggccacgcaaggattctctgagcattgctaaagtgagacctcatggtaccaaagttttgctcatggccaactgcaagcaattctgctcactgaggattcaggaagattcacttcagaaggtttgtttgcaagaggcagtttgaattccctgaaaggccactgcccccattgaatctgctttgacttgaaacatttgataataccttttactgtaa

SEQ ID NO: 33920 - DNA, 1150 bp, Bovine  19866880918099
tcatatgcatttttataaattgacagttggttatattcatataagctccctgctttaaagcatgaatgttcaaaagattctaaagttttatgacattttggtcccctggtcttttagtagtatagcagctttagctgtgtaagaaaccatcccaaaactttgaatcttaaagtaatagccatatcagtagctcaagatttagtgaattgacattttgggctgggtggttctgaccatctcagctgtgctcactcaggcatcttccattggctagtggttgatggcctcgttcatatgttgggcagttagttggctggctggtaggataactgggccaaataaaactcatcatccagtaggctagatcaagcttgttcacactgtgataatctccaggttcccaatggcactgagagaaagcaagctcggatgtgtacgcatttttcaagcctctccttgcttgaccaaaataagcctcatgaccaagcccagattcagtgtgggagaagactgcctagaggagatgtgtataaactgtgggccatcattttaaccacctggcccaagcaacattcctacatcgttctttcctcttgaatgaacccctctgtcgcacctttcttggagagattccagaagaaagttcttacacacaccgttccattctgccccaaactgaataaggcctctttctctcattatgtgagcctaagtggcttagatagtaaaggatctgactgaaaggcaggagtttgatctgaactcagatcagatcagatctgaactttgatcagaacctcaggtttgatccctgggtcaggaagatcccctggagaagggaatagtaacccactccagtattcttgcctggagaattccatggtcagaagagcctggaaggttacagtccaaggagttgcagagagtcagacatgactgaatgactaacactttctttcagataccttgacattaagtcaaacatggaagttcttcctaaattattcttaactgagtatcaaccactgaaaccagagacattctgcttttgatatttcaaagtcaaatcagggtagcgctgatgagctgcagatcttttattttttattcttgaagaatatcatagattgcaagtctactttgttttcat

SEQ ID NO: 33921 - DNA, 2217 bp, Bovine  19866880922147
ctgtgcctggtagctgtgttggtggttttgttttccctgggaggccataagtgtgttaatcatcctaaggcctcttgaatagccttccatgtatttggggttttgaaatacacggacaaatctccatgcatttgttgtgtaatgataccatgtgagcacatgggaaactcccccaggaggtcattaggactgagcaatggaccgtgaggactttaagcatagtctctggtgcatttttgctttccaggaaagagctgcactcccccaacttaattttctgaactaatgaacttctccagggaagcctatggggaaacatgatctcttatttaatgatgtgccgtcagctcacttaatgctgatttctgcatcactcagcaaaggtttggagataatattctcctgctattgtgtgttttcctatggattattcctgtggaataatgatgttaacatctccaggagagttgaattccaagcctgaagtgaagattgactgtcattattgaaaatatcttgattatgtaaatttattcaaactttcctctctggcaaagtttgttcccatccttttaaattcattcaatgccttatccttactatcaccatcccaatagaataggctggtaaagctactgcagtattttttaaaaatgagattgagacagggtgaagaggtaaggagattttttaaggaaacagctatgagaggggctgggttcagttgaagtgcccatcagccttgtttttgggctttgctggcagcatccctctgtcttttaatgcttttctgatttcctggagttgccttctgtggaaaaacccttcattgtttggattttctctacactttgtgatctcaaatgggaattacggagcattttgagaccttggagccaatgacagggtcaagaggtgaccttggagtactttggctcctccttatctccaaagtcatcctcaaatactaaccgttctattggtgagaaaatgacagcaatgacatggccaagtagcattttattagtctgatataaagtctctttagaaaatgttgccattttgatctgtatcctatgctgtgagtaacacgattgtgcttgctgtgcaaacacagcttccaaacaattatttgccaaccagcatgccaccaccaagcccctcctgtgtacaaattctggatctgctctaagaagtggcttttaattgacttttggattatggctccctttgagactctaatgaaagctgtggatcctctgctagaaaaagtgcacagatctacatttgacagacagtttatggggtttactttatccctgaaaccagttaaaataaaacaaagcaaaacaacagaaaatccttgtgaacagacccgaacactctctaggaaagaaaacagaggtccagacaataagacgttcatttgggtctgtttcagtaggtatgcaacacaactgggactagactttaagttactaaatattgctacctctgaattttagtgacttgtttttctagtgacatgtagccagaggtgataatcaaaatattgaccaaccactatagcttgggaatactgatttgatgaatcaattgattttctctgtcacctccagcctttgttcaaaaatgcatgttccgtaagattagaaagggcctgataaccagccaaagacttaaccactaggggggatttccaagtacatcagcaggcttatgtggcatgtagggtctgatctgcctcctggccacagcagaaggagcagacatccaagattaaatgtggaacaagatcatcagtgcactgacagtctgaccaccaatgacaagagttcagggatggttccttgagtgatgtgcagtttgaggtttgctgggagatggagcaattgattctggtttcctaggcaagagctttgcattagacaactgagttctgggtatggtttatagtggagatatgcaacatcatcaatcttaataatcaaccatgtggacaatgctgatgggaccagtcattttgcataatctctttcttggcaatataaatccccataagccatatttcccatcttctgtgggtcagcaaatgttaaacctgtgatgggacatagaactcatctaatgcaagtccatggccacccaccctatctgctgattgtatttccattttatagatatggaaacagtcttagagatgaaaagtgatgggct

SEQ ID NO: 33922 - DNA, 1456 bp, Bovine  19866880936171
ctgtgtttcaatgtgtatgacacgtgggtaccacaatgtcgtcttcaataagtggcttccatttatttgcactgttcccattctctaaaagtaatttttaatttacaatatccgatatgattcattaatctagaaaattagtttctgggcaaacatggtctgtgtgtccaaaaattgaaatccaactctttgtgctcttttgttttccttcaaagaaacttttaggtttgcaaatgcagaccaaattaatttagcaaaatgagtgctgccatatttacaacacttcatgtttgaattaattgtcctagagctataagaagtgcagggcaccaaggagaagatgctggattaaaatggaagtgacccgtcagttaacagtgagggcaagcgggggcatctccaccctggagacagcactcgagacacaggtaaaagggcggtgactcattgaacaaagggcttgaaaggtgacatctgggatgagtaatttctagcagtactacagggctcgtacctgagcttttcaaactaatgctttagtgaagaatcaagaagtagcaggagaggacttctgggggtggtccatggttaagaatccacctgccaatgcacaagtttgatccctggtctaggaagatgccataggcaactcggcctgggtaccacaactactaaagcccactcacccctccggtccatgtttcgcaacaggagaagtcaccgcaatgagaaggccttgcaccgcacctagagagtagccaccgctcactgcagctagagaaagcctgcacacagcaacgaagacgcagcagagccacagataaaaaaaaagaagtagtagtagagaggcttttctagccatttaggagtacaaggtaattggctgtagaatccaaactactaatacctaggagacaagagcctggctgccgtccaacttgcctgatctaaactttctcatctgcacaaaggggataacaccaaatttccaaggacagtgatgagatttcaagagaaatctcacttaaaggcattttgtaacacctaacaatccctgtacagtggcattgtccctgagaaataccacagggacagaatgcaactccccatacaccacgtgttggacactattctttcaactaaagttcacatttttctgagtcaaccctacacttaataagccttgctgaactgatcctttgggaacaagaagaggagttgggcaaagaagtaaattatttctcattgatgatagtaatggaaaactaagctcaggacaagttcacaatttctataaattttactaggcagtgggttttatctgaattaatctaaccagtccattctgaaggagatcagccctgggatttctttggaaggaatgatgctaaagctgaaactccagtactttggccacctcatgccaagagttgactcactggaaaagactctgatg

SEQ ID NO: 33923 - DNA, 1125 bp, Bovine  19866880968614
tctctgtccatggaattctgcaggcaagaatccagagtgaatattcctttctccaggggatcttccccaacccagggatcgaacctgggtttcctgcattgcagacagattctttaccctctgagtcaccaagaaagccaaggtaagtacccccaaaaaagtatggtggacaagaactctattcttttcctgacaatagactgtatccatttgtgaaactcatgagatccataagaatttggtataaaccttaaataatcacatcttgctgaaaacacaaagaggctgaaaagtgagttcagctaaatgctgtggtcactgtggtggtcgtggtgaagagaagttctatctggacaccaccagctggagtgtctcatgccatgtagcctaaaaatacatattttccactttgctcaaagacctcacatgtctcatcccacattaggattttaatctgtagctatcttttcaggaagaggttggatataatctcaaatcaaataaattcagagttttaatgtgactccttagtcaccttgcttcctgatatttttctgtattctgttccctttccactctttaatctagatttttgatctagatctttccctttagtgatcacccttaaaaggagtcctgatatacacaagtgtgtcttaattttcttttaaattcaaagtgatgctcagctttctcggctcccatagtccctcaagttgatgttccctcccccttctcccctgcagttgtctccatctccccatctgatgtaaacctgaggtcaaaccattttgctggtttttccatttggcagtactcatacattccctactgctttattaagcacctctacggcctcaagaaactttccttattcatctgcaataagcccattatttaaagacactgaagaaagaataatttatagacactaccaatgagaataatgtctggtttgagaattatgagttccatcactaatgcctttggcttgatttggctctttcttcatgaacttagcttgcccctgacccatcatgagtaactggatagcaatatgaagacagcttttggaaaattccacctgtttaagatcaacctcgatttgaaatgaacaagtatttt

SEQ ID NO: 33924 - DNA, 1973 bp, Bovine  19866881001635
ttgaagagactaaaaggaagaaaactaccatttaaaacctccacttacttccctaacaatggctttttcctctccttttctttataagcttattaaatattttctctgtttccactgccttgaatccttttcatctcagctttcttatcttccaaagtttccacaggaaagaagagtgtcttcattgtttttcttagaataaataaatcctcctaagtgactcattctcatcacagttagaagcatttcttaagtgcctagtatttgccccaggcacataatatactaagagaattctagaactcagacagctatctcctgcaaccttctggtatttacgggtagaattaaggttgtgtgtgtgtgtgtgtgtgtattcctttcaatttgttaggatgacacaatcatgctcatcccagacagaaagtagaagcttccccctctaagaggctttttgcaaaatcccctcccattttcccaagaaaactcaatccttctcaggattatctcatcctgctgctgatgaagtcatcagctacctgcctagtacaatttttacaggcggttcaaggatgtgctttccccagaataccctcgtccccacccaaacctgcccaaatacaaaaatacctttccaactgagatggcactgacatcccaagaatttccactgtaagagttccagagggccactcttaatgttcggatggtaagatcagaggtcacttgcatgaaagagtcatttacacatatttaacacattttagcacatattaaatgctcagattggtttgcagacatttggcagagaacgactgccgacaaatgacgagcccggagagacttttctggggaggatcagcatcagggacaaggccccagtcttagaagtgaccctgaccccagagcattttgttaggtcacgggtctcaaattatgccttgcaaaatcagttggctgtaactaagactccgtgcctgcagaaacagagctttgtcgttctttgtttctcgttgctcataaaccccccaactggagtaatttctgctgaattcattttaaaaacatccaagtctctgttatttcttctgcttttttgtaatgaacaagatttctttattctgtgtgttatcaaggaatgcttctggctttgtgtcccttaggtgaggcagatctcaccgaaacaatgcccccttgaaggtcccatccgagctcgttagtagaaagtaaggatgcaaaagccagccagcttgtttatcccgtgttccatcttttatcctatttccatctcccttttttcatttccacatttgctcggattcttcgtatgtttcccactgtttctttatttgcctccagagcttaaaatcaaatctgcctgccgtacaagaacgccacagcaacctccctctctgatacatgcagcaaatcacattacgatcacttcagaaagggcctgccaggcttcccagaatgctgtacaaaatcttcctgtgttagacaaaaacatttcaattggaacaaatgcaggacctcaagatccaaatgagttcacatcacaaaaagcagccttcctcttattggaaacaagttacagattttcagctgtcccagtgtaaaatgcccagatccagccctttctcttctttcaagggcagctttattcaggccaggttattgtatgttgtggatcatatttcttcccatgacaggcacataagatatgccctgtatttttagtgtattgacacatatatttctcaaaatgcccaataaaataaatattatcccaatgttacagaagaagaaactaaggctctgatactactctcctgcccctacaaactcccagaggtagtaagaggcggaaccaagtcttgaatgcaggctctgcaccctagaatcaatattcttggtttccctagtggctcagtcaagactctgcctgcaaagcaggagacctggattcaatc

SEQ ID NO: 33925 - DNA, 2278 bp, Bovine  19866881112183
tattttattaaggcattttacttgggatttggcttctgtaaacatcatagcaaacagaatccagcagtatgttaagagaaaaatcatgacaaagtaaggttcattttaggaccacattaatttttaaatattatgaaatctatatgatttcatttattaatagcaaggggaaaaaaaacaatgtggttgatcatcttgatagatgctgaaaagcatttgataaaaattaacactcatgcccaatacaaaacctctcaataaaatataaataaatagatatgctcataacttttaccatgtatttataatctatggctagcctcatgctcagtggtaaaactctcattaaagtcagaaaaaaatgttcattgtcatagctattacctggtagtatttttttccagacaagctaattctactagaaacagaaataaaatgaatagaggagacaatatcatgatttgcagagtgtgaaatactttgaagccattaaaaggacagtaggttctccagatactgactcataaagatgtctactccatatctgggagaaaatataggatatgaacagtaagtagaatatgatgtcatttttgtaaaagcagagtacatgagcatatgtaagtgggtgaggagcatatgaaacactcttgaattgtattcagcaaaatattaactgtcttgcttctgaccgatgggctaataggaccttctgatttcctgctctgtgccttttggaaattgcttgactttttaaaaataaataaataatttgcccaaagtcaaagccagtttgactttaaatcctacacttttaaccactcctctgttattcttattattagaaaaaaatgtcattgctatctccaaaacacaaatatatgtattacatatatgcttactacccactccagtattcttgcctagagaattccatggacagaggagcccggcaggctacagtccatggggtcacaaagagtcggacacaactgagtgactttcagttttcgtacacatatgtatgaaacatttaaaattatgacataataggatttctaccatgcagtcaataaattatatttattagcctctctaaaccctgcttaccttaaatatgagcagggactatgcttattcagctttgtatcccctagcaacaagcaaatgtccttcacagagtgttaatattaaacagacatattttatacatgtaaatataataaacactaggaaattggattacattgtacaatgaacagtgaactctcttgagaaaccccccctggcctttctttgtgatgagcagccatgctggcctgcagcttctatgtgggccaaggtacaagccctggcagaggtccaaggggccatggattcagagcctggcatccagtagaagcccattgagagatgactttcagcagcagaaagatatgcatttcctctacacagcaatctggcccctgcaaaagcctgaaccaagacttcatctttctgctcactgccatcctacatggaggctgtgaggaggaggttgaacatatggccagcctgtggggtaggtgaacgacgcttatatgacccagcgggtactgagaaacctgaaggccctaggtgagctgtctggaaaacaccagggttcagttttcttcagctagaatacagtgccttgtgtttttccaccgtctggtttctgagctcaaagaacatgaagaagggctcaagctgacatgagcactggctgtggagggaatcagatgttccaacaaatggttccagtcatgtggtcctgcgatggacattgctgaatgtccctgcagatgacctttttgccttggatgggggaagtgccatgggaagacccactgcaggcttcagcgtgtccatgcggggctgctactatgaagcctgtgagggtccggtgccacctgagtggttactcagggattgggcaagtggagggggtctttgcaatgtggtggccttcctagagcttcttccccacccctgctttgtagtatacccaccacccactcatgaccccctcaatctccccttagaacttcatgtggtcctgggcttcctaccttgattggattaaactcttctctccagttagttctcaagtacccaaatctctctttacaagttgcttttcccttttattggatctaggttttggattcttgcccttaaatatattcatctcatctctccctcccaccacctcaaagtttccatgatctaggtctccattttcgcaagaaagagctaa

SEQ ID NO: 33926 - DNA, 1550 bp, Bovine  19866881127550
ttggctctgtggttttcccttctcggcctcatgttcatttctttctgagtaatgttttgggcccagtggaaaagtgcacgatgttttctgctggttgaaatgaggttaaagtaatgaaattctgccaactaaagtttaggagaaaaatgcttagtagttgctgggacacagccagtttttatgaaagcagttgtgtaaccagaaaaggatctcagtggcttctacagcagtggatggtcctcaagaactttggtagacactgggaggtttgaccagtttgaaaactggtcagaaatgaattcccactgggctgtaagctccgtgagggtacagctggtgtcctattttagccaaggcatccctaattcctaggccacaaatcctggaaaaatcaacggaatgagaccaaagaggagaaatctgagtgatacaatagatgctctgatgtccaggatacatcccctctcctccctgtgaattggcagcagctgcatgggcagttgtaggccaccttgtgctggatggtatgcaaggctgggatgtgaatctttctgtattctgcctcaggtcctttttgaggtcataggacttgaatggctatacagggaagactagaagccgggtaatggtaactctcctggggaaatcctcagcccgtgagggctgggaactgttggctaaacgttagtggctaaagtcttctgtcttttaggtggaccccgtgggaggcatcccctacgagtggaagtgattctctgttgctcacagcagcagttctcttggtcatgtactctgattttcttctttctgcatcccatccacccccctccctcattcctgcttcctgagttcctctgccaaataaaactcttgcaccctagtccttggcactcactcggctttggaggaaacccaaactaaggcaggtgtgtaggaggagggcacaagcttttgtttttccaagtgggccctcccatgatttcaggcctattgccattccaccatgacatgctgatggcgtcctaactatagggatgcagagctctgccctgggtctgcctgcctgggttcaccacttacaaatggcaggactgcaggcacagtccttttctctttgtgcttcatttccttttctgtaaaatgaagatgataacagtgtacctaccagggtgatgattataatgtgatgagaacatgtctgtaaagctcttggctccaggctggcacacgctacgtgcctgcccatgctagctgttgttaggatggtcacttctcatgcgaaattttttcactcttctatactcatttctaaacctcattttctatttatattaggaatctattattcctaacatgaaactataagcttaagactggaatctgtggcttttccatctttgtgggctctgctgcactcagcattatcactctcacagagtaggcattcagtcacattataggaaagaaagaaagtccttgctcttatgggcaatgatttgaatagacaccacctattctcagaactggaggtcggaatcactttactgtcc

SEQ ID NO: 33927 - DNA, 1451 bp, Bovine  19866881240920
cagtatcccaaccacccattcatcctccaggggagtcaccagggggactgaagaatgttgtaatctgagaagggttgcgtctaatgatcaaggaatttcagggcaatctagtgactactcatagttttcctgtatgtatgatttcatgctaagatcttaaattggtcaagaaatttctagggagctggaaagaaaggacagtaccaggtaaataagcagaagagatttttatttctatgcctggtcttagagggtactacgaagcaagtaatcaattccagagattctacactccagacatggaagtgaaaagtgaaagtgttagtcagtcatgtccaactctttgttatcccatggactgtagcccaccaggttcctctgtccatgggattttccaggcaaaaatactggattgggttgccatttccttctccaggggctcttcctgattcaggaatcaggaaacccaagtttcctgcattgcaggcagattctttaccatctgagcccccaaggaattggaagtctatgggataactagagaaactcctcctcattaaaataatgggtattatgtaatgccacttgggaatttttttgtgtgtcttcagtcaaatacactttataaataaaataatggtagtacaataactaatacttgttgaacagctatcatattctaggttttataaatttatttattaataaaaatatagtgaaaaatatgttgtagatagctgtgaaactagcttgtcccttgtcagacattaactgtagagtgggaatttgaacctagattggcctggccaaaactcatatggatttaggaccatatcaccctacattccacaaaacaaagtatccaccattcttctcgatgcatgtttataagaagaaatgtataatgctatacacatgctctcctgtgactctgggtaaagaatggttttaaaagataggttttttccttgcctctatagtgaaccatagccttcagcagttggacttagggtattttaaagacatgaaaagatctggaaaagggaaatcagtcattaattaaagcagtttcctgggcaaggatccacaaggaatgagaagctgggtgcaagccggttgcttttaaatgaccatcccatttatttggctgcagagatactcctgggccaattaatcaattcccctttccttttctattcaaactttgagcagaccttacttcatctaaagtgattgccttgcaagtctgcaaaacatcaggatggcaaagtcacttcttgagcaaagcaaagactaaggctttccttcagatgttcctgaagatggataagaagaagctggggcataattttacccgtgaccagtgatgaaatgctcagccaagtaaattactaagaaaagtcagacaaaagctggaacatcaagggtatgattatttctcatctcttcca

SEQ ID NO: 33928 - DNA, 881 bp, Bovine  19866881544960
atgagagacagaattctgtgagtgaccatctgtccttttgtataagtggctgcctctggcccagggctgtgggtgaatcagagcatgtgatttatcagacatatatttagaaagtaaacgattgccaaaagaaaggagggcgtgaagaaacaatatcacccgtatctgtttctcattataaaataatattgctggtttgcacgctttctagattccttagggcattctattgccactctgggtttgttttctgtttttttttttttttttacatatttagaaggcatttaatagaaatgttgctgcatgggaacaaaaatatttttctcacaaaatgttcccattcaataagttgctgcatatttttgttccatatggtgcttaagctgacagtgtctgtaggcaatgcaattgacaagcatcagagaagtaggcttatacatttaaagtgggtatatgatttcatgtccagagatttttttagacaaaaatctgtgatgtttaatttaaaaaaaaaacataatgttaaagaggagttcaagctaacttcaaaaaaaggactgcagaggaagtaaactcattcattcactttattcattcatcaaatttactgatctttttggggggattcaaagatgaatgaaaccttgtccatggcactgaagaactcaccccctagtggaagagaaagaaggaagacaccaaagggtaataagagtctatgtgggtactctgggaacacagagtagggctcaaagtgatactgatggtggggcaggaggtgaggggaagtcttccctgaaaacgtgacccaaagagggaattcacaaagttactccctcagttccttcaggtctctgctctgtgtaagtaaagccctt

SEQ ID NO: 33929 - DNA, 1003 bp, Bovine  19866881786722
catcatatagattcttcccattgctctaagtacatgcataatcccatctttatatttctgtatacaaccaaaggcagctattagaataagaaagtgagggaatgaaacacttcccaaccaaccagcttgaatattataaaaatccaaatcccctgaatattataaaatttgcatgttctctacattctcaagaaagggtgagttcagattataaatagacagaaataatctcattgtatttctcaaagaaataatattttcaaaactctacaactctggcaaaacattggggccctatattaatctacaaatatatctctatcatgagaagtgtactgaaacatgtttcaagtgagaagtgttaaaacttagagcaagaaaaactctcagagttcatttaattcactgaatttttgctttgttttcatgaaacatgttttaagtgagaagtgttaaaacttagagcaagaaaaactctcagagttcatttaattcactgaatttttgctttgttttcaatcattgcagtccaacaatacattaaaacttttcataaaaatagtaataaatattcattaacaggcttcaatcaatcaagcactgtatgagaactgatcctctacgactttatctaatctccacatctaccttatgaaatagatccaattatcacatttacaatcacattgcttgagggtgacaactacgggattcaaatctactctgtctgacaccatggtctgttctcattttgtctccaagtaaaacagtaacataaacatatttcaaaacttcagaaaacaatccaccctaccacaatactttggagcacttgattcttttcttctatgaagctctttccttacctgtatggtaataatgaatattttctacttttcaattaatgttatatcaaatattttctgtgttactatagaaaccccatgataatcacttcccttattggctgcctaacatttcatactgggataactatcatcta

SEQ ID NO: 33930 - DNA, 1139 bp, Bovine  19866880228923
tggaaggactgatgcagaagctgaaactccaatacttggccacctgatgtgaagaactgactcattggaaaagaccctgatgctgggaaagattgaaggcaggaggagaaggggacaacagaggatgagatggttggatggcatcactgactctatggacatgagttagagtaagctccaggagttggtgatagacagggaagtctggtgtgctgcattcggtctgacataactgagtgactgaactgaactgggctttcatttttgaaactttttgacaaagaagtaatggagagggggccagtcagccagtgtgaaaaactctaatgaggaaactttacactagatattacatgggcaatataaacagtccttagactgtgtgctataaaaagtgtatgttcccttatttcttgttttagcatgtatcagatggtagaagtgcttttaaatctcccctctcctctccccaaactttgtatttcaatagtggaaccaaggatggaatgcagtcaaataatacactggatttaccatgataacatcactttcctgggtccttcaaagcttttaatcacggtgtattgggttatctgtttgtcttgtagttcttggagaacagaggtggtataatgtgggtctacaaggccttcagccttcagatccattttgtttggccctcaaaatgctggcctctgaagcacataaacaaataaaacttcagccaactattttcagataggccccacttctttgaaaaatgaaaattggaagatcatttctgtgtggtaaaataccacctgggaatttattatatttataaaattgaagggagaaagagttctgtttctcttttctaactagagtctccatttctaactagaaaaaaaagactgatgatcatattttcatttttaatttagttcattttcctagatatggttgtaggtgaaaggaaataaagtgtttattatctttgccttgagatcctcgaaaagacattctgtctgagatcatgcaagtatccatgaatgtaagcttgaaatgattataattatgggtttgatcatcacatcttacacatttctcttttcattttgacatctattattgaacacctgtacgaggtcaaaacggta

SEQ ID NO: 33931 - DNA, 1658 bp, Bovine  19866880421345
tacctatactcattcctagtgtagaaattgtctagcctgtctgtgatccaaacaagttagagcaaaacgacattatattgcacaatggagagtattagtccatgttcaacagcttctgagtgctaacaccaaaggaaaggccacccagcaggctctgtcaaagtatccccttcctgggaacatctgagcacaagaactagcttggagtagccttccatggaaccatagtccatttgcctttttgcttctctctctgtgcagggtcatttatgcgttcatttctgaaatctatgcttaaaattttgagactatctcaaaatgagcaagctttttttttttttttccccagaaaaaccatcatcaatttggcaatggcacaaatcagaatggtttggcaaaagaaaaagtgcttggcctatatttttcctctcaccttatttaatagcccatatattaaaaaaatatgtctgagattctactgggatgccccttctgagttatgcccacccccacagatttctatggtgatatctggataagtgcttcacacatttaaggctttattagccaatgttgtaaataaataaattacctaggataactccacaatatgaaaccaggagattcggctcttatatcttggagaagattagctgtcttatgccttgattataaatgttgccctccgggtgtagggaaagtaggatggaaagacgcaaaagagagaacttgatggtactggggatggctgccaggaactgaacaaggcagatgatgaactttgctttaccgagtaatgctaactgatattaaatttggcccctgaagtggtcttgcctcccaggttcttaatccctccatgttgtgtgtgtgtgtgtgtgtgtgtgtgtgtgtgtgtgtgtgtgtatgcgcgcatttctctcttgtagccaaattttcctgtaacaaactcatacttgtgcaatataaggaggatgctactaaaaaacaaaaattttaagctcctaaattgggcttttaaatcataattaagaggaaacagttggggaagaaaacatccagaattttcagtaaggctggtgaaactatgaggctttccaggatgttatgggtttaaaaagataatgctcaaagtcagattatgtgactctgtgaagaaaataaaattgcagatagaatgtaattatggatgagaaaaataagggcactaatgggcagccgagtgggtggaacatttcttctctgcctcaaccccagtaaccctcagtctactctactctgcctttcttgtttgcgtgactaaaatgccctgaattcagttaagggtaattgagttaaatcagtttcctatccaaataatattaaactaatgatgaattgaaccaaaaaaataaaataagaaactgctttgtaaacctctattttaagcctgagaagcagcccaacgcaatttagtcttctctgccttccctctatgtttgagaaatgaagcagtgttttgcagagcaatgcatttttttcttatgctcatatctatctccttcatgttggcaaaagatcattgaattctgttttcagacatctgaactcttgctgtagtgactgccaagtcctgccacagggtcaagggaactgcaagaaggaacccgggaaggaga

SEQ ID NO: 33932 - DNA, 1629 bp, Bovine  19866880542100
tagatagtgttgtaacttctactttcctttaatacatattaaaactttgacatattatatattagtgatatggtgaagtgaggatatgttttctttttttttttaatatttagtctttgaggagccactgcttctatatatatgtctggacctgggtcctgcagtcacagttacttttccctgcttttatttcactcccacctcattacttggctccaacaaatgatgatcctcaatgaccaatgagcatagtcttcttatacagtttgttgtatctaaggatgtctggccaaggcagtaagtggggcctgaaatctagccatgtttctctccccaagctgtgtaccttggcatggggtgtgaatgcccgaagaaaggtcacctttctctagttctcataaagactccatctgcttgccaagctgttcaccttcagggctacctctacctagtagggaagtcatttgctcatttgtacaaaggctatggagccatatgggctagcagaggccccgctaatgaagaaactccatactctttgcctcagtgattgtttcatggatgggcccaagctcaaatctggccaatcacaatattcccttgaacttacttcactattagcttgaaatattgcatttaatggctagggttgcaaaactgaaggatgactgcagccatgttcctcatcatttacagggtctatatgcagcattaagcaaacacaatgaggaaagagagctaagagattggaaaaaagagaacaaactaatttgaatccctggttccagccctcactgaaataactaccagcatttgagctacaggagccagtggattcttccttaattaacttgttgcaagttgagtttctgttatgttcaaacaaaagagttctgatatacactggtggtatagtgattagttcagttgttgcaattcattagaaaggatgttgtacataatggaatgctactaacctccccctaataacagtgctccagttactatgtaataacaagcatctgttgcctttcaacctgaacctgtatgtaaaggcaggtgttttcagattaaatgactgagtacagtggcatgaagttagtcaggaaaggatctctgaagacagatgaatgctttttcccaatctcaaagtaaagaaactggattggcaaaagaatgaaatggaagattccttaatttgaggaaagagcaggagaaaaggcacaaagaaacaagttagagatatatattatgactctcttttaagtttcaaaggaatgaatttattagctcactactgaaagtctccatggatagtatggaagcaggattgttctgatttgtatttagatatgattgtctggagtctctcttttctctcctctcagagagggagctgctctttctttgttatttcagcataagtcttaggagtaattattactgaattattatgctgcttaggtcatgctgctgctgctaagtcgcttcagtcgtgtccgactctgtgctaccccatagacggcagcccaccaggccccgccatccctgggtcatagtactaagtaattatgctgcttaagtcataggtccaagcttcactggatctgaatggctaaggtaatgtga

SEQ ID NO: 33933 - DNA, 1690 bp, Bovine  19866880594096
tgaatggtaatgctgttcctgagatgcaaacacagaggagcaggctggaggagcatgagtgatgaattcagtgcagggatgctgagttgcgtgtttatgagatacagtggagctgtgcagtgctactagatatgccaggcaggagctcaggataaaagtctgtcctgaagacataaacagtgtaaactgtaattgaagccacagaagtagacagtattgcttggggaatttagagaggtggatcttaagcttgataaggttacagaattcttactttcctccaaattaatgcatgtaagcacatactgctgtaaacaaaaagagcaggtcaggagaaaatccttcaaacaccaatttatggaggctgggctgagaaggcttagtcaacatttctctgtctccgcttcttatgcaaatgtccatttttaactcactctaactgcccatctttccagctctcaggtgttttgctgaggttctgtttatagcctgggacaaagaccactggtagacttctgaagtcttttatttggtatagagctgtcctagccatacttcctttcccaagaaaggaccctattcccacccttgcttctagtggcagttgtatcctgtgactacttcgtatccatggaaagtgaatagaaatgatatggaccattcctggccaggacttttaagaaaaactttttttggttcctccaatgtcttattgatccctcctgatggtactgatggtaattctaatctgtgacttggggacaacaaagccacagagtagaaacagtcctactctcaggatccctgtgtgaagagagttcccactaactaggacactcatttgggattgtcacaggagtaagatacaacttccattggtttagacttatatttgtttcttttatagacctttagcccacaccaactaatatactatattatctctgatttaaaaaatttttttcttcattccaaccattcttgctctgtgtcttgaatctaacactcctcgagagaatccagttggctttgtattcatagatcaccgtctgatcaagtattcattctggcacagattttcctgccaatcgcctggtccttcttatgttcagctataggtgactgccttaagtttaatcacagatgcttggaattgattctggctatgataacagggtcaaatgccactgcccatgaaatagtgtctaagctactttttctggccactttcctgagaaaaagaatagccatccgtcccccattttccatggtaaagtcccaacttatgcctcttttttctagtgtaatcattaagactactccccttttactcttgaaagtgttgcagcttggaatataaattacatgagttccctattcagaagaggcacacctcatcacaaatatttctccagtgccaaacaaataaccatgtgcaaactccatttttatgtgcaatactgatattcaaatacttcaaatttaaaacacttcagtatttcttgaacttggtcccctcatttatccaacctcatttttttatgctgtctaatagattcattccttgtcacctagccagtcatcttatcctcttctttggaccttggatatttaatctatccaacatctattttcctttttctagtaatacccaccccctcctttcttgggcaaacacttatcaatgtgt

SEQ ID NO: 33934 - DNA, 1845 bp, Bovine  19866880656491
tggtaatatacttctacatttctcagcaattttctctaaatgttttatttcagttcagtcgctcagtcatgtctgacttattgcgaccccttgaactgcaacatgccaggcctccctgtccatcacaaacttccggagttcacccaaacttatgtccatcaagtcagtgatgccatccaaccatctcatcttctgttgtccccttctcctcctctcagtctttcccagcatcaaggccttttccaatgagtcaactctttgcatcaggtggccaaagtattggagtttcagcttcagcatcagtccttccaatgaacacccaggactgatctcctttcggatggactggttggatctccttgaagttcaagggactctcaagaatcttctccaactttacccaaaaaggaagtagcatgagtgactttataaaaatgatccttaaaccagtcctttatgtttcactgacaagaaaacatgtcagtgttttcaaggtatgattttagataacatgaaataagtgaaaactctgaaagccaagtcaaaacatcttattccttatgaacttcccctagtcatgactgctcccagcatttgagaagaggtgtaaattaggactacaacccaaagagttaaactcccagtagaaacatccatagatgccgcagcatgtgttgtagaggctggtttgaatcagcactgttagttttaaagaaagataaaaacagagtctttattgtcttgctttggttcaatattaaaagtgaggcattttcttcagcaattttccatctagttgcgacacaacagtactcatcatgggtgatggacaagtagatgattgagtagtttttgaggtaagaactgcttagtagaagagttgtggagcaaaccagccaataaatccatctataaaaaataatggacagtgatgacagagctataagcacagcaggaaacatttttagctccttttcctgtcatgggggtgcactttcctctgcattagcaagggttgggtcaacacctgcaatgtaatgcattttaaatctcaaatgcaagatcaccctgctcaaaagcaaaatgttcaatcagatttcctttcagtttagtggagccattgtgattgtgtggccacctaacaaaacacatgggctggacatcacaagaaaaaaataagccaaattatgacaaattcttaacatctgataataccaacctatttacatatagagataaagtgatctaatccaaatgacagaacctgacttctcccacaactacaaacatagaaaaagtgatcagtgggcacattttattcctaaatcctaatttcagtttcatttccaccataaggtttccaagttattatcaaagacaagtggaaaagagaatgggaatatagacaagtcctggctgaagctcaggctgttgggcaaaattggaaacttgaagagaagcctaaatttatgagatactaaaaatttccagagaaataactcaatctaagagatactaacaaatctcttttccttggagggcagagcaaagagtcattaagatggcccccatggatatatagctaagtggaatatctcataaataaaaaccaaaacttctgctttgctaagaactcaattagacacagaccacataagagttcctggtaccggttttatgtgtgacttcctcaaacagatttaaaacagttttgcattcagtatacagttaatgacagcagagagaaattgattttctcttttaatattgttttaaaaacaggctaacattatttaatttccattgtctgaatcaaacctggaattctggaagtagcttataaac

SEQ ID NO: 33935 - DNA, 1674 bp, Bovine  19866880687742
ctgcatctcttaacatctactgaattggcaagcagtgttttgtttgtttgtttgtttaccacaagcaccaatatctttaatgaattctaaattagaacattataaatatacagtttataaattatgtaaaaagcagtatgcataatgtcatctctttgggtgattgtaagatattccatatattatacctttggtaaaatgctgttgtctcactaatctatttttacaaaacaaagcatcaaaagcataatggcttaaaagaacacctctatttgtccatgattctgtgatttggcaattggattgggttcagctggtagttcttctgctaatctcacctaagccatgtattcatctgcagtcaactggtggctccagaaggacagatggtccaaaatattaatagccctacacattttgggcttctgaggttttgttggttgggtctctctttccagttgtatctcaccctcaaggagcttatctcaggcttgtttaccaggtttcagtatgttctaagatcgttccaacagaatctacaattactcttgaagtctggatccagaaatcaatttcaccactttcaccagcatttcaacagcatcaatttcaccactttctcttggtcaaagaatgtcctcaggggccaactcaaattaaaaaagagtggaaatagactttaccacttgatgaaaaaaagtgctagtagacacattacaaagaaatatgtgtgcagatgtaaaaatgatctgtggccatctcttgcaatggattacagatatttatgaatcatttattatcatttctatgctttctatacttgaatataatgtttaattcaataaattatcaatcctgaagaatacctagtcttataggactgaaaatttaggttatatgtgcatgtgttcccaaagatggggaatatttttgtcttttctcttcccatgtatgcaaagttaaaacaaatctcaaggctgttgttcattattttacctgtaaaaacctgcatattctttctagtgaaatggaaaaaaaaaattccaatgaaggctttaaattaaataaaactacaagttcaggttaaattacatcaattaattaagggtatcacattttctttaatttctaaaatatttgaagtaattccatgatgagaaatgatgtttataaaaggtgagctgtagttgaaacacatataaatgaagagattatgagtatcacttataggcacttataatttaatgacttccaactaattatcatattctgtgcccccagcaaacagcttatcttgctctccaaattgtttcttcctccctgttctttggacggtagtcactggagccacaggctaacagtggaagaatgttttaagaacaacatctgctcgcattgtaaaattagccctgtgttagtggctttttgcttttatttaaactttaattgtgaagaaatgagatgcatgtatagcatttgttgaaggaaatattttcttaaaagagtaaaaattgttagaatgtttatatacattaggttaaataaaatcagagaaccactgaaacatttctttccatgaatgttatacactgaaaagaattaaatcaaatttatatttttttctatgaagataacctatatgaagaaaatatgaattataaatatttctgatat

SEQ ID NO: 33936 - DNA, 2801 bp, Bovine  19866880734909
tattggtgtttcagcttcagcatcagtccttccagtgaatattctagactgatttcctttaggatggactggttggatctccttgcagtccaagggactctcaagagtcttctccaacgccaaggttcaaaaacaccaattcttcagtgctcagctttctttatagtccaactctcacatctgtacatgactactggaaaaaccatagctttgactagacagacctttgttggtaaagtctgtcactgtttccattgtttccccatctatttgccatgaagtgatgggactggatgccatgatcttagttttctgaatattgagttttaagctagctttttcactctccactttcacttttatcaagaggctctttagttcttcactttctgccataagggtggtgtcatctgcatatctgaggttattgatatttctcctggcaatctgagtccagcttgtgcttcatccagcccagcgtttctcatgatgtactctgcatataagttaaacaaacagggtgacaatatacaaccttgatgtactcctttactgatttggaaccagtctgttgttccatgtccagttctaactgttgcttcttgacctgcatacagatttctcaggaggcaggtcaggtgagaatgcaaaaagataggacactgatggtgtatacctagtacactttaacattctgtttgttttttttttaatttactttattattatgctataagtgtgcctctcattttaaaaacatacagctggattgttaaaaaatgtcagtatttgaattgcaacagataaatttaattcatttatatttactgtgattatcaacatatttacatcttttatttgattttattttgtactttcttattacccagctatcaccatgttttttactcctctttttctttgcaagcagggtttcttctctttcatttattgattttatttctcctttggattgcaaattatacattgtctatttttttagtgcatattcacattttcagtttccatatgtaacaaaggtgaagccacatctcaactctactcctgaacaattttaggaacttggaatgcttaactctgcttttcttccctcacatctttcatgacattaattttctgtattttaattctatgttgttatcctaatatatagactaatcactaacttactgtttcatgtcataaatatgtaccatatattaccaaaattttttctcattattctctgctatatcacagtacaccttttgaggttcaatttccatgttcctaagatgaagcttttagaacatcctttagtgaatgtgatggtaccaaacactgttataattagaaaacaggtttactttgccttcattctttagtaatagtcatggcagagattttttaaattttattttatattggagtacatttgattcacaatgctgtgttagttttaggtgtgcaacaaagtgaatcagttaaagattctggtttcaaaagcagggatgtctctaactggacacacacacaaagttctaatgatttctataagttatgacttttcctgagaacttcaggctccttatggcatgagacaggagggcaacaggaggactcaccattctggcaaggataactgacctgggttatcagcctgatgttacacaagagggacagggaggaaaatgtttggctccagctgattcacttcagtaccttttgctatttccttgctcaactttgacagtaaatggactaaggtagaaaaacagcctaaaaagggtaagctcagatcccacaggaatgagtgtcacagtcacatcatctagtaagccacctagacaaagagaatcagctgaggatagaaaaaaactagaatgtatcaatagtataccttgtacactttgtagtatatagagttggtgaagaacagggaagcctagtgtgctgcagtccatggggtcgcaaagagtcagacatgaccgagcgagtgaactgaactgatcaatagtatagaaggaagatttgtgcataattcgtgatcctgaaaccagctgtaccagtggggctgtagtttgacccattaacctttctcttctgtgttttcctaaggaaaataggtacaccagcatcctagaagatttgctccaaaaatttatacatatgattgtacctaacaggcacatatttcctttcagagctcaaagactaattctcccagctgtcagctcatccttctggctgtatgggccctctgggagctgcccacagctggagagatctggtttgtccaaaataaacacttcttcctgggaaagtctgccttcagttgacaggtcagtatgagactacaaagactcagtcctcttcgttgcaactctgagggttgtctcagcttcagagctcctcaccttggctagctgaggcctttgctgagacagcctccaaacccaggccctcccttggctgttaatcctgcaagcaccccctgatgcactctccatctcagagtctcctttctggggtaatcaacaccttcaagtgcccttcactcttcaaatatgtatgtccctccaggaggaccaacatgttttctgttttacaaaaatttgccttactgatctcttagttcaaaacctctgctaagtgtatctgccttcaatgcttcccatttgttcaatgccaaccctatttacaatgcacaaaatcttaatccacattgacattccactgccttttgtctgcaagactatgctccttatcccactaagtcatatagtttacatttccctgta

SEQ ID NO: 33937 - DNA, 1860 bp, Bovine  19866880800641
tgtacaatgttgtaacttcgggaagggaggtatcaatctaaaccacaacaaacaataaagataccaagacagaggtgactcataaatggtatatatttgatgtacagtctcagaaaacaagaaacactatttaaaatagcagaagtataaaagctccaaggcagagatgattttaaaaatatctaaaagaggatattgatatgactattttgaggtagtgatgaaagaaaaggatgaatacataagacattagaaaggcatgatgcaatgtagtaattacatgaagcaaagaaaatagtgttatttccatcataattcttatttcatctttataatggttttcaaatttagcgtaactcactagtgttaatagccaatatgtcattggagtatccataataaaatctggttaaaaccccaaaacctgtcttaagaagctatgatcttaggcagcaaagcctagaaggtccactaaagttctattcttcatctctgacatctagactcaggagtgatgaagaaaaccctgttcttacaaaccattcaagttagggtacaaaaataaaggtaaacacatatgtgccactaacattgcacatatattcattcataggtaaaaagacatatccttgccatcaaggatgtcacaattgtgaagaagagacaaacataatggtaaagctttctgaatataagagacacgtactattttagtaatagaactgtgtataaaacatgataacatactcttcctaggaatatttataaaatactacagtggaaaaggtgatttctaatttaaacaaagaataaaattttgcaagatctactgatactgaaagagtatgcgaagcaagataaatgacatgggcaaaggcaggaatacacgcaacatctataatgttagggtaaccataggtattttttttttatcattggagcctgtaaaacaaaccaaaccaaaacaaaacaggagtattcttgcctggagaatcccagggacggtggagcctggcgggctgccatctacggggtcgcacagagtcggacacgactgaagcgacttagcagtagcagcagcagtgctaagaagtagaagagaggcaaatcattagttatagctttgttctgttggacatggagaaccactgaagtgttgaacctaggaagaaacataatcagattactctgcctgcattaaagaaaacagactaaatatagtctagtctagaggcaggaaattcaggaggccattgcaagaatccaagtgtaagatgaatgagggattggatcaaggcataatggtaggtatagagaggaaaatatgtatctgagagatttttaggaaaaaagatttacaagacttgcttaatttactactactaataatgaggatggtaatgatcataacaatcattgttgttcattcactaagtcatgccctactgtttgcaactatatggtctgcaccacatcaggctcctctgtcctctactatctcccagggtttgttcaaattcatttccaataggtcagtgatgctatccaaccaccccatcctctgccattcccttctcctttcgccttcaatctttttcagcattggtcttttctaatgagttggctctttccatcaagcagccaaaatattggagcttcagctttagcatccatccttccaatgaatagttagtgctgatttcctttaagattaactggtttgatctcctttcaacccaaggtacgctcaagagtcttctcccaaattgaggcacaatttgaaagcctcaattctttggtggtcagtcttctttaaagtccaactctcacatctgtacacgactactggaaaaaccatag

SEQ ID NO: 33938 - DNA, 951 bp, Bovine  19866880862109
tctcttttaaaaatatcatctagctattttctcttcattagtttttatagatattgtttgtttattaattcttatgttaaaattaaaaatttacagctacctgtgaattttggggtatggccaataatttagaatccaatcactaggaaaagctgcagcatctgatagtgatctggtctcagatttgaggagataattctatccaaaattctttttctgcattaggattttaaagtaaccccttcaaaccaaaatgtctatgttctattttgagagcttgaaactaaccacacccatgcttagactgtattcttagaccatatgtaactccctctcttccttctgctctttgttgatacctggtattatttgtgcatattcctgaatcttcttaaaagtatagaaaatatttcttatcctacccaattgctagcatagtattttgtatgaagtagatgctgaatccatttgattaaatacattacgggcaatttgtgaaatgaatagaattaacattacactatttctactaaaatttataatgcttcagcatgttgccaaatggccacgtctattcttcattgatttcctgtcaataattaaacacatattttattgttccattttacttaattgttcagaatttcccatttcagccataatttattacttgttctatgttatttagtcctgctttctgattctaaatgaccacaatatcattttacagatataattcatattagatagaaagcttaatatagcttctcaacatttgatcacttcataatgtcatgtttttggattaatggtagactgtatcctatttcactaagttaaaatgaggatctaataaaaattatagtgtctagtaagtataattttattaaaataattgagagaatatatatctagaagtcacattccccttaatggtcactgtaggaatgt

SEQ ID NO: 33939 - DNA, 1664 bp, Bovine  19866880905815
tacttatactaaaaaaaaagttcccatacaagaagaaaaattaactatgtgaggtgattgatgccagtgaatttactgtgataaacattttgcaatatatacatgtatcaaagtatgttgtgcatattggcttaatataatgttaaatgtcattacctcagttaagacagggaaaaaaaagtctttgacatactaagcccatcagtggatctccttgaaattaaagatcgtaacttttcatttctgaatatctcttttaatcaataaactcctctagaatacttcttttccttctgagtgacctgttatccctcttaacccaagtctcagtttatagctggagaaggaaatggcagcccactccagtattcttgcctggagaatcctgtggacagaggagcctggtgggctgctgtccatagggtcgcacagagttggacacaactgaagtgacttagcatgcatgcatgcatgccttggagaagtaaatggcaacccactccagtgtttttgcctggagaatcccagggatggggggcctggtgggctgctgtctatggggttgcacaaagtcgggcacgattgaaataatgtagcagcggcagcagcagtttacagcgttacatctagattggagttgaagctggagatttccctgaaattatatatttcatcagagttataatggttataaatagaaacagaagcaaaatcattgaaaaatgtaacagaacccaagtaaagttttgacttgtagtccattctaatgtgtagaagagctaaacttggagaaacttttcatttcttattatgtgaaatagttactaggtctcatatagatatcacagaactacaatgaagacacatgaaagccaagaatccaatgaatagtccctagtcatgcccagctataataaaaactatggttttccctcctgaaggattattctgggtcttttgcaaatttaaaaagtgctcagtatagtgtgtgcctcttcatttgtgctccataaatattatgtgtcattaaacttattattgggtgtctgtagtatgtcatcaaatgctttatctgaacatatgataataattcttgaatcattgttctgagttactcagtttcaaacacagataacctcagtcaaatctttatatgagccatcatcctataacagaaagtcaccctacatattttgccttaaagttaatagaaaatggagaaggaaatggcaacttcctccagtattctcgcctggaggattccatggacagaggagccaggtgggctacagtccatgggtttgcaaagaatcggaaatgacttagcgactaaacaacaccctatccattttgccttaaagttactagaaaaagtcaccttcttgaaagataattcttgagctcaactttattcagtgtttccatctggatctatactattttatttgcctccttaagacttatatgctatgataagcaaaccatgaggtaaatttaaatttaataattatgctctattttctttaaaaagcaaaacatgtacacatgtatacctgtggcagattcattttgatatttggcaaaactaatacaattatgtaaagtttaaaaataaaataaaattagaaaaaaaaataaataaaaagcaaaacataacttgttta

SEQ ID NO: 33940 - DNA, 1685 bp, Bovine  19866880906004
cctgccctgtgcccacgtgtctattctctaccagtgagtctctaaattattagagccaccatggagaagagtactgaggttcctttaaaaaaactaaaaagagaactaccatatgctccagcaatcccactgctgggcatatcccttgagaaaatcttaattcagaaactatagatgtttttttaaacttcatgtttagactaaactttaccaaaacagaacattttctttttgactgttacatctctagccttcagaacagtacccagaacacagcagttattaaaagctgaaatatgtgctgtaattaaaataaatagtattctctggtaagacaaaaaagtaaaaagcataaagagatgttatagtttctgagtaagtattacacatttaaaagtatacagtgtaagtttgtattaaaatcatattgacctttaattggtgactttttatcccttctttaattaaaaaattggctatcacattttaatcaatactctatcatatccatggagaatgctataaccaatataatatttttacaaggcatttttgcctgcttctttgaaatcagacctctaaatatatgatcttaacaaaatttatagcccgattatgatccgatttagaaactaaaatatacagttttatgtttctaacacaagcttattgagttagaaagattaatatgatgagagaaaagctcccaaaattttagggacagtggttctgcatttgcaggttattataataatcaaaatatggtaaatgccagttgcttcttatgtgcttaatctgatgatatattcatgttactatgatgtctttatgaagctaagtactgagtatcagattaaatgtcttagcaggctcaaaaaccaaagtcagaacccttaatttaagtttgaattaatccaggttgccatttgcgtgctttttgataatagtccacccaaaatgacatgagtatagagatttttatctcaaaatgatatccctgccagcaccaccaactgttgaatgttaaatatgagattaggcaggtgcagagatttttagttacctacaaaaagcagtatgtagacacccaagccaaacagctcatacactaacaaaaatcaacatccaaaccatctgcccatggagcaaacatgccagtcatttttccatttgactggcagtatttctagaaatggatgattttaaacattatttctgacccagaaaaaaaaaaaaaaaaaaacaaaacaacccaccaccaccaccaccagcaccaccacagagctttagttttatttacctggcaattgagctgattctaggcaaagttatgaggttaaaaaaaagtcttcaggttgtggcccttgctctttcatttgcctgcctccccattaccagtttatacttacatgctcatcctagcatttattaactcttgctggctgcctaccagtgactaggatgagctgatgcttacatctgatttatttcctcttaggcaagacatgttttttaggactttacttataggtgattacctgtagtaattaaatcagatctaatcaattcttgatgattagactacctattaagttataattcctaggttaaaaatgacttatctttataaaatatgcttcctcctccccattaaaaatctttaaagactaagttaaattcttaaa

SEQ ID NO: 33941 - DNA, 1596 bp, Bovine  19866880964026
tatttgtaagaagttacatcccccatcttccttatcaagaaactgagaaatattttgatcaaatacaaagcgttatatatcatacatagaaaaagatactgtttaaaactgtcatttatatgtgaaaagtacaaggagatttacttctctctcttctctctctcttctctttcaagtgtaaatgttttattcttgcaaggggaaaatattgcaataattgatggtggttgcgacacttgctattttatatacaaaaataattagtaaatttcaaatagggaagtagatagtttatatgaatattaaacagtgtatttgctagaaaagtttaagaaggcctctttcctttttgggactgacagacattacatgatagtagaacttaaatgtagagatgtttagaactcataatattaaagaaaataacctttaaaaactgtatttagtttttaaccatgtaattccatttaagacacaagtctctcaggaggagtctcacttgggaattcttcagttttcattaaaataagttaaaataattcagattgtcaactttgacaccttaaaattacataaaaagagaaaatgctaaaaccatgtatatcttctccctccataattttacctatttttcataaaataatacccattaaagttttccaatctttcttttgtcttaaaatgggtgcttaaaactaattttacacctcaaggatgtttaaaataataaagcagttactaaagcaacagaagtttttctaagccagcactttttaaatataacttccaataaacaggaatataaaagaaacactacttttacagggtgaatactattatcacctttttcccaagtaaattataatttttttttacattttattgacagcgctactcaaaatgacatatatttcagattcatgcttattaagttcaagctacttcataagagtcaattatgagaaaaccagtgttttccaggagacaaaatagtctatcttacaagattttaagaccgttgatacaggaggtagccagaaggtggtctattgcagtctttagggggaaaatatgaatctgggcaagtcaggactagtctaagaccaccaagagtagttcactggtggtcctctttacataaaaatcaaggactattcctgatgtataatcactgtacaaactgatatggatatacgaggtccaacattcttaaccaatattgaggaaataatttaatagctctctccataaaatatgtggtgagctgagagctcactctgaaggaagagagtgtttagggtaccctagcttttttaagcaactttgaacataggtggcattactttatacaagtggctattaatttataagatccattaatatttctatcttccaacttctagaacaaagaaagatgctatggaagaaaaagaaagatcaaggcaaataacaaaatttgggactctgaaaatctttgggtgaaaagatatattattttgtagttatacctcctgttctttaagagaactattgaacggaacagaacaaggaatatcaaggctctaggaagactaggtcaacatcaagtcagaatcg

SEQ ID NO: 33942 - DNA, 3576 bp, Bovine  19866880982327
ctgaaatctatttatatgcaattagctatccttattagtatgagaagaaacttgtgcataaagggagaaataaattatcactagaagccattaatgaaatctatttcaaaacataacattttacaagagtcctcattcacgtaatatttgtttaagccttgaggggaaatggtgagttctacgcttaggtgaaacccaatactacattatttctcatgccggtgggttttataaaattcatctatcctcttcttagaaatgactagataattttaactccaatgagtctttttagggaaccttatcactgaaataagggtcctatgtatttgtcacataattgccagacttcttaggagaatttatttttactcttaacaatataagagtattaacagggaataactgttattccctgaggtttacaaacattaacattcagttttatactctaatagcaataacatagaaataaatgagctttaataaggaacataagtcttactgcaataagttgaacttctatggaaaagactaaaataagcaacaatcaataatcaatagagactataaattaatttcataagctctgcagattttctctttgggtttctcattttgttcttgagctcataaattccttggttagtccatatctgagtctccatcagttttaaacactgcagatattcttccctctctcatctgcttaactttgccttggctactcaatattgaactgaaatatttagtttttgatatattcaagctcataccatttttttttttttttgcctttggttctttaaagtttttattaagaaatctttctgcacttttttaggttgcagtggtgttcccagtattttcttctactaactttgaagtttcagcattttatgtctttaattcacctggattccatcactgaatgtagtattttgtctgcccattttcctagtgtgtgctactaaaattttcctttatccattgatttgtgatggcaagtttataataaattgtcttcatatgtacatagatctatctctgagctttttctttgtttccttattcatttatcttacttattgccaaaaccacaatgtttttattaatatagttctataatacatctcaataaataatatagggatttctcctattcctttactcttttttaaaattattcatgtacctttactttttacatacattttagtgtgtttatcaatgtcttccaaaattcatactagactttacatttgtaaattacagtggggttacatttataaattaaaagaggaaaaattaatatcttcattatagaaggaaatcctattcaagggactagaattggctcttcatttattcagaccaatatgtctgtccattgttagaattttaaaattctatttatggaaaactggccttcttagttaattcctagaaattttattccttttaatatatgaccactgctgatacagagaaatattactcatcattacaccattcttatatctagcaagtgtgcttaattttattagttctaagaaaatagcaacccactccagtgttcttgcctggagaatcccagggacgggggagcctggtgggctgctgtctatggggtcacagagttagacacgactgaagcgacgcagcagcagcagcagcttcttgatttaaaaaaattttttgcaacaatgctataatctgaaactgaagactgttttctcacttttccttcaatactgccatttcctctgcattcttaggtattctatccttaggtaatagtgtatggactacctactttattaagaaggtatggtaatagtggatagctctgtcttcctgcgtttaagaataatatttagtataagttttaggtttattatatataggcttccctggtggctcagactgtaaagaatctgcctgcaatgcaggagacccacgtttgatccctgagtctggaagatctactggagaagggaatcgcaacccactccagtattcttgcctgaaaaattccatggacagaggagcctggcaggctacagtatatggggttgcaaagagttggacatgactgagccactaatacttttaagatactgcttccgcagctctttattaaagtactttttaaacagtattgtacagaaaaatgagaacatcttagactgcactacaaccggaactgctcttatctttgctcctgttaatttacctttgcccttggatgactaagtaatttaacatgcagtgttcttctggccatcaccctctatgatccttgtgctggcatttcagagacaagaccacatagaattggaatgaggcaggacagtaggaagaagctggctggcctcctcatccatcctaaagcaaacctcactcttcaacaaactcccgcctctgtcaaacaagacagagttgcacatcagatctgttgtacaaagagagaagagaatagtacctcttctattggtatacccaaagagtactgaaatagagaaagaatcttcttttaaatatgtgaacagataccaaagatcatttggaatatatgaagagtttatttcacatataaagtgttctctggtcaaataaatttggggaaagttggattaagaaagattaaaaccgatttatttattgcagatcataggagagtctgtgatattctaactcagacataacgaaggatcaacacaatgtgtgcgtctcctatcaagcttcatcacatactccccttttgtcccttgatcttatagcatcaatatttatggaacatactttagcaaattttaatttccaaataaccaacttagttacccaatttctagtgtcacttttcaatatactgaattctgaaactgccatttaaaatttagccatggtgctggttagaaagcacagatgataggagagacaaaattacaataaagacatttatccactgatattaaaaaactcaaagtaaattatcattaaatagttcacatttttaaaagccatttacataatatttagttttgaatgttatggaactgtcctcctcagtctgcataatcagtctttagcaatgcatgctattatctgacagacaatagctttgtcagtttcagcatggagtatcttgagataaacataaagtacgaaccaaagatttacatcaacagtgaatggtattctctaataattgtccacagctgcaagaaatttattcatttttattcttttcaacctctctatcctctaatttaaaaacatatcttagaagcatagtggctatagtcagaaatttgtacaataaaattattatatggcacagtaaaacaaatatgggtattcagagaaatgaaataatttgaaggcatgaagtttatttataaatgttggtttaaaaaccttccattccattgatgacatttttacttttattattattttaaaaatttcatgggaggccaaagaaagtcacttaaatagaaattgtttcattttaggttaaacaaatttagtaatgtagaagtatttttctatttgatgtatttacttcctttt

SEQ ID NO: 33943 - DNA, 749 bp, Bovine  19866880995910
tacttatgtaaagtgaactttgttttaatttatagttaacttggcagactgtatttttacatggatataacaaatgtggaagctttcccataggggtgcattatatatttctttttagaagacaaactaatccgctgaaataaaaattttcacagcataacagtgagaacagtagctgtctaattaaatctccccctaggtgacagatatcagatgaaaacattgaggttggctccagataacatctagtccactctttctctaattttcatttctcttactttaaacaaagagggaagtgggagcacttatttgtggaagtttaaagagagctgtaaaagtggccactagtaacaaatgaaatatactccatagaatgaagtagaatgtatagaaacagcaagtgcctgctgtttcaatattcaaatatgttaatagactgaaaccaagcaaaaatatattgcgttggccaaaaagttccttccatgttttagtaaaagacacatttttcattttcatcaagaactttattgaacaatgcattggccattttatttcactatcttctgccatttttaaggcaacttcataattccatcttcccaaaacttatctttttgaataaagaactcttctagggcttttacagtcttccagggaattggcggggtttttttttttttttccatagagactgttataaatctaaataaagaaaatggaaggtgcaataccagcttcccatgggg

SEQ ID NO: 33944 - DNA, 758 bp, Bovine  19866881016733
tttcttgggagataggtttcagaatgaaaatagttaatgttctggtttctgagcatctcccagtaatttatgttgtccagacagatttacagagttctttctcccggttgtgacccctgctcacacaaaataaaatgaggaaaattcaagtttaaaatattacaaaaagaaaagtaacttttaaaaattttcatctctacataaaaaaaaataatttaatataatgaatgcctagtaatgttaatcaacttcctgaaaatcatcaggctaaaataattattttccctatattatcattctggccttcttgtgactgaaaccctacaaataaatgatgtggcatttccttcattaaaatgactttttttttttttttttttaccatttctgtgaaacatacattaagttgttttggaagtcaccagtaataaccttgccctttagacctcagcttgcagagataatgagttggggtttgctgaaaatttcatctttgctttaggtcagggtattgaatgacccaccccagtaaaacatactggtatttctttattctaatcacaattgggaagtaaaatgtcattagctgactgactggagaactctagatggttaattgaagtataattcatcaattggaaagctttgttgcttttctagatctttcaagtcaggcagaacagaatagtcagaaaaagttcccagcagttcttccgtaggaagctcatttagcccttaataaatgctatttctataaa

SEQ ID NO: 33945 - DNA, 2235 bp, Bovine  19866881104678
tttttaccctaacctaatgttttattgttaccttccagattatgcagtatatttcatataaccaaggcagtgcagtaattctctggtttaagctttttcatgcaacaaagcttacttttttttttttcttttttttgttctagcagccaggaaacatttgactgaaaaacaaatcacaatcttttgagactaggtgcatgctgtgtaattttgagttcagcatgtgtcttggggaggtgtgtttaataatttttttttcctgaggcagttttattttgtctgcctggagatacaaagacattctgttcaactgttaaagctctgtattagtataagcaacagctttaaaatcaagaaaaaaattgcaaattatttttagatttctgtttacaatatattctgattgagaacactttcctccttttggggcatacaagtagggtttggaagacattttcatatttagggtaataaaagtagaaaatgacagtactgaaaaaaattgcctttataaatatttgtcatgtataaaacacatttggtccctttctgattttttaacatatatatatgtaaatcattttcaagtatttatttaatgtgttcatgaagtcttcagagagaatacaaaatagttctcttgtctcttaagagtgaaacttaaaaaaagaccttgcaagtattcaggctcatgtggacaatagctacttattgatataaattacttcatctttttttttaaccaaactcctcagatagaattcaatgaaatttgaaattttgttccttatattgttcccttggttttttttttttttttgtcctaaacaacttttttctcaaacatttaatgtatatagctttattgctgggagtgagtttctttgaacattgtaaatacaaaaaatatatagtttttacctacatttacattgtttttgaaatataaattattctcttgaaactgactccatttctgtcactccaaggaatgagataggattgtgtatcaggttttacgccatagtttagaactaaaaaaaaaaaaaaaaatgctggcagaaagtgtagagtctgcccttctaggtgaaaacacagtacagttgtaaaagatgtcctatttccctgcacagaggcagaggtgctgccacagtgcctaacacactctaacaacgtattagaatgctttagtaagacatgtacaaagtttcagataaataacatcaaatgtgacttcagttacataacaaatcactgtccataggcattagtttctataaaaatcccccaggcagtaatgtgttaacagacataaacagaaaaatcaacagtaacacaataatagtagggtacttgaatactccatttacatcattgggcagattatccagatagaaaatcaataaggaaacacaagtcttcagtgacacattagaccaaataaatttaataatatataaaacattcaacctgaaagattcagactatgtgcacattcttttcatgtacacatggaacattctctgagatagattacattctagaccacaaaacaagcctcaatatgtcaagtatctcttctgaacacaatgttgtaagactagaaattaactgtaaggataaaactgcaaacacacaaatatatggaggctaaaaagtatgctactaaaccaccaatggatcactgaataaataagataggaatacaaaaaatatctagatacaaaaatgattgtccaaaacctatgggacacaggaaaagcaattctaagagggaagtttctagcaatacaagattacctctgaaaacaatagaaaaaaaaaatcaaataaacctaacttatccctaaagcaactagagaaaggagacaaaacccaaagttagtagaaggtaagaagtcataaagatcagagcagaaataaatgaaattgactaaaaaagatagaaaagaaactaaaatctgattctttgaaaagataaaattgataaaatatttagccagactcaagaaaaaaaggagagggtctaaatcaatcaatcagaaatgaaaaaggagaacttataactgaaatcacggaaacacaaatgattttaagacactactacaaaccgcaatatgccaatagaatggacaaccaggaagaaatgggcaaactcttggaaaggtgcagacagaaccaggaaaaaacagaaaatataaatgggccaattaaaagtactaaaattgaatttgt

SEQ ID NO: 33946 - DNA, 2991 bp, Bovine  19866881125032
ctggagtgggttgccatttccttctccgtgcatgaaagtgaaaagaggtagtgaagtcgctcagtcgtgtccgactcatagtaaccccatagactgcagcccaccaggctcctccgtccatgggattttccaggcaagagtactggagtggagtaccattgccttctccaatatgtatttactacatataatattatgtgaaacagctaaaaaaaaaatacctctctgcttcttctctgtccctttacctatcaaccacatatctgctgctgctgctgctgctaagtcgcttcagtcgtgtctgactctgtgcgaccccatagatggcagcccaccaggctcccctgtccctgggattctccaggcaagaacactggagtgggttgccatttccttctgcaatgcatgaaagtgaaaagtgaaagtgaactcgcttagtcgtgtccaactctatgcaaccccatggactgcagcctaccaggctcctccatccatgggattttccatgcaagagtactggagtggggtgccatcgccttctctgaaccacatatctaaatctccccaaaataaaatagtaatataatgtattttatttcaattggaattggagctactcatccagtgaagggctgtgaatttcaaaaactgttattctccaaaaggaaaaaagaaaattgttcttattagatttctatcttaaagacaaaaggaaacttatagtgaaattacctcttaagaatcacacatataaactcctcactgtaaaagacaaattcacaaaacaagtacacacaaagtctttggcatgcagtttataaagttttatggctttgtccttattcttagaaggtaactttgatgcctttagcaaatattagtggtctggtcccattaggatgtgatggcaagacaacagaattaaatttcaatctataaagcagaatatttttattttattagcaggtaaattctactaatggaatacattcagtcttctaaacatggaaagatatttcatttcatttaaaagattgcagtaagagttaatgagaaagcataattatctgatcctgtgtttatattcttttccttttatcttcattggtagcttctcacatcttattcttcaggatagatgctaatttgcctaacttttattataacccaaatacaccataaataaacagagtatacaataaggagagctgtttattcctttctctaagtcattcagtttccttctgttacaggcagcaaagtcaagccaaataagtcttgggatgtactatgaattcatcacacaaagcacacattaaggcttataagctagaactgtattaacattttagtcactaaacctgcttaattaaatgcaattgtattttcctcacattatagccattgcgcactaaccacattgcctttcctgtcctagaaaggaaaccttcattccagtgtaagtttagaatttcaaacattatctttgagatgaattagatcatcttcctttaccaaggaaagaaataaggaatatcagtatgtttatttggtagtagtgccagactaaaatttgatacaagatattgagggactttctataaatcacttaatgaataaattaccatgtaaatactactgtctgtcagttttgtattattttcctgtaaagtgaaagatatactcaggaatagtcaagtcaaactagtcatacaagaaatatagttttaataattagacaataaaaatgtgaatttgcaaatttaagtactttagatttcactaggatctaggtcaggctattacatatgtatttaatatgcagacattgtacattggagaaatacaaaggtaattcagaaatgcaattaaatgcaaaataagaactgaaacatacatataaattgcattttatggtattagaggaaggaaagaactatcttcttcctgtagatctaaaaagacatcattgaaggagtaatacattacctacacttttgaggatggttacaatttgtgcaggaagagaaaatgttagttaagatttaaggaaccccataagctgtgacacagacataagaaggagaaaggagtctgattgaatttaacagaagtaaaaacttcaagatgggaagtactagaaagaaattttttaaaaagtagttggaaggaaatcattaaacgtcagacagagtctaaactctttttgtagaggataaggagccgttagaggtttttgaatagtgaacagaaggggtactgagcctatatctttcatttcacatgttgtacattttaacctcttttcaaatctgtgctgatcaatcataatttctcataatcatggtcaaaaccacaatatgggcttgaaccagcctttcagttagctctctttagcctagataatacatttaggacaggaatatgattgaagagtagaccttgacagctgtgtccttaaccagtatctcctgatctatgctggcaaaagtgaagtgttatatatgcattcaagactaaagggttctatagcttatttgacggtgatggagcatggctacatggtacagtgtgcttaaggcaacttttagcaatacaattcttggctttagtatgaggagctatttcttcagtggactatcagttgtcagtcttgtttcctttaaaaaaatggtaattatattattgctctgaataaggcagaaacacagttatatcagtacttattatattactattcaggttgtctttatatcctggaaatatatcaattgtgtgcaatacaaattattctatttctctgacaggacaggtcataaatgaaacatactgctattcacagtgtgcactggttgcttacagttccatttgtggaaaaaagtatgcctctctctgtgacaacttcacagatttattcaggaagcactttagttcaagtggaaaagttgcaggcacgcccaccaggattttaggatctcctttcattgtacg

SEQ ID NO: 33947 - DNA, 861 bp, Bovine  19866881150963
ctctttcactaagcttcaatcatcaaacccccacttggaagtctagtgggcatttcaaaatttacatatccaaagccaaacttctggcttgactcatctcttcctcaccttcatgtaatcggtcagaaacccctattgaccctcctttcagaatatatatgaatttcaactgctctaaaacttctggcactaccactgtcatcaacttttctctgaatgatggatgtaacttcctaacgggtctccttgcgtgtctgcttgctccttctagcatttattctcaagactgtagtcagactgtgctaattaaaatataaattagactaaatctcccatctgttcaaaacactccatgctttacttttcattctatgtaaaagcgaaaatacttaacttagagtgatataaggtcctatgcaatatacctgcctctagctccaacccaactgctcttttttctcatcccctactaacctccaccgggttcactccatgtgagtggcactgtctttctggctgttcctcaggcctgcctttgtacctgctatctctgatgccttgaatctcaacatcacctgtccagtggttcattctcaattccttccagtctttcctcatttatcaccttctcacagaggacttccctgattactgtattaattgggaacccttctcccccaaggacttctccatgtctcttctttaatgtttaatcacattttaatacgctatagacatatttgagttttgattttaataactctctaaataatgtaaacttcataaaactaaatatttttatctgatttggttactgccatttcttcagtacctggaagcagtactgaatagatcctcaag

SEQ ID NO: 33948 - DNA, 1001 bp, Bovine  19866881155379
atattaaaatgtgaaaaatgtgtttcttagaagtaataaaatacagtaattcatacgaagtactaaatacagtgcctgacacacatatttaataaaatattagagtagtagtattgaaagataaaaaacacacgttggatgtatatttgattttcctgtctgtaaactgtaaactttagtttggtatgtatgtgaaaaatctaggtttgtcaaccagaaccatgtagtttaagttattcactctggcatagctttgtttttgagttgctgagatggttggtagaaaagagacccatgcatgccatttgtcatccagcttataaaggagattttaaattgtcttgttaaacctcaacaggttcaatatcttattgataatcctgccagaatcagggcgatatcccttaatacgaagtcctcaaagaatagcgttttcctgagtatactacagactgtgtagaaaacaaaattgatgtatgtataaataactctgtcctttaaacattttgttatgaaatataaaaaaggaaagccattttaaaaaacatttggctaattacagaatgtctgtcagtatgtctatgaaaaaacccttcaagatgctttatattatgctctatttgctatcctatataaagtttcaaaaatgcacaactctccagttcagtgcattaatttagctcacgtaggttaacatcctagtttaaataaatgtgttagcagagaaaaattaccttctaatttcacttttataaaaattttgctgcactagatgtcatactaaaatattttttatgtttttagaattctgaactgaacgggcctatgcaatgaatctcgaagggatgaaactttaacctctacaatatccacatactgtgtgcatgtagagataaagagaatgatctttctttttgtaaagataccagcactatggttatctttggccccaccctaatgacttcatttaatcttggttcctaatgcttctatctccaaat

SEQ ID NO: 33949 - DNA, 797 bp, Bovine  19866881189291
ctataagttaaagcgactccaagtgcctcctgaggaaatttgggaccaacccttcccaacaggcattttctaagtagaaatggggtatcattatcccagctccttcaaaggcccctcctctttccttagaaatgctggtctactcccaggccacagaacaataaagtgtgcaaccctgatcttcatcaataacacaaagcacttgcattccaagcatttgttagggaatccaactacaaattactgctgctcagtagccatcaaaacttcagttaagagaataatatctggaaaaatttctgaagtgtaactgaatccacataaaggaatcattaaaatcaacccatgggttagggctgaaaaacagagaaatgcacacccagacaaccaaacattgtcctccacagaaatatttctagtcaattatgctttccccttggcattgtaccctgggcctgcgctgcaggactcagtaataaacagttccataaaactactttgatgtagttactgcaacaatttcttgaggatactgttcactgtgtcacagtatccctttttatgaggactcaaaggagaagtttgtctctggattcagtgccaggaatcactgctgcttctaggcaacaggtgagcttcttttttattggcactaggcaacatgtttcctctaatgccctctttcctttgactgcttcagaactcaagagtcaggtgtgtggctggctgcaagcaagttagatgcctttatggcattctgaatgatctcatatttttttctttgctttccttctccc

SEQ ID NO: 33950 - DNA, 702 bp, Bovine  19866881217492
atatcatttcctatgtttgatgaatatcccaggcaaaacctgataatgctttatttttaaaaaatattttattaaaatagatattttgtcttgggtttcaaattgtcttgccttctgggtatagataaagctgccactgaatttgattttgtgtattgtgcttaaaaggaaacaaacacacagttttaaaatttcagccaggatatatgtaaagaaggaagtgaattacgcctgcaaagagtagaggagttaaacagtctcaaattgatgcattaaaattaacttcatctagtatcacaatcagggcccagggaaaatctatggtatctactctgtgggcaagaaagagctgtgtcatactttaaaggaagatcattgatcctgtatttttctcaatcttgaaacacatattaaagtacaaaaaggagaaaaggaagctggtctgattatttcccctgagatagggagtagaaaggtctggacctaataggcaggtcattttggaaaagctatgactatatcaatttcaaagtagtatgaatggatgctcaaccttgagtagcttgagcaaaacactgcagaacttgtggatgcccagagagcacacagagaagacaaaatgagcaaggcttttcaatacaggtagctcatacatttccccttaggtttgtttttcttttctctgcagctgaaggctgaaag

SEQ ID NO: 33951 - DNA, 1422 bp, Bovine  19866881280776
tttgcctctaaatgagtataggaattttttaaaaaatcaagtcaggtaatctcttcattttttaagcttcagttcagaattttccacagtttattgtgatccacacaatcaaaggctttggcatagtcaataaaggagaaatagatgtttttctggaactcttttgctttttcgatgatccagcagatgtttttaagcttagaaaaacataaaatcatgaaatctttatctgggtatgacaggcagaccctaaggtaaccccagtgatctccgctatctggcattcatgcctgtcagatccccacccctagagtgtggttgggacctgtgacttgtttataactaatagaatgcaagaaaggtaatagaatggcactcctgagattatttcacatggtgtttagtcttactgggcttcccaggtggcgctactggtaaagaacctgcctactaatgcaggaaacataagacatgcggattcgatccctggatggggaagatcctctggagaagggaatgacaacagactccagtattcttgccctaagactcccatgaacagaggagcctggcaggctacagttcatagggttgcaaagagtcggacaagactgaagcgacttggcatggaggcaagtcttgctagtcaaattgcttcagagcttttctttgctggcttgatgaagtaaacagctatgctgagaaagcccacctggcaagcaatcactggtgtttgatttgtagcacctgagggcaacctcagttgagagttgacagccaagaacaagtcagggcctttggacttacagccccaagtaaatgaattctgattggatgtgcttaagagaagatatattcccagctgagccagatgaaaatgcagttcataaacttgtttgcaaccctgctacatcttgagcagagaacccagtcctgtatcaggatgccagaccaacagaaactaagaggtaataaatatgtgttcttttacccactaggtacataggaacttgttgtggagaatataaaactaatgccctggatgagaagcaagattggcaggaatatttcagaaaggaaaatgacatctctattttaattcacttgcatctgaaccatatctgtgtgcactatcaatccttgaaatatagactctagacttctgaaattacgtcagtgatctcgaccttgaggcttagagcaaatcccagaatgaacagtgctttagagttccatcatgtcaagtggagaagaagttttgctttctctcaagttaaagtattttttattcttgcaagtgagaattcatctcctgagtcattattattcaacatcaaatatacaatatttttgagttgagattttgctaatgcacaaggaaaaaataacaatattcttttatttttcttgctggcccttgat

SEQ ID NO: 33952 - DNA, 1253 bp, Bovine  19866881421359
catatggataaacccttttcttttttatctgtattttcatgataaatatttttgtagctatatctgagcaattgtaaaatacaatcctaaaattaaaacatttatcatgatttttctactttaccattcagcattgaattcctaaatagttcttaagaagaggctaattcatttttataactttggaaggtgtaggggaatgaagtaagccatggattttccactagggcatctttcaacatcttgtcagtctgtatatgatcccatgcaaaaggccttcaagatttgagcccactattcagtctctcaacaaagatccatatagtcaaagctatggtttttccagtagtcatgtatggatgtgagacctggaccataaagaaagctgagtgccaaagagctgatgctttggaactgtgatgttggagaagactcttgaggatcccttggacttcaaggagatcaaaccagtctgtcctaaaggaaatcagtcctgaatattcattggaaggacagatgatgaagctgaagccccaatactttggccacctgatgtgaaagctgaatcattagaaaagaccctgatgctggcaatgattgaaagctggaggagaaggggatgacagagcatgagatgattggatgacatcactgatccagtggaccaccatctctgggagatggtgaaggacagggaagcctggtgtgcagcagtccatggggtcacagagagtcagacatgactgagtgtctgaacaacaacaacaaattcagtctctcaaatctgtgtacaaaatacaaataacttaaaaatagtctaaaccctaaggggcttagatattgtgggaataactttcaactatgttagggagatctattagttggcttagtagtttgtttgttttagtatacagccttgtcagttcagttttccattcagaagacatttagcctgagattcctgctacaggaacagcagtagctgaaatgctaaataacagtcctttacaggggcaagtgtatagtgtaggctgatctcatcttgtgtacctgagaactataaaaagagagtgtactgtgaaatagcctaatatgtatatttatatatgttgaattgaatgaccctctcttaggttgcactgtaatttctaagagagatttacaggataaaacatctaactcaatgcccaataaaacagaaagtgaaatcataactgcttagtggcggcatggtgagccagcaagagatgtga

SEQ ID NO: 33953 - DNA, 1159 bp, Bovine  19866881422819
cccaataatataatattcctgtgagttgcattggaaatacctgatgctgtaatcgcctcagtacaaagaaacataataaaagccatgtcaataaaggacaccttgttattcagtagaattgtgttacatggacatcttcatttaaatttatataatatataccatataaagcatgaagatttttaaagtaagcaagcaacaaaggtcatacattcagtaacatctttagaaaacttgtttttgtgtgtgtggtaaatacacctatatttccacctcatagattcagcctatgaaataaattatttatgaattattttaaagagattttgatatactaatcacctaaatatgtctgacgtcagtgcataattattatttagaaacattcagatctgattggttcattgaaaattttgtcacacaaatctgaaatgacagattcattacctgaatgtattcacccctaaatttttgtatatattagtgtcattatgtcacttcttctctggaatagtaaaacatatagttattatttttgctcttcttaaacattatgttctatataacatgcttcacaaatacttctttactaccactcctgagacggaacatgttttctgggaaagagtcaagattttgttttctttgctgaacttctgttataaaagaaaatcgtatatcaaggatgaaagagattacagtatttttgatttgaacctctactttgaagaagcccaggtcactgtcagatggactatacctacaatttctttattaaactaaaatagtgggtaaggtggatggttgctaagggtattgactttctcacaaacttaagagtctcccagattgtcatgctggaactctgtatttactcagtctactcctactgcactcttgcattgcccattttaaaggtcctttttggactgaataacattagatgagatccagaagaccagaaaagaaatgtttagggatatgccccacttgaactcttgcctcagatgccatcagattttaagttctaatcactttttctttgataaactttatatactaagtattttgaatcatttctccagttgctgtgttttggactatttgcaattatttcacaatataatcaattccagatttgtcaacactttatttgtaa

SEQ ID NO: 33954 - DNA, 916 bp, Bovine  19866881510914
ttccctctcttgtaccttggtgccacagcaggatgcacgctccttttaatcatgggattgtgttaaacaaatttttaccagcagagactataaaaggcccctcatcatttccgagtatcctgacctcttgactgtccccactgcagcatataaagacaaaggctatgctaaatttttcatcattttattccatttcagatccaattatgtgagggtcttccatcacttacaggggtgtatatgctataacaggaagtgccgcacattaatcagactctttttatccagcagacaccagtgctaaatcacattacttcacaaaaaaggaacatgaaatagaggcaaacgtacaaggagggtgctctcttttgcgcagttacaataggaggtgacttgtgcgggtggccttcccatcaagtcccagagagtatcaaagagcattttgtttttcatgttttctgccacattcctccccaaaaggaccctcttctcccacttgctttaatgttcctctgccagttcatatcacagaatccaccactttaaacactgccctgggcaatgactttctagttgaactgttgtaactaatcggcctgaaagctgaaaaatgaccagcttgacacttgttcagccctcttagcaatgaaaattctccctttatctcagcagtctctttacaagcacgtaggacaaagaccttagatgctgaatatttctgacaaatgacattgaaattgtggatctgagggaagcagaaagatttacattactaaataatcttaactatttgggagttaacactttcttaataatatttcaaaattctatgtgattgcttaaccattatgaagataagttgcttatatttcaaagaaatgtataaaagtatattataaaagttaaataactttca

SEQ ID NO: 33955 - DNA, 1117 bp, Bovine  19866880082185
tccgtctagtcaggctatggtttttccgtggtcatgtatggatgtgagagttggactgtgaagaaggctgagtgccgaagaattgatgcttttgaactgtggtgttggagaagactcttgagagtcccttgaactgcaagcagatccaaccagtccattctgaaggagatcagccctgggatttctttggaaggaatgatgctgaagctgaaactccagtactttggccacctcatgtgaagagttgactcattggaaaagactctgatgctgggagggattgggggcaggaggagaaggggacgacagaggatgagatggctggatgacatcactgactcgatggacgtgagtctgggtgaactccgggagttggtgatggagagggaggcctggcgtgctgcgattcatggggtcgcaaagagtgagacacgactgagcgaatgaactgaactgaactgaggaagtgacaggccaaagacttaaatgcggcacggtctcgctccgagttgcttgttctactctctcttacttatttctacagaggtgctgggtggttagtgaaagaatcctccgttccctgggccaggtccctcttctaaataaacacggcaatatactcaatttccttctgctcctcctgcctttctttcagccttgttttctttcggtgttcactctgaggcttcttttctccccaccgaccaatgactgtgatgcagttcgtgttttctgttgccatgcagaaggcggcagagagtgatgccgtgtgagagaaagagaaagccttccagatgaaatgccatgtgtaaatggaaattgtcattattatcagatgaataaatggagaagaggcacactggctcaaacagaactgaaggaaaaattggatggtgaacaaaagcattattaatttaagaaactgcctgaatttgcctctggcagtttcctttgtaaacaccgttaacaccctggaatgcttgaattgtatttaaatgcctagcttaaatacagaaaaagaaaacagaaacctaggcattacttttaggcattcagaaaactgtttgcttgaaaatcttcctgagcaaaataaaactagcataggagacttcccaat

SEQ ID NO: 33956 - DNA, 887 bp, Bovine  19866880347665
ttcttgcctggagaatcccagggatggggggagcctggtgggctgccgtctatggggtcgcacggagtcggacacgactgaagcgacttagcagcagcagcataggaatatattataatatactgtaggaatataagataggagtcctctaaatagagattaaatcattttcacccagacttcttccattcttcctatttttatctttccttctttctctcttgcccactgtccttttctaccttctatcattcaacaagatgtattgatatgatatacagtacaagatgtattgtatatgatgtgcctgagattgtgctgggcacagtgaacccagaaatccaaaggttaatatgtagttatctttgctttgttggaagctcagtctcactgatgacacagacatgcaaacagttattatacagtgagaaatctggtgtgtgtgcagggtatccagagaaggtataagatgtgggaagcaagggaagatatcaggtttcagccttgggaatcagttctatgaaatacagtctaagttcataaatatcagtatatccttaattgattcagcaaacctctctagaaccagaaattacattagatactcaggatttggacatgaaaaaagatacagttgaagcttcaaaaagtttttgattagaatgggagaaagacaaggaaagcaatgattatatatgtctgtatctcataactgaaatctttggatgtagctgtgtttcctaattctgaatttttagaatgttgataaggtgcacaaactctgcagtacaaaacactcataagagagtctggggtaggtaccccataatgaaaacacattcaatcatcttaaatggaataaaggtgataaatagcctcacatcaat

SEQ ID NO: 33957 - DNA, 1868 bp, Bovine  19866880365741
cttcactttcacttttcactttcatgcattggagaaggaaatggcaacccactccagtgttcttgcctggagaatcccagggacgggggatcctggtgggctgccgtctacggggttgcacagagtcggacacgactgaagtgactcagcagcagcagcagcagtatatataatagataatagtgtgtgtatatgtcaatatcaatctttcaatttatcctcccccccaaccccatcctttcccccttggttaccatgagttgttttctacatctgtgactccatttgttttgtaaataagttcatttgcaccatttttttagattccacatataagcaatagcatttgatatctgtctttctctgtctgacttacttcactcagtataacaatctcaagtccatccggttctctcacttctaatccagatatttcaggatctacttggtatttattttgtccccagtggaaaaagagacctgatctaccattctcagtacaagagtcctttctctactgaaagttcatttaaatagcctactaaactatgagattctggaaagcaaaaactagttcttatttacccatgctgtgtgcctaatatctgttaagtgccaaatatgttttggatagattttattggtccaacgaaaaaaattcagtatgtaagtggtgtgctggaactagctaatatcagctttcaaggaagccaactctgtacatttcttcccaactccacgctcaccttgcaccagcagcttgaaataagccacagtgaaagtattttgtgatactatgacttataataagaaatatagggacttctctggtggtccagtggttaagacacctcatctgcagttcagggggtatgggctcaatccctgtttggggaactatgatcccacctgcctctgaaaataaataaaatggggggcttatgttaaaagaaaagaaatatatatttggtcttcaacctgttcctggcacgtgcgtgggtgctctgtcactcagtcatatccaactcttcgtgaccccatggactgcagtctgccagactcctctgtccatggaattttccaggcaggattactggagtggattgccatttcctcctccaggggagctttccaacccaggatagaagctgcgtctactgcagctcctgagtctcctgctttgccaggcggattctttaccactctgccacctgggaagcccctgttcccagcacagagctcctaaaacccctgagagtggtaaaggtgtcttgttatgttattaaggtggcttctgaaaagctcctaaggaagggaggtcagcagccagtggaaccaaccacctgcttagaaggttgggactgaaagtccccatccaccccactccctcgacctcaggggaggaaacagggactggaagttgaatccatcgccaatggctaaggatttaatcagtcatgcctctgtaatgtgtgtgtgttagtagctcagtcgtatctgactctttgtgatcccatggactgtagcccaccaggctcctttgtctgtggaataatgaggcctctataaaaacccaaaaggaggggacttagcagagcttccaggatggagatgcagctttcctggggagacacaggcagagctgcatcctctgagaaaatgtggaagctctgagcctcttccgcagactttgccctatgtatctcttccatctggctgttgttgggttatattcttttacaataaactggtaatctagtaagtaaaatgcttctctgatttctatgagctcctctagcaaattactcaaacccaggaaaggggtcactaaaacctctaatctatagccagcaggtcaaaagcacatg

SEQ ID NO: 33958 - DNA, 882 bp, Bovine  19866880401950
ctgatgtatgggaaagtctaacttacggaaagcagaagcaagcaggagcagcctgagagacaaggaaaggcgagcggccggaggacaccgagtagggtgaacagctagagtctgcagatgcactcagaggttatcactatgaaaggctttttagccatagcagggcatattcctttatcctaaaaccaataagaaggtgggtttggggggctttttgagggagaggattatattcacgtcatcaattttatgtttcaaaaaagtgtttctggctacagtgaagagtactggctggcaaggggcctaagttacgcagatcagctgaactttttgaacagagaggcactggtaacgtggcctaggggagggaggatgaattctaagctgtcaatgaattctaaggatatacagaaggtaacactgacaggtcatcttctgctgtatttatgtggagcccatgagaaagtgtcagggaacactggcagaggaacaagtctgtgaagactgatgctaaattcagggctggacatgctgaatttgagatgtcttggagttgatacggggtagagcaagcagacatttggttatgggtgtgaagcttgtcagagagctctgaagtcccagccagagatagaaacttgtgacgcatttccacattcacaggtctggatgtgaccaatgggatccacagacggagatgacgtgcagagaaaggttataacgtcagcagtggcagagaatgctaggaccaaagccctgaggaattcaagtccatcaagcccaccaagtgaagggcgagcgtaagggtgaaaggaggagcagaagaagaaaaagaaggaaacaagactgctgggtcgtgggggtgagggagcaaggattcca

SEQ ID NO: 33959 - DNA, 1203 bp, Bovine  19866880402940
taaaaatatgaaaatgatatcagtaggaatattatgaggattaaataagggtcatatatataaaagtacttgacataggccagacacagggtaagcatttaaagatgtgagctattattattcgggatcctactgaaaggtacagagcttggtattaggaattcaaaaatacagtgtctgtttttagtctgatacctccccttctctactggaggtatttctcgtaacatgtctcaataattcttaaactaaatatgtcaaaactgaagtctatgctttcttaacacagagtcaatcattcccagtattaccaatggcaccttcatatattcagctgtcaaatataacaaacattaattttgcacttcccctaaccctttgttgtaaccattactatctctagctggttacttttctctaatgtttttgcttcttctgtttatttcttcctcctacacttttatcctaggactgggcctttccatcccatgcctagataactttcgctgtttttatttattcagggttttgcccatttaccaattagatcctgtatcccagtataaaaatcatcttcttgtaacacaattccataaataaagcacaattccaacaaatcaattcctgcctagctctacagaatttccctgtaatgttcataatatcagatcccagttccttaggttgctgtatcaagtactataaagtcctacccattgactctctccacttctttctctccaagattagttctctttagtgaaaggaaaactccgagtaaggcagtaacaatctgatctgggtgtacctagcacccaaatcttggtctctactcatgatccttcagtaagacgaaccagatgttcctggagaagtgtttgattccagggctaaggcaaaaaatgttcaagatgaacccggaacaccttgtggtgacaggaagcaaggaaatgctttaaaaaatgaggcttgtcccaagaacaatgaccagtgcattttcttgacaaaactctgttagtctttgccctgcttcattctgtattccaaggccaaatttgcctgttactccaggtgtttcttcacttcctacttttgcattccagtctcctataatgaaaaggacatcttttttgggtgttagttctaaaaggtcttgtaggtcttcatagaaccgttcaacttcagcttcttcagtgttactgg

SEQ ID NO: 33960 - DNA, 4392 bp, Bovine  19866880444121
gtgcttattgcattgcagtctgctagattcctcaggaaaggcacatgagaacaatattctctgtgttcatgcatgtttacatcagtttaccagaggctttttatacttaaaggtcaatttgactgaacataaagattcttggccctcgttttctttccttcgctttcttacatatgttaccatattttccttagtcagtaaagtgtttctgcaaaagtctctgacggcaatctgattttctttctattggtctttttgctgggctgtccaaagaacttttctttacaggataatgtcagccattatgggccagtttccagtgctctcaacatgtaatttcaaattctcttttatttcaggaaagtttcctgaattataatttcccttcagggacccctattatataatagagattccaaaatctgtggaaattttatcagtctgtcaaaaccaacggaccccctttcagagtaatatttgcatgaaatggaatacatagaatatcataggaaagtaactatattgagatatagttcctaaaaatatttttaaaattgtttctacttctttattatcagagtaaataataagaactagtggcaggtctaataataactataagtttgaaaaagtgacgaatgtaaatgacatttggagttttttaagctatagatattatgaggtttgtgattaattttggtgacaagtcacagttactgttaacactactgtgttttcatgccttaataactaaagaaaaatgttaaatttcatctaaaggtgaatggaagtgtagacatatttttatcaatcaaacccacagatcacctgaattttatccacaaacctgaaagttcatgcctctaggtcaggaatatctgtactagatatgggttgaatcttctaaacttgtccctttctctcagctgttttaaaatgcattttgattttttaaaatttcttccttttttgcaggggaaggggagagggccgcactgggtcttcgtttggtgtgcgggccttctctatttgcagcacaggtgcttaattgccttgtggcacatgagatcttagctcctcaaccagagatccaaccttcatcccccgcattggaaggcagattcttaacactggaccactgggaagtccctaaaattttcttccttttcatgttctacttctcttattgcattatcctttctgtctacttgcttttgtgttcctcttggtgcaattccattacagaaatgattttgttattttatttcaagttgtttttaaaatcttccttaatcaccacgtttctgagtttttctatttgtgattcattgtcccagcatcttccatttgcttgcttgctttcagttcactctggaatcctgcagctcagttctcatctgctttgtgggcaggtctttcaatgtgcctcccaggtcacggggaatttattcttctcctcattcactttgttagattgcatacttttccctttgctcatatgtaagtaaacaagtttttgtctgcttttaagagggaggagaggtcagaataacttttctagattcatgactgtaaactcccttttctgtttttctctcaaagtgatttaaaaatatgacctcggacttggtgacacctccctttttaactctccaatcccattgttatctggatatttttgccccttttgttactaatctgctaaatttccaatctattctcaatagttcctcctggaaggaaacattggcttattatgactaatggtctatagggtccaggctgtcccagcaccatcagatctcaacaagcacatcccttgctcccatctgtgatccggatcctgtgaaactcccaaccagttcagctgcattttccagtgagtacgcgttagggatataggggttctcagaaccattcaggattcacactgccttcccctgacttcctttctacaaagatgctgatactgcataaggtatcctgactctcaaggggttttccctggtccactcatatctaggtgtttgtggagataccttaaaacctagtaacagtagataggtagaaagacagatgataaatgagatggatgataaatgaagagatagagaggtggacagatggatggaaggatggatggatagatgatagtcagacagacatactgtctgtgggttgtcagattttatgtcctagctgccctattagttttaggcagggcagtgattctctacaaggggcaattttgttccccaggggacatgtgccaatgtctactgacagttttggtgctgacaactgaagctgggggtaggggtgagaacagtactacaggcctctaatggataaagcccaggaatgctattaaacctcctacattatgcaggacagcctcccatgactaagaattctccagttcaagctatcagtagtgcagaggttgagaaaacctggcctacagaattaggggagattcaaagttcagccacaactgacgtcttcccctatgcttcccaattgcctcatcaactcttcatccagaaattgtgttcacttctgccccctgctattcacccctagttcaggcccatactatctttgacctgacctactgtggtagcttcctaaggtctgcatgaagccactctccttttcccccagagtccaaatcactctatctaccatgctggagcaattccctcaaagcacagctcacatcatgccaaacatctgctccaagagattcacatgattcactggcatcttgtaaataaagttcaaccccatcagctgcaaattcaatgttttctatgctctgtccctaatttatgttccttttatcccctgtactccttgacacataacttgcaatgcagtcaactgggaatctccaccatttgacaaatatgtctcttttcccctcaattctttgttacattacaacaaatacctcaatttgtagcatctcatgtccctccagacaggtcccaaagctcccttgtacatgaaatcttttccttccctcatattctccctgaccactccaaccaaaactgccctgtctctcttttagatatcttaacactttagatacacttgtcttacagcacttaaattatatgctatagtataatcacagtacttcccactctactgtaatttaaggattgagtatttttcctcttggcattccccacagcacctaagaaatacttagagcagatgctcagtaatacttgttaaattaatgagcagaactcagtcctacggaggtaaagtggtcatccgaaattcatccttctggtcagtggcagagaccatgtggctgtaaaacaaaaccatgacaatgggttcctaagaccattttgtgtacatgatactacaatcatcacattattagtaataattacaaatctaggactggatgttggacaggcggcaatgaaaaactaacaggtaacatggttgctattactgaggagaatttctaggcatagctattcatgcaggtagacggtcaacaagtgattaaccagatatagaactgaatactaaatgttaattatttgatactccatctcccaaagcttcatatctctaacaccctaagaatttatctccagtttgagttgcatttttaaaataataggattatatccatagaagagacataccataagtcttaatagacataccatactttgcctcagatcccctccctttctttatactatgtattatatcctttatagagttatcctggcaccaaacatttcatatacacatgtatttctgcaggtagaacttgactggtgccttcctgatggtatgttatgtgcactgagagaatcaccactctccagaatgctttcccatctactagtccctgtattctctactcattatagattcacattttgatgtgtaaaacagggatcttcataaatcatttaggccaggaaaggataagttttggatttcctgtccccgagcaggcactatgatgtcagtgagctgtgacactgaggagaagaaccagggtatttatgagaaccaagcactcctcagggcaagcgtgctaggtcactccacgtgtgtctgactctgtacaacaccatggactatagcctgcaaggctcctctgtccgtgggattctccaggcgagaaaactggaatgcgtttccgtgcccttctccaggcgagaatactggaatgggtttccgtgcccttctccaggtgagaatactggagtgggttcctgtgccctcctcctggggatcttcccaacccagggattgaatctgtgtctcctaagtctcttgctttggcaggtgggatctttaccactagcaccgcctggcaagcccaagtactccacagtaattctg

SEQ ID NO: 33961 - DNA, 743 bp, Bovine  19866880482141
atacagttaagggagttttaagaaaagccttttgttgtcttgaaagacactgcaaagttgggtaaggcctgtttatgttggtaccaaaatgtgtttggtttaagtttttgaaagtgagtgtgccaatttgcttagattatttttttttcctacagtaagaaatattcattttagccaacaaaaagtataccagaattgtgattgaaatggagaagatgactcatgatttgaacttgaatattctgaaattaagatcccttctgcacagttcactcttaaaaataggacattcagagggtgctctttgtttatcatgttgaaggacaagaaccaaaattgaaatgttgtctatcagaatgaatatttttcatgtccctatgctgtgggaattattagacattattaagatgctattgtttgttttctctttcaaaacagcacatatcagactataatttattctgagttttatttaacatattttccattctttttcagttaaggaccttcaaaaataatatatctctgtcctgattccaaattgaattcaagtctgactattaaaacagcttgtagctgctttttaatttccttattcacttggtaaacaccctgaagtggagcaatataaaagaatttggaaaagttgtataaagcctcctagtttctgctttctggcatttaatttattggatttgatttctcctttttgaaactcaatgcaatgggggggaagtttaaaa

SEQ ID NO: 33962 - DNA, 1260 bp, Bovine  19866880496713
tatatgaaagcttcagctcattcggaagctgaaagaatacagtgttgccaacttataatcagtcagtcagtgaacattcatcttgtgttgtgtgcagaatactgaattaggcagttggggcacgataaaaggaggagaagactctttctgcatcagatggttttataatttaattgaggaaattatctaaacttaagagcagcttattaaatatcaaatacaaatttaaatggtaagaaatgaattggtgtatactgagggaacacagaggaggttttacagattaatcagagacactctctacaggaaattctatcagcactaaaagtcctaactttgaatacctactatgtgcaagtcctgtgcagcacaagctgtgtcttatttgatcctcacagctatctttaaatgaagtattatgtttgctcccatttaaacatgaggaaaccaagtactagaaagccaagacaatatgcctgaagttcctagctaatgacagactgggtcatgatctaagctgaaggcagtctgacacaaaaaaagctgatgtgctagtcattctgtatacagtgtttaaagaagctgtgttattagtgcccattggcagaaacgtggatggacctagagattgtcacacacaatgaagtaagtcagaaagagaaaaacaaggactgtagaatattgtttatatgtagaatctagaaaaatggtacagatgcagttatttgtaaagcagaaatagagacatgaatgtagataacaaacttaccaggggataaggaagggaatgaattggaaaactggatagatacatatacatcaatatatataaaatagataactaatgagaatctcctgtatataacagggaactctactcaatgctctgtggtgacctaaatgggaagaaaatctaaaaatcagtgaagatatatatagcttattcactttgctgtacagcagaagctaacacagcactataatgcaactatattataataaaaattgaaaaaaaataaagaagctacattaagatggatgttggctctggagggatggatgaagaagggtgagcacattcctggataaaggagcacagatgtgaaggtgaataatcatgatggaagactgaaggcagatcaaactttttattttaaaaagtattttatttgaactaattttaaacttaaaggcagtaaaaatagttctttttatgtcccttaacacccccttctctaatattaacatcttacaaaacca

SEQ ID NO: 33963 - DNA, 999 bp, Bovine  19866880553349
attatacagattattcttacacactgatttttctcaagtgtttttttaggcccagtgagaagtacagtatgtgttttaaatgataacatcaatcagagcgatggtttctgtgtgtctgttgagataagatggctctagtttcacactgaaggccaggtaaccagatacagcattaatgcattccatcttgaatgcttggttgaggcccgttaaaaaattcaggaccgtgggcgaccagtgtttatgtctttgtctgatattgtctgtacttgtggttaaaggcaaggggaaaagtaagaaacaactcatgtgcctcgataaagtatttttgaagtagctctcattgtccgtggcatattctaattgctgggccagaactaacattctaatgatgatttcagtatggcaaacagcctgttggaccaagaaacatatctagtcgaggcgggccagggccagggcaagcgtgagccatgtaaggcactcaccttgggtgtaaaatgtaaataataataaaggtcagatcactgttaactgatcttctctttctgtctcaggctcagcatggcaaatgttactggtcctgactttatttaaaatttttgtattttgttcatcatggattttttttaaccttaattttgatttttggaaaaatatgggtcatctggattactgaggcttggggcacctcttcagatttttcacctgatgctagtgcctcactctttacccaagtcctggccctgaagatggactttataaatggataacaaagcagcaaagggaggaaagttaccagtgtgtatactttatagaagagtcatccaaaccacacttctaaatgtgtggtctagagggatcttgggaaattactgcagcttgtttcctaaagatatttagtcctgctgtgaaataaaggactggactaagacttgcctgggttatagaaaatggtagaaagacattagaagagcagccggttggaccgagggcggg

SEQ ID NO: 33964 - DNA, 1220 bp, Bovine  19866880567830
cattactttgctagcgtgagagatgaggcaattgtgcagtagtttgagcattctttggcattgcctttctttgggattggaatgaaaactgcccttttcccagtcctgtgaccactgctgagttttccaaatttgctggcatattgagtgcggcctctttgtcttaactgaatatattaataacatcactttaccttgtatttcctcagtacttggctcaaggtaccagctaaaggaaaatatttaattaattagcacaaaagaagcatgatcacttgctgcatgtttcttatctgggcctctcctgtcaagctcaatgagaatatatatcgaattcatctttggatatttggttgccaccaaattatgcaagataaactgaagaaactcaaatatttggtgagtggagctgatagagtttggtttgctgtcatatttcattctcacatcactggtataaactgatgcacagccaagagccaaacaactaatgttcatggtggagaggaaagcctcgggtgccacaaggctctcaagtgcctatctcattttgaaggatacagtaaattttgtttcataacatcttagcagtaagaggatgttactctaactttgctctttgaaacttgccaattatagtaaacattttgcatgaagcagaatatttcatggtatgaaattgcaggtctgtatcagtccagatgacagtttatttaggtaaaatagaacctcatttcgttaacaccactagaaaagagacttttacattaatcccttaacttactgattagagatatagttacaatccattgccctggtttatcgaagtgacttttcaaagagaatgatttaaagaattacttctcactataaatttttagctctggcagaaagccctatgctgctgctgctgctgctaagttgcttcagtcgtgtctgactctgtgcgaccccatagatggcaacccatcaggctcccctgtccctgggattctctaggcaagaacactggagtgggttgccattttcttctccaatgcatgaaagtgagcacatgcatacctgtgatggattcattttgatatttggcaaaactaatacaattatgtaaagtttaaaaataaaataaaattaaaaaaaaaaaaagaaaagtgaaagtgaagtagttcagtcgtgtctgactcttcgggaccccatggactgcagcctaccaggttcct

SEQ ID NO: 33965 - DNA, 3524 bp, Bovine  19866880572538
cgaagggacctgtcctcttgaggcagagccaacccaccttgatttcctttaataaaacagtaaattcaaggattggaaatacagtctacattacaagaaggacggaggtcatcaacatactgtgtgagcttgtcagccccagtgaggccacctatacgtggaccaaggatggagcactgttacaaccctcagaaaagtaagtacaatcagagtacagtgtttactctgagatgccttctaaatggatcttccagctttccttaaaatattgtcaaattccttctcctaagaatgtgcttccaacaggatcctttggaaaagaaactccaaaatgttagggcatggcattcacatactcattggaattctaaaaatgaaattgtaccatcacagtcactaccatgaaggtgtagtgccaaactggataccataagattaaatgtaagactctcgcttttcaggtcacttaatacttaaaaataagatcagggacttccctggtggtccagtggttcagactctgtgcttccaatgcagggggcacagatttgatccctggtcggggaactaaaatcccacatgctacgtggtgcagccaaaaaattaaaaaattgtccctccaaaaaagtgaaatcaatcaggccattaaaaaaacatacttgcagttctcttagaatatgcaggaactgcaagaatcttctatatctgggagatgtggtgtctcgtttgaactcacaccagccctatgagtctggcagggcaggagttgatactttctcaatgagatcattgaggaacagaatctcatgactaattcatggccagtcagaagcaggggccacgtcatctggaccccgccaggggtgttagagggtcacacaaataatagctttggtagaaagattacctgaagtcattttctaatatcaggcaatgatttatgtcacaaaaccgaaaagtaatgataaggatcaaagttttttgagatgtttgaagcagtattcagtcactttattttattgtaataactatccatgtcagtgagaaaatgtcgcatttcattcattttacataaaataatggaataatagaaacattcactcattttgtcttctctactgtctccaaatcttgctgttaacacacacagggctgtagacatcttgctttctttcaatttgcattcaacagctccttatccacctccagggatttttcagagacatagatgttaaattgttttgcaaaccataaggtactttaaaaatgcaagttttatttttatcatcctttttttttctgcatcacctaatgtgtgaagcattaaaagaaatctaggtaaaattcaatttttatatcactggactgtcttagaatggaaagatagaacaaatctaattttaaattcttttgcctaaaactctgaacattagagtataatgtagtttttgaagtggaataaaccttccagatcaactaacttagcagttctcaaatcttttggttttaggactccttcaaacttaaaaaaatgatgagaagccaaagaacttttgttaatatgaattaactttatgttaatatgttaacatatctcatgatgtttacgctgttagaaattaaaaccatgaaacattttaaatagctgtttgttaatccatttagaagtaacagaagtaagcccaattcatgtttatgtaaataacataatttttgaaaagcagtattttaaagattaatgataatgacattgtttcacatctctgccaatctctttaatgtctggcttaatgaaacatagctgggctttctcctcaatgcttctacattcagtctgttgccatatgttgttttaattgaagtttatggagaaaattgtgcttcatacatatataaacaggttagttgggaggataaggaatacattcataatcttttaaggtaattatggctattcttctttaatgctacactaaaaatagacaagcagtagtttcttaaaggttaggtgggatgtggaatctaaaaccatgttaaagagattttggtagtctgttacaatgaaatctgttgctttatcttgttctttgaatggatcttttaactagactagattttataacatcatacattggtcatttggaaagtgttggctgactgagttatacacatcttccaaatgttaacacgttccatcatacaataccaaaaatacgcgtattctttaatattactatcccaacttttcagaaaagtctttgagctttgggaagcagtcagactcacagtgagcatgacggattttctgaaattctaattttcactcggaagcttgaattttatcatcggcaacaattactgtcagttgttttccttgcattggccagctcatttttgttcattaaaaaaatatatcttccaaatacctaaatccaaataaccctggcttatctgtcagtcattatttcaagtaaagtagtatgccatgaaaaaggagctagttcagctagcaattcaaacagtcacacccacagactttggcagacagcagaggtatggtgtgtatttcctgttttgttgtacagaatgttagaaaacttacactcgggggtagagatttagtgaaataataagttctactgcttcattaaggatattcttatgggaaattggcattttgtttttactgcaagtgtgtggtagccagaatacagtagctactggtacactttgctgccacagctttgattccattctggtgccaagttttatccacaactgcttttactatcagtgcaaatatcaacactcacagtgaaaaaggcaaataacggtatagtgtcaatatttactattatgaaaatagttttgacctcacggatccctgggattcaaggaccaccctttcaggattgctcaacaatttcactttagaaattataaggaacataagccaaacccaaattgaggaacattctattttttatcagtagtcctcaaaactgtcaaagtcatcaaaaaaatggagggggtgggggaaaggcagaaaaattgtcacagaccagaaaagactaaggagacacaatgtctaaatacaatatgatgtcctgaatgggagattgtgcaacaggatagcaacgttagtgggaaaactaatgaaatctacataaagactgaagttttgttaacaacagtgatggaccgatgctggtgctttagttttgatgaaagtatcacgtgctgaagatgttcacgtcagggaaaaccaagaaagaaggagataagaaccctctgtactgtcctggttgcttttctgtaatgccaacatcattccaaaataaagtttattaaaaaaaaaaaagaaagaaactataaggaaacagaggctgagaaagctgatcagctgatttgtggccataaagtactggagggatgtggtggaagaccgtggttagttcaagtcagtgtttgttaactgagttggtttgtgatcgtctactgctcaagggaatttgcattagttt

SEQ ID NO: 33966 - DNA, 1241 bp, Bovine  19866880587861
aatttctgatgatcttattttcttctactgctaataaactagagaaatggacagtaaggaattttccagtcaggacttggctcacgtattgtattaatttaatatctgggctgaatctaaaagcccactggcactgagtgatgatgaaactgcaaacatcagaggaaaaggtttccttgttttaaaaatgacaaatacagtcatctcaggtcatcagcctattgttgttcagtcactaagtcatgtctgactcttggcggccccatggactgtagcagtccaggcttcatccttcactatcttctggagtttgctcaaactcatgttcattgagttgatgatgccatccaaccatttcatcctctgtcgctgccttctcctcttgcccttcaaatttcccagcaccagggtcttttccaatgagataattaacctccattctggtggtaaggctcagtggtttgatgaaaagaaaaatgtgtctcaaggtagtagcagctttgcagccccagcaccagtgagcacagctggcctctgcagtcgtgtggatattcacccagctgtgatgaaattgggtttggttttgagactctgtgaaggagcctgtttgacactggttgatcctgctgatgttcttttcttgagtttgttcctggctgaaaggctagagaaatatttttgcatcttacagccttgggacttttgttataagccagtagttcaccaattgtagttaataacagacatgtattttccccatacttgaagataggaagttgtcattttaactgttacacctggctaatgactgtgattccagactaattacagttttctcacatatactaatagctctaatttagaattttttaataatcacaggtagaactgacaagcttttgagaaatggaaactttgtaccgtatatcccctggaggaaatttaggttgttgcacatataatgcccttatctactgtaatgagatattattatttttatttatttatttattttattatgggcctttccaggtagtgctagttgtaaagaaccttcttgtccctgcaggagatgtaagagacatgggttctatccctggtctacctccaggaaggtcccctggaggagggcatggcaaaccactccaatattcttgcctggagaatcccatggacagcggagcctggcagacttacagaatcagacatgactgaagtgatgtagcatgcacacatatttt

SEQ ID NO: 33967 - DNA, 1405 bp, Bovine  19866880592133
ccagctgggtgcacaggcttcggtacttgtgactcttgggcttagttgcccccggcatgtggaatcttcctggaccagggattgaacctgtgtttcctgcgctggcaggtggattcctatccactgcaccatgagggaagtcctattgtggaaagttaatactgctctaggcatgatgggaaattctttacttgtaatatcttatcaataacttaaaagcaccctttgacttagtggcatgtaatcagataagcttttcttctcattttagggtctaccatacccactgattaactatggaagactataccaaaatagagaaaattggagaaggtgagtggttttaataatataaaaggatttttaaaaaatgatttaatgatttgacatctttgacatgtaaatattcaaattcagtttttaaagtatctaacagtacattaattagtgcattaatatatatgttttctacataatagcataagcaaaaaaaaaaatagttaacctttcaagagaattgaaattattcttacatgtctccctaccagtatccctccaataatcttacattcttctaatactaaacacttaaagcaatatatctatatattttttaaaaaacactattgctattttgtaggtgtgttgaggagagtgttagggcagtgaaattatgtgctttagtttaaagtacgtctgcatatactctctgaagttctagtcagggtcatgtatttcatttagtggttaatgtcttcttaatgtcttttgattaaaatatatcaactcttatttcaattattaccaaattgttctgtgattttcttctgagttaacaaaaataattcattgaactcaggttataatttgaacccctttctggctttttagatcatagagaacataactatatgcatgatgtggaaccttagttagcatttagcagacactctataaccatttgttgataaacagtttttctgtttattgttcagtctccatgctgctgctaagtcgctttagtcgtgtccaactctgcgaccccatccatagacggcagcccaccaggctcccctgtccctgggattctccaggcaagaatactggagtgggttgctattcagtctccataatttgcctgtattgaagatttttaaattttataatgcttagttcatttcaaagtgcaagtcaggagagacagagcacttgtgatgtctaaaactcaattcagtatatattggagtgttcactgtaagttaatcagtggctcttatgagtaaattttaggaccaggtgaatgttgtacacttgagtgagaggtaagaatactttaaaaagtttgactttaccattaactacttatttgactatattatgtaaattactgatcttcctgagtttg

SEQ ID NO: 33968 - DNA, 1498 bp, Bovine  19866880672139
ttcttgcctggagaatcccagggaacgacggagcctggtgggctgccgtctatggggttgcagagagtcggacacgactaaagcgacgcagcagcacacacatgcatacatatgaatatgccttaatttctgtctttgtttagccttcttttcaactactttttttttttttgatacctggagatttttgtttattcttatgggaagacgatttctacctaaaacaagtgttaagaattgaagtgagttttataaaagatgatgtggatccatgcttgaaaatttctggcccagctgataggtgaagggacggtgtatatctgccatgattttattgtagcagatcacacgtccatttcactcctgtagaaagtgaggagcttgcaacaacagaagcagctatttggcagagagtctacattacatgcctcagtgtttcttttacatgtgtgttcttgtgggccaagttagttggagccagctgctccccattctctaactgcaaacatgccctgactgtccttcggcagtggtgggccgaggagctcttccccagaggttcaggtaggatttgattcactggcttccctcctgccataatctccattcctgcctctgtgaaaacagtttcatttgtctaatcccacagtgtttgaaaataaagtattattgtcgaaatgatattatgacctcctagtatactaatttaaggataatattaattccagtaaggtgatttggaatgttcatttcaaagaggtctcattattatgtggtcacatttttcgaccccctagagaaaactattatctcttttaagccaagttattgtctgttgttaaggccaatgaatttcctattgtttcttatttgatgccacttaaccaagaaaataaacaatggcaaaattttctctttttttccaagtgcttcccaaatgccttatgaagttcccattctttcactcaataaatatttattaagtgctaatatttcctatgtctagggcatgtgtgttatcagacagatttattttcaactagctgatatgattctttagatatttgatatgattctttcaacctgattctccatgactcagtcacaatagcttagaaaacaggggaaattctttatgcatctttagaaaatgcacatttatagaagttattttaagcaaagtaaaatggcaaggtctgggcatactctactatttagcaaaaataaactcaatatcttaaaagaaaattactctttgagatagcaaaatataatagcttttcatggacatatttcaggaaatgatatctttggttggaaatgatttgaaaattagccctgtgtcaccatgaattgttttcaatcaatttagaggcggcagactgaatgatgaagtaggcaaaaggcaagcactggaaccagaaagaccaggttcaaattctctatttggcattttctttgggagcccttgcataaacctcttaaacgttctcttatc

SEQ ID NO: 33969 - DNA, 1745 bp, Bovine  19866880735108
acatgacgttaatgtgttgaacagcacatacattcctcatctctttacccatctcagcggcctcattattcataagtctgtgggatcttttgggtccacaaatgttttcctgggctcaaccacaaaggaccatttttcccagccatgtgcccagtgtttgggcagcagccagcatccttccaggtcctggaacacaagtgaccccagtcatcagtcaagccctgttcctatctcatctggcactgctgtttcccaaggacattttcatcccaggcacagtactgggttgggctcttctgatattttgttttctggttacaatacaagatgcaccagctcagagcaggcaggacagtgggggacagtaggctgggggtgatacagacacattttctgtgtgccaggtggagtggcatcactacagtcctgtgcttcagtgcttcagcacagaatccatatatttctactacattaaaatcttttaattacttgcatacatttagtctaacatatttttctgttttggattagcacaaagcagtaataatcccccttcaattgttttacttaatgcccttctctacaggtaaatggattaaaagtataagtatacaattatttttttaaataattcttataaagaacttggaaatgatacccagaggagaaacaaactatagttggaaaaacattagtgttaatacatgcaattctctgtttaagactactcattcagaaaaggcatcccctcccctgcctccacccaatttataaattcacagatctggcaaaaagggagagttctgagggggtagctgactacaccctctcctttttctcttggcctcacaccattctctggttccagaaagaactgaccgtggtagacaaaactgttactatttgatggagaaacggaaaactttcagggagcgtggtagactttattcggttattacagggtacctggacaaatgtaccttctcagaaaaaagctacagaatcaaagtcaaagacacaggcctcttggttggattacgatccacacagctgacggttctatctctgggaaaaggggtccagccctggtttggggacaacattagctttggaggtgccagaactatcccatttcctatattcagctattaaggatctggtcttatatttttccctgctaaagttgacacaaataatttatattttcaaggagaactaagtttaagttctataaataatcaaaacatatagtgtcagccatgaaaatttcctcacatactatagactacttcgattgcccataaaattattttatctaaaaaaaattattgagctacaattgaaatacactaaactctggatggggcttcccaggtggttggtgctcatggtaaataatctgcctgccagtgcaggagttataagagatgtgagtttgatccctgggtcgggaagatctcctggaggaggaaatggcaaccaactccaggattcctgcttggagaatcccatggacagtggagcctggtgggctacagtccatagggtcacaaacagtcggacacaaatgaagtgacttagcacacacaagctttgtatacataaagtactcaatgtgattagttttgacataggtgtatactcctgattctgtcatctccatcaagaaaataaacatttctgtcacccccaaagtgtcccttggtaatccatttttccctccaccatctttcccaggcaaccag

SEQ ID NO: 33970 - DNA, 827 bp, Bovine  19866880782641
ttgatcatgctcaattaagaattaaaaccagttctatactgaggtctcttttcccctattgcaatagtttctgaataaaaatctgttcttactgctttaagaaaaaagttttttctcaactatagagctaggatgtgaccataattgcccatcttggtatattgcaaagtccttggctataggagccatctcataaacttctcttgggcccatcacttggtggtttgtacagagtcaagactgaaggaagtaccatgaagtgacagatgcctcagatggaaagggagtaaacctctctccctcccagccgtttccatcctagccttagctccctggtggaactctccacaaatggccccccaaacatggcagccatccagtcacagctagaaatcaacaggggcttgtgggcgctgatggtgccatcatccaggatgaaggtcacatctgttgggtgagagaagatgcatcacgtgaggatggggtgaaagaatgtgggacaaccgacccctcaggtcgacactgctcccagatgactgcttcctcctgaagccagtctgtgagcaccacatgacccaatctcaagctgggggctctaggtttcaggagcagagccgcagtatctccaggacatcagtagctgagatgactcagaatgctactcggaccaacccagattctgcagaaggctccttggagggaagtcccctgcctttgggacaccagctcctaaagcctgtttcatacctgagaaggtgcctttggccaagcactcctttaacccggtttgtccggtgggacatggaaaggccttggtgatctcctcg

SEQ ID NO: 33971 - DNA, 729 bp, Bovine  19866880877828
ttcatcccatctccccatctgccttgacatccatatgtttgtcctctatatctatgtctctatttctgctttgtaaataagattgtttatacccattttttttttcagattccacatatgtgtgttaatatatggtgtttatttttctctttgtgactaacttcactctgtatgactgagtgccatccatgacagtgtatcactaggtccatccatgtctctacaaatgacccattttcattcctttatatatatatgctacattttcttaatccattcctctgttgatggatagcaatgttaataattgatgccattttcagaatgagtgaaacacaaattttaccaatactctgtgaaagaacaaaagtatatgttgttatgtttcaggattgaaatatttttgttgatcttaaatcttttatggaaatgaaacaactactcatgaatggattgaaaactttcttgctctacttgctctactctatttcttgctctacataatacttatgtatttgtgcacagactgacctccttaatttggcctttagccctttaaacagcttctgaaatgaatgtgtgatcatgctaaccttctgtagcaatcttttacacatggtttaaatgttgccattactgaagtcctgactttgtaccagggatggtataaaccaagccctgaggcagctattgggaatttcaggctgaaatgatttctctagaggctcc

SEQ ID NO: 33972 - DNA, 1455 bp, Bovine  19866880887769
ttggaattctggcccaccagtacttacagtagtatgtgcattactgtaattaaataatgtggaacgtcacggtggagaattagctcgagcagctaacccagtactggtagaatccgtgtcgctctttgcagggtcactcacacccctgtttcccagcctgctgccatggggctgccatctcaagaatcccccattctcagctctttccaggggactggtggttcgacacgtaggaagagaaatgttaattgcatatagacacaacctcttttacaagacaggtaaaaaatggggaatattttaacataaacatcaatccttttgttcaatattttagcatcatttcttcaaaccagtgctaaatctttccacatgcacccctgaaaactggcccctgtgacatgtttttccctgtaaggctgtgctttatattgattttaatccagtttctcccaagtaaatatgttaatattaattttaatccaatttctcctgaataaaaatgtttgagtgaggaaataatatgattcattcctagcttctgggcccctacggatggatctggccttgctctccgttgtcttctcccctttgtacttgttcctgccttcctaccctgcacctgtgtctgttaactgcccaataacgaggtccatcacaatcttggtggtcacccacagtagctcatagaacctcgttccttcctgagttagtatgtgaatctggcactctccaagagacacttaagtgacaacttgtggtaggaattcagctgtatttaaatggatggaaggcctggtgagggagtttccacctagatatgaagcccccggatactcaggaaacatcccgaagccttgggctcaggatggcctgcagtggggcaagtgtaatgtgtaatcatggtcaagaagcacagaatgtgtctgccacatagacagcagccttgctgttagtagttcctgactattctggaggagttctagttgggtggttggtgtattcatggagggacaccaatacttaaatatgaacggttgtaaattggggatagagcttcctgtaattagcctttcttcaggaatctttaattgaaggttggctgtttgcccatcttttggcttatcccattacaaaaaggtaatcatggagaaagtgtaatgtgtggtttttcaactagtagtaggtctcttttattgtttgaatcattgagtgtttcttaagaaccagtaacccgatcttttatcactcccgggaccgcctcctcctctgctctgccgatgcattcaacacatgtgttcgcctgggaggcccagcagcaccagagcaatttacattcggtttcccagcctgcgaggagcagcaaatcagcctctgggaaggcttcggagacttgtcggcggtctgtagcttatttctgtgaggctgtgtgtgtgtgtgtgtgtgtctgtgcgt

SEQ ID NO: 33973 - DNA, 3554 bp, Bovine  19866880960618
atacaagctaaaactgatatttactatcagaggtatttagcattaaggatatgaatcccttaaggggaatttagttacctcttttgtaaatacaggaaaaatagattttataatttgtaatagaaaattatatttatgtcgaagtctaaaatgttcaaatttctcctcttttctcttcctcccgaactcccacattcattccagaaatgacttaagtaaggcatttaaccagatgtataaagctaactaaacataataaaaacatgttagaggaacataaagtgatttcagaaatgacaacgacaatccattactatatggatctatacactgctttgggaaggatgtaaatgagaatttttctctcttattaccagtatgaaaagggaaatgtgatcaattagatagttccctgagaccattaaatactaaatgaacccattactcagaagtactactgttgctggtactaagattagacagaaattcctcccattgcacttgacaaagttataccatacacagtgttctggacagcaaagctacaatgaggtatcacctcacaccagtcagaatggccatcatcagaaaaaaaaatctacaaataataaatggtggagagggtgtggagaaaagcaaacccttttgcactgttggtaggaatgtaaattgatattgcctacagagaacagtatggaagttccttaaaaactacacatagaactaccatatgacccagcaaccccactcctgggaaaactgtaattcaaaaggagacatgtaccccaatgttcattgcagcactacttattgtagccaggacatggaaacaatctaaatatctatcaacagatgaatggataaagaagatgtggtacataaagataatggaatattattcagccataaaaaggggaaaaagtgggtcatttgtagacatgcaggtggacctagagtctgtcataccgagtgaagtaagtcagaaagagaaaaataaatattgtctattaatgcatacatgtagaatctagaaaaatggtacaaaggaacctatttccaaggctggaatagagacacagacatagagaatgaacatgtgacacacaggggaggaagcagagggtgggaagaatggggatatacactgccacgtgtgaaatagctagctagtgggaagctgctgtgaagcacagaaagctcaactgggagctctgtcacgacctagcgtggtggggtcggggaaggtggcgggccgaggtggaggggatatatgtatacgtatagctgattcatgctgttgtacagcagaaatgaacacaatattgttaagcaattatattccaataaaaacaaccaaacaaataaatgcagtgatgagtttcataagtctgggtgggctgcaagcccaattcaaggaaagcatgattatcacttgtgatttgtccttgttatcctgattgcaatttgatcactcataacacttctgaagtcctcaaaatatcaaatcatataagaactttaaacattatcctgattttattggtttttgttgattctttgggttctccattaatccccatttttaactgtttttataaattatgatacaaatctacatattttaaaatatacttcttttttagatttttgaaactttctggttgtgcctattctccaaaactactgtattgagccatcgtagggtcactgtggtttatgctactaacttcatagtgatttatgtaactttattccctcagcctgctcagttgcttatattccgtaaggcacagggcactttataaattaataatttttaaaaaggctacaataagagttgcaaaaccagaaaaacccacagtgggcagatttcactttctgttccaaattgctagcacaggtctattagcaaccagaacaatggtgaggattataatggtgtttcttgcatcacatctttaaaaagaagttacagcagagtaggtcaaggtgaaaatagctgaaacttctagttcctattgtaattcagaaagtacttatatttattattattattgttaatattattatcatcattatcattacaaatagtgaaggtagggatgcataaataaagtctgccctaggggcagcctgaagctatattccagcaagttactgtgcttcagtattatgagaatttttatccatcatcaataaaaaatgagcagagcagttattatggcagtttccacagtcaagactgttactgctattacatctcttagtaaaagggtgatacactctccattctaagatgtcaactcatccacctttctgacattaaagtataatgtacagtctttatgtggattcttccctagtgaagtcacattcccatgaacttggggcaaggatacaatggggctaaattaactctgggcagaaagaaaagtaaattacattttttataaagcaatagtagcactgagctgcctccattgctttctcagaaaggaatgaagttgaaataaatttgataaaataaatattttacagagcaggattatgctcaccagtgctggaattatgccagaccaatgcccttgatgctccactgggcacactctctggaaatacaaaagaagcaagtacttctctacccccacactctccagcgccctggatatgaagagcagcctgagcaaacagtctgactgctgcagtcatctttccagcagcagggtcattggtgttggggcctcagaatatcaaagttccccttcctatatgctatttttttttctcctccttaaattttaattttaatttaaatgttaaattaggccctttttattttgtctttttaactagccaatcttgctaatggtcattgaaggcatatagaagtttcacaggtaactcactaaagagtacatatggagaagtctgaaaagcatgagattaggaagagaagaccccacttcacgtccagcctctaccctccttcaatgtgttactttggggatatgctttttacacttccaaacaggtatttttaggggcatatgaccaatttgaaatgattcccatttttctgagaagcaatgtctgtctcatctgcatactctttacctacagcaaattagaccttattcatcagattttctcccccaacagggttgataaaaggtaagctatggaaagtatcatactgtcatatggacaaagtaacagaaaaagctaatttgcagtgagaaaataatgtagaaaggagagaggaggcaatatcggaaaaggagactgagtgtcgtgtattcttatgccttcctaagaaagaagccagaatcaccttgacagtgttcccacctccagcctatactgagaccctattgacatgttgctgcattcaggttttgtgagacaccctatgtcatagccttgggagtgctctctattgtttttctagatttttgtgggtctttgtcaagaattctaaagacaatcttgaagtctttttttttttttttctaatttttccaccacagaagtaagaattcctgacccattattat

SEQ ID NO: 33974 - DNA, 1414 bp, Bovine  19866880966722
aggaggacttcctttctacccgattcgtagtgggtagaccggaatggtagagaattttttaatgaaaaatttcacctgaattgaaaagcaactgattttagtacataaaaaatatgctaagatatgaaggtagtactatctaatctaattcctgctgtgtttgccactgcatatattgaaccagagccatcacaagggcagaggattaggaccagagacaagctgggggaggcaaaggagagatgagatttcaaaaaacgtttatgtttctggattgtggctattgggctggatatgcctttttatatctttgcttctaaaattcatgtcattacatgcactataattgtctctgcttccatatggtgacagaattctaaccactgtatcaagatctcgatacataggcaaagcgaaaatgttgcatcagtcgttttccctcagttacattacaagtacaggacacccccctcgccccaataatgaaacacaaatttagtcaattagaatagtatcagtatcgtgaatgtacttttgcaattacgagagtaaaaacattccacattgaaataagaaatgccatctgatttcaatttaacacaaagggggagaaacacattccatttaagaatgacaaataaagctgtcagtgtgatccatttatagcccctcagagaatgccacaaatccacataatgttctgaggagctagttattgtatttgctgtgtccgagagaaggccttggaagtctctgatggtctgctagccaaggaaactaaggttagctggaagaaatgtgcaaattcagtcagcatcccgaggagaacaccccttaaaggggagcgtgaaggcgcttggctgttgtctgtaaatagtgtgccgcagcaggaggggtggaacgctgcaggatacacccttgtcttcttttgtctgttccccacccctcctgcccttgcgttcatgttattcagtcgctcagtcatgtcagaatctttgcaacccgatggactacagcacgccaggcttccctgtccttcactatctcctggcgtttgctcaaactcatgtccattgagtcagttatgccatccagccatctcatcctctgtcgcccccttctcctcctgccttcaaccattcccatcattggggtcttttctaatgagtcggctctctgcatcaggtagccaaagtattggagcttcagcatcagtccttccaatgaacattcagggttgatttcctttaggattgactggtttgatcttgcagcccaagagactctcaagagtcttctccagcaccacagtttgaaaacatcaattcttgagtgctctttacggtccaactctcacatccgtacgtgatctagaagggtcttaacggccaaatgaggcctctctctcttaggc

SEQ ID NO: 33975 - DNA, 986 bp, Bovine  19866880980103
cttaaattgcttaggtaggtaccatgcaaagttacatttttctccctgagttcctaatgattcttgctctcttaaatattgcttttctggcttcttgagtttgctgaatcattgcctgtgcctctgggagacatgctgttacttccctaaggagtcactcctgacaaaaagtgattaccagtgtgttcgcagcttaggtgtttctgctgttcggcttctctccggataaatcacagttgttgcagagcaagtatgcagctaagctcaggactagaagagtgcgtggaaaacgtgctcaaagggattggtgacagattcgacattggttttatcttcagccgttgctcctgacgctgcttttcggagctgatgtgttggttccctctgtcttgtgtcttactcttgacttgagttttgaagctgctgccactggagctcttgtatgtgtcagagatgaacacagggaattcaacaacaagcaattggataacgtttctaacaacatgtagctttctaaaagcagtggattactggaggtgtcctcacctggacagtctgttgaagaaattcagggcgactgatcggagatcatgtgggttaattaagggcatattccaaaagagggttgcattttactttcttggtgataaaagctgggaaagcttaagaaaatggctttaaatgccatcatgcatcattaattagagctgacaaaagaggcaatcagtccgaatgagaaaagacagagcataatgcttcggcaatgaaagcggatgattaaaataggatagaggatgttcccaagcgagtgcaaaaacaactgagtctgcgaggtctggaagagtccatggtgccccacccgtctcatctaggtgtgtgattctggttgacatttctagttagtacaggacctggtggtggtttctcagacctgcgagatcctacggaggtttgaagtgagaaatagggtgaaaagagacatgctg

SEQ ID NO: 33976 - DNA, 1860 bp, Bovine  19866880981787
tatggctgctgctgctgctgctaagttgctcagtcatgtccgactctgtgcgaccccatagactgcagcccaccaggctcctccgtccctgggatttttccaggcaagagtactggcatggggtgccattgccctctctgccatgtatggcagttctattttattcagcctgtgctgagcaccttcagggcatctcccacagtcccttcaagatggcagactcaactacttactgactttcatggataataaaatacaaggcaccttttctgaagatacctttccctcacattaggaaatctaactcttcaaagaaaatgaaaacaaggaaaagagagtgaagtactgaaagtaaatttgaaaagtgaatttggagaatgaccactcctattttctagaagagtaatggatgataacaagcctgtgtctctgtgaaggtctttgcattagccggtctctctctctggaatgcttttccctccaatcttgcttggctcagctaatattccatctccttagagaggctgtccctaaccatccaatctcattcatttcctattacattactttgttttatgtattacagtacgttgccatccaaatatttcacgttgttttttcattgccttccctcatccccactggactaaaagtaccctgaggtcagaggtcaagtctacatgttgattgctgttttctgagcaattaaaacagtgccaggcacttgtacttgcacttagccgctcagacgtgtccgattctttgcgaccccatagactgtagcctgccagactccatggggttctccaagcagactacccggagtgggttgccattttcttctccagaggatcttcccaacccagggattgaacctagatctcctgcattgaaggcagattctttaccatttgagctaccagagaagcccttgctagacaccgagtaggtagtcaaaaaatattttgtcatttagttgaatggcaagagacccagatctggttttctggggttattccagtgaaaaagagtatatttttaatcttttgggtcaaatttgcctttcagaattggattaaaatgaaactcctccataataaaaatttatatgcacaaaattttgcatataatttgagagagtccatggacctcaggctaggaatttcagcaataaaggtgtatgcataaatattaagaaaacctaactgaaatattgagcgaaatatcacaaaaaaatttaattactatgaacatcagtgtcttaatgttcatttatggtaatgaattgtgttgctctgggaaaattttgcagccctccagaggaaaaaaaaaaggctatctataaatgttgtgtattttatttatatgctggaaaggatttaaagcttatagagaaaggctaataaaaatacatactgtagagcaacataaaatatattacaaataggtaggaaaaaatgagtcaaaagaaaaaaaaataaggctaggaatgtaagatagggccaggagagagattcatactcaaaatttatgccatgaaattcaacattcttgctagaagatagtaacaaattttattcgcggttttttagcagccaatgcaaaggagaaaaagtaatcagttatgccttgcagagggtcatattttatatacacttatatatgaatatatgtatatatatttaacagcacacggctgcttgaaagaaggaagcttgagtgcaggaataaggaatagagattatatttccactgtttgtttttgataagtgcccttgtacctgagctggaaataacctatagtaacattttcaaaaataactagcactgggatgtttataatcaagatttgatgcctct

SEQ ID NO: 33977 - DNA, 1468 bp, Bovine  19866880985831
tgtgagtacgtatttctagagtataagtgtatgaaacaccactaaacaacaataaggaacaatttttctatttattgagtttaagttgttttaatttttcaacctttaaacaaagtttgattttacaaaaaaaatctcatattgttataaattaaattgctattgatttagtgatattttaaggccttaattctaaaaagaaatccttttgccttacacttttagagatgtaattatttgttccttccaagaagtctggaacttaagttatataaaatgaatgtaaaaacgttatacatcacatacttttattattaattatatatgttaacctaatacagcatatagtttgatacattttatgattattttttgaaactgggctctctatcagacctgattatgcaataaaatgtcttgaagttttgttcagtcagatttatgagttcatcatcagcaaggataagtgcttcctcagatgatcttttgtagaattgtgctctatgatcccatcttgaaaagtcttgtttttttcctatccaaccagcagagagcactttagcttgtaatatgagcattatgtatataaatgaatatagtcaagctcttgctttatcaaagaaatgggccagacagttatcttctaaactataaccttactcttttctgtcaatttcagtttgtttcattaatttcctaaattttgcattatttaaacaaactttcatagtttaaaaaagttattataatgactttgtcccaaaacacagtcttgttatttgcttggtcaaaaatttcatgttagttgtattttgtgtatttcataatcctaattagtttgtaaatttttacgtgaatggattaaatttagtctcaatttctgtacacctttgttttgtttttttttttagagtttcatactctgtgaatattcaaatacttgttgataaagacttttctagagagatgattcaactcagtaagtgtttagacactaagaatcaaaatgtcagaaatctactgtaaatagacatactgtctttgttgcgtgactaacgaagaatgcagagatgttgttagcctggttggttgtcctgctcacatccttgactgtaatcggaatttgtctaaagcacctgttgttgattagttgctcagtcatgtctgactctttgcgaccccatggactatagcctaccaggctcctctgtccatggattttcacaggcaaaaatactagagtggctcgccatttccttattcagagtatcttcctgactgagggatccgacctgtgtctcctgcattggcaggcaaattctttactgctgagtcaccagggaagcccgtctaaagcatctacttcaccttcttccctttacagggccacaactaataagccctagctgatctgattgaagtaaatgaaagcttgaggtggtatatgtacagccagttcccctatttt

SEQ ID NO: 33978 - DNA, 711 bp, Bovine  19866880993907
tccagagcttccctggtggctcagctggtaaagaatctgtctacaatgcaggacaccaggtttgatccctgggactggaagatcccctcgaaaagggactagctacccactccagtattcttgcccggagaattccatggacagaggagcctggtgggggtacagaccatgggttgcaaagagtcagacatgactgaatgcacctttcagaacaactggggaagagggtcaggccctgtgaaaaagaatcatggaaaatttggggaaagcaaatatacagcccaatccatgggtgtactagggaagaaaagcatagtggtctgagggaaaataggtgtgatatgtgagctgttccccccccacccccacctcaatcacgtctggggggaacagccagcactacgtgaagttaaacaaggatgggcactatccttgaggcaaccagaaaataaataaataaagctttggggacaagtgacacttttccacctaagtggactgttttcagtgtgtatacgcgggttttactatcttatttttagggggaaaaaaaacaggtagctgctggccactgaccttcgcctgaccagggtgaacatcttaaatcaagagcgcgctacgacacagctgagcttagcgattttaatgagaaatctggtcctgctggactagtgttcctgggccacatcttgtcagcagttcctcaggaaa

SEQ ID NO: 33979 - DNA, 883 bp, Bovine  19866881336225
acctttcccattgtaattaataagtgtgtaagttttgagtggttatcttgatagtgtacatacatgaatgcctgtttaccaggcaggtgaaaatgttcttgaagaaaaagacactggtttcatgttctcagtattccttctcccaaagttctctataaggagtaggatctaatttatttctgttgggttttgttgtggcatcatccacctgccatagtgtctgtacccccctccacccctgctaccagatagtaccaacacactttccatgaaaacctctgaagttcatataaattttcattactctttctgcaggataatgacaatttcataggcagcacatcaaccttttacttatatctttttttctggatccactgttcagtcacagcctcctccaaacaaggcctgccaatacatctgtttttgagttcagatattacagaaaacagatactactccaaacatcaaccctacccaggattctcacagtcctagaaagccagcctgtacaattaaactagcttgataaacagatgagcttctatgggtgtttttattctaggtttcagatcctgaccatgctgatgtctttttctgtaacccttgaggcactcagttttctctgctggctcagggaagttgctttttctcaaaccatccaaatcacttttccttatgacactttctagaacctttacatctaacttctctctttgaggacctacttttcctctgaatatgcatattctctatttttttttttttttaagctggtccctattgccgcttctgattttgttttcttttttttttttttttaatttttttaaaattttactttatttaactttacaatattgtatggtttgccacatatcaa

SEQ ID NO: 33980 - DNA, 981 bp, Bovine  19866881389946
tatagtagaaagaagcagaataaatgaagaattagaagccgtaagtaatcatactggctgtgactcttactatgtaaattcagggaattcattcaatgtttgagtctcagtttcatcatttgtactatgactggattctattatatttcatccaagtttccctcagttctaacattttagaagctaaaatctgtctctcccatggctacacctgttcaggaacccagtgttcactgcagattatgacacctccaattttaggaaggctccaggtcacaccaagcctgcacgatggagcagcaaagggaactatttctagtccttctcatcggatgtgggtggagccacgcaaacaggcaaggaatcctggagttatattccaggcacatggatagaattatccctggtggggggtggggcaggggggaagagttagcattgtgctccattctatgacagacttacttatggggcttttagggacaccaacagaggatgcaagccctctaggggagagggatgaagacagcagatggggaagatgttgctaagtcacctgtgagtacagctctaccagtgtccccacctagggttcctgtaatccctgtgggtaaatctgtgcatctgcagtcctgatttataattagctacataagctactgggacagagcctgtgggtttctgattcaccgtgtatctccagcattcggaactatgtccagcattcggaactatgtccagcattgtgttcactgaaggagaaatgataacacaggatggcatcgaaaatatgagtgtaactggcacactgagcacatgctatctaaagcacttgtgaattttaagtagcacatttaaaacggtttcagatactaaaatgggagtggattgtgaaaggtataattgagagacaatataggaagaagtagaattgagttgccaaaataagaaaaaagaaaggaaatcaataaacaggaaagt

SEQ ID NO: 33981 - DNA, 1256 bp, Bovine  19866881441694
gtgtttgaaaaatcgtgtaatgaattgctccctgagttggaaaatttcattcagtctgttattcagaatatacatgagtttggtcaaatcattacacttttactcagagtatccccctaacctgtaagatttctacctgcttaaaaattgtctatgctcccaaactgtggtgaggtgtcaatcaaaactagtacatgtattttccagaaccttccagtgagctaagtctaagctcagaaattgatgaagactctgaagggatgagtaaatacctaatacacatttacacggaatcctgaagaagccttttatctatttgtaatcattgctttaaattagaaatctgagtcgctaatgagacttttcttctcctctcatttagtgaggtagaagtgcctgcaattctgcctcctacgtgactcttaaatctaattctctcttcagctctgtgccactgctttggttctggctctcatcatctttgacctaagccatttcaaccaagccacagttgcctaaattgtctgctttcttctacactgtcttttaatggacagctggcttccttacttatttttgcaaaacacaaatatgatgtctttctcctgtttaaaaaccctttatcatatccatcataaataaagtccacaatcttagggttgcagaaaaggtcttttatcatcatgtcccagtgcaacttaccgtttttatccttcatctttttttccctgaaacatctgactttgtgaccattcttattcttttttctccaacctttccccaaatgaactctgcctttgcatttgtccatatctttgtacaagttttctttctgctagtttgtgccattctcattttttacttcctggaaaaaccctacaaatccttcaatacctcgctcaaatgttgccttttcaggcacacttcctagccttctgcagatagtgacactgtcttctgcagtgttatagcatttcgtgtatgtttagcagtcatggcatttatcacgttttattggaactgtttattctgtcttctctaactagctgaacagtgggcacctagagggcttatttaccgtttcccccctccatttttgtgtctgccttcccctgtctaggatctagcatatctgatgctctgtttattcctattgaacaaagggaaatttgtcagttggaccatatttgctaatgtgatttcctctaagatagtgttgaggttactttgacattcaaaaaccttcaaaagataat

SEQ ID NO: 33982 - DNA, 2582 bp, Bovine  19866881508026
aaatgaaactgtaggctgaatgagtcctgaaatcccacccaaagtgaaacattctaaattagtgatagttgcctaaagtctatagtattattagatcacttttttgaattcacaattgtaaatcaaagaagtgtaattggagtttcctttttaaatatttgaagaccgtatttactatactgttcaaatattacatctattttaagaagggaattttaaagcattgtaagctaaatagaaatgaattcctattcaattcactcttgaaagggtgtactgtcatttaagacttttaaatgtattaagtaactttttaatattacaggactgttatagctaaagttttaaaatatttgcaccgttaattctcttggagtgaaaagtgcagtgatttttgtttttttgctttttgagactgggagtttggtttacttgctagccatttctgtctgctgaaaatgatgatgaaaaaaatcatcatcgggttgaaaattagatccagaaaagatgtgtttaaatagaaagagacttcttgtttttttttttttgcagtattgttgtttttgttctttccatttattattgaaaaacacttactgtataaaagtggtttttgaagaatgtgttagtgtattttcaggttgacatacttagaaaatacctgacttcattggcttcgttttatagctttatctgtagtaagtgaatagaaatattgtcgttatctgtagaaatttctctttagagaaactcaatgttaggagtattccaaatgctaacctacttcaatttttttttttctaagaatgttagattttgtgtatgtgagggtgattcttttaattctgaattgttatgctactatgacacattaattttgggggatgattaatagaaaataaattctttcaagcaccaagttctatacacttgacacttccaaacagccaatttttaatgctggatggatatataaaaatctcattttctaatggtggtcattttcttcagtgaagtgttatcgttcacacttggggagctatgatttataaataaatggaaagttattttcattaatttatttgcagcctaactactttgactgctaatgggaaacatcctttaaaaaaggacataaaaattgaactttcaaaatgagaccttgacagcattgggaatgggtttcagaactgtgaaacctttagttgatctaatggattcttaaatcttgtatgttgtcttattactggtatatgcatcagaaataaaaatctcagtaaacatatgcttttgcgcaataaatcaaatcatattatcagttcctaatatcacagatttcactggggaactcctaaccacatgagttttcaatctgattagaagcagtcatgtctgcattgctgaattgttgaaatctagagccttggatcttgggggagatggaagtttctttagaaccatctgagaagcttaacaatcacttaaaatacttggtgaattttgctcttttgtttggagtgtatggtttacactgtatcatcttgtcaagtcctagaggatgtcgcagccatgtctttccatttgatagaagttgacaaataacccaagttgttcatcttagatgagctttttagaggctctctggaacggagtggtttttatttgcaacgtgtgtcattagcacagtccttaaatggtcatgatggcaacggagctgcctttcttgtaggagctgaatcatcatggtggcttttataaaagcaggacagtgccttccgttattaaaataatgcactggatggggaaggaaatcgttgtatttgtgtatttttctatgtcagggagcattctcatcagtttcattctttacatttgaaaacatgaagtaatcacccagtcccttttctgttctgcagtgctcttctgaagaaatggatttggggaggttactgtgaatatgaatagttgcttaattgcaagaggaaacttgatccaggtggctgtagaagtagggtgtttttgagggctggctggacgagtttgaacttagatactcaccttttcagcgtggtaggttacttgattagtttaggattattttttttttccactggaaatgcagagttgtacttatataaaatcaaaagatttttttctgagccctctaaattttttagagttttcttgtatagataactcaactttgccgacccccagccccagactggaagattgtgaatcagttggcatggtgtaattttcccccttcttcagctgtaactctggaccctgcctctgactgacagatttttcatcatatgtaactgtgcatattacatatcaaagagctaccagtaagtttagcaatgtcagtaaatataaggcccaatatcagtaaatataaggccagtcacacagaggttacaagaaatttaaggtgttttttccttgtaactttccaagaggaatagctaatgcttaagctgagcaataattcacccccatgagttaaatattaatgacaaattaatggaaaatcttagggacaaaacaataagaaattaacatgaacaagctgtaat

SEQ ID NO: 33983 - DNA, 770 bp, Bovine  19866881750668
atcaccctgtacaagacagtcctatgttgggtgataaaaatttttattcccaggaggtattattttttgcatacatgtcattttgataaatatgacagtcagataccgcatggccctgagtcatcagccttacctgcaagtgcaaccaagtgtggcaggcaaaatctgtttgccaaggcaattagttccagtgggtccaggtccaagttaggtggcaagtgcttagtatagagataatccaggactgcctgcattgacatcttgtttatgtttgggagatatacctgaaatggcatttgaaaaggtaagttctgctgaagaaagcagtgggcacattttcaggctatactgcttgtaaatatccccgccatgtgattcattattagcaagtctgggacacgtgctctgaggctgtgaggagaagtcactcactatttacagctgtaaacgtaacagtttgatttgtggatgacaaaagagtggggctgcctgacaaagcctgatttggaatttttaaatagctatttgggcttataaatcagacaaatgggctgtaaatgtatgatgacattataggccctccttgccaagtaccctataatactctattgtggggaaagaaatctcctagcaacatgacaggtgttggggggagctgcagaccgcactgttgctgacacacaatagagcccagctttctaagatgtcaaaagaaggcgatgagcaaccagcctagttgccacaggacggcggattccaacgttctatca

SEQ ID NO: 33984 - DNA, 835 bp, Bovine  19866881966547
ccagctttccaacagcatttcatgcactgagatattgatgtgacacagttagaaattgggccctccggacctgtattgtgcaatggcattgtgctgttctcatcgggagattccattttttgcaacccccagggtcctgtctgtacttgtttacaggtcatctggatagcagctagtatatgttcaatggcatgagtgttagcacggtaaccttggcaaccgagctagctctgatttcaaaaccgcacatgctgtatcataaaattagataacagaattgacattttgctacatgtctgtcatataaattaagctctgagaatgatttcctttatagcagtgtgccttaatatggaaagagaaggtacgaattagaacaattttattacacacatatatatatactattccacatttatgcgctggatatagttcttcaattctttctttatgattttgaacctcagatattaccatattactctcactgtgctggaattcttggtggcttcattttatgattgggatgaagcttatagcagagctgtatccgatatcctatagaaatagtattatgactaatagaagactctgctcctaaaaaaatgtaaaattcaaagcgttcttgactttactggataccgttatttatgctgattacaagtaagactgtgcacagaatattctactaactaaatcagaatcccaaagacaagacatgcttccctttcatttatatagttatgcatatttttacacacattatattttccagtgcccaagaatctttgataagatctttatttcaaggacattttaaacatgcagattaata

SEQ ID NO: 33985 - DNA, 1268 bp, Bovine  19866882000877
ccctaccatatttccttagacgaattaataaaagacactgacagggaagacgtgggattgttttccagagggccttttgagtttccctgacacagaattttttccctccttctcccttccaagctcttcctcttttgtagaagcactttaggtcacagggccatgagtctgcagcaggtgaaactgaaagaaaatcactgagtcttcctttttattctttctctgacttcttcatttacataaattaaaacctattctaaactggcttcttccttggcatgaaaataagctcttcaagtgctcaggaaatgcccagtcacctcatcctgggactttggcttcctcaactttttgttcctcaacttctcatgcatgtctcttgaagactggtaataattttttttctgtaaaatatgaattggtaaccttggaaagtctgaactgcatccaaaaggaattcattactgagtgggggtgactttgactttcatgaaaatgagtgctccgaaatcatcagctttagaaaataattcattacacttttttttttttggtggtggtgcggtggataaagtgcctttcataaaagcacctcttgtatgagtatcctgtgtgacctacctcctatgaaaggaaatgttaggacagtcagctatttggaaacattgtacgtgcaagcttttatgctgactttcactgagaacgagatgaatgatgaatacttaaaaatttttccccacagttctgctgaaatcctagttaattgtttcagagtatccacctgagggaagccatatgcaatatgggtttgggggttggcgcttccaatgactgaccagctctgtagccagtgaggatgctgctccctccaatttttatcccagtcctcacttgtctcattatctgggtagattcactcatgtctgtctttctcttgagacaaaagaatacataccaccatcccaagtaatttgcaggttaacaaaagttatgagattttcccttaacttagaaaacttacataatagaacagagtatacatttcatatattaaagatgtagattttaaaattttaatattctatcatatctgctccagaaatctttcatattaaacacataaataaaataggaatgaagggaaaatccactttgtatgcctactcaatgggattctctgtccctccctagaggcacacactctcataaatctgggatatattctcccagcccatgtttttatatcttcactacccatctttaaacat

SEQ ID NO: 33986 - DNA, 1641 bp, Bovine  19866880469844
tgaaagcttatttaattaattattaaaaaaataattaatatatcaatgtcttctcttacctacattcttcatatggtctggatctttgctttcactcacttcagttcagttgctcagtggtgtccaaccctttgtgacgtcatgaactgcagcatgccaggcttccctgtccatcacaaactcccggagcttactcaaactcatgtctattgagtcggtgatgccatccaaccatctcactcaagaatgtttataatgtgtgaatatgaaacagtagtttctcaagaagtaaggtggttcaaaatctaaattaaactaattgtcaatcaacatgggtctcactatgaggactgtgagctccttaatggcaaaaatcctttgttactcatattaatttatttatacacaccaaaaggcccagcacaaagtgtggtttgtcagataaggaatgaagatgtgacagacactctttaggaacattttttaccatccaattgggaagaacaagataagaatgggagtatgaaatatgatacttaataactgacatgtgattattagcttttacagcaaaaattaaactgaaaatggaagaggtaaggataatgtcagaatttatagcttatgaaaaatatttatcttgtatatggataggtactaaagaatggagggaatcagtataagtattaaaataatgataaatgttagctcaaaatcaaatattaataattttataaaataagagattggcaaattaaggtcactcaatgtaaaatctagcatgccaaggcaaaactattattttgtgctaccttaaatactaataagagttttgagcaaacagataatggtttccagcagatttctttgccatcaaggacacttctatttcaaagaaactcagtgagtggctgaaacttaccaatattttgtcatttattttttcaccttttaatttatttcattagatgtgtctaaagatacataaattcatatatttgtatagaatattttcccagtacttcaagttatataactgtgaatattacaaattagaagtcacttttcaatcattctcatgattatacaacagatggctaaatgcttttaaagtcttaattattattttttgccaatttctcattccaatcttatctaaaacatcctgcatgtttctaaatgagcattttatggggagtgaaaaatatgtcattagactttgctacagttaattacaacaaatttgagatataattctgcaaaagcaccatcatttatttcttatttatatgttcttcaaagcattaacattttcttatcttaatcttcatgaaacattctggtatggttcctgtttagaataatatacaatattagcaatcagttggtccaagtttgtcattcatccaagaaatctgagctacaaaatcatgaagtaatatatgttcaaggtcatacattagtgagagggttaagatcacaactctagactgtttttgccattccaattattttacacttaaactatgttcagttcagttcagtttctcagtcgtgtccgactcttggtgaccccatggactgcagcataccaggctttccttgtctatcaccaacttccagagctcgctcaaactcacg

SEQ ID NO: 33987 - DNA, 1491 bp, Bovine  19866880484290
tgccgagtctgttatcaatttctctaagtgtatcaggggaattatgggtcgattcagttccaagttataaatgacaactcaaaagccgcagaagtgtttgaagctgggagctgatgacgacattatcataaaagcctgctcgtccttgcttttgtggtttttttcttttttcttttttttgtggcctatcaagtgaagagggaaaaataaggctgagaaatgacttcaagatttcttcacacagcagcaggtcagatggccaggaaaatgatcactatttttagtgatacaccctgaggagtgagaactaaagtggtccagcgctggctcttgtttccagagtcccttaattatctgtttcactgtatgatgaccaaggcctggggtttggtaaaatgctcttttcaattggtacattttcctgtagtgcaatcacacagtaatcagaagtgagtcatgctgtagtaacgaaacaaaatgagaaccaaacacaaaggaattctgagaccttgagatcgttgttcagaacatcattctggaggatacactttaaagcgccttagataccactcatgcattgagctacccgagcaaataatcgcatgccattttatgggaaaatcaaataagtagtagagatttttttaacttcataatgccccaggtagacccctcaaaaaccaattaatccatcagcattcagtaggtacaaattaaacccatctagtaggaaggtatatattctaggtaactgcagtttatcgtaacagttggggagtatcaagtgttttggaatttaaaccaatgggttcatcttagataatatgaaccagaagggtgccttaagacaaaagcaatttcagtgctttcaaagcctgcgagggtgcccccatgttgctgccaagctggcccactccaagttcatactggatatcttttgtatacttaagatgtctcagactgtcctggaggtaaaaaataatacaaatccataagactcagtttctcttaggacctatatcaaaaccaaagatctcaagagtccgagatggtctaagaagacaataaggttcctaaaagaaacaaaaacactgaatcaagctagctgtctagcatcaacaagtgtagatatacacaacacaacacatacatgcatacacactcacttagacctacataaacaccatcagaagacctatcggccaactttataaaaagaggtgcttctctcaagccctttccagcaacaatggagtcaaactaatctaatgttactcttcctgcttctgcttgtccaagctagatttctctaccgccctcactgccactatactgattacatcagtgctaatctatgacacccactgtgccaaagcagcagtctctgttcattccttgggcaccttaagagttgactagagcagttcttgctaaagaataagaagtgtcgggggcatgggtttagcatagctgagtagatgtactttgtgt

SEQ ID NO: 33988 - DNA, 1422 bp, Bovine  19866880526407
aaacagtattttaaaaggcacgaagtgtgccatcataagagaagtgaagggcaggaaaaataagataaggctagttgtcagtgattagacaaggagcaggaatgcagactaagaagacaaggctgcttttcccattgctcctagcctttccattggactggtttggataaatgtgctgtgggaacacagaggagggaacttccagaactgaaaagaaagaagagggatgtggcggtcactcaagcagttgtaagacaaatattcaagaacagtgaggaatgaacatgttttgggtgagtctctgtgtttgttggggtgggttatgagtgtggagctgggagaggcatccaggcattacctgttgaggctctcctaacacatcatatttttgacaaatgcactaagtagttgttgattagtaaggaatttttttcttcagggaaaaaaaaaaaaactaatgctgatgccaaaatttggatattcctggaattttgataatgatgcaggagcccccttcctcttaaacttacacatcatgtgttattcccacctaggtgtccccagcatgttcagtgccttttgttacatttgcagaaagaggcaagaatagcatctgtttctcacatgcaataatcaggataatgttgattttcctcacgttaatggtcaggtctaccctggcttgcaatcagtgtttcatttcctccgctgctgctatcaaagatgcatcacagtcctcttccctccagcacaacgagaggatccaccctgattcgaaatctctctttccccatctctctttctaattgtatttggattttcattagttttaaacttgatgcaaatgatactagcaggaacaccccaaggcacctgggaaaagtaaaacagataagaggccttcatgaaattgttttgagaattttgtttcatgttgtggattccacaaaaagatcatgttgccctagacttggaaaatatagtccaagatattatgcagccagggaattctttgtaaataacaaagaaagtttgcagtattgcatagatcgtgctaattatatatacccagttatagttgcaaggaagtagacagcaaccccctcccctgccggatagatatatacattactctgtgttgactgcaacctgtaaaatcctatagaatctttaattgcctgatgtccattgcagggaagaggaaaattggaaatgaaaaccttaacttcctccttaattcacttaactgtagtgttccctctgtgattaaattcttttgattgctttgacattatggaatgcattttgaaatttcattttcattttcttttttaaagtaaaaatgactgtaacaaaaactattaaagttcttctgttgtgaaaatgagatattttaaaaatgctatcatcaaagctttacac

SEQ ID NO: 33989 - DNA, 3626 bp, Bovine  19866880674209
ttccccccattgtgtgggcttcccccgtcaagccgtctgggtcgtggttgaagatgtctaacttgccctacatactttctctatactttaataacatctcgctggagtggaacattagggttgcacttcttttacagcttctgagcttttcctccattatcttctggcatggagtgctgggtaaatttgataagccttgagtttcacacattctctccccaccccctctctcttctattgcagatctttgctttacttgcctgaacccctgaagaattatttagcatttgaaattcaatagcccagttaggatatgactctgtgctgagcacttgcagcaaattttcctaaaagatgagaattctttcaatatgcagatttctttcttttttcccccttgtcagtgaaataatctttatttttagaaaataatcttctgtttcaatgttttagaatatcaacttcaggacataataactcttatggtacactgtcttattactgatttctctccaattgctttaatccattttcctttttcagtccctctgattgtctccagcctttcctcttagttggtaaaaattttcactggtatctattctgtttcctgctatttctaatgaatatttttgttctataattatcatgctttctttcattctaaatttgttttcctagacttaaaatatcctttttcatcccatattattggtttagcatcttatctttgagcttctgctttatggaatttatgttcttactaaggtgctctacttgcaggaagaaattattacataatttcatggtctcagtgaagttgatgtttttttcttagtaggatctatcatactagttttcggggaagaatatttcactgcaaaaagctatgggtctttttgtttccaattgacagtgttgctctgaagtcttcatttctctggagagggagcatttgttcaccttcctccatctcaccagtttctcttccagaatccttcatactattcctcagtcacacgaaaaaaacaccaccagcaccaaaagctgaggatatccactcagtttgcttctctccagttatgggaatgttagtgagaattttcaggaagctgtcaacttgtcagtaaaattctaaggaagaagagaattcaggccctgttaagtctctgagctctgatcaaagatccctgcttccatttttcctttgactgccagtttctgagatatgttgcattaggtcaaatcattttctttgcccagttaatgctaagtgttgtgtatggggcgtgggggtagacagtttatactattttaggattacttcattattaatcattggtgggacataatatagtacattttcaaatttctcatctcaaaaatcagctttttaaattcagagtttgggcttatcatagtcttctgagggatttattgaatttccttacttaaaggacacaacaacaattatgccacctgtgttacccacagaaaaatataatactcattctcgtccccattctcaacgggcctactcataaccagctttttgcttatcaaatatttcaattgataacaaccttgtaagtaaagataacctgagttagaggatgggaaaaatagtgattatggggaatgccagaagtgattcttgacatgacaggggcatttcacagacttacattttcataattagattctgctttccaagtagacataaatgactactgaatcttaaatgttcattttccctcgataatacacaccaaggagatgaaaggattctgaaagggggaagagacattttccttaaaagaaattcagaatttagatttcaatgtttttcttttataccctaaaataagaatacatagtgaaaacaggagttttccttattgtaaatgtgttttacaatgatgctgtacaaactctaggaaattctttcataataatcattccaatatcatctggatggctctgctgtccaacatattaagcaacaagcctggcaatagggcaacacctcgtattctgccagccactgctcagtgacctgagtcagtgcttatacatgcttcagcttctgccacttatcacttacattggcccacacagccacaaaagtggagactgacctggcaagatgtgtcactcataccgaactgcaagattcaatattataaaacatttttagtaaaaaaaaaaaaagaaaagaaaaaaacactagcagactacattgtagaacctaattctaccttagatgtttagcgtggctgggtcagaattaggaaaaaacggaaccataaaaagcacttgtaattcaatagtgtataaagagctctgaagtacagtcatcgatattaatgcatagtatccaacataactagaaaaacaaataggaactgtaaagcaatgactaacaagaaaacacagcttttcaaacaactaatctcaagaaatctgctgggatttcactgttaattccgcaacttctttgcctttgaatattatgtaataaaacatttcatagcatacagacacacatgcgcgcaagctactctgattaaaagtcaccatttgctcaaggagagaatttaattcttatcagaccaggaaaacaaaaccaaaccctgatttgtaaggtaactaaggaaaatttatcaaaataaaaagtcattcacccatgtgatgtacaatctatagcttatctggctcattcggcgagatagatcttggtactgaagaaccagaaacccaagctcattcactaaaagtattaataaaaaatagtgagaacacacattaacaacatgttacctttgaccttcacaggaatgccaagaggtaagcaggaggacatctttattctttagtttacaagtgagtaaaccagtttcacaatttagcagcagagctctggctagaacacagagctctcagctcctagaatagtattccttccaccttgcactgctacagtgtatctttttttctttcagatccaaaaactccatcaatttctaaccctttcagtcacatctatgccactggtccaaagaggaacaagatttgtagctaaatgtaaacaaaaacacccctaatgtagcaattaaaaggcaagccctaccaatatgggtcaccagcatcactatcacttcccctttcccctgtatcagtgataaccaaagtttgctgcatattagaattactcaggatttaaaaaaccccagtgtccaggctgtttctcataccatttaaatagaaacactaagaggcggacccccagacaccagcattttgtaaaatactcttagtgacaccacctttgagagtcactgcctcagcagcacacaagactaggggaattaaacttaagggcatataataatatgctaataaacaaaaccaaaagttacaggacatggtaggaagaacgcaaatgtcttcatgtttcaaatttaaaaataaagagaactttgagtttccttatgtataccagacaggtttggggagtgtttgtcaattgacatcacgtttcatttattggtgcttacatgtttcttcctgtaaaactgacaacagcacagacagtctcaagcgggtccctgcttgaaaatactggt

SEQ ID NO: 33990 - DNA, 2226 bp, Bovine  19866880702126
ccctccccgtaccatccctctgggtcgtcccagtgcaccagccccaagcatccagtatcgtgcatcaaacctggactggcaactcgtttcatatctttgaagtcaccaaaggactgaagcaaaggtagtgactcttaagtggcaaatagagtagaatgaaagtcagatagccattacagggctatctcaggagttcagattaaagataatagtaccttggattgtatggtttcagcattggagataagagagttagtatgcatcttccagggaaaaatagacattacttgttggtttattggagagagagtgtcaaaaggacagtaagatttcttacgtgagcagtggtggtgatatccttcactgaaatgagaaacggtatgtgaagcttaagattatgagctcaaatacgatatttctattttatgaaaactaggagacatccaaatggagattttagatgggcgatttagatgagtgttcaagtgtataccgctcaggagggagatcagccctgaagatgaaaatatgagatttgggggcgtgtggagggattctgaagccatttgtgtcttaagaatcaatattacatacttagagggcatcacaagtcagacaaagataaatactttataaactaaaatctgtatagtcagatctggaatctaagaaataaaacaaagcgaaatgacagcgtactcaattgtgtagatgccagagggaaggcggctagagagctgggccaaataggtgaaggggattaagagatacaggcctccagttgtaaaataaataagccatggcgacgtaataacaaggtacaagggatatagtaaaagaactgtagcagggacttccctggcggtccagtggttaagactatgcttgcactctgcggggcacagctttgatccctgattggagaactagggtcccacatgccgtgtggtttggtcaaacaaaaaaattgtaacagctttgtatgggcacagatgtttactagacttactgtggtgatcattttgcagtgtatgaaaatgtcaaatcactatgtagtacacctgatttaatgtaatattgtatatgtcagctatatttcaattaatagaaagaagtggatattatttggaccagtgaaatagttttttcttagacataatttttgccacatggtttcaaaatacacatgtcattctgcatgattttaatacactgagggacacatattttcccctcttgaataacatccttctaacacaataatgtaagggggaataaaatgcattaattgaacctactttataacactaattgcttgtacttatctgttcttgaatagatatttagaaagttattataatggactcttctgcattctatgcccccagagaatgtattttgatggtaatttattggaatatttcattggttaaataatttcttacatcaggcagttttgtaaataacatgttttccccccaaggaatagggttaagggtggaaatcttcttataataattatcatctaatttgtttctttaaagagccctaccttgtatatgcctaatagttcatttcatcaaatgtgtatgaaatctttcacatcagaggctctgaaacatgaaatgtgttaactcatgataatttaaatgcagattttgttgtgtctatgtgatttctactaaagatattgctactgacttattttttttaagaaacacttcaaatgttccacaatattttaaaaactatcagttaagttcagtcgcctcagtcgtgtccaactctttgcaaccccatgaattgcagcatgccaggcctccctgtctatcaccaactcccggagtttactcaaactcacgtccatcgagtcggtgatgccgtccagccatctcaccctctgtcgtccccttcttctcctgcccccaatccctcccagcatcagagtcttttccaatgagtcaactcttcgcatgaggtggccaaagtactggagttgcagctttagcatcattaaaaactatagtatctgtattacttatagattgacataaattatgagagaagcacagtaagcagaaaagaaactctttctgcacaacttggaaggaattaataagcatatgaataggcaagtagttggaaacccagtcttgttacagatataacagacctaaactatggcaagacttactcgtaaataaaatcacacttaaagagctcatt

SEQ ID NO: 33991 - DNA, 2046 bp, Bovine  19866880880038
agtttccctctccttttgaactcctggaatcaacatcagtcaaagcactcacatggtccaattccccagatagttttcttccccctattttcttacctcatagtcatgtccaactattgtttttctccttcaataaaagcatctctgactagattaacagcgcagagtgaaaaggaaaggtcgaggtccttcccttggtcttcaagttatgaaagcagtactgggaacatttatgaatgttacacattaatccactgaaatggtcatttagtttcttttccaaacacaggatttcatcacatctaataataaagcaacaagccattttctgtatattttaaaccatggacttgtaattatatgaaaagcttctatatgaattctctgtgatgatgtaagctggtattgcagcataaatgggtttttttgaagctcaatacatacctacaaggatctatttacactgggctaatcatgtcgaaatagcatctatttgagagtaaagtcaaagtttcttttataaacctctatagatagataaataatctaggaggctttttatagttataaaattaaggctgcttttcaatgcctgctaaagtttttggacatactatccatctaatgggcaaaatgtaatcctaaattggtgattaaagactctgcataaaaacaagctgtcatgtggatagagagaaattaaacctgacaacagtaatgctgactttcctaaatgaaagcccagttcaagtttctactcatccatttttcaaaacttaaaaaaaggcattttccaaccactcatagatgagatgccaacatttgcatttcagttgaacctgatgaagtcagttgatttttcagctttaggcttgctcagaactcctgtcagaaaatgtctgcccatctaaaaaacatagcaatgttacaacacaggaggaaggaatgaagcatgcctggctgtagtatttctctactgtaactggttctctactgcattcacaccccaccactggaaacccaagagaacatctggaaggaccaccattgggtccatataaagacacttccaagggagtaattggatggagggcaatgcgtagagaactaggaatcaaggtcaggaaatgggatttcttcatcctggcaaatccaaaccaatacctaaaaaataagatgaccttccttttttgttggtttgtttgccatgtttttcattgtaagtttcctactttgggcaaaaataaaattaggaaaaccttgtctccttggtgataaaaaacaacactgaaaatcactggcccaagtttaggttaaggacaggatttttttgtcagacaacctatgctggcatcccagctctgtccactactaatctggtcatcttgatcaacttagttacaaaagaactaagaagaaaataaactttcttcatagtaaaaaaaaaaagtgtattatagtttgaggagatgatacacataagaatgctggcatggtgtcccagctcatggaagagcctatacagagaagagagctggcactacttaaaggaacctatccctaaagatcctttgggaactttctggagagatgcaagttgtgtaaaagattgggaggaaaagacacactaggagaaacaggtgtagcaaaaaagcaaaaattggtacatggtccttatgtaattattcgcaaaattttcatcttacaagtaaggcatggatagaattcacgttattaaaataaactaatatgaaaaaaaattaaaaataaaaacaataaaataaaatgaactaatatgatgtgtgacttcaaaatatgtaaacttttgggattgtaaatgtctacgtaattgctcaaaatttagacatgtttttagggacactttataagaagaaacatatgcacacacacaaaaccatgctatgtgtgtatgtgactacaggcacgaaagaatattctcctctagcctgttctggatggattactggggacaagaaatgagtatgaatcatgaggagttaaggagaaaatgtaacatctatgcta

SEQ ID NO: 33992 - DNA, 1697 bp, Bovine  19866880925512
cccttatggcagaaagtgaagaggaactcaaaagcctcctgatgaaagtgaaagaggagagtgaaaaagttggcttaaagctcaacattcagaaaacgaagatcatggcatctggccccatcacttcatgggaaatagatggggaaacagtgaaaacaatgtctgactttattttttggggctccaaaatcactgcagatggtgactgtagccatgaaattaaaagacactcactccttggaaggacagttatgaccaacctgagagagtatattaaaaagcagagacattactttgccaacaaaggtctgtctagtcaaggctatggttttcccagtggtcatgtatggatgtgagagttggactgtgaagaaagctgagtgctgaagaattgatgcttttgaactttgttgttggagaagactcttgagagtcccttggactgcaaggagatccaaccagtccattctaaaagagaccagtcctaggtgttcattggaaggactgatgctgaagctgaaactccaatactttggtcacctcacgcaaagagttgactcattggaaaagaccctgatgctgggagggattgggggcaggaggagaaggggacgacagaggatgagatggctggatggcatcaccaactcaatgcacatgagtttgggtagactccaggagttggtgatggacagggaggtctggtgtgctgcgagtcatggggtcgcagagagtcggacatgactgagcgactgaactgaactgaactgaaccatgggaccactagggaattccctaactcttctttccctactccttttctttctggataaaaactcgaggagaacaggttattagatgatgagggagctatggaaggagataatgtattgggggggaggagatataaactctttttttgtaacatttaaagaagcaattggttgtagcatgtgaaatctccattgataagcttgggcatgagcagtgagatcagattttttgctttgcttaagagagaagtatatccacaataatgaataggtgtgaactgattcattaaatatgaagtataggctttgtaacagaagggtaactttgccactcataagtcatttattattcttttctttaagtctgcagccctgcagatctttgtagaataagaatgcatccctatatttagggacagtggataaaatattttcagaaaatgagatatatcaatggaaattcttgcctaatatgtcactgctttgaaaatgattaaagaaaatggggtctccccccagcagaggcaggtactttgacttgtcaaatataagttggacattttctcttagtttggaactgccacaaaatgagccctttcatgtcctcagtaataccaaaccaatgcaatccatctgttctgctaaattatttctagttccctaaccaaaggcactgctttttcatgcattttatcatgattttatgccctttattatattttacaaaaggttctgattcctccagggccaatgagaactgattaggacactggcctcaatccaggctttgaacacaggaggggaaggaatagaactgtttccttttctccctgctccttggcaaaaaaaaaaaaaaagaatctataccgtgtgtgcactctgtgtgtgggtgggtgtgggtaggctgcattttttcctgttgca

SEQ ID NO: 33993 - DNA, 1825 bp, Bovine  19866881131067
tgcatttctaagaactccaagtgtgttataaattagagacttctaccatctgatattatttttaatgttataaaatattatatacatggcttccttggaggctcattcagtgaagtatctgcctgcagtgcaggagacccagctttgatccctgggtcgggacgatcccttggagaaggacttggcaacccactccagtattcttgcctggagaatcccatgggcagagaagcctggcaggctacagtccatggggtcacaagagtcaggtacaacttagtgaataagtcactaccattatgtacataaaaatatgtaacataaaccactactgttgcacttttcttgtgctttttgtataaattttattaatgaatgcacaaaaaagagtaaacagcattttataaaagtaaatccaaaatactacttcatgctttgttttgatgataatgttctctagcaacagagcaaccatatattttaatgacctaattttaataataccagtttgcactaagactaactgccaaactgtactaagtgtcagaaatttgaagcttctactttggaagtcagagcactccttgcagttgagtgttgtgaatcttttaagtgtgaggaccacacactccttccgtttagtcggagaacctgaactgtggtcgctacttcctactcactgacggctactgctgcctgcctaataattgtttttggctccctgtaaacctgcagccagagaggtatttgaattttccccctctagcacttgcaaatccgatttttatgtatagctaagtgctcttagcttttactctatctactgctggggcctggtttctagcaagcctgtaactacgccagatccggcctatgtaatgccgtttgtaatgagaaatctaaacagggaatggcagtgaggcatggcaggaatgtgtttccattggagaagtcagtgtagagaaaaagtataagcaaagccgtgtccagaaggcccattcagctggccaagacggaagactgatgttattgtacataggctgttgctgtgccagcccttcctcacgaatctgcttgctctctctctctcccctctcctgaactcccctcctccccctcctcttgcctctattccttctcctcctctccctctcttccgagggctctgctgactgtttgctcaggtggacagtgacaccatttggaatgagctgcactcgtccggcgctgcacgcatggctgttggctgtgtcatcgagctggcttccagagtggcctccggagagctgaaggtgaggtctgggttgcattaagtgtgggaaatccagggaagacgctgaaacagagatgttgttgtttgggaattgtggggagtgtggtgcagtaataaaaggcaaggggcggagggaaggggcagagggatggccactgaggtgtgataataactggtctgtaggtagctggtagctgatccggctctcagggccttcctctccttggggagactctgtggttagggcactctggtgtatttttaagagcacagaaatggtgagtaaagctatggtccaggtcaaaaacacccaagtctatacatatctgtcatgccctcctgggattttcttttgaagcaacataaaagaaaaatctgattactgagtactgtgtataagctcagaataccacccagagagacgagtggtgggggcagggagaaaggtaaatatcagaggggaaggattgagaggaagaaggaaattgttgattagaagggtaatgatccagagtgtgttttgccatgaaagaacttcaaaaatgaactact

SEQ ID NO: 33994 - DNA, 860 bp, Bovine  19866881170732
ctgcaggcggtccatggccattctgaatttgtagcacacacatacaggctcacactggagattttacagaccagacagcatgatcatttatccaaatctctaataccttcaagtattacaacttgattccttaattcttatcaatccctgccagggtaataaatatagcaagtccataatttcaatgttttatgttccatgttgaaaactatatattctattagcaaatggtgtaaaattcgttaaataatatttaaagactgtgctgctaatctttacaccttaacccatttaattcaatgtgtaagttacattgtttgatataagtctagaagctaacataagcatagcgcttttgaataaaatatctttaaaaatttttttatttttaaatttagccacagaaatccctcatgtccccacaaatattttcagaaatgaatatcaaactaagcacagaagtatataaggagtaaatctgttttggatagacatttgattttctgaaattgtcagcaaatcattcagcacaagtgtttgaattaaactatgcaaaatgacctttgatcctactcatcactttcttattttgcctcagattttaagacagattttcttggggaatggcaaaaggacaagcattttttttttcttttaaatacatgtacaatacttctttcggaaaataaaacctttctcttaagctccaaggaaactagatttaaaaataatgataaaattctgtctcaactcacaaatagattaggttatgtaccaactgttctcagaaacaacatgcagagtttggagggctttcaaatcgagaggcctacttagagaagaactcgactcaagacaaa

SEQ ID NO: 33995 - DNA, 731 bp, Bovine  19866881225737
ctggagcactggagacagtttagtattgcgtatcattgtactgaagcccaaataaaacttttcctaaaaggttaaaaattattttaggcttaataactgggaagtttatttctaaaatattttaacatattgtttaagtaaaaggtatattagaaaagtaaaatttattcagattgctaaactcatgactacacaatagtgattaaaagctggaaataaaatggtctgtaattcgggagtttcaagcaggagaaacaatgcactctttatatgtcctctaatacattcacagagctgtgggtgtccaatatttaatttttaaaataaaattcttgagataagtcaatgaaagattatataaaatatgaagaaattttatttaaatgtgtattttatattaatttataacagagtctcaaatctctaaatattgaaaatgacactcagatacttttgtttaataaaataaactacaagtgaaattagatatcacctaaaattgctattaagaacttgaaatatatgataacatagtaataaggcaataataattatatcatcaatagtaataatgaattctcctagtcaaagaacttaatgaatggtggtcattttggtattacaacagcagaggtctaataccttaaaattatgtggcatggtttcttttcaaaactcatggtttcatctttcaaaattgctgcatgccaggggaagcaaagcatttttca

SEQ ID NO: 33996 - DNA, 4614 bp, Bovine  19866881323151
actggatttgcctttgtgaagtattctgccagaaagtttagtagaagtgtttaagattctcaaataatacatagtgtttctttcagaattcaaaactaaaataaattattttactgaatgcttaagccctagaagacagttcacagcagagtccttaggatgtaatcattctaaccccccaagtagaatccatagctcctgactcctagccagcagcatcattatcactgtgtcatggtttatttttaaatataaaataataagtaaaacaaagtacttaaaatacaaagtgacgactcaccttagcaatgaagcaaacattgcatcaccgtttttatcagtgctaataaggctattgaaagactaatgcgtttgtgaatgatatgcatccaaaatcatttggtttatgtataatgttatccctctgtatgacagtctgtaggtccatccacatttctacagatgacccagttcattcctttttatggctaagcaatatccctttgtgcatatggactgcatcttcttcatccagccctctgctgatggacgtttgggttgtctccatgtcctggtaattgtaaatagtgctgcagggaatctcgggtgcatgtgtcgttttgaattatgtttttttctgggtgtatgtctagtagtggaatttctgggtcacacggtagttctgtttttagttttttagggcccctccatactattctcaattgtgtctctgacaatttacattcccactgccagtgtaagagggttcccttttctctacaccctctccagtacttattctttgtgggttctgggctaatgaccaccctaagcagtatgaggtgatatctcattgtagttttgatttgcatttcttttttttagtgagattaagcatccttttctgtgttggtctgtatgtcatcctttcatctgtatgtctccttggagaaatgtgtatttagatcttctgctcattgtttcaatgggttgttttgttttcttgatattgagctgtatgatctatttgtatattttagagattattcctttgtcagttgcttcatttgaaagtattttctcccatcccaacagttgtcttttcattttgcatgtgatttcctttgctgtgcaaaaacttttaagtttaattagggttagctaaataatatgatttctatggtctctaattaatatttactgtggatacattgttatcttttataacaatcggtaaacacttctcaaagtgattctataccattctgaagtgtgatccttcagcctcaggagacttactactgtgtacctgcggcatttttgtattctatagagaaggaaaccgaagcccagagacggggggtaacctttttaggtcactctgttactagatggtaaagtacaaatctcctgattccaagctcttaaccacgggttctgtgtacacacacctcactgtaattccaaacgcctatgattgtcagcactcctttcccaaatgagaatatccctaaccataagaaaagcaaaattgtttcttttgccaagaacattctattcttattgaagttcctataaagtattaaacccatgaactcaaatgtcattaatttggggtaaacagtcatgtagctgtatacagcatttcaaccctaactagaatgctgaagaatctgcacttggagcagaccactgtggagcaggttagagagaatctcattttacatactggtctgagtcagggttcgttttatgaagttgctttgggtagaaacaggactctgacattcattgattggtgaaaaaaaggccagctgattatttaataccctttacacagtatgtacatcagattaaatgaaagggcagtaggaaaatacagaaatgacgttattcacctctctcagtcttggtaggactgaccagcatgttgctgaaattgtgcatagcaacaatgggaactctcacattccttcactgaccacataacccacaggaatccatatattatttatcacatcctttagtccaccagtatcttaactgaagatcctgagtctcaagaggtagcactttgccacaacaaacatgttaccctgcttattattggcatgtaaatagcaaagagagattttttctgacaatgaagagtgactaaaaattgcacctctaaggtcattagagctgtcagaaagcagttgttatactgggagggggttcgtagcagagcattaatgtgcacagcctgccccgggatctccttcagctgctgcattgatagttcacgccttctttccatatggaatagtggtcacagtattcattcatcacatccatggttttccttggaatctgaaggtcctccacatagctgttctatttctttttcatctcaccatgactaaagaagctaaggtgtgggcattataatctataagggaccccgagggaatgggctgtcactcacgtgttcctcccagcattgaacaaaaggtataaagcatgcggggtcatccacccattgttatcataaatccatctccgctgcatttcaaaggtctcaaggtttcagcagaacatgtaacatgaaattaatatgtacctttgaagagctggcatgttgtatcacacaggagaagggaaaacacccatcactacaggctgcagagccaaatgaggaagagtccaataaagaatgtggctgttctttaacccagaaatatgtcccttatcgtgatcctataggaggagaaaagcaggggtcacccaaatttatcatggacttttaagaggttctgaaatgttgctgtctaagtgactgtagaactgtccctgagagggtttatgattttagggaatgtgtccttatgcccagtcctagagtcagagaaaccaacaatagatgtctctgtgaataattacttcattcatgtgagtctcagtttatctgtaaaataggaataatgaagcctttctcatcatgttattgagaagatgaaatataatagtgaagattatcagtgacagctgtgactagagagtggccacttccccgctttgacgaggaattatttgacagccctaattagttctggttttgcagggaataaatagctgttggctgtgtcaagggtgtgatataaatgcttcttcaaagctctgaagccctgaggtctcataggatgcacctaaccaactgatggtctaccattagattcctggctctgtagggagactagtaagggaggggaggccattgtctgttttttttttttcttttttaatatgtttattttaattggaggtgaattactttataatattgtggtggtttatgccatacattgacatgaatccattgtttttcaggagcccctgtgacaagcacataggcagataaccttggtttagaaattgaaatttttggatttaaatctccacactgtcccaacctgaaagtgtttctctgactctgagatatagattctggttcagcagaactgaatgtagcctgagattctgcatttttcacaaacactcatgtgatgtcagtgctgctgacccatggaccacagtttgagtgataagatccatgactggatgaatcattttatttttctgtgcttcagtttctttacttttttttaagtagaggcagttaatgaaatttgctttatctttttccttggggacaaatatgacatactcggcgatctgattgatgaaggcttcaagaagcagtgtgtattcttggggcttcccaggcggctcagtggtaaataatctgcatcccagtacagaaggcacaagagatgcgggtgtagtccctgtttggggaagatcccctggaggaggaaatggcagcgcactccagtattcttaccggggggatcccatggacagaggagcctgatgggttatgttccatggggtctcaaagagttggacacaacttagcaactaaatagcaacaagccctgtattcgtggcacttaatactagcttttctggtgtattgttaagagagctacaggagaaacaataaagacaatcttttagagtttatgtctgtatcagtccactgagaataaactgagttatgttgtaaaatgtttaacaaggtgcccaacacttatctggtgcccctactgccccatgtgtctctctttagatgctgaccaaagatacttagtttttgctttctttgaataatatattttattttactatgtcttgcaccgaatctactaagaatttaggtttttctctctgaatctttcctcctcccacccctgctatcagtattcccagaaacaaaatatctactgggattttcagttctagttgtaagtgtggaggcttaatgatagaaaaatgcaaaatttttcaaatatctcttaagtggataaaagtaattattctattcccaaaatgaacaaataaggaatttagtttgcaaatgctattgtatgtaaggtagagttttaaactaattaaactatgtattaatagataaagctaaaatgtcttggaaattaaatcatgccttaaaacaatttcagtgactttaaaatatttgataacttctaactttccaaggtgctattagcagaa

SEQ ID NO: 33997 - DNA, 1126 bp, Bovine  19866881558283
cagtgatctaaaacatggttatgttattgaaaaaatagcacggcctctaactgccaaagtttgtgttactatttttaatgcacaaatacatatttagccttaaggctaaatataagaaatataagaaaagacataaaatggagcagaaaataagttcacaggtggattagatccaatctctggttgatttcttttcccctcccccgcaaaacatatctagatccttggccccattcatctggccaattcagtttattctttacatctcacattaaatgtgatttgcttaaagaaagttccctcaacctctaaatcatattcttctttaaagttttctgtgatactcttttttcccatatagcactcatatttataattgcattatacttagaaatatttagtatctgtctcctcactagacgataaacattaaaaaggctcaacacaccagcaacgtgtctggctcagggtatgagctcaataactagttactgcatgcagtaactctaatacataaaagatgatggcagggaaagagagaaatagagtggagaggaaaagcatgtataacatgtgagtttaaaaggtttgcgataagatttgacatggactgtagaggaggtgaaccgttgctgaatgtgaagcctcatggacacacccagagcaggtgacacagaaaagattggaagcacggacgatcagggccaatatgtccattagacacagcagacactgtgcccagaacccactatattctaaggtacccacaaaatattttaaatgttagtttttatcagaagaaaaaatagatattataataatgattccaatgtatgctgatcttagcataaaaggcaatgtttagtattttttatagaggaaagagcccatgaaagaatacaaccctgaggatggtatttgttaaacagtaggtaggaatttgagctagaacctgaagaaggaatagaagagctaacattgaaattcagattggtgtcaggtcagggagaacctgggcttcccagggggcacgaatggtaaagaacccacctcccaatgcaggaggcgtaagagacatgggttcgatccctgggtcagaaagaccccctagaggaggacatggcaa

SEQ ID NO: 33998 - DNA, 1597 bp, Bovine  19866880445234
gtaaattttgtacagcatatttagctttctgtatgcctttgtgaatttgtcatagaaatcctggatgtctatcagtaagagaattacatcttgaacataactggattaaatggatctgtgatacactccacatgaatactgcagagctctcttgagggaggagggttcaggatggggaacacatgtatacctgtggcggattcatttcgatatttggcaaaaccaatacaatattgtaaagtttaaaaataaaataaaatttaaaaaattaaaaaaaaagaaagaaaatacaatttccaatgccacttatatttgataaatggaagcccacggcatcgctcacagaactacttgattcaaatctgcaatatgttcatgctctgtactagcaagaacttgtatgatgtattaaggtcttattttatacactagtattgatttgttataattatacttgaagttcatgattatactggattttggagacacatatctaaacacatagatacacacaaatattgaaaacaacaaaaccaggaaatctagcatcagattggatattgaatggaatgaaagttgaacacaagtaagagcatcaagaaaaatcaaaataatttcacattatataaaaaataatgtgagaacaaacattaaaatgtgatggaatttttatctttttaattaaaaattactgtattgacaaaaaataaaaaataaattagtatttattaactactttttaattttttaagtataggttacttttgcccccagggcttacaaaacacaaagaataagaaatattttcaggtccctgggaaagactatgtgcttataaattgtgcatttctttaagcttatgaaactctgaatgtaaatattttaatatattctcttatttatttttaacaaagctgctgtttttgtggactctggactatacatccacaagtctgaggcagaaggcacaattttgtgatattctgctcaagttgtagttgaaagaaggaaagcagtaataaagagcaggttagaggaagaaccacatactgagaatggctagataagcttccaggggaaatattttaagcaaatggtacccaagacaggttacatgtttatttatgggacaaacttcttcatctcccattatgctctgaagtgaaagaatgctgatcatgcttcagtccctggaactatatgcatttaaattaaaaatatagaaaagtacagtatacactgagggtgggatctattgactgtgtcagcaatagcagcgttttcatttttccttttgtaatagaagtcattgtgtgtgttcgggatagattcttggtctttattaatctcagccatgaaagcatctgagattttaaaagctattgattttttaaaaagagactgtagttctgttctgtggtatcctcaacttctatttcaaatctgtcataaacgggtcttcattacagatggtccagcacttgctgatgcattttaggtaccttctttattccgttttgaaaaatttggatacttgtttaattttaaacaataaaaaatcattttgctttgactgatgactttctttccccactct

SEQ ID NO: 33999 - DNA, 2265 bp, Bovine  19866880460816
aaccatctcatcctctgtcatccccttctcctccttccctcaatctttcccagcatcagggtcttttcaaacaagtcagctcttcgcatcaggtggccaaaatattgtagcttcaatatcagtccttccagtgaatatccaggactgatctcctttaggatggactgactggatctccttgcagtccaagggactctcagagtcttctccaacaccacagttcaaaagcatcaattcttctgcgctcagctttctttatagtccaactctcacatccatacatgaccactggaaaaaccatagccttgactagatggacctttgttgataatgcattgggttctgccttcacccatgctccccaaaacttggttttataaaatttataacatgagtgtggttccctgccttcatgcagcatctaatcacatatacatatgggatgtaaaagaacatatgatgggtagtaaagatggaaccagtaacaaaaacctcatatgatcaaagaaatgaaattctctgtatactactctagagaaagaattgctttaacatggatagattttggatgggtggtaaaggatgatggatgatggtgaatacacaaaacaagtgaatttgtttgaagtggattattctcagaatttagtgagaaacaaggttgggatcagacaacaggaatccctacaaagcaaactcatgtgtgcatgctcagttgctaagtcatgtccaactcttttgcaaccccctggactgtagcccaccaggctcctctgtccatggtatttcccaggcaagtatactggagtgggttgccatttcctcctccaggggatcttctcgctccaggattaagctcacatctcctgcactgcaggcggatactttatcactcgctacctgggaagcgcaaaagcaagctcagatgaattttaatctctgtgggaagctagaaattgatttttgagtttcatgattagaaagggaaaataacagaagacaatagtgttatctagggaaactagagttggggacctagatctttatgaggtttcatggtataattcagttacagttagggaaacaaaattatcttttccagaatataagagataactcttttgtagttagaaaggtagtcttttttgatctaattattcatagataaggtgaaagcagaaaaaacaaaaacacaccatttaaagaatgaaattatattttaaaaatttatctttaggcctggatttttagaagtatttcattgtatgatcactttaaaaatatttttaaatcgaactagattatagtaagatcttagagtttttaacacaccaggattctaatgaaaatgacagtactaaaataggaatgagtgacagttagagaagttttgaatgacacataatttttgaagatctctgcatcctaattggagtgggagaaatcagaggaatgacatagatgttacttcaaaaaataaacttttttaacagtaatgttctatttcttactctgggtgctgatttattattatgtaaactgtgaatatatatttttcaaactttaaatctatggtgcattttaaaatttaacataatttaaaaattatgttagaaatatttcaaattggtctttttagaacatatttaccaacatatatttgtcaaatgatctgttctttatggggaaagtcatcattatgttccttgttctatagataggctatgctttggcagcaggttctccctttcttttactctgaatctagaagtgggactgcagttctccagctcccaggttagcacagtggtcctgtgaggtgggcagctgaagaaaacatctggacaataacagctgttacaattctacattttatccgggtcagtgtttttaattgttctgaattggtaacaaccagctgcctcagaagtttctctcctcattcctgagggcaatgggctggtttgtcagtcagagagttatcactgtttgaattttgtaaatgcaccattttttcttcaaaatgttgttagtccaaaacccctgtcaaaataccaacatcccccaaagaacctcaatggtttactttcattttctacacacagctgtctaaaatgccattttttaaattaagtacttaaagtggattatattgttaacatctctttagggcattttctatcacgataaacagtgctttagtgaatgttcctggcttccccttccctcctactcttctccccaaactaaccccaaaggcctgga

SEQ ID NO: 34000 - DNA, 783 bp, Bovine  19866880483996
cttccctggcagtccagatggtaagattctgtgttttcacttcagggggcacaggttcaatccctgattggggaattaagattctgcaggccaagcacatagacaaaaataaaaataataaaagagaattatatttctgtattaaaaatgatagtgaccacagcatgaggagcctataatagtagtgataatatcaacagtagtgataatacaatagtagtgataatattcatctcttggttagttttaaagaagaaaacaccgtgaaagattagttttggatctaatatggtcactggctaaatactatgctagctaaagcaaatatttctgcaacaggccaaggttaaaggtgaacttaatattaatttgggtttttcttttaagtaagtggaaagtatttcctatcattaggtctaatttataaatcaccttaagaaatttttaaaaattcagagtggaaatacattctataatagttgaataaatgcacaattcacatgaagcactggtaataaaaatagattcctatgaaaataaatagctgttttaaaaagtttacctagagaagcccagcactgaagcccttaaataatccatttgccagattgattagagaccaccacaaattttatcttggtttcatagctccaggttaatttctttcagttaccagttcatctcagatcaatcattgctctgggtaggtcagagctgtctggaaaagagaaattctgcctcatagtttcagcactatgcttcctcaggctacacagattacgg

SEQ ID NO: 34001 - DNA, 1617 bp, Bovine  19866880514774
ttcagagagggtggtgggaccaggaaccagaaatctctccctggtgacgttggttgcatctgtgcagctatcagcatttcctcctacacctctatcctaacaaatacagtttttgatgtgggtgtaaacctaatttccctgtgcataatgttagtgcctctggagtgtgcagagctggctggaatctgtactaagtggtttgggaatcaggctttccttgtcattatttgcacagtctgtagtattcagctgccaacccatgccacattatttgtgtgatgcttggtgacagtctgtgttgacttttagctatgattcttgacataatttaatgagctagaatgccattttcccctggaagaaatatgcacatattttcaatgccaatgaaaagttgtttattttacacatatattatttttctgcatccaggattttgactcttgaaatgtattaacatgatacattcagtatataaaaatgtactatttcccacttgcatttaaaagaggtttggtcttcagcataattgagggaggaaaatgtacccccttgcttgtactaagcttgcttcttttctccccttcctaattagcttttaacaagctgtcaatcttccactctatacgttgcatttgtagggaaaggacaggatgtgttgcaagctcccgtgaaagtagactgcattccttaagggaggcagctccaggctgtcagggtgggtcttaacgccacaactttgagtcaaatacagtctgacttttcctggtgccataaaccaatgctgagcacttatatttatgtgtctgtgtcatctgtctccttctttagagatggcatcggcttcttctgcacagacccacttccatataacaggaaaaatctcagtcagtgttttatttccttcattaaattatttaaaataacatctactgttttagtggtagaaaggttagttgctcagtcttgtctgcttctttgtgactccatggaatgtagcccaccaggatcctctgtccatgggatttcccaggcaagaatactggaatgtgttgccatttcattctctaggggatagccccagtgcaaggattgaacccaggtctcttgtactcctggaagattctttaccatctgagccaccagggaagccgtggaacatttaatagtagaagtaacatgcattcagtctgaagaaaagtaaacactcccaacttacgttgactaaaccaaaatagcctgttattccaccacactgataattaatttaatattttgatgcatttcttttggggttcatgtaggatttgtgggttcatatctatatagaaatgtttaattttttgttattcacagaaaaggtcacattttacattattttgtaacatacatttttattagcaatagtttatgaacatttctcatgtcagtaactgttacagtatgatttttaatacactgtcatgtggcagtataggaatttacttaacctactgccccattaatggatatctaactcatttttaagcttttgctatgcataaattctctctttgcatttcctggatcatatctttggacagatttctagacaggaactaccaaatcaaaggctac

SEQ ID NO: 34002 - DNA, 1482 bp, Bovine  19866880580831
tgcctgactctctccttgcgcagctgactgtagaaacaatgtattacactcccaccacccaggtgctctgctttgcaggaaagacttcaggcttcctaccagacagtacaattgctgaaacaactgtggagcaggaaacaatgattagagaaaagagggagggaggtaagggaagaatagaaaggagttaagcctattgattccagacataatttagaagcactaaatattaatatctttccctctaaaatgtaatgactcctatataataaatgaaaacaggagcaacaattcctgaaggctgtgcaacattattaaaaaaaaaaaatcactatcttaaatgcacttataactcaagcaccacctgctggttcagtgctagattttcccactcaacaattccaatttgatttgcattcaaatcagccaagaagacaattcaattttccataggaataaggcaagatcattatcaattttaaaaatcagataacccaaaattttccttgatttaaaacaactttctacctccatcttacatttaatcccaaattcacatttggtgaaatatttaaaatgtactattagaggaattgaaagataacttgttaatctgaaagatatggaacctatataacaaatgttaaaatttatgtacatttcagtgggtgcatcgatactctcattaattacttggttacaaatatctggctaatgtttatttttattgtaataaaattttatgataatatatgaaccttttaatatcttaatgaactgtaatatgtcacacagactaaataaaaatgtaacaataaaagaaactatcaaaagaaaaagtttatagaaatgactccctgtgaatagctagttatctttttcagtatttcagtaaccaaaaaaaaaaaaaaaaattatattcttggacaatggcctgagaattacgtcactgaatcaattttgcatttgttttaaaaacagtcacttttagcttctcacagaagattacactaaattaaaataaaaataagtattatcaatgtcactactcaaaaatagttggttatttcattaatcatcacgcatctctcccaaagtgtctctgttaaatttatctattaaagcagcagctacgtgcagcactttcaggcatggcctcaaagcctaactggtagcagtatcttagggctacattaactgtgtatcctaggcaaccaagtaatggctaaagcaccacagtgtttgtttaaaacgtgatgtggaaagcaatcagaagagcttcaattccggggaaattccttttcaatgtaagtctcacactgtattagagtggtgctatttgcaccattataattaagattgtgtcaccatattcattattttcaaggggtttgtaactgagctgtaaaaaattagtcatagtaattaaaagacggaaaacatctagttatgttaagatgtcctactggggcatttaaggtc

SEQ ID NO: 34003 - DNA, 1898 bp, Bovine  19866880584112
tggaaaagagacagaagttggcatcattatttgcagatatttttaacctctagttatatattttaggccttccctggtggctcagtagtaaagaacccacctgccaacgcaggagacataatatatatattttagatatcagtaaaattgcaacaggaaaatgaattttgagtcaaagtcaatatattttaaattagaaatgttcttactatctgacagaaatcaaaggaacagtacaaaaaagaatgtggtagtttaaaagaacaaccatacctaatcataacatcctgcatattgatactaatcaaacatctaacactgactacccagtccaacttaagacacatcagaataaaatgtaacgttcagtgccatgcatttcacagcataccttacattaactgcaaaataccaaacaactcagcaaatttgtcttctcttgttcaagcaactttttagagtgcttagtttgaaaacaacaggtgttgttttgtattatagatggttctatcctgtcattttatgggaagattcctgaagaagtgctggtctggcagtgaggctgccctgactttgtgttaaaactatatagggcagcaggagatttgattcaagcctggtgttcccttagctctgaacaattcatcacagatggcaataaggagataaatgtctttcttcaagaatatctcagtctgtgttaattcgcatacctttgctgtgaaagcatattaacatacaaaagtcaggcttagaccaccccatttctgtgccagaactccagcatctgttgaagatttagctacacaaactcatttctgttgagtatgtaatgctcattcttgcacagaattgtggtgggccgcaattaggtcttttctgatcacattttggtcttaaacaactaggtctttcctggtcacattttggtgttaaaatgcagcatttttgacacctaaagtagagaacctgtggtgaggatttaaaagtctccaacaccatattttatacagcctaatcttcaatagttatttctaaatattcattacacacttacatgctcatcaataataaaaaagtacttgtttggttcctaacaaaataactctcattttcatgctcacaaatccttaactgtgttaaaaataaaagggctgctgtttcccactaatgtgctactttaacacaaatcgtagaggatgagaattttgcatgccatggcaagttttcaaattctaatgtttagctttcgaggttacaaaaacatcccattatacatgggctgacctgtacagggaattatagtatggaccctaaatagttttcagaggtcactgttataacaacagttgcccaagtgcaatgtacaaatatggctagtttaaataactgaaaatttaaacgtgtgtgtgtgtattagttgctcactcatgtccaactctttgcaaccacatggactgtgtagcccaccaggctcctctgtccatgggattctccaggcaagaatactggaatgggtagccattcccttttccaggggatcttcctgacccagggatggaacccgggccttctgcattgcaggcagattctttactgcctgagccaccagagaagctgtgtgtgtgtgtgtgtgtgagcgcacgccaaaatatagactctcaaatttgttgttaggaaatttttcctatttattggtgtttccttggtatatgccaaacccttagcttttaaacctttacacctcatttacaacaaccctataaactgggttcaacagttattccctttttactcacaaggtatcaagacttaaagaggttaagtgccttggccctggttctcagctcatcaatagcagatccaggagcccactggcatctaatttaaaggccatc

SEQ ID NO: 34004 - DNA, 1014 bp, Bovine  19866880667910
ccttctgaatataggaaaatatgttcatttgatcattattatagccctttgctatggattatcttaaattaaaaaaaaaatcagtgaccattaaattataagctctttgagggtagaaactgcctcttaatcacctttatatcctgctcttgtcacaagcgtctaacagggactggcatagggaagagaaagagggaagtggatgaatattatatgtcaccaccatgaagtgtaggaaatggctaagacaaagcaatcaagaaacatcaagaatacatgacacataaaaacttggtgaaattgttgggggagtatgcaatttccttatttctgtctcactgcagcaaaaatttgaaatggcagaccagtgttacagcttggttacagctcagttttatttggccaagcaaaggaaaatacatccttgaggcatgagggcaggccaacccaaaataagaaaggggctcaattttggcttctctttttgtatgttttttctattcctctgagcctatgtaaattgggctagccagaaaggctgtttgtttcacttgaggttctcactccagtccttggattttcttttgtttcatttttgccagattttcctttctttgtcttttagccaccaccattttggactcctttttcctattctaactatctaacaacgtgaaccaatatggtgaatcaaaaaagaaagtgtccttcctttgagagattgtgtctaggattcttcttgagggaggagtttttgttacagggagaatgtttcttccacaaggaaaagcagagctgtggacaatgaaaggagatgctccagggaaccctcaacctgatgctgaatttcttcatgttgttttaggtcaaaataacatctctttggaatcttggctttagaggaaattgatagaactgaaagcacatttgacatgttcattactcaaggaaattaatccattatggcaattactgtactcttttgcaaactaaagtctaaataccaaccgagga

SEQ ID NO: 34005 - DNA, 1196 bp, Bovine  19866880699563
tctaaagattcagaaatgatttgattattgggaaatagattctacatgtttattcattaatatatttgaatggtgatgaaaaaatgttttgcttttaatgctggtcccttaaaagtgatttcttaatttcttagcaaagggtatataataatcatttctgcctttttgttcatcaagtgcctagtatttgataagtttactttaaaagggacttttagacatgttcaaaagaaaaacattactgctactaatagagatcatgtgttgtttgctttagtccttgtcattacagataagtagttttctgaacagagttataaaaaagagcagcttggtactggtgtttctgcctaaccaaaaagtcattacctccccctcataaataccctccttcattaaaaatgttacccttctttcttgacctaatacatagactatactgcatttttctctaaaaatgtctttcttttactgaatcaatgctaaaatatcacaaaaataatgcttcagtgaacatgaggtttttattcgtaactatactattaaaagaggatctaactttataacatgtaaaacatcatatatttaaagtgaaagtaacagctgaaaagggtaaagaaatctttaaaaataaaatcaacttttctgtggcagatgatggggatagacagaggaagaatgtgagaaacactggctacactcaaagcacagttaaatgattatgccagtttgtgaaaaccataccatacattatacggagaaaagtattaaaattattcaacaacaaccacaaaaagctatggaacaaaagagttaagtcatcactatggcggacagtcaggaaatggaattgctgttttctgtgggagtctttgttgctgcttttctaacacttcaatggttgaaaggaaatcaaactgtgagaacttactgccactccaatgagccctggggaatttgtcacaaatttggaacctgagtggcctccagcttcacagtttgggctcttagaagtgacagaaagcaaacagaccagcagagaaagtagagcattagttacctggaactgaacaccaacatattttaatttgctggacgaacttcaggctacctattcagttttacatcaagctaaatgatcaaataatttcctccaaaacatatgctatacttaggaaagttcaagcaactgccaa

SEQ ID NO: 34006 - DNA, 2009 bp, Bovine  19866880735795
ttttagtatatttgattaagtggaaacatgtgaacgtttactcatgcttctacatcttcctcccaagtagcatttccaaatgggtcttagtctttcccttctctctttgagaagatagaaaataaccatttgtttcaagctacaactcatgaactatttactaaataatctgttatgcactatttatgaattaactaatactttaatattttagcttttgattcaaaattaagagcagctgttaactagtaaaataataaagtatttaagaagtattcattctacttgccagatttagtcaactacatctgcctcaaaaatcttggaatgtttaatgtaataaaagaagtttttaaggagtctacagatataaatcaattgacatttaacagagttaccagtttgaaaactcagtacaaaagtgaaaaaacctagtgttaagactatggacttggattaatataatagatgaaagaaatgtctttgaaatttagtgagattatttttcttgtagctagaaatatagctttagtaattgaatttatattggcatctatatcataatacattcaaatgtatgaagcctcttctcggtttatagcctatagatcaatgttgtctaacagaactttctgtagtcatagaaatgttctgtatctgctctgattggtatgccagcccctagttacctgtggctattaagaactccaagatatagttaatatgactgaggaactatttaatttcacttaacttttattagtacaaattaaaatttaaataggcatctataattaactgctaccattttggacaatgaagctggaggatgaatactagtatcaccagaagaaagataaagtttatcttggattttcatacatgagtaaaaagtgtctttgttttcataaaatttgaatttagaagataatagctagaaattattacaaaaaatgaacttattcaaatggaatatgtcaagtatgactatttttaatttctggcactttcagaataagattctataaaatttattttaaccagctgtttgcatgattttttccttgaaattgtatcatcagtgtttcaaaattgaagtaaaagatattcagagcaatctgtagcatcaaagtttattattttatacagggtactcttgataatttttttccagaaatatatatacttaagagcatgttttttgtcattgaaactagtgtgtaccaaattttctctaaagagtatatatcgggggcggggggcacattctcccaggtattctagaattgttctgtaaaacatgacttaatcatttcaaattatttttattagtttctcttttgttgttgctctcagcttacaaattgtcatatggtttgtttttagagattttaaattgaccattataactgttgacttttcaaatcatttttaagactgtactgatgattcataatcttcatttcaaaaactaactgttgccaaaatgacagaactatcccagtgggagacaaaagtagatttcccttgggaatctcttgaaactcactgtctagggaacaaaaacattttcataaaattggttcatgagtaagccagtgtcatcaaaattgatatcttctttcttgcctttctttctgtactttggcctgccatggttttaagctgaatgcattatatggaagaatttgcaatttgtgattttctagcatattaacttgagagccaaaatcttatttgccttattgcatcattttacctagcattatttttgttgttgttgtttgtttgtgggaaatgagttcattggagcctttagtacaaaagtttttgctttaaaggctgttcttttactcatgattttcttaacagcagcttgtgttcccccccccccccaatttttaagatgaatatgtgtcacttattttacatactttttgttttttctctcacaaggactcatactttaagttttcaaccagttggctgtacatttcatccaggtgaga

SEQ ID NO: 34007 - DNA, 844 bp, Bovine  19866880785807
tagcttaaatgacagaatctgtactgctattgaaattgctctcagatttagaatgaggtaaaagcaattcctttcaattagtaattcctcatatttgataaaaatgagtgatttcctcaacatagaaatgactatatgcctttaaaaccagttccacatatcaaaatgctactagagtgtccataaatttaatgaaaatggtaagtaatcttgaacattgccagatgatggtatctaagattgcagatgtatgctaattaattgcttaaggaaaatgtttggttttactccctggataccagaaacctataatcttttattgtaaggaaaaatgaaggttctctttaaatcccttcccagagcttatcttaagaagacactttctgtttttgaataggaaatagatgaaaaaatctgtctgtaggaagctacatttatgggtggtcaataacctaacctgaccacttcagtggaaacacaggctcctttcatgtgggaagagaccctcaaaccagcatgaaataagatgcatttttccactcatgcttcccatttttgtactggcctcagtggaattataccttcatataatattaggcattatataatatatatatatatcaaaaaagctctaattaattctctttgactagtgtttttgttgctgtttgcatcagatgcctgacagaggacaaattacaatttcactctgtatcgagaattccagcagacagaggcatctgattcagataaattaagcacacatttgaatgaaagtcttttattctagacatggctgacttcattgctagctgtgatgttcagcaatagattcagaggccga

SEQ ID NO: 34008 - DNA, 838 bp, Bovine  19866880795901
ataatagttgcacatgttagtttagaagttattggcactcaaacctgagcctgtgtttctccactagaataactttccttaggaaattccaattctggatgttcatctgatttcacatgcatgaatgcttcagtgctctcctaccagttaccgcttaaattcctattagccagcataactcaagcagaagaattcaatgctgtctctaaagatcacctaagttatagtttgagaagacattgtattgtcaccatcctcttccaaaatgctgtgcatttaaacttgttagaaatcagctcgtttgttaagtttgaacgaaggtataaggagccaaactatgactaccacttcacacttctgttcaatagacatttggaaacctaggtttaagttttagagaaaaaaaaaatgcaatactaccacagcctccacaatcagccctcagcatacattccaaaatgtaacatgtctcttctactttagggaggtgtatgttttgagcgtctatgcgattcctactcagatgatgaggataatgtaggcatagacaacatctcaatctccttaagtactggggacaaagcttaattaaagactctcaaaagttcagacctcagttaatccccccatattttatattcacgaatgtagttcacagtgaagagaaaacatcatgttaaacaggagagccattaccagactgaggggcaagacgtgatatacattacaaatcatagcatctattcatttaaacattataacctgactgtgtacagattcccttcaaatgttgcacatgctttcattggtcaattccatgaatacagaaagaggaagt

SEQ ID NO: 34009 - DNA, 1083 bp, Bovine  19866880818187
atccaaataatattttctagaaacaaataaagtgttaaaatgaaattctgaactaatgtctaattaatgagaagatcaaaaattttctaacttatctaaatcttactgtttcaacaatcctatttattgccacagatcactgatgtaaaattcatcaagaaactatctcttagttatgaatattattattttaaatatttgatattttataaataaaacattaaatgtgatgctagcctacttactttaattatttgttataccagggacagattaggtatacaaattaaataggataattttatgattatttttactatataagaataattttatttttataaatattattagttaaaccgtaatatagcaaaatcttcaagcacattgattattactttttatctgtattatcctaaattcttcttataatgtataatcttaaattctacctttgttcctctacttaaagaacatgaagtaattgatgttgcttattgaacaaacatcacctgccacttaaaatttattcttgccatccatttttagagcactgacttcattgttaagaaagagaagactgagagacaaaatacactcaatagggatataatatctttgacaagaaatatggaggttaaatattgtctttgtatgacaaccttaaggcagataaacaagaggaaacatatattagtagagaatgataggaaaaattatttttaggagcaatatgttatattattcatatcttcttagggaaaagatggcaagtttattggctcccctctgcccttatctctgccagcaagagccatctgtaaaaagatggaaacattggcacacaaaaaaattcacttctgtttcctaaaatcattgcctaataaaatctggggcatattttccaaggctctagtcttttccatttttcttatttttcaacaatcagagggatactgaggtacttcatttgggtaacttaaagtctaatttcaaaataaataagagattcataaaactaaaaaacaatagagtggacccaaatgaataatattcatatttataaatataaatatatgatca

SEQ ID NO: 34010 - DNA, 2870 bp, Bovine  19866880824875
actgaatgttatgctttcttactcgatacctttgaatgcttcattctcaagggggaaaaatcacttggagccaatgaaaggcttttggaattacagaaagtaactgaggaatcttggacagccctttccataagataactccttttgaggttaaaaaaaaattatatcctggaactgaaggtaaaattatgaggttactggcattggagactgggtacctccttcccaaataactggcttttcagggagtctacttgttttctcatgccctaggaatcctatactatgtgaaacaacttcaaaggaaactagagctcgctaagtgaattatgtttacatccgatgagcaattttcgatgctcaagactgtgataggttgtgtggagcacatacaagaaaaataccacatgatctttgcctcaatggttacacataacaaataactaaagaaccatttaaaacacaaaataattaagcatcattggctattgtgggtacagaagggattaagagagctggagtatgtttctttaattcttcaagatttctaaacaacgagaaaggagaccactttaagaatatgttagggggttatgaaaggtcacctgaacactcaggaaacaaaagaaatttctagacagctctagactcagaacagtaaaattttttttccaaagcaaaataatttaattctttgtagtagctgttttgggaagaatttttttttttttttaaataaaccagtgggcaaacttagaatattccctatatatagttatatagcacatgcaggagcattctgaatagaacttctattagaaagatggaagatgttggcattaaactttatttttgatatgtgcttacatgattagaagactattcctataataagttgtagaagtggtttactactgagaatcttctaatgggaatatatttgaggtaaagtacatgtcccacatcacaagaaaggcaaagtatatgggtaaattccttctcaatacggtgaatgagttgagaatcaagtgaagttataatggccgaccttcaatgaatcagcttggtacaatgcgtaagatgcgcccaactggccacaggacaactagacaatagatttaaaaaaaatcagttttgaccaaaacctgacaattcactggggcaataaagctccatgacttgttcacagaaattaaataagagttaaaactcagtgaggattgtattcttcagattcacactgactgccacactctctctttattatcttattttagttattattctttaggaggttcatgcctcataacattctttgaaaaagaaacataattttccatatttgcaaatgtatttatgtcataaaattcattcaatatatttttattactaccagaggcattaacatcaggtatcatctctgccctgacttttttgcactaatactttctctttcaacctattacaatcccagtcctcatagtaccattctttggtaatgtttcatcacactgtcaagggtacttgtttattgctgaaatcactacccgattaatatgcccaaaaccactgctttagacttcttctatggctatttaattactcttttcacatgtttacttcagaggaagcaaaatgtgctaaaacatgcaaaatagcattagtgacatactggccttgaaaaacttaattattctaagtaaacacactacaaaattaagttcacccttcactatcaaccttagctaatatctaagtagttctgtttcctatttcctcatctgtgcttgtttataaatagcattttgtgcaatggcactgtctagatgcatggttgacccttgaacaatgctgatggtcaaaacaatcacataaagtgacaagctgtgcgcctatttctcaaaggggaggaatggggaaagctggtttggtgacttgctttgactccagaactacacgcttatattctaacaccttttagttgttgttgctcagtctttcagtcatgtctgactctttgagaccctgtggactgcagcacaccacatttccctgtccttcactgtctaccagagtttgttcaagctcatgtccattagtgaggccatccaaccatctcatcctctgtcacccccttctcctcctcccttcaatccttcccaggatcagggtcttttccagtgagtcagctcttctcatcaggtgaccaaagtactggagattcagtttcagcattagtctttccaatgaatattcagggttgatttcctttgggattgactagtttgatctccttgctgttgaagggactctgagaagtcttattcttctaacacttaaaataactcaattattccaggacatcagagagatgagaacttccacctagtgtctccagcctgtcatctttcgcccacactaggctgcctagtttctgtgaacaatgggctaaacttcacccaccccacttacctgttagtttggagtcaaaactgaactgtttgtatcacgtcaagtttctctgcaatcagtaaacatccacagtgtccttccatgttttgttagagaaaataaaatacatttccatagaatgaggagcttggctagaagtaatactgaaatttagcactggggatatactcttgtgggtgagatgataaaacacagacaaggttatctactgagataatgcagtagctctgcctcagtggattctcagtccttccactttctgcaacttaagcttcttgtgtctcagtttattaatcaataaaatgaggataataatagtatctaattcacacagatattatgagcattaagtcttgtcatattgtaaaggcttaaaagatatctacatacaaaaatca

SEQ ID NO: 34011 - DNA, 2019 bp, Bovine  19866880869337
tggctggttccatctattatgagaatataaaatctacatagggcatgagtgtacacacacacacacacacacacacacacacacactttctataaaagtgattcaggaaaaaaatctggtaaaaccagaaactagaatttgaatactctaactggtttgtctgagattttatttaatttttgtatatgtatttttgaatgtttttaaccaattgttagtgttaaaagcattcttttagtaactagggtgaaaaaattattagaatttataaactctaatgaaatattgaattataccatgagggaaggtggtaactaatacgattttcagtctccaaagacatatatcagtccccatggatggtgtaaagacttcagcaatgttattctgagcttgttaaaaattcttaaacatattttcaagggtaacacctcatggaaaatattgaactagttgccaaaacttgtcatagacatagattatgttgttcaaaattatcactaatttcctgaagattattggatcactacattaatattaaccctttaaagggagtagtttcctcttttatgttatttttatgttttttccaagcatttattattttcacttgcaactggcacaagaatttctacaagcagggtcatctaagtaagtgtcagcaaactgcagcccataggtcaaatccagcatgctgcttatttttatacagcccttgagctaagaatgctttttacatttttatgtggttgaacaaaatcaaatgaaagatccttcgagacatatagaaactatgaaattcaaatttcagtgtccataattgaacttctattggaacacagacctgttgattcatctaattactgcttatgactgttatcatgctacagtggcagcactgattagtggaaacagagaccctgtggccctcaaaactgaagcaattaatatctggaccactgcagttaaaaaatgtgccaaatcctgatctaaagcaataatttttaagtcttccaaaattatttttaatgtgggagacatctgtttccttttttccccaaaattgtgagcctcctttaatttatttttatcaggtctctctcaaggcctagcatattcattgtatcaataaaattggtaatgtcaaccatcaagatgattaaagacttaattacaagaaatattttctttaaagaatattttatgaacagaggccctgtgttgaaaggatggtcctggatatctcattttttaaagaaaaaagtattttaatctttttctgtgtctactcaaatgctagctgggctctctgttgtctgaaggcaaaaatcagatctagaattctatgtaacagctctaacaaaatagcctgagtgttgcattttttaatctttcaaatacttattctgggtttgtagtttataaatccagtctctgcatctgctttctccttaagggcaccatgtttcatcctaagcatggccatataggtgtctacctcctacacttccttataagtaccgtgcatttcatgtttattacagtgtgtttaatttgcattatttcaggttcctacactatgagtttatacatttcaggttaataagcactataaaagtacttctctcatttattctagcattataagggtagtgacatctaagcagtgtgacaccatggtgagtctgtttggatgactggaattacaatggcggattggcagcctgtggacattattactgaagttttactgttgcattttcacatattttaaattaaaattctcagctgaaagggtgccataagattgaagaaactacctttaaaatgaagcaaccttgtgtaacctttcatgaatcagtgtatgggattctgtcattcttttgagggtttacaagatatatgccgtgtttgctgtaccaccattgttttagcattataacatggaaaggaagactctgttgccttagtttttaccctaacattggtgcttttgcttcagcattcactgtcatatgt

SEQ ID NO: 34012 - DNA, 1674 bp, Bovine  19866880883657
aaaaagagaaatattttagggctgtgctttgaccgaatgcaatattctgcagggatttgaaaggctttttctctataaatattttaaatgatttttcagattattcagataacttgaacatccaacaaaatagcacatcaggttaaagagaatcttgggagatattattagcctacaatgctccaaactgggaaacgagagatcaacaaatgcatttgctacttttggttatttaggccattgcatctgatcaacagctcaaagaacacatagtgtacaatattactactgtgtccataaagcttacagtgctttactgacatcacctatcaacttttcaagcatctatgtgttatgtggaacaagtggtcctgtatcaccctgttttttcacagaactagacttggaggtgaggctccggtaggagaataggtcctgagcaggagaaataaacagaaaagaggccatgcctacctatctccactcttctcttcttcagtctatacattatccacttcaaaataaatactcaatgatgaaggattcaatatttaatttccttataattttttcccaaggttatttaattcaactctcattacaggtgcaaccaattccttttctatctgtagctgaaaattgctgtagcacacagaatctgaccatattttaatgaagtcttttatttgtgcaggggttcctactgccatgtgaaggagctctcagattttccattagaggccacattttggatgggtttataacttgaaagtaaaccttttcgtcaggttgaaatagggcaaaaaaggttttagccttaagagtactttgttatttcatagtaataaatcaattttctttcaagatcagagtgcaataacaattttcctccaatgctatctctgtgtatttcttcaggtttatatagatgaccacctttcacacatttatatctccagaaagcatttgtctggggtcagggagaagggttcaagagtaagacagttgaacattttgtgcacgatgctaatgcaatatccataaacgtcagtgagattttgcactgaggagcatctcacatctctgtatccaaggcacaggctccatctctgatccaggcagccttttcacaatgcattctgttgatcactcaagaaacagacaagcatgtgtgggtggttctgaacaaacctctcaccattctctgaaaatctaaaggctaggtcctaggaatgagggtcagttttggggtctgaacacatgaaagacagtttcctgtgtgaatggtaatactatcacttttaaaagggaatttcctctcacagtccaggttaacacagaatgctaaaggggacagcttggttgcagatttctactctatacacgttatagctaagtggagtaactgaaaatgattacttcgtcaccagaaaaatgatactgagcccaaataaactcatacaattttacttaaacacatacagacacatgctcatgcacacatacacaaaaacaatgaacattttatttttggcaaaatctcctgatttctgcaattcaacacgctctttcttatctctatgagactgaagaattcaaatttttttttttgaatcattcagaattggagttagtgatggtgcttttcaaagtgtaaatttatacaccatatct

SEQ ID NO: 34013 - DNA, 1305 bp, Bovine  19866880917484
aaatatggagtaaagtaagtatacaaatgttaatgactgaatttaatggtagatttaggagtgcttgctgtaaagttctttcaactttattgatgtttgaaattttttataaaatttatcaaaaaagttgaaattttctgatgttatttcatcttctggtaaaggggaagtcataatttccttcctaaagaatttttctgagataaaaggagacagtgacatctcaggtacatattttgcaaatctgttttcccacaatgtggattctctgtttttgtttagtcactaaatcgcatctgactctttgggaccccatggactatagcctaccaggttcctctgtttatgggatttcccaggcaagaatactggagtgggttcccatttcctgctccagggatcatccagactcgtggatcaaacccatttctcttacattggcaggcggagaattcccaccaagccaccagggaaggctgcactgtggattacctgtccattttcctcagaggtgtccttcaaggagcgtaagttttccattttaatgcagctgatcaattattctttttataatgcatgaatgtgttgcccagcacaaagctgacctactgtgtgtcatgtgtgttggttctcttatcctttacttcaccaacatcctctttcagggtcacaggaggccccttcagaggaggctagaatctgcttatattttcccacctaacttccatttctcactcctcctggacggagttggctgtcacttgctcagagtttcttttgaagggtgtccttgacttctccaaggaataatagacctccctccccatctttcccctcaccatacacagacctaatcagaagtagatccacagtggacattcagcctttttagcctcctgcatcttttctctgaaaagaaaagagtaggcaaaaaagaaagaggacagaggaatgtagcaggctggatgtcaaattagagcctatcatgaagagtggggagctggagtcaactgctatggaaagtcaaggagaattaggacagagaaaaatgcctttgacttgtgagaactgtgaatactgacctcaaaaacatcattttcaggaaagtggttggaacatccgaggattggctttatttctattctcagcttatcagtagctcaacttcaacaaactttttgcctaccgttgtggcgacatgaaggtcctgcctattttactggagtttctcacattcttaagcagaaaatggttacctcttaatgttccttatcttcctaagcacaggcagtcacaggcctgtta

SEQ ID NO: 34014 - DNA, 2400 bp, Bovine  19866881007047
atggaaactgagtttccccatgccccagggaagccagtgataatagaaagataattcagtgaagtaattgaaggtctaataaatgctacttttcttaatttgaattaggaggttttaattattccatcctaagatgcataatttccctaacatttcatttggaagaatttcaatatacagcaaagtaaaaagaatacagtaagcattcatataacaactatgagttcagttcagttcagttcagtcgctcagtcatttccgattctttgcgaccccatgaatcgcagcacaccaggcctccctgtccatcaccaactcccagagttcacccagactcatgtccatcaagtcagtgatgccatccagccttctcatcctctgtcgtccccttctcctcctgcccccaatccctcccaggatcagagtcttttccaatgagtcaactctttgcatgaggtggccaaagtactggagtttcagctgtagcatcattccttccaaagaaatcccagggctgatctccttcagaatggactggttggatctccttgcagtccaagggactctcaagagtcttctccaacaccacagttcaaaagcatcaattcttcggcgctcagccttcttcccctaacctattatttattacatttgcttgatcacatatgtgccatctatccacctctaaggtgcaaatttcaagaaataatttttgtatttttataattgctgctgctgctgctaagtcacttcagtcatgtccgactctgtgtgaccctacagacagcagcccaccgggctcccccgtccctgggattctccaggccagaacactggagtgggttgccatttccttccccagtgcatgaaagtgaaaagtgaaagtgaagtcgctcagtctgtctgactctcatcgagcccatggactacagcctaccaggctcctccgtccaatggcagtttttatgaaattggatcacatttcacaaccaactaccaacatatatcttaaatatgatagtgctatttttccttcaaggattgtttctaacttggtgataactcctacaatcaaaaagatattttatagttgagaaaatatagtcatagttttgacaaaaagatgaattacaattcagtctccctattaagttttttaaaaagagatagttcacattatttaaatatttgaagtcgactttaagtaagatatcaagactgaagctcatcattctagtataaaaacatgaatcatgattgaattatagaagatagacttttatggcatatcatgagtggaacaaagattacaggaaaaatttgaagcattaaatgtcaggaacagtattttctgagaagttattaagaggctgacatcactctctcttaatttagatcagataatcctttccaatcactttttcctttgaatattgatgaacccaaccatcatctcaaccttacttcagttatctgtgttcatctgtattctgaattcttagagaacaaagaatataagaatacaatttatgtgcttagtctcttttgagtcttcctcccttatcctttgtttttttactccataccatcttcaagagtagaaagagtatgttgtttttgttttaagtaaaacctagagagaatggactatgaaaagatagatggaattttcctgtaacctatttattaacaactcttctttaggaaagactattattaaataaattgactatagctgtaaagtaagtgcctgtacaatcttagaaaaatatatgaaaaatgcaaaaggagagaactttaaaaaactgtgatttggaatttgttttagtactcagttgtttgaaattaagtaatcagccttttcatgtaattatttcttcccatatcccttcccacacaaaagtactaaattaaaaaaaaaaatcttctaaaacgtgtgaaaaatgtttttgctttgtgaaatagtgcattgaatggtaacttactaaaaatttagcagaagtatcatctttttgtattcactgtactgcaaaataaaaaatagtatttttttccccagaaactgtttgttcctctgcagaatgaatggttcttgagctttttgttgttgtttttcacaatacatagttgttgttatgtccctgtcctaagactctgtctaccgactctctttctttcttcttgtcagaaaccctgttaccagtatcttttcattttatttgctgtggttacaaaggaaaaaaattgagatcagggtatgagctggttgcaaaataagaaaaagtactccaagggtttgagagtttttaaagaatgaattacacaggcacccgcactagtatatgaactttccgaatctattttttaaatattcaaagacttaagacatccatattttaa

SEQ ID NO: 34015 - DNA, 973 bp, Bovine  19866881013922
gaagatggcatgcagctcccctaaggcctgcatctgttattgggcaggatatatggcagcttgctgtgtttactaattgggttggctagttactttgttccctctttctatttttcagaaatcctcccaaagaagtaatttccctatttgactcaaattcttaaaagtgagcagcatgatcactttagaaatgcaaacattcatttgcctaaaatctcaaaatgaatttgatttttttctctgtcttttcctgggactacttttcttcctcttctagcaggtcagcatcaaaaagcaattggggcattctatcatgttctcatcttaccagatattctggccactgctctagatcccacatcctgtattctcagtctttctttgaggtttatgtgattttaatgatcgaggtgtatgagtctgagggaagagcctccccaatcccatctgtacttctcacagcaagacaagtgactatgctgctccaaggttctttgggtccattccacttccatgcagataaacgcagcacttgatgtgaacagttaaatagctggaaaaacaggatgggtctgtgtaattggccttgtatactttctcaatcttggcttgtcagtgagaattatactcacacaggctgtggcagtgggtggccttttcctgagtgaagtgttatgtaccctattcatttctcttttggaaatctagagctatgtccagctctgaaatgacagtagtagaggaatttcactgcagaatattaatcatcttttgcctcctctttggttaaaaaaaaaaaaagaaaagggtatttttttcagaggctttctctgccttgatgaggttaataatttatttgaaaacaccataatggcataaatagctttttttgtaccttcattttgataaaaagaaagaaaaggagggcatattcgtttccatgatcaattttgctaaaatttcacaagctcat

SEQ ID NO: 34016 - DNA, 2519 bp, Bovine  19866881024728
gcatgcatgcatgcattatatattaatacctgttgatttccttaggtaagataatagcattaaacaattaaatgtctatagtttgtaggtatgttttcagaagtatttaataattgatgtgggacaatgtcagaaattttctttaaaatagcaccccccccccaaactgttgtaatttgctaattttttttattattaatggaactctgtttgaaaaaaaaaaggagtagatagatgttccatttatgaattagagtttagcaaaaaataaaaaaagcctgttattccatttgatcaagaactttattttcgtttgcctcaaagtatattttgaaagtcttataaaagccctcatggcattagagcacagaggccaaaatattgtgttttaaaaagagtctgacctaggtttcaagtctacattttttactagcttcttgacttgtgggtaagttgtttatctatcctaaatctcaactttctcatttgagaaatgacagtattactatgtatactaatcttatagcatcatatgagaattaaacaaaatactgtattttgcttaacacaatgcttgatacagaacaaacactcaagatgacaggtatttagtagcattagtcagcattggttttaggttataaaaaaactagatatgaaagtgatttttcctactttatggaaatagattattggagatgtttattatagagtatttacgttttggggggcactcagttcattgtagctttggttaaaagcacatcttttccttcctagcatgagtttctgaaaggaaagtaagcatttctggtttgaacatgatgaagctcagaaattctggggttgttaaactggatgtttatgcttgagcagacatcactcgttgaactggggtggttggtagtgggagaagagggctgaggttggataggaagagaaagaaaagagaaaagaataaaagaaagatttaaagaactaaagaaagaaatgttggtgccagtcagttaaaaatggcagaatataggagaaaatgttctaattttcataataatggaaatcttcaaactagatgagtcattcattattagaaataggaatatatacaatagaaatatatttctacattatatatttaacatatgcatagataagagatgaaagagaaaattagaaaatagctataaaaattaacagctatgcctttgctgcctattatctgaaattaaggcagcttgaaatttctcttacgttaccacttagagaaagatgttgtagatttatgtatatatgtaatatacacacatatattcatatttaaggagccagttatttgacacactaatcgatgtctataggtcatagcatttttctgaggtataatatcagttcagttcagtcgctcagttgtgtccgactctgcaaccccatgaattgcagtacgccaggcctccctgtccatcaccatctcccagagttcactcaaactcacgtccatcgagtcggtgatgccatccagccatcttatcctctgtcgtccccttctcctcctgcccccaatccctcccagcatcagagtcttttccaatgagtcaactcttcgcatgaggtggccgaagtactagagtttcaatatagtatctgaaccaaaaagtgctccagttactgttagaaaaattactctgggttaagtttctcattttgaatgtccactgggtaagagttctagacttcctgcatataacgctgtactcctcagctaatgttacaggctccagagttctgggatgactaaaatagtattcagatagctttaggataatttaaagttttaatattatctggtctctgtcctcttgatctttctgacctaaaatcttggagttattttcaacaccattctctcaacctcacattccaacacatacaagatccttgcattatacccatttctcctctgaagttactcaagaaaacagtcacatatttattctcatactgacaggttttttccatttctagatttccttataacataggggaggcaggacatgctgccgaggcataaatgcccatgagagagagtgaattcttttgcaggggtctgttgtatattctccaagggtgagggtaccagagacagggttgaaatcttgtttaaagctaaccttctccagcaggtttgtaaattcaaaagcaggggaggatgagtcttaagtacataatcagctcttccctcagggaacaagagttgcaaagaggcaattcccataatattgacagggagaaatatgtcagaggaactaaagaattactcctgagacccattacatttgaggatgatggcatctgtctaatgatctatagcttatctgctatgcatgtattttccttcagatgatcattggctgtgtatattgcaaatgcctctccatgtgagagaaaaagcagaaaggaaaccttgggagatgttcttttgtgaaaggggacttgctcttaggcacatggaagaagtaagc

SEQ ID NO: 34017 - DNA, 729 bp, Bovine  19866881036933
ctgagcacaaatgaaatttttatatgagactccttattcatcattaggactaaacagcatgtatagttcatacaggtagctctgggtttttcattactacaacatttctgtgaagtactcattctagctctgaaagtgattttcagatcatttattcatgtcttcacaactatagaagccacactagtaatgtcagtggttaattgaaatcatggatcatgtcttagtttgaaaatgtctctacagcttttgtctataataaaaccaactaaggttttggattggagaaaatcataatataaattaaaagtgtttctctccttaataaaaatatatttaagatagtgtttcagtatggcttaattttacttttgttgttgttgtctcactttgcacggcaatgaagcctgaaatacttcagggaaagaaaaaaataaaaaagaaagagaaagaagtgaatctttctaattcacgggctctggtagcatcttcctaataactaacaccatgaaaatggtattatgctctcaaagagcttacaataaaattgtatttaaaaacaaaacaaaacactcttttctttgtttgttttgtcaaaaaatatgcatttgagcctctttttattttctccacctctgagacacatgtaactgtaacctagcaaaattatttttgggttttcttgttatgctattgctttgtatcagtagcaggccgcattcagtatat

SEQ ID NO: 34018 - DNA, 1391 bp, Bovine  19866881073096
caaaaaccattcaaatcaaaacacaggctcaggatatactctgacatgtgatcaaatcttattttctacttaaagtccaaaattctcccaagagccaactaaatagcaatacttttggataccacacccaagaaaacttggcttaccttgttactgttagacaaagtattaactacaactaaaaccctacagtctttactcttgcagtccccctggtacatcagctgtgttctagttgtggtataacacacgcaaagtgtgctgaaacaaatattttgataatttattcttcacgaattaattcacttaaatactttttctaaggcccaacacatattttaggaagtcaccagaaaatatcggctctagaggtaaggttccaaaacacccctaaaaatgtttcactaacaaagtttagtactttatggtgtaagggcagataaacattagggtatgatgtctcttagaggaacaaaggagaccactaaagtttaaatcttaaatgtagcagagccagagcaaatatttaacactggaaaaattatccattatcaaccccaacactgcctgccattatacagatgaagttcttcattttttaactggtgaatcttttggcctgaaatccaatcatttagaatacacatttaaagaagatacaaagatcaaagtcacgtctttatcagttccaaataaatttttaaaaatgggcgaaacttgtactagcataacagcacaagttactctatgagatcttatgtgagtataaccaatcataggcaacatgatgtatggccaaaagactttttaaaataaaatcactgtatataactatgcagatcttcaatccttgaaaacactattaccataatttggcatctaattttgaattttcagttggaaaactagtcactgcatcaagattttcaatttaataaatttagaaaaatataagaataataaacattaaaaacaatttagctataaacagtgccataattaaagttacatgcattaaagatagtgaagattctcacattcaaatcttgtctaacaaaccaatgacaacactaggatatttaagattaatttgagaagattattattaacatctctttatataccttctaacatggagagttttcattggtgtgaggtcattcacccctatgtagtgaaattataagaacatctgaaccaatgcatgattatacatgatgggtacttgaactgatgtgtatttgaacaatgctacagaaatattttacacctacattgctagagtgtatctattatattatccaccatattccaaattcaaaactgcacactagaaaaagatcaagtctcactttgctttgctaacacatccccttccccaaaacacacaa

SEQ ID NO: 34019 - DNA, 1482 bp, Bovine  19866881094872
ccacagagtccataagactgttcccatacatcggtgtctcttttgctgtctcgtacacagggttattgttatcatctttctaaattccatatatatgcgttagtatactgtattggtgtttttcaaatggtaaacttgatcaaatattccttttattgccttctagaaagctcatgctccaatttttgcctatacctagcaaacatttcagacttcagagtgcccgtttagaaccccagggtgctgcatggtttcaaattatttttccttccaaaatttttccttcacatacatttcatcaactatctttgtctgaaggaaataacttgtaaattatatctatttttgactatcttgaatattttggaagaataaaactgaaaaaattaacatttttcaataaaaatatttagctgtaccaacaacacagtgatagggatagaacctggtacaaggcctccagactctcagtggcacactctgtcttctctggctgttctttatatttacttgatacatactgtgtacttgtgtgtgtaggtatatgtgtatgcttaagatttattcatctcttatccctcctatcagattgtaaaatcccaaaggatgggaattgtctataaatttttttttacaatcttctcaagcaaatataatagtatgtgcatatggtatcaacacaataactgaatttggacaattctcaatctatcactaaatcctaactcatatctcaattctcagttaccatctcacttatatatagaactgtctatctgaccttggctaaaactgtaatcctttacttgatagaatagatatgtaatcttggggtttactgtaaaatgaatttctgttaatggaatcttgacttctcactaacttgagggaaatgaaaaacatttgcacttcataaaaatatacaagtgtacctcatagatattgtgggttcagttccagaccactgtaataaagtcaatatcaaaataagcaagctatatgaatttttttgtttttcattgcatataaaaattatgtttatacttcattgtagtctattaaggatgcaatagtattatgtctaaatatatatatatatacgctttaattaatacatattttattgctaaaatgtctgaccatcatctgagccttcaacaagcttttaatccttttgctcatggaaggtcttgcctggatgtttataactgctgactgatcaggtggtaattgctggaggttggagtggctatggcaatttcttaaaataagacaacaatgaagtttgctctgttgattgacttttcctttcacaaacaatgtctctgtatcatgtaatgctgtttgatagcattttatccacagtaaaacttcttccaaaactggagtcaatccttttaaactctgccactgctttatcaatataatttatgtagtaatattctaaagcctttgttgtcattttaacaatcttcacaacat

SEQ ID NO: 34020 - DNA, 1282 bp, Bovine  19866881109424
agaaactattttgcacttattatagagatggagggtactgctgaatagttttggtggaatcaaaagcaggaggatgcaagctatcaaaaagatcaccttaatcatagatctttatatgtgaaaataattttaaatttagatgtgaaaaacaacagacaattaaaaaataaactcacagatggtatacaacttttagaaatactgtaataacacctcatttatctaacaccatcggggatgagctgtttcacataagtgaattttcctattaaatagaacttacagatttaagtactagcactttttaattttaaacaagtttatgtggaaacttcaaaaatggattagacaattccttgcctttttatatttataacatatgttgtgaattcaaaaataatgtatgatcattatataacattttaaaatagacatatagaggataaaataaaaatctgtttttaatctcatcatgtagagataattaatattatgatgttggtttatttcatttttatcttatctgcattcatgtttttaaagagttgaattattttgtatctagcatatgtacataaatttatttgtaagcattttcttgcattattaactgttcttggaacacatgatttttaatgggtgcatactatttcggcaaatggatatattacaattattttaaatatatgcatgctgttttcagttcagttcagttcagccgctcagtcatgtctgactctttgagacaccatgaacagcagcacgccaggcctccctgtccatcaccaactcccggagtccacccaaacccatgtccatcgagtcgatgatgccatccaaccatctcatcctctgtcgtccccttctcctcctgccctcaatctttcccagcgtcagggtcttttccaatgagtcaactctttgcatcaggtggccaaagtattggagtttcagcttcaacatcagtccttccaatgaacatccaggactaatctcctttaggatggactggttggatctccttgcagtccaaggaactctcaagagtcttctccaacaccacagttcaaaagcatcaattcttcggcactcagctatcttcacggtccaactctcacatccatacatgaccacaggaaaaaccatagccttgactagatggaccctttgttggcaaagtaatgtctctgcttttgaatatgctatgtagggttggtcataactttccttccaaggagtaagtgtctattaatttcattgctgcagttgtcatctacagtga

SEQ ID NO: 34021 - DNA, 1015 bp, Bovine  19866881167736
cagaaattatctatagccaaggaagtattgccaaatttagtgctttagatattcctgcgtagaaatttgctgcttaaaattcttcaaaaaatggcatagattactgtaaggaataaattttttccacagtaatcatgcaatacacatatgtatttccaaactatcctcacaccttctggcagaagtaggtcagttaaaattagtgatgggagaataatattttattaatgtttaaaatatatatgtgcaagactatatgtgcaagccatatagtcaagtagtttttgattagtattcatctacttatttaggaattcttcaacaaatatttatgagtatttacctattgtgtttcaggcaatttcatgggctctgggaaatggcatgaaagaagcaagatgaaatacataaatctctttattagtgctataacatagcactcttaatgctcttttccaaattctgtaaaagtgagattcatctgcagtggaatgggaatgatgtccaattcatgtgcttttatctaatttaactgaaataggtactttccagtataaatgctttaccttgccataaaatttcattacagaaggtgtcaaaacgatgtacaagcaaatggagttaaagaagtgaagttttcataattctaaaaagtcaactgtgaaaataaaaactgcctctctgcctaattccccatgcacatcctgcttttacatgaataatgatataaaagattctgagctcattcacctgacaaaggaggcataaaaaataccggtaaatatattcttatctgccttgttaccatttgccatctgtagttgttactgaattctacagtcacttcactacagatgcaaagaaatcttagctacaactctcttccctcaaaatcacagtcagtgtcatggtattggattagtaacagttgagagaatgtggcttcctttgaacaccagaacagtgtcggaccaagttcaaaaatctgcggaagagttaccgaaaagtgagaaat

SEQ ID NO: 34022 - DNA, 1287 bp, Bovine  19866881422312
ctgtatgtagagagaatatgagcagtttcccattgctgtttaatacttgtctgagcttccacaatgtgcctggtgctaactggggcacctcaattattctccatctgtgctcactaccaaagctgccagccatcatactgctcgggccctgacgcctgtggcagagagcctggcagggtaaatggtgcaatctagtatttcttcctgggtagccttgctagttaacctagtaaagggatctctttgtgcccagtattgacttagaccatgaaataaagccatgggttagcatggactcaaaggcaactttgcatagaagagatactatgttggaattccacataagagtattttcagtgccaatgggacaggatggcttaagagcaaaattgctataaatgaaggtgttctaggggagtgtggggcaagtttagtaatcaaacctgtggatagattataaaatgcatcagcctctactcccagttttgttgttgttgtttagtcactgtgtcatgtcagactctgtgaccccatggactgtagcctgccaggctcctctgtccatgggatttaccagacaagcatactggagtgggttgccatttccttctccaggagatcgttcctacctagggatcaagcctgcatctcctgcttggaaggtagattctttaccactgaagctcctgtgaagccattcccaatgttcagttcaattcagttcagttgttcagttgtgtctgactcacttcctattaaatagtgtgctatatcaaatcagatagacttttctgcaaaaaccctgggaaaatcatactttttctttaacctaacagccatgctgcaatcttgagactacagttggtgaaaattaaaacctatgacttctggcaatatttgaatcaagtcatatgccttctgacttatgatgaccccaagttgtttcatgagaatccatgaagtggcaagctctgtgcagtaagctctacatggattattattcctaattctttcaataactatgcaaattagttgttattcctatctgacaggaagaaactaaggcacagaggagttaagtaactgtgctaagtttgcatggctataaagcgtctaagctggagatttgaacctggctgtatatgacagtataactcacattcttgtacacactgtgtgtaaggactcaaagccctcatggatttagaattgatttctgtgacttctgaattataatctttgtcctctttaaaactgctgatgagtgtgtgagtggagaaaaaatta

SEQ ID NO: 34023 - DNA, 3610 bp, Bovine  19866881452110
ctttttgctgtgaaaattcgagaaatttcttttctgttatccttagcagttttcagaaacatcagatgacttagtgtcattaggtaatcatatttttctttcaccttattttgttgttcttcctttcctagtttttctttttaaatacacttctcaagcacaaagttataagaaaataagccacataattatcctgatttctttagattccgttttgagtcttaatctagattcttatataagagaatattagaatcatctataaaataatatatgaattgtttcttttgtttcatacagtctgatgctgcactattcaaaatggcatatatagttattgagctcttgaaatgaaattggacacctccatgtcccagattagattttggatactttgtatgaaaaattataaaatatctcaagcatttttggtagtgttacatgttgaaatgatattgtttaaaatatattgagctaaacaaaataaattattgaatttaatttcacctgattctacctttttaaaaatgtatgttagcaagtgtaaaatagtatgttgtacatgttatgtttctattagatagcattgattattctcaaaatacttctaattttttaattaattgcattatgtttctattgctgctgtaacaagttaccttaaaatttggtgacttaaacaacgaaatgtattaatttttagttcaggaaatcatctaaagtgtcttggcaaggactgtgctctttgagagactctagagaggaatccacttctttgccttttgtacttctagaggccacctgcattccttggcttttggccttttcctccattttttaagccaatggtgtaacatcttcaactctctcagtttatctccttatgattgttattacatctctgactcttctgcctccttcttataaggatcctttgaatacatcaggcctatctcaagatccttaatcatacctgtactcccctatgtcacataaagttaacacattcacagattacagagtttaggatgtgggcatctttggaggaccattgttttacttactatgttaactacatttaatgtcatgcttccttggttggtttgttgattacaatttttacagtttggtttaggaatgatgatacattaatataagctccaaatgtaaacagcagcaagtctgaagtggcatggtggaatggattctcatctatctatgccatagactgcatgcagtgtgaccttagttatatcagtcatttgtcttcttgggttttttctatttagcaaaaggagatttttggagtctatgcaaggactataaaattgtaattctttgggtcacagttcaaatgtactctacttcttttaatgattggtttgaatcctggtaaaattaatttcagctatatgatgttttctatgtctttatcagacttgtgaatcctgaggatatgaattatgtattggtttaatgtattaaagatagccaagaataatacttgcttcattgtccgatatgtaaactttctgttttccaaaactaactgtcttatagtctattaactttgtgatttataagaaattttgctttgaacgtttgtgacgttatcttctctgcataatctacttaagcaactactttttaaaagctattttttctctttccttctctccctctcttctagtaaacttcgatatagaggcccagatttaatttttaaaataacaaaacatttatgagcttgctaatttctagggagggttgggaaatttttagtgaaaaagcaaagtgctaaagctgaaggtcgtgatttttataatggatggttaaatggttgaacaacttcttatacattggatgtaatgtggttttatcattctatttgattgcatcattttattgtttgtttccaggtatcagaaatgattttattcacatacactcaagaaacaagctctaactctgaatacatgtgattttaggaaaactcatctttttgaaacattcatgacataatttctaatttgatgtaagtaatcaaaaattaattaaagaaacagatttatgtgctcacggattctgagagggagggacagatagacagagagagagggagagaaagagagagagacacaaacacacagaagcacacagacacacacaccaagagacagaatatccatttccgtataagatgtagcttaaaggtctcttttatttaatgttttatttaatgttccctaaatattttgggacacgtagatgatgctcattagatcactaattgaacaatgatgaaaatccaggcttgtgtttacttttaattgtgttattagcataaaatcctatttagagaagaaagagtaaccaacccatgtctttgaagtcaatgagatggtgatgccattgggatagaactgaattttttcttttccagcttgaactatagaacattaattttcatgtgacttttccataattaagtcaaattttacaatacattttacaaatactggaaacatagactcaaataagctaatattatacaataaactttaatggatgatttacaataggatggtttcctggttttatttatttggtactaagggcatgcttaaggaatacttttaatgcttattataagatacattctagactacactgcagtgtactaaaattaatcatgatatgatagagtctaatgcagctaaactactgctatgacgattatgagaagatcagcataaataatattcaatcttacaaatatataaaaatgtacaattttaaataaataagatactccataaaataataatgtattgagctagtgacagctgaaatctttgaaccttaaaatgtattgttaagtaaagaataattgtaccaattaaatgtaaatatcaattgtttgttgttgtttgatcactcagtcgtgttctactcttttgctaccgaggctgccaggctcctctgtctatgggatttcctaggcaagaatgctggagtgggttgccatttccttttccaggggatctttctgacccagggattgaacccatgtctcctgcattccaggtggatgctttaccactgagccaccagggaagcctaaatatcaattataaagtttttttttttgttttttttttaagagctccttcaaaaagaaacaaattcttaattattagcataacacatggtttggaaatttttagtaattcagatgataaaaatttgttttgaaattttggatgcatttctgacttaagcccctgagctttgaacacgtgtttcattatgtcaaaccagctttaatgaagaagccctatttctctgtgtaacagtctcatcctaaaatatctagtcttgatcattccttccttggtttccattacaggtcttcccaccaagaaatatcaagatgcatctggtaaattaaatttagcattggagcagatgtgttctcccaatacatacctgaaatattcagtatcagtcaagtgttttaagtagtcttttctaattaagcaggattgtgtgaacagactattctctgtagaaagaacctcttcgtaaacagccacctttgcagtagtta

SEQ ID NO: 34024 - DNA, 1089 bp, Bovine  19866881494893
tgggaagccccatagaatttgtacgtgctagtaatttattggatataaataacgaggaaaaagggttcaggaagcaccatatttctggcttgggcaactatatggttattataccattccctgagataaaaggagtacatggaaataattgggtttggagaaatcttgaaacaagtttgagatatattgagtttgaaacactgtggaacatccaaaaagaggcatgtaatagtaagaaaaatagattaaaaaatatgtttgacctagatatatagatttggaaattttcagtatattggtggcaaattaagtcatagagttgatgatgcaatccataaagagactacagaatgaaaagggaaacagtccataatagaaaactgagaaaccttaacactgaagacatgggagaccaagaagtccctaaggttaggagaaaaaagcaggaaggagtattacagtagaatcagggaaagacagtgctgtaacacagagggagaaaggaatcaagagtatggcatgatactgacaagtcagtatatggtgaagagtatgttatctgttagatttagctgtaagataatcattgatgactctgcaaaatttttattgtcagagatgaagcctcagaggtaaggtaaaggcagagaaagaaacaaatgtgtacctcagaagacttataactctaagaaagtgtgtgaggactagcttactttgaagccctgtcatttaagaatagagagatgttaggtagataaacagattaagtaaaatttgaaactttctcacaagagtaaccataaaataaaaatgcatatgagttagaaatcactgaatcatctctctggacacattaatatgatcaaccaggacagctgggtcatgttatcaaatctctgcattattcttcaactgacagtgaagttataataaatgttcaatatcatctgtttgaaaatacctgtacttatacacataagttgagcagtactcacaaatctgcaaacaaaaaattgttctgcatcctaaatgaagaagaaaataaatatcttaccaaattccttaacaaaatgagtaatgctctttaaa

SEQ ID NO: 34025 - DNA, 2335 bp, Bovine  19866881546840
ttacatattagcgtcactaagtaattgagataaactactagatctaggaaagctagaagaaaaaatgttaggcataaaagcactggagcttgtaatagcttaaataattatttctcaaaaattagcacattttcattgtttagaggattactctcaataaattctgtgtgtatattataacaatttgcttctttctagaggtgagttagggtgagtttaaagagcttgttttttaatttactatctctcttatagttaagtttaatgaggttcattgatattggcatgtgaaatgcaataaaacatattgtgatctcagacaaggtatatgaaaacaataaatcatcaatatttagcaacaatgtaaaatattttgtttgcaaggtgtttcatgtaaattttctattctagttttcaatactccctgataatgtaatgatacccattctacagatgatgaagaacaatttaagatggtaagaaaactgccagtttcaatgaaatgaatacagccctaatttataatcaagtatctgaaccaattatagattctttaagctgcatcactatcaaaatgattgctttttcccctaagtatttacataacatacatattaattgagagctttatatattatttataaaaatttagcaattttaaaatcttaaatatagtaacacatatatgctgaagttgcatgaaaatctgcataccacattcatgctcagtcacttcagttctgtccaactgtttgtgatctatggactatagcctgctaggctcttctgtccatggggttctgcaggcaagatactggagggctgcccagccctcttccaggggatattcccaacccaggaatcgaacccatctctcctgtgtctcctaattgcaggcaggttctttacccactaagtcacctgggagcttcctgcataccattcacagaacttaaataaaaggataccaaagaaatatgacctatattaaggaattaactacattacttttttcccatttttttcctgcattgggaaaaaaagaaagaaaaaggaaaatcacaaaaaagcacaataaagtaatagcaaatttcaaattttagacttagaatgatcatatggattactggaagggagaatgaaggctaatactcagtttgttgtagcaagactgcattctctcctcctctgtctttcagggtttggctcatttttgagcctatgtttttttaatggcagcccatggataagcaacacaacctgcgctacctgagggagttggaactgcagaatctaaggcaccacctcagttccactcaaccagaatctgtgttttagtaaagtcctgagtgaactatgtggtgatccatgtggtgatcaatggacacgggtttgggtggactccaggagtcggtgatggacagggaggctgcagtttatggggtcgcaaagagtcggacacgactcagcaactgaactgaactgatgtggcctttaatattcactgcaactgttaccaacaatcagggaaaagaagaaagaaactgagtatcaaccccagtggtttcaagtgcctagattaatactccagggacttaaaggtttaatactaagaggcctctgggttaataaactgctcacccattgacttgacagatgaaaaacgatataatccatcagaaataatctgcatcttcaggtgaactgattgttcagtagtggagccggaacaaggtgagtcttaaaatgagattgtaaggtctaggatgccagggattattcctggcacagaacacacacacacacacacacacacacgcataaacacagaatctcttttgaaaaaaaattgttacaggaaagaaaatctgcaatgcttttatttggggaagtcctatggtaaagtttgatcccctagggacaatttatccacagaagaatccagaaggaaacacaagatcaacagcttcctaaccttgataatgagtcaagcccagggttaaaatgaagtttgcgttactttttgagataccaaatgccagtgtctgggccttttctgtatcttaactgagccttcctgactcccttcagtcaaatattccttgtgttgaatcattccgtaaggacttcttgactcagtaactagctaatataataagatgcatatgctagttgtttcctaaaaatgaataacattcattttgagagaaaatgtcctaatccaaatgtgtgcctgtaatggaagaatgatccattttcctgttccactgataggaagaggcacttagtgatgcgttacatatgggactcttaagacaaagggactcttaagaca

SEQ ID NO: 34026 - DNA, 711 bp, Bovine  19866881987201
tatgtgcatgtctcaaatttagcatactaaaaataagtgttagttttattatgatggtaaaattatgatattttcccccaaatttttcttaagttgatttctcctataaagaaagagaaagcagatgaatcaaaaacataagctgatttattaaaactgattgctattactcttagatcttgatttccatgcaatttgaaaatgatcatcactattctgaacacacagaagaagcttagtaaatgcttagtgccttgatgtgattattaataccgtagctcagacatgacaaggaaagcgactagaggtggtgaattgttttacagcagacattctatttttattttaactattgacctacttcttgaggttgagagagataatgtataactcagtctcattttaacttagagtaaggaagaaaaagtgatgattatcttgtttatttacagaaggattataaagtatcatgctagacttttctttctagaatatgtaattttggatgccatataaaagtacactgctttcaagtgtgatgaaatgagaaatagaagtgtgccacctttttaattatgagttaatggtggtattttcagaaattcggtaagtagctcagtttaaaaatggacaaagtgtaggaagttattttgggaacaaaatgtcattaccaaaggtgtactttttcatatattgaactaataaatagtt

SEQ ID NO: 34027 - DNA, 1841 bp, Bovine  19866880360161
tagtaaaggctatggtttttccagtagtcatgtatggatgtgagagttggattataaagaaagctgagcaccaaagaattgatgcttttgaactgtggtgctggagaagactcttgagtgtcccctggagtataaggagatccaacctgtccatccaaaatgaaatcagtccggaatactcattggaaggactgatgctgaagctgaagctccaatactttggccacctgatgcaaagaactgactcattagaaaagaccctgatgctgggaaaattgaaggcaggaggagaaagggacgacagaggatgagatggctggatggcatcactgactcagtggacatgagtttaagtaaactctgggaactggtgatggacagggaggcctggcgtgctgcagtccatgggtggcaaagagtcggacacgactgagcgactgaactgacctgaaatgaactatgctcatgaacacttgcttctgatttttcctaaatatttatgaataacagagtctctcattcgacagcaatgttcttggcacagctcttcttccagatgcagcatccagtatggtcttgaattaaggatcaagtggcatcctgagtgctgcttccctcaaccatctgctagctttgtggggttttaacaaaccaaatgtcattttaaatgtttccagtgctcctaaccacaataaaataactgttaagtaaaattaacttaaggcttagcaaactagaaacacacacaaaaaagagataataatgaaagctcattcctctttaagagagaaggaggtggaactgatatcttttgcatggtcagagtctatctgagatacagtcagtccctttaggccagaaactgctttacaaattaaatgtgaggacaggtccattaaaagtgagtaagcatgggatcttagggtttatagtaaacttcacctcaggcccaccagagttcagagattccttctaggttattttccatttcatccttcatacccatttttcggaaaacaggcccatgggaaagagaggatccaaactctataaatcttagtccagggtgccctaagattacttgattttaattgctcaccctgactgtagtttgacatctgttccagtgttccttccaggaagcaagtcacagatgcaagaaggctgaaccatccagttgctcagtcttgcgtgtctaattacttcccacccaaggtcaacatgacaatcagatactcaaaatgaaacctattaaggagaaaaaatattttaacctcagattagtactttttaatattgggggtgtaatataccattcatccctactttgttttaaaaaattattttaattctcttgtaacttttcttccttccagtgtagtaagactttatagcaatttgtaactctatttcaattcagcattgctaaccaaacattgttattttattcatgcctataacaaactgtgatactgttaaaattctccgttttggtgataaaatttttaaatgtggaggatctaggaattctgagtagctttttaaaaatattttctctgtcttttctgtgactctaaccttcattcaattcttctcttcttcaatttttctatttcaaagagataacttttgaggacgttttggttctaaatattgtacaattctataaaaataacttctatcacatctatttggaaaattttaaatattaattattcagaaattttgtaagattggcagtggaaaaagagcaagcaattggctaggaggaaaccataaatttggatttctagtggtatcctcaaattccgttacatatccaggcaatactttgtaaccat

SEQ ID NO: 34028 - DNA, 1126 bp, Bovine  19866880477217
gtgttcttgcctggagaatcccgagacgggggagcccggtgggctgcggtctctggggtcgcacagagtcggacacgactgaagcgacttagcagcagcagcagcagcagcggtaagccatgcattgctgaggctaccagtatctggtacatagtagatgctcaataaatgtttggaaggagtgtttataagctggtttaacaatacatgtcaaaagaatatacttaaaattacaaggactggtttagaaatctatttcatttccatcatagtaagatgtgataggattggactctatgattctgcttcatgctagtatttgtatttgtaggggatgtattagaggcaatttaaactgttaattctctatttctgaagagtaaaaatttttgtccactataattagaaccttgaggacaagtgaaacagccagaaatttttttctatcagcccttaaagaatttctttggtcctggaattattgtcaaaaaatcattaatcctataattcgttagagcaagaaattctatattatctcaaatgaatggtatttttcttcctctcaccacgtcctttatattcatctcattttcatgtcactagatcaagaaaactaaaggcactctgcagaaaaggctctcaggatatctcacaaacaggatcttatgaaaaccaaataaactggaacagaagaaagaggcacagatataagaggttctaaaaccttctgaagttttcttgaagtcccagggtttactttgatatccataacataacataagccaagaaatacagctttgtgaccactgcctcattgttatttcacaacactaggaagcataatctatgtgttgataatttatctttgaagtataaattattcagtattttcagggtgaaagtcatatggtttagagtcacaagaaaattgcatcagcgtcctatctttataatgaatgactaggtttattattccattgacctatggagacatgttagagaattaatgtactgtactgtatgtgttatatacgaggcttgacacatataaatattctgaaaaattactcatttagttggctggatcatttaacagatttagcagaaataataatccttttagcaa

SEQ ID NO: 34029 - DNA, 1617 bp, Bovine  19866880632387
acctgaatttgaagccaatctcccggtctgagatattaaaaaacagtccacacagcatttctttacactaaaatcaactagtccatcttcattctaaatgcatcttttacccccaaatcattcagtaacaccacaggtggtcatttgaaaaatattggctcactgagttatgcaaatctttcaaatgttgacttcatagaccctccaaaagggggcacgagacccccaggattctagggactacatttttgatagttattgctctataagaacaaatcttttgcttctttagttcaactagaatttcccagttagttggacagtaactaccacacagtaggtactccataaatatttgttggataaagaatgaatggatggatgaatgaattatccctgcagacatttggttgaaatttctttaccactctatctttgagaataaaatgtacctgcagtttaagtattcatttcctatctccaaactgatgagctctaaatcatgcatgttttaacactcccaataaaaacagtagagaagacttttaagatttaagttatcaagctaaataatggattaattgcaatttacaaacctctgataaaaacacttactggacatttaatagctaacaactatctgagaccatattaagataatgtattttgtcctccttttaaaatattttttgcatgaaaagtatgtgtatctatcacacagtcaattatctcccacagcatgagaccattcccaacatacgcacaggagagtaataacagagtatttggtttgttttaaagcaataggtacactagaatattctaccttatcgaaatacctttaatgtcccagtgttaatgtctttaagactgtgaactagcaagagtgtgtgaatgctccagtatattgtactgattcaatgactcagaatgttaaatgcattggataatctttctttttattttgttttcctcccaaatgtagggggatgggggaagctatggggattgtttcttttcttagcctgagcacccctgtggagaggatccaagcgtgaagtttcctttgaagtgaatggaatctccccactcagatcagttctgaggatacacagaggagaacaagaaactggccgaatgaaaacagacactagcatttaaatgaggctaggcttaaaagaaaatgtatgggtcaaaaaatgcccagatttgaaaattaagacgcaatttttcagcaatcctaggtcaaaccatcttgtaggtctttcttaagtctaacacaaaggaaacaacagtagcaaatattcaaaaaaacataatgattaggttagcaatagggaaacatatcgaaactgcacagatgccaagtatataatactgtggatataatagaagtctggcaacatccatggattgtatgtgccctatatcctgattttcagtatgtctttaataccagcaggttggtaaagtaaaaaacagaataaaaataaccattacaaaataatattccagataagaagtcaagcataagtcttgctgatgtgagtaaatccaatgcaggaaatataatcttctttgaatgtaaaatgtatctgccatctataaaaccaaaat

SEQ ID NO: 34030 - DNA, 892 bp, Bovine  19866880756788
tgtataaatgatgtggcgtaggactgcaaagactgtgattgtataaaagcctgtgtcaatactgaatttgaaactaaccttgacaatgacctaaaattgccagcctgggtaccctgagcaatctcggccatagtctgctttcgcataagagctgcgaattattatttagtatggataattcttaaaggcatatgaaaacagcccatggaataaactgtatatgtttcaagagaaaatggaaattacaaagggaaaattgagtggattaaaatgtgtgacttttcatagcaatggcccaaaagatatgggaaaggtggaaggtggacaccatgtactttatatggcttttaacgtgtaacgatattagatctgatattattaatgaaaatacttgcatttttaccaatctgcatatatttaaatagtcttcaaatctacatgctgaaacatcacaattttttcttctctctcctacccaactgacacatctccatcaataaccacttagaaaaataggcaaggcaatctcaaaaagaattactgcgcttcattatgtaaaatgaaaatggagcttttaaaacacactctgtctgacattcagttctgtatgctgctacagcaggtcaaaagccattagccacctgctgaaaatacatcctaggaaataaaatgcccttcaaaattatttcacatacggtatttccaaagtaaaatgggtgaggtcatattctaaatgtctaaaaatgtgatatctcaaaaagaaacacacttaccatgtcagaaattaatttgaacacagatttaataatggccatataatttagaacattcacattagagaaacaaagtaccgtgtctactagagagaaaagagtacacagaatatcctaca

SEQ ID NO: 34031 - DNA, 828 bp, Bovine  19866880799740
ttccaggctcatctgagagccttttaaattgtcataaaaaatctccacaaaagattccaatgtgtttattgtaaaaaaaaataaaatctgtgtataaatagacccatgaagttcaaacttatgttgtccaaaagtcagctataacttgtatatattgttgataaaatgtgagtccatgaaaaaaaacattacatatgtagagttaatcattacatactaatagattctttttcttcaaactcaatttttaaaaaaattgatgcagagggcatacaggagcatgcagaatgttggttagattcttttttaaaaaatatattttttttcaagtaagtctgaatatatacaaatgtctgaaaattgtgtaattgaaattaactttttattttatctatttccaaaaactttgttctctgaaatttcttatgtggaaaaagataggcttttccttctcattcatttgatgtgttgtcatactaaattggtatcagtaaaatgggaatgatggttgaaacggaagttgttcagagattccaaccaaatgggtctcttctagatttgtttgatttatttatgttgatttctatatttaatttaaatgtaccaattaatgcttgaaatagatggggaaacagtggaaacagtgtcagactttattttttttggactccaaaatcactgcagatggtgactgcagccatgacattaaaagacgcatactccttggaagaaaagttatgaccaacctagatagcatattgaaaagcagagacattactttgccaacaaacatccgtctagtcaaggctctggtttttccagtggtca

SEQ ID NO: 34032 - DNA, 3326 bp, Bovine  19866880923066
ctccttaaatttaatatggtgactagaactgtacttttactttgattttaggtcatcattttgaacatactctagttaagtcctatgtggctgatatgtagggttggtggtctttctagaaattggcctcagacttttcttttatgtcatctaacaatctgggatttttgtcttggaaccagtaaaaagccattgcaagattttaagcaagaccatgagaaaatcaaatttatatcttagaaatggtcattatggcagtcatttggagtttgggattttaggggttgagataagagacaacatattgtaaaataaaacattaagatactctgactgaaattcacagtgtatacatgtatatagtgtatatggttcaagaatagcagataaaagaaatgaaaaattccaattgcaaatatatgaagccattagtaatcatacagttatgttcactatgttcaacttaagaaatcaagttggaaaatttacttgtccaactttgaagtgtgaagagatggagacatttacatggaaagttaaacaatttttaaataaagcacatgatgaatttggagtggcattagaatcttggacttggctgcagtaaagtaggcaaaatattatgaagaggggactacactgatggcaggggagatggagagaagagaatgtacttgagagttcaagaaccattcaagaggaggaatccagctggattcatttctcaactatatgtgagaattgaaggacagagaaatgtcaagaatgcctcctggcttgggcagctaggtatctgataatactcattaggaagagaaggactagaaaatgagaaacagagatggggcagggaggggggaagtgaaagtcactcagtcgtgtctgactctttgtgaccccatggactattcagcccatggaattttccaggccagaatactggagtaggtagcctttcccttctccaggggatcttcccaacccagggatcgaacccaggtctccctcattgcaggcggattcttcaccaactgagccaccagggaagtccagggatagaggagatgaagtttagttgggtatttgttgagctggaggtgactgttggacactggaatggagatacccgtgaagcagtaagatgctcagatccagaactcagggaagaaagttgaactggaaggtaattccgggagtcattagcttccaggtgactgctgcagccctcaatttagatgaaatcacttatcttataaggtggcatgagaaaagcagaaggccaggaatgcaacacagagaaacataagcagcaatcttgtttaggaaggccgtaaggacagtagaaagtaaaagaaagttaagttgctcagtcatgtccaactctttgccaccctgtggactgtagcccaccaggctcctctgtccatgggattctccaggtaagaaatactggtgtaggttgccatttccttttccaggggatcttcccaacccagggatcaaacccaggtctcccgcattgcaggcagacactttaacctctgagccaccagggaagctactatctagggcaggagagacagagctattggagcctagctttgcccctactggtttgggtgagttatcctctcaagcttggtttcttatatataaaatgagggtagataatgtttcctctgagggttgttaaaacggttatcaggataattagaaataatataatgttcctaggccagtgccaggataatgtagctttcatcaacatcctcttcttcactgtggtcacttctcaccaagcttgtcagaactaggtgagcagaccaatagcttctgagtgaagacaaagatgctgaccagaagaaactcagagtttggggtttcaacattagcacatccttttggatactcagaaaaccatttttgccagttattattttctaactactttaggatcgttaaaattgctgcaaacattctaacactttcatctacattgtctacatagatgtcataaaaacagagcatcaaatattaggcaaaaaagacaaaaaattactgcagattgtcataggataagtatcaaagataatgggaaagctgttcagaagctttatgaagagaatcaggaccctgttcttgggcatgacctctggaccttgtgaatttactgctgagcacgtaagtcacgactcaacttagtggtcgacagccttctcccccgctcccctcaccctttatacagtctgtgacttcgtgaacctggcacgttgtgtctctcagaagagaaaattaggcaaaatgtgcagtttcttctatcatattaagacaaaggctggtggaagtactattatgtaactcactgaaatgaaaaactccaggacaaattaccaggcttatcaatcaaaagaaatatatccagcacgatgtacagaattttgaatgtttccctgtaagatatcagctttgccttaaagtctgataaagtcactttcgaaaaatataccagccaccgtggtaccctggcagtttgaggcaagcagtatttgtgcaaggtcagcacggtctgaggatacgtgggcatttcctcagagggcaagccattcaatctcgtttgcaagagggacgaaggcttatgaatgttttaggactttagtgatctgacttgagtgcattaaatcatacaagcttgctcttaactaaagaatatctgaagaacttgttgatgattcaggaatagacaacaaagtttcccttattttctaaccaactttgtaacttatccctgaatcaccagttagaaaataagacctttagaaagattaattgaactgggattattctgcttgaaacttgagaagctagtgaaaaatttagtagctgtctattcctatctctgttgcttttacaggttaagagtgacagatgcttatatgaaaaactcaagtgataaatgtatatgcacaaagggaaagtccctgtcattctccagcaacaaataggaatatagattcctccacacttttcccccgtgcatgcatcaatatattaataatactcttaattaatagcgatattcaagtccaaagcttctcggattggtgggagctgaggagaagggaaagagagaaaggagagctggagacaagtaaaatatttgatgaacatttccctctatgaccaaagaaacattgggttgcagtgaggaagaaaagttgtgtctgtaagaatatggagaatgtagattccttctctgttttctccattatcatgtttcagtgtgaaggggaagggcagagttcacaccaggggcaagtcccaagcta

SEQ ID NO: 34033 - DNA, 1314 bp, Bovine  19866880932032
tctatctagaaactgtgtgaacatgtgtacaaataggttctcacaaatgactgattaatgaaagtcagatctgttcacttatctacaatttccattaaaattttagggagttgagaaaaagtggctttaaaaatctgtggtgcaaagatatccagtataacaagtgtgaaaatgaagtgctttttttacaaaaataaaattctgaactttagtcaatgacctgcttacccaaagtctaaaatacaaaataatttggaagataactatgttctttgtaatggaatctaatctctctctctttccttggaattattggtagaaagtttctccttatctcctgtgctgatgcctgaaaatattcctcccagtttacataaataaaagtctcaaaaataagatcagcagcaggtcttgacccctgacttgcagatttttaaaatagctctttgagtgcatgccttttcttgcataagagaaagattggctattttaatctgggtagctcgtcataggaccgaaagtgctgtactatgtactatgatctatgtactgcgtactttttctgttgttcagtcaccaagttgtgtccgactctttgtgaccctgtggacctcagcaagcccggcttccccgtccttcaccacgcccgtagaatttgcccaagttcatgtccattgaatcagtgatgccatccaaccatctcatcctctgttgccttcttctccatgtgccttcagtgtttcccagtatcagggtcttttccaatgagtcagttcttcgcatcaggtggccaaagtattagagtttcagcttcagcattaatctttccaatgaatattcaggactgatttcctttaggatggactggttgggttctttgcagtccaagggactctcaagagtctcctctaacaccacagttcaaaagcatcagttcttcaatgctctgccttatttatagtccaactctcacatccatacatgactagtggaaaaaccatagctttgactagatggacctttttgggcaaagcgatgtctgctttttggttagttaaaatatacttgttgaatgaacgaatgaatgatgggagattggcggatgcaagacaactcattttgtctaaaaagaatttaaattctctcatcttacttcctctaactgcatttataattccttttttaagaggcacatttcctatacagtttatgagtggttcaaacagatttcttctgttttctgtgctgctttcatctatcaaaaagaaagaaagaaaccagaaagaaaagcaagaagaaagaaaaagagggaaa

SEQ ID NO: 34034 - DNA, 806 bp, Bovine  19866881006815
tatgctgataaaatgcaatacaatttacagagtcaaaccaaacccagcatattcacatatggtaattcctgtctgaatatttcttctatctttcaattagatacagggcattctggctgagctagtgctgaggctcatcaacactatttgtgtgcagtttgacaaacccctatctctccaggtcctaccccagaagtactttttcttttcttttctttatttgtgctctgtgtaggcaaagcctctttagctgtcatagaatccttaggggatgtgatcagcctcttgagagaaatgttcctttgtgtgaagaaatgatctgtcaggatgggctagactaacacttagtagtgttcagaccatcacatcaagaattttagcagcaaccatatgcattgagaagaagagaaaaggggatgagtgtaaaagaactgcattacgaggtctctagcccatctgctctttagctaaaaagaaactagatgaagaaccccacaaatgctttaaatttgtaattctcagacttcggcaagcacgagagtgaaaacttataaaccagcattctgagattctgattcggtaaattcacactgtggccagagatcttgaaatttagtaggctgccagttcatctgatactgcagatatatgggtcacaatttgagcagttctgctcgaaagcacagactgttagattttagtgtgcatcagaatcagttaggggtttgttaaaacacagactgctggggtctgcccccaaggattctgactcagaagtctggatgggggcccaagaattcacattc

SEQ ID NO: 34035 - DNA, 1534 bp, Bovine  19866881008126
atattagccagagtaagaaaatcaagactaagagagaatggatggctaatccttcaaacttaattccagatttaaatccatgagtgttttggaaagggattgtaaattttaatattgaacagagttataggaaacattggttctcaattcagaatgaagtcatcatagggtgagtgttcaggcataacacttgtctatatactaacacacagaaagcacatgagacatttatttagtgaatacatggatgtataaattaatcaatgaacatgctttaaaattcgcttgaaagattccccatgaggtatgaggaaatcacccctcctctctcaagcccagactctgtacctacgtacctcacttctacatgccagacatttgctgacagctctccatcagttattgcagtgccataattgggtaccacaggcctgctgcattgagggtaagtggaactctgtcgtgcctggcagggagctttgcctgggagctgacaactacatggaattgactgacaccttctgcaggtgaagaatcttacaatattatccaacttaccaaggcaatcaagagaagggatatggtcaatttaaaaaaataacaaagaaatttcccatatctggattcatgttttttagattcttctccactcatggtctgcctctaaaaagccattatgtaggaaaaactaatttcattttcatcatcaatgaaacaacccataccttgaagtaattttaagccaggtaaatttaggaaaagttaaccaaactaaaattagttgaatcagtcctggccattaaaggagtaacagatgttatagccaggctgtcctcacattttgccagaaaatcaagtcataaatttagacagattgcaagatgttcagcaatattccaaatggaatcattctgatcttaacaactaatactgcagaattgctgaggaggggctatgtatggagggaaaaaaaaaaaaagattgctttagagacgacaaagaattccagcatgagggtcttttcaaatgagtcgattctttgcagcaggtggtcaaagtattggagcttcagcttcagcatcagtccttccaatgaatattcaggactgatttcctttaggatggactgactggatctccttgcagtccaaggggctctcaagagtcccaggactttgtcctggaccctttccttctacttacatttcattagcacttgtgcgggtgctgtgcttagtcgctcagttcattagcacttcagatcagatcagatcagtcgctcagtcatgtccgactctttgtgaccccatgaattgcagcacgccaggcctccctgtccatcaccaactcccggagttcactcagactcacgtccatcaagtctgtgataccatccagccatctcatcctctgtcgtccccttctcctcctgcccccaatccctcccagcatcagagtcttttccaatgagtcaagtcttcgcatgaggtagccaaaatactggagtttcagctttagcatcattccttccaaa

SEQ ID NO: 34036 - DNA, 694 bp, Bovine  19866881128005
tagattagaaataaatgtcattgatcatcgattttatacaatcaattaaacatttatataaaacagatctcaagtattctaactagcttaacctcttatccgcagaacacctctaaatcagtacttaatattgtttataacaaagcttctatggtgtccttagaaactctacaatcccctcaggaaatgattggccaaagggactttgagctaatgaggttaatttttgtggtttgttgcttgtgtatttccaagaccgctgtaaacacagtggaaatttttcagtggagttaaggggcttccaggcggctcagtggtaaagaatctgcctgccaaagcaggagtcatggcttcgatccctgggtcagtaatatccgctgaaggaggaaatggcaacccactccatttttcttgcttagaaaagtccatggacagacaacctgcgacagtctatggggtcgcaaaaattcaggatgcgattcagcacacacacagtggtgatcatagctgctgaaaaccctttataaaatattagatgctctaatttccagactcgaattacttttattctaaacgttattgttaatgtcaactcttcaaatacgatgattaatttgctttcctaactagattgttcataaacagcatgaatcagcaaaaaacaaaaatgaaaactgacagcattaatgcccta

SEQ ID NO: 34037 - DNA, 833 bp, Bovine  19866881182861
cagtacttaccagtatgtggctcataccgttattatcctttttcttgtttccattatctctgacaagtgactctttactggaactctaaatgagagctgatttctaccaaaaaatttgcagtagcctgttgagttactattgaaatgcaacagactgtggctaaatctgctgtctttgtgtctgtgggaaatggagtttcctgaagctcataaagttaacattactcgcagtaagatgatttccccagagattatgcttcaatatggaatactctagatttatggcacagttccaatctaggttttggattctttctacagataccctcataaatttatgaatcaaaacacacatttagaaattaatggaagcatgaatctgaagataacaattccaaaagtcagcttggcttttattgtcgtgcagaaaaaataaattactctcaatgggaatttagtttaatttactgctcaaatattcaattgtaagcattaagtatactttaaatggattctttcaaaagtagttcataaaaaatttgttgggatattgctaagaaaaattgataaatcatatatgatacaaagtaaaatggtcactcactccctatttgagaaaaaaaaaataacaagaagctgatctattccttttcttgtgagcaaaagagaaacaaaaaaaaaattcttccaagaattgcaataacatagtttcaggaattcatatcttccaaagacagtaattgcacattttctttatttttgctcttgagacaatgggacaaatgtgaatcaagaactgggaaagagagatagtgatttgtattcatgttttc

SEQ ID NO: 34038 - DNA, 1604 bp, Bovine  19866881220325
atttagcagcagcagcagcaacacaaagcaattgatactgtatttagaacagaccagttttatctttcttcactaatgtttctttgaatcatacaacaatgaaagtaaaattgcaaaattttagaaagaagaggaatgagttgaccattgtactaagggttgaacatgtcttatttaagtctcgtaatgactctataaataagtgctatcccattgtatagataagaaaaatgagacgtaagaaggttcacacagctagtaagtgataaagctaggattaaacccaggctgtccatcttatcctttctcattttctactttagctgtcccttttggcttcctctttggctcaaagaaattggatgacatatcctagactgtcacgtgatagggtctcgaagtttatctcttgattttcagatgtattatgttttctccaataatacatttttgagttaaaaagccttttctataacacctgcccctcaaattacaacctaagtcacagagataactggaatcagctggtggtgttggtagggcacataggttaggatgctatcagcagcaagtaataggaaatcctgaatcagctggtttaaacaatgaataaaataccctgtaactcaaaacaagtaacctcaaaaatgagtggtgctgaaaatcagcctaaatacactgacattcctacagatatttatagtgctgaacttttatcaatgagcaactgaatgaaaggagttacataatctgttgttcaggctcggataagtcccccctaccaacccctctaacacctcagcccaccttcttgtgtgagagaatcactgaaggcaatattaagattcctgagataagattctgccatccttacagctggttgcatgttgctgttgtcgtgtagtcactaaatcaggtctgactcttttgcgactccatggactgtagcccgccaggctcctctgtccatggggattctccaggcaagaatactggagtgggttgttatttccttctccaggggatcttcctgacccagggatggaacctgggtctcctgtttggcagacggattctttaccactgagccacccaggaagcccagaaactagcttgcttagaaatttagccgggggcaaagtcctaaggagtataggcttctaatcttactagattcttattctctttttatgaaagggaaggatctctaaaataattttagcgagtccatataactttaaatactttttttttctaattttattttatttttaaactttacataattgtattagttttgccaaatatcaaaatgaatctgccacaggtatacattgtgttccccatcccgaaccctcctccctcctccctccccataccatccctctgggccgtcccagtgcaccagccccaagcatataactttaaatacttttaatttcaccagtaagagcccaattttaacatgcatcatgcttgtcaacaggctgctatttttatcactaaaagcccttttctggcattcagtatgttaattagccaagtgtaggttactgaggaagatacagctaacagaagttcttgtaagagcccttctggaattt

SEQ ID NO: 34039 - DNA, 772 bp, Bovine  19866880736398
ctgcctaggaaggcaaagaaaagtcataaatgtaatagcaccaaccaaaaatattttgccaggaatggtaagactaaaagggatgaatgggcttattagctcagtgaaactttggacatggtagcatgtgacaggagagatcgatttttaaaatactgtgttactaggttatcaaacacttatctgtcatcttttatactcaaaactagggccagggatcttctgagagatggaactcacctggaataattatagcagctgacaaatgcactcacgctgcccgtggtctacttgctttatttgctcaaacttttgatttttaggcaaactgccagattctcatggtaatatccgtgtcccagcggagactctggtgtgcacaaatctttattgtgacagctccctttggtgcttctgtggttcaatgaagtgaaaataatgatgagagatttcaagattttggaaagtagttttgactatttaaaaagtgactattttagtttctattttataggatttagagcttaaagtactgaaaaaaaattctggaaactctgacacccttaattttattttttcagattctgaataggaaatacttcctaattgaccaagttaaagagagacagacattgatgcacattttctttcaacagtaaaagaaagaaaacacaaaatagactcacctccttttaattacacatgaagttagtattagtctgaacagctaggaaaggagcaaaaaaagtgtgttcattccttcaaaagctgc

SEQ ID NO: 34040 - DNA, 1275 bp, Bovine  19866880943814
tccccaacacacatacacgtacactcttcattcttcttaaatagttattctttaaggaaaactgaaatgtgacacacctatgggccatccaattacttattgaataaccccaccaaataccaattatgtgccaggcttaatgccagagcttcgaggaatgcagaaataactcattataaagctgatctcaatatcttatcatgacattgaaggctctgaaaaagacacatatgcacccaggtaacttaaagggttagaaagactatactgaagcttggaaacatctgagctatcacagaagggatggccagccatctttccaagacttcgggagagtgtgacaaggatgtcactgggcatgtacaaggatggaggcaaaacctaagaaacttttctgctcattttttgtttttcaaaatttgggctgaagggagctaattctttggcttgaaatggtgtaccagtgaggtgccagaagccttaggttcagggtgcttcaaacttgtacacagtttgtagctacttacgaaatgattccctcacaacatttacccctcatttagaactgctcatagagcactacaggtcaaatacatatggcagtgaaaactgtggaatgatgctacaacactgagagcacatttgtaaatgcaggcatatggttataatggcattatttttaatccaaatgctatataacatgcctcatttaggatttggttcatgcctggcatgaatcaatgggaaaagctatttgtgaattatccaagtgtaacaggtggtctggcaactcattttagggagtttctcagtctcactgccaccaggggggtgacctctgggtggactttcaaggccacctggatttcctaacatctgtagcaaagggttatttcaactggtattttagaaagcattcaaaattgctgtttgagaggagaggaggaaaaaaaaaaacactatggaaaacaatggacagagtcagtgaacagttaaacaaggaatgtgtatgtgtggttgtgtacataagtatacacatggtatgctctcagtgacctcagttttatagtaaaaagagaattctaatgtacatgattgatttttgaggcagcctttgaaaaaagcccaaggcactacaccactgtgcatcatatatgtgcagtggtccctaccctttctggcaccagggcctggtttcgtggaagacaagttttctacagactgggggtgggggggttttgggatgatattcaagcacatcatatttattatgca

SEQ ID NO: 34041 - DNA, 1114 bp, Bovine  19866881753897
tgggaacagttaatgtctgtttcatggtgttcgggacctcagctgggataatttgattgtgtagagccagccaggcaactctctctccatacagcttttccatttggctagcttgggcttcctcagaacatggttgccctgaggttctaaaagtgcaaggcagaaattattagtccttttataggctagacccacaactagcacagaacactactggtcaactaagtgactaaggccagcctagactcaagtgggagggcaatcagattccatctcttaggagtagaaaagaatctgcagccatattcagtcttgcatagaaatatatcaccaaaagtgaggcactggagagccgaaccttcccccagaagtgggacctgaaggtctcatacatcgacccagaaaaagagccagggttaggcagttattcaacactagcaaagcttgttgcctttctttcttgataaaaacaaatacaattagaaatttctgtattcctacggggcacctgctcctttctaagtaaagacaggcattatggaagcttgaaagaagcagtgatcacactgaactgaaagatgcaaatgggtgatttgctatggctctacaatccatgccgctgggttgcaggcatttgaacattttgaagtaaatgctctcaattggcttccaaatgccagcttcttgttttcatcacacggtggcccagcttcacgtgctggactggctgctaggtgccgctttggcagtctctgtgcaccctctgacaggtggatgggttactttcacagagccagaggcctcacagctgctaatagtaattatacttgtcagcaatgtattcccctcaggaaactcctgctgcttcattagggctaattgccaataggcagtgcaatttcctagaagaggaggggacataaacccacagggagttgacagaacagctgtgtgagctcagagaagccagatgtggccatgtgccattaaagtgtagctgagggctgctgaatgcattcaacccagttgaggaacacaagaatttggtgagggaggccaaactcctctccagcttgactctcctacctgctttcgtggaaaatatgaacacagg

SEQ ID NO: 34042 - DNA, 2107 bp, Bovine  19866880197959
caacaacacaagagaagactctatacatggacatcactagatggtgaacaccgaaaatcggattgattatgttctttgcaaccaaagatggagaagctctatacagtcaacaaaaaccaagaccaggagctgactgtggctcagatcatgaactccttattaccaaattcagacttaaattgaagaaagtagggaaaaccactagaccattcaggtatgacctaaatcaaatcccttatgattatacagtggaagtgagaaatagatttaagggcctagatctgatagatagagtccgactcttagtcctgtgctaaaccagatgaattctttctcgttccttcagtccgtctttgctttagccttcttcagtttcccataggtttccttgatagaattgtaaatattaattttttcaaaattattaaatatattcaaattattgtcttctggtagctcatgaagtgtgaggacagtgaaaaagcatgttggaagtctgctgctgtgttgtataaaaacattggcttgagaaacttctgatatggtctcttaccattttttataatttcgaaaaacttcaaggaaatttagttttaaatctgagtttattgctttcgtttttgtgacgtaattgaattttcccaaatgaatgaaagtgaaaatttagccattcttgaataaattataatgactagatcagcactgttcagttggaatattgtttgtgccacatgtgtaatttaaaattttgtagaaggtatatgagaagaaatcagggtagaattagttttaataatatattttatttaacttcatatgtacaaaatctctttcaacatataattgacctaacaattgttaatgatattttacgttgttttgtgcttcaaaatcagaaatatcacgtgttttatactttgagcacatttcagtttggactagatacatttcaagagatacatgtggctagtggccactacattatatgacatataggtctaggtaaataaaatgtaatattacaacaatagtgggctttagctgtgtgtgatagaacgtcagtagttatcgctggtttaaagcttgtctttatgttgtagcagtcacttatgtggatggtgaaaatttacccatatttgcaatctctgtcccataaatgatttcaccagttattcatttttcattcccaaagacttgtaagttttcataggcctaaaatatgctcttagatgattgagagagtaaaccgaatttagtatacatttgttctcttcacattgataaaatctgtaggtgtgacatgagcaagtttgtattttgagaagctcctcttggttcactgtgaagagattggagaaggtgtgacaaggcggagagatagtgggaaggctattgcaatttacagcccctgatgggagggtgtgtgggtgggagataagatagaaagaagggggcttatagtagtagcttgagggtgattgaagaaatggttttgtttttctttgcttgtgtgcattttaaagatgattgagacttaaagtgtagatgtgaggtgtcctgttgagaagaagaagatgaacatatgagagaaaaggataactgatagggtaatccagagaaaagatgggaagagatgaaacttgtatataaagatatatttttttttttgcataggttttgtcaagttgccttaaactttacaactgtgggaaatatctgtcactaagaaaatcaaaggataaattaaagactagagttgtattctcctccatctccttagaagggagagaaaaggtgaaattagaattaaaataagaagtgagagagagctgacttgtggttgccaagggggtgggggttgggagagggatggagtgggagattggggttagcagatgtaagctgttgtatttgttgttcagtcgctaagttgtgtccagctctttatgactctggattgcagcacagccagattcccctgtccttcagcatctgctcgagtctgctcagattcgtgtctgttgagttggtgctgctagctaaccatctcatcctctgccacccccttctctttcgcttccagtcttctccagcatcagggtttttt

SEQ ID NO: 34043 - DNA, 1574 bp, Bovine  19866880346127
cagtggtccagaaggacaaaactgctaccagatgtcttctctgggaaggggcctgaggctggggggcatcacatgaattttggctttatttgtactacttgtattttttaaaaataaaaatatacttggtgttagaattaaactgtttgtaaatgaatggaaattgacgatgtagagaaagaacatgtacgctactccttgacaaagtttaaagatgaagagaaagctggccagaatgaggcagaattaaaggaaggaatttttaggatgtgggaaaattgagcactgctaacttcagtcaagttacagttttgtataaagcattatgaaggcgcggggggtggggaataacttctagaatacttccacttattaggtcaagatttcaacaatgctttgccagcaacgactttcccactacagttaaatatgcatgaaatgatagaatttctctttctgtttttccaccgcatgtttctttaatttgtgtttctttggtgtgtgtacagctttttgtaactaaagtgctgatgccattatggaaactgtccgtcttcagagctggaaagacctgagaatagaagctgactttgacttgtgtttggtctggcatggctgcggacactgcaggagtgtatttgtttttcattaatttgtttgtaatttttctccatgatctatggaacatttatttcccctgaagcaaatgtcataggtttctcttggttctggtggggtaatgaattgttgagaataagaaatttttcttatatgctatttgattgtggaaggagacattttgtgaccttttgctgttttacaatgataatgaatttcctggcaaacgtggaaactttgggcttctttattaaaataatgaggtttgaggaataactttgacctggacctttgtagaattaatcaaatatggattttggaaaaatagatgagttcagtctttactgagacactttaatgcattcctgtcaccaaggcagtacacagatccatatcacataaaaacatcaaacaattaaatacagacccaagtcccagcacagagcttcaggcatgttgtgtgaggaggttaaggctcagggcctgtcagcctgatcacagtgttactctgtttcctgtgttcgttgttcctttttttttttttaattgcaagagtaacagtacaacttgtaaaaaaattttggcttatactgaacaggatgaaaaagataaaagtcatctgcaatctcactctcaaaagctaatggcccatcataacattttggcatattccttctagtcctattttaatgcccatatttttgtatgcaattgaggtaataatgaacacaaaattttctactctgcattttttctcttatatactgcataaaatattttgtgtccatctctaaacatttagaaaaaaattttattggagtatagttgctttacaatgtggcattagtttgtgctgtacagcgaaagtacatcagttatacatattaatatatccactctattttaaatttccttcccaggtcaccacagagcattgagtcaagttacctgtgcta

SEQ ID NO: 34044 - DNA, 3552 bp, Bovine  19866880350776
tggttgagatggtacaggctatttgttgcctacactagatgttttcttttttttaaaaacctcagtatcaaggtaactcagctgataaagactccacctgcaatgctggggagaccctggtttgattcctgggttgggaagatctcctggagaagggatcagctacccactcctatattcttgggcttccctggtggctcagatgataaagaagccgcctgcaatgcatgagacctgggttcagtcgctggattgggaagatcccctggaggagggcatggcaacccattccagtattcttgtctggagaatctccatggacagaggagcctggcaggctacatacagtccatggggtcacaaagaatcagacatgactgagcgactaagcacagcacacagaacatcaagctgtgaaattgaatttcttactgctcttactacttctgcctctaattgcccttatctcttctagactgtcttactttagcttaaatcttctatagaccaatgaatacaaatgtatctaaaattatatgttatatataaggttgtggatctaaaataataggctctgagtgagagtttatgtttctctacttaggggtagtggggaatcagtcttaatgccaagacttttcagtgttgccttttctactgaggctttaaacttccttctggtttcacagagtattccgaatgattaagtctgcctgaagactacatcccttttgagaattccttgatatttacagttttacttttttttaaatcaggcaaaagaatggaccccagcaggaaaagcaaagaaagagaatcctgataagaaattttattccgaatctgaggaggaagaggactcttctgagagcagcagtgacagtggtgagtctttaattcattggaaagccttgttcaccgtggcttataggccgtgctccctgcagaacgcggaggcccagagcgtaacattcagccagcaggtttaggtgaagtgtacacgattgaaacaattcctttcatttacatgtcaaagtaattttgatacgtaagttttcaaagtaatttctaaccgctttttatttgacattgcctcttagacccataactaaaaaatgacagaattgaaaaaagagctcatgcttttctgaattctaacccacactgcctgggatgttcattaacgtgttgaaaaacataaatttacatttggcaaggctttgttttcagtatttgacaaattagtctgtggtgtgttattttctgaagtaataagctgaaaaatggggaaaattacttcaatccaaacagctaatgctaaaaatatggaatttcaggaatgacatagaccattgagaaagatatgttgtgtagttaagagtgtctcacagatatttgtctccatcccatttattcacaagctcatgttctatttagagtctaacctttttcagtatgtatttgaaatattccagtaacattatggcttttcatggcattatctgaacatgtatagtagggatattaagagttcccttttagctaccagaagaaggagaaaacttttcttattagaagataccagtttttttcccaatgaacacgtcttcttgaagataaacaaatttcctcaaagatttttctaacttgaaaatttaaataaatggtacctgaaatgaactggatccagatttggtttgaactcccatataaacatgaaaagtaacttacatgctataagttttttttattattgtttatagcataagccagttatctaagttaacatgtatgtgtgcttaactttgacttcacaacaaattcaagacacccttaatcaacagttttgttttctaaagtttgggtaaaggtaaattttgctctttgtaaaaagtcacaatgggacttggcttgatggctcagtggatgagactccacctgccactgcaggggacatgggctcgatccctggtctgggaagaccccacatgtctcggacccggtataaggtcacgcgccacaagggctgagcctccgtgccgcagctactgaagctggtgcgccacggcaagaagcccttgtgccgcaatgaaggggagcccctcctcggcacagctcgagaagacccgtgcaaggcagcagaggtctaacacagccaaaaataaacaaacaaaatgatagatttttttcttttcttatgaaatgataaagaagaaaattttaaaagctcaaggcgatgagtgccttaccatgtggtagtactgttgtgttgtaatcacctttacgcatttcaaatcatttactcttcacaacagctctgatggagctttgctgaaaaaaaaaaaaagccaagacccagagaggttgaataactgctcagtcttacaccttggtatgtgtcagggccaggatttgaacatgggcgttccagcttgaaaactcatgcttatcactctaggctattccaaaagaatacaggcattcctagctttttgctgtgtgatacataaattaatcttcatagagtagatactactatttacctattagaatactattttaactagaggttatgttcttccctggggacacttcatcagatagatcataggccaagatggttggatggcatcatcaactcaagggacgtgagtttttgcacactctgggagatagtgaaggacagggaagcctggcatgcgacagcctatggggtcacaaagagttggatacaactgagtgagtgaacaacagcaacatattcctccctgaggacacgtcatcagatagatcataggctaggaaaacagtgtgtcctcttatccaggatacaactctgtacatgtcatcgtttcagctaccaaaaagttatgcttcctgtttaaaatacacaaaaacatgctgtatatggggcttccctggtggctcagaggttaaagcgtctgcctgcaatgcgggagacccgggttcgatccctgggtggggaagatctcctggagaaggaaatggcaccccactccagtactcttgcctggagaattccatggacggaggagcctggtaggctatagtccacggggtcgcaaagagtcggacacgactgagcgacttcactttacttcttcagtgagccctagtatgccataatttatacagaaaagttttaactttgtagttcctcagtctaactttatcatttctttgacttatggaaaactcttacactagctaaagtaagtactttttgattagtgattttgctttgttgcctttgaattaaggaaattttgaagatgatttgaacagcttttttccctctcaaaatttgttcctaagatcaataatcccttctatttctttaaataaaatttcccattataagtagaggaaataaaatatttctttattcttatatcatcctcattgttcgttcggtcagtcatgtcggactctttgcaaccccatggactgcagcacgccaggcttccctgcccttcaccatctcccggagcttgctcaaactcacgtctattgagtcggtgatgccatcca

SEQ ID NO: 34045 - DNA, 2791 bp, Bovine  19866880363941
acagttagaactggacatggaacaacagattggttccaaataggaaaaggagtacgtcgaggctgtgtattgtcaccctgcttatttaacttatatgcagagtacatcatgagagatgctgggctggaagaagcacaagctggaatcaagattgctgggagaaatatcaataacctcagatatgcagatgacatcacccttatggcagaaaatgaagaggagctaaagagcctcttgatgaaagtgaaagaggagactgaaaaagtcggcttaaagctcaacattcagaaaacaaagatcatggcatctggtcctataacttcatgggaagtagatggggaaatggtggaaacagtgtcagactttatttttttggtctccaaaatcactgcagatggtgattgcagccatgcaattaggagacactccttggaaggaaagttatgaccaacctagatagcatattcaaaagcagagacattactttgccaacaaaggtccatctagtcaagggtatggtttttccagtggtcatgtatagatgcgagacttggactgtgaagaaagctgaccactgaagaattgatgcttttgaactgtagcgttggagaagactcttgagagtcccttggactgcaaggagatccaaccagtccatcctaaaggagatcagtcctgggtgttcattggaaggactgatgctaaagctgaaactcccatagtttggccacctcatgtgaagaactgactcattggaaaagatcctgatgctgggaaagactgaaggtaggaagagaaggggacgacagaggatgagatggttggatagcatcaccaactcaatggacatgggtgtgagtaaactctgggagttggtgatggacagggaggcctggcatgctgtagcccatgggatcgcaaagagtcggacatgactgagtgactgaactgaactgaataagctggtagcttaaaaacaatgacaacaccttttgttgcagaattcagatcctgactctgtaaacatggaaagaatacaatcacagatacaagactacagcctagataagctacatgaataatatgtaaaacaatggaacattaataatcctatttttccctctttcttggcaagagttccccttagaaatgcactgatgtagctataacttcttccaagtgaaagtctcttttgagaaaagcatcagtgtcaaatacagccaagtcacacagtccagtcatgaactgcatataaaaaaggatacattgcaatttgttatctaggaatttccccaatgttttgaattaagcatatggtatagtttagctgtatgtgcaatattatcttcattaaactgttgattacatttgcaaaatgtaaatctataaataatgactgatgatgttaatggaaaatgattttccagtaatcacacaagttcatgaaatgccctgattttattatagcaggtgtttttattagggcaaatgtttgggctccaggctgataggaatgaaacagagccatctaatcagcgtctttaagctaggcgcctaggggactgttcagagttctttcttcctgcacagtgctcacaacctgccctagcagacgatgatggtcacgggtaagtgccgtgacaggaagatttatgcaaagacaaagagctgtaacgtacccactggtatggcgcgtgtgctcaggcatgtccgactctgtgatcccatggactgtagccccccaggctcctttgtccatgggatttttcaggcatgaatactggagtgggttgccatttcctcttccagaggatattcctgactcagggattgatccaggatctcctgcattggcaggtggattctttactaccgagccgctcaggaatgaagagtggaggttgttccggccaagttcgtttgaataatagtagctagaatttagagagcatttattgtgtgcttcacaccagtgcaaatgttttgcgtgtactatctcatttaatcttctacattatgacagacacaaccttggcacagagcagttgagtgacttaccagatcatgtgtttgggccagtgacggaactgggtttggaactcaggaaaactcctgaattccccactcagagccagtatgctaaattgtctcctccatcaaatgtagacatggactcagtatctttttaaatatattacatttccattcattcagcttatttttaaggatccattaacaaacatctctgtttacttcaagtgcctctattaacaaaagaattaataatttttctccatcttcttctcttaaagacttatatacaatggtatacagttgtctctgatgccatttcatttagaacagttcagtcactcagtcatgtccaactctttgagaccccgtgaactgcagcacgccaggcctctctgtccatcaccaactcctggagtccacccaaacccatgtccattgagtcggtgatgccatccaaccatctcatcctctgtcattcccttctcctcctgcccccaatctcaatctttcccagcatcaggatcttttccaatgagtcagctcttcacatcaggtggccaaagtattggggtttcagcttcaacatcagtccttccaatgaacacccaggactgatctcctttaggatggactggttggatctcacagttcaagggactctcaagagagtcccattctcaagactctcaataccacagttcaaaagcatcaattcttcagcattcagctttctttatagtccaactggcacacccat

SEQ ID NO: 34046 - DNA, 1838 bp, Bovine  19866880390357
ttattaccatcatcatcttctccttcttcatcaagcgtgactagtaagtaccaggggctgtactcagcgcttcgcgtattaacccatttaaccctctgaggagcttctatttccccattttaaagatggagaagggagctacagaaggatgagctggttgaatggcatcactgtctcgacatgagcttgagcaaactcaagataatgaaggacagcgaaagcctggtgtgctgcagttcatgaggtcacaaagagtctgacacaatttagtgactgaacaacaagaaggatggaaagacaaggcacagaatgtttaagaaacgtgccacagcttgcaagaggaacaggcagagttcaaacccaggcaggctggctcaggggtccatgtgtgggctctgtgctaggctgcttcctagcacactcccagcagccctaggatgtagacggttgtccctgttttacaactcaggacactggctcagagaggcaaagtgacttgcccagcgtcacacagctgggattcaaacccaggtcaggaacataacccagtattcagaaggcagtcaataatgaatgaatgaatgggtgatgactccataacccaagatttttagcccttgtgattctgaaacgatcattcctccctccagcatgaccctctaagcttcatccctatgtggaaaagcttgaccctggcctttctgtgctgtgtgagctcagactggactggctctcaccctctctgctgatgtagataacatggttttagtccacattaactgtgtgtactatgtgccaagcccagcattaagtgctttgacatataataccctaggaggtaggaacactatgatacttttttccgggtgaggaatggtaggctcagagaggggtagtcacttacttgagatcatagtgaaagtgttagtcgctcagtcatgtctgactctttgccaccccatggactgtagtccaccacgctcctctgtccatgggattctccaggcaagaatactggagtgggttgccatgccctgctccaggggatcttctcaacccagggattgaatccaggtctcccgcattgcaggcagattctttaccgtctgggccaccagctggctcccccacaatcaagtagtgaaccaaagaaataaaatatgtcatttgccttaaataatctgtggatggaaggaaaaattcccttagccacgtgctcattgaatggggaagttagccttatgaccagtatattcccattgccatcaagactcagcctactctgtgtctggagacagaaaagaactgttaacagttgtaggggaagacattttgcacagcatccttgcaaattttctgcatctgattccatgggaatcattttacaactctataggttgtaggtaacatataggttgtagataaccagccagctataggcgatgaaaactaattgtgtgtgttagttgtaccgtcctgtttctttgccaccccatagcctgccaggctcctcggtccaatggaattctccaggcaagaatactgagagtgggttgccatttccatctccagaggatcttccagatccggggattgaactagagtctcctgcattgcagggagattctttaccatctgagccacacatgcaaatgaattctatccagtggagctgcaccctcaccgccaccaccatagaaagaagttttgcctccacttacacgtgtcatattccggatgtgttccttggattgtcctttgaactggtattaacgcttcaccagttttctcattaagagttaaataagatatttaacatgtattcatttttatatatg

SEQ ID NO: 34047 - DNA, 1500 bp, Bovine  19866880667057
tatgaataaaatgtattattccatgtgtttaaaatataatcacatcttaccttttattgaattcagctttttttaaatgcactatctttttcatttatttgttctagtaacatgaatttcttgaataaatcatttgagtaggcaagtatgaaaataaattcatcaaagtaataattgtcctccatccaagatttattgttaaagaataaccatatttttgaaaaagaataaacgtgctttaaacattggctagtatttgtctgtctctaaatattcttaattatagaaaaacctattttaaacctgaatttatatttaaaatttatgtctctatgtagtatataacatgggattttatttttcaaaaattcacataaaatctttgagatttttaggtttattaatctggcctcttataaacttactactcagtgagttggatatcttctcatttcctgcttatatttaaattacaaaatgatcctaagattttattcaaaataaaagagctttagaaacagagtttttcaaaataaccaagcaagaaattaagagttgtcaagtgggtacaagtgagttattctaatgaagttttgtgaaagttgaaaagttgcagactttagtaccttttcagcgttggacattagaatcccacagaggtgccccaggccagaggttcagtttatttcttctctgtcacttccagtgatcagattaaatcacttagtagtggaaaatattttactgtagaacatcattatgaaatttcaaagtaatgcagtgatccaagactcgagaaattcagattttattcacattgtcgatagttttttgtctgtgtgttttgcttatatagtttattttctatatattgtaatgcctttcctgtctgtaacaggcagattataggattgtttgttttaatatgtattctccaccttggagccaccataacttttttttttttttttaatttctttctgagtgatttgaaacatagcatgcaattacacgtgcaccagttttctaacaaaggacaacactgtaattgtagaaaagttctccttgcaccgtcttgtggcttccactctaaattatgagtaatggaggcagatggtggatgttttaccttaatttagcatgacagtatgttagtgctaaaaattcatataccttaaatctgcagcccagctaaagctatacttttactctctcaaccttttctttcatttggacaatgtattttagagatattgagcgtgaaaatgggaccttggggtaccttgaatatatggctttgaaaacagttcattttatggagatcctgatgggtatagtgttctccttgttggaagataatatctttatgccttcagtttcctcatctataaagtagaaatgctttatacctactctgcttctttcagtgctattataaaaaaatcagatgtgaaagatcaatgtaaagccctatataaatataaaacatcagtgttaaca

SEQ ID NO: 34048 - DNA, 1603 bp, Bovine  19866880709254
tacttgcttaataatgggtttttttcattcggttagaggagaagaagttatttcctaacaaaatgatttttttccgctacccataaagcttggaatccatgaggactccactaaccggcgacgcctttctgagctgctgcgctatcacacgtcccagtctggagacgagatgacttctctctcagaatatgtgtctcgcatgaaggagacgcagaagtccatctattacatcactggtgcgttggaacctgggtctgatcaaagcctttttttagaggtgtggggagaacactcaagggtcctggggaactggcaggatgaggcattttggccctggagtcacactgagtaatcctacaggtgagagcaaagagcaggttgccaactcggcatttgtggagcgcgtgcggaagcggggctttgaggtggtgtacatgacagagcccatcgatgagtactgtgtacagcagctcaaggagtttgatgggaagagtctagtctctgtgaccaaggagggcctggagctgcccgaggatgaggaggagaagaagaagatggaggagagcaaggcaaagtttgagaacctctgcaaactcatgaaggagatcctggataagaaggtggagaaggtaagccattatgaaactaagttaccttgttagagatgccttcagagtggtttccttccatctttggctgctacagttagtggtttaggcagcctaatttgtttagtgccctcctactttttattccaaggttggtatttctatagagcttagcaaagatgaggcatcttttctccaaaaagtggacagaagcatctttgccttgaggtggtaattggaaatataatgagtttttctgactgccctcaggtgacgatctccaacaggcttgtgtcgtcaccctgctgcatcgtgaccagcacctacggctggaccgccaacatggagcgcatcatgaaagcccaggcgcttcgggacaactcgaccatgggctacatgatggccaaaaagcacctggagatcaaccctgaccaccccatcgtggagaccctgcggcagaaggcagaggcggacaaaaacgacaaggccgtcaaggacctggtggtgctgctgttcgaaactgcactgctctcctctggcttctcgcttgaggatccccagacccactccaaccgcatctaccgcatgataaagctcggcctgggtgagtgcccttgtgctctcaagcagcaaggtgtgtcgggcgcgtttgaacgcttttggggcatatctcaagtggtttctttcctgctcttaggcattgatgaagatgaggtgacggcagaggagcccagtgctgctgttcctgatgagattcccccccttgagggtgacgaggacgcctctcgcatggaagaagtagattaggagtttctacctgcagactgctccctctgtatagtgtccccatggctcctgcagcagcagccccagtggccctggcccacatggtttcctctgctgatgtctagtggttttatttctgtccttctaaggcaggatacatggacctcaagccctctctctctccacgtttgacatggggtttgaatgtt

SEQ ID NO: 34049 - DNA, 1831 bp, Bovine  19866880714305
acttcactttcacttttcactttcatgcattggagaaggaaatggcaccccactccagtgttcttgcctggagaatcccaggaatggcggagcctggtgggctgccatctatggggtcgcacagagtcggacacgactgaagcgacttagcagcagtagcagcagcaacatactatagtatttaagggttaaataagacatgacatcatggaattgcttcaaaataattgagtgttatggtggtggagtgaatgtaggttacagattgcactgttcaatactatagccactagccatatgtgggtaattaaaattaattaaaatttaaaatttgaaatgacagttcctcagtcatattagcatattttcacattagtagtaggaaatctctttcgtgcataagttcttttggctagagcaggtgtagatgaaacaaggttgacccttgtgttgataagttttgaagctgagtgatgagagattcattttattattctctccacatttgtatacatttgaaattttccatgaaatgaggaaacaaagaaaaaccatgcatgacctttgtggagaaaattacaaaagatctaaaagaagaactgaagatatacttttcatgaatggagaggctccatatgatatcagttcagttcagttgctcggtcgtgtccgactctttgcgaccccatggactgcaggacaccaggcctccctgtccatcaccaactcccggagttcactcaaactctaatcctaaccttggatgctttgtataggcattgagagttgtgaaccaatgccctggagcaaaggtcagctgacttttcctataaattgatagataagtaaatattttcagctttatggggaatagcagcccagtccaatattcttgcctggagaatttcatggacagaggagcctggagatactgagtgactaacacacttgtttcaactgctcttctgcaattatagcacaggagcagcagcgatgataaataaacaaatgggctaggctagacagatctggcccaggagtttgcagatctctgatagattcaagattctagaccagtgggttttcctttatgaaatcagttttattcagattttctggtaactgaagaaaatctgtaaatataagaggacttcctggatatacgttaaatgaattaatagatgtaaaaccttttataatatttaaagccttttctatattactattaaggagagtgtgattattttgtttgcaatgattcgatgttatctgcttctactattaggttcctgtggctagagcaagtattctttggctaattggagaaaactgtgaacgagttcctaaaattgcccctgatgttttgaggaagacggctaaaagcttcaccagcgaagatgatcttgtgaaactgcagattttaaatcttggagcaaaattgtatttaaccaactccaaacaggtaagagactaatccttagtctacctttgtggaatctactttcttctttgctctgatcaagcagctctgtccatttatacattagtctgtccattcaacaattacccagtgcctgtttctttaaggttttactttagatggtagtggtgtaaagagatgatgtcctggtctagttgaggagaaaaacataaaaaaatgaaatagtacatgataagtactataatagtgtattgtgacacagtggaattccagaggagaaagttattgaaagtctgaaataggaggaggagagaggtcagacagagtttcataaaggataagattcctgactaagggcttttaaagagtggtttactatatagaataagg

SEQ ID NO: 34050 - DNA, 2288 bp, Bovine  19866880736446
atttaaaaaagaaaatttaatccatccatgatctcattgacagtaccaagtaaaattgaaaatcactttaaattaatgtcagctcagcagcttcatctccaggctgttgggttggagtgctgaatttttaaatatcatttgaatcatttcatatgatcgtaacaaaacaagacattttattagatcattaataagaatacttaccagaagtaagtgcccctggatggatgtaaatcagccttctggggccatttataactgatgagagaattgcactgcttgactttaataattcacccaggaacagagaataaacagcagcaaacattaattttattggacagtttcatatggtttatgttttgaaataaaagggatatgacttgactcctgcctgaaaccaaagcacttagaaaggactccctcgtgctgttggcatctccatgtggggaacttgttctcagatgcctttgttaatcagttgggcacccttcttgccataaataagaagccaaaatataaacactttaagtagtgactacagctttgtgttctatcatgtcctttggcatatggctatgaaatcctttctaaccaatcatcttacttgtctacaacagaagccacagtatctgagaaaggaaggagcctgtatatgactgtgatttttccaaaccaagtacgggttctttaactgctggctccatgtctgcagctaagggtagagagggcctcgttttcagctggcagcccaaagactggagtggaggctgctctgctgtgattccaagaatgagaggcactctggacctggaaatgaaagggcagaggaagtaataacgcttcgagaacagggtgccagtcgagcccacgccctttgaccatggcccttggacaaatgtgctcagatatgaccttctcttctgcctctgcactcggcagctcttataactgacagggtatctccctttcccatccatctgtaggacttgggagagccacatgcttcagggggagaaggtgatacaaggtggtcatgcacttcaaaggcttgactctggggactgatggtggtcatctgcagatcctccccagctctgcccctgactctctgaagctagagcagccaaggatgccgagtgtgctcacataccattagccaagagcctaggccagagtccgtggcccccggcttcctgtctatagtgtttttgtccccacctatgactttaccatttgacaagcttcagtctacagtcactgatattaaaaggtgatttttttgtgtgtggctgtgtggagacagctctccaagagcagaaaaatgaatgttgaccaaatatgataatagtaataattcctaccacctattgaatatttaaaattataccttgctttacatgcacatatttttaatcctataacaccctttgaggtagatcctttgaacactctcacttcattgctgaaagacacagagctacaggtacagacagggtgatagtattgaaagagatcttttgtgccctttttatatctgtttgtatcctttatgctatagacctcttcttacacggagaaaattggtgtttgatggtgaaactacttacccccaggccaggtgggccctaaggaagatctaaatggggaaaggagtgccctcgctgacctcataggtggccacgctgatgtgggctttgggggtggggaggccggatcccgctccaggaagtctactgcacctgccctgcgtactttccttttgccaaccactgtttaagcttatgatttgcgtagttgccttcacaacaagcctatgtggtaggttctattagtaccctcgctttacagacccaggaactgagatacagcaccacctctgggcccaaggtcactgcccagcaagtgctagaactgggagtcaagtccagacagtctggctccagacggaataatcgttccccgaggtggctttctggatgagctcattggctggaagggtggggcagtgggtttggtagcagtcttgggagagtgactgttgagtccacgctcatcctgtacgtgagcctgagagacctccccccaggtcctgcccacgttttctgcggggacccagagtggtcagccaccctgctcgtgcaggcctggcactttctctgccctgtctgggtgtcatctcacaaggccggaggtcatcagagccgtgggaaacgtttgctgtgaggaagcctgttagctccaaacacttcagagaaacgtgtcagcacccaggggtgctccttttt

SEQ ID NO: 34051 - DNA, 748 bp, Bovine  19866880748189
cgttgaggcatgtgtcagagacttctgtgatgctggttgcacatctgcctatagtttgaatagtggctgctgcaaactgtttatcctggcttttcacataggtctaaaaaacattgtctcaattagtttacacactggtactatcaagcaaagaaaaatatccctataataagaagctttgtcacaatcaaattctagaatacacaatcttctcatctataggaacaaaagaaagtccaccttttgacttaattcagttctgttttttcacttaaagaatgtgactgtagtacaggcacattttcaagtcaggttcattcacctgtggccacagtagcttataactccaaaacaggtagtgggggagcagtcacccaagatagcaattagtttaagtgcaaggttgaaagaaatgatgagacctctctttttgaaggtttcagttcatttaaccagcagcatctatgaatctatgaaaaaagggtggccttttcagagatactaaacctaaatattgagagaagtggagaaaaaggagcaatacgctaccgataaacattttactttaaaaaaggttatctgaatggtggtaaaactacaacagccacagtgagaagcatttcaataaagactttataaatatacctaatttgcaataaaataaaacatcacacttttgaaaaagattttcttgaaaaaaatgttttaaaaatacaatgtaaaccacatatttatacaaacttaagaa

SEQ ID NO: 34052 - DNA, 1402 bp, Bovine  19866880796262
gagcagggatccctgggggctgccttcggggctgccctctccagccctgttctctctttctcattgccacttcaggttgtggtgtgcttataaaaaggactggtgattgcatccctcttttctctgtgtcgccaagagtggggaatggccttgcatcatgtcagcgtgtcaggctggatgttctgcttgtacagatgggggacccagaagccttggtgggactggcaaagcctccctcacaagaggccaactactgaatgggaggtggtaagtttaggaaaaggttgtttctgaatgcgtttggctagaggagagccatttttcaaattatgacttaacaccccgatctgtcccttgatgcggctaagtcatctaccatcttataaagatgcctgtagttgcctcgaaggcacaggactgaagagctgacttgcagagttcggtttcttgtgccatctcagggctcagcctttcccatgtggtcacagaggccagactggccttggtacctttcccaccttccctttcagaccttgcaagcccttcctggctctgtgactcagcatagtcactctagtccccagtcatccttgtctcctatgagttctctaccagctccagtccgtccttgtcaccatcttggctgagaagcacttaagttacaacaattcatgggggcaggcagaggcgcttgcttagcccagggtttggtctttaagctccatagttataaggtgccatagggaacaacagttgttataacacaatggtgactaatgaacttacccaccactcttaaaaggtgtcatgcaaatacctcaaccctaattaaaccagcctgcttacgatgcaaccgccgcctcctcttagtcagtaatcctccagctgatttccagtgtgctaaaaatgccaaataagatgcagatcaaattcactttcataaagttggagggtaaatccactaacaaaggagctggcagaactggagcccattaacagcggagggaaaattgacaaggatactgacatagactcttcaaaagaagatgatttgaatatcaaagatgggagaaaggccctagcaaactgatgaaactctgaaatatttttgcaaaaatattcctctttatcttcctgtcattgaatttaaaatggaagacatactgcattatataattttatcaaacagttcatgcccaagaaacacaactcactcttttggttagtctaagaattagtgcacaattacacaagtatattttatgaaatagatcacatttttgtaatttttggttttgttcaaagatgaagttctaatcaaacctatttcctttactatttactgtgacattttagataagggtggtgagagcaatgatatgaggtgaaaggcagaaaagaa

SEQ ID NO: 34053 - DNA, 1648 bp, Bovine  19866880805825
tctgccttcccacccccctttatttttaactcatgctgttttattgttataggcaatttgtaccactcagcatgacagtgtaaactgaatcaagattaatttacatgcaaaagaacacttaggagagcagcatggtaagcaaatgtattgtctcgattgctgaggtggaaaaagaacctggaaagaaaaaaaggtgctctaattaaggggcatcaaatatgattgcttgtggtggttaagggccagaaaatagtaaatgtctgaccatttaaagaattagcatcttgctagctaggaacccataagatggaggcataaatcataataaaattaagtaaccattcgaggtttcttaaaccagagatttttttcctaaatgaaaatatatcaggtattcttaaattaacgaaaaagaaaaatatgccaagatatcattaaaagtttcttctacaaaaacattctttaaccactatacagcctgctcatacctaatgaaggtcgtcaggtaataggaagaatattttaaaattctcaagactgcagaatatgctgcctcattaaaatttacattttggtgaggcagtggacagcacttaggttaatcagctgtaacggactgctgaaatgtaaataaaataagaaaagaagatctaaaaaattttctgaatgttttagatttccaatttaattcttaagaagaaagcaaataagaagggaaatttggaataaccactttccttgggtctcatacaattaaaactgcttcaagaaacgaaattacatgtttaaaaataaaacatctcactttatagtactgaaatcatcccacagctagatcatgaactaattctgcaaggatcaaaattcataataatgaaacaaacacaccttctggttaaggctcataatatgaatactctggataacttcaaaatatagactaaaccgatcttttgtttagtacttggaccaccaaccttacagaaatgcacgtttggtcatggaactgtaaacgcaacaactgagctaagggacagatcatgctatataccagaaacaaaacgtttcgctttaaaaaatattaatctgatacgtacaacctgacagaagtattcttaattaacattatacacatttttcaaatatgcacatctgtagtataaaaatagaaccatattcctttttctggtttataatttcttcagttaaatcctagttaatacagttaatacatttcttgagtcttgaaatctatgccctgtgaaatgagatattaagtgtataaattcattttatttaaagtagaaaaaccagttaaagctagcatgtaatgacacacatagacatttcttaaatttaccggcattgataaaaatctgaggaaactgatttttattctgatttagaatttccagttaatgagtcatttctaggtatcttctgcaaaataagctaagctcttcctagagtgatgtaagaaacaaatacatgtgtaaagttgagaattgagacctctattaccaaagcagctgaaatctagaactaaaacgatgctattgaaaagactctttaaacctgtggtaaatttgccagcatcaagtcccatatcaaagaatgaattcaggaagacagaaagaatgatacagaa

SEQ ID NO: 34054 - DNA, 933 bp, Bovine  19866880847643
gaaacgataacgttggttgtctcttgataggcggttgaccctgggacagggagaggaggaaaactaactttcacaatatatccttcacatctaaattttaaactctgagcatgtattatctgttcctagtaatattattattaacaatttggtagtaacataatttatatttaaacaaaaagtaaaatgccttttaagttaggacagagtgccaagaataaatatgccccatgaacagggctgtaaagcccacaggccgtgcactgaggaaatcacgtagatgcttttgctgtacttctttatttctctggttttcagagtcttgggttcttgtcatggttctaatgggctaaaagctacgctcagaagtcatgaagtctctgttcaacgcttgtctcaacctgtttggtttcagggcctctgaatatgataaatattgcgtctaaaggctgaacagttttaaacatgtttctctaaaggtttaaccgttggggtagacataagaatggcaagaggcctttcttcagagagaaaaactgaagtttactaaccaagtgtggtaaaatgtggtaggtgttactcattgcccattactaccttgaatagttcagaaggagatagacttaaaaatcggaaagaatagacaaactttgtcattttagatgtttagctattaaactattttcaaaatatatttagttttgagaattgatttgggatgggatttgtttctaccatatctaagtgagggcgtcaagtgaagtgaaagtcgctcagtcatgtccaatgtttctaatgggctaaaagctacgctcagaagtcatgaagtctctgttcaacgcttgtttcaacatgtttggtttcagtgcctctgaatatgataaatattgcgtctaaaggctgaacagttttaaacatgtttctctaaaggtt

SEQ ID NO: 34055 - DNA, 3334 bp, Bovine  19866880889545
tctgtattttcctcttctgccttgctctctcctcagaacgaagattaaatccctgatcatcactgcagtttcattagcccctgtttatgaggcctcaaccgtagggtcttcaagagaggaccgggttcttcctgaagttgggctgggttccacggatgcttggatccatgtttttgggtcctttctggatcccagttgtacctagcaagcagcccggctcaccttgaatcacaagggcatgcattttctgtagtctaaacatgttaatgattaaacacacaggattagatattgtttggtgagtgtgcagcccatttgaggatttttaccagttaacaagcacaagagaactatatatcagactctttggaggaatgagtgcttgggagacagccctcctgagccccgggttgccccaggaggagcgggctctgtgttcggacaggacctgtggtggggcggaatcagccttgagtcaggcaggcctgggctccaggccccacctcccactgccaggatccatgaccccaggcacgttaccgatctcaccaggccttagcttccttatctgtgaaatggagataatcatatgctcactggggtagaattgttttaataataaaggaggtagctttctgtaggcagatctggaacccagtaagcagcggttatcgccactgttgctaatacaacaggaacaagtttgactttaagggaatccaagaactctggaagtttctcccaggttgttggcctcctgtgcacttgtgtagctggcgttttaaggccctttccactcacctctgagtttcctggcgctccttgtcttgcttgtccagcttctgtaaaccggcctctcccagggcctcctttgctttaaggatcaaaggagttctagagaattttgacatgaggtaaaattaatggtcatttaaaagctgagttcatcctatggtcggatttgttatggggtgtgtgttcctcgggcctgagacccttgctcagtggcaatgtgtgggacagctaagggtctccctccaggaggggaaatcttcattggaaacgggttgcagaatgtgaaagtttataaaaagtgtttatgtttgtcctgggagaagggtaacacatcacaggccattaacaggcctggctcacactgcagtgtgcaccaacccagcaatgtaatttatttcactgagggaattgtggtttttcgtgccctggataggtgtcactgaaaccttgttttaagaggaaaatagcaattaatgttagaaacaagaactactagccttacaaatttgtggtggaagagacccaataaaaatgactatcagaagtttcccaaaggtgaacatcagcgtttataaacagtgttttctccctggtaaactgacagctcttgctttgtaagtataaaccaaagtaggactgccccaaacagagcagggcatgtgcgaatgttcctgcagggaagaaagtcggcccaggctgtgggccgggcaggcaggcatctgtgttggcttagggacaggtggcagagggccggctgtgtttggtcagattaggccacgtctgtgtcatcgctgctattgttcccctgctgggagatgacagatgggagaggccgtcctgaaagagcggctgttaatctataactcggggtttgcttgtacccatgcataaacatttcagctcattattttcagaaacaaaagaccagagcatatgggagccctttggttctgattcatttaaagtttgttttttggtttgtctgtctgtagtgttgctgatgtaactgggtgatctaaattaaaagtgactcttaaaaattaagtgaaaaaatgatttcaagatgagaactatgattttccgactttgaagagaactctttccttaaaatgacactttccagtggagcatggcatctgtgcatttagctgatagaaattcaagcttcccatgcacagtgcaaaaataggggagagagaagtgacgatgaaaatgctgcagaactgctaacagtctgctctgttagagtgggtgctttagagcagtggtccccagcctccgggatctaagacctgatgatctgaggtggagctgatttaataataatagagatgagctgcacaataaatgcagtgcacttgagtcatccctagaccatcacccctgcccaccgccagtccagggaaaaaattgtcttccacgaaactggtccctggtgccgagaagactggggattgctgctttatatgtagcaggatttctcagccttgcctccgcgggcacctttgtgctgagtcatttcttggttgtgaggctgtcctgtgtgttgcaggctgttcagcaccatcccgggtttctgccgactagaggctatcagaactcacttcctctggttgtaaagatccaaaccatctccagacatggccccttgtcctctgtgagccgggggcaggaagcaggcaaaggctagatccttttggctgacagtcgatgccttggagtgagagtgttagagattcttttccctctgttgttaccgaagtgatctgggttccaggtcctctgatgcatcatctcgccttactgggtatgattgggttaaaagaaaataaaaagtgaggcctaatgagtgtaaattgcaaagggtaacttggagaaactgagtttacagcattagcgattatgtctcaagggagagcgacctcagtgaaatctcctagaagtttctgaagtccaaaaccttataaagaaaagcgattggtccttttacagaaatccttgccttgtcagttcagaactgacactatttcttggtaatagtgggggctcgtggccaatttctaaccccaggtctgttgattgcatctgggtaatgtcactgggctgtttccctgctgtttttgaccaattttctgaaaagcagtcattctggttcctttttctcaggctcaacatccccaaacaggcagttctgaaaggatatgttcaaggctcagtgccaaccacctttgtgagaatctttgaattatttttttatacaagttctgccttgttggtgggaacactgctattcaagtcctgagctggcatgtaaggggtctgccctgtgcagaatggcaggtgccccagaggacagtcccggctaaacccagccttccagccacccccactgacatgtgaatgaagccatatgggaccctccagactagcacatccacccactgcctaaggaccccgttgccatgtggaatagaagcatcacatcagctactccttccccagattccggtacacaaaatgtagacactatcaaagtcgt

SEQ ID NO: 34056 - DNA, 1788 bp, Bovine  19866880913739
aggactgatgctgaagctccatactttggcccctgatacgaagaactgactctttggaaaagactccaataatgggaaaaatcgagggcaggaggacaagggggcaacagaggatgagatggttggatggcatcaccgtccacggtatcacaatgggcatgagtttgagtaaactctgggaggtagtgaaggacagggaagccaggctgcaaagagtcggacacgactgagtgactgaacaacaactacacaggcaaggctatacgtcagttcaccaaatgtgattcttctggacagggaattctcaacaccaccctagttatcaaaacccagagcttctaggacatggcagatgctttgttattactttcgccaagccaccaaattgaccttgcttcttttaaaattagtagatctctcctggattcaacatttgcctcttacagacaccagctttttctacctcagttttttcatcatggcctttgtggtaggttgacgctataaaacatatgcctggcatgtgagacacaaaattcttttttggaaaactttttgtatggacctgaagagactgtttcattgtttaatccatttttgacttcctgcaagtttaaatgtggaatcaagtggaaaatgacttcaaaacagataagagattacatgaatctttccatactccatgtagtcataaagatatattaaccctatcagatatgaaataccatgctcgtgatttattttttattttctgatttgtgtatggtaaaattcacttatttggtgtgtagtgctattcattttgacaagtgaagtcatatatgcagcaccacaattaaatgtgaaaattaataaagggaagactcactaaaatggagttggaaccagaaggggaagttctcacacagtaccacttccgggtcaattacaggaagaactgtcaattacagaccacaatagaataatcaccagcaggaaacaaccatcaaagacagaccttaagaggaaaagatgtacactgtatctcttacaagaaatcaatgatcgcaacaactcagccaatgaaagaccacaaacatcttaaactctcccttttctccagcagactttcattcaaaacaacccttcccaacttctttgtctttataaaataatgttcctctcctttgttggatgtgtctattcttttgctatagcttgcttgtcttgaatttgcagttctttgctattctggagtaactcattttttgctggtaaaagaacttttaaggtcaacacagatacagaaaactccatcaacccagaatccctccctagtgctgtctctccagagtcaaaccctccaccccactcttaatccctgacaaccactgactgcttctccatcttcaaagctctgcttttctagaatgtcatataggaagaatcatacagtgtgtaaccttttgtaactttttgcagctacccgggagatagtaaaggatggggaagcctgttgtgctgtagtccatggggttgcagagagtctgacacaactcagggactgaacacagataacgtaaccttttgagtctggcttcttgcagaagtacaatgcattcaagactcatgcatgttagtgcatgtataatggttcattatattgctaagtaatagtcaactgtaccgatgtcctataattttgtgtatctctttactagttgaaggacatttgagttttttccagtttctagcaattaacaataaagctgctattaatatgtgggtataggtttttgtataaacatg

SEQ ID NO: 34057 - DNA, 1381 bp, Bovine  19866880981234
aactgcagatgagggacaacgtttcactgctgcacgacactggccaagacttcttttctttttgacgtgtgtgcatacacactggctttatccggacttaggaatccagcgaggccccgcggaggaacatatgtttttgacattggcttctactactctgcaggctgcttgtctttttattttaactctttgggggcctctggctagaccttgaatttcctggtgcagtatgacagaggagagagggcttgagggagttaaagctatgtgctgcccttgaaagaacttgcaaaagctttctatcttaaaacaaacaaacaaaaaaacctcacttggatcaagcttttgacaaaaagtccaccagttaggtgaacagcatggtcccgaaggcagcgacatttggtgccaagaatactggactggaagactcctaaggctggcagtcagcaggcttctgggtccaagattccgcactgaggaccagacgcccttctcctcttattcttcttctaatacacgatattagcttctgcttacaccttcttccagagagcattcaacttagtaaaaatattcctctgacaagaacaacctttgggtaaaatgggaggcagtttcatttatttgagggtaactaaaaaaaaaaaaaaaatcatccttgtctatgttctaaaggaagaagaatgccatttagaagattcagttaaaaaaaaaaaaaaaatacgacttccctagtggtccaagggttgggggttctcctgtcaatgcaagggacatgggttcgatccctggtccaggaacattccacatgccatggggcaactaaatttgtgtgccacaactaccgagcccatgcgctgcaactactgaagcctgaatgtcgagagcccaagctccccagcaggagaaaccaccacaatgagaagccggttcactgcagccagagttcagttcagctcagttcagtcgctcagtcgtgtccaactctttgcgactccatgaattgcagcatgccaggcctccctgtccatcaccatctcccggagttcactcagactcacgtccatcaagtcggtgatgtcatccagccacctcatcctctgttgtccccttctcctcctgcccccaatccctcccagcatcacagtcttttccaatgagtcacctcttcacatgaagtggccaaagtactggactttcagctttagcatcattccttccaaagaacacccagggctgatctcctttagaatggactggttggatttccttgcagtccaagggactctcaagagtcttctccaacactacagttcaaaagcatccattctttggcgctcagctttcttaactgtccaactctcacatccatacataacta

SEQ ID NO: 34058 - DNA, 2563 bp, Bovine  19866880990244
gatttcctttaggattgacaggtttgatctccttgcagtccaagggactctcaagagtcttctccagcaccacagttcgaaagcatcaattctttggtgctcagccttctttatggtccaactttcacatccatacatgacttctggaaaaaaaccatagctttaactatacggacctttgttggcgaagtgtacaagagatcatttagggtttagcttttgttgaaggaggacatagacacagcccctcacttacctgcttgacagctgttggtgggtcccagctgccaacagccacgtacagactccttagcctgcctcctgcagcctctgtcatttccctcagcaccactgcagcatcctctgccatctttctttgcttctctgacccttcttgagggcccaggtcacattctcctgctccatgaagccctccccgaccctccggacttgagtcccttgagtttttcttgagcatattaagacactgagatcttgcttcttcctcctgcagttatttctgtttatggtttcccaatccagagccatacattccatggagggcaagatttcatcatatagctctcttgaggccctttgtataaggagatgtacacatccccaaagaaggcatgctgataagttaggcatttaggttggttatcatctgctcatttaatcagaagacatctagcaagagcagtaataccatacattatttcaaagcactttcatgtctttctgggcatatttgggaagtagcaacacaggacggctttctgtcattcaacctgaaatgatatattgagcaggaaaaaaaaaaaaagttaggtggaatgcatgaggccaaccagctgtcagtgagatttcccatcatcacatggagtaccagcagctagaaggcaccctggcagtcagttcagctacccactttataatccagatggagaaactgaggcagcaggtcacacacatgtaataaatgtgtctgcaggtccaggcttcatgtataagatacaatctactgacctcagaggtctctgttttctgttctgcatgattttgtgaaaaaagtacaatcacctcactcaaatacccagcatgttgatggaggattatacatttaaatgaggctggggaagcagatctacttgtgacactaaccttgctgtttcacatgtaacctgattctgtggatgatggcagcttctctttgcaaggcttgttaagaaactgtgtttgtgcctcgtggtaattatctctggggagggtggtggaacaagggagcggggtgtggctaaggcagagtagcctactggacatgtagagtcccagagtatcagaaagacctggatttgagttccagctttgacttatttcttgtgagctggtagataagttctctgtgtcctctgttccatcacctataaattgaggacagttacagctgtcgcctgtaatatgttcaaaaaatatatactgactgttgggattggaggtgtagtgtccctactttttatgttctatatttctgcagtttcaatttttagtaatgagcacacattgtttccttaaccaggaataaagccataaaaattattttttaaaaccagcttagaggattcttgtgagattgtaatatctggaaaactgctgggttcttagcgagtggaagtggaggctgtaccagagttcttggtccctatgcccacctgtcctgggtcagagaagctgctgctgctgctgctgctaagtcacttcagtcatgtccaactctgtgcgaccccataggtggcagcccaccaggctcccccgtccctgggattctccaggcaagaacactggagtggcttgccatttccttctccaatgcatgaaagtgaaaagtccaagtgaagtcgctcagtcgtgtccgactcttagtgacctcatggactgcagcctaccaggctcctccatccatggaattttccagcaagagtactggagtggggtgccattgccttctccgacagaagctagcatgtgacagcatttttcctcagctgttagtcctgataccctgaccgtctgagttgccattctttttctatatcaaatatgagagctcattttacagcttgtcacagaattagcagaattttgtgtcttctcttgctgccaatgtttgtctgcagagggctgtcaaattttccttggtgtgggctggtatgagccctcaatcacagaacctaaatactgataactcttctcctttttaattttcaaaggcttttagtctttctccttgactttggggagtactaaagtgtgtttggaaatgtggcctttctgatgctgaaggccgtcccacaagcctcgtttcccgcccaccccacttcacacagggcatctcaagtaacatacatcaaaccttcgctgttaacacttggtgctggcgtactggctttcatcctgagaaaataaataaaccaaaccaaacccacagcactttaaaaacactaattaatcctcaccacaggcctagactacacagaaatggcaaatcccactgccccaattt

SEQ ID NO: 34059 - DNA, 1860 bp, Bovine  19866881141863
gagttctgggatcccttctatagcaccctgtacttacctctactatgatattttcacacccaataatactggctgcctcctcagcaagactctgagctcctgaggacagaggctgtgtgccacagtttgcacagtcttagtaagtatttgacgggtttgaaccacggctctgccaccaactggttctaaaataaacaagttgcctaatctagaagtgcttcagttttatcatctctaaaatgaagaaaacatccaccttttaaatttgttataatattagatgagccaaagaacatttgatacctcaataaatgttaggcctcttccaatcttgttgaatggaatctaatcaaatcttttatggaaaaccaactttagatcaaaccctttcagtttttgaagaccctagctttatttctttgtattttctttaaaaatcatttactttgcatttaggcttgagtgctccacttaaaacaccaaataggcaattgttcttcactatagtctagagagatgagctgttatgaaaccttggtattctaattgttgctaatgcggttaagcatgaaagtacctctgcttaactgcggagtacagcactttgctgtacacctgaaactaacacaccggtgttaatcaactatgctccaatttttaaaaaagtacatttgacaaagccacaagctcatgtccctgttttcctgtgaatcaaaagactcaaagactgaaaagtacaattttctttaatattgaatctattaaaagtcattaaacacacacaatgaatgctattttcattttgaaacatctagtttggatcagatgctaattaacctaattattggcctggctcatgagtcatattttaattattttctccaggttttaatgtatccacacttttcttctggttaatagattcccttttctagttgtatcagactttatcaagaaggaatgcttaattgattagcagttttggttagaaaaatgctagatgaattttttgttttaaatatgccaagagtaaagaataaaaaactatatgaatatgagaatattcatttctagccaataataacagactggaattgctacactcatagtttaatattttgctaataaagagataggaaaactgtggttattataaacttacatggagtgttataaaattctgccaagaggaaaaggaatcaacaatgggaagcctggttttgaggtttggtgttaactcactttgtcactttgggcaataaccttaactttgggtctcaattttcttatataaaaaatgaccttgcactaagttttctgcctgcttaaatcctgtatggttctaattgtgtgacaatgaaatgaatgatggtataatttgttttgatggggtggtgggctggtcagatccattccctcaatggaacaaacccagtatgtgattttatcagtttaactgttaagacaaacatagatgcacatggtatttgacaaatgaccagagaaagctagttcgttataaggaccataggttagtcataattaattaacctcttccaacaacacaagagaagaatctacacatggtacatcaccagatggtcaacaccgaaatcagattgattatattctttgcagcaaagatggagaagctctatacagtcagcaaaaataagactgggagttgactgtagctcagatcacgaacaccttattgtcaaattcagatttaaattgaagaaagtatggaaaaccatagaccattcaggtatgacctaaatcaaatcccttacaattatacaatgggaagtgagaaatagatttaagggactagatctgatagacagagtgcctgatgaa

SEQ ID NO: 34060 - DNA, 899 bp, Bovine  19866881166524
gtttccttttgaacttgaacaatcttggggttacattttgaaaattggtgtaaccttggaaagccgagttaagtgatcacgcagttggtatgaaacacttaattaccttttgcagcaattttgctgagagtgaaaattaaatccttcaacactttgccattatgtaactaagacaattgatttttctaaataatgttatattaaaaagattatgatccaaatattagagtcaggggctgtgaaggaagacggtcataaggtatttaagtgttagcactttttaagatctcccattatcaacaatattatcatgtgttaaaatgtcattaaaattttgagtaattggggctaataccttggattgtctgagtctgttttccccactgctgtcagagagtggcctctgcagacacgatggccctttccctgggagcctgctgcccgctcagttgatgagcttgtagcccagctcagtcgtggctgacagcactgattggggcgcagtacgctctctgctccttttattacagacagtaattaaagcagctcgccctgccacttccataacaaacacagcataatgccctaattatgactttattaatttaagtcaggatttaatgattttaaaagtgatttatattgtttttcctgttcagaacaaatgaaatctgtaggttaaattaatacaggcttttcatcatgcaaagttaaaaagctagttaccagtaaattcttttcattagattaacatctgaaactctaagcagtaaggtaaacaataattacccatcaaaattgagtgatgcataataaaataacacttttacctttaaaatcttatcttaaaggctagaagctaagtatagtcagaatcattcacttgttgcagcaagcca

SEQ ID NO: 34061 - DNA, 742 bp, Bovine  19866881271475
tggttgaatctgcagatatggaggaaccagagacagagagggctgactatcaactatacgcaaattcccaattgcatggaggaccggtgcccctacctccctcattgttcaagggtcaatgtcttacatgggctattcaaagtgagctgaatgtggtctgtgcacctatacaaaacgtaaattacaataatgctacatatttaaaatacaacagtacctgctcactacttccaaccacagaacaatctcaggtgaatagaagctcagaatctaaatcggagacacacacgagagaattcaacctgtggcagtttggtgactagtaactgtaacgctgctgaagagattcaaactgtagaaagtcaaagcagagaccaataatagattgctctgtgatcaaagaaacctgtactcacgccaacgtcacatgtacactctgaccatttaaattaattttttaatttgttttattaaaatgaatctctgctcttgaaggttggcttcataataaggccaacaggatccctggggagagaaatgaggaatgaggttctacaccaacgctgttcaggacacattccttcaatcctttttgtttattctattccctgcacttatgaactccctgaatccctctacttaaaccatagcactaaaccactaggattaaaggcatggtgaattttctcaagaatgtacttaactttacatctgatcaatgtgtttacagattcatacatta

SEQ ID NO: 34062 - DNA, 1164 bp, Bovine  19866881302890
tgtcctaggggtttctttcttgattgaatttggatcagaaagcccactcacttaacagtcatcctagttccttgaaatcattataaaagtttacaaataaccctgtaagttaaaaagtgaatttgaatggataaggggactgttagagcataaagttagttttcattcttctgtttaaaattcatcgtactaaatagctagcagatatgcctgaattaacaagcattcactctttcagccatcgtttctacttaaatatacaaaaaaaaaaagaagaagatcatcagctacttctgttttgctcaggacataagcagtgtcagcatagtctagtcctttagttttcttttaagtgtttttaatgccagcattcagggttatccaacagaagcagaaaaattctagcctttctccaccccaactgtgaccctcccttttgagctaatgatagatttactttgcagttattatagtcctgataaaatccttatcatggcttcctcatggttctccctgatctgggagtgctgccccacccaccagagcactcctctgtggcgagtcccattccttttggccctggtctttcttaatgtctctgtgtttcctgattccaactttaatgacatttccatgaggccagtaggagtacctttgtgtctcctcccaacccaccctcccaccctgctttccctgcctgttccctgcacaccttggactgtcagatcttggacaaggacgcctgcctggccttacctctttagagcttcagtgcttagttcaatacaagttagcagtggctaatcaccatgataaacaatgcacagtaacaggagttgtccagtttgggaagcccacaataggcgactcctttttaaatgcttttgtttcagcagatgtttaatgagcattatttcccaaaaaagggtggggtgtaatgagataagaacagaggaaaaatccaaaaatcaaatattctggatcctggggaaaataagagctatttttgcagtactgaggcagtttcaccgagtacctcagccattcattgcttctgttctttgaagcctctgggcccttggcttcttggcaggtgggttagggtgatggggtgggtggtgtgtctgagcgcatcacccacctacgcagagggccttagaaggg

SEQ ID NO: 34063 - DNA, 1103 bp, Bovine  19866881371966
ccagccacccaccatccccacttctccagggagtcgcggcccccacctctgcagccatccatcacccccacttctccagggagtcgcggcccccacctcccagccgtccaccacccccacttctccagggagtcgcggcccccacctcccagccgtccaccacccccacttctccagggagtcgcggcccccacctcccagccgcccaccacccccacttctccagggagtctcagcccccacctccgcagccatccatcacccccacttctccagggagtcgcggcccccacctcccagccgcccaccacccccacttctccagggagtcgcggcccccacctcccagccgtccaccaccccccacttcagcccagatccatcccggtggcagtgactcacaggacagactctaaatcagctgctttgaaagaaatcatctacaggacttctccactggccagcagtgaagatgggggagagaaaactttgggggaactagagagagggcagcgagcacctctcaagtatttattgacgacaaactgtgaacactcagaccggaggcccaaggctgttttctctgacgtttcccattcctcccgaatggcccctgagagcaggcctgagacgcaagagccactaggggaggttccagagcccccacggacaagccgcctttaccgccatgtggagaacattcctgcactcatggcagggccagtcacaaagtccctgggaaaggaggcaggggtcctggccataaactcccgcagggtcaccagcctagcacctgataaatcagttactaaaacaggtcctggccttctggggactggggatcgagtaacactcaaaagggggaaaacataaaaactaaaccgtgctgcaaaccccagaggaaaagagaacttacagttcaagacgtgcacggcaggaaaatggaaataattaaagagagctgctgagaacacgcaaacttcctgaagtgagggcagtcactgccttgtgtccaccaagccgaccgacggcaagaactagagccaccaagcttaaatttaacttaagaaaacagaaaaatagcagctcccccgcattaaaaa

SEQ ID NO: 34064 - DNA, 860 bp, Bovine  19866881419621
catgttaaagctaacatcaggtaggtgtatatgttattagtgaatggcagagttaaaatacttgaatatcttatcaccagtatcacatatgctaatgtttaaaatttggtagatattttcttgatcagattatacacatcatattgaaacaatataatgagacttgaaagaatgagaataagtttgcaaaatctggtttaattcatatctggggagggtggggagcatgtggtgaaaatacataatgcacaggaacctaatcaatgctagacaaataatgtattagtttacaataggatgaccagaaattcgaaggctctgattgagtccgtcagcggtaacacagttttatatttggctcaagtggctgctgaatagtatcaagtggtgccaagttcctccagagcaccgcatgacccccagccttggaaggcgcttcaccacagtctcagaagaaaccccagtcgtgcccttcttgtgctgccccggtacaaatgcaggcctgggatttccaggggccatatgttattgcacagagaggtctggtctaagcagacccttatggctaagaaggtgtgagattagcccttaaatagtggtctagcattaacgtggtctatccaagcaggttaagaaatagctccttagtgattatgtaccaacgactagttatcacgctaacagaaaaggcaacacggcagcttcacatttcacacgaaagcctggcatcacctgggcctggccggccagcctaacctttcacatacgtctagtgattaattcagacccagggaaaggtgatttcataccagtcttttcttcacataggtctgtgtagcattagaattgttctgggttaa

SEQ ID NO: 34065 - DNA, 823 bp, Bovine  19866882085463
ctacaccatcagctacgccaactccagaaagttatgagctgaaaaataaatcaagatttagataaaatttaacactcactgcactgttacctgctggctcctatgccccttgccatttgaaaacataaacagtgctgatgaaaattctctaagttgaaggctttgtcttatcaaaaccacatagttaaactgtaaatatgaagcccacaagaggggtaagaacactagaggggagcctttccctattttgctagaatcttctaatcaaggacatctattgtatttatctaggatagattagaggcaacatctggctagcttagaaattttctacagattcctttctatctttctatagattgtgataaatcttaaagtttaaaaatactcattcttaacaaaaagtgtgctgttgtataaaatgtaccctaaaattctggtagaaatacttcactttccataatatttaaccaccgagatacaaccttttagtttaataaacaagtattataaaaaattctagtgttttaaaacacacagttctactctaaataaatttatactatggcacttgaaaaatctatcaaagtacagatttttaaacatcctcaattatttttacattaaccgcttttatttcacctctaaagttcttaatcacaaggaatcagtaaattcctttaaacatttagcttaaggaaaaaatgaaagaatcacagtgcaatgatgagtgacagcacagaaattctaataagggaaaactgcacaaaaatgcaacagattctgtacagaaacagtgtagatttttaccaataaaaagcaa

SEQ ID NO: 34066 - DNA, 763 bp, Bovine  19866882121730
ttccctttcctgcctcaatgctgcactgttgaactggcagttagactaaaaccaacccaaatgtttgaaaaggcatcaggactcagcagctaaaagaacgctgttttctaaaaacaaatccatatatggcaggcatgcttaatctgttctttcataaactctaaacccaagatttcaaattaagacctgccagacaatctccaatcaacagaagtcctttcctttgttcatccctatgcaaaaaaactcccaaaagaaaaaaatccaatttggattcaaaacctggtgctacacttaataagaacctatattctgacacatagggaaccactcacttggttccaaaaatgcaaataaccgagaagtcataacgatggataagtgagaaacacaaccagcaaactccttgctcagcctgccctctcttctctgccactttgtggggtgacacgccagcaagaccatctgaaggtggctcccctaggtgacgacacagagagcactccccttggtggagctggtgtcgggatgtgggttcccgggaccaaccatcacagcgtcctccagcctctcacgtctccacctctctcccgccctcctcctccgtgcttccctccattcctctcttccccactctgccattcccttggcaaatgccaatctcctttctcaggttttctttgcagccgtcctgattaaggattggttctcaggatattctgcacaaaaatcacaaagccaggaggggatggtggcaagaatt

SEQ ID NO: 34067 - DNA, 1684 bp, Bovine  19866880599173
caggttgaccgcaaaagctgtggccgtgctgctgcccatcctgggaacctcgtgggtctttggcgtgcttgctgtcaacaacccaggccatggtcttccagtacatgtttgccatactcaactccttacaggtgagggcccaatgggattgtcagcctgggagctgtcagctttgtgaatagatgagtgggtgcaggttgccatggcaacaggaaggagacactctgatctgttccctccacaggggttcaccttttgagcccgtagggtgggagcatcccagaggacagaggcatggatggggcacacactggggtctctgagcaaacagggcctggaggaccccatttacaacagggttgcctcatctttcagggaagtacctgtgggagatacatccagcttgaatggaagatgatcagcatgtgggtggctcctaaaagggagccgggcatggaggggtggtgaagagggaggtacctcaggttctgagttctcatctgccctctacatggaaggacagaaaaggtaacggcctgaaaaccggagatctgagatgcccagagtccgagtccccagacccacaagcccctgctggaaggacagaggcgaatgctcattgccatccatagcctacacagccgagctgtgggctgaatcccggccaatgtcactgcggcccagctcagcccttaccgtgatgtccttgctgcctctgggtcttcacgaccagcagctgtgttgcacttttaatctgtaataagcccctatacacagctttcttctggttgttatggtgacaggggataggttgtcgtggcagcagcccttacacaccataggtcctgggttcctcatttatcctctgtgtcctggtctccgcttccataaaacgggaacagtaataagacccacttcatggggctgcttttagcactcaatgagatgaagtgtttgcctagtgctgacacagaggagaagtctctagatgtttggggacatcctcgtcttggatctgttttcgttgtcatcatcatacttggtctgccggtgaggacacaagggctgtttagctggtaggctcgtgccctcccacctgtcctccccagcaagtttgctcctcttccaggttaagccaatctgggcatgtacctgtctctgtatcttggccatggtgtctgcctgcatctatgttaggttacaggacacccttccatccgcatggtttcatggtgaagcatcacagcctgctcacatcctctccaacaacaagccatgctgatgccactctagagtccatgggtgacattggaaggaaccctcagaaagtgtttgtaacaaaaatgcaagaggctctaattctgcgttttcttccctttccttcccagggatttttcatcttcctctttcactgtcttctgaattcagaggtatgtctgctccacttcctgccaacatgaagctggtttttcatttctgcaagggcacagagagcaggaaaggtgtggcctcatctggctggtttctgggactgtaacgctgaatgagcccttggtttctgtaacaaggttgtgtgcaggcggctgcttcacatcagtccctcctccctcattcccggttgctaagcaacatacacaaatcctccctcactgatgtcacccaggggctgctggctgcatggagg

SEQ ID NO: 34068 - DNA, 1272 bp, Bovine  19866880736513
cctgtttacatggaagtccgaggagggcctgaaagtctacgtcaacgggaccctgaggacctcagacccaagtggaaaagcgtctcctgcctacggggagtccaatgacaacctcgtgctggacctgaccaagaactacgagaacagagcttttgacgagttcatcatctgggaacgggctctgacaccggatgagatcgccatgtacttcacagctgccattggtcagtgagaggggaggggctgcaggccgggtgtgacgtaaacactggggggcggggactttcctatctaccgcccctttacccgcagcaggtagttctctgctctctcctgctgggctgttggtactgcagggtgaatgcgtcctgatcagttttttctagaaccccttctccctaagatggaggaattcataatttaccagaaacacactgaagcgaatattctcacgctggtcaccagggaatttttgaagtttgtgatagatggttatggaaagttttgggaagcaagtgttcccggtccatttgatgcacaaatatttgccacatcccttccgcgtgtcaaactcacccatggaccctcagagagcacccctgcccacctccgttcctgctcggcacagagcggtggttcagatcagggacctggtgggccggcagacctggtttcaaagtctcatgcaaccacgatgagccgtgggacttggtaagtcactttgttaaaaaaaattgagctaaaattcatgtagtgtgaatgtcacctttttacagtacacgattcagtggtacttactatgtccacatgttgtgcaaccatcctccccagagaaacccagcccccatgagctgtcctccccatttcctcctcccctgcccctggcaatcactaacttaccttctctgtggatttacctatcctggatagtccgtataaatggagtcatataatatgtgaccttttgtggctcaagtgatgtcactagggaatctgttttggactttgccttcttttgttttcttgtggtgccagaatggctgccattccctccaggagcacattcctcccccccacccccctatccccacgaaaccttagcaggaaacaaggagcttcttttttttgtcatccactacaacccggctggccatcactgttgttggcccacactgaccacgaaccaattactgtgggtggggatgtggaatatgctgattggcttaagcctggctcacagtccaccccactgaaatggcagtgaggtcaggg

SEQ ID NO: 34069 - DNA, 930 bp, Bovine  19866881037554
ccagtctctcttgactcttatttgactcactctgggaggaaaggtcttccaagagccaaccaccaaggaggaagctgggtgggagaggagccaggagagacagacagagagaagggctgacaggtggatgtaagctcagaggagagaacctgtccaagaccctgagacctgggccaggaggcagagcttaggaagattcagcctcaacatcaggaaaataaaagcatctgtgctgtttttactaattctccaaaagcaccacggatctggcatctacttgtgataactgccttgtttttttttaaatgttcatgaaaatgttcatttttagcatggataattttaaaccattttcaaatcgacctttcctggcaatgagtagatatgatttgcttccatgaagacacccacaggctgtctaaatctggcatcgccgctgagtagggatggatctgtaatcacagatgctctgtgaccccggtttcttagtttcctggaccgagctcctcccttccatcctctcccacccacaggcacaaacacaacttcctgctgagtgttgggagcccctgcccgttcccactgctctgcagacctacccacatcatacaggaaatcagatttagtccttggtattttaaggatcagggtttcccaggtggcgctagtggtaaagactctgcctcccaatgcaggagatacaagagatgcgggttcaatccctggctggggaagatcccctggaggagggcatggcagcccactccagtattcttgcctggagaatcccatggacagaggagactggtgggccacagcccatgggatcgcatagtccgacatgactgaagtgacttagcacacacacacccatgtaaaggatgcagaggaggaagctctgcttggggccatccagggcaggccaccagc

SEQ ID NO: 34070 - DNA, 1989 bp, Bovine  19866881343407
acgttggtaatactgactgaattggaaattgtgtgattcagttcaattcaaaacatgtaccgactgactccagagagttgaccatttgaggggaggaaaattttgtgaaagttgtcttgtgccatttgattgattgcatgcttgtgttgtgataggcattgttttgaaatacactgtatagtttaagttgaggctcttaatttgaagacagtaagcaacagatagttgttgctacagcttcagtatttaagcgtttatgtttgggcatatgttttggtgattgtcaataattatttcttgtgcactccattaaaaagatagtgaaccatttgatgggcttccttggtggcttagtggtgaacaactctcctgccaatgcaggagacacaagttggatccctgggtcaggaaagaaatgtcaaatcagtccagttttcttgcctgggaattcccatggacagaggatcctggtgggctagtccatggggttgcaaaagagtcagacatgacttagagactaagacaacaggacccatttgatactgagccagaggagctaggctttctattttataaaatgctgttataagaccagctgatttctctttaattgtactaggttttgcagagtatttttttttttttaatgcttgattttagatttaagaagacaaaggagacaaatgcttgttatactgagcaaaaaagatgcacagaaaatactcatctaacactcttgctcacttgatgaaaattgttgggaatcttcccatgtcttttgcttttacttgagtacatataaatgcaagggtcttcttgcctccccccatccccaaattcgttagttaaaaatccataatatattatgcttactagctttatcatggctgtgtttttcaaaggatagatttctagatactcagaatatgggacatgaattctgaagtggtggtttatcattgatcgactttagatacattctgaggctgagacaagtttatgaagtattgcagatgaaaagaataaataaatatggtaagcatttttctttatgtggtaaatttgtaggcatgtactcatcactgtaaatgtttctttcagctcagtgtgccattataatgtttgacgtaacatcaagagttacttacaagaatgtgcctaactggcatagagatctggtacgagtgtgtgagaacatcccaattgtgttgtgtggcaacaaagtggatattaaggacagaaaggttaaggcaaagtcaattgtcttccaccgaaagaagaatcttcaggtatgttttttaaagcttatagaattataatcctttagttaaaattatgatgttaggccattaaagtgatttattgatgtttttgatgtgtgggtttttaaaattaacttaaccattcttttaaacagtactatgacatttctgccaaaagtaactacaactttgaaaagcccttcctctggcttgctagaaaactgattggagaccctaacttggagtttgtcgccatgcctgctcttgccccgccagaggtggtcatggacccagccttggcagcacagtatgagcacgatttagaggtatggtgtttatgtctcagcgatgagtgcttttagattcctggagcttttcatttggagcattgtaacatttccatctctttgtctaggttgctcagacaactgctctcccggatgaagatgatgacctgtgagaaagtgaagctggggcccagcgtcagaagtctagttttataggcaactgtcctgtgatgtcagtggtgcagcgtgtttgccactttattatatagctaagcagaacatgtgcttaatctttggatgctgaaggagatggatgggctttggagtgaatgtggcagttaaaaaaaaaaccttcattttttggacctgcatatttaggtgttttggaacacagttgtttcctccttgagtttcaaatataagactgctatagtcacatg

SEQ ID NO: 34071 - DNA, 1465 bp, Bovine  19866881398926
acgtaagaatttatcgaatgaatgtggagttattaaaagaatacatgcgcaaatactcctgttgacattgaattctgctgcaaagctgacgttacgcggaatagactgctgattgctggagtgtggaagaacagggtcaaaaatgaaaaccccccccctcccacctgctcaggatgctcttctagccttgcctgacttccagcacctctgaatcacaggggctccatgctgcctcattgattaaatgtccaggcccattcagtgatggattttgcatcaattccatcccgcccctgggagcaggcctgggcaggaaagctctctaaataaagacatttaatgataggtttgtgaccctgtgtgaagggaggcagggtagggaactcctttttcattagctgaggccagaagaagccaggtgggaggaggaaagagggctggagccttggagcctgtactgttctctgagtcagaggagcctgggtcacaaagctgcctgtgagttgtctgggcagagggtattagagtgacttgtagtgaggtgtcctgaggctgatacaaaggagatgggaaactcctacttgactttgcagcctgtttgcctggaggctgcaagggagaaagggatggagcagctttggggcaaccatccgagagtgcctggcaaagggagggaattcagatgcttgttcataagattcagctcaataggttgcaataagaattcaggttctgtaacactagctgtattccactaatccagaaaaaagaaaataagagaaatacgtttcattcatgtgtgctatcaaattgcatcatttataaaatgctcttttttccccctagatacttaaattgctaatactcttgcacaatttatagaccaacacctgaggtagtttttccctcaggcttcttttctgtgtattatggaaatctaaagccctctccaagactccatatatccccctgggaaatggtctcctttgacaccaagctgcctccactgcacgtaattcctcatcccatattccctgtgtctattctgttcataaatgcccagatctgggactcagcctttatccttattttccatgaaagaaagatagggaggaagggagtgaggaaggaaagaggggtttgcacagatcactcaacatgttctgataactgcaggacccctggcccagcccttcctccttctggatgctcctcccatctcctggctgatggtcaatttgcaaagttatcagaaaagactcctgtaggtttaattaattaacctacaggatattttcttctttctggtccatacccctttctccattacaacaacactggtcttacagctttttagggaaaagttgatgctgtggaatggttgagtcacaaatcttgttttgacttgaaagactcacagcatagacttggagggctacgggttcattttgtcatcgcaaataag

SEQ ID NO: 34072 - DNA, 1250 bp, Bovine  19866881706286
gaagagaattcctctcaagtgtggatgagaaaatataaaagcagggactcttacagagaaacaaactgagaagctgggacactcagagaggaacaacagtgggaggttgtgtccaccccctccagaagggcaggaggggacgacatagggggagatggtcacagggagaggggctgcgggctgaagatcacaggtcctgccagcagtgcagcccccagcagggagacgtgggtgccaaatgccccaccctctctctacacactctcggatctcccgggagcctcccactgcgggggccagaacagaaggcaggaggcaaggcagcctgggtgacctggcccccaggtcatctcctgggggtgcagtgggtgaaagagggtggctctggaggatagaggggtccacaagccccctgtggacatcagggggtctcacccaagaatgcagaccccccagacacccttggataatcagaagtttcccaacactggactccacaccaggcaatgatcagtgaccccatcagagggggtacacacactccagttcccggagcccccaccgggtgccctcatggttgtccccccgaaagccctccaccagctgagtctggacttgggaccagactctgctatgagcacaatattgatgagccgcatggcagagctggaaagtctgaatctctctcccctcaaagtgtgctggttccctcgagaccagcaataaagaggaaaagcaaaaataaacctgccagcaaaaaactaataagaaacgagtttgggtgcctttggcaaaaagagctcagaaatgcaataatattttcttttaacattgtatccacagactcttgtgaaggaaatacctgatcagatcccaaaatgagcaattatgagagactgctgtttgagtgagacacttttggcagaggaagctaattttgcaaagtgctctgtctcctgacttgggtcttggttgctttccaggggtgggaggctggtccaccagggagagacaacctgagaggagggggccctgccttggggttgacccccctggggccgatgtgaggtccagagagcactgcaatcttgccccatcaagggtcaggggcatttggtgatggggtgtcccatggggtgatgctgggggagacatcaggcttgttgccaccttttggctcttgtaaataatactgccatgaacactgagtatatatccaattccttagggtatataccaagacagaatta

SEQ ID NO: 34073 - DNA, 1409 bp, Bovine  19866881760657
tttgccctttattatatagctaagcagaacatgtgcttaatctttggatgctgaaggagatggatgggctttggagtgaatgtggcagttaaaaaaaaaaccttcattttttggacctgcatatttaggtgttttggaacacagttgtttcctccttgagtttcaaatataagactgctatagtcacatgacaatattgagaggtggaatcttgtttgttactgtcattcccattccttttcgtttagaatcagaataaagttgtatttcaaatatctaagcaagtgaactcatcccttgtttaaatgagcatttaaaaccgctaacagggaaagttgtgccatgttactatttgaattgcctttgctactaccacttaccttgaagtcaggttaaatgcttctaattttctgtatacttgaatcatttcacacaaacgtaacaagtcaacagtattgtatttgatgagaggtgtaaatactatcaatagttaggctaaaataacatctaccccacctgcctttgggcttacgtagtgtcacctagagatgagatttatgtgacctgtgaaaggtggtacctgtttcagatgtttcaaacagataccttaattatatttgcattttatggcagaagtaaccattttctaatgtagagcttgtcaaagtccaatgaaatcatacaaacggttgcaggaacttgagggacatctcatctgttaaatatgaatataattgtgcatttacttttttgttttttgatgttacatgtttaatgtaaagttggcattctaggaagatgttccatgtttacctgctgttaagtactcccaagctttaaaggttatcaaagattaaggatttcaatggatatatcacagctttgatgatttttctctccccaaagaattttttctgggtggtgcaagaacacctcaggatgctgcagcataaaagtaggtcttaggtaagcctctcagtgatgtgaacagactgccaaaccttcagtagattaaccacttaacattgtatggtttccacatgtaaacatgaattgggtctgtcttgcctgagtttgatctcactgacaccatactgtagcaattagaaatcaagacgagctattttcctcttgtaagtactactgtactatagttcagtttgccaaagttcttcagatgtccaattatccttaaatgattactttcctacctaaaagtagggaaggatcccttttaagtatatggaaaaatggactataaagggtaaaattgggtacattttaatttgtctaagtattgaataaatattaatagattcacttacagatttgaattgatgtatatgctatgctatattcagttcagaaccagactttaacagataataagtttcccagatcagataaat

SEQ ID NO: 34074 - DNA, 895 bp, Bovine  19866880633731
tgtgagagctggacctaaagaaggcttagtgtggaagaggtgatgtttttgaattgtgctggagaaggttcttgagtgttccttggactgcaagaagatcaaactagtcaatcctaaaagaaatccatccttaatattcactgggtggactgatactgaactcgaagctccaatactttggttacttgatgcaaagagctgactcattagaaaagaccctgatgctggggaagattgaaggcaggaggagaaggggacgataaaagatgagatggttggatggcatcaccaactcgatggacatgagtttgagcaaatttgggagatagtggaggacagaggagcctggtgttctgtgggatgtccatgggggtcacaaagaatcagacccaacttagtgactgaataacaacaacaacaaaatacttttctgccgtgtatttttaaaataatgcatcagtggcacctttttgccagagcatgagtggaggggccgttgttgctggccctttcctcttccccaccgtccagttagtgggttgattaggccatcggttctcaagccaaggcttgtttcttatttagttctggggagcacctggccggcatgaatgatgtaggggagaacaactttgaagccacagaggcgatctcgaagtagatccggtgcaccaggatcctggcgccgaaggagccgacgtcactctccagcgtctagccggaggagacatacaggcagcagggcgaacccctcagcgtgtgtgaccactgagtggcggcagtgcggttcatgaccagcgaactggacgatcccgaggatatgctttcgtttatctcgagagaatagatgactcaagggaagctaaggaaagggcaaatggaccggaactggatg

SEQ ID NO: 34075 - DNA, 801 bp, Bovine  19866880643743
ttttcaaatcatctgagggagtttttgagtcctgatttcaagggggaacccctataccaatttgaagagtgaaacaggacctagacttcagtatttatttcaatagctttatgaaaatataattgccttgtaataaattacacatatttaaagtgtgcagttgaatgtttaacatgtttatattcattaaaccatcaccacaataaaaaataatgaatatatccatcacctccaaaagtctcctagtgctcctttgtaatctctgtctcaatccctgaaaccactggtctactttttattactgtagattagttgcatagatacttcacagttccttaggaaattccgtagacatagttgaaactgctgcagagggatatgagttgaagggatattatgcttggatttttttttttttatatgtgtaaggaaagtgagaagtaagagattaggaaaaatgagatatgtattggaactacgttcctgaggaaatagtagatggaattcagagctttgaccagtaaagaaacgaagacaacatctttaacaaagaaaatgatattaaagatagtgtatttttttgttatcagcatccaggttgtcatcatgtatcaagattggttctcagaagtgctcagaaataattagcatcttagtgttatgaaaatgaatgccctgtagaaaaaccccttaaatctagcccctggtactaccatgtaatgctttgtcattttttggaggggagcagatggaattaacagttgactattgcttactgttagagccaagtactgctagaat

SEQ ID NO: 34076 - DNA, 1677 bp, Bovine  19866880663843
atgttctgcattgacgatctacagtgatgtgaaacccctggagtaggaaatggcagcccactccatgttcttgcctggagaatcccatggacagaggagcccggcgggctacagtacatggggtttgcacagagttggacacaactgaagtgacaaagcagccgcagtaaagtgacaatcaggaaaaatgcaaatatgaactagggatgaccacagcactgattatgcaggaaaagtcattgtattagggatacatacagaaatatctagcagtaaaatgccacattttttataatttaaatattttccaaaaattggacaaagcaaatattgcaagatgttagaattgttaagacctaagtgatggattatttgggtatttatcaggtttctatttttcagtacatttgaaatttttcataataaaaagtcaagacaaaattactttgtgaacacctgtgcatgaagcagtgcattggatctccatgattacaattaaatggggacaggatgaagaggagaaaaccaggaatattctatggttatcttaccatatcctgccatagaagcgccattctcgacatccattgtgttcttattttcctctgctagggctttaacatattttttgcttaaatctagtatctgctcacgtaacttgacactgctttgatgtcttggtcgttgaaaaatatagtgcagtaacatcaatccccaaaggagtccaaatacaagcaagagtaaactcaatttctgggacatagattttcttgagattgtaaaaaccatttctgaggaaccacacagactcaactgaaaaatggtacccagaggcaagtcaccaagcaatcaagacgtgaaagaaaaaaatctcctcctctagtgtatattcttcatcttcagcaaggttgccgccaactcacaattaactctgtaaaattgagaagaaaaaaggcaattagtcttaactatatcagtaatagaataaacaatggtagattaaagaagagattgtacaaatagttttcatttagaattgtattgtcttctttttgataattttctctatcactaaataagcttcctagtcttttatcagctctgttttcacagctctttaaaaatttaaactagaaataaatgtcagttcattagaactacctgaaagaaacgccgccatggtcatgaaactctgaataacttctcattgtctgtaaataaaacaatgaatatataagatttagagatatcagtctcttcaaatacaagtcaccaacctaaatgtgtgaaagcaattcctccttttcctttaaaaaaaaaaagttgattccaaaatgaaagtcagaaataggaaaggtgaaacagactggaagatcaaaacagctgactgaagaacaaaacagaacccacagtaagcatgccaatgtcactagaaaatactactactgacaacaggtaatctgaaaaaacaaccaacctaagatgccaaataagtcataatttctaagtttatacttttaagtatatgccagacatgacaagcactaacttccttttttttacctttccaaaatttacaattctaaacagggaatgtatttttataatttgaggaaaaactggaaaagtttaccttcagtttttaaaagaggataaagtaacaacaatcaagggaat

SEQ ID NO: 34077 - DNA, 2545 bp, Bovine  19866880736840
ctaacagttttttcagttccattcatcattacagtaaaaaaaaagaaaaaaatctgctgctattttttgttgttttacttaaatagctcgactcaaggaaaaatgttaaatttaagaactcctaatgttattgaaaatttatacttcttataaatatatatgcaatatatatgcatatacatgtgtatgtgtgtgtgtatatatatacttattatatatatatatatacttcctctttcatatgaaccactcaaaacaattttaaaagccggtttttttctgtatttaaaattgcccttttaaatatttagaaattccacaggtggtggctttaatggaatttttcccagagcaaatttcttggattgaaactgttccagttcttctgctgttagttgatccttgggtgtgaataatgcattatctgttgaggtgctgccaagtgagaatgagagagaagtaggtatgctgctgtttccaaaggtgtcactggatgacttagagaaagcagtgtgaggctgtgagcctggactaccaaaaccagctatagaactgccacttccaaaggctggggccactggagatccaacagggcttgctgccatagaaggtgaaaatcctgaaaatccagatgatccaaaaccagaagctgcaggggttttaaatgaaaatgaagcagcagatgtgatttcgggtttcctaaggccaaaagtcggagtagcagcagcaatggcagaactggaagcgggtacagctccaaacgctggagtattcccaaacacaggagggcttccagaaggggctgtagcaaatccagggcttggtttaaaactaaaattctgagcactgttgctgctgctgttattcacaggaaaacctacaaaaaccagaaaaagaaaaaaaaaactattagtcaaaaaatgtagctatattactaccttgcccccaccttttctttttcttatttctgccatgtttagatgatgagaaacttattggaaggaagaaaagtgaaaatgagaagttaggacaaactcactaaaccctgttggcctgtctttctgctacactgatctcatctgcactctaatttaccttcacttaagaaggtagctcttgagaaatctcagggattagggagtggactttcacttcagcttgtcctctactcttgttggagctgtcacttgaaaacaaaactacgctgttatgtacaggaacaagaaagtcctcataggtactgttaccatagctatgtagtcctatgaaactctagaaacaccattcctaaaatacacatctaaaacccgagccatagggtctttcaaagaacgtgcccattctgaacaccatttcacaatactagatgagccaaattctttgaagctctattatggaaggtggtaaaatttgcaagggtgacttaacacggcactagagacaccttcaggctttgtatttgaaacccataaaatcccatttttctaaatcaatcaagtcttgcatgacttttcacttacctggtgacccaaatgttactgtttgcctattgccaaatccaaatgaaggtgttgcttgattcactccatcctgtaaatcggacagctattaaaaaagaggtaggcaagtgaataactcaagtactttttctgtacacttttagccaaatttaatttttcaaatgtgcactttaaaatgtcttcaattgcttaacatagaaaaatgcccacaagtgaatatgcatagaaaaaatgggccctgagttctcaaggagttcagagtgatggtctggctgatgaattgtgagtgtttttaattttatttatgcttttaaaacattttctaaatttcttcaataaacacatattaaaatcataaatactttttaattctagatttcagtgtctacaggttgatctgcattaaccaagaaacctagatattaggtaagggacctttagaggctaccccagttgacttactcaaatgcctgacttgaagttaattcacaattacattattaaaagcttaccagtaaactctattaaacattccctattcccttaaaatattttatgttcttgctattttctgctgtagaaatatctttcatctctgcttactgaaatcttaatctccttttcaatgaacttttcacttaatcctgacctctaataagtccttcctcattaatacaagcatatattatttctctcatttgaaaaccctattggcactgtttttaaaaaatagttatttatttggctgcactgggtctcagttgtggcactcaggatcctttagttatggcatgtgggatctagctcctcaaccaggtatagaaccccagccgcctgcattgggaatgcagtcttggccactggaccaccagggaagtccccagcattttctaaaattcaactttattgaggtatagtttacataaaataagacgcatccattgagaaatttgtttttcaatgggttttcataaatttataaccatcactacaatcaaaatttagaatatttccatcacccataa

SEQ ID NO: 34078 - DNA, 1168 bp, Bovine  19866880742989
aggtgggtcatagaggattctgctgtgattcatgtcggagagtgttttgcctatgttctcctctaggagtttttaccatttcgggtcttacgtttagatctttaatccattttgagtttatttttgtgtatggtgttagaaagtgttctagtttcattcttttacaagtggttttttttttttttaatttttttttttagcttttgtcttattttattcaatatatttgaaataatcattcacaagtttaacctatccttaaaaataggcactacttatttcaatataatcccatttatgtacaaagcaaaccctttacatagtcacacttaattaaaaagcatgaaaggatatatattattaaacactggtaatctctgggagagtaaaatgaagggaaatcataattctttattccatttatttctgtatatttgaaattttcacaaacattatactcacataaattaattttttaaaaggcctaatgggtcttagttaaaccacttttcaccaactgtttgcatattaattaaagcttctgtagtttcagggagctctaaaagtttttctatgtcctaaactccttttccgggagaaggcaatggcaccccactccaatactcttgcctggaaaatcccatggaggagcttggtaggctgcagtccatggggtcgctagtagtcggacatgaccgagcgacttcactttcacgtttcactttaatgcattggagaaggaaatggcaacccactccagtgttcttgcctggagaatcccagggtttaattttttggaaaaaaaatcattagttactgcagttactgagttttaacaattaggaaatttcacatataagctagaaatagtatgtgtctttgggcctacccttcctaatggcagcgaccaactgttctcttcagataggtaggtgctacccaagtttgccacagtctctactcatccctggagtcttatacttaaggagcctgccttattatgtgcattcctgcctgattcctatagtcatttactgccttactcaaaggcagtaattgatagagtgaattaatgaaatatacaactttcccatgttccctatgtattaaaagtcagtatacatgaactgcatttttcgtgggaattagatcataaatatttcaagcc

SEQ ID NO: 34079 - DNA, 876 bp, Bovine  19866880797175
aacaaacttcacagtaagaattaagttttcacagggtggagaaaaacaaaaagagggagaaaatccctcaggacaaggtttctcaaatttggctgctttcaaggacgtattcttgagggaggaaactgcacgttttctttcatcacattttaaattttatgttttacttttgttcatagtctaaaaaaatacacacttgtttgggactatctggacaaccatcttctgtaacagagtgctaccacaggagccatactgctaaaccagaactgcagtccatctgctaattcttgctttgcttctttgctttacaggcatgtattcaatatagacattttcctcttccagctcttagtattgtttcctttcgtccctttctccttctgtaccaaaactcccagggagcctagcttgctgtatgttgaacccttataatattttttaataatatcaaatttttaaatggtttgtctttttgactaggaggaagcaagggaagttaacagaatagatcctcaagtgatatggactcaaatttcttgttggaatttgcaaagccaatttaagtacgatcttatttgtcagaagattgttttttaaatgtagaaattcaagaagacagcctttgagaatgcaaattttgaagaacttggaatcttttttttcatttcaattatagtagaaaccacagagctcagctagcaggatatcacagtgtgttcaacataaggaaatcacagtaataaaaacagcctctcttccttgggtgttgggtgctctctttgccctgcaccatttcctgtgtgttattgattagaggaatagcaataaagagttctacaggggggaaaattaaatcatggtgactagctaagt

SEQ ID NO: 34080 - DNA, 1417 bp, Bovine  19866880820418
gtctgggaaggtagagatgttaatgtagatagaggtcttaaagaagactgtctgaagctggtcacatctcatatggtctgctctccatcagaaagcttcccctggccctggtggactagacttctgtatatgcactcccagcaagctaagtacaagctaggactccagtgggagtgcagggattcacttcctttggctttatctcttcatttgggggcagggtcttttccttagacacaaaccaagtacatttagtcacagcaaaataatatctttaaacctaaataatatgaacagttatagctataagcttaacttgtgtgtgtgttcagtcatgtccaactctttgtgacccctatggactgtagcccaccaagctcctctgtccgtggagttttctaagcaagaatatttggagtgggtaaccatttcctcctccaggggatcttcctgacccaaggatcgaacccgcatgtccctcatctcctgcattgcaggtaggtatttactgttgagccactagagaagcccaagcttatcttactattagttacttttttcccagttacctaaggttaggccttctccctggtgaagacatgaaggcattttggaaaaaaaaaaaaaaggcttttttaaaaataatagacccaaacttcaggtaactcaggtcagaagacaaactgctgttttgaaatttctcaagctatggcccaaaggtccacctccctttgaacttgatggggaaggattaaaaatacttctacttcggtaagcaccaggagttcagaagaggacttgtaggaatcatgatttgctagactgccattctgctttctaagataaagtgaagattagtttttaagcctaagattttttacaatgcaactgacaggccaaaagcaattttcagtttttcacaaagatccagggagtagaactccctaccacacgattaaacatttcttggcagcaagttgctagatgggcttgagagctcttggcggaagccatcattaaatcatccttcttccctctatcacatcagcaaaccacagttgatttacaatactttctgagaaaggcaagtctcagtcctaagggacatcaaaatgaaaagcacaccaaatgaagtgtttaatttcatcagcccaggaattaagtacaacatctttttctctgtagtgtttataatagctttctgttagacagacttgattacaggattatgtataaagtaaactttttgcatagagtatgtgggctccccaggtggtgctagttgtaaagaagctgcctgttgatgcaagagatacaggttcaatccctgggccgggaagatccactggtgtaggaaatggcaccccactccaatattcttacctggagaattccaggacagagaagccaggcaggc

SEQ ID NO: 34081 - DNA, 1888 bp, Bovine  19866880834871
tgacagtatttatttcttattttgttctctattatataatgtctgcagcaaagatttgagtacaagaccttgtgctgaatactgtggatggagagataagataggtcttgcctttgaggaattcacagtaaagttaaaatgaatcaaatatccttattataaatatgctgtttaattttctatgtctatttatgcacacatttacctatatatactaaaccataacccattttaaatcataaaatactaggatatgggacatggaagaaataatgtatatcttacaattaccagtatcttgagacattagaagcaaggtatcacacggaccacagctttgtctgactcaatgaagctaagccatgccgtgtggggccacccaagatggatgggtcatgatggagaggtcttacagaatatggtccactggagaagggaatggcaaatcacttcagtattcttgccttgagacaaggagatacaaccagtccatcctaaaggagatcagtcctttaggtgttcattggaaggactgatgctgaagctgaaactctaatactttggccaccttatgcgaagagttgactcattggaaaagaccctgatgctgggagggattgagggcaggaagagaaggggatgacagaggatgagatggctggatggtatcaccgacttgatggacgtgagtctgggtaaactccgggagttgatgatggacaaggaggcctggtgtgctgattcatggggtggcaaagagttggacacactgagggactaaactgaactgaactgagacattgtatctgctgcaggataaacattgttgattagttggttgattgatagaaatacttttcctaggaagaaataaagacttggaagacagaagttgttaaagaaggccatactctagaaggataggtttttatcatttgttatgaagttttattttgtttgtttgtttgtttttccagatttccctactacctttacccaaaactgtctgcttactactggagttttatctcttcccattcctttttggtcatggtgtcctttctgaaagggtgaccctgccaaactgtggttagttgttgatattttaaatggcattaggaaaatttgttggtagtgtggctatctttttctccattccaagaagtaaaaacttccccccagttctgtaaaggagaacagtcttacttaacagacattatacggtctgtggctttaaggtttgaaacattagatccttatataacatgtttattaagaaacaggataaaatactgttaatgagattggtaagttgtatgttgctacaaaaaatgtatctctggctttacaaatgattcgtattcttatttccaactccaaactatgatcaaagatgcagtgttgatattaatttgtatccctgttgatgttgaggattaactgtatcttttgttttatttttaccatttttttgttgagatattattcacataatgaaaaattcactgttttcaggtgataatacagaggtttttactggttttaaaaggttgtgccattaataccatcatctaagccttggatatttccatcacccccccaaaaaaatctgtatctagttagtcactctcagttcttcctcttcccaattccccctcccccagtttctgacaatctgctttctgtatttggatttacctatttgggacatttcataaaagtaaagtgtattttttaaatttgtttagacactaccagaaacatctttaccaaattatgctacaaatttgaaggaaaagagttctttagtttcatctctctataaagttatcccggagccacaaagtgaggtaagtactctcagagttcatcatgctagtagttttca

SEQ ID NO: 34082 - DNA, 1759 bp, Bovine  19866881052519
aaattctaatattttcctcctttaaatatactttgcccccaaaacaaaatagtacaaaaatcatccatgctgaagacaacatgattaatgtccatacctgactccaaaccctggccagaagtttaaactatgatagaacccaccaaacacccttagatctgcaccactttcatacctaacatatgcattgagtaatcaggcatatcattttctaattctggaagtaagacctcaaatttttatgggaaaaattaagctactgctatttcttaatttcttaggaaattaagaattgtcctccttgttaaaaaaggaagcataatcaaaagcatgtggtcaaaactgaagaaatttctcactgaacatactccctttaaaagtcacggaaagtgttatttgcagaatgttacataatttttagtgcagtcagtgccttttctcatactttcaagcctttagctatggtagataaaataaaaaccaatacagaagctatgaaatcatcacaactttcttccttaaataattaaggtacatactaataaataaataataaaactaagggcattttattctgagctaagttttgggctatttcacctttttacagctattaagaagtacatccacagctactgaaaagaccttaagatcaatgcagacttttaaagaaagagattaattatatatagttctaaaccagtgttgctcaaactttatttacagaatccccaggagatctagttcaaatgcagattcagattaatatgtctcaatgggcctggcaatgctccccaacaacgcttacactgctggtccatgatggctacactacgagcagcaaggctctaacttctacagagaaccatttcaagtagtttatgtttggaaaataatttcgccccaggccccaacatttcataggccagcaatgagactacaactgaaggcccacattccacatacctaaacatctaagtatctgaggtgtccagtcaacatcaggacccagcatagtgctcctagggaaaaggcctggagaactggaggcgaaaggagcagctctgccctaggtaagctcggtataagctgttagggacttttggccttatgtgaacctaaaaggggaatgggacctgacccatcaagcttctcatcctcattttttctggctcagaattactagatatttctggacgtcactcagaagtataccacctagacagttcgagggaagagcagtcagatagcaatccctttacccaagggatttggcgggaccaccttgagatggagcaacccctgtggctcaggtttcaagctgcacctgtttcccactgaggcagtgatcatctgacttcccctttacacacacacacacacacacacctgcctctcacacagtttcccaactgtcaaaaatctttcttgggagaccttaaaaaaaaaaaaagaacacattcttgcaggtacaccagcctttgtcagggccccaggcagtgagtcactaccaaaagccctaggggcggctgcgcttccagttcccgggtaagagtttctctagaaccagtcagtcagtctcctaaaaccagcacctcgtggtccggggtacgtttggaagttcaagtcccaccctattacaaagtgaacatgcaaacctgatgtctgcttttacaggccaggtgtactcaacgtgtgatctacaagggcagttaagaaaagaacaatggacctttgcgtaaatctggagttaataatt

SEQ ID NO: 34083 - DNA, 1242 bp, Bovine  19866881106830
ccataagcagcgtattgtgagcagattctgtttgtcataatggtgagaagtgaaaaatgtttaagctgaagtctctagaaaataaatgagaaatatttcattagatggtcaggatacattgaaagcagtgtgcaaaagtagcagaaaaaagggacattctgactccttttaatgactagaaaactgaattctgaccaaaggaacatttcccccagagttgcttatgtgtgtttttccattaacaaaataaaaaagaggcatttaaaaaatattttcagattccagaatctgaatctaacattatttaaaaggaatggcattaatagaagaaaaaagtacatagctaatgatgaatatatagctgtgatgaaatgacacctacctctttcaaaaagcatactgttgggtttggtgaagtacagcaggaccctaccatagagagataactcttggtgtaaccgactaaaagtgtcagaggagcttgtccataattaatggaatattcatacataaatctgtaggggaaaaatagtaggattaatgaaaatatttgtgggaaacaactcactttttcagaagtgttttgatgggggaaaaaaaaggatgcatgttactttatagttttaatatctaaaaaagcacccgggatatagagcagggggttataatactagtcactttttttttaattgtatgatttttattaagtgatattttacagactggttcgaactcaaagtctgcgagtcaagaaaaattaagtaaatgaaaaaaggatatggcaaaaaatgtgctccaggtacaacaaaccaacttttttcttcaagaaagaaaatgtggtcatggtacactacttgaattttaaaaaggaaacaaaacacataaactgaaagttactgtacatgaaatgagacaaagtctaattttttaccttctatcacacatgttcctataaaataagggatgaggctaaattccttccagatagacagttgagaacaccaacggattaactatccagaagggccaagtctcaagtatttctccctggctgcccagtctgatccattctgaagggttttaagttcatgagaaactggctacatgatcagtttataaatggatattaaggcaatttacttatcaccatcttaagacattcgggattgtcttgaataagtggttcagcttgtactgttttacttaagaaattctttgatataagaggaaacctgactttag

SEQ ID NO: 34084 - DNA, 1646 bp, Bovine  19866881310462
gtttattcttttttgagccctttgtaaactacttttaaacatggttgagttttcataggacatggagtggatgtgggcagggtggggaggagaatggaagtgggggagggagtgtggaaagggagaaaggacaatggaatggcctgaatgtttatgaggggataatgtgtctcctcttaactagaaaaactgggaggcaaacagaaatgtgaaggactggaagggggaaggcacctgtacacataacaaggaactgtatatgagccaccaagtgactttaaacatattctcctttcttccatattctaacaacacccatgataagtaactaaaggaaatcaacaggcagaaaatggaatcactgcagagtctttacataatctctttaactaaggatctaattatacaaaccacatgaatttttttctagctgttaaggagccctgccaacaaaaattaacctggaaaacacttacccaaaggaggggtggtttttggaggtctgggtgaaggcaaaggacaaggtccaggcacttcagcttgcacagtgaggttgaggctaaaggttccattgagcacataggtgtgattcaaagtgtgattgttggaaacaaagagaccagtattatccccgaagttccacttgtagtaaatggcagactcattgaggaagtggctgggatcgtgaatcaggacactgaacgtaatggggagatccctgaggaaggtttcatcagatgaatttcgattgttcttctgggacatagtcacaaatacaggaatctgatctaaaatgtacatccaaaaaaaaagaaagaaagagggtacgattgcttgattttaagtgggtgacttcaacagtgcctttagtttagatattaaaacgaggggacaattcagcatcgtttccccttttctaatgcaagttttctagagttttctcggtttactttagaaaacacagatggaatatgttattaaatatatgaggttgagaaggagtccagatgaagtgtaacctaccccagaatatttggttctactttttcaaacccgctaacatcaccagaactcagcgcctcgtcctctgttaattcacagctcatatcactcacctgttactacatacacatctttcacttttgcgatgggaacatatgcccgtcggtgtcttctatagacagttacttccatgatttgagggccaagactcacattggctgtgttgatggaaattgtcactgaacactgtcccaatttctggaaatactgacctttgagaagatagaaatgtttagttattggctacatcatatcattatagaaagttgatgttccttaaagactaacaactaccatttacagattgttttgagaaaggaaaagcagggtggggatgcggtcttggttccttcagaaaggaagacagtgcttatttttatataaaaccttataaaatccacaaataaataaatgtagttgtatatgttgactaaaatgaaaagagctgtttaagtgggataatgctgttagtccttagttgacaaatactataagtaagtgacctggcacttgaaatacatgtgtttcccacagaaaatacatttaatgtaacagtaagtgtccaagggagttaaaaaatatat

SEQ ID NO: 34085 - DNA, 2010 bp, Bovine  19866881414759
ctctactgtggcagcctgttggatgaaaccaactctggcttctttttcctttggtgtatagcagagcaaatttgtggctatacataaaagagatttactatgtataatttctggttgtatgcagcaatcgacaggatctgtttgagtgcatcagttgtatatgttgacttgattttgtagcttccgtcaaagtagaaaccatctggctaagatgaagaaatgtttgacagaaaatactccttgctggcccatttagacatgagcttggcttcttgtgagccttatgtgggtggctctgtagttcattcagtctctgttactcaagaaaaatgcagttactatcttactgccagcaggagaattttacctttcaagactggagagccaaccaacggtcagtcattcagctgccgcagctgtgataatgtcagcactgtcgccatctttcctcgggctcctgccatctcttgggcggcaggccaccatcaggcacagatgtatccctgcagagggctgctcccgtggggccaggccattaactttacccactgtaaaatcagtcaacctttggcctttcctacctgaatgacactgataggctatgttctcatctgtaggctcagggaagaatttatggaaaaattaaagaagaaaattttgttagtcctaaagaagaggtgaaacttgaagctcacatccgagtgccgtcctttgctgctggcagaggttattggaaaaggaggcaaaacggcaagtacttcagcaaaacctgtgcagtggtatgacagggaaagcatcgaaaggtacttaggagttccccgtccctgaatttgggctaacttctaacagcaggacacctgggtcgaggtttggagaagactgccctttgttctcctgagggttggctgtcagccactggggaaagcagcacctctctcagaccactttgtgcgagaggactgtctcttgaggggccttttgcatttttctgttgataaacatcagctttttatttctgttgtgcaaaaatactaaatgacatgaaaactttaaaaagtgtcatctacctttataacttacacatcctctataactgaaaactcgtttgcagtttctctttaacatatataacttcaaaatcgtaaacagctttgaaaatgacttggaagtgactgcaagtatgttttggaatcagatttttagggtttaaattaggctttgttattgatgtatgtaactgtaggtaagtcagtttctttggggattagttttaattatcttgaaatgggacaatactaataaccaaatagaattattggtatattagatgagatttacaaagacatattttggtacaagcgttcaggaaatggtaatttttttaaaaataaaaaaaccccaacagttccacttaacatgatttctgtttatctccttcaggtgaatgagctccagaatttgtcaagtgcagaagttgttgttccccgtgaccagactcctgatgagaatgaccaggtggtcgtcaagataactggtcacttctatgcttgccaggcaagtgggctcccgtgtgtcagggcagctctacagctgcctccgcaaatggaagccattctcccatgggtgtctccatgccgtacaaatattcaaggctgtgtttgatgcttaatacgttaaatcccctttgagcaggtgattttagagactctgctagcaaactaattagtacatgtctttaatcttcaaattttaatttgaagttaattttaaaaatggaagaggtaaaataacttcctgcaatacttgatcaggtaggtgtttcaaggttccctccttttgcaggttgcccagagaaaaattcaggaaattctgactcaggtaaagcagcaccaacagcagaaagctctgcaaagtggaccatctcagtcaaggcggaagtgaaggctcaggaaacagcccaccacagaggcagacgccaaaccaaagacagactgctaaccaacagccggg

SEQ ID NO: 34086 - DNA, 1036 bp, Bovine  19866881416694
taacactggacagctctgaatacaaaaatctttaactttcccttttcttcagctcactgacattattctaatcgttttcttttctcttcattatattctgctcactgacagtattttcatctgtttggttatacaaaatgcaatcatttgtttttgagactaatgaaggcatgccaagatcctttccactgattaagttacaaataatataattagagatgaaaaggtttgttaaccaattaatttgtcatagttgtacctccatcaaaaccactcctcacctatgtcattctcaacatccaaattcaggaataacacttcacagtatatttagtggcaccagccaagaatatggctctcaatattttttatttaaaaataagtggtggcatatgagtttactgagaaataaaaccacagaaataaatactcctgaaagattttaaggcaaaaaaaatctatatattgctccctgtaatactgaatacccccatattttgaaaatattcaaccttttatagttaaactagtaataccactcaagcagaaattgagtggtaccaatgatatagctttatcaggtactttcaatatctagtgaagacttcagccctgtaagagggttccagtggccgagtccagaatcagactgcagatgtccaactctcagttccagtacttactgtgtgaccttgggcaaattacctcacctctctgtgcctcagtgccttcatctgaaaaatcagaacaatgagagtattctcttaccacctcatcttggcaggttattgtgaagaaagtaaaactgtattgtccaatatacggaaaataatcattgtcattgccattgtcatcattctggatggaggccaattaactctctaatctagcctcacaactctgccgaaatggtcttcctacagccctgctctcatcctttctcacacttgcccacgcttgacaaaacctctggcattttttcactcatcaagtaatctgccactccccctcagaggaattttcctttctgggcagg

SEQ ID NO: 34087 - DNA, 1276 bp, Bovine  19866881562163
agtttgattttgtattcgggaggctgttgtttttgtgtgtgtgtctgcgtgtgaacaaagtgtgctggggcaaaagtattgagtatcctacttttagttttaattttactggcttttataatgcttgtgactttgcacgtgtactttttttaaatgtgtgtgtgtcacttcacttgtgtccgactctttgcaactctatggtctgtagcctgccaggcttgctatgtccttgggattctccaggcaagaatactgaagtgggttgccatgccctcctccaggggatcttcccagcccagggatcaaacctgcttctttgtctcttgctttggcagatggattctttaccactagtgccacttgggaagccctttttatatcttttcatgataaatatctctttatatcactgtagactttttattgaatctagaatttgtttcctttgctcccactgaagagggttcctagactgtatccccaacactatcctatcatcttcagaaacgcacacgttcagtaaggaggacttggaatctagggtcatgcatgtcttatccattatctggagcacgggagccagtgtaacatttaggaagaggttacttgagacactacttacgaataatcacatcactatggttaataatcactaatcttgtgggagaataaagatcagtgaagagatcatgaaatgaaattgctttctcttccaggattaggtcagctcaggtgctgtggaaatggggacacttttcacagtcttgagggtatggctggagccaagtgtgtgagggagatgtgggcagtaccagatcattgattacctcctgcaccaggtagaagtttggcattttgaagacactgaagagaagtaacttccagcaggagggcagttactgggctggaagaaagaattcaatcagacccttgcttcagatgattcagaattgatgggacctgagcggtgggtataaagaataagtcatcagcagtagatatatctgcagagcatggattacaccacacccataggcggtcaggcttccctgttgacccagtggtaaagaatccgcctggcaatgcaggaggtacaagagacatgagttcgatccctgggtcaggaggatcccctggagaagaaaatggcaacctactccagtattcttgcctgcggattccatggacagaggagcctggcaagctgcagtccatgatgaggtcacaaaagagtcggatacaacttaccaactaaacaacagcaaccataaggggt

SEQ ID NO: 34088 - DNA, 760 bp, Bovine  19866881703884
tgttaaatattcccaacatagactaccagacaccaacatataaagaaatgaatctatctttgttgtgagattagcacaggacatttttcttttccagtgtgtaagatggtggtatggttcagtccctaagtcacgtctgactgtatgacctcatggactgcagcatgccaggctcctctgtcctccatatctcctggagtttgctcaagttcatgtccactgagttagtgatgacacaggattaataacggatctgtactctttattctttaaaagtaagttggctgggctctggttctaagggaaatgccgtaaagcccgtgttgttgtctctggagagcttgagtgggtggttgggccatgtcctaccacattggcttgcttgcctgttggggagcagggcattgcagcagcattctctcagcctcagtatttggtaaacagaggccccagtgagaagaaatttgccaaattggctggcttcatcagtatcatgaataacattcagaaatagtgatttaaattcactacccaactatagttgaatctacagtctacccagggatttatacccagggtcaacttgcaatcatgctgggagaaactgactgcagaaccttgttgacaagctacataaatacaaagaaaacattgtgtgatgtgattcttatggcccaggaacgaaaggtacctcatcatgttgtccttggtgcagccagtcatttttttaaactttatgctcacaactcacatgcttgaa

SEQ ID NO: 34089 - DNA, 1369 bp, Bovine  19866880737029
tttattttttttttctgtagcatcttaatatctccttcagtccttaatgttgcctaccataatttatgagttaaataatttatatttcgttttagcttcagatggagaatccaaatatatatccatatataaatatatatatatatatcccccacacaacacatacacacacatatattccctcttttctaggacatctctccctttataggaaggaatacaaaatatggcatacactttctctcaagatgcctgtttttaaaagagggatgtgattgccaagaaatgaagtagggagaaagcatagggcaaacataacttcagcattctctgctgcacctactgcaaagaaaaaaaaagtcaactatcatgttattcaactccaaaattacttcctttaatgagagggagacaaaaagagaaataaaacagtcgcccagtgcaaatggatccacaagctcacacacatgctgccgtgccaacaaatcccttttctttaaaataaaagccctttagattttaacacaagagtatatcccctgttgctgcaatcaacattttgacagagcaacaacacatttctctgtagcgattacaggagcactcaggttccactggttacctttttgcctcccagctcgggaaggacagggaacggaagccctgggcaacctggaagctgcataacacaacattgacccttccttaattacagtctagtaggcagggctggtagcatttacagctcttcctacttacagtggggttaagtcccaataaatccattgtaagttgaaaatatcctgaattgcaaatacatttgtgctcagtcgctcaggggtgtcagagtctttttgaccccatggactgcagcccaccaggctcctctgtccatggcatttttcaagcaagaatactggagcaggttgccatttcctactccaggagatcttcccaatccagggatcgaacctgcgtctcttgcggctgctgcactggcaggcagattctttaccactgtgccacctgggaagcccccatactacacttcctagccaaaaggctgagaagcgaaatgcatttagtacaccaaacctactgagcatcacagtttagcccagtctccctttaacattcccagaacacttagattagcctacaggtgggcaagtcatcagacacaaagcctgctgtgtaataaagtgttgaatttctcatgtaacagactgactactggactgaaagggagaaacagaacagtggtgtaggcccattatatttttatatggtgggaagcagatcggttgttgaccattgtgatcatgggcgactgagagctactgctgcttcgcccagcatcaggagagag

SEQ ID NO: 34090 - DNA, 1188 bp, Bovine  19866880893114
tgctgtttgctgatgggcagcatgactcactatccgcagatcatttttctaattaagtggggagatggacagatattttcccatacttgggcagaagcctcatttgcttgtgtctttttactgcaattactcagctttatattgaaggggcgattttctccactttaaaaaaatagtacatgaaacctgccccttcagacaatgtgtggggaacatggaaaggaaatgaagcacttttccaaaatgcaccctcatgagagagaagaaacaaccttcactgagcttcttccacaaaattgccatagatgggaatgcccagctccctattttatctttaggatgctggctggcgtttaaccttcctgaaacgattcccatcctcctcctgctttctggactcctctcccctcagccactcaactgaacaacttccttggggcagcagctttattctgtgaaggaacgacaggagcttgcaggcaaatcctggggtctaggaagtgggatgggaggtctagctcagtgatagcccttcatggagatgcaggagcaaccatggtggaatttgaagggtggacaaggataaatttgcacagtgtcactctcatagcctcaagaaatcaaataactagtccccctctcttctaggctcagaaatagctcctcagataaacccaattcaagctcaagtgctcaaagtgcattgtagacagatactgctatgaggattttttttaagtagaatgttagtagctcctggaagtcccactcagtcccccatgagctgaagtcatggaactcaccagttggctcagccccctctcatttctgcctccaacagggtaagcagccctggcactggtctcactgctctttcactgcattcattgggcccttgtacaactttccagttatgagtccagtcctgaatcccaagcgtacttggacagaattacatttcctgcctggcttttgccaggctctttctccaagggactacttcctataacacacacacacacacacatacacacacacatacacgtttgcctctgccatgcctaagtcttccacacccaaagaccacccaagaaccagtattcccaaccccaccccttccttaatagcctcaatagtggctgcaatcccagcatgcctcctgcccaaattatgacaactcgcttaaat

SEQ ID NO: 34091 - DNA, 1115 bp, Bovine  19866880939259
aaaaaaaaaaagagatggagaaattggagaatataaactaaatgaaatgggagcactgaatatgaaataaaaaatgtgaaacaaactagataaaaataaaagatcatcatatagtccagttgtttttaaacatgactgttcattagaaacatatctggagctctggagaaaaaagccttttttattgcacagctctcacatctgtacatgactactgggaaaaccatagcttagactacatggatctttataggcaaagtaatatctctgctttttaatacactgtctaggtttgtcattgcttttcctccaaggagcaagcatcttttaatttcatggctgcagtcaccatccacaatgattttggagcccaagaaaataaagtctgtcactgtttccattgtttccccatctatttgtaggagagatgtggtcaaatctataaaggaggtaattctgataacagtatgacaaatagatgtgagcaggtcaactacataaaggtttcttgctatagtccaaacaagagaaaatgaggactgaaaccaaactgtaagtgaggatagagaggaagagatggagttgagctgggttcagtgagtaaaactagcaatattgttgagaataaatatagggaagtaggaagaagtttagggcaactttttagatttttaacttgggtaactggatataatggtaatgatgttctctacaataaggaacatagcaggagaaacaggcttttgggggaccagtcaaatccagttaagacatgacaagcttagagaccatatgggacttccaagtgcccatccagcaggcaagtatttctatgtcatgttagatatcatacatcaaagttctggataagatttcagagttatgagaattcctcaaactaattattggctcatccatccaggagtagagcttgctgtgtttggacacagctggattcagggctccagcctcttaaagtgttcctcagttgtcagattctctttctataactcatactcttttgctgtcttcctccaggtagagaaaaagttggccactgaccaccctaggcctgtatctttacaactcactatccaaaaggaagacagtctttc

SEQ ID NO: 34092 - DNA, 2013 bp, Bovine  19866881211694
tgtaatttctttgtaatcaggttgcagatcacaaagggaattttgaatcttttctcctgttttgctcgcaagtcagttgacaaaaaatctttaggtggaaaaaagaaaagggtatttgaacttaaatctaccctgagtttatagctcctccagctatgaaataatagatgctgggggactgatccagaagtacagcaagacaagtattaaagtcatcagtgtgttaggaagggggtacaaaagcccactgatttacattcattctggaagagcagaggggaggaaggcagcatgattctatgggattctgttccctttgtgttcctacacttgaaaggaacttttgctggacacccagcttcacatcccatctgccaaggcattattattgttcccatgtcgacatgagaaacatgtgactcagaacagtaaaatcaatgcttcaggctgaaacccagagtctaatcacagaagtaaacgtgccagctatttctggcacctaagcagagctcattctgcttttaggacactgtaaattggcgatggttcagggtgggttagccagtggcgtttcggtaaattttaataaatgtttgtcaaacaactccttgggtggggggaaatgtatgcttatataagtacacaagtttgttacaaattttagtgatgtgaacatctactacataccatttacaaagaataatgaaatatacagtgttctttatcatccatcccatatagccagttgattctcacagaattattttattgatttttgctaaactcatagccttagccaacctctggttgcaattgacaagggacgacagttctgacatcaatattgattaatattttcctttacacgaatgagtaaaacagaagtgaaaccacagagaagaatgccagaacctcactggtttgtcagcgacgtgaacaacctcattgctgaatctgaaaataccttctggaaaataagttcttggtttttgtgctagtcacagtggctcaactcgagacatgactcacgtttaaattaaacctgctttactaacatttcttccatcattaaatcaaactctgatctgcagcgtgtgccgatgcctgcgggtaagtgctcctagtgtggaaaaagtcagtgccgatgtgaagtcatgaaatgcactagggcacgtttccatcaagcatcggcatatgcacatacatacatcatacaagtatgacagacaaaactagcaccaagaccacaggtaacagtacactatggtagaataagtaggaagtgatgcatggcacagtggtaaagaatctgcctgccagtgcaggagatgcaggtttgatccctgggtcaggaagatcccctggaagagagcatggcaacccactccagtatctacccagggaagacagcccctcctccccgctcccatgcaggttcaatgttacagtcctcagtcattactgatcttttgtttaaaaactcagggctttctctgaacactgacagttattagttgaccttgggaaagttgtttgaccttgacactcattcctttcattgtaaagtggggaagttcatagtttcaccacagtatcactgtgaggactgataaagcaaccagcacagagacgaccgcacacacgctcagtaactaggagtttgcaccccagtctgcccctccctatgtcctggggctctctctgacccccattcattctacactgacccccactcattcttcccatctctgtcattatcatttccaatttctgtgcccaaagataactgaccatatgacctttctgactaggagaatacatacacataaaaagcagtagtaacaaggcttttcatgtattaactcatttgattctcctgacagttctatgaaggaagtgtttttctttgctccattttgcagatggggaaaatgaagtccagagggaacaggtcacttacccaaagtcacattacacctttcctacttgatctcatggcctctagttacaagg

SEQ ID NO: 34093 - DNA, 934 bp, Bovine  19866880113431
catattgaaaagcagagccattactttgccaacaaaggtccgtctagtcaaggctatggtttctccagtggtcatgtatggatgtgagagttggactgtgaagaaagctgagcaccaaagaattgatgcttttgaactgtggtgttggagaagactcttgagagtcccttggactgcaaggagctccaaccagtccattctgaaggagatcagccctgggatttctttggaaggaatgatgctaaagctgaaactccagtactttggccacctcatgcgaagagttgactcattggaaaagactctgatgctgggagggattgggggcaggaggagaaggggacgacagaggatgagatggctggatagcatcactgactcgatggacatgagtctggttgaactccgggagttggtgatggacagggaggcctggcgtgctgcgattcacggggtcgcaaaaagtcggacacaactgaacgactgaactgaactgagactcatgagtcacaccttctcaaggcagaaaccagaaactgggttacccagcctcctttgcagctccagcacagacatgtgactcagatcccaccaatcagattcattcattcactctagaagggaagtactggagtaaggaggcaatgcccatagtccacagtgctggcaagggtggaagtggaagtgtccagctttgggtagaagtgacaacaagattaagttcctggtccaagaagtgcaatcagtggggagtgacagcaaaggttctctggtgcctggtgggaggcgagtccggtttccccatcagtctggttctgtgtgcagcagggcatcaggcctggaatatgagcctccagtctggctctctacccctccctgcgactagacaagacacccagtattcctactaatattcttcaatcagtcagagtcg

SEQ ID NO: 34094 - DNA, 3973 bp, Bovine  19866880420616
ataagagagatgtatttcctgtggctgcaagaacagatatttgaaattcacagagaaacagattaagggtcagtcaataattttctaataggaggagaaaggcactaagaatgctgaatgtgtccctgtgccaaaaatcaaatgtggtttatttatacaatgaagtattattcagccataaaaaggaacgaagtactaacacgtgttatcaatacaacacagataaaccttgaaaacactgtgctaagggaaagaagtcacacaaaaagccgcaacttacatttaaataaagtaggcagaatggacaaatccacagaaatgagaagctgatgagtgattgcccaggagtaggggtgttggggggatatagagtggctgccaatgggtaccagatttctttcttttgagggtgataaaaaatgttctaaaattgattgtggtgatggctccacaattctgcgaaattactaaaaaccactgaattgtatactttaaaatagtgaattttatggtacgtgaattatgtgtcaatttggggaagaaaagtaagccattaaatggttttaagctgggaagtgacatttttcatctgcattttagaaagaatgtgctctggccacggggtagaaaacaaactggaagcagagaaatcctgacagttatgaggctgttacagagtcttgatgagagataatggtgacccagacaaaggaagtttagtgcagatggagaggaaaggtcagatccaagaagcatttaggatggatgcagcagattaaacatacagtcaaaactgagatgtgcagaaatacgagtttctttataatcgaattcaacttcattcttgtggtggtttttaaaatgtcctcaaaatattttgacagtcattccttcagaaggtggagtctagttgccctctccttgaatgtgaccaaatttagtgactcacttctaactaatagtatgtggcagaagcaaggctacattaattccaaagctacataataacataacaggctctctctctctctttttcttactgcccgctctgggcaaaggcagcaccgtgccatgaggacactaaagcattcctgtgaagagccccacatggacaggaatgagccctcccaccaccagccagcaccaacttgccagccacccgagggtatcatcttagaagcagatcctcatttgcccagggaagtcctcagataaaatcccagccctgagcctttgggtttcccagctgtggccacagtctccagagtccctgacccactgaaattgtgagagagaataaaagtgatcgctgtgctaagtcactgagttttcagatcatttgttatgcagcaataaataaccaatacagtgctgaagccctatgcctactgagagcagagaacaattaaccttgccaagtaaaggtaatagagtcacttctctttgaaaacttaagtctctttggggtcaacactcagcttcaaactgatttgaactcagagttcaagctccctatctgggctcctggttttctctactcttgccctctccctaggatgtctcattcatgggagtttcatgtaacatcacggccctgaacaagggctcccctgccctcctttgagggctggcttgtcctctgtggcccttgggcattggtttctgcttctgcagcatctgccactgaagtggctatgagccaggtgacctgttttctgtttcccagatgtttagttgtgttgtttagtcactaagtcgtgtccagctatcttgcgaccccatggactgtagcctgctacatgctcctctgtccatgggattttatagataagaataatggagtgggttgccatttccttctccagggtatcttccccaacccagggattgaacttgcatctcctgcttggcaggtggattcttcactgctgagccaacaggaaagctcgttccccagatgaggccactctatatagttagttgtacacattgtgcttgtatagagggttcttccaaggggctgaatgggaattttaatccagctgtgccctgctcaccaagctgagacagtccagaggagagggtgctttgggtaattcatcctcccagaaggggcgcctatttgcaaatcccacaaaggcacagatccaaacatcagccttcccccaccccgatccttctaacagagacccctacctcccaggacagcaaagagtaaggagactaaggcactcacacctcaagcacaaatttaaggcaatgcccccaaaactcagcaatcaagatcgataatattttaccatcggctgctgctgctgccaagtcgcttcagtcatgtccgactctgtgtgaccctagagatggcagcccaccaggctcctctgtccctgggattctcccggcaacaacactggattgggttgccatttccttctccaatgcatgaaagtgaaaagtgaaaatgaagtcgctcagtcatgtccgaatcttatcaaccccatggactgcagcctaccaggctcctctgtccttgggattttccaggcaagagtactggagtagggtgccattgccttctccaatattttaccatagtattttttaattcaaatgaatgctgaaaattgaaacaaaatatcaaaagtttaatagggacaagatccaacccatctcttgcatgaccctgtctcactcgcctcattgtaatcccagcccttgttccaataaaactttatttataaaaccaggcagccaaccccaaggccacgacttgccaatttgattttttttttttaagtacagcagtaaagtattatttattttgattatccaatcgctcacctcctgctagccctggcttgtcccaccagccctcatctctcagactggggaccactctgtatttcctggattccagccacagaccaggaactaaaagggtagcagaggaaggctgctaccagaggcagtatctcaggccctctcccttctgctctacagtgttcaacccctgctggtacagggcattctgggagttccagagagaaacagggcacaaattgccttgggctgggcagacttcctgggtggtcttcatcatgccctggggttctggtctctaagtgaaaactgagggtgggggaggacagagaacacccatctgaactctagctctctgtctctttgggctccccgatttcccagggaggaatgcctccttgtctggtatggaaattaccctcaagcccctgatttgtggttactgttttttcattcattcagccatttacttcacagtcaatcctcagtctctactatatgccaagatttgccagattctagagatacagaggaaaattctagtactgatgggtcaaacgataagagacaataacatttataataattaaagtctcttatataaagtgcaaaaatcaaagtgtgttcaggcttagttgtggcagggaagagaaagtgattgcctctctccagaagcctcaggacaagggaggtttgatccccaaagccgacaaagaacttgaatgagtagcagcagtgcatatagaagtaataggatcgatataaacagagagaggcacattagagggctttcgtgcatgctcagttgcttcagttgtatctgactctctgccaccctatggactgtagcccgcgagtctcctctgtccatgggattctccaggcaagaacactggagtgggttgccatgccctcctccagaggatctttcacaaagagtcagacacgactgagcgactgaactgaactgaactgaactccctctaatggttcaagagggcttccctggtggttcagcagtaaagaatactcctaccatgcaggagcctcaggagacatgggtttgatccctgggttggaaagctcctctggaggagggcatggcaagccactccagtgttcttgcctggagttaggcagttgaccggagttt

SEQ ID NO: 34095 - DNA, 2765 bp, Bovine  19866880557813
cctgtatcctgcatcgaacctgggactggtgattcgtttcttatatgatattatacatgtttcaatgccattctcccaaatcatccctgcctctccctctcccacagagtccaaaagactgttctatacatctgtgtctcttttgctgtctcgcatacagggttatcgttaccatctttctaaattccatatatatgtgttagtatactgtattggtgtttttctttctggcttacttcactctgtataataggctccagtttcatccacctcattagacctgattcaaatgtattctttttaatggctgagtaatactccattgtgtatatgtaccacagctttcttatctgctgatggacatctaggttgcttccatatcctggctattataaacagtgctgtgatgaacattggggtacatgtgtctctttcaattctggtttcctcagtgtgtatgcccagcagtgggattgctgggccataaggcagttctatttccagttttaaggaatctccacactgttctccatagtggctgtactaatttgcattcccaccaacagtgtaagagggttcctttttttccacaccctaaaatcctcacttttaacagttgcatattattacataacatgactgttgttgctcagtcctgtctgactctcagcgaccctatgggctgcagcacaccaggcttccctgtccttcactatctcctgcaagtttatgacatcatatatttaatcattcctgttgttggatatttattttgtttaaaagcttttaatgtaatgactttacttcagtgtatctttctacatagccagagatggagccaaggtagaattactgtgacagagaatgtgaatgttttaaagtatgtattgccaaaatgcttaatgagtaaatggtgcaattttatatttttattaacatcaacaaaaagaattgtaattaaaatttttgcattacccttttaatgacctttttctctttatgaaaatagtatgtgttataagaatatttaaaaaacacaggtgagcaatgctaaaaaaagttagaatcttaccacctagagtcagacagtaattgacaacaggtaatatactcattgccattcttatgtgtttagaatcatgcttgctgttttttactaggagtatcttgaacatctgaggatgttatatatttcttctgccacagtgattttcgaattacttcaggtaattgcaaagcagttcattctttctgtttttttattcttcctcttccagacctcttcctgtgccaaagctgcctcctggggagcagtgtgaaagtgaggaggacacagagtatatgactccttcctctaggcccgtgggacttcaaaagccagacgtgaagtggcctccggagatagcacagagttcacggtaggttcacaatagtcctgttagggaattcagttgacaccaactcactcacctgcttggcttgctgcctgcacatagcattatccagccaaaaataaagcagaaagatgtgtgtagccgctaatgttttaagcttcttgcagctgtaagcagttcaacttaacatttcttcagcatcacagtaatttcaaaaacatacacagctgttactcgtaataggagtcaatcttatgatatttactagtagtgacactggtgaagggagagtgttatcttgatagaatcagggtctagagaagttgtgaataagtgactcctggtaagtctgcagataacagagttctgtttctgaagataattatgccactttccttccggtccagaacgtgtgactgtgaccagcagatcgatagctgtacatacgaagccatgtataatattcagtcccaggtggcgccgtctgtcacagagagtggtacctttggtgagtagtcattctgctactttattggtttgtttatttgaatttatttatccatttggctatgccgggtcttagttgcagcacttagttgcagtgggatctttagttgtgatgtgtaaactcttagttgcagcatgtgggatcttagttccctgaccagggatcagacttgggccccttgcattggagacacggagtcttagccactggaccaccagggatgtccccagttttgctgctttaacaatcattgatatgccagaggaatgagctggtaatgtctggccaatgaaagcttgatctaagtgaaatattcttaaataattttctttgcaaaatatctttgatctatggcagtaaaggcctttcttctcttttatttctcacagccagttccatttgggtttttcatccttccagggcctggcggcctttgtgttatatggcctggacctgcagtgctggcagctagctccctcttactcccattgcttttcaacattgatgaaattcttgtgtgtgtgggtggtgaacactcaattcccatgttaactagcttaccaagttgaaagttcaagaaggcagtacatacaacagggccctttggctgatcttccaaggtgaaatgcagatgaaaatattgactgaatgctgtaaagtggtgcttgagtcttggatttcagtggctgttaaccttggccagggttgcttttgacatatttagaaaagtagagctgcaggattggtgcagattttaggttccttgtttcttttatttctacccacagggccacacagtgtttggcccataatggatattcagtaactgatgccatatatgcttgatgagtggatgtccctgt

SEQ ID NO: 34096 - DNA, 2921 bp, Bovine  19866880585891
acctgctgtgtccactttcaagcctgccctgtgccccgtgtcagctccttggactgccgggctggacagtcccagccttctattcccaggatgcagccctcactgggctctcgccatttctgtgctcggaaccccaattctgccttcactagagctgggccctttctcctccgtcctctgcgtctgatttgttgtcagctcttactggtcccatttctacaggaccccccatccccaccccagtctaaacactgccaccctctgagacatgcgagtgcggggggctctccctattcccttgtggcctgcacacacagagcaaggagatactggggcacatcacactcctgctctgcctgaaaccctcgtgccttccccatcccctgccagtgctgcttcttaagcacacactctgtgaccgaggccagggctctcacccgcagttggcactgttgacgtcctgggccaggtgattccatgcataatagaatgttcagcaccatctccggcttccatccaggtagatgccagtggcgtcctcccaccatctccctccatgggacagtaaaaaatgtcctcagatattgctaaatgttccctgggacaaagatacccccagttaggaaccactggcctaggcttttgctgtagccagaagatacttttcaaagctatctcccccagcctgccatgggcacattcaaggttccatgtcttcaatcttcctaacccagggatcgaacccaagtctcctgcattgcaggcagatgctttaccctctgagccaccagggaagcccattcaaggttccagcaggaattaactgctccctctcagctcctcctcctcctgctcctgctgctgggtcagtccaaagccccccgtgtgaaaattgctgtgaaatgcttggttgccaaagggccccatcccctgagttctttgccagcctctgggactgcattgtctggaactttctctctgcccctcaccctagaccctgagtctttgaaggggaggactgaaccttacaatgtcttcaggctccagctcagtgctttgaacacagtaggtgctccataaatgtgcagtacaccaatgggagctgctggcttgccctccttctcaagcccagtaagctctgagaattccttcctctgcatacctctctgttttcctggcccttcgtctaaccctataaccaaggcaggagaaaagggcaacagaggacgaggtggttagatagaatcactgattcaatggacatgaacttgagcaagctcagggagatggtgagagacaggaaggcctggcatgctgcagtctatggagttggaaagagttggacatgacttggtgactgaacagcaacaacataaccaagatgctaaaacttctgatatttccctctctcctgacacttcccatactcccctcatgctgtttgctgcaaacaaaagcatctttttcccacaaagtcaacatttactaagtaccttccgtgcacggagccctggggagcaggggactctgattttcatgtgtgtgtgaaggtgttcctggctatgtggtttcccagcgtgtgagctggtgcatcactaggcatgtttgtgtttgagtgcaagtttgtggggggtctgctcctccactagctgctgcaccctgggctcaccccctctactcgccatccctcacctttcattcctcccggcctttgatcacactgtcttctctatttaggggtcctacttcactgcctggcaaagtcccactcatccttcaaggccctttcttctctaaacacccctccccaagttcatcatttcctcccttttactgtcatggcacttgtaaacattcctgccatggcacctgatcgcaatattaatccatcgtcccttgaccccaggaccatatcactcttttactcgtgtgtgtgtgtgtgtgtgtgtgtgaaagagagtgtgtatataattccttctctcagtcacttgatagattcttaatacatgtttattaagtaaattgaaataaattgcttatttcatctcctaaagcattttccttgtacagttctaagaatgtgtctctgattaatgactttgcttaacctttttgcgtgtgccctatgtgtttctgtgcctgcaaacatgcacaaacacacacgtctgtatgtatacagcaatgtttaattgcacgtgtgtgcttggtcatatacacaggcaggcatgtgtttcgtttcggtgtttctgtaggtttaaatgtgtgttccccccaatgcagccactcttcaagccgctcacatttgggaactgagagagtgagggtgcaggagacaggggatgactccctccaggtgggtttctccgccccttctgagaggctccttccagaattcccttctgaccctgcccctggtctgctgaaagtgaccagggacttcctgtccatcctgtggcagcccagcatgggcaggtggggttggagggcagagccttctgtggcccagtcacatcacaccccctttctgatccatctctgccctgtttaattggaatttggctagtggagaccatctgttctattccgtcctgtttccatgacaaccaagtggcttgagactgaggtttgtggttagagaagtggcctgggggatgctgggaaaaatcagcgaggtcctccccctcagaccggctccacctcgccttttcctctctgccctgccctcacccccaagcccagagtaaaaataaagtgattgcttgccagggcatgaagtcccccagcaacgctctgcctgcccggccggcctgctctctcccaggctgctctgggctccccacacacggctccctcctgcttccattcataagctccggctagagagatagccctgcccttttacccacatatggggctgaaag

SEQ ID NO: 34097 - DNA, 1255 bp, Bovine  19866880611908
gaaggaggggatgagacgggtgtgggtctaaaatttactggagcaacaagggctacactctcaggaagagacccccgaatcacagaggtgcagacccctgtggtgccagggtcacctgtggtggcttgtggacacgcatggcttagacctccgccctgggcagcccctctggatccacctcagcttttgtgctgtgcccacacttccccaggctgctcccaccaatggctggacgtgatggggtcctagtgcagctggttcctgtggaacgggaggctcctctcattgcagctgtggcttcgaggtctctctgtggcctgcccagagcttctgcagagtgtgtggtcactcaagactcttcccacgcaggcttccttcctcccccatctccccatccactcctcctccaattttggtccttcacccgggtccctccccccatgactctgtgtctgatcccatcttggtgtctccttcctggggaaaggaaggagacaaaccaacaccaaagctttggaactccatccctccccaggtcgttgcatccagtcttctgcttctagtctgggctgtctatcctcccaagactgaggagctgggagcccctctccctaaaggtgaggcagcactccctcctcccacttcttctaggcatctaccttggagcctctggaagtcctccccaagatctagccccaagccagccagcctttcaaatggtacctgctgcctgagtggactcctggcccagaaacctcgatagaaattgagagatgcgtcacacccttgctgaatgcccttgagtgtgtgggcagcatgggacctggcccacccaggctggggccagtaggcttggaagggggagtctctacctgttggtccctggggccccctgcaggcttccctccagagccctgcctcagtgaacggtgcacgctctcttcttggctccctctcactacttgttgggaaggagaattgatgacaacgtcaataatgtgacttgtatacaagctgcaccgccaacaaacccgagtgctgggaataaatcctctccaggccccgtaattgctctgtaagccgaaaggaatcacaccagtcttggcaacaccggcgcctccctgggatgctggaggtgaccctccgtgtaccaccccacaggccgttctcacaagtgtccagccaccctggtgccctcatctcacggcctctgggtccaagactcagagtgcgcccatcagctaacctttcctgc

SEQ ID NO: 34098 - DNA, 1858 bp, Bovine  19866880627249
aaagtggagatttcttctttcaggtagtgaaggatccaactcctcttggagcccatgtcttctgatgagtggctgaataatcacaatttactctgccaagcaccatggggtattaaatgcatgatccctcttgaacttcacagcatcccataaaacaggaatatttagttgtatttactacagtggaggaaccaaaggcccagagaaggttaaatgaactgttcaagaggcaggaaggagtggactcaaacacaacttggcagactccacaaccagatacactctttccctacaggtcattttaaatcatgagatcattaatttgtcttcctcctccttccccctcagtgattgtgggtagcatagaaatcaaagttcagtccagattttggctatatctcatctaactcaacttcctggaagaggtgggaggaaggaaggacaaaggtgtaatcctctctgttgactggtgcgcaaagaggaacacccatctagaggtcagcgatctgcagcagcgtggtccttgtccatcactctcccacctccctgcttctgtcctgcggctcagtcatcattttcctttcccccatccctttgctatcttggcacacgggtgatctcagttagactttgggaaggactttccaagtctttcgttgagaagtttcttggacaatttatatacttccaaggagaccatggtgtgggggtcagtttgctatttcttgcttttgtgtttagactgagccggctttgttcttctttgttctcgccttttcccctcgttgtctacacacttccctgacacagagcagtcgccccatggagcatggccccgaagccgaggggtggagtagaagccgtgttcggggcgatcgtgacatagtcttgaaaaaactcccatctgtcatctctggccttttactgttgtaacagcacttacggtcccagccaactgctgaggaatctgtctgtggtttaattagcctataactccaagcctcccccaccacacaagaaagcaataaacagcttccttcctcttagtggggctgggcagccatggcagggggagccatatgaggcttggggccagtgaggtcttaaagacaaatgaaggactcggggacctgcagggaaggactctacactcgtgcctcccttccctgctaaggtcatgagagaccagccagtgtgcttcaggggaaaataaccacaataatagaacaattccttgtatccatagagagctttccagacaccaagagctttcccagactctctttctaggtaccactcggaacctcagtttcttcttctgtgaaaagagggctttgggctcagtgattcctgaggtctcttctctatctggacccgctgtgggttccacaatcctaacaaaatccctgtgatgtgcctggagcgggtgtcattagcctcatcctatagttgagaatgggcctctcccgtggctaagcagtaaagaatctgcctgcaatgcaggaaatgtaggagatgcgggttcagcccctgggttgggaagatcccctggaggagggcatagcaacccactccagtattcttgcctggggaatcccatggacagaggaacctgttgggctattgtccatagggttgcaaagagttggacatgactgaagtggctgaacacgtagtcatgcatgcatcattgagagtaaccaggagcagagaagggaagcagttcactctagagtactcacagaaccctgccagggccaggcctggaactgcaggagataggaagagagaaagatggatcttgatatctgccttcttaactcaaggaggtgggaggtgggagggcagggtctgaggg

SEQ ID NO: 34099 - DNA, 1169 bp, Bovine  19866880628190
cacatacccacacctacatgcacacacaggtcattcgtgtctacccctgtactccccctggggtcacatgccttacccaggctggacactgcccaaggcccgcctctctgctccatcttgcccctccttccagcggagaatgggacaggggcgggggtcggccttcagaagcttccagggagagctgaggcaagccccctaggtgcctccaccctagcatctcaggccggcccttaaccacttcctacagcatggaagtttcttgagtttctccctacctatcaagtgctagcaactcttgattctcttggggagtccgagctgggatcccagaaaagagtgacctccgggagtggaggaggatccacgcagagggcactggagaagtcagcaagcacagttggagctctgccatcacgggctgatgagactctagagtgcagggagctcctcgcccacccaagagaaggacagcatgaggggaggcagggtcaaggatcctgagtcagccgttcctgcaaaccacccgccccgtcctgctcagttctccctggtcatcattctggatggggtggcgggggaaccctggagatgctttccctttgagttgtagattcccttcttgaatggggctctgggttcctgtcaatcacccaagaccgatggtcttcccatggacaccctggaggaaggcccctcccgggccccctcttcgttcccccggctcaaagtgcctcagtccctccatctgcccagcccatccccctcagcactctggatgggagagaccctgggatgggagaggcaggttcgtgtctgcccgcgaggattctggtgaactcagcccagggtgcagaggctctgtgggatggcaagtgttgaggggagggaggcagaccactctgtgccccacgggcaccaacctacccttgccataggcttcccaagggagcctccaatcccctctcctactcctcccctcctgggtgctgctattgaacccctagccagctccatctctgccctggcaaccctggacccaccagctgggtcacccttctcacccagcccctgctgccctagccctagtccagtccacccagtagccacgtagcagaagtctgaagccatgccagccctggggcggtgctcccctctctggcattggg

SEQ ID NO: 34100 - DNA, 3098 bp, Bovine  19866880635251
gtcttttccatgagttggctcttacatcaggtggccgagtattggagcttcatcatcagcatcaatccttccaatgactattcagggttgatttcctttaggactgactggtttgatttccttgcaatccaagggactctcaagggtctgaaactctagaggtggagtaatttcccatagttttcattgagcttgtctaaaataaaagaggaaaggccatctaactccaggggtccctactaaactgtacacactttagatgacaataactttaccagatgggtttcccttgaaagcagaggaggagagattgacatgtatcagcccacagcagcaactccctcacatcaaccagcacacatgttctgtctccactgcagtaacagcctgatggagacaggaggagtgcactgagtcggttcctcatgaagtgagtgggtattcttgaagcctgaaaaccaaggccatacagagccaaagccatgaaaatcttgcaaagggaacacttgagaggctcaaagaagtgtgtggaagtgagataaggtcaaaggcagtgggatgttagagattcatcaggcttaaaaaaaaggaggatacacaggacattgccagaaacagcgtccagcccactccattccctccccatgtccactgaaaatattgaaaatggtggaagattcagctgattaaaagagaagattaacagtgagaatgatgcctaaagagttcagctaaagcaaaaacaaaacaaaacaaaccagagccccacaagaaaacagattgggacttccctggtggtcctggggttaagaatctgcctgccaatgcaagggacactggttcgattcctggtccaggaagatcctacatgccgtggagcaactaagcccgtacactgcaactatagagcagctcccacttgcccaactacagaaaatccatgagcagcaatgaagacccagcacagtcaaaaatgaaactttttaagaaaaaaaaaaagttttgtaaaaggtagagccacactcatgctggacagaagagagagctttcccatgattgtaacttccagataaagttggactcgcaacaccttttgcaggaaggtgatacttagtgaaccagaagtgcctcaggaccagctaacctgggaccagagaacccatgcattaatatctaccaaggaaactccagctcccctggccaaaaagtgcctccaaaatctctccctgatgtgaaaagatcatgggtcatttggtctcaaacatcagtgccctcccctccccccacaggctctctcccatcaaagagccaatgaagctttatttcacatgtcagtattctgaaacacttgagaaatctctgtgccatccaaaagctggggcctgtggaacagtgagtgtttctactatagttcactgagaaatgttttcagaggtttttgacccaaagcaccaccacccatttagtgcttcaccttattctccagactttaatccaatgactttggggtatttccaaagatctagttcgccccaagataaatactcaccaacattcaaacccatatgccacagacttcccaacgagagctgtgaaggtgcgttgccggtgggacatgactggaatacatatcaaactttccaagaggattacattgaagggaacaatacccacttcaaagttctgactttgggagaaaaacaaactgaatctaatttttcttctcacagcggccactagcaatggatttgagtctttttttttttctttccagccatgtggtgtggcatgtggggtcttagttccccaaacagggattgaacccatgccccctgcagtggaagtccagagtcttacccactggaccacaaagcaagtccctctgagtccttccttatgttagttaattactaccttgagccctgaaggggtgagaagacaaggatggtttggtgactaggagtaagaaggcctgggctcaattctggctttatctttgatatcctgtgtgaccaaagacctgaacctgcttgaggctctggattttttcctttacaaaatggtacccataacgcctcctcaatgggcttgtaattctggccaaatgagatagaggatctagcacagtgttcggcacggcgtgcagtatgcatttattatgttagttgattctttggaaggaaggggtcgagcagccacaggtcctgaatgagtgcctgagagttgtcccgaagcctggagagaacaagggtggagatgggcattgaggagagagagaagagaggtgtgaatggggggagatgggcaggaaactgagagacaaacttacctacatgatgattttgtctaaggataggtcctaccacagggatacaggaaggggcagggtttcaacactcctcagattgactctcggacctaaactcagtaaatgaaagacaacaaaaagttcttagaaagatttctttattatcctagtgaaggattcaaatcgacaaatcgacttacattgcagccaaagagggcagttagataagacggagaacttgtctaactaaggatctagtggactagatcctcaggctgctgagagaggcttaggagcaggacaagcaattgttcagagacaagggaatggatgagatgaactagtgaggctctaactcttccatctctaaggttctgcaagttgaggtccctcttatgagcagctctcagtatcgggaggggactctgcaaagcccggggaaaacactggtgtggcaattgagtggtgagcagaacgctaatgagtgccaagaataacagtggcttcttaatggagcccttaatgaagactcatttctggttttattaacgtagagaaaaagcacacactctcccccgctctcagagagcagacagaataaagagcagctccaaacaggggggctgatcccatttcctggaccctgcttaggataccattataggctctgggaagtgggataggaaggtcaacctcagagttctgagatgttcctctgcactttggccaatctgtttagaccccaagaccccacacagtctcaggggggagatttccagctgcgctcagc

SEQ ID NO: 34101 - DNA, 1029 bp, Bovine  19866880664608
ctgacagcctcgtcccccaacacacccacctccttccacagtgccattctgccaggcccttcgtgaaggacagaagagaagaaggaagtgctggtggcaagacctccgccctgccaggcgccagacgaggggccaaggagcatgtgggcacaagcatgagctgctgcgccctccccccgcccccggcacgcctgctcagacagtccgccggcctccccggcctgccttggggagtgatgagtttatctccgcgagacagagaggtaggactgacggcagagatgactcgggctgaacttctccgtaagcaggctccccggggaagggctaggagagatgctatcgcccctgattgtcagtcagtcatcaggaacccaggcttcgtgaggccccctccctgctccccagctccccagagctcagcccagctgtcttggcagccgagggagctgtacatatcccaggggcacctggctccagagccctgaggacacaggaggcgaaagcctgaagacacaacacccaccctcaggaaaaggaaaaagaagccgggccagccttgctgctctgcctctcgatcctgaagcctgagcggagctctagggtttaaggagcttcagcagtttgagggtggaggacacgtctgggccagaggggacacgtctggccattcctgcgggagccccaggaggcctcgtctccaagtccgcacaccccaccacatgttgcctctcacgctggtggggactgtcagcttctcccctagaactccccctaccctacaactgcccactttacccatccatccaggcggccagggccgataggcacggcctctcaagccagcccagggtccagggcccctcctctggataaaggaaaatgggccagagagcaggagagttggggactgaggtttgtatctgcaggcagcccagctgatctcccagtggtgcgtctggccctgggctagcagcttagggatagtgcctggaggtggagatgaatgtaagtcaggcaggaaagggg

SEQ ID NO: 34102 - DNA, 2530 bp, Bovine  19866880666589
acacgaatttcctggtcagctcaatactgccaactgggaaagacctttcttgggctcagtggggtaagaccttgatttaatctcactcctctcccctcaccaccctcaccctcgcttctggtgctgatcacatcttgctggggtgagaaccacgctgttcgtggggcctggaccacttctttctagaaccaggtccagtttcttttctgacctccctcttcccatctcattcattcattttatggtgttcagcttactagcagcgtaaccttagagaaatgcgtgaacttctgaacctgtttgctctgtaaaacgagagcaatcatagttcccacttcagagattgtggtgtggaatcagaggttgtggtgtgaaagggcttggcacttagtaggtgcttgatcaacatcagtcctcctttctgccttccaggtgcttggggtttgaggggggaggggagcaggagagatgtgagctgtggtccctgccctcggggaagcttggggaagtaagttctaaaaatagttgcaccggaggccgccctaggtgtttttttagtgtcataggtgatgggaaagggagaaggtcatccgaggctggatgaacagtttggccgctggaagaacactttgcctctttaaccttggatacctctcatctgaactgttgcctcacccataaaagggagtggtcatgcctgccctgcccacctcccagggatgtcatgaggttcaaagcaaatcatggatgcaggggaatctgtaaccagtaaaatgcaatgggagagcttccttaaactccagggggaaaaggtgctgctggaaaagaaggggccttggcagctgactggagtgggggcggggaccaccgccgggaggaacaaagctgagagtgcatcctagggcagggccctgggtgagatctgactcctctgaggcagccctggccctgggctctctgggcagctgacctgaactacaggtcaaaagaagcaggaccaacggggggaatagaacagatctaaccagactcaatcctcctgttaatagtaacagcccacatgaacttggaatatcacagactcagctgagctgagtgaagaactggtggagggggacaagaattctgaacacctcccgtccatggctggcttgcttaagcaccaacaagatgccagtccacggagtgcgcactgtcagcctagggcagtgagggtgccctagaccccccttcagacagattgcaggggagttgtatgttggttcagaactggttttaaaaaataaaaataaaaaacccttcactacccacagtgggggcttcaagccagaccaggtgggttggccctgcagagagccaggggtccaagcccccagcttggccacatcccccctccactccacttctcttgttcccctgggcctatggaaggacaagctgttcccactgagccctaccagggctgcgctttaacccctacaatccatgctaatcctcagctccacccactccagctgctctctcccctgagccctggcagtgctgcctgccagcttcagccctgcgctcacccttcccagggcaccctctcctctccctgagaagagctgggagctggcccagggccctccagagcacaagtcacgggctgggcacctgctactcagatgcggagcccggcccagcctcttgccctcacacggcccccacacccttgccctctgccctgggacctgttgctaggagcagtcggcctgggcacctggactacctagatcctatttgcccctgggggggctgctgactcatctcacaaagcctcgggttccagctgttcagtgacagggagattatataagatgaggtcatgtgattttcctcttgggtgggactttggacttgactgctgtcaagcggtggggggaagggaggagttttagtctgaagtggaggacagcggcggctgtcctaggactcctgggtgagaagtgtgacctttccctctgtccccggccttctcactgtttattcagccacagtgaactgcatccctgctgtcctgtttgtccagcttggcagcctgagaccctggggcttgtccttacccacaaggccacctggaggagggcaaacttcctgagggcctgaagctgtgctcacggcctaggaaggtcacacagaggggtcccatggcaggactgatcctagctgctgagaaagaaagggcagtcgttttgtagtttgtggtcagaatcagcaagacgctaatgtctccaggcctcgaagaccggctatgggctgcgacctggctggtggccttggagccgccttatccaggctcattttctcaatcagtgcccagcaccatgctccctgcttcctcctccacccccactctgggatggatgtctctgtgagtgagttcaagtggcatgggggtgggctcagcaaggcaggagttaatccaagcctagcaaaatgttccctgcctgtgggagagccgctccactgaccatcctgctgcagaaat

SEQ ID NO: 34103 - DNA, 852 bp, Bovine  19866880709104
ctgggtaccttttctctcagccactggaactgaaggtcctggttgctctcggcctcacagttcagagtgaggctgctgccctcctggctctcaggggctgcggggctcacccggacatcagacacatctgggggtgcagcagtggggtcaggcagggcagggcagattggattccctcttgccccagcctggccccccctgtcctgggcccccagccccctcacagttcaccaccagctcctgttggtcactctgcagcgatgtcgtggtctccaagtccaggccctgacattcatagcggccactatgctccttctgggcgggatccaagaccaggaccccgttgtcatccgtcctctcttcctccatctccctggtgtggaggttctgggagaggacgaaggcatgatcagagcggacctccagccattcctgcatgcccgcctccacccagaacagagggttccgcacctgcttgatgatgctgaaggggggctgggggttgccatcagccaaacacctgatttccacacggtccccctccttcagcatcccctcaggctccacttccaaccacactctctcggccgggtctgcacaggcaaaggggacagtcctcagcccaagagcggcctctgcgccagcagggcagaagcttgcaggactcagccccactgtgaagagtcggtactcacagaaaacagggacggtgacctccttagattccttcatgtggttcccgctgggcagccggtagctgagctcacagtaaaactgggcatctttgtcctccttggacacctgtgcctgcagaacgctgcgcaaggtaaacagaccattcgactcctccgt

SEQ ID NO: 34104 - DNA, 896 bp, Bovine  19866880713961
gggaccaagggcttgaatgatccttttccactgttacttgttggatgatcttgggcaagcccctttatttcactgagcctcagtttcctcatctataaaatgggggcaagaataagacttatcacactgattgctgtgagggttaaatagagctgtgtttgaaaagtctcagcaaagtgcctggcacacagtcgtgttcatcactgtccctaggcccccttgttggaactggcagggccaggcagtgcagcctggacatgggagtgtgggcaccctcacgtgggaagaggttgtccagccacagtctaaggaacggactttgcatccactgtgagttttagcttacttggaagcctctagattgactgaggaatgacaaatggctgtggtcttcttaccccctgcatggaattggaaggtgggggccaagttggtcgtctgggctgagcacccgggataggaacgctgcctcccaggggcaaggtttggcatcttgagatgcattctctttggcccttccagccgagagggagcgtggtgaggctgtggagacaaaggcctggctctccccccagtgccaggcgagggtgtgttatctttgggcccaggcggtctgccccgggtctgtgggctggcactctaacgggtaccaccccggcccccaagtctgctgaaaggagtgggctctgggcagaggtggcaggcattcaagtggacgctggcccttggagcggctcggagcagggccaggaggaggggctgcggctggctttctggtggtcactggcaggtccagggactggggtgcagggtacagagctggggggcgggcagggctgtgggagggagagctgagcaccaggctgggctgtgtcctcactggaggcgccaccctc

SEQ ID NO: 34105 - DNA, 960 bp, Bovine  19866880716295
cgctgagctattttgcagtttgtactggctctgggcttcaagcttctgcctctgcaaaataagtaagttggatcaggtgacctcccagggccatcctgttctgatacatgactctgagaaagaaagcgatactctcatccagatcaccaagtaatttttcctggcagcagattatgtctcaagaggggaggacacagtaagacatgtaaacagaaaattttggtttctataaataggaggaacttttaaccttaatgacagccagtttaacacatacaaagtattcagtactactcctgggctaaactcctttcttcttcctgcccactctccaggtagcagtactgtcccacaggcccatacgtttgggtaaacaatccaccaagacaaaaccatgtctcagattcagtggtcccctctgtctgactcagaacagtgaccttgctgtacctcagtttctctttcatccccggcattctacaggccttacccctttcctcctggtgtcaaaactgtgacttatcctctcaaatgccctccggggtcctccaataggagttggcaggatgagtagcaagaattattattaattagtgaaaatatgtatcatcacataattggagtgtataattgatgcttcactgctgcaggcagaaatagagggagagatagatgaaagccagggaagaaggaggccaccatagatcccagccactgtctagaatgagaaatagggaggatttggcgctcctgatacccgcaaaatgtggactgaccaaaggtcatgagctggggcggggggtgcctaacaatcaaaaaagcaggggacaaacaagcccttagtgttagcaggggatgtaaatagagctgcttcccccaaggagatcattttaaacccacattctgagcctgctggtgtgtgtgtgtgtgtgtgtgtgttttacagcagcatcagatttc

SEQ ID NO: 34106 - DNA, 861 bp, Bovine  19866880727507
cacagattaactgagagaaggaagtggaggcccagggtctctggtttgaaggaatcattaaggccccttctctttgcttgtgttttcatgccctttccaagagattagaaaccttgatggagcagttccatgctgtttattattatttgaaataggctggaaagcaatcagaattggattttcttgaagggagggtggtgaaagagacaaattaagccttcacccctactccgagggttgggtttgtaggaaaaagagaatgggctggacttgggggggggtcccttccaggggggatccctccctcttcttggacaccagcaactgagggaagacggtccttcctgctgctgagggaacaatgaggggctggtagccgaggtgggctgggacctagcaagactcacagccttctccacagggagtcaccagagccgctggccctcctcacggtgggatctagttcccaaggagggtgccaggcagaccttctgcccctgcaaaaacaaagctgcctaattgccttttaatctggggatgtcggtctgctggtgtcggtactgaattgtaaggggagatagtatctttccctttgagtgagaagttatttgatctctgcgtcagaggaaggcctgtgcccagggaagaggtgggacggaagggaaggtggaaggagagagaagagtgagggcctggctcccggccgacctgaggctttatttctccccataacaatcataaataaagggaaacaagcatcgctcttgtcttggctgaaggccattgtttggtgcaggcttcctcctcacccctgcccctcctggcctccgtttcaggcccaggaaggggaagacagcttgt

SEQ ID NO: 34107 - DNA, 1751 bp, Bovine  19866880735067
acccggccccgggcctggcccgatcccttccgttcccggtgttctctcgatctgacccattgcccggccgtggtacgccaccagcaggcctccaaagctgagatttttcctccagcccgggatcacttcgactttagagatgtttggcttctttcttcccaaacagaccgccttcaaaaccggcagtcctggaccagcacctggccccctttccctcccgagactccacttcttctaacccagtttttcctcagtttctctctgattggagagacggttcacttcccttccagattaatccctgagcccccttccccccaaatattgacaaccctggcacccccctcagccgggagccagacttctctgggaccaaccccatagccctatcatggaggctgtgtacttggtagtgaatggggtgggcctgttgctggatgtgctgaccttggtgttggacctcaacttcctgctggtgtcctccctcctggcttccttggcctggctcctggccttcatctacaacctgccacacacggtactgactagtcttctgcacttgggccgtggagtcttactttcactgctggccttgattgaagctatggtccgcttcacctgtgggggcttgcaggccttgtctacggtactgtacagctgctcttctggcctggagagtctaaagctcctggggcatctggcctcccatggggcgcttaggagccgggagatcctccaccgaggtgtcctcaatatggtctccaatggccatgctttgctgcgtcagatctgtgacgtctgtgccatcaccatgagcctggtggcctacgtgatcaatagcctggtcaacatctgcctcattggcactcagaacttcttctcccttgtgctggccctgtgggatgcagtgatgggaccactgtggaggatgacagatgtagtggctgccttcctagcccacatttccagcagtgctgtggccatgtccattcttctctggaccccctgccagctagtgctggagctcttggcctcagctgcccgcctcctgggcagctttgtgcttgtcaatctcactggcctggtgctgctggcttgcgtgctggcagtgacagtgactctgttgcacccagacctcaccctgaggctggccacccgggcgctcagtcagctccatgcccggccatcctaccaccgggctcagagaggatgttgtgaggctctctcggctagttctgggcttggaggcctggcgccgagtctggagccgtagcctgcagctggcgagctggccaaaccggggaggggcccctggagccccgcagggtggccctaggaggctgccctcagccaggacatggcgacaggatgctcttcctgaagctgggccccgatcggaggcagaagaagaggaggtcaggatggccagagtaacggctgcccggggccgggagaggctcaacgaggaggagtctgtagctgggcaggacccgtggaaattgctgaaggagcaggaggagcggaagaagtgtgtcatctgccaggaccagagcaagacagtgctgcttctgccttgtcggcacctgtgcctgtgccaggcctgcactgagatcctgatgcgccaccccgtctaccaccgcaactgcccactgtgccgtcggggcatcctgcagaccctcaatgtctacctctgaaggtttcctccctccctcctgcccacccctccatgctccacgcagccacctgcgctc

SEQ ID NO: 34108 - DNA, 1503 bp, Bovine  19866880738986
ctttctcgtttactttttctgccttctagtttctcctccatccttagcgtgcacatatttgtatacacacattcatcacagcaacacaggtatgtgggctggtgtgacagcaagggcgtgtgcccgcacacgtgctctcctgtgtatacttgtcatctttgctactcacgtgctctcacgccccctttctgcacggtcatgctgtgtcttctgctcgtagcccacgttggctgcacccccggcccccaccttgccctgaagggccagaccgcagccaagaaccacagcccaggtttctggcacacacagggcatctacagggccagcactggggctcccatcctcctctctgtaccctgggagcagacgaagtcaggcgtggggcacccggtctgctctaggctcggcgtctcagaagccaaggtgtggtactagggcacagtgaccggcaggtgtcaggcagaggggcagtggtgacctccgcacaggctttccgtgcaagagaaccaacaatgtgtcattggctggtggcctcgggaaaattacttaatctctgtaatccctgtctcgtcgtatgccggatggaaatgaatagcataccactgtatggggtgtcagggacactgagtgtcatgcgactggcatggacaccgggtcgtggctggactggctccaccttcaaggagaaagtcagtgtggaggctctggggccacgggactgtctcttcctctgtcttctccagctccagctaccagcgccgcttgctggtctcctggatttgggggagggggttgccaggggcacctctagaacaagagctggccttgggctcacttcctgccttcgcctccccatctccctctcgtcttccttccctgccacccctgctgactcagccaccggagcagacactgacactgtccccctccttctcttttcctcacccagagttcccctacaccccgtctcctcccgaacacgggcggcgcgcggggccagtgcccacggccatcattgggggcgtggtggggagcatcctgctggtgctgattgtggtcggcgggatcgtggtggccctgcgccggcgccggcacaccttcaagggcgactacagcaccaagaagcatgtgtacggcaacggctacagcaaggcgggcatcccccagcaccacccgcccatggcccagaacctgcagtacccggaggactcggacgacgacaagaaagccggccccctgggtgggagcagctacgaggaggaagaggacgaggagggtggagggggcgagcgcaaggtgggcggcccccactccaagtacgacgaggacgccaagcggccctacttcaccgtggacgaggccgaggcccgtcaggacggctacggggaccggactctgggctaccagtacgaccctgagcagctggacttggccgagaacatggtctctcagaacgacgggtctttcatttccaagaaggagtggtacggtgtagacccctgt

SEQ ID NO: 34109 - DNA, 1071 bp, Bovine  19866880750988
acaggaggcagtcatgccatcggggggcccacccctgaaacatcctctggaccctcagccagaggggtgggggagagtttcttcatcagaggaaaggccaccgcagcgggaggggagaggaggtgaaaggtttctgggacaagccactccaacgagctttggcagttttgaaggtcactttttttccccttccaccaaagaatttaattaggcttctataaagcagttagatttaggagcggaacatttttagctcccctgctaggagtgctcatgaatattaaagaccgaggaaggaggcaggagctgggccggcttgcaccctacccggaatccctggggactgtggcacgtgggcacaggagaaagggcagctgggttcctttggcgatggtggaggggggcatttcctgcacagcccccagcagccccgtatcattaagagttgaagtcatcacttcttccactcagccaggacccaggctggagtgtcctggagttcagtgctagcctgatgacacggatgacagcagaggggtgcaggccttggaaagggcactgaggacccactccccaggccaccctctagggctcttactgcccctgagaggagggccagttccctggggccagcttcaaggctttcctacagcaaaggtcagccacttccccatccagagcatgactgggtcatgtcagagagcaggggctgatcaagtagctgtgtgctcagcctgcacggggcatgagacagacctgcatccggcctgcagaggtttccagtggagccaggagaccagatgggctctccagagctgtctaagagagcaagtggacgagtccagctgtgctcagtgagagcattcttagttccgtggactacgggtgggtggggggggggggggcaccggggcaccggcccagccagctctcccattacagtgaggagtcccttccagctcctctgtggatgtcagccagaccccaccttctgacacgtttccacagtgtgccgagctctccagacaggtttcagtcccaatgtcacccaggagccccactcacagggcc

SEQ ID NO: 34110 - DNA, 1933 bp, Bovine  19866880752928
ctttgggaaaacagatgaaagtggctgtggtcgcgcttaaaagctgtgcagtaacctagcatgttaatggaatcttatcaatgtgttcctttgccatcttcatagactctcctgggtaggaagacagatgcagcagggaaaaaggtccttgggtcaggtcatacttggtcccttctcctgccttttcagagccaaggctcttaaaataagctcctctgttccagggaagagagttcccagtggttgtctctgagtgattccttggcctccctccccagcccccactgtccccttgggtcaagcttccttgcgtttggtcctcttctactggaaccagacagatttaggttcagatcccgaatcgatcatttgctcactgtgtgatcttgggaaaataacttgccctctctgaacctgactttaggattgtaaacttgatgtcagaaggttgctgtgagcatcagatgagactggatagtaagctgcatggcatagagcagctgctcaataaatgtcaccttttttttctgacagttctgccaccgttaatgagatccttccagctattgctcatgtttctcaaaagtccagggaactttgtctgagagaccttccacaattcactccctgaaatgactgtcatcctctcagaatccccccggggaattaaggggcccatttgcaggtgctgttgtgtggttggagatagagtcaggctccatcaatttcttgctgtatgactttgggcgattgatttaagccatttgtgtctcattgtcctctcctgttaaagaggcaagataatatctaccttacaatgatgttgtgcgaagtaaacgagaaataacatgtgttaagcactttgtataatgtggggcgcccagcagtcactcagcgatgcaccctgctgtcttttcatgggtgtgtggatgtggtgtggactgctccttatcaggttgggtccttcctggaggggactgcctcctctttgtcctctctgtcctctttccctgagcaccaatcagagacagtccccatcctagaaggctccgctattggagaagtgcccccttcattccccttataggttcttaggccattcatctcacaaacttggtaactgttggcgcctgggttgcagtgtggccagaatagccgtggagtcacttggggatgaatttcacccctctgttgagatttcccatttgagtttagggtgtcaaagatctattaatataaaatacggatctcctagtttatttcacaatgagctttttttaaaaaaaagatttattttatgtatttattttattttttgcctgcggtgggtcttcgttgctgcgcatgggctttctttagttgaggcgagtgggagctactcttcatttgtggtgcttgggcttctcattgtggtggcttctcttgctgtgaagcacaagccgtatgtatatgggcttcagtagctgtgatgcatgggctcagttgccccatggcatatgggatcctctcagaccagggattgaaccggtgtctcttgcactgcaagatggattcttaaccactggaccacccaaagaacttttgaggctctaaatgatttgagtacagccattcctgagttgtatcctggttagcatttggtcactggagacaactcaaaatcttagccacaagtgcccctgaggtacagccttgcacatgccagttcagccccagggatggtcagtcagctgggttatagagccctgagagagggaggtcagtaggggcagaggctggtgtcaagggggagcatttccaggaatgtcctggattatggcttagatgcaactggctgtttgattttttgagtttgtaatttctctgggcctcagatgttcacaaagcaaaaaattagactagatgaactccaaggtcatccacaagttttaaa

SEQ ID NO: 34111 - DNA, 865 bp, Bovine  19866880785136
tggccctggctgagccctctataatgacttaatcttgccgacagggtgacaagcggatgaatcgaactccgaggcttttttctccactccagattcatttgaagatttctcccagatgcggcactaaaaccctagattcaatttccctttgacataataaccgaattagtctcatattgtcatacataaattactagccagtcagggtgccaccagagggagagagagctggagagaaagccaggcacgagcatccaaaggggtgtgactgtgacaagtggggacctgaataacaatggggacaggagggtaagagctaatcacatctgacaaacgaggagcatccccaggcggcagcaaaggtacagattatttaccttcctccccatgcccctggccattaaaatgtcaccatggggagcctcgcaccttacaagagatacacggatctaaatatcttctccattaagtaatgctctgtttgcaaaggctgctttcaaaggggaaaatgtaattgtgtggaacactgatgcagcttcccaggcttcaagacggagctgagcccggcagaggacctgtctgaggcccagtttggggcacagatgccaatcctgggcccaggggggctcagcctggcttattctgagcacagaggcggcctcccagccttccccatgtgggtcctggggccatgagtgagaccagatcgaagccagctggaatgaggcttcctcacctgcccaccagccactgggccccaggccagggccctggggacgctctttaagccttcccctccatttcccctggcccatctgttcatactgctcaattctcctaaaagctctggcctctggcctcactg

SEQ ID NO: 34112 - DNA, 1664 bp, Bovine  19866880832601
acccgcaaaaggccttcccactggcctgtgggacagtgcctgagatgtaccaagaaagggtttcctttcgaggcagccctgtgtctaggaaaacctgtttaggacagaaatgctctaaggaaaggtgacccacagtcagcatctcagaacatgcaggactttttcagggaggtgtgaagcccacatcatttgtgagtcagaggaaaagagaccttgggcagaagcggagaggggcatggagcccctgtctggctgtcactgcccagcaaacaaagttggattgctttctgcctacatccgtgccctggccgggtcacagcaaccctgggtggggtggggtgacacagcctttggtgagcactcggcctgtcctgtgaccccagctgggacaccagctgtcagagccatttgtctcccagtctccactcccaggggccccggggcagctcccacattatttaaagagcggtggaggccctgggctgtagagcgctccaaaccagtccatgtttccctgggaggggatttgggtggaacataaataagacaatttattcagagaaaccatctcccctatttacatttaaattgaataatttaaaacacctttacccatttccataaattatcccctgttggacgggcagttcagctgcatggagggggtgccgtcctggggaaagacctaattacattcactgctacaggcctggggtgggagggggagcgtgggaggtggggaggggccgcagcgcccgggatgagggtgggggcgctcccagaggaggaagacatttgtcttagaattggcaggaagaaagagggagctactaagaaggtgcggtccatttaagagccttacaactgagaggtagagggcaaaaaataaaatcctgctcttatcacaggggcaaggcattggaaccaatccctggcctcctagccaagagtatcacccaagtttgactgggtcaacggtcctatatttacatcttctggagacctgagctcttggtgccagggaagaaggggaagagaaagaaagaatggggcttcttctgtgattcgttacttctgagtatttcccaggcacctgctctttccaggctctgtgctgaggacacggggatgactggcccagccctgccctccagggctcccggggtgggtgagaagaactcctttcacacaggctgtgtgtgctcagagcagatgagtgggcatggcaagacccaccggagggggaggagtgaggagctgttccaggcagtccctgggttcacaggggaggtggctcttgaggaccctcaaaggctgagttgactcaggggggtgctgaggatgagagaaggcatcaccaagaagggaccagtgtgagaaaaggctcagaggtgacaaggtcttgccagctcctctcctctccgtcagggagggggcactctggacagaggggagccccagagcactcaacgtgctccacagttggaggcaaagtgaccagtaaagtgtatggagcagggagcagagaggggtgggcttaggggaggcgggggacaagccctttgatgcttatgacatccctaggaggcaggcacgattagctctgtttaagaggtgaggaaacgggagctctaagctccaagctggggaaatcaggatttgaa

SEQ ID NO: 34113 - DNA, 3865 bp, Bovine  19866880878089
tttgtttctgtaccatgaagctaaagtcgaaggccagttcttcatgaagagttggtccttggttgtaaattgccaggtgagacctttagcctatgctggctgagacaaacaaatttccttgtcatcttcctagacaaattaatgacttgggctacccctttctctggtgggaatgtaacatttgaacatcaaggcaaagatctcagttccaacacttttcctcagaaggctcagagcctgggtcttgggcctcatgtgagccctaaccccatgggcttgcagtggcaaagaggttcccagacttagggaatgaacctatggttgccgaggggaaggatgaggggaagggatagttagggagtttgggatgggcatatacacacactgctatatttcaaatggatagccaacaaggacttattatatagcacatgcaactctgcttagcgttatgtggcaacttggatgggagaggatcttgggagagaatggatacatgtgtatgtaaacagcaaacagtccctttgctgttcacctgaaattatcacaacattgttaattgcctataccctaatataaaattaaaagttaaattaaaaataatgcaaatacaaacaccagcacagtcatcaaatgctaagtagacaaaacaaaaaaacatgcagtggctacagcgtcactccagtgcttcctgctatagggtctttgtgtctggcttgagggtgaatgttctttcttaaaggtcagttaggcacttaaagaatatttgcctttctaggtctttgtcctgggtgtgcattctggccatataggccactgcactgctgagctgcaagtcctgcctcttcttcctcagccctgaatgccaccgtgacccgcctattacatccttctctccagcacatggggcctgggatctgtggttgagtccttcctggcccattcctgagcccaagtgccctctggttcttgtgcctgtggggcttcatggtgaacaaccaggcttcctgccaatcctcctgcagaccccaaatattaggctttctccaccagtcacccctcctgtgtctgccctctgtcttaacagaaatcagacaatgtcctttacatgccactgtctcctcccctattctttgggttcttgtgactgtatgtctttcttttcttttttctttcttttatttttttcatttcatcagggttttagaaaggagagagagaaacacatgttcaatgctccacacttagcaggaagttcaaagagtaacttatcttcatgtttctttaattacaagtgaggttgtactttctaatgagtccattcgaattaatttattattattattattaattgcactgcagggcttgtggaatcttagtttcccaacaaaggattgaagttgggccctcggtagtgagagcttgaagtcccaaccactgaactgccaggcagttccctaacaagtccatttttcacaacttcgttgtcattactgttcacatcctttacctgttctgtttgttctcctcacctgctcccaccccatcctgggtctcagaatattcccttcaattcatatatcaattatttatagtagaatattaacgcttggcctgaaaggttggaagcaaatatttttcttcagtcttcactttttataaaggcattttattggtttgttatttacataaactcttaattgtatgtaatttaatctggcaggttttacctttttctgtttctcctattgctcctgcattgattgggagagtggaaatgttcccaagagacttgctggctactattgctgtttggttctatggggagagaaggccgtgatgggaagcagagagaatgaaataggagaatttcattagagttgtcatttgaccccggttatctgtcagtacacagataattgagaactgactccaagtgaaattgataaactgaccttcttaattacatgccaatgtaccctatcattcaccatgggcaggaaagcaatttccaggttcggtttatgccatgtgctcatccaccctcttccttgagactttgcacttttgtgacctgcccttccagcgagttccctttaagaccttcttgcctcctgatgccaaaagtgctgaaagataacaacatccagtctttattgctgcctgagttcctgtgcccccagctagtgcgtaaagaggaagcagcatatatctcaagcgcctctgatggtagctggcatgatgcttgataacagaatttctcagacaacaggcccaggctggggaattttaatattgtctttccctacaagtaatttccaatgtttatgctctgtggagccccttttgagtgtcagagcagaacaaatgccagttttaatggacttgctaaatcataaaaactgcttgcgaaattgcatctgattaaaacaggaaaatgttccattattcagaaaaatctccctgcagaggctcacggaggctgttggaggtgcagaaatgcagggagcgcccagatcctgtggagttttttctccatggaaaagatgtggctccatttatgttcttttctctcccccaagtcccccattcttctgccttccctgatgaaagggaaattgacatgagttatttcaaaattaatttatgcaacaacatattattagcaggggcagagcacgcatgacaaggtacagccacagaagagacggtgggggtggggtggaggcatactctgaaacctctgagttgcctctgagttgtctgagcacctccacagagcaaagaccaaccgatacagcaaaagccaaaagggtgctctgttaagctggacgaggctctcctggctaacaacaaaatataaaatagaatttagttatcccatagatataagttgggcttccccagtggctcagtgataaagaatctgcctacaatgaaggagatacaggagacatgggttcgatccttggatagggaagatcctctggaagaggaaatgacaactcactccagtattcttgcctggagaatcccatggacagaggagcctggtgagatacagtccatagggtcccaaagagttggacacaactgagcaactgagtatgccccgacataagtcacccactagagagccgtttctagggaattgtcagtggagtctggtttggggatttaacctacagccagttagacaggcagatggctagaccaatatcaccagcaagtactctttgtttgcagagaattgtccctaagtctggagagatagcaaagggaagcactgcccagttccagccccagctaatggtgggggcagggtgggggcaactgtagcctcatgaatgagccaccctgacaccacatggagcagaagagctgcccagcagagcccagctatcccaggaattgctgaaaacaatgtcatggttttttcctgcactggactgaataactgagacatcagtcggttccagcctctcccctgggaccctgacattggaaggacctgcccaagttgccttcttggcactgataactgaatgacaccaatcaggatggcatctacagtgacttggctgtcactcattgtgtcctggtctacctggagtgatcctgctctctatctgggactttccttgtcttgccccttcctcctttgtgtcctgtctcccacctcaaagactgggcactgttcccttcaccttctcttcagacttagggacatgctgaatgggctttccagatgttgctagaggtctactgggcagctcttctgctccacgtggtgtcagatggctcattcatatgtctgcaatttgctggggctggaacattcaaaaggcttcactgccacatactg

SEQ ID NO: 34114 - DNA, 872 bp, Bovine  19866880882348
gcacatgaagacttcagcatgaagggttctccgtgctcagcagacccttcacccacagctgcactggatctgcctgtgatggggaagcaccatcatgaccctgggaagggtgctgatcatacataccatcagcttatcccacaggcagtggacaggctttctatctaacatggctcttccattttcatcaaggacaaaaatgaaaaggaaaaaaggttcaggcagaattcaggcagaacttctaggttcagaccagcaggagtctcaggaatcacttctctgtagaccttaaagaagagagactcctgtctaggtgggctggctcagatattaacctgctcagaggcaggggaataatagagatgaccctttctaacctcattgttaaagagttccctgtgccccaggtccacctgtttccaggctcccaacagcccaagtgccattaagtctctcggaataaaaatctgacttcagaatcaattgatggagaaaggttctccaaacattcgtcagcgaaggtaattaaattccgataggagaagatggagcggtgtgacagggcggtgggggcagcatgctggcgccaggctgctgagcagtgaaatcgcaggcgtgcgcagcccaaagctggcagcagcacaaaggaaattggagcagtcaaatatttccctcctcgttgagttccatttacatgtttataatagaggttcttaaggccctaatgagaaggctgctcattgcagggaagaggatgattaaggctctgccagacgtgatcagggacaggaacaaaggcctgttaattactacagaaggacaggaggggagccaggctcggctcgcagctccccaaggcctccccaggctgg

SEQ ID NO: 34115 - DNA, 1741 bp, Bovine  19866880909212
cacaaaccaaggatggtaccgggcatctccctctccatgggttcagtttctcttcaaagaagaatgaaatgtgcttggttccacgtcaagcctttgctcaggcccttctctctgcctggaactcccctgcctcttccctgcacgagaccccctcccttctctacctgcaagccctgctcaggtgtgcttcctccaggatacccaagcccacggaacccccatcgctcacgtaatcacccagcactcaatgtcaggaggcgcaggctgcaatcctaacgttaagctcggtggccttggcgatcacttctgccctcagctcctgcacctgtgtgcttcattagcacaacccagacgttttgtaaacagttcaaatgccagggacccctcttaagattctgattcagaagatccacggtggggtatctacatttttcaaagtacctaggcttccattcaacaaatatttattggatgtctattattgaaagcttagagtagacactggagccagacatcagggttcaaactctggctcagtacacctgcgtgacctcagaaggttgatggaggcttcggtacctatttagcatcactaccacttgtcatacgatgtactttctgtggctggagagaggagtgagcatgatgtggaaggatctgcatgcgcgaggcacaccctctgtgtgctgcagtggccaagaactgccaggctggatggcctctggggtcctgccacacaaagatcctgtacctttaagatgctctctataagagccttttgtctgtttcctggcgtccccaaaccccgtgctcctctagggcagagccaagctccttcaccctctggaccatcaccctgtccccaggagagggccctgcacaggaggtgtggcccaacagacctcatgttgtttgaccagagagtcctaggtactcacctgttcccaatccacctccgccggccttcaactctgggtattgtgcaagacaggcaggaaagcggacagtggccatcccaataccagcccttgagttagcactgatggtggtgcaggggctgaaaagcagctatgattgcaaattgatctgttgtgcactgagctggttactgagaagagagaaagcaagttgtcaatactgcgttacccactggggtccagagctgctcccttgggctacccagaggagagacagagggaggaaaagagagctgtttccattttactggggtccttgtggggtcttagggagttgggtgggggcccagcttgagtcccatccagctcagagccagtcctgggctctctttttcatcttccctcctccagaaccaggagcttccctggtggctcagactgtaaagaatctgcctgcaatgcaagagatgcaggtttgatccctgggtcaggaagatcccctggagaaggggatgacaacccactccagtattctggcctggggaatcccatggatggaggaagctggaggaccacagtccatggtgtggcagagagttggacacaactgagcagctaacattttcagtttctttcacttcctccagtaccagcttggagttccatgtggaacagaggagctaaaatagataattcagaaagttatttccatttggtttgtaatttgtgtggtttgccatgggtctgggatcaaaggacagaccactcgcctttattcagcagctcgggtcaagtgtttgcatttctccagcgtcaccagtgca

SEQ ID NO: 34116 - DNA, 941 bp, Bovine  19866881019357
ggccctggaaggggtcccccttcctgcaacactactatggcatctccagaaccacagaatgaccaaacggagtggaagagaaaccccccaccccagtccctgtgtttccttgacgaaaaggccaaggtcaagggactaaccccgggtcacacaattgttagcagaaatgccaatgtctggctctcctcccacccctcacactccttccataactgttgtctcagcagctgtgctcttgggtgctgggccctgaactcaaaccctggtgtgactcaggggtgcccgtggacaccccccacccccacaatccctgcactgagaggccttcccggtgagttcaagataggcatagagggctgccacagccacaaccctcctccccggggctccccaccctgggctgggcggggctctggcccctgctgcgccctgacagctcttggtgctgccaaagaaggtgattgccatgtttgcagctcctttccttgtttggaaagatgtggaggcaggtgaggctggagagaaagcaggactgacaggttgtgatcagtctctgctccagagcagagtctcgcgaaggctggctggctgtggggccggtcactgcctccgcgcccggcatcctaacgccgccctccaggacaccgtgcaggcctcctcttcccgatccttcaggcccccacagcccccaaacccctgccttggtccgctggtcctccctctgcctcggacagacccctcagcaaacccgcaccgccagccagtagccctcccccgcaggccttcctttctgaagtccgactcaaatctccggctctggcacaacgccttgtcttcgtaagaaggaacattatgcagtcgtgctggttcccttcccctcactcggagggacccatctagacatcagtcacgtgggatttttctcgcgccagacaaggcaa

SEQ ID NO: 34117 - DNA, 678 bp, Bovine  19866881024190
aagattgaccttctgcattctccagtggcggctggggggcagtgcaaaacgctgcctcagcagtcatcatctttgattgcctgcccttccccccttcttcccctcaccctcaggatccagattctgcccttctcccaacagggagctagatgagagccccccacctccacgggggagaagatggctattagaggctgatcgggagcagacacacacacacacacacacacacacacacacacacacacacacaaagcacatgacctcatgtgcgggcacacgcacacacacaagccataaacctctcatacacacacagaagacataaaaacacttgtaaagaaacacagaaaccagcacaaattatcattacgtgcaaactgtgtacacaagtgccgagggggcaggagtaatggtgtgatggagacaggagaggataatggagctctttcctagcaagggtgtttctacgcagagctggggtgtatgtgtgtgtggaggggtgacctgcagagaagctccctggtggcattgtctgtcccctgtcccaagctcccaggagggaaggggagccaccaacacccttcccagttatcccacagcagtgctgagaggtgggggccaaacggtgttgccttccctcctcccatgactaacaccacccacccacccccactc

SEQ ID NO: 34118 - DNA, 1351 bp, Bovine  19866881070110
cctcatgcagtgcctgcctctctcagcccggttgggtaggggggccaagccagtgcactccagggcccaggcacttagccctttgtggggagaagacagtgagggtggccttactgatggggcccctggggctcccctagtgcttcctgcctcctgacatgtactcatccatcatagcatttggttctcttagcaatctgtgagctacagaggactggattatccaccccgtttatcagacgagggagctgaggcccagaaaggtgaagaagctggtggcgcctcagctggtcctctgcccaaaaagcagcacattcaaccctcatcaaaaataagggtgcggagggatatttactgccatggagcaacattgataatatatcactcagtgaaaatacagcttaaggaatagtatgtacagtatgactctgattttgtttaaaaaaaaaacatggttaccaagatatatggagaagaatgtaaaagaggttgtgcgtgcatgctaagtcactttagtcgtgtctgactctgcagcactatggactatagcccgccaggcttctctgtctatgggattctccaggcaagcatactggagtgtgttgccattatcttctccaggggattttcccaacccaggatctaacccgcatctcttctgtgtcctgcactgaccagcgggttctttcaccactagcgccgcctgaaaagcccgaacaagaggttacttcccgtcaggtgatcagtgatacgtccgagtggtgaaatcatcggttgtcattttcttctcaggatttttcaatatcccccacagttcttctaaaaacagataattattatttttatagtcagaatttgtaaaataatgactgctggaaaataaaagaccagcacacagggagtcagggtaggggctctggctgaccctgaccaccctctgccctctctctcgaccaggcgcccaggcccagatggtccaggtgaacgactccatgtacggtttcatcggcacggacgtggtgcttcactgcagcttcgccaacccgctgccgggcgtgaagatcacccaggtcacatggcagaaagccaccaatggctccaagcagaacgtggccatctacaacccagccatgggcggtctcggtgctggccccataccgcgagcgcggtgggagttcctgcggccctccttcacagatggtaccatccgcctctcccgcctggagctggaggacgagggcgtctacatctgcgagtttgccaccttccctgcgggcaacagagagagccagctcaatctcactgtgatggggtaagctgaccctgaccgtgcctctctgcttgggcacgt

SEQ ID NO: 34119 - DNA, 1014 bp, Bovine  19866881114986
catcactgagggatcctatctcttgatagagatgaccagggtgtttttacagcccacccttccttatccatcagcagctcctcccactcaatgggttgacatgaaccatcattccacgtttgggaaactctgtgggtccaaaagttccaggggagtcagggtgtgtccactgaaacctcagccggaaccaagcatcattcagaaagtgaactgatgagctgtttatgtaaccaggttcaagagcaagagcccaggcccaggcctgccgcctccaggccgcaccagttgcggggagaccctgggcgctgctcaccttgatgcggtccttctccttctgccacttctcagcttcatcttctatctcaatgatcttgagctgcaactgctccttttgcagtgacagctctgtctgtagggaaggagccggggttggaggagaagtcagggggaggaagtggaaaagacccagagagtcagggaggagggcccacaaatcatcactctgcccttcattcaaccaacactcactgggcccttgaatatgccaggcactgtgccagtcaccaaggatccagcaacaagtcaagcgccacctcattgtaaactctggactctgaggctgggcaacccagccatgtctttgtaaggcggaccctctaccaggccctccacccaacgtgagcaggaaggaagctcattagggggttcccgctcctttcaatggacctggagccatcggagagcagcttataggagaaaggggacccagcccagctcagcccagcccagcccagcccagggagcgtcccatggcagtaagagggtacagcatttctatgacatgacatgaggcttgtgttgcaagcaggagtctgggttgccgccagcggggagtctgtctgggcaggcacagctataaacctgtttatgggaaatggagcgcagtttgcagtctgggcaagattgagactttattcaagtccctgggggaggagagaggccaggagcaaggca

SEQ ID NO: 34120 - DNA, 807 bp, Bovine  19866881144264
ttgcctgggtgctccgagatggcctctgaggctgacctggaccattgtgctcagaagtgtagacacagggcctccaggccttgggcccagctcacaggatggcagtggggaccaccacagcttccctgaggccagagtgatgtctctggcaggcccattgcgaaggctcgggctcagtggagaaggaggatatagaagcttattagtttaagcaggatgaaatgtgtaaattaattaccccagccacccgtgtatgtagcagccagcccctcgcactgggaggagacgcatcagccttcatccttctctcagattgccttttctgctagatactgttgaaggacctgtggctgcacacccactcagggtgggaagggtccaggcccatcccgtgcccaggaacctcagtgggtggtattgagggatgggcaggccctcctgcggaatggtgaggttgaattctgccaccaccagcagtgaaatcagtgtcagcaaaggacagcaaaggcctgccgcccactcccaaagcattatttatcgagggataaggtgtcagaaaccggggcaatgctttgcttgcttcctttcatttaatcctcacgaaacacataagtggttgtaattactagccccattttacagatgagaacatagagggccaggatgttgagatgcctctaatattgagaatgagtggaggaagcccccaccagccctgctcccacaccaattcccactcccacccctctgttctcacctgggcctgcgcgcagacacaatcctggactcaagtcatctagcccagat

SEQ ID NO: 34121 - DNA, 1142 bp, Bovine  19866881160134
ctaccacgttctgctggagggggagggcctggggcaggcgctgggcaactgcaaggatgacctgcttaacgtgtgcatgcgccacgtcgagaagatgtgcaaggcggacctgagccgcaacttcattgagaggaaccacatggagaatggtaagtcccctcccacaggtgggccccaaggccgtggaggttttctcccaggtcagttcctgctgcctggctcaggctggcaccccaccagctgggacctcactgtttccagcctcccaactcacctaagggtgtctggacaaggactcagagatggtaccctcctctctcgaagttgctgcccaaggtatgcagctattacaaggggcctccaggggagcatcccaggcactggctagggagatgcaccgctagggacaaatgtcttctccctggattgttcatcaaactcagggattggttttacagccctgagtctgactaggggacctaagccaggagccgtgtggatgctgcaaattgtaagggccagactgcaatctggtggctttgtaggctccaggggacatgacctagaactgcatgcatgcttggagggagaacttgcctgtcatcatggctgtgctgagcagtgttgagcccagaggtggacttggcctggtggactggctgggcgtggttgagcacatgtctcagtgactcaccagctcccctgaagtcagcttctctattgaatcacactgtcctctgcagaggcatctgaatcatcttcatagaaagcctccaaacatgagaaactgccccgttaagtgcttttccaccagtcccagcccatccctttagggcccgaagctggacactttccccaagctccacccggtggcccagaccttgaggatgcagcctagttaatgacttctagctgcaacacccagaggaagtgaccctgtctttggtctccaaaaggagtatgtgattctttggggcatgagaagggggtgtggtgcactgaggggctgggactcaagggctggtgtctgtatatcttgggaatgttgacatcacatactctccccgggagatgtgagggacattgccaccctgaggacagataagccactgccgcaagacaatcattggcttcaaggggca

SEQ ID NO: 34122 - DNA, 1030 bp, Bovine  19866881191863
atatgcccaccccctcccaacccaaatgaagaaccctgaagagtacactgccttaagcccacccacctcttctcctccaggtggaattctggttttaatctccaatctcttatcttacctcttttgccctgtcccagtccccttgagtaactgagagggacccaatccccttgatgacccctggccaaggcatatcaggcactaaactggtgggtcatgagggtgccagcctgagaggtagagccgctagcggcaggcagaggctcctgagcatctgagagcagtaaacagaactcctgaactgtgagagcacaaatatcccccaccccaacctccccctccgcctacatctcactcctgccaggacatccctcgacgtatgggatgacgcttgtgtctaggcaatgtcccagcagctgggccttgtggtgggaaagtgtagatggagacagggcccctctgtcagcccactttacccttcaaggtcagccgtctcagtgcctcatctccgatgttgttagcaagcagctttgggaagctctgaggtcacccctgtgacggttcccaagcacctgtgggactggctgggattccctactcacctgcctcggacacagataggaggaaaggaactaaaccccgctgaggtatatgtctgaagcccagctaggggctttctatccaggcagtggcaaggccacagaagctggcgtgccttcaccccagacaggagagcggatctgggcagaggggggccgtgaaggctactgggatgttgggcatcacccatcccataccctgggggccaagagtgcctggcattcctggggagcaagtccctcccctggctgggcaggttagggagcccttcacgtgagcaacaggaaatgacagtagctgacataatgggctggtggccccaggaagataggcttcattttaagccctgactcacctagtctgggtaccctggggagtgggccaagctgccgcaagagtaagaggcgggggacatgcaggagcttggcat

SEQ ID NO: 34123 - DNA, 1661 bp, Bovine  19866881222492
cacccgtgggcatcgcaggccccagggaaggaaggcgcagggcagagctggctccttcatgctgatgagtcaatccttaggtctgcatggaggtcatacaggtcttaaggcccccttccccctatcacttccaaagtccttcccagggagggtagggggcagattccagtcccaggaaccgatcccgcagctctggcctgggtctgggccacagaggccactctgtaattcaagctaacggagcatggataatctagaacagcagagagtctgggaggaatttctctttggcgtcgaaatgtatcagatgactgttttgcagccgagttaccttcctaattaagcaagggagtttgtgaggcctgagagcacgtggtgacctgcagggtcagggtgtggggcagggcactggccccaggtgaccctcgagaggacagtccacaggtgggccatctggactccactcttggtcctcggccacaacactgggaaagggtgttgatttttctgctcccatgatcgtccttcctgggaagttcgctaccccagctgtgaggtggtggccaatgcctctgtcccctggttccccatcctgaacctgcctggggcataggaagcaccaggccctttcatcccaggagatcaaagcagctggcacaggtgaacaccctaaatcctctccctgccccgctccccaggtaggggcccctcccttgccatcttttgggatctctgggtgagggcaatagagagggggaccttccagaagcttaggataggcgctggcatgggatcagtttgctgagccgtggacccacccaggatgtggaaccagcctggaaacacctgctgggggcaattccaggcagattctccaaggggcgctattataccttcctctggtctcacagggaaacatggtgggaggccctcagatggcatcagtgatgctcaaaggctcaggggatgaaagagcaataatgtcaagacatctccctccagcagaggcacgttagcactcccaagacacaacagtgactggcaggatgcaccaggagtgtaacaactgcacttctagtacttacaggggatccaggaggtaaagtagtaacaaccgctgaaaatttctgatgatgagcattaataagcccccaacgctccaggaaggccccaggtcattcctgcatcatcaaagggagcaggtgggtaggctctacgatgctacataggggtgataggcattctggaagcaaggtcctatgttaccccaggcttagtaaggatcatggacactgggcctgatttcccagatccaaatcctggctctgccactaaatagctttgcgaccagaggccagttacctaacctctgctcgggcctcatttgttcgtatgttaaaaatgaggagaataatcctccacaagaagtaagtattgttatggagattgaataagttattaccggtaagatgttcgtaatagtgtctgagtgtctaaaaagtcttgataacagtttgctgttgttaccatcatcactgtccaaacaatgatgtatccacctaacattggacgatgtaataagtatccgcctaccgtgtaatcagcccacagagtggcccaccctgtgcaatgccctggggagtccaagccctctcagcaat

SEQ ID NO: 34124 - DNA, 1517 bp, Bovine  19866881321608
ctcagttattaggccttattaatttaagattaaaagtcttgaaatagattactgttaaatttttttttcttatttacctgttaatgcctatttgaatggagggacatgagtggacttcaaatgaatgcaacagtctttcttgcattataatcacacaccctggtgtagtggattcagcacatttaaaataaaaataattttatgttctcatttaaccattgcacttctggatcatttttaggcgaaacctgaccaaactgtccctgatcttcagccacatgctggcagaactaaaaggaatcttcccaagtggactctttcaaggagacacgtttcggattactaaagcagatgctgcagaattttggaggaaagcttttggggaaaagtaagtgtcaaaataatgaatttaaactatgaagaactgaagcttgtattttgggtttttgtttagtttgaaacaaaaataatgaatatatgcataactacttcccaactgtggtaaatattagcctagtttttttgttgttgttgttctgatcatgtttgtgtttttttttcttaaagaagtagatagacctttgccgttctgttgaaacccatgctgttctctttttcctaatccattatgctgttaatgaacacatacatttcaaattatttgctattgcaagcagtgctacagaaaacaaaattgtatttgccttcatatgcaggagtttctcaatacttacatacttaggagtggaattgctgagtcaggggtttcacatctgctttgccatacattgcctaactgctttccaaagtggttgtaccagtttctgttcctttgagtagtatgcatgtgttccagtagctctgcaatttggctaacactggtaatatgaattggtatcatattttgctttatattcttaatgacaagggagcttgagcaccttttcacatttgtcacctgtctaggttctttttctgacttggctgttttcctatagacttgtctttttcctattgtaagatactaattctttgttagtcactaacattagagatgtctgtggcttgtgtttccactttgttatattgtcctttttataaaaaaaaaaaatttatttggctgtgctgtgtctatgctgttgcacaggcttttctttagttgctgcaagcaggggctactctctgattggggtgcatgggcttcttatcacaatggcttctcttgcggagcacaggctctaggacatgagggcttcagtagttcaggtccccaggctctagagcacaggctcagagttgtggcacagggactcgctcaactgctccccgcatgtgggatcctcctggaataagaataagaattgaacccatgtctcctgcattagcaggcggattctttaccactgagcccaccagggaagcccatgatttaagtcaagtttttgtttctcagtattaatataaatgttcttgaatatactctgaaattttaagtcaaagaactgaaaaagtagaaa

SEQ ID NO: 34125 - DNA, 1270 bp, Bovine  19866881334144
aaatgctgtgtggctccctatttatatcaaaacagagatgactgcctagggacagtaagtcagtagccgaaaggagtggaccaaagtgggaggagagctggtcctgggacccaaattgggaagttaaagctgatttagactgttgagaattttgcctgacttagaaataaggttattccttacaccctggctctgcctatgctgggggtagtaggctttctggctcatctgagcatgtgtgatgacagtggtaattcagcttgatgattcggagcacacattcctgacttctaggccctgtcccgctggaagggaggcgtactggctctggaaagcacactgagtgggcctggagccagcccacatttggacctcgactgttaagggctgtccttcttgcacctgtggctgcctgggaacgcagcggccagagtttctgtcactttagtgacggaagacagcctttaggacagctggtgaaaaaagatacatggcctccattgcccaaacaggcagtgatcccttgccacccagccttgtttaatgcttcttcactgtgacctcggcttatttctgttccttgatttgtaaagggagaaatctagtgtctgctctggcccctcagaaatgttttttgacttattcaggcagtaatgcatgtgaaaatttggtgctcagtgtaaagcgtgttgcagatgtgtgtgtagggcagcgtggtccccgtcggtagggcaagtgcatggtgtctttagaaagttgtcctgccatgagaggaaggctgtacactaaaacccttaaagctgtaaaaacccagccgtgtgactgaagaacacatggacccgactgacagtgggtcagtaatatctcatactaacacattgttattagatgaggctttctccccacccccacccgcccccagatttgcaaatattctctttccgatttcttctagacttcactgagagtgcccaggttcctgagaggccacccaagccgttccctcggagaatcaactctgaacggaaagcaggcagctgtcagcagagcagtgctgccgcctcggccgctgcctccccgcagctctccagcgagatcgagagcctcctgagtcagggctactcctatcaggacattcagaaagccttggtcattgcccacaacaacattgaaatggccaaaaacatcctccgggaattcgtttctatttcttctccagcccacgttgccacctagcacaccccctgcctgctgcagtcttagaggaccg

SEQ ID NO: 34126 - DNA, 1402 bp, Bovine  19866881346254
agctgggggaaaggagtggagagagggaggccctgagcaaaatgccagtgagggaaccaaggcagaaaaccatctccacggtgaggcaaaaggccactctcttttgatttattctagcctatgtgcttcttattgcaacagctggtcttcaatgacgcctgctagcattcatcaccttgtgtggccccttcccatgaatctgagctagccccataatttgtgttgatcaataaattgtagtggatatgatgccctgtgacttcagaagcatgagcagccttgccgatctctctgggccccttggagtgctcactctgggggaagctggccaccatgtacgtgttctgagcaccccaagatggccatgctgtgaggaagcccaagctcactccctggagcaggccagtcagtccccagctgttccagtcatcctgactgaggcacgtgagtgaagaaaccatctgggagggccagccccatccagccttcagatgactgtggccctagcctccatatgacagtacctgtgtgagaggccctaacagacaccatccagctaagcctggtcaacacatacaactatgaaagacagtaagaaattgtcttaagccacgaaattgttatctggtgagatgtgatacacacatggtgataaatctccatgaatctggacatctctttcaacctggagaagttcaaggctaccccaggcctggagtgtctacatggccaccccacattcctcagctggacatggtcctcagcgcctggagagccggccctcagccaaaggtcctgagtttgtctcctggtttgtccacaccagtcgcgtgactttagacaggtcagtgctctctctatgccttattttctcgtccacccaatgaggtggtagagttgaaagcattaaagcctcttccatttctctggctcatgaaatcacactctgcctgagaaatgggtttgccaccaccgagaagtgccctgtctcactctgcagcaggaagaagaccatcctggctgttcctgggctttagaaggggctccataggtgccagttatctcgtcacctgtgggtctgtgaagggctgtgcgtgcagggtggtccccaggtttccagtcctctattgcctcttcagctggttttcagcaccgaagagggaggaccaactctaaggcctaggtcaccctggactcctagctctgcctgagcagggaagtccccgcctgcaaggaagaagggagctcctgagaggaggaagcttctggggtggctgtgaaacgtctggtgacaatattttgcatctaaaaatacacacagctgagaaccagttaattgcagcctctggagtcattcataactcggcatttccccgtcatacctgctgtctctgccttcatc

SEQ ID NO: 34127 - DNA, 1232 bp, Bovine  19866881346399
aacttacttcacagtatttcattttaggtcacatacctatctcccttaccacgctgagccatttgtatctaaaaacctccatacttacacaatattggtacgtactagatgctcattgatggggggtggagggagggaggggtggaaggaaacctcactagttcatccttcccagggtctaagaagtaataatctcacttcctcaatattcataattctgttggtctatatatttatgtgtaatcgagtatcttcatatcttacgaagcttgacatgtcagtgcttttctccttttaatgcagcccagttccatggggttgggaagagtcggacacgactgagcgacttcactttcacttttcactttcatgcattggagaaggaaatggcaacccactccagtgttcttgcctggagaatcccagggacaggggagcctggtgggctgccatctatggagtcacacagagtcggacacaactgaagcaacttagcagaagcagcctcaattctctttgagggtagaaagaaaactgagaacttcagaaaaatgtgcaaaagcatagttttctccctaggaagctttcagacactcttgaagaacccacctggagtcacttgggcatcccgggttcagaatcctgtcttgctggtctggatagagactaggactcttgcccctgcatacaaggccctgggttcatgacgatggtggtaaatgggtctgtcttgcgttgactctcatggactttggccatttctgaggatttttcactttagttttgtccaaaacatacacaaagcaagtggatatgtgccccaaattttatgctgataataagcaagtccctgtttggggctaagctattctgtcttgaaaacaccgtgttccatgaacttagggctctctggagagcgccccctgtaggaaggccagggctggtacctgtcttgtaccccagaaggagtggcaggaccgctatgtctgccctttgcctcagcgagtgctctcctcagacttagtgaattctatgctggagtcggaaggtctccttggctgaatctactagcagagcccgcagcccgaggcctggtggggggagcaggtggggctcagcccttctcagcagcggaaaagcaatgaggttgaactttatatatttattgatcacagcttctctggacctttactatcatttaactctcgcttctaaccaaatcccctttatct

SEQ ID NO: 34128 - DNA, 713 bp, Bovine  19866881502416
tgggtcacgcagccacctggctggcacgaagcccgcggcgcctcctgcgggagagccccccaaactgggaccggagttccaaggcaaagcccagctccgcgctaggcggggagattgcgatagcgcgccgccgggcctcaccctcccggaaaagaaccgcaggtgagcgagaagccgcctctgccgcaggagcctgctccccgcgcgggtaggggggcgacgtggtgcgggagggggccggagcgcccgaaatctcttggcgaaagggctggaggaaaaaaatccgaagccccacttccatccgccaagcccacagcccaccagctccgagactgacgccctccccctggggctgttgtctcctaccccgagacggtgattacggtgattattttgcatttatgtaacattcagtgtttccaaactgcttcccgagctgagagctggttattaaataaatagaacgctattacatattattattttttgtgtgaaaaactgcgcggagaaagtgctttcttgctacacagaaacgtgcatccgattgccttcccgcagggcaggctgttgggctcctcagcctctctctccgccgaaccacccgcaccccccttacctaagccgtgacccaacttttctggctcctttcactccctacaacccagacgtgcccgccatccagctcccagccctggggagacattggatggggg

SEQ ID NO: 34129 - DNA, 1629 bp, Bovine  19866881549512
cttcattaaattgcattttcccagagcagggcaggccggtgacagaatgagtcaacgccagcttgctacaactgtcgcccctggagccggcgggcacggagggagataattgggagtggtttgacagcttaatgtctggggttggcttcccggagcattgaaggggcggggcggggtgggcgcgggccagccccgcccctaggaggcggcagggtgatggggctgcgtccattcagactgaccccaccagccagcacctttcccctccatttccctagcagcagcttgttgggcaggaaaataaagcacagggaaggaaattagatctggagaataaatgaggctttctttattaatttgtcagaactaattaacgtctcgcccagattcatctcctctctagctgcccccctgagcaggagggagggaggagtctgggagaggccagatctgggcttcagggtcctattctaggggcttcaggctgaaaggcaccccatcaagttctctggtccacttacttggggtgctgagtcccactgtgggtgataaagctcagggggtggagccccagaaaaaccccctgcaccaggtctcagctacttcccctctctgagcttctaccagttcatctgagaaactgagtcagcgcctcagggctgttgggaggatatgaagcagccagtaccttcctggtgcaaagtcagctctccgtgtcactctgggagacggaacttaagtacagtactggaaggaactcccgagttccttcattttcacaaagtcatttttagtttgaccctaacagcaacctcaagaggtgttaagaaacagttaattggtgtccccatgtcacagatgtccaaaagggagcacagagtggttaagaactttatggaaaccacccagtgaattgctgcagacacaggactagaactcagctggggacctgctctgcttgccgacctgtctcatccccccattcccacccctgacctctgcagagacctgactcactgccggagtctcacttactaatagctgcctcacttcctgggtttgagctcaaggtcttcagcccaggagccccccactcctgccagggagctccttcaggctggccctcgacttgggtgagagctggcatttgtctgacagagctgagtgccttcccttgcctcccgtccccatcccagaactgggcccagccctgccgtttcagagaataaccagctctgagaaatgcctctccacaaccaggcagaggagaagcccttgagtaccagccacgcctgggttgcaaaatccagtctgttctctcgcctgccatgctgtggtcgcgtcctagacattccgtttctgccaatcggcagctccctggggcctgggaacatgtggagtgaatgccttccaccccgtagcatctcccctgcggccccggagcttgctgccttctgcacatggaacggggtgggagctggctatggagcagagactccctgactggccgggccagggtgagggtcggcgtggggggcgtgtcgggcggtgggtacctgaaggaagcatggaatgtccagctcctgtgtttgaactgaggaaactgaggcctcgaaaagaaagtcacaa

SEQ ID NO: 34130 - DNA, 1817 bp, Bovine  19866881779609
atgacatcccattgatcctattccccagcatgagcggactgaccagaggcctcagggccaaatggtgtgccctaccccagaggcacggccaggacaggaaagtcagggcctcccttctcccaaagtccagggagatgcaggaccaccgtgaaggcagggctgctcatcagagtcatcagatccaggagcaagggggaaggaaagagggcaacttcccagatccaggctgggaacagagaggaaggaagggaaaccagcgtgaaggggaaccatctcctagggcatgatcgcaccagtggcgccctccgtggggtctgtggtcaggccgaggtggtctttagggaaaaaatggacggggcggggggtcacacagggctctagctggaagaggcgcacagcatgtcctctcctactccctgagtgcagagcaggatgggggtggccaccaaagattcacacatcgggggtgagaagggccttgtataaggggactctgttgttgatagcccagttaagcaggagccagggaggtgtgatgctcgcagaatcattaatgggcccaggagctgtgtagctagccgtccccgagggaaggtctctcagcccctcaggaagactcaaccaggcagcctgagccttttcagagctgtttgttctcatactcaagggcaatatccacgcagccgcaaaccccacccgccttcatccctgtcgactggtctctgtggggaacacagccttgccctgtgctccaagccctgctgatctggagggaatgcatgaactagatggataagtggaaatttaatttttcattctggccatccgtccaggtaatagttctgccctgggctcatctggagagggagagacgaagagcagggcggggaaagatgtgcagtagagtgtgtgccggagacacatgtgtgtgcagggttgccacatcgcctgtacagacccactttttccctgacttcttgggggagtcccggatcctgggaaaggttgtctctgagtcgttcctccaaggatgagtggtgggcggtgatggggaaagtaggggttccccggcagggggagcatgtggaaagacagtggctgagcaagtaggcaggaacagaggagcggggcttcctctctcttggccacagggagcctctgaagggtgctcagcagagaagcagcgagatgaggagggtgactaagaccgagcgcctggggggctgtgtggatggcacttgggaactagttaggggttgtgtgcacaatgagggtttttctagagggaaaccacaggccaggctgtggccgtgcagctgagagcagaggagacagacccaccagagtttgcaggtatgcttcatggggccctcagggaagcccatttcccaagagcaatttcatgggtctggccccatagccataaaacaaagctgtgagttctccttcctccaccctctaggggcaatgctgggggcagaaaaggagcccagggtatggccttgaccaaactaaagaggccaaaggaggcgacgtcagtcctgtccatggaacaggggtgccctgagaagagtgtccagagccctcccaggagccggcagggaagcccctggagtgcaggggtccccaatttccaattccggtgcagagctcgctcagccatcagggtagggagagggggtgaggcaacagggtctgtaccttaggctgggagtccttccgaccaaggtttgtggggcttggaggtccctctgcaggagagggctgtgtgagcctgtgagtaggcgtgtgcctttgagcgtgtaaacgtgcatggg

SEQ ID NO: 34131 - DNA, 1142 bp, Bovine  19866881797610
cagggaggccctgcccactcacaccttcagagccactcctggtcccaggaagtggatggtaacaaacagctagggtgtgccagtgccctgtacttcctggaaaaagaacgcagacacagtctgggcagccatcctctggccactcaagccaacctacttcttggcttccccatgcccttctccttctgtgtgttccatccagctgttctctgggaagaaccttggctcgggctgtcacagctggctggagggggagactaaaccctgaaaggtttaagccccaaaaccacaaagccaagaatgggattggccttggggcaagcactccatgaacacaggcattctgggctgactgctgcctctccctgagaatctgggggtgctggagaaaaggaaaaggaacaaagagagatctgagatgctccagaaagccagcctccctggggatacctcgataaaaataaatactgggggctgggatgggagtgactcagactgaatcaccaaaggagaatgacaacgttcttgattagggagcagaaaggaggcagatcacgagggaaagacccctggcagaacggtatgtcctgctgaccctgatgcagtcaaacatgggagggtgtatgtgtgtgtgtgtgtctctcacggcctctctccttttcacggagaaacctgaatctagaccttcatttcctccctgcccaaggtttctggaggtggagtgggtgcagcaaggttccttgcaaggcgagcagccagccccgcagcacttacgtggtccagtggtactcagtggctggggggttggcatcggctttgcacgtgagcttcacatccatccgctgcaggtaccagttgccatcaaacccctcgatggtcacctcgggctcgtctgtgagacaaggggtgatgtttgtaaagggtgaggtcaggagaacaggacttggggcggtcctgtaggtgggcgggtggggagcctcagagggtgatgaccctcagaaggggaaaagacaaggaaaaagccagaagacgggggaagagtgacaggggttggggaggtcacagaccctcagagtagaagcagcaggggaacaaggcagcggggagaggacgggcaaagcgagaagacagggcaagagagg

SEQ ID NO: 34132 - DNA, 4116 bp, Bovine  19866880585272
tctgaaaagactattgttcgtttatcttgcgttttatactgtgcaaattcctgcatcctccctatgaatcttggtgactttcgttagcttttcttgctgtgacaatatctgtcattgtagcataaaataatacttcgatttttttcctatgattgtgttaaaatcactataacactggaatttgctttttttttttctttcaacttcttagtagtatataaaagaaaaaactaagttattccttaggttttaggcttaaatgttttctttaggttgagcgggagggtaaagagaagcagcactaagaagctggtcagaattcagatgaactgttttggaattactggttctctgccatgatgctttaggaaggaccaatgtctggaaccagggtgtgcgcctctgaaattcgaacagtgtggcacagagccaggctgacatgaacgtgcgtttttctgtcatctgtcttggtacggcatattcaagggatttccagttgtttacatcttatagttctgaaccggctataactagtaagtatcttacttgagctctaagccgtcttagatgcaatagatggaaagcgcattattaggggttgtgccacctgtgtcgtgtccggtgggcagcaccttggaaggcgaggcgcctcatcgggtagcatttgtctgtctgtgcatctcgttaataagtaatcgagtatttttgactcccccgttgcactttgaagtagatgtgatcgtaccagtgcccacgctatttcggtactaattccccactgtttttaatttggggcagagatttggggacggaattggggaagcatgcttcatgcaaagttatggctcaaaacgtaaacaccgaaatcatcctggacacgtttcgacagcacacgtgaggcagcctgttgtcgcagcgtgtagagacaccaaagggaccgtgcacatgcgtacagactcagcctcacgacgttcggtggcagatacatgggacgcgagtcatcttggtgactcagcggggtttggtacgtttaaccttttagccagggtattagttggtgttctatggaatcgttcttatttatttttgtccaattagaagacaaagcagggggagaggtgcctgcgcctgtttgctttcttagcacagatgacgtatgtaaacacgcacacacgtgtctatagatttctcccagaggcgtctgtctacacaccgcgaacacgttgcacagttcacataaaccaactccaggagagaaatcccaccataactgcttgccctggctcagggtctgtgtgtctgtgtgtgtcaatctgtctttcaactctgtttccctcttcctctacattatgaggacccgcagggcgaggatccgtaggagtcaggccaggtggattgtctgaatccatctcctctgtgtgaatggcttgtgtctagaagggaaaatcaaaaaaaagcaaagtatcaactgcagaaaccacattcaggttaaagggcaccggccatcctgcttgaactctgcctaaaggacgaagctttcatttgataaagatcattagtcaccaagacatatattttagagagttcccagcagcgacaactccgctggcagtcactggagtgtaccagatggttcattagcataggctagacaagtcagaggctttcagaatcatttagaaaatgtcaaacagaaacaagaaccctgtcactttttattagaattaactacatcatagcctggacacagatttcaccttgggtcagaaaaattaatacagagttccgtgcaccgtgtcatatactgggttaagatcagtcttcctcaggggactcatttgctggcaatatattacgatccttctacttttggaatcctcagaccttttcttttgtgagatatgaaaagaactgaccttgctcaaaacccactggtgtctagctgaccggaggcacaggcagaatttccacaggacgttgtcctaaagcacctttgtgaccgtctgctcaggcagtctccatgagtggggctgaccgaccgtctggcggtgcgtcaggtgggctgaatgtcaggaggaaaatgcaaccctgaattgaacaggctgctataaacagggattaaaacaccattgaaatattgtggttttttttttttaatccagatgtcaaaaacttggagaacttccagctggtggagggcgtccaggagcaggtcaacgccgccctgctggattacacggtgtgcaactacccacagcagacggagaagttcgggcagctgctgctccgcctcccggagatccgggccctcagcatgcaggccgaggagtacctgtactacaagcacctgaacggggacgtcccctacaacaacctgctgatcgagatgctgcatgcaaagcgagcgtgatcacagccgccgcgggctcggcctcccaacaaaacacagagatgggtggggtgggggaggagaagaacaggaagaaagggaaaaaagaaatactctgaatggctccaagcaacatgaattaaacacttggtttaaagatactgaatttaataaggcatagtagtcaagtgctgaatggccaataaatgatgtatcagggtatttgtatcgcaaactgtgaatcaaatgtgtcacatccccagagcgttctgtgcaaaagacactggaacggagttgactgaacccacagacggacccgaacaccgtgtcaggctggaaacggacagacgctttcctgtatattgaaaccgatctccgctgtgaagaaatctaggaactgatctatgctattcgttaggcttacgtggcagggaatttgagcttacagaattcctccgtggtaaagcggaactggaaccatcctcaagaatccatcagctgcaccgataacagccctctcctcttccttccaaggacccggcaccttctgtcctgggatcccggagtctgtagcgaggacctgtgctcagctgcaccccccaggagctccgccaccaaaccttgaaaagcctattcttgactgtctgtatcttagacctgccaacagctaataagaacagtccattgatatgtgagcttgccattttgactatgttctggattgttttgtcacgtgttcataatgtttgggaaaaaaaaaaaaaaagcaggcaatgtccctcttctgatcctattacaagcgttcattaatattaagggcagcgactacaaacttgtaaagctttagctttagcattactggatttcataaaaaatcccagcagaaaggcttattaggatacatcagcctttttaaccatcaaggtttgtagttcattaaaaaaatacaataggaaacatattttgctggaatgtcaaatagtcaccgttctgaacagaaaaagaacacggaagcatgttaagctatgcaatatcaaggcgggggtgaacacacacgatgagtggcgtgttgcaattgatcatcccctgaacgcagagaggaaacggtgagcctggaaagatagcaatgtgcttcaaatcttccccagtagggaagggaagagagcgatggtgacctttctgagtcactctatagaccaaagtctgctatagaacaaatactggaggacagagaactgcgaaacagtctccagaccacgctgtcagtattatcaacaggcgatgccagagatacagaagtcttgccttacttcacaattctcaaaggtagcagatgtggatcaacacttgtttaaaataaagtattaatactttaaagtcaaatgaaatagagtgtttacattccttagggcctctggggggcggggggggactgtgatgtgacgaaagagctggagtagcaatttcttaatgttatttttctgatcggtaattatttttaacagtacttagttattgtatgtcgtgagacactaaaatcagaaacggggatctcatttagattttaattttttttttttttttttgagattattggcggcacaatcacttgtagaaactgtaaaaaaatgaaagtatctcctagtcccttaattttttcataaatgtttctggcttttgaatagtttatttatattgtatatcataggttcaactgtagacaatta

SEQ ID NO: 34133 - DNA, 1254 bp, Bovine  19866880616522
gtaaaaaggcagggacacacgggcagctgccctttgcgggaccgtgcggaggtgtcgcttacacagtgtaggcgggcgttacaggggtccccacactcgcggtcagtctcttgtgccctggctctggaggctgacctgcttctgcaacaggaaaccccactgtgtggagtcccctcgcccggagacaaggccacccagatgttccaccgactacccgcgaatgctgcccactcctgggttcgccgacctgaccgtttctcatgtcttctccatctgccctcagacctccagggctcaggggccctcctggcccaccacgtcccatctgcagggaaatacagacgcagccctggatggggcgggctcccagaacccacaacactgcaggcgcctgtggggagctgagagaccccagggaaggaggagaagccatgtgagtgagcaaagagaaagggggtcaggacagatagaaaggagagatggaggcgaaggaaaggggagaaaaccaagaggacgatacagcaggtcagcgtgtctccagagacgctggccggggccccgtgcacaggaggcccgagcttcgcctggcacgtggcgaaggcagccccagaggaagcaggtggtaagcatcaggtatttaagaaagacccagggctggcagagggacgctgcggaccgtgctgtgctggagggcggcggcattcttgggtcagagatgaatgtctttaacgtgagcaacagcacagacgtgcgatttccatgcagccattctgcaaatggatgtggagctcgcagagatttgtatgatcgacttcccgagctgcagaagaatgagtcagagcaagtcatccttcacttgccctggaaaacagaaagacctactctacctcacaggttcagagggcaaagtccttcaaaaagtgttagggagtgtcacacgtgagtcatgtttgcggcgttgccacccactaccagactcggagtgccggcggagatctcccctccccgagactgaggagcagacgttctagactttcttaagatctgtgagcagcctgtgtgtcctgctgggcagacgtgtgcaggccttggaccgaccagggacccagggaagtctcagcaaacaggtgtggaccaacttctaagcagacaggctgacacactgctctctattggccacgcggtcggaatcagagctgggcacccggggtggcagagcctgcccggcgtgccctagtggggagcaccaccccc

SEQ ID NO: 34134 - DNA, 1415 bp, Bovine  19866880739040
aaaatctaaaccatggcagacaccatccagaggtctttaaagagaccatcactttgtcataataagaaaacaggagcgcacggattgccctcattccaatgctaaagcaagaaagcggactttaaaaatcttagattaagatggattgtgggtgggagacagagtccttcttaggaagagagagtatctcacaaaaaagtgatataaatttgcattcatctagaaaatccaaagtaaatcaatatgacataaattataggtgctggaaattgtggagctggttttaaaggaagataatttatactgttctttactctgggattaaacaaacataaccagaaggtacaacctggaaatcaagttcgttgcaaagcacactgggggtcctatgggacgggtgcccctcgagtgagccggagcgatgtgactgacatgcaggtaaccggggggtaacaggtgctctaggtggtcagtggccaggcctgagcctcgttcctgaaggtcagggggagggtaggagggcctcctcgtctctgtcccccatccgcgctgctgccctgatccaagtttcatttccattttctcatccaattacatcttgctcagttcctcactaaaatttatagcaaactttgcaaagcttttgacctgtagcatcttattaaacttttatgaaaaatcaatgccgctccatcctacggaggggctgttcctcacgccattgtcaggggtgactgaagcctatttacccccggatctgacgagagagattgaaactgcaggaagtcttcatctcacaggccaggtggccataaagaggaaattctcatattcttctaaaatatggcgtttccagaaatgccaccttgggaaaatgagtctggaaagaaagcaaaagcgtaagtttttaatcatttgtcttctttttattgttgttttgatcgcatcgttctcccccagaatagcatctctgggccccctggctcccctctgggttcctcgtgtgggacacaccagaccctctggacaaggacccgaccccaccatccccctgctccacagctattccagtgacacgccccaccggtcagccggtcagaaacccaagaactggcccagaaacctcttgactagtaaatggttcttgattctgtaccctggctccaatccactccccagcctccgctctgtccttacgtccaacacggcagccctccgctctgtctcctagaccctcaccaatggcttcctaactcttctctcggccgcccatctttattttaaatatgaggcagtaagtacttttttaaagtgcaattgattttatttttttaacttatttttatttattttgggccacaccacacttgcatgtggaatcttatttccccagctaggtatcgaactcatgcccc

SEQ ID NO: 34135 - DNA, 1201 bp, Bovine  19866880779089
aaccctttggaagaaattcttgccagctgagttttgtgctattgaagtaggacatttctgaaggcacctcaagcctccacatggccctgaggctcttccgcacagaaccagagggtgcttttttcctaagagacgttgagagacctgtaaacccactccctcattaaaacgggatcacagaaatgtgttttccttgggaaaaaattcatttttaaatagaccgtttctgacttctaaatatagaccaagaggcttgtctttgtttttaaacgtaaaaatgcaggctcctgagagcaacgtgactggggacctttggtgtcacgcgtgtgctgtttgtttattttgccatcatctggcgtgtcagccaggcctcataacaccccatgtcacagaaaagcaaacagtcccggtatactcacgagcgcgctgaaatcagaccgctgactggctacaattcgatgccccctttgctataaaaaacatgaccctaaatcctaaccagctttagagtaaaaggccccacaattatgatatagtaacaaagttcatgctgtatacaatgtgattgtttcaatacttcgtccatcccttttcattttacctgctatttatatgaggcagtgaaaaagtccagcggaaaatccactctgtggtgtgttaggggtaatattcatttacctggcatgtttgcaggataaaactaaatgtagtggaaccttcttttataatcctggtgtttgaagttagagctacagccgcctggcggtgtgattgtaaccacagaccttttccatatgtatccacatttcccaaaggctggagtcatgctttatctctgaatacctggtcagtcctccccaaggccccctgagttttatccggatgggtctttaccagataatagatattcaacaagtactaaccatttggagcagaaataagccttctgtttgggctgtttcttctccaaacggtccagtagagacttgtagtaaaaccagggcaacgagtccaaagtctcaggcaagacagtcctggtgagagtgggtctgcgtggcttctccaccctgttgatggcgagcagcacagaggttgatgcgcgcttctgtccttcctgagaggcctgcggggctggtgtttggaggccagatggagaaacatctaccgtggtatcatttccatcagagccggcagctttatt

SEQ ID NO: 34136 - DNA, 1490 bp, Bovine  19866880800413
cccttccactacacaaggacacagggatttcaagggtgctgactataaaacaggaagaaggctcacaatagaaccatgactatgctgacaccctgatcttgggcttccagtctccagatataaatttctgttatctttaagctactgagtttgtggtattttgttacaacagcctgattagataagatactggttttccgttttgcctcatgttcattctttaacccatgctgaactggctttcattcctaccatgctagaaatcacccttgctaaagtaaatcaatggtttccatttccctaagtccagttttcatcgtacacaatggaccaggtactctttgaaatgttcttgtccctgacttctgtgatcacattttgttagttctcccctaccatctgggcttcttcttttgtactgtataagccttttcactcaactctttactgttatgtacagttccttggggctccctcccaagcactctcatctactccttaaacaaatacttactgtgcacctactatggcagagacactgtattagttactcggcattgcatatacagcccctcttcttaggaagtttagagggaagtgaaagtgaagtcactcagtctttgtgaccccatcgactgtagcctaccaggctcctctatccacgggattttccaggcaagagtactggagtgggttgccatttccttctccaaagctgtcaaccataaattatttaactgatcatttcattatagtcagtatgccagctagtgatagggctcagttgctcagttgtgtccgactctttgcggccccgtggactgtagactgctaggctcctctgtccatggggttacccaggcaagaatgctggaggggttgccatttcctcctccagaggatctttctgacccagggatcaaatgtgtctcctacattggtgggtggattctttatcactagaaacacctgagaagccccatagttggtataaggactattggaaagttcaaggtaccacttcaacaggttaactggaataaatgtggctttgtctgaaattccaaagattcaacccatttaatcacagggggaaccagaaatgctcttataagcaaaacatcttctcacatttgagaaaaaaattaataaacaagaataaaatctttttgaatttatcagttgaaattgaggttcttcttactctcatttccttctctgaagtgtttcactaggtaaatctctagtctgtctgaagagatcaaaatttaggtggcgaagtgattgcagattgtgttttgtttataaaaatgcttctaccttgtgccacgaggctgctggtggaatttcggtagggctcctgattgtcaaagatcaaaagattaagacatgttggctatctatattttgttgcaacttttaaatgtactttgaacttccaaaccacatcattccagcctgataggacaaatattcttggatctttgatt

SEQ ID NO: 34137 - DNA, 2034 bp, Bovine  19866880844395
tgtgtgagtgcgttgatgggcaggtgtgtgccttatggagaatacctgtagctaaatcagggcacgtaggtcagggctaagaaagaactcacctgcacaagcccttcaacttcttcagaagccgcaacctgcctgcccttcgtttctctgtccccagttttaacccaggtcagggttgcagagaaaaaaaagggactcagatgtgctgagacttttttcttctcgggggacctctattattgcacttgccatattgtaaagcaattatctaagggttttgttttgtttttttttttaatttctaaaaaagtttccggaactcattctctccccgccctcctgcccctccattaataacagacataactatttggcataaatcagcctgtgtgacatgctagagtacgggggagcagagtcacagagcagctcaggggagtggatcatccttggctcctgccggccttctcccttcctccagcatttgtctcctgaccgcggagctggacaggctgatggcctcacagcttctctcccctccctccatccttcagtgagaaccagagacagcaggccttccatcagacccaagagatgcagagagagccatccagacgcgagagaattgtcttgtaaaggtctgggcaactaaagaggagacatgaaatgcatacaaataaacacaccttctggttgctggtctacaccagggatctctctactgcagagccctggagatgtagttcttgctgggggacagccttctctcctctccccacctccaaaccgcactggtcctctccccccacctcccaaatagcactggttctcacatcttacacacatgagccttcctatctgaggatggagaccattccatctctgtgcatccaggttcttgcacagtgcactttgcaaatatgatctcactttatttaaaattaccacatcaacagtacacaatccctgttttgtagataaggacactaaaagttaagttcctttcctgagagcacgtgaccacaaagcggcagatctaggatctgaggcaagtctgactccaaagcccatgcaggactgggtggtcctgtggtgaagaagccgccttccagtgcaggggacgtgggttccacccctggtcagggaactaagatctcacgtaccacccagcaagtccaaaagataaacaaaacaaaaccaagaaacagaggccacttgatgaggcccccactgtgatgagaggcaagtaacagttcagtcagtgcccagcaacaagcagggaattcgtatcaaacacagcaccagactttccggtatcaattaaggaaagaagaaactgatgtttccagatcagtggtgactcaccctggagcctccctggggcacagtccagatgctgctgcctcccactaccttcaagtcatctgacctggaacaaaacagcttacaaaacggcctgatgatagaattcttaaatagcactaccgaactgaacttggatccccttgctgggcatgcagcaaagccaacctactgacaccgggttgtggtgaaggaaagcacagcgtttattgcagggcaccaagtcaggagaatgggcagctcgtgctcaaaatgcctgaactccccattgggtttcagggaacaatttttaaagccaacatttagggtgagggctgaagggggtgtgaccttctcctgacgggttggtgatgaggtaaggcgtggcgtgtgggcaatcctaatcatgctctgttttactttgttccctgactgcttcttgtcagccgtgttccctgacttccctaattagtaactgcttgagcctgctctttggaagtcagggaagaccaaggacactaaaccctttttccacaaacctgatatagggcacacagaaggccctgtgccctgaaaggccctgaggggtcctgtgctgatggctcagtcaccaagtcgtgtccagctctttgcgaccccatggactgtagcccgccaggctcctctgttccgtgggattatgcaggcaagaat

SEQ ID NO: 34138 - DNA, 2797 bp, Bovine  19866880998064
catacacatatatctacaaccgattcattttgctgtacacatgaaacgctgaaaatcaactatattccaaacaaaataacagggacaggatttgacccacctagtgcagcactcagccatcgcactgctgtcttctcatgtcacttgatcacctaaaatctccagggcctcgaattttgcctaaagagccgtcacattcaagccccacggcccgagggggccctcctcccttctcgcccacacaccctacggttagtttcttgggattttgtcattgtcgtttttcacatggaccgcttttaaagtcctttactcaatttgtcacaataccgcttctgatctatctctcggccacaaggcacgtgggatcttagcccccaaccaggggtccaacctgcacccccgcatcggaaggtgacgccccgacccctggacccccagaaagtccctgcagttcgttctggacgtggccctcttccctcacactttgcacaggccgttccctccgccaggagccttcacaccatgccgagcacagtcagggaacccactcctgctccagctcagcgcgggcgggcttgcccccgactctcgcagctgttaaagccagcccctaaagccagcccccacgtctgggtttcacactgtaagatggatgttggtcacctcccttcttaaacactaggctccccggatggtgacttactccaccgtgaccctagcgaacggcatataggagatctaagtaagtacttgtgggctgaatgaattcattatacttgcagctgtccagaggacaggagcacctcatgttggatgcaagattaggaggcctgaccattctcaagaattgatccatgaatgcacgcctgtgtactcgctccgtcacttcagtcacgtccagctctttgagatccctttgtgatcctatggactgtggtccaccaggcccctctgtccatgggattctccaggcaagaatcctggagtgggctgctatgccgtcttccaggggctcttcccaacccaaggatcaaactcgcgtctcctacagctcctgtattgcagacagatcctttaacgctgagccaccagggaagcctgacttagcaacactagaatactaaaagtattttacagcttcaaacacattatcgtgttaccaaaatctgctgaaactgtgagcattgaaccaaacaaatgttacaacaatctttacaacaagcaattgaagaaagataaagtgtaataataaaagaaatagtatactctggcctccaggcaaaaggcattagaaattgatgtttttttcaagaaaaagtcaacaaacatcttggcagtgaaacgggaaagtcaaatttagtcaagtttagtcaagacgatatcatcgtggaaagacattgatccagtaggctcatcttctaaaactattcagctctattcagctcgtcttctaaaactattcagctcatcaactattcttgaagggaatataatttttctctggcttgaaccttgatgaccatggggaaaggctttaactgggatgttcttttggtgatagataaaatgtgtgtgaaagggtcacagaacatgagcaggattctccaagaagttaagggtttagtcattctacggccaatggaatatttttatgaagctgtgtttataaatatggctgactggtggctcaggtggtaaaacgtctgcctgcaatgctggagacctgggtttgatccctgggtggggaagatccccaggagaagggaatggcaacccactccagtattcttgcctggaaaattccatgggcagaggagcctgctaggctacagtcatggggtcgcaaagagtcggacatgactgagcgacttcacttcacttatggagtacttgctgagatgctggatttttactcttttaatcaattagccatataacagagaactatgacggttcatgaaaatgttaaggaaaataaaaagggagtgtaggtaagcaatattgcccagtaatctaaaaataaatcattacaagctgtggataataggaaatggtggtagaaaagggcatttgggaaaggactgtgggcatcgaaagatgagggtgagcaatttgagaaagtaaccaagtcatacagcgttggaaagagaagactcgttacagatcactagaccttgattactaacctcattcccaagacccggtaaaatcaagtaccacgtgcagtggtattccagctactagcgtttcaatcctgtagaatcttatatccagacttggatatatttcaaccctagtcgataaataacagccgtttttttaattctttgcaaagccactaagtgtctggtatttttaattacactgggataaactcccttgactgcttactacgtgtttactggtatcgcaccgtgtgtcaactacgttataggagaacctagcgtcagactgatccagtcttcccagctttagtcttgtgctcttttataaatcagagagcagtgtgttgaaagatttctccatcaattactaaaaaatatatatatatatatttctattagtgtaataattaaggcagaagctacaaataaatatggcaaatgttatagaatcagagtattaataagcaacaatcttcaatcagaatgtttattttttcagcttttcaagaaaaatctattatcatttattttacatgttttatactcttatcccccaaatatctgagtgaaatttgatgccaggacagcttatggaagtaggtgaacagaggaaaattggaaactggaat

SEQ ID NO: 34139 - DNA, 1376 bp, Bovine  19866881072218
acacagcagaggccccatgctccgccccccgacttctagacgagtctgggaatagtgacagccacctttcaaggaggggatgccaggagaggagctgcaaaagaaagagcttgttttgccggcgtctccagcagaggcccagcagcttgctgggtttgaggggttttgcctttggcctgtgcgcccctgttgagttggaaggggcgctggaaggcgggcgagagcacagttctaagcaaagccacaggaaccaacggaaacacaaaaccccctttgctttttggcaacattaaatctaattcacggaagtggcccagacccagcagattcgacgacagtggttaacgctgcgtttgcagcgcctggagcaaaatgaactgtgctctctgtcagtcagaccacgacgcacgggcgttgggtcaactgcggagcaaacccacggccgacctgggtcgtgctgctgggctcagctcacagcctcggtccaccgggggagcttgcgaaggctggaagcctggcagacctccgcacgtgtgcatccccctgtgcgtctgaatattaattcagttctgaaaacaggcacagctgtctgcaggtcacagaactacttataaagtacctgagaaaaagatggaacagcaaaaaccagttttccatgatgtggtcgttggttttcctgaagctggtctcaatatttgccttgttgtagccttccaaaccctcacctgtgtgctagagcacgcgtgcacacgcacacacacgccgtccctgaccggtgggtatattcccctcacatcgttccccaagtgcactcttaagttgttccttgtgaaacataagggaaagagggctcccggcttcttcctacaattagcattccgtctcagtttttcccttttcgtgtatgatattataatttagaaaaacactcaccagacactttctagatctccacaggattgcccggctgatggagatgcagcggaaggtaatgctggcaaataagcatttcctaaaatttatgtaatcatttgaaattcagaaaggattgattagcattcaggagatgcccccgctcaatatttacaccatagagatttggcaggagcaaataatggcacataaagttgatgcttgtcttaattaaatgcggtataataggtgttgtgtggatttttttttttttttctttcagtgagcaaagcagtttagcaatgagcagatataattcattttggagttctaagtttgagctgaatcgatatgaatttacagccgtggaagaagtgattatcatttgttatctcctggtgcaagaatataattgcctaaatagcatttatttaggcatatttctgaatagcttatgcctaaaa

SEQ ID NO: 34140 - DNA, 969 bp, Bovine  19866881145876
tttcgtcgcgaagtactgaagtcctttaatgaacttcacatgtttccgatcatcactgcaaaatataaacacctcgagctcccctgttaaacagaaatcaggcggcagcttcgcgcggctccctgcagggatcgggtaaccgtccagctccggacgcagtccggggaaggcgtcttcgcagctctaagaccgagaaaaactgcgcgggaggggcggaggccgggagacccaggtaatacctgatccggcccctcccggagactcggtccacgccgggggagcctcgcagcgcgggccacgggccggggaaggcgggggacgccgagggcaggtccgcgcggcccggccgccgccgaagcctccgggcacctcctgcgaaccccggggcgcacttgcctctcgccccttgctcaacttggggctacacacaggcgcacgaacgccccagtcaagtttgttttaagttaatcagtggcattttcagggggcggggcggggctgggcgggggatgggggaactgagagccggcaggagtttcctctgatttgtttaccgaaaaggaaagggagacaacaggccccccacccgtccccaaagtgccaggacactccagcaccactttggcctcctggccaaagcgttgtgtgtgtgtgtgtgtgtgtgtgtgttttaaatacagttctgttttctttacggattctgggggcttctggaaagggcctttagggtgggggggggtccctagccgcgcttctcgactgacccccctaccgggagcctctcccgagacatggagtcctgggttggggcgtagatcgggatgagttaccagagtttggggagggggggttccaggaaaagatgggaaaagccgaggcaggcgtctgagctccgagaaatagaaatagagacacagagcgcagtcctctcgcgggggccaagggaggtccccgctcgggtttggggag

SEQ ID NO: 34141 - DNA, 1248 bp, Bovine  19866881277649
cctgatttatgtcaagggtattctgcttatgctgagtattttacatttcggttttcaaagggaattatttgattataatttgaagataccaataccatttaatataacacctttaatacaaagctttctaagatgaaaaatgggactgtaactaatatataagatgttttgtatcaaaaatatagtttcactattaaaatatgaggtacaaattttcaattataatataaataattcctggggatgtaatgatggagaccacagttaataacatgagtgtgtgctctgactctttgcaactccctggactgtagcctgtcaggcttccctcggtccatgggattctgcaggcaagaatactggagtgggttgccatttccttctccaggggatcttcctgatccagggatggaatctacatttcctgtgttggcaggtggattctgcaccactgagccacctgggaagcctatagttagtaacattgtattgcaaaaaagatatttgttatataaatatatgagcatcatatatgtattagcttcctgctgtaacaaaccacgactacaaaccaggagcatacaaatagcacacacgtcttctctcactcttctggaggtcagggtctgaagtcagttcagggaaccacagtcaagttgccagcagcgctgcggtccttccgaggccccttggaggagtccaggtccctgcctcttccagggaactctggcattccggagctccggatacctttgtcaccttcggagccggcagggagcggctgtcctccggctccacttgcttcttcttcctcccgtgactttcttctctgtcagatcttctccctgtctcctataagggtacagtgatcacaggtgaggtgcacccagacaatccagcagtcttgtgttaatccaggatcttcatctcagcatccttatctgaatcacacctgcaaagtccatcttgccaataaacattctcacattccacggattagggcctgggtgttttctctgggccatcatccagcttcccaggctttcctggtggctcagcggtaaagactcgcctgcaatgcaggagacacgggttcagtccctgagtagggaagatacccttcaggagggcatgacaacccactccggtatccttgcctggagaatcccacgagcagaggagcctaacgggctatggtctagcggaccacaaagagttgaacaagcaagtccagttctatgcaacagt

SEQ ID NO: 34142 - DNA, 1831 bp, Bovine  19866881432974
ccaggctcctccatccatgggattttccaggcaagagtactggagtggggtgccactgccttctcctcactaacaccacagactgatgttaatagtttaaataatttacttcaaacttcataatgtattaaagcaaaattatactagtaaaatataataatagagatttttcataaaaagagtgttagaatggaaaactgtcatatattaaaataaaataagtttgatatgttacttttttcattttgagggtgtagtgcctgtagcaagtatagacactggaaaaaataaaatgaaaacagtagaaagggatattataaatacccacttcacctaaagtgaatatgtaaaatatcacttcaaaaatatcagtgtgtagctttgggatgaataaaacaaactcattaattgttcttagaaaatcttcataaatatctatgtgttgctacaagaaaaaccttcagcacagcagaatttggtcctgtctagaagtgtttctctgtctccactaactagatgtttatgaagatttcctaagagagaatttttcacaaggatatctatcctaacatgaattatatatcatattatttgaagtttatgcactatggcctcacatctttgcttaaaaacataacttttaggcttaggagcagagattctggcttaagagtctcctaaaataaaagcagatgcaatcagcacaaaggtctcaactgaaaataaatgaatttatcccggaagagaggtaaggctcttagcaaaattagattttagtcacaggatgttttaaagtgacaaaacgttgaactaaattgtacaatgatattctactccattagtaattaatcattaaaggcaaaaaaaaaaaaaaagatacatttttcaaagctttgtaattgatcttttcaaatatagccatggaaccacaaaacacttcatatgaccctgccccagcaaaaaaatttaaaaaagaaagaaaaaaggacaaaagaacaaagttaatacttctgtatagttatcatcaagataaagaatactaagataatgaattacttactaatgcatacaggttgagctgaccatccatttttcagacatgtaattaaccctgatgtcttaccatctgctgttacatatcctggtttacacttatattctgtttgtttatttaggggatacgtaaaggtagattcagacaaaaatccattctcaatccttatattggattttgaacatgtttctaaaagggagaaagcataaagaaaaggtaagcatatatttgatacacatttcataaggacccaaataaggtaatgatacaaaaaaggggagtcacttatgactataaaccaagaaaacttctaatcatttaaggtcgtgtgtaagagaaaaaaaaaaaaaaaaactatgagtttccaaagatattaaaccaaaacacttgatttctgttttctagaacaaagcaagatttaaaatactccaaattccttctaggaaattattagaaatctgtttgtctaaaggatctggaatcccacagcatgtcagaaatcttttagcaatgggtttcctttcctgggacttgttgaaagtattgtctagtctggatctcttacacaacccagaacacagatcaggtgatgatcacagaatcttccaccatagtgaccccagcctttgtctctgagaatttgaaatgctgtcatcaaaactgggtgcttaaagccatatcagtacatgggagttcaacgaagatgacaaagatgaatacatccattcattttactaaggacaaaatactggatccttcaaaccatgaataactaaa

SEQ ID NO: 34143 - DNA, 743 bp, Bovine  19866881866168
aaaaggacagaactgagaaaggtgtgtttgtgtaatgaggataaatctctttggttgacataaggctattttttgcttaaaagctgttttagtgctgctgtaagataccagtcctctttttctttttcaagcccatcccttagaagaaaagaaaacgcagtcagtgatcattagccagttttattttatttactaagataagatttacagctctcaagcacggctaagttcttgtgtacggcccacaggtacctttgtgacacagaatatggtggccaagtttctttgtaaatgctggactctcccaagacagtgaaaattcctgcataccacttgccccggagacctcaaagaaatagtcaaatcacagctcattactgattagaacagtcatataacagaaggtaatgtgtggaaaatcagttatcacaggacaacagaaaagcaaagattatttttaaatggcattaggataactagataacgttgtggacaggaaaaaggatgcaagaccatgatttacattaatgcacaaaatcaaagtctaaactagagcacattagttttaaaatcattacaatttagcggaaaaccaagtaggtctttggaagaacaatcacatgttcctcagacttgacacaactgaaggaagtctgaaagaaaacagaactctatcaataaaataaaatacttgaatttctatacaaaaaaaaaatctagattagaggaaaattagtataaat

SEQ ID NO: 34144 - DNA, 2073 bp, Bovine  19866880172272
tttgcctagaaaatcccatggacggaggagcctggtaagctgcagtccatggggttgctaagagtcagacatgactgagcgacttcagtttcacttttcactttcatgcattggagaaggagatggcaacccactccagtgttcttgcctggagaatcccagggacgggaagcctggtgggctgccgtctatgggtcgcacggagtcggacacgactgaattgacttagcagcagcagcagcagggtcctgagggtatcctctgtgcctgtcatggggaagcagggtgcacccagtccccagcagctcctgagtccagtccagcctggacatcttcctgcactggtctctcccgggttccctggaggtggagtgtacccattgtcttaagaagaggggctttagccttggccatctctgcaaggtcagacccattgctgggtttaaagccaacattctctcaaaatgtaggtagagaagaagtgacattaacaagaaatttactccaccctaaatgactctgccaaggtgcagactgagggtacaaaaatactatcaattttcttaaaaagccatacacaatttttttctattggtgttaaaagaccaaacaaaaatgtttatcttcattagctcaatgcatggtaccgcgaggtagtggaggaaacgggagtggggacttcagaggccctgggtctcatcctagctcccccagggactcagaccttccacacaggtctttggcagactcagtttacccacaccctcttcaagactactgcgaggatcaatgaattagcacattcctaaaccaaacgaaccgctcatgcacaattactatggctcttgaaatgaagatcaagtaacagcggccccttgccttcagttccctccaggtcagaccaccaggaggcctaagcagtgcagcaggcactttctccctgccctttccacacaaccttgagctgactatttagtagagaagccaccctcaggtggatgaggctggggtgattgtctcttgacgaaccacttcctaaaaaggaacgctaagtttacgacagtctttttggtcaaacaagcattccagaaactcactcatgtgtgacttttcagagcctgtctggattaatttgctatttgactccaggagcctggagctagggatgcttggagaaggctctggagatgtgagtctggcattctagccagatgtccagtctttttcacggatgttggagaaaatattcatggaacaatggtaagctgaatgaagatcacaagattctaagagttcagagtccttcaagaccttctaaaagccgcatctatcatttcactgctgggaaagggaagatgatttctcaagagaaagagaaaggacatctgttgtgtgtctccagtctgtgatacacaaggttcttcatctcagtacttatttaatttgcacgacatctttttaatgagaaaaccaaggctcagagatgttaagttacttgttaaaggtcacacagtcacaggtaaggataacagagccaccttctgaggaaaagacacattggaataaactgaatctgacttggtaggataaatgtcctcttctttttctcccttctttctgcttcaccctccaagaacttctgccctgacttgaaacaggcggtccttttctctacccaacagtgtctcctgagggaaaagtcctccctcgaggcagcctccttacctgtttctgagtggcagcaagcagtccttcccttcaggagggcgctgggcttctcatgccggcagatgagcgcccggcaccactcacagtgttttcggacctcgcagcagctgcaaaggtgcagagaacacgggctgggtaggagcctggcaggagtgcccagctggggcagtggctgccggaggggcctgctgggcagctccgggctctacttatccttcccctggagcttccggagggacaatcacagcacagggctgagggctttgcaaggaggtagcctttggggccacttgcggaaggatctgttggccacccccaaaagaccagctctatgtggccgctcct

SEQ ID NO: 34145 - DNA, 3036 bp, Bovine  19866880346482
gtgtggggcccactggctccatcgaaaggctctgggacgaaggctcgctcctggctcctgactccgctcccggccatccctctgctcccttctggaactgcagcaacaacccacagcaggtagagaaagccacagagcagtgtcagcgcaatcacgctggagaacaaggcttctctaagcagactgtttctgggtgccggctgttggcaggctggagggaccaggcgaaggctgtctgatggactgctgggcgcagagctgtggcctgctcacgctgcagagcctttttgatacccagcctgggccccccacggctccccattcgcctttgttctgggagctccgcccctgctccctccccactccccctcctccagcatcctgttcgacgggcaggatcagtgccccgcccttctgcatccatcaacgggacaggccgcgggcagcccacgaaggccagcctgggtcagagggggcctcctcaggtaccctcccgagcctgtgtcccagaatcacagatgaggacaggacgacgttacaacatccaggtgtttgtcatcagctaaaggaaggtggagtcagggaccagaggcagggaccagggaccatcagcttctaaactggggaggcccctttgccctcagcctcgtgtgaccccctttgagtggttaaggggaaggagcttacatttactatgtttctgctctgattgaagtgaggggctgggtgtttctcatgagctctgaaccaagtacagaatcccataagattctctggagagatggaggagagtccccaggatcaagaatgcccataaatagtttctttaaatgagggaacacatgcacacattttccatgaatgcaattgctacagtagttttccctggttgatcacacctaattcagtcattctgccttctgggagtggagtgccagaacctggagtcaggctctgactctagctctgggcaggccccctcctcggcttctcccctctcaccttccagaaacctttgtaagagtctgttccccaggttcttcagaccacctcttcatctgggcatttatggaaagagcagcaagagaattccactcctttttattccaagagggggaagcacccactgtattggcagagccagcagtgagagtctggatggctttagatggaggaggctggctgtgggacctcctgtggggcttgggggtgggagggtggagagccgtcccagggcaccccatggatacccagaagacagatctgggagttcatggctggagtctgacttgggcttgtgcagggtgactggggctactggggggcccacattgatgaccctgtttaaatgccacccctccacagagccctctactctgtgcccactcccaggtgacaaccatggcagtgtgctgtgtggttcattcataagtctgtgtcctgcccatgtacgactgcctccaggcccagtagaaactgactctgggacaagtaggtgctctttcctgagctccaagcctgctgagtgctgtcaccaaacaggagagatgaagacaggagaggagcaagaaccagcagcacacctgtggctctgggctgtttttcctggcccagagcctgtctctcaccaactccctgtcccactgatcacgtggtacctggttgaattccagaggaccctggctccagtcctgggtccagtccctggttggccccagggcctctgactatgccagaagacccttagcccctgtggctgtgtcagcccctcacacctgacacagtgagccagcacagaggcagctgggtcaacacctctcatcacagctgcctggctgaggtggggccatcgtgccattccagaaacccagaggagggggaagtggagtcactgggcaggtgggtctcctagaggattgcacaatgcaaaacctgcacccagagaaacggccctgcacccacaagaccaggaagccccttctgcaagtggatgtttgtggatagactcccagtccctggaatgggcattgttctgtggcccaggtactgacttagtggctccctggtattcatcaccttgaacccttggtcccctggaagtgggaatgagttaggaggctggcatgtgaccgagggaagtaagaaataaggtggcttctcaactagcaactaggactgctggatgccccgactgtggcctttcaggacctgggtcatggtcctcacttgattgggtttggtgtacactttggccaagtcattcaatgtctatccccccagtgagcatcgggacaacctgcaggacagaccagctgccatactccaccattctgaaaaacaaggagcttgaatggctaaatggcttgtctcaggcccaagttgcccagtgcatgtaacggcattttgcaaataaaggcagggaagcaggtgtgttgggctcagagaggcatccggctaggtcctgggctttgctgttgatggcctctgaagggggcagtgatctagtgggcaatgagagctgatggctaaatatttgagaattttctgagttagtcttaaaccaactggcagcttgaaaccagacttggtgggagcatttataccacagaaattggcaaattctaaatcaagcccccctttttctggaaagccagcttgtcatcacattcctgcctgcagaccttggtcactctctctggggcaggcaaagcaccacagccagtgattaacaagcttctagcatctccactcctgcccaaccacttgtgccccaagtcccctctccagccccccttgcctcacgctcccccacagcccttattcttctgggtccttggacctgagggcgaacccctctaggttagctgtccacacagtcccacctggggtccccaagacagaagcacacaggggacctcatggttattaggcgagctggcaagggttggattagggaggttctctcgtgaagatcaggaaaatagtgacctcagttctccagctcccttcagcctttgggagaggcccatccctgga

SEQ ID NO: 34146 - DNA, 1614 bp, Bovine  19866880472106
aaatgatgtcagttgtttttttaatgacatcaaccaaggatgttatttcatatgcacttggcttcaggactctcaattatagttcctcagctcatttgtatttttcagtaatgtgtatcttatgatatttcatcactaatctatggtggaacctcttcaaatgccaaattagtcacttattttcccttctattttaacattctaaaaaatttcaaagttggttttgtttatggacaaattttctattccaacatgtaaataagaagagagctaaaaatacacaactctacaaatagttttcaaaaatcagttagcctttagtaactgaacttagtaaaaaaagattaatggactttcctggtggctcagtggtaaagaatcaacctgctaaatgcaggagacttgagtttgatctctgggtggggaagatcccctggagaaggaaatggcaacccactccagtatccttgcctgggaaatccccatggacagaggaacctggcaggctgtagtccatggggttgcaaagggtcggatgtgacttagtgactaaacaacaaccagtgtgatgttacacatggtgattgtgtagatgttatcatcatgattagacatcttgataaatggagggtagaaaatggagggaattgtgaggaaagcacagttaacgttctgtggaaattagagaagagagctcttcctagcagctgggtcatttaacttggcctcgaagaatgcacaaaaaccagacggttgaaggttgaatgggagttgagaaggcagtttaggcatgaggaacagaaagtggtgagttcattttgctgaatcaaaagacccataaagaaattaatgaaaaagaaagtctgaggtacaagtgatacaacattagtatctgttatcctgattcttgatttaaaaatcaaaatttcaaagcctatgcaagaaatgggattagatatgaatggtgactgatttgagaatcccatcagttcaggtcataagttaaatttttgtggatatgaatttttctagaggagatatccataacttgtatctggttttgaagaattctctgaccagaaaaggtgaggctctgctacccactttccctgcatgccttgcacataatacatatgagcatttgttggtttgaatattggtatttctttatatgtgactataaaaatgtgaacaagattgtaacacttgagagttcctgcgatatcatcaggatctgaaaattcagtcattggactatgtcatgcttaaatgaatcttgccattaaagaggtctgtggaatccagctctttgatcaaggcatttaatatattctttctcttgtgtgttgtttgtttgtgtgtgtgttttggtttttgttttttgcttctctccaggggaaaaaggtggatggctctgtaaatgcctatgccataaatgtatctcagaagagaaagtataggtatgcatagctgccattattatgtttgaactaatataaattatatgcttgagaaagaatttgttatgggataatcatgtttgtaggaaatgtagcagttttccatacaatcccttactttagttaggtttccatattgttccttattactctt

SEQ ID NO: 34147 - DNA, 2476 bp, Bovine  19866880678354
ctcaatacaacactccaaatggtggaatttgttaatgccaccattacccagatagaaaaacagatgctccatgaagtcaaacaatttgttaagattacccagaacttgatttcaagactcctggctgtaaagttcacttgttttaaacaattacactccattcttaattggccttttggagaacttccttgaaatgcgaagagtagaactttgtccaggtttatctgagtctagactaatagaaatgcatttgctttatctgacattaatgaaatgactaagaacagtttcactttgctaaatatagtgagaatataaagtccttgaggacagagatcataactgatttttaatgtttatcacaggaatggattaacattgttagatatctggaaaattctcaatacctcctcatatctatagactattaatattgatcttcatccctcatctacatctcattctaacaagatcaagtggtatctaagaagaagtattctccactataacttgttagagttgtgccattcttagtatatttgtgaagcaatataacttgtatacctttcagaactctgatttcaagttcatgaaactataggacagaaaggaagacttttgttaatttaactttgatttagaaatatatttttgatgtaagtaaaagtagataggggcttccttggtggcacagtggtaaagagtctgcctgccaatgcaggaaaagagagtttgatccttggtatgggaagaagcgcctagagaagcaaatggcaagccactccagtatcttgcctggaaaattccacagacagaggagccttgccggctacaatctgtggggccacaaagagtctgacatgtctgagcatacacacacacaaggtagacatgaatccaggactttaaaataatctgttcaataagctattttctaatttgccagcatcctctccagaaaaatattgccagctcaactattaggcaaagttgaacatctgaaatcctacagaaagttaaggatagtatgagacatgttttcctatacaagtaccttgttatatttccaatttggacctttttggattagcagcaaggcaatagctttaagcccagtatcaaccctataccatttatattttagcacattctttcttcctgatacattagatctagggtttatacttttgactattaatacactttataagaatagagccttatcattgccttcccgtttcattgtatattgtatcttaccaaagttctaccactgttggtataaattatggttttatttcatttttatagttctggagtgaggaagagtgaggtggtaaaacttcatcctacctaaatgctatgctccttcgaggctgtaaactgacagatccactacatggctgattcagtgtattgcgtttgaaaatgatgtatcgattggtgtaagttacaagcaggtcaaagccaaagttaaaacctgtccaccgccagcagtactgaaatacaaaagagaaagatttacttcattttatcatattagcaagtcaaaaattaaaagatcaaaatgtcttttctttttaaaattcatttcaaatattcctgtatcatggtttcctaattttgtcagtgccttaagacttaccacacagaatacatataaaaggtttgctacacaaacatggtgtacatcaaagccagcaaaagcagcctttatgatcattattccttaaggtactttcttaatattgtctctttatgatctatttcatcaactctccacactgtaattttatcataactaatatggctttttactacaattctaaggaggtgtataggttcggaaactaggagtctagataaaggtagtaagaatccattaaaatttctcctgctttaaaaataccttaataaaaataccttatttatactctgaaataccttaagtgataccttgtgtgatctctcttacatgtaaaatctaaaaaaaaaaaaaaatatgtacagctacagagaacagctgggtagttgccagaggcaaggggtagggagtaggagaaatgaatgaacactgtttttttaaaaaaaaagtttaaaaaatttaaaaaatactctaaactaaccaacagaatcaccaactgagtttttttaaataccatcatgagggacttccctagtggctcagtggtaaagaatcgcctgccaatgcagaagggacaggtttagatccctgacccaggaagatcccacgtgctgtggagcaactaagcttgtgcaccacaactattaagcctgtgctctagaaccggggaactgtaaccactcagtccacgcgcccttagagcctgtgctctgcaacaagagaagccactgcaatgagaagcccacgcaccacaaccagagaaaaagcccacagagcaacaaagaccccagtgagccaaaaaataataataaaccatcataagctcacaag

SEQ ID NO: 34148 - DNA, 1039 bp, Bovine  19866880691748
tgagcactcacacacactgactagggggaaaaaagcctcacaaactgacatttaataaaaccattaattaggtgatgaaaatcctttaaatcatcgatacatctattgaatagtgttcttttcaaattcattttttcttaggtaatacgaggaaatagtatcatcatgttagaagccttggaacgagtatgaacaatggctgtgttcaccagagaaatcaacgcttccatgtgtcccctctccacattttactaccagaaaaattgggttgtgtacattttcttacttttttgttaaataaacttttgtaatagccaaaaatgctttcttagctgttctcaacttagaatatctgctcttattctgatttttttctgtcatgacctgttattggttgagactgattagttcagaggtttttaatgcgttaaaatagaaaaatcttattaaatatgaaacattggcaagatacccttttcccatatcttttactactgaacaaaattaaagaagctgcaaacctgaatgggtttcttctaaaacattaactggaattttcaaagttgttgcaataacttggacagactctgactttttcacatacatctacattccaagtacagtttcactcaaacaacatgggttaaactgtgcaggtccacttatatactggttttttccagtagtaaatactacagtactacaccatccacggctgaatccacggattccagactgaaaagaggaactgcatatgcagagagctgatggctcagggtcagtgtccataaccccccagtgttttaagggtcaaccatatagtggaacagaagtaaaacacaggaagtaatgatgtctttgttttattttgaacataagtgggaaaaatttttgaatacaagagtagaaatacaattccggaggaaaacattccagtgcattgtggttctttgtgggatagaagatggtgataatgctgcccataatatactcacctagtttgtaaattttatggtgcacaaactccagtaagagaata

SEQ ID NO: 34149 - DNA, 1250 bp, Bovine  19866880739180
tcaaataaagtcattctgtctcaaaaattcagaatgatattcctgttactgcctttcagtgttttcaaatttcactaattttgtatttcttaacaaatatttatcattgtataactgtaaaatatgtttcttcttcagttttgaaccacctaataccaactacatgtgggtaatgagcaacaaaaataaaatattctataaaatccatgatgctaaatcatgtcagtaatttttgttgcatttgttatttaaaagacaatttgtttgtgagcttgttttgaggcagtgggagggattgcacagatcttggccttggtgcttgctattgtttatctagggggacaacatgcaacatttcacgtgattatattcccctgggcttatttaggataattttccacctctttaccctattctgaggaagggacacttaccctgcctttttaacgaagaagcaaccacaggcttcttcaggccacttttccttagattactgctcactgtatctggaggtagcagggaactgttcgtctgtgcacctaaaccacaatcatcatagtgtttaacaagacgtctgcagagtataaatcaattcaacgttaatttctgaagtctaaaacatataaaatgcctgttaatttctacattagcttagcttcagtttctaaaaggaattagcattagcctttatatataacatttaaagtgtcttacactctttacaggaagttggtggggggactagaagtgaaaggaagaaaataaattcaccctttgttctacgtctcagacaatcactatcaattttctggtgaagcagtgttcattttcttttttataaatagtttattttgctggttttgtgattttaaggacctgtgattacatccgccttcatggatcactgccttgccgtggcgaaggggcttgcgtaactcaatgaagctatgagcatgccatgcagggccactgaagaccaatgggtcatagtggagagttcggacaaaatgtgttccactggaggagggaatagcaaaccattccaagtattcttgctgtgaggaccccatgaactgcacaaaaaggcaaaaagataagacaacgaaagatgagctccaccctccttgctccccgccccccctgagctcagaaagtgtcccctgggctaatggggaaaagtggagggcatcactaatagctccagaaagaacgaagcagctgggccgaagcagaaatgatgctcgttgtgg

SEQ ID NO: 34150 - DNA, 2954 bp, Bovine  19866880746553
aatctgaccaatggaatttcaaggaggacagggaaggctgagaggaacagatcatcaacaatagattaagaagatgtcccagaactaaaggacagaagaactttccaggttcagagtgccctgtgaaaccgaggaaaacaacagcatcactgtgcatttcagaactctgaggtccaagagaagatcctacaagcttccagagggaaaaactagatcacattatagggatgaggaacctgaatggcttggggtttctcaatagcaacactcaaatgagaaggaagtggagtgatgacccccaaattattttaaaacataagttaaaatttttccaatctagaaaaattaatatttctaacctagaattctataatcagtcaacaatcaatgacatatgaggacagaccacaataaaggcatttgtggccatgtaagttctacaaactctacctaccatataccgtttcttaggaagccattggaagctactggaaataaagcaagaaagataaggccatgggattaaaaaatgaatttcaagttagaaagaaatgaaaagaatcacccggaatatgatgaaagaaggttccagaaggatgtctggggaatggatatataaggtaattgtccagactggagaagtgttactcaagggacagacacgatgaggatggccctcactgtgccctccactgcgggaccaacttgttaacctggtgagacacctggagcatctactccatccaaataaggtattaaactaaaaagaggaagacatcaaagaaacagaagatgcaacaccaaatgagagccaaatagttctaaggatgacagcagagaaaagccagtcccagaaagatagttatccagtggagctagagagcaaatgtccagataggagaaagcaggtcttcatgacggatggcttcaacaggaaaaaagggaaaagaaggaaagaaagaattagattggctgatgttgatggccttgtagaaaaatattctgagaagcttttggaaattgtggggtgagttagcaattaagtacaaaaaaaaaaaaaaaacctaagtaaacaaagggccaaggcaattattaactacagataaaaactaagaaaggaaacataatcgtagtgcactacagtgctcagctgtgaataatatctgtctaagcatattatgtaaacagtcaccactgatctaagaactgtaatctaactacacagggaggagaggaaacaggaaacagaggaatgagcagggtggtgtaagagaattagatcctcatctaccataataggaagtcagtagatagcacctacaaatggataaagtaaaagataatagcatatacctgttattgagaaacatggaaaagagcagttgacagctgtggcctctggggagggggaagatggggaaaacatggaacagagagtcatatcttcttacaaatagtttagttcaagttgatgtttgaaactatgtgcactgttaaaacaaaaattagttttaaaaatggattaatttctcctagcacctttgcctgccaatcttgtagctggctgcctctgtatgctgtggttccttttttgacttctttgacccaaaggtaaggcttagaaaataactacaatcccacctcccctaccctccaaaaccacctcttatttttctataggtgtatgtttcttaaagtgagctgttatctcaaagaacaaactgtctgggagaataaaaaagtggtcacaagcaagaaacacataactataattttaaatatttgcagacaacactgaaatgcaagttaacaccttcctaaacatcagccatgttaacttatcatgtagctgatttccttttttttaaaagctatcccttggttttattttaacttaaccatgtgaatacgtcacaaaaaatacacataccgaagccaaacaaactatacagtcaaactaaatatccagtagataaaacatgtagtcagaaggtcaaagatgaatagccattcaggggctgatgaacttgtttgcatagtttttaaaaatctacttggaagtaatgaagtttatttcctttttgacctctcaggaaatcttgaatttccctctccctttgcatttcctgctcagaagtctaagtgtagcctcccagctcctggggacctgctctggggacttcaaggggtccaggctcctggctttagcccatgtccagtcctttcttacagtctcatccttcctttgagagacaaggacatacatccctgagagcaatgacctgcttgctaccccatgcttgacacagaatatactcaaagataattagctgaacaaatgaaccgtcttcctaacctcagaacaacccctaaacactattgaggctggagggatcctagtttatctagtccaactacctgattttgcagaatctcttaaaggagccaacatttgttaggtcacttggtgagtcagatactgaagcaggtgtgtgtattagtttcttagggctactgtaactaagttccaagaaccaggtaacattaaacaacgtgcatttattctctcatatttctagagcctagaagtacaataatgaaagtgtggtcgtgaccacattccctccaaaggctttagggaaaatccttccttaccccttccagcttctgctggtagccccagcagtttctcagcttgactccaatctctgcctctgccttcacatggctatcttctctctgtgtctggggggtcttcatgtcctcatatggcattctcccctttttatcttcacatcttctttttaaaaggacaccaatcctatttgattaaaggaccacccaactccaatatggagtatagcttcatctgcaatgaacctatttctaaatattccaaggtagccagggttacaatttgaacacacctctgcaggggtatgttcaatatataa

SEQ ID NO: 34151 - DNA, 1349 bp, Bovine  19866880838550
ctgccaaggtggccctgctatctgggagcgctgcagatagccccgggaaggcaggcaggtgggggacccggcctcaggggcagtgaagacttactgtatcagcacacatgtgatgatgaggacagccagggccacgatggagaccaccaccaaggcggtgatggcctgcttcttctggctggcagccaccacggccaggaggtctgcgtgttcacagcgtgcaccgacgtacccagagtggcagctgaggaagacagggacatcagcatgctctccaggcagaggtctcattcactgtactccccaggaggactggactggagagacccaagccctacaaaaaagcccaaaggggcccctccagccctggctattggaggcaaaggtgtcggtaaaatcgccccgactcccctgcataggcttctcttgcttggagaacgaggtaactcatcagcttatctgcggaggcaaggtgctgctgaagcactctgttatcatggttactatgccagatcctgggggagtgaggaaggcagcaaatgtgtctaggacgtgaagctcattttggcagttcataaaaaaccaggttatttttaaactaaatgtgtgtattcagaattcccagtgatgagagaaagaaaacacgctaaaccatcaggagacaaagactgtggcttgatttttatattctttgtcagggttaattagtcctgcaagcatttaccaggtgatccagcgcacaggggcacgtactggagtagaaccagcagcactgtctcgtaactgtagggcctgaaaagccccaggggtcttacatttgtgattcccttaatctgggggcttccagaccccagatgccaggagtcacaggataaatacagggtatttcctggaggatagcttttgctccatgttaacaaaatcttaatcattttaatgttaaaagaacaagtactgtatgggtttaaaattaaggcaaacaggagatgttgcaaaaatggctgcctaaggccacagcctgggatactggagcatacagcttcagtctctaagactgcttaatggtaaagtttcccactggtgctctttattccaaagctcaatcgttatgtacctcatttaaaggcatttttagtttgaattcaggtacttgctttcagttaaagattaatttacatttgacccatgttttctcatttagtttgcacagaaaagtcaagtcatttgcttgtgaccaccatgccagggaggctcaggaggtaaagaatctgcctgcaatgtgggagatcctggttcaatccttgggtcaaagagatctccggagaagggaaggccactcactccagtat

SEQ ID NO: 34152 - DNA, 894 bp, Bovine  19866880921984
atagatgagagaaggggagggcaggcccatagagggatgagcacaagttgattaaaaacatgatttcctcccattatgctgcttctacctgcattattcttggcaggttgaggtttgctaaggctggtccccactttagttgttctgatctgactctgattgtacaccaggaaaagaggacctccgtgaaccagtcaactcaaagagtcagttttgttgcttattagcaaatcactgaacaatgcagaagtgacaggagaatttgggcttggatgtcttcctggtagagttttgaaatagggaaaaaaagcagttcacttattttgtgagcttgtggaggcaggatgactttgggggtcaagaacaggagcttttagcacacctgattcacatctgtgccccttgcttaacagttgtatgctctaggccacacagcttcttcaagcctcagttccttcatcaagaaaataagaataatactccaaatctaacacaaactttaaaaacttgatgatgcaatatatgcatggcatatgcatggtggtcaatcagtaaatgatacagccaatagtaactgttattgcttatggccaagatttggataaaaaagatatttgatagatttaatgagatgggccatttggcaaagaaattcattataatacttattgggggcttccctgatagctcagttggtaaagaatccacctgcgatgagggagacctgggtttgatacctgggttgggaagatcccctgaagaagggaaaggctacccactccagtattctggcctagaaaattccatggactgtatagtccatgggattgcagagttggacatgaatgagcgactttcactttcactttcctaatacttgttactaaaagtgaa

SEQ ID NO: 34153 - DNA, 1422 bp, Bovine  19866881140774
agacagaagagacctagcttagggggaaatttctacttgtttattcacttctgtactgttgagaaatgtaattatgttcataaagaaggctcctcaaagtcatgtacacatcttactaggctgtgctaactgatcagttgaatcgacttctgtgctctactggaagaaaatccaacgtggaaaaattcagattcctctgtacagcagaaatcaacacaacattgtacatcaactatgcttcaaaaaaattgtttttaaaaattcagattcatgacaccaataacactgggaaattactgaatggcttccagcatcaccagagtaaagtaaaacgtatgcacacattaggaatttaacttggctctgctatgtaagctgaggaactcagtctttgggcctcggtttcgcctctgtagctgatgatgacaacagccacctcaggtcacagggaggagcaggtgacacatggaaagccccactactcattgtcagatattagtaccatgatttcttaaacatcaaaattccctcaacaacttgattgactcccttggttttataaaaacatcatcattgcataaaatcatctgagaatggtcctcttagtagaaagggttctgccagagagatttgacacatacctgcccagatcacttttcctactgaaacctgtaaaacttggatgagccggtgaatgtgtgcaaatgatttctttccaccattcccaaggcctcccgcccattcgccccaagcctgctttgtgtgggtgcgtctcttttatggtctgtgaaaggccttcgtcttgtctctctcacctccctgtcctcagacaacaaagccggcttttctgtttgcacaaagtgcttgttgctctcttgagccatgagaaaacatggagcagaagagtaataatgtgctccttctttctgctccaataaaaagttatgaaacagaagcctggggccaaggcaggctcactgttgtgtgtgttgacaaagaaataatttctgtaagcacagtcccggggcagatggcggtaaactagcctgtggcccagatcacataatggagaggctcctatcctgtccatgagatcctggtctctggacccagtcggtgccagagcagcagacaggatcccgaccttccattcagaagcccctctctccactcagggaagaggagtggagggggctgccctccactgcaagagattgaaggcccctggggctggccccaattgccagcccttcagggatctccatctggtcacagggacagttattgggacaaatacaggcatattctcagttttccccactgcagtactaaattgatcggtctgagaaagagttcaggaatcagtgttgttttgtttttaacatcttcagttgttcctgatgagcagccaaatttaggaag

SEQ ID NO: 34154 - DNA, 1827 bp, Bovine  19866881165080
tacttacaattgcaggcagattcgatgagtaaacatctgagctaccaaggaaacccttagatataatgttttagcttgcatggagtgtcagtattactatggatggcatacagtcatttacaaaattgtattaaacttcctgtggccggttgcatttttcaaaatcggttgaaatagtatattcagtctcttgtgctcttccaaccccaccctccttacctagtcaaaagatggcatctttgttcctattctttggacctgagtggacttcttgggtgagcttctataactgcacaagaaagtaatgcttttgaagctggctcttaaaaattgatacagcttccatctagttcccttactcagagcatatgcctgcggacccctgaagtacaggtgccccgaagtcaccatgctgtggagaccacacagcagacaacatgtacgcagagaatgtcagaggaaccccagctgtttcagccccagcaatttgaacattcccagactcaatggcaaacgtgctaatgaggaaaacagatgacccctgcatcatccctgcctcacggcaaccaggtgagagaccctgagtgagaaccacctagcggggcccagcccatctccagattcctgagagacgacaatagtatatgattatcattgcttcatatcatcaacgttggggtgttatttcatgtcacaatagattaccagaacacttctagatagaagtgtggggggcgtctagcccagacttctgaatatccctccccagtactcactgaaatggcccacagcacatagaggggaaatttttaccctgagtggcaagcgcctctctgatagccagtctggctgctggcccagaaggaggtgaagacaaaggcaagataaccttcagccctttggggcagtggctttgcaaaacattaagaagaaaccttgcaggagtgacattccttgccagatggctctcttcacaatctttataggctgctggaaggtaatcgatcgtccagcctaagatattagaagaagattccaagggcatccaaatagacaggcagggagccaagaagaattagctcatcctctttgggaacaaatgcaaagcatgtattaatcttttaacattcaaggatgagtaagcataaaataggatataaaaccatgaaaaaattctggaacatagaaaagagcatctaagagacagaagaagaaactaatttttcaagttttacaatatgaagcagaagtaagtttgaaactgtttcttctataactttgatagactgaacagaacaaaaaacatagacaggatcggagtataatattatttgtgaggtagaataaatagttatgaactagattggattattccatattctagagagaaaagagttttttacaatcatctactgaatagtcacaaaaactgacaaagatatttttctgcaaagaaaacctcataaaatttcaaaatgaaaaaagcatctctggacttgcctggtggttcagtggttaagaatctgcctaccaatgcagggacataagttcagtttctggtccaagaagattccacatgcttcaggacagctaagcccacacgccacaattactcagccggcgtgcctcaactactgaaacccatgggccctacagcctgtgctctataagaagagaaaccacctcaatgagaagtctgtgcaccgaaactacagagtagcccccacttgctccaactagagaaagtccacgagcaatgaagacccaaagcacccaaaaataaaaattaatttattaatttaaagaatagcatctctgtccctactg

SEQ ID NO: 34155 - DNA, 1795 bp, Bovine  19866881308814
cttcgaatcaagtttgagtatgggcacccccgcaacgggcatgtggcagagtaccaagaccagcggccccccttggaccagcccttggaactggccccgctgaccaccatcacttttccttgaagcaaaacaagagtcttttgctgctaaatttgcacatccccaccctttgacaactttaaatactagttagacacttagatggctctgttccttagtgaactacttttagctaagatgcagtttctcagtgcattcaagtgaattcttttgaagaaaaactcttcttgtaaatagcccttttggtgctgctctgtatagtctacatttaaccttggatgatattcctaggtagagtttttaaagaaacaaaaccagctcacttatcttcctgaaggactcacctttagagtttgtttcaacctcttcctaattctctaagaagtcagcagcactccaccttatactaacatgttggaaaattaataataccttggttagggcaaaatgttgaagatcatcctgacagagttccaatcatatccttttattttcttctcaaataaagcacagtgtcactagtttttataaattatatcttgtattggcctaattataaaagtataaaccttttgggagatttaggtgatagtgaactaggaaaaagagattcaggtgtcaaggcaatattgattgacgtttcaaactaatgcttgtaattgcttgttcacttcatttttatttccttcattactctccaaaaagcttaacaggtggtaagattcagtttctattttttaattcactgatcacagaatggagatactgaaagtcacagaatagaagcctgcctttaaggagaaaagaagagaatggaacatttcctatttgcctgttacatcccaggcattttcatttataatctcacttaatcatttttctcatttagtcctcatcattatttgaatttagccaccactccttttataaagttacacagtctctctgagattaagtatcttactggaaatagcattaaaaatgtttcattttattccaaagtgcatgttctttccactttatcatattgctttataattataaattcttcataattcattatctttggaagacaagagaagtgtgtaggtaggcatttttgattgcacataacaaaaagccaactctaaccagctcaggcaaaaacaggaatgaatgactggttcatgaacactaaaatagggctagacaactatccttgggtggagcgggggtgtggttaggcctcagaacccctgcagccagggtccatctgacccatctctacctctcctgaggcttcattactatcaacacagtgcagctccttctggtaggatatctggctcctaacacatcctggacagcaaagagatcaaatcattcaatcctaaaggaaatcaatcctgaatattcattggaagtactgatgctgaagctggagctgcaatactttggccacctgatgtgaagagccagctcattggaaaagactttgatgctgggaaagactgaaggcaaaaggagaaaggggtggcagaggattagatgctaagatagcatcaccaagtcaatggacatgaatttcagcaaactccaggagatggtgagacaggggagcctggtgtgctgcagcccatggggtcacaaagggtcggaaaagacttagtgactgaacaacaataaatgcacctggaactatggctatcacttccgctctagagcaggactgactgctctgctcagcttcgaaagt

SEQ ID NO: 34156 - DNA, 1648 bp, Bovine  19866881469029
acgtgggagaagactggaatctggagtttcacagatcgtgtaaattaacagatcaggccttccaggagtaaggtgtgcttgcactggatggttttgagaactctactattcaaataatctttggcagacatatatcctgaatcatatttatgcataactatgtacacatgcatgtgtataacatattaaaagatgttaatgttatgactccccccttctattaacaaaattttgctcatttttttccctattaccttattcttttttaaagatttttaaaaatatggaccattttttaaagtctttattgaattttgttaacattattacttatgtttttggttttttggcccagaggcatttgggctcttagcttcgccaccagggatggaacacatatcccctgcattggaaggcaaagtcgtaacctctggaccaccagggaaatcccccattaccttattgttggtgaagaatcatgaatgagaacctccacttatgaaatgcccatggggtggtttgggaaccttttaggtatctgtagttggaatctagaatcattactctagagcagtggttatcaaatctgagaatgcatcagaatcatgtgggggagcctcttaactccacctccagagttttggattctgtaggtctgaggttgggcctatgaatttacacttttaacaaattcccagttgatggtgatgttcctggtcatggaaccacactttcacaaccacttagttgtagtaacttcttataggttgaaatactggtctggatataatgaaaatataaacataggggaattttaatcatgcacacgggatcttctacctttttcagattcttttgtgctccctattaaagttgcctgtgacctcctcactggggccatgctttgggtggacttgattccctgggttttctatacgttggtgaatctgaggaaggcttatacctcagatgtgagaagacggagcgacacccacacactctccctccaggctgaacattcatggtggccttaaatattggtcttaaaaccctgcttttaccttaagaaagagtgaatttctgatagggactcaaacatagttgaactttgcgaacattatgccaagtgaaataatctagacacaaaagaacaaatatatcgttccacctatataggataaaattcaaattcatagagacagaaaacagaatgatggtttgcagagtctggggtaagggagaaatgatgagttattatttaatgagtaggaagtttctatgtgggatgatgggaagaagttctgggaatggatagtggtaatggtgtacaacattgtgaatgtaatcaatgccactgaattttgaaataagtagaataaaatgtagaaaataggaataaaataaagcaaatattatagcaatggggaagagatactcttaactattaaaaactattaaaatggtaagttttgtcatttttttttaaccacagtttttttgaaaaaatattctgcttctgttactgttctcccagtggtatcttggggaattcttgtatcaacccatcagagtgcatgctctgtcactcagtcatgtccaactctgcaactccttggactgtagcctgccaggttcctctgtccatggg

SEQ ID NO: 34157 - DNA, 1191 bp, Bovine  19866881498269
acttatatgagagacttaaaacagaactatgaaacaccactctctcctttatccctctcctggttccaaatggaatatcactggcaaaaaaaaaaaaaaaagaacgtagtctgaacagagatgattttgaatcagatatttcaccattatcatcatttaacaaaataatcccagtgagtcatgagaaacgcaaggttctaattaagcatgaaggtaaaactattgcatcttcaaaattgaactctttcttgaatatccatcagcagcatttcgcaaacttgtctgatcataagaatcacctggagtttgttagacatatgaattctctagctcctctggaggttctgatttaataggtctgggatggggccctggattttgaacgaaactttaaagcattttaagctgagcccttgaggaagacttaccttttagttcagggctagttcatttgcgcttcacggttggatgtgatcttcattcaggtaaaattaccatggtaactggtatcttatgcctggctttagtaacttatattttgcaaaggacgtatgcccatgctcgaagccttgactttcagaatgttcttttgattgcttctgtctctatttcattaggggtgaagttcagaagtcttagtgcagtataaagatgtcacacaaaaatctcatgtaaaatgaaaagcaagtataggctattgacttaagaaatttcttaaatttgtcttctattatcaaaccctcacctgaggagctttgaaaaatggtgatagagccccacaacagagattggtttaatggactgaggacaggacctcagctttttgtagctttttagagttcctaatgtggctcagtggagaaggcaatggcaacccactccagtactcttgcctggaaaatcccatggacagaggagcctggtaggctgcagtccatagggtcgctaagagttgggcacgactgagcaaattcactttcacttttcactttcatgctttggagaaggaaatggcaacccactccagtgttcttgcctggagaatcccagggacgggggagcctggtgggcctgccgtctatggggttgcacagagttggacacgactgaagtgacttagcagcagcagcagcagcagcaatgcagctcagacagtaaagcgtctggctacaatgtgagagacctggttag

SEQ ID NO: 34158 - DNA, 1009 bp, Bovine  19866880385303
ccctggtttattcctggcttgggaaaatcccttggagaagggataggctacccattccagtgttcactggcttccctggtggcttagacggtgaagaatccacttgcaatgcgggagacctggattcgatccctgggttgggaagatcccctggaagagggcatggcaacccacttccgtattcttaccttgaagaatccccttggacagaggagcctggcaggctacagtccatggggccgcagagtcagacatgactgagcacacagcctccctggttcctgaaggtgggtagacctgcctcatttcccttcttatacaaatagagtttgtctctagtcttacagaacaatgctttttgtaaccctgagctggcacttgtggattctaaatataagccaagacacttctcagagattataatcagaattttgctttacgtgtgaaatcttattttgaattcaggtacacaattactcagagacataattatactgccttaggatagtataaaaacaacagttttaattttttttttttggtggggggaggtttacaaaagtaaccttgttaggaatcggaggtgactacagtctgagaacttcacagatacaaattaactatcagctgtgagatttgcctatgattccttcatgtttattcagaagtaaagatacttgcatgggggtcccccctcctctcattatacttaatgtaaatctagtggtgcttgcatgtatctttaaaaattgtagagaagtggaaagagaatccaaccagggatggctcatgggccactggaggtgtggccccctcagtgctttggaaaatattctgggttttgaacagcaacacctgtaattatggaggcgtcatcctttccataaaaaagaaaacaaaaccaagaaagcaaagcccttctactaacaaggtatagtcatagcatgtgttcagccttcccaaaacctgtctggcatttgtttctggcctggtagggaatatcttccat

SEQ ID NO: 34159 - DNA, 1924 bp, Bovine  19866880420994
tctcaaataaggaggaatatacatatttatgcatctacaggtttttatttgaagaattccaatttttaaatgttggcaacacattccttttcttaaaaaaacatggtgggagccaagtcaaacatggctttaggcgatcactctgctccctccgcagagcccagcttgtttgcctggccctctgcttcctccatgcagaagggcatcactgagaattcagctcaaggcccacagtccagacagtcacctctggtccacttttgggcttggaacctgggaatagtggtaccctttgatccagatgatcagggctccactggtcccacacttcagagggtcacctcccgctgtcccccctgcccatgaagaagaggagggtctgctgggccaaggtgtctgcccacccagagctcacaccccttcttctagaccagcctctgactcctggcaaccccagaagtccctacatcagaggcccagagcccgtttgccagaccagtgtatcagttttccattgctgtagaagaagccgcatggcgttaaataacagtcatcccattgttattacctctcccggcgctggggctggcaggatcagtgcagcggtcacccctcgggtctctcctgccgtctagttggtggcggccaaggctgaagtcatcctgaggttcttttacccacacgtctgcggtctctggctgtcagctgaggtctcggccggggctgtcagccagaacacctgcacgtggcctctccagggcccctgtttcctcatcacggggcgaattatgctcagagcaagggtcccaagatggggaaccaggaggaagctggatcacttttaccatctagcctgtggggtcacttctgccgtacttactggtggaggcagaaacgaaagtctgcccaggttcaaggggagggatgtgaactccccctggatggtggaggggcaagatgtcatggggagaagaacctggatagtgggagatgcttccttccggggccgtttgggaaagtcttttctgcagcagtctgcttgtttctcttctctgcaggcctcctctgaggactggctagcagtgggagagtccctggggcggtcgcaggggctgggagcagtctggtggggcataggccggctgtgctcaggccagcgcccaggccccctgacccgcctgtgtcaggggcaggttgcctggagggcagggcaggccctctggatgcgctttgaggagcccccactgagagccacgtgtggacaaggcagaggccagctcctgagggatcagagtgacaccgccgctgagcaggaagggccaaggggaggagagagacggagataaatgagcccctgtgtgtccactgacctcctggccgagcatcttgaccgagtgtgtaaaggagaatcagcacttggcttgcagggagccgtgagggattctacgtggtacttcctggccagaacttggttttgctcagatgggacaaaaagacacacaagtcagatatcacataatgcaagtcactgggtaagtttgggtcaaagcataggcctttctaaagatgttgttttctttaaaacaaaaatgatttatttatggtcatacttcttggcatggcatgcaggatcttagttccagaccggggataaaaccccggccccctggagtcttaacaactggatggccaagggaagtcccagacctttctagaaggaagagatcagagtcctggttctcttatacccgctgcaaatcaaaatcacctgggggagcttggtgacctagtgatgcccgggtcctgtcagctcagttctgaagcaatctgtcccttggaggcctagacttgggggatttttctgaacttattttttataaatgtaacactggtttataacattataaaagtgtcatgtgtacaa

SEQ ID NO: 34160 - DNA, 1332 bp, Bovine  19866880444764
caagacttgtccaggggctgcattctgcccaggagggcacaggtggcaacgcctgcagcctcacaggtccccggagcacaccgtccacagggcagttggctccagggggaagctggggtcaaacggatctagtgggaattcaattatggtttggagacgagtctgcgaggtcgctaattaaacaagggcagagtctgtaactgaggccccaggctccaggagctatgtggcagcccccacacagagccaggccaggcccaggagaaaacgcaaattcaaggcaagaggtagattggatcagttgagacatgcctctcgactaacaccccagcctacggttatcaatactctataaagcatgttggaactgctgtttacaagtatctgttaattattaaaatggaatctattttccccccctccatctagttgagaaatctcatgttacacagaaaggttaattacaaaccgacttccaagaaccctttgttggaagcttctgtttcattttctccaagatgaatccttgaactccatatttgggaatgcagacacaggctggcttagcaaaatcgtttcctcattctagcagcccccagctctagccaacctctcagatggcctgatgcagctaggattaaccagaaaccacttcaaacccctcccctccacacaccatctaaaatgtggttttgttgctttttccgttgagaccgaagaccaccatgtttgccacatgttgtcctggttgcaaaagtaagagggtctcaagtcctgggaccacaatgagacatacaatattccaggggctgcaccaattaggtccgtttgcccccagccttggggaaggtaaatggcctattacttggtgggtaatgcattccacatggcattcctcagcctcgaggaagccggagaggactcattttcctagcaagcactggaggtgtgcagtacagagcaggcccccagcaccaaggcttggccccttccccaccatcacctgtgccagtgagcttccctgctcgccaaaactccactgtgggcttcccagaattcagttctttatagccatgcttggaaaccttgtatatctctatctgtagctgactcttgaacaacacagcttgaactactcagatacacttgaactactcaggtagttcacttacactcagatttttttcaataaatactatcaatacaacactacacgatttgtagttagttgaatctccgattggttgaatccgcagatgcagaaccacagatattaatacccagggctgactgtgagttacactggattttggagaagggggcagcagagga

SEQ ID NO: 34161 - DNA, 946 bp, Bovine  19866880475150
tctgcaggggaggcacgagatttaattgcacactctgagggacagttacagcagtgaggaatgctgaggggaaggtgcaggcgccatgggcatacacaggaaggatgctgacacgtcaggacatcagagaagtgtccctgaggaagtggcacttcagctaagatctaaaggatgggaaacaaaaagagagagggggctggggaagaatgttcaagacagcgctactccctgtgccatagttcgggctctgcaaaaacagtcaaggaagcccggaggcgaaaccacagcacgtggagtgagagaaggccgtggaggaaggaagtgaatgaagggggccaatgaaagatgctcttctgcttgttattcttgtgtgttattctgagaacaatgggaccacatcttgtttggagacattgttccaactgtgattcggagaaggaattgggggatgcaagtgtgtgtggagagagcagggcctcagcccctctgagaaggtggctggagagcatgtcagacatgccgaaggagctagcccttcccactcctctccatgaggaccactcccatctccacttctgccacatggttagggggtgtgttgataaagatggtggtgctgctcatagtaagggctcctcatccacaggatcctagatcaagggccagatgcctggggcgcagaactgagggagccattcattccctgtctgtgctgcgcacccctcagagtgaatgcctcccttgctccctctcctcccggccctgccaggagggtttatctccagcctcacattgtatggcaggaagctgggaaggagaaggagggggcagcatgccccttccttgaaagagcgtgacccatgaccggacctgtcgctccccacacatcctgcaggccagcatggagtcactgccaccgctgctgcccaagaagctatgcatgtcc

SEQ ID NO: 34162 - DNA, 3685 bp, Bovine  19866880483164
atgtttgtaaccttggacccttgagttaatccttttcttgattgagcccacctcacctttgccctataggaatgcaactctatccaatgctttttggaggctggtgcctgactttagaataatcacctttacagaaaaacaagtttcttaaaatgttaacaggcctccgggccagaagatgatgtaaatcacctaaacttttgcatatgataagtttgcaggaagaaagcctggcttactgcatgactctacccttcccccattatcctctatgcataacttaaggtataaaaactactttggaaaataaagtgcgggccttgttcaccgaaacttggtctccccatgtcgttctttctcttaccttctggctgaattaattgttcagcctcttttctttactgaattttcctactgagctatccttatttcagcctcttttctccactgaatttcctcactgagttatcctcattctattactttttatatccttagttaacgtttaattaagcagttgtttcctgatcctcgctgatgccatctctccttcgaataccctggatcagctggggctggaccccggcagaagttcattatgtttattaccaaggtcaagctcatactgcttgatgcatgacaggccagtaaattgagagaccagttgttggggtaaggaatagtgactgtatttggaaagtcagcaaacagaaaagatggtggactttgttgtaaagaaccctcttgcctgagttagaatttaggcttcttgtatactaaaaggggaggaagtaacttcaaacatttcctgattccgatcagcctccagaggagataagttaatttctccctgcagtcattcatgggtgggcctggtcaggatgtttcctgtgagctaaagaaaagtatttcagctgatactcattacctgggaagcaaggttcccagagatggaccatcatgtatgtatgtgtgtgtattagtcattcagtcatatctgactctttgcaaccccccatgaactgtagcccgccaggctcctctgcccatgggattctccaggtaagactactggagtgggttgccatttccttctccaggggatctacccaacccagggaccgaacctaggtttcctgcattgcaggcagactctttaccatctgagccaccagggaagccctttatgtatagtttaaacttagagatgacatccctttagtggttaacttgtaatagaatgcaaaggtttttccctattacatgctcattagagagaataaaccacaaatgatccctttcctgtaaaatatggtgctgttcaccagtttctggttcctcagaaaacagagggtattacagactcacattcattgcctgtcccttgaagacagactaagtcggttttggtttttttttttttggccattaaaacatgagcagaaatgatatatgccaatttcagaggctttttttttttccagatagaggcatttgagagctggtgtgcacccttcccaggtggctcagtggtaaagaatcagcctgccgatgctgaaggagcagtttcgatccctgggttgggaagatctcctacagtaggaaatgtaggatactccagtattcttgcctggaaaactctggacagaggagcctggtgggctgcagtccatggagttacaaacagttggacacgactgagtacacatgcattgtgcacccctccagcctccctcacctggaatagaaacttattctctgacagttttggaggctaaaagtccaaaatcaagatgtcaataagactatgcttcttctgaaggctctagggaacaatcttttgttgactcttccaggttctggtggttgttggtaatccctggtatttcttgacttctaccatgcattactccagtctctgcctccacctttacctggccttctccttgtgtcgctttgtgtccaggtatccctcttctttctcttataaggacaccagttgttagatttaggatttaatctaatctggtgggcaagacagaaaaaactgtgttggctgaagttgtcagagaacaccaaaggataagacttaataggaggctatgcttaacaggggcttccctggtggctcagatggtaaagtgtctgtctgcaatgcaggagacccaggttcgatccctgggttgggaaggtccgctggagaaggaaatggcagcccactccaagtattattgcctgaaaaataccatggacggcagagcctggtaggctaccatcggtggggtcgcaaagagttggacgcgactgagcaacttcactttcaccttcatgcttaacagggctcctagtatgttctaaagactgtgctaagcatgttataggtattatcctatttaaaccccatggaggttgtttaccatgagattggtatttttatccattttacaagtgagaaaacagaggtttagtgaagtttttaaacagcttgcccactggtcactgagaattccaatccagctcagtctaatttacaatcctgaggtctagggactttcctgtactgctccttcaattcacctgttcccttgatggtctgctagaaaacaggaatctagattctaaactacacaaagtttggttttctttctatagttatcccaaggctgcattgatcacgtggcaaaattaacagtaagaaagagaatagaatagtcaaactactcttcaatttctatttcaacaatggcttccctagctgatgtttatgaactagttaaactcagctttccatctttctctttatgagatgcaaccaactttcagacttcaatattttaacttggccatggatacaaagatctgtcatatcagaggccttcatttctcctctaagcattaaaacaattagaagaaacagcaggatcaaaagaatcaacatgaaaccaaaccaactctaagaattttaagtgtttccaactttgtttcaaaacatctttatgaggattgttttccaaacagcagtgtgtgaagccttctacttttgaaaactgactttactctggagacatagcctgttttgtatgcctggagaagcaggggatacccaaactggcattcagcagtaacaaatataaattagaccattaaaaaaaattgtaggaatgttaaaatccatgttgactggtttttacatttacccggcagcattcccatgctaccattggcatggagattggaaaatgaaactttccacggatctgtcacttgctactgtttccacttactttaaccgtgaacccaatttttacaaatttttaatgtaaaaaaaaaaaagtttgatatttttttgttttctctttcaagacatttctcaaacataaaaacatgcatgaaaagggtttttaaaaatcagtcaaaattttagttttccaaatactcagctgtttaacattcggataattgccttaaaaaaatttttttttccacatttagtctgaatgctttggcatggggggagccccacagtctgaaagtaactttgtcccgactctccccactgcatttattatagaaactggaagacacatctgcttttcaatagggccagggaaagctgaggtttcaaggaataaagtcgagcttcccagaacttcggggaaacaagtcggagggtcacacctaggat

SEQ ID NO: 34163 - DNA, 2456 bp, Bovine  19866880585103
tggaaatacctggtagagcttgaggtattttatcaggtcggatgagaaacgtcttcccttccaactgtacagagttgtaagcatgtaaaattacaaaactgccccattggtttttacatcctcggtgtgaggctgagtgaaggaaaaaaatagtctatataacagctggacacaagagtgtgctacttccagtggacagaaggatttttactgcacctttccaatgcccatttagctttttatacaaatagctataggcaagcaaccttaaaacagaaaacgttcctgaaatttgcaatgagacaagccttttgacattaactaaagattgaaacacacgagttggaaatgactccagggtgttcggaaatcttgctactgtagctctgaaatcagacagaattcaaaggatggttttccacaaaaggcaatttgaatatcaaccagttaccataagtacttccatccagtgtgtctccagatggagagtcaagagtgttttaagttcaagcacttgaaccgaggcttgatttctcttagctattgaatggtgacatctgcctaggctctcaagccatcagtgaagagccagcttgaaaaggggctgccagggactcaaggggtcagagaccaaggggcttcacatctgagaacctcctactttcagatgtcatgaaacagatggagggaaaatctgtagaaagccaagggcctaggacccttacaacagtacttttcacacttttgtgtagatttgaataccatagggaatctttaagaatgcaggttctgatccaagggggctggaacagggcctgggagtctgcattcctaagcagctcctgaggtgatacagatggctgtctgactgcactttgagtagtaacacgttcaagacaaaagactgtataactgactccctgtagtcaagatgctgaagctggtggaagtttggttcccctgctggaagcttgttaaagttgtcaaattgccactcaaggtgtgtaagagagggaggggttggagagagagaaagagagggagagagactgcatgtaactatttttcctttagcaaattcagagaacagagctaatttctcctgctactattatggtttctctactgagaggtgctttcataagataaacacattcttagtgaccatttcctaagtaaactgtcagtacccagcctctgttagcaagagaagcagggagtgttggttctggaaggacccttagagattaatttcttcaattcccccaatttttcccaaataaagggcctaaaaagcaaacttaaggacaatcagacgactgaggaaagcctttgaaaggaaatcattcattacaagaggaatctcagcctacacatcttggagaataaatacagaccatttttacttttgcaattgctgctcccgccagtgctccatcaacacccctgctcccaactgaccctactgccccaagtggttaaagattccttaaataacttttaatctcattctgtaactttgccatcacttctgatcactacatcagtctcactttgcatcctaaggtttttcctactcactgtcaagcttgatctggcgtttgacttagagacttgcctgctctttcccagagggcacagagagcggtccagcaggaggaaggagtctttgtgcatggccagggaggttttttccgctttcccacagtccatgggtgatgaggagggaggaggaaatagatttcctttgccttcccagcctggcagaggttgtggtcctttacttcactgctgtttctgggttttctgtagggcgattctgaaagctcagtcttggggaagtgtcttggtggaggttttaaaacatgcccacaggtttgacagcttatactttcattttacttttgttagcttatgtgtgtgtgttagtcattgggtcgtgtctgactgtgtgccaccctatggactgtagcctgccaggctcctttgtccatggaattctccaggcaagaatactggagtgggtagccattcccttttccaggggaatcttcctgacccagggatgaaacatgagttcctgcattgcaggcaaattctttaccatctaagccaccagggaagcccttgttagcttattctttagtctatatttttaaacatgggccagtgtgagtggagagggcaatggcaccccactccagtactcttgcctggaaaatcccatggacagaggagcctggtgggctgcagtccatggggtcactaagagtcggacacgactgagcgtcttcactttcacttttcactttcatgcattggagaaggaaatggcaacccactccagtgttcttgcctggagaatcccagggatgggggagcctggtggactgctgtctatggggtcacacagagttggatacgactgaagcgactttgcaacagcagcagcagtg

SEQ ID NO: 34164 - DNA, 1876 bp, Bovine  19866880658551
gggaatatgtgggaataatcctgaccaaaacaccaccccctcccctaggagcccaggagagaaagggtgacaaggatatagaatgggggctggggacagggtggtgggaggggggtggaggcggaagaggaagcaacagaaaatacaaaggaaggaaggagggcaattggaggaagcaactccaccctcttacagcttcaaagagggcccttctctgtccctgagccttcagggaaccaagagggcagggggcccatggaggagacagctgcacgcagtcctggctgcacgcatggcaccggctgccagactggaggggaagcaggctctcctggctccagaaggcagagggctggtactttgtgcttttctctgaagagttggagaaaacagagcccagccctgtgaacctagccaggtccaatttcctcccacaaggcaaattctttcctgtgcttgggaaacacacctggctcgaattctcaagcccgggccaggagctcagagctttctcccagtggatggtccctgggagaaataaaatgcttggctgaagcagaacattttgatggcaaaaatcctcagagggagacaaataagctctccagggctgccccatctgctctcggtaggtagcagtcacagtaatggtcatggcaataaagatgataggaataatgatgggcaccattaaatgagcacttactaagtgacaggcttttttttttttttaatggcctcctcatgattcaaggccatcagcatcagagaccagagcccccatctccacccttaggtacaggatgctctggttggtatcatctgcaacccctgcgtcactttgctgaaggcttcctcctactccagctgcctctgcccactcatcagcaggctgggagtgccagagaataaataatcccaccccccagagcaaccttggccaataaggaatgagttggcggatcaataccccagctcctctgctctttgaatgagagaagtctgtgtggtcttcactggctcccagttgggcttaatcctaataggatgaaactctggtcacccaggatggtcatttgcttgatatcatacctggtgtgggctgccttcctttcctgtctcacccactccccaggatccttcctagtgtttccttggatcaccttcccaagaaacagcttgtgctagaatccttgtcccaaggtcagcttctggggggaatccaacctatgaaagttataggaccattttacatgtgagaaaactgaggtccacagggtttaagaattcaccttcttctgcctgactcagagtactcatgactattctctactgtgatttctatgactttgctgaattctctgggtgccaagtaaactgtagttcaagccagagaaagcccagaggaggcacccgcattgagaggctgtggatctgcagtgccctgaagcagctgaactaggcctaactggttaagaagaaaggctttgcatcaggagacctgggtctcccttctggagatgccacttagttccatggccttgagcaagtctttcaacatccctgtgcctcctcgggaaagggaggctacaacaaatacctggtgaggtgaaaattcagagcagtggctgcccagtaggtagctgccccagaccctgtatccctgtgagaaagagaagagcagtgtgggaggggcagggccagccaggggagccccagtcactctgccgcttgccagccctgagccttggggcaagtctcttgccctcttgtgcctccattcccacctgggtcaggtctgggtatattgtgtcgtgtggatgaaatcagatcctgaagggggggtgggacatttgatggcagcccaaatgccttc

SEQ ID NO: 34165 - DNA, 1670 bp, Bovine  19866880736639
tttgtaaagcactttactgttgacaaagcccttaaatctctttgatatacctctccaccatgactctgtgatctggacaagaattattaggctgcagtgctcagggcagtaagtaaacagtagtcactggtagtagcagcattgtgttccttttacatgtgagggaactaagcctcagttcaagtgccttggcagagacacccgggcgagtgaggagctgcgtgttaggacctgcgcatagcttgccctctctctctttctctttctctgtccagtgaccagtctggtacattctcccagcaagtccctggacccctgctctcttcttcaaagcctgttggctgattttcagcggaatacacagggctttcaaggaagtatttatcccctactttcagctcagcatggaaatcagaaacagaatgtcaaaaacacaaagggttcaggttgcactgctgctggaatgcaaaatcaggaaactttgcttccttctcttgagaggttgtaacaagatggctggaaattaacttggaattttctggggcatgggaaggaggagacagaagtacagaaatggttcatcggtgcctgctctgattggaaagctggttccatgctaagtgatgctgtgtggacatatctttcccacaatactggttggggagcccacaggggtgagcagggagaaaaagaaaaggtttgataatgttatggtccacatttcctatctttccaatgtaagagcttgactatcctcagcagtggttctcccctgaaggtgactttgcctcccaggggacatttttggttgttacaaatagggcatgggggtggacaatttggtagatagaggctggacatccttcatgcacaggacaaatcatctgattaaatgtcagtagtgcccaagtatcttgaatattcttcccaaattaatcctaccatcagagagtagtggaaacagaaaacatatactgtgttttgagggtgccaaggtgatgtatctttgaagtgttttatctgaaaattgcagtgttactctgatattgtgatttataataagaaatttatatttggtcttcatgccttttcttatcatagagctcctaagattcttggaatttcctatgctgagatctataaagatgtcttttgttatattaattaggtgactttgtggaggtgcctcagaatgggtgaatggggagttggttgccaggggagtcagccagtgattagaggactagaactcaagggaggtgagaggagctggagactgagttgagtcaccaatggtcagtgatctaaccaaacttgtctatgtaatgaaggcaccataaaaccccagaaagggctaggtttgcagagcttctgggttgatgactacatggaggtgctgggagggtggcgtgctttgcccatctggctgtttctgagtcatatccttttataataaatgcatgacctagaagataaaatgtttctctaagctaccttagaaaattaatggaacccatggaaggggtcattggaatctccagtctgtagaagtagagaatggttggacctctcacctttagctggttggtcaaagtcccacagatgataacctggatttgcaattggcctcttgcctggaaaatcccaggacagaggagcctggtggggca

SEQ ID NO: 34166 - DNA, 1517 bp, Bovine  19866880739403
aaggggagctagaattctttcagaagagatcatttcaaccccacttggtcgggtttggagttgggttcttagatatcttccactagaatccagagacattcttgcctaaatataaacttaagcttttgtattttgttgtattctcttccaactcctgagaacatttcaggctaacatgaacactcaatcaagcaacatctctgatcactgttttctgctgagacctgtatcattaagacccctcaatctgtactcatgtccccactgaacagatgaggagactgcacctcagaaaggaatgcagtggcttgtcaaagggcacacaggttgcaaacggtggagcttggatttgattccaggcccttcaacttaaagtccacattaatttcctcaatagaactgaatctgctatgcatccggctctgattgggatactggggtgtgtgtggtagagtatataaaatgtttcttgctttcaggcaatttacaacctagaggaggagaagcagttataaacaggtgactaaactgtaagtgtaagtgcaaatgtatacttctaacgggtgcaaacctcacactcttgggactgcagggaagagagagagagagagatgtccttataggtgggactgaggggcatgtggaaaggcttcagggaagaggtggcacttgagctgaaacttaaatttcaggcagaacaaaaggccagtgccccaaaccaagcagtagatacacttgttaaaagtggtttctggctccagatgctttttaaaaaagttcctcattcaactttcagccagtcctccatgacagagctctggaatttcacacatgttctgattattgctcttttttttttttttccctttcgtaattgcacaactgagcgaccaagttctctaagcttctgttcaggcctgaagatttgccgtatttggcatgccttgtgctttccgtcatcatcctgattaaactaagtttatgagacaagcctcttatcactgctatcagcacttttgtttccccattttctgctcattttccctaaataatcagagctaagagctcttaaatagtcaaataatcactctaacagtcactcacataacactcactaacacattaagcgatgtggaaaatggaaccgtggatgagaagaccctaatctctcatcacttgaaccatccattcaacttctcatgaacataaacctgatttctgtgtgtgaaggattatgtgggggctttggaagcagaaagcatgaatatgcagatgatataaattcatttatttattcatccactctataaatatttattagatacccactctatgctctgtttcagggactggggatgaagccacaaaccacctatcgggtagtttcctttgtggagcttccagaccagatgcggaagatggaccataagtaagtgagcaaatctataaataaggtaaattcaaatcacaacaagtaggacttccaggtcaaaatataatatgtccagttaacataa

SEQ ID NO: 34167 - DNA, 1004 bp, Bovine  19866880786279
ggctttcttatttcttcttgctattctttagaactctgcattcagatgtttatatctttccttttctcctttgcttttcacttctcttcttttcacagctatttgtaaggcctccccagacagccattttgcttttttgcatttcttttctatgggaatggtcttgatccctgtctcctgcactgctatgggcccagctaaaaaattagcagagatgtctactactgtagaaaaggatggggtcgggaagccttgatgaatattggccatcaacaatttatgccacactatgactccaacacaggactaaggaggacccagcccccttgaagctatggttgcctcaaacctgcagaaaatcagggtgctgctaacagggcaaggtggagaatggggttggctaggaaacagcaggttcctgagactaggaaatgcctatcactccttaccaggttacccatcaacagaaatgagcaagcccagtttttaaaagagagtaaggattccttttgaccttttcaagataccaccttcctcctaccttctccctttcctttctcctctagaataaagtctgcaaaacatgctgtaggcattcgccttgctcatgagtcaggcacatggttttggtgttcagtgagtgcctgaatcacttgcaagacttggagcacagaacattccatctccatcagagctccttggggggaggaggtgatattatcctgaaagtcatttgtattgtattcatccacctcctttgccaaaatgattcattcttaatcctcacaatcattcttacaagaatagcactgcatgtgtgtgggagggggattctttacctctctcaaagcttgacaactgtggatctgtttatattatttctagaactcagaatgaactgaatcactgggataatagaaactgagattccacgatgacagacagctggaggagagggacactgactcagtcaaccagatgctttacctacgtagtatttatgt

SEQ ID NO: 34168 - DNA, 2040 bp, Bovine  19866880832888
tttagcctcatcacctgtgtctccccaattccattatttcactcagtctgtctattctttctgataacagcagatgcctgccctttctcctggataaaccatggacttgccatcctctgagatatatctcatgatattgcttctgcttggggtgcccttctctccttcttctacctgaaaacctgccacgcatgctttgaggcctttctgagatgcccgctctgtaattgtccttaattacataatagcccttggccccggcggggttaagtgcacctcctttgtgtccctgcagcatttttatagcctgtatttgtgttaaggatcgttgatgcctcttctgtccctcccttctgatcatgaggcgcggaactgcctcgtgtcttgactcccagaaggaagtgcgccttacagtgtgcattgtaggtacttagtgagtatttgtgtccttgtgtttttgatcacaactgtgggccctctctacgtcgcccactgactccaccccgtcacggtttaactgcacccagtcagttgaaatgcaggccctcaccctgccctagacctactccatcagacctggcgtggcatgtgcatttggaaccatggaccctcatgtgcatttgtaacggatgcattaggcgcctaacgtgccagttactgttgtccttattgatcaaattacttaagcatatcagctgccagttactgttgtagctgctgagaatgcaaagatgacagcatgggcctgggcctcctaggagttccaggaggagctctgtctgcctcagtagcatcgatgaagagtttgatgagggacctgccttccagggtgaaaatgtgtccaagggcattccggtggtggctccatagtaacaggcatgatgggggcagggtgggaccaggcttgacacagaggacccccagaatgtccttcctcatcccagagtggcctgctgggtctaggcacgggcggctgacagggagagaggaactggcgtttcgacttctcctattctttttctccattcttgcccttctgaacccacaaactcttacttgccaggattttattttctgtgaggcaagtgtttctgggtacttcaggcagggaaaggcccagactttggggctcacagcctgtcacctgtgggtcagtagctgcttcctgcagacaggcctgaagaccttagacatcctcactcagaaaacttaccagtccttacctggtatatagtggcttcttgaaaatatattttcctgctttcagtgtaacggatgccatttccttatttccaaacctaaggcagctggtgagacctcagtgacctgtcacgatgacagttcagagcctggcctttttcacttccgctgtcagctctaacactgttaaacttctttatcccccatcctctgtgtactaaaggattcatcagatatctagatcaaagagttgtagttgctaccatcagggagctcataggccaagagtgacagcagatagaagcagggaaaaatcaaactcaaataaacatgcaaagataaaatatttagattatgtggatagtttcagtagatgcgctattaaatgttattaataggctcttacccatttttgcaggtgactctcaaacaggaagctgatgtagccgcaagccacagatctatctaaaagtgattaaactgcaatcatctctaatggagtgaatgatagacaagggacgtccttcctcatgtatctgggcttgtgcaggttttctctgtgacagccgagcctggcgttagtaaattcagcaagaagactggcttttaggagtcgtatccctggctttaaaaatttccccatttaagttattctcctggctgaaatgaaatgatctcttgtaaaagtaaggtgaagtcacaattcatcttttcaccaatgtttattgtgtacacatgtgcactgtacgtgtgtttccataacttggctgtcctgtaccatatgtaaagctttaaacaccttgtttgtcacttttaaccaattaatatttactcctgttt

SEQ ID NO: 34169 - DNA, 1453 bp, Bovine  19866880864762
tgtctctagagctgaatctcatttgtgatccctggagtgctggggctggcgatgctaatcctccagatgagtccacagggacatcttgggtgcagggatcatgagtttctcctggatctggagtctgcactgattattgctggaaggtctgttgttgtcaattccctctaactcatggagacatcatttttctagcatcagggaaacacccatctgggtgtgactctaccttctgccagatgggacatgagaggtcatctccccatcagcccctcttgagtcatggagccctttctttaaatcacaacttagaaggccaaagttcaaaacaaatcgaggtggaattcctgtggttgatgtggtggtaacagtctcaagccagagtcaatcaacacctcctcagctgctgcatggccacagaaggacttcctggaatcttgggcttggaggggcagtggaatataactgatcttataaaagtccagtgttatatagatggtgagtctgatgcccagagaagagaagtaaactcacaggtcagtaagcaccagacaagaacccaggaatctccttgctcttaatccaaacacccaacccagtgtcaaatgttcagtcccttcttttctcaaacgatactgtctccctgagctactgcagccactccctggcttccagtcttgtttgtctgcctgcacctcccatgtcttgctgttgttcagttgctaactcatgtccaacagctccagcctgccaggctcctctgtccacgggatttcccaggcaagaatactggagtaggctgccattttcttctccaggggatcttctcaacccagggatcgaactaatgtctcttgcattggcaggcagcttctttaccatctgagcaagtcctcagtgggtggatggatggatgaatggatgagaagcaaggagtaagggcaagggagagaagtaggggaggggagggaactaggaaagacaaggctgaatcagggaaagaaggccacaacagtaaagaaaatgtgctcagtacaagctgggccactctctggactgcagtccctggcacaagcctggctcagcccagcagctgctggccactggctcccagcccgagtgacacccctgcctggcagggccccgttgtgcttggcagcccagcagcccaacccctcagtgctgtggggcatatgtgagccaggaaccacctcaaagacttgactctctgccttggggcctccttttaccctgcaaagccaggggtgggatcagcccttgacaagctgccaggttaggggtgttagggagcgtctggtcaccctggagaagggcagcttctatcctcttgatctaaaataacaactcttcccgtttttttgccttgttttccttcccagcactcaccattgccgctctattgattagaggcaaaacagcctgggttcaaacc

SEQ ID NO: 34170 - DNA, 2017 bp, Bovine  19866880871927
tcaggtaaccatttgcaagattcagagattaggagacacatatctttggaggctattctgtcttccataatgctacaggggtccaggagaccacccacaatcattaatatttctttggcaaaatgtatgaagattcatactaaattgtacacctcagtggttagcaaactgcagttgatgggtcatgtccacctgtttttgtaaatcaggttttattggaacatagtcatgcccactcattgtggctgctttcatgatacaaggacagtgttgagtaaattgggatttgcaaagcctaaaatgcttactgtctggccttttacagaaaaaaaattcagacccctgctataaataatatctctaaagagtttggcttagttttgccaccaaacaaaatttccagaaacctacagaaaatcttgtggttttcagtgatgctgagtttcagaagtgtaagcaagggagcatggacagcttgttagtgcctgaaccaaagactcaactctagtttactgcaaagcctaagttcttaattcaaatagccccaaattccatttcctttgtatttgagccaggagtacgttatgtgtatacactggacccattttgtgatctcagatgctcagagaattagagtagaatgtggtcatcatccggtgcaaagataatagttggaaggtcaccctgggtcagaggtgtgtcagctagaactgtgctcttacaacaaggcactgaaagccgttagtcaggagtatgcactctgattaaccacagtcaccaccattccctgtcttccttattgcctcacctaagctcctcctcacatgggcattcccagcctggtccctgaaggcttttaatacttacatgtcgacctaagctctgccttcctgtactagagaggaggaaagcaaaggtccagagaagcatctgtggaggtcagggagaaaacaggtggcagagctgaaagcagaacccaggtttcctgccctctctgcccattttcttttacttcactgtcaggtacttggacttgaccccgggccagttatgattcacatgctcagccttcgctggctgttctccctgccctgtcaatccacccacccctggctctactttgttttctccacaggtcagcagtaaatcacttgcctaaacaatcatcaccttcaaatgctcagctgcagtcccagatgttgtaatctctcttggcttcctttgatactctggagagaagtttccttggagatcttccaaattcagggctgataatttgttatcacatgaatttcagatcatgctaggctttggctttcaaaatcatcagagctcacctttcctctaggtcagggttgagttgtaggctgtgcccccagtttttggctggtctgttctagatgggctgctggagtctggttgttggaaagaaggacttttgacccggggatgatgatccactgacgtcattttccctgaaggcattccaggaggagggaaacaaatgcatctaccttgatgagaaagggcgtaaaatctcttccagctgttgaagttttgtaaggacgataaagtttctttattgagtacccctcctctggtttgagcttagccaaacctcatccataaagaatccactattgggatacaaatcactttttaatcagaatccctaaccgtgggttcagggatagggccaagaacacccttgtatactccattacatcttcctttgagagacattgcagagagctggatgtttctagaagctggatgtctgctttccctgtatttgaatgtaggtattattttcattactatttagtgctttggacaagtatatgaccattgatgtagactgaaagttatacctggaaggggttcactggagggaggaaattttaattcttccattatttccatcaactaaaccctcctccagctattccaagtgaacacacaatccgagtaaaaacaatgagcttctctgcagacacacttccatgctaaaactcca

SEQ ID NO: 34171 - DNA, 2360 bp, Bovine  19866880927735
agccaacaaaggtccatctagtcaaaagctatggttttccagtagttgtgtacagatgtgagagttggactataaagaaggctgcgtgccaaagaattgatgcttctgaattgtgatgctggagaagactcttgagagtcccttggacagcaaggagatcaaaccaagtcaatcctaaaggaaatcaaccctgaatactcagttgaagggactgatgctgaagctgaagctccaatattttggccacctgatgcaaaaagctgactcactgaaaagaccctgatgttgggaaagattgagggcaggaggagatggaggcaacagaggatgagatggctgaatggcatcactgactcagtggacatgaatttgagcagactccgagagagagtgaaggacaggaaagcctagcatgctgcaggccatggggtcacaaagagtcagacacgacttagcgactgaacagcaacaatcctcggaagggagtgaggaaagggtgttattacacagcaacaggcagccaaagcaacgtgtttggactagcacagttctcaatacttatatttatttccagttcaggacagtagtgtgtccatgggggtgttctggaaattggcagggggcatatttttattgccacaatgaccaggtttgtggggtggaagagagtgtgctattggcatttaatgcccatgagcccaagaatattaaatatattaaatatccaaaaatgtctgagatagttacctacagctaactgccccacatgaaataataatagtgctttgactgaaaaacagtaagtcacaacattaaagacctgtatagagaacttaaagatgaaataaaaatataagcacttaatgtaaactgctttctcagcaaggaaaaataagatccatcttgatgtcaactttaatcactagagaggctgcctggaagattgtattgagaatgccttggaggatcatcaaggactggatgccgtgatcaactagtgatgcctgtcattggcaggggaagggagagtagtggccttgaagtacggtgatcatataatttaacatccaaactggaacactttggggagtaaaagggggcagtgttagtacactgggacgacaggcataacctgggactgtcccaataaaaccaggacatactgtcactctacttccacgccgtggatgtcgtctctgacacatcccaatatgtagctcagaggtaagcaaaataggggcttgtctggacctacaagcccttgagatcttgaacgttaatttcccttttaagtactcagtttcagtgtgtggttaggtatgaagaattgttctaaagaacgcattaaaaattaattaagagtttcctctaatatttaatcttaccagccatgtactctgagtgatgtattcccagtcagcgtgtcaggccatgaataattaaaagaggaggggagtgtgattcagcccctcgatgagcctttctggggttttagatgcagcacagagcctgggactgtatctcccaaggaaaagttctgcattgaacagcagggtccagtgccatccaaacccctaatactggcattcatcatgagtcagcctcacagggagatggagatggatttgcctctgtggagccatcagcccctgagacgtgtcagccctgccttcttcccaggagggaggagggggagttggtggtgagttatagaaaccttcccagggctcctccacgtgctgagagcttccatatttcctcacctctaagacacatgcttcttcattctgtaacattttggaaatcaagaggtgacctaaaatcaatgggaggatttaaggtggtatttcttgggaggtgttccaacgtgacagttcagagccaggctctgaagttgcactcagcgctctgccatttcccaaccgtgtggccccgagcaaatttcacccactctattgcctcatctgaaaacttaatctattcctaacagtcccaacttgataataaatgaaaaagggcttgagtatagtgcctggcagatagtaagctctcaacatgtcagctattctttcttttggttttccttctgcgtgttgttattaaattgccagtctatctagaaactgaaagcattttcagtgtttctgcagtactgtcagcttcagaaagagttcaaaaacaatgacttctgagcccactctattgtgacacccagcacaccgatggtggcttatctttgctgcatcaagtaagggaaatacatatttgacagcaggtgaaagcttatttgatatcatttctatttagtcaaatgtaggaaacagaagattctctaagaatgactccctcccaacttccaa

SEQ ID NO: 34172 - DNA, 2612 bp, Bovine  19866880936834
cctccctggggattaagcaccctccctgcttctccgcactgctgagctctgcccaaaggcttcaggagagcaggggctccatcctatcccagtgcctgccgtgtacctgggctcaaccactgtttcttaacttacaagagtcaggccaggcttcacctctcccggaagggctgtcttaatcagggatcatttactcggcaaaaacaaacccacttgagctaacttaaataaagggaaagcaattatgaggagttaggttatctggcaggccccaagggcaagaaatcattcgggtactcgctcatttaaaactagaaattcttcacaaaagattggtactgggaattgggaagctggcagggatcaaatctgctcttgatcctctctctcttcgcgtcctgggggaacacttgtctctttctctgcttcattctcctgggttttgcggcagaccagctctccagctctttttgcttgcacttcccagaactcacggcctgaaagcggccacccagcatgactgattcagttcccttgggctgctataacaaaatatgacagattggatggcagaaagaaatttatttctcatagttctggaagtggggagtccaaggccaaggtgccaggaggcttgggttctgggaaaggctctctttatgggatgcagactgccagatcctcactgtgtcctcacacagtagacagggcacggaagctctctggggcctcttgtagaagagcacgaaccccattcgtgacagttctacgcacatgatataatctcccccaagatcccacttcctactttcatcacgtggagtagtaggtttcagcatatgaatttggggggaacttgtcagctgctccaacatggcagtcaaagtccaaaggagtcaagtcagagcctaataccaggtaaccatggccaataggctatggatgaggaggcagaattcaaggaccatgaatccctcagcaggagtaccaagaacaggaggaagtgggctagaaagaggaaacaaacaactgacaaaggaatcgaagggcagggacatttgtggagaaggaatgatcaggcagaagaaaggcctggtgtctctcagattgtccttagggtctcctaggttggggacacatttcctctccaaagaatggccttgtccctcttcttgttgacagagctgccatgcctgagtgaggcccactcagaggccaccacccctgcttgcactgcctctgcctctccatccccacacttgatggcaattagtagggctgcaggtcaagtatctaagcgccttcaaatctcagggaagatatgtaggtgcagacaggatgcaactgggttccaatagccatagacaaagtctctggagttgtattctcaacctctgcttacttctggccactggcttccagcagctgatgggatggagtacaggcaggtcaaccaaacagatcagattccaggtagttaaggtgaagtcagagctgaacactgtcactgaaatgtggttcttcccctcctcctggggagacagaacattaaaggagggtctgatggcttctggccaccctaggttatgggtcctgtgcagtgtctttacggtacaaatagggcttgcatcttctacccagaggagggcatctcccctactcctttccaccaccatcagagacagcacacagatggctggttgcaagcaggaacttctgtcttcttcctccccttctggaccccactgggcttattatattcagcaggttgccatttagggcctgcagtttggaagtaaatcttgtgagtcactataactgcaggtgtagtacagctgcaatagacacccctggagagctaatgaagatgcagactcctgggccctacccctgacccacagaatgagaacggctgtagcagtgggacccaggagtctaccttttcaacaagcctcctcacccagtcaccattgccaccagtgacactgatgtaccccagagcttaagaatcaaccatcaataggagctgtggttaaaagctaggtgactaaactcagagcctggctctgttcttagctgattgtgcgaataaattaatttccattcttggcctcagttctctcattgggaaaatgggcataaaagcagcaagccctccctaatgactattgtcatgctctgattcttggagacaggagggaggaagcaaagagatgacagctatgaaggctgaagaacaggacccagcctagacttggggggttagaggaatggggtataggggaagaattatcatgcaggggaaagcccggagaaggcatctggcagtatccctgcagtgaaagagcatgggatgcagggacagccaacaaaaggggaaggctagcaccagagatagtcaagggcaagacagaaacgtgggtaggagccagactgccaagagcctggtagaccaagcagtggggactcaatcccatagccggaagagagccattgcagggtgttatgcactgaaggcaagtgtgttacatttctagactgccctgccctcagacaaaggcacccaaagtccttgctcagggtgcccttcaccgtgtcccatgctgggcctc

SEQ ID NO: 34173 - DNA, 1260 bp, Bovine  19866880966847
caagatgaaactctatcatttactacaattgttaactacaatagtaatagcttctgtttattgaaagtttattttgatcaaatatatgcacagtgcctcacgttgggaaggtaaaaatcaattatcccgtattttccaaaagaagaaattgaaactcaacactggtaataaacatctccaaaggtccccagctggtacagaaaaaacaggactcacaaacaaatcagtccagttccaaggcttgtccctctccagctatgctatgctgtccttgtggcctctgccttcaagatgccctcctccctcaagatattttatgtggccaaatccatgaagaaaaaagaatcaaactgactgccaaataccgtgtagacataacaaaaagctaattgactgcaactcttattttccagcctactcttgcggtttcaggggaagtcatctcagccgtggagacagcgacccactggtttgaaggggcgccaggggctgtgttgtccagctcagtggagccaggcagcagagtctcatctcctgcttaggtgctcatgttccctgtgtccctcacgtctggctctctatcaaacaccactgggacagcatccctgacaccaccccaccatcacaaaccacaccggcagcctcacaatatctcactctatgacacatgggatgtgtcaggcaaacagtgctatttaatagagaatacagggctatatattcgatgtgactgttctcattctattttccccatctctggaagtaagtcattttacacactaggaaactgaggtttcacttgggtctgtccaaagtcacataaaaagtaaagatggggactggaaggcaggctgccatcccatagcccaggcacttaacctctccttgtagaggctgaggacctttctccaaaggggcaaagtaacatccttccaggacaaacctgtaggtggtctcagagctggggcaagaactggggctctctcattctagaagtttctccaccattctctctccctatttgttcccacagcaactagacacaggctgtgggcctgctatacatcaggaactatgccatatgctaacagaaaaaaacaacaacaaagcaaaaacaaattgaaagaagttgtggctcctgtcctcagcagccccagagtcagactgccctgtgttagactcctgcctttgctaccaaccagctttgcaaacttggacagatgacttggcttctctggacctcagtttctctatttgaag

SEQ ID NO: 34174 - DNA, 1727 bp, Bovine  19866880984173
cagggaaaggggcatccagctgtacacccacaaggaaccaagttctgccacacaatgtgaatgaacttagaagctgattcttccctggagccttgaaataagagccagcctacttgtcaccttaattctgaccctaagcaaagagctcaattaagttgacatcaacttctgagctatacaatggtgaactaataaaaaggtgcaattttaagcccctaaatttgcagttaacttgttatacatcaatagaaaagtaatacaagtatgaacctgcagaatctaatagtttcttttctgaccagccatagagcatggtggttaggaacgtggattatgacttggagccacattgcctatttcaaatcttagctctgccattgtcccaggtgaaagatctgagcaagttgtttaatctccctgggcttcagtttcttcatgtgtagaataggggtgataataataatatcttcgtcctggtgccatggagaaccaaatactataaaatatgtaaagttctgagagtaatgtgtggtacattattttatcagccctgtgattagtactatttaaaaaaaataaaggtttctagaatctcccctcaaggcccaggacctgggaaagctgagccatagacccacatgacaaccatcagctgaaactgcccccttcttctggttttctcatatgcattcctcttggcaccgttatgcttcctgctggcccctgtaggcatttgggtttgcaatctctgatccaggattgattagctggagagtcaagcaaaacctcaattctgaccttcacctatgaaaacaagccaagatctttattcattagctgagcggatatagtcttctctgaagccctccttaatttttctttggaaggatttagaagctggctggagtatggcttgaagagaaacatgcaaggactcttgcgggtctttgaactgaagatcccaacggacggaggagaagtggctcagaagggctcttgagcatctaatccatttgcggctgtcactgcctcctggctttataaaataaaggacaacatgaagcctgtaaaagatgccatccatccttctggtggccccaaagtccaagcccactagactctgcgaattgtaagtgctggccactcaagagccctcatgcctctctcttctgttgtcctaaatgatcccttggctctggatccttgccaagaacccggagcacaatgccacttcaagcccaaagtcatctccctgtctcagctccaattagctcagagcttttgggaagctgtgtgtgagagcagcagggcaagcaaagtgctgtccagctggcgggcagatggacagaaagagggccaactcttgtttttaatctaaaaaagagcccagggtagggaactcaggcagctcccctcctgtctctgaatggtaatctcttggggccatgagaaaatgtttcactgcaacagtacctgagttttcctctttagaccctatgaccttcccaggctgtgcaaatggactattgacaacaactcttcactgtctgttattcagtctccctttgaagcaaaagcagccagggtttgaccagttggctacacacaactctctctctctctctctctctctctctctctctctttgtcaaacttgtttctagaactcaagtctgtgtgaggtacaagaatgtcttgaaatattagaatcatctaatattctatta

SEQ ID NO: 34175 - DNA, 1699 bp, Bovine  19866881062969
agtgaagaacagggaagtctggtgtgttctagtccgtgggcttccaagagttcaacacaacttagcaaacgaactacaacaacaacagtatatgcaatagaatattactcagccacaaacaagaacgaaataatgccattcagcaacatggatggatctagagattatcacactaagtgaagtagtcaaagagaaatattaaatattatcatttatatgtggaattttaaaaaatgatacaaatgaactcatttacaaaacagaaagagactcacagacataaaaaacaaacttatggttacccaagtggaaaaaggggagggatccattagaaatgtgagagattaacaggtatataatactatatgtaaaattaataaacaataagaatctactgtatagcatagggaactatattcaatatgttatacaaaactataatggaaaagaatctaaaaaaggatgtatatatgtatatattcactgaatccctgtactatataccagaaaaactctaaatcaacgatagttcaattaaaacaaacaactctacagagtgagtactgatatttacatcccacaagggagaaaacaaagacccagagaaggcatgggcttggcctcagagggttttgctagtctttaaatcctagagaagaattcgagttctgcggtcctctgtgctacctctttcttctctgaggccctgtggagtgatctgcgtgtgcctaaattcggcccaacatttgcagatggccacaggtgaggtgaaagtgagacctccgagaggagagtgaaaattcaggggaaggattactgggactcaggtgcatcccacttctcccactccctttcttcctttgttctttccattagtcctcattttgtgagtattttcatgcacatccaatcaaattttattttctcctcagttctttgtttctcctttttaggatttcacgtttgtttgtttgaggtgtgcttccctacaaatgaaaaatgttctcaaacataccatccattgaaaaaccgcccactgtaattatgaaacacttccatggtgccatcatttgatcctgtctaaccccatattcaaaagccatttagaaatgggttttctcattcataccttaaatagttaatctagccacattgtttggttattcttgtttgattgattcactctgttttattatactgaacttatttaaaagcttctgttttataattgtgtgggacttgggggcaattcattcaaaggtctgtaccctataaataaattactctccttttgctactaacatgaaccggttctattgaaaccaggggggaaaacgcaaaagaaagctgaagacacagcttttgttaaagtgaggggaaaaagcacacctattctgtttagagaagacctttaaaaacccatagtgattatataaaagggagcaaaagcagtttaggaagagatgaaataaatggtaaacaatcgtacctccaacatagagaatgcgtcatttcctcatttaaaagaaggtgttagaagtcaagaaaactggtgtcagtcttaagaaaaagaacagaggttggccttttttttttttttttttctggattttgcggcatatgtagtgaccatcctgttaattagctatacttttaaaaataaccccatgaatcaggttttaaaactctggaaacgaag

SEQ ID NO: 34176 - DNA, 1308 bp, Bovine  19866881178213
ctatggcagctggtcaggttgggcagtttcagtcagtgtgcttccccctaacagagagatgggaccatgtgacagatctggtccatggaatatagacaacagtgacagacccccccttcccagcctggcccctggtagatttgctatgtgacttttcatgcttttttccccagacattaaggggagaactctgagaccctaagggatgaaaaacccaaagatggagagagcctggatccctgaatgactgagtggaacagatgttcacttctcagctccacctgtactggactatgacctgggagagagataagcctttagtatgtcgcaccatgaggctgaggtgtatttgttacaggaatgtgttatctaacacaaaggtatggggtggagagagtgttgtgctcttctcctgtctccatgaagagcaaactggagagtcagagcacctttgtcagagaatttacagacagaagttaaactgtgtcataactcccagaagaaaggaaagagactcagaaggctggccctgccttccctggtctcctaagagtatgaagcaagaatcttctgttctctttctctctgcaggggaacagcaggcagatatctaacacatcatgttctgctggctccactgacaaggagacaaaattctatcactcagccgacaggagacctcacaggtgactaatttaatccctgaggcctctttagaaggagaaatgtctcctttctcagcaactcctccctttccttagcctgatttccacgaagcaagagagtcccttgcgctcagatcagctcagcagggaacacatattcttggagtgattcttccacaatttggtgggctgaattgaatagccatttattagtattcgaaaatagtgcctttggcataacacagccttgggactacaccctggaaatcactccatcctgcacatagcagggttttgagaggggtaggatataccaggacctgggcaggaccaagtgagatgaaaagctttggtagaggaagaaattagcatctgctactgccttcttcacctttgggcactgggatatccttggtcaccatttcttggagactgaaatcccagaggttaatgtagtggttgacttagaaaaacagagagctcaaatctagagatcacatagaccaaggtttgtctctcagctttagcatgtactaccagctgtgtggggtggtgggcagcggggggcttccctggtaactcagctggtaaagaatctgcctgcaatgcaggagaccccagttcgattccgggttgtaagatc

SEQ ID NO: 34177 - DNA, 1499 bp, Bovine  19866881250543
gggagcacttagcgcttcttttagcatcatctttctggagctgagagggctgcccagggcctccacacatagccgcctctttggtctccaactcagttcttctcaagacatttttagggcctcctccagaggctcaggcccaaacagatgtccctctcgcccccacttcaaactggtgtggtgtgaagaaacacaagagggaagaaggggaaaaaagctttggtaaccatgtgtcacagtatggaaagtggttcatatattaagagaaagtcaaaatgaaaaaccagaaaatatgtagctagtttatgagtatcacaaaaaacagcttctagcagcttctcagttgaaccaagcaggtgtgaacctagaggattagactgatgatatcatggtacacaggtggggcttttgactgtggaagacaaattgaactcccaaaggcaaagtttctcaacctcgacaatacaagaaaagcacagtggctcatgctcagtgtaggggatgtattaatactacctgctgcagggagcatccctggcctctccaccctagagtcccagagcactgcatccatggtaaccgaggaagcctccagagttgtcaagtgtctcctggtagcaaaatcactctcaggccagaatgtctgatttcaggtctgaatttgaattacagactgtcccaacttaatgatggttccacttaacgatttttgactttactatggtgcaggacagggaagcctggcacgctgcagtcaatggggtcacaaaaagtaggacacaaatgagcgactgaactgaactaatggtgcaaaagtggtattcgattcagtagaaacagaattatgaatgttgaccttttttggggctagcaataatcttttgtgatactgggcacaggcagggggcacagctcctggtgagccacgtgatcatgagggtaagcaatcgataccattcatctgtacctatacgaccattctgtttttcatttctgatactgtatccaataaattatgtgatattcaacacaagtataaaataggctctgtgttagacggttttgcccaacagtagactaacttaagtgttctgtgcacttttatggtagactaaggagatccaaccagtccattctaaaggagatcagccctgggtgttctttggaaggaatgatgctaaagctgaaactccagtactttggccacctcacgcgaagagttgactcattggaaaagactctgatgctgggagggattgggggcaggacgagaaggggatgacagaggatgagatggctggatggcatcactgactccacggacatgagtctgggtgaactccgggagttggtgatggacagggaggcctggcgtgctgcgattcatggggtcgcaaagagtcggacatgactgagcgactgaactgaactgagactaagctgtgatgttgggtaagtcatgtgtattaaatccattttcaacttacagtattttcaat

SEQ ID NO: 34178 - DNA, 735 bp, Bovine  19866881295326
tagaaaacctttagttgcaagtcattgacaggagaacaagaggtagaaagtgtaaggaccagaaaaaaaaaaaaaaaccacatcgttcctgctggcaaagcagttccctgactgctcctgggtagaaagatggggtcagagaatccaggcgtggggaagctcttgccttggggtccccttactcctgaaggcaaggggcagcttctggctcagacccccgggcgccaggccatggatctgccagctgtgggggctctgcctcccccgcgccctccgcctgtcacacgcggggatgtcacaggagacaatgtgcttttgctagcgccctggctgcgttggcagaggcctggcgtcaggcatcacaatgactctcatttcctaggaaacagggagtcgcacttgtacctttgctgagagcctccgcatttggagctgtcatgtgactcagggagctatttttagcctcccccagtcctgtgttgtaggaagaatgatttgatgaaaatactaaactcattaaaagcctgggggatggggagtggaggaggggttgctagagcagaagctgcaatctctaagattctggcccggggttgagcagcatgagggaatgacagctgggacctggcatttccttggcgtctgtgccctgggggaggtggtggggggagggactattgactccagtacctggtactgctggtatgtactgtgggccaggcgctgggctcaaca

SEQ ID NO: 34179 - DNA, 1229 bp, Bovine  19866881351059
ttttattcagttcccatagactctaaactaggagacactggacttatccagggacataataaggtgcaaaaatttcatcatctaaaggtattgaaatcatacacagtttattctcttatcgttgtactttccataacttagttctcatagaaacagcaacttctattgccatttcaatttttgaagtgagtccccaccagtaacactgtcccttttaacaaataatagtgttaacgtggtcccctgcagaagggaatggcaagccgcttcagtattcttgccttcagagtcccacaaacagtatgaaaagtgttgttaaaacaggctgcaaaaatgggctaagtgttcatattctaagagagactggtcacttgaatagtcactatattttctcaattccagaacttgtccagatgaaaagttctgaaatcaagtgcttaaagactgatggagacacgtccaaagaacataggagccaggtttacagggttcccactggccaaacctgggatcattttgaatgttgaatagtaaacaaatataacaacacagaatagcttaagaatccatgagtttgtgtaagtaaattaataaatggggaagtttttatgcaaggatagttttgcccctgcggatatttgctgaggtctggggacatttttaattgtcacaacaggatagggaaggacttgttatggggtagagactagggatgctgctaatcatcctgcaattcacagaacagcaccacaattaagaattatccctcccaaaatgtcggtagtgccaatatgaagaattctttcccataggaaagtgtccacagtttcccaaagtgtgatttgtagaacactaatcctctaaactaagattatggcatctggtcccatcacttcatggcaaatagatggggaaacagagacaaactttatttttctgggctccaaaatcactgcagatggtaactgcagccatgaaattaaaagacttttacttcttggaaggaaagttatgaccaatctagacagcatattaaaaagcagagacattactttgccagcaaaggttcgtctagtcaaagccatggtttttccagtagcattgtatgggatgtgacagttggactataaagaaaactgagcactgaagaattgatgcttttaaactgtgaatgttagagaagactcttgagagtcccttggacctgcaaggagatccaaccagtccat

SEQ ID NO: 34180 - DNA, 1524 bp, Bovine  19866881424989
ccttagagatcaaagggcactcaggtaagctgcatgtgttttctgacacatgaaagccatgggttaatgaagacgtgttttaagctggtaaatttggggcaatttgttatgcagcagtaggtgactaacacaccatccaatgcattttgctcagttagattgcagtgcagaccccaccatgttggtccacctgtaagtctgcttttcaggatagaaaagtgtatgtatatcatggtaggtcaaatagtagaaaccccaaaatgatccacatcctaatccgtggaacctatgaatatgttagatcacatggtaaaagggaaattgcagatgtaattaaggttacaaactttaaaatagattgttctggatgatccagcgggcccagtcaaatcacatgcagccttaaaatcagagaactttctctggctggaggtaagagagatttggctgaagtcaaagttggagagatttgaagtgtgagaggaaccctgccattgctgtgctggggagaatgtgtccagaatgagattgaatgtgggcagcctctaggggcaaacaccagctcccagcaaggactgggacattggccctgcatctgtcagggactgaattcagccaaaaacctgaatgagcttggaagcaatgcatccagaatgtctccaggaggaatgaagtcctgctgacaccttcgttttggccttgtgaaacccagagcagaggaatcagtccagccaactgggaccgtggatctaaaaggtatgaaaaaatacatttgtgttattttcagttactaagtttggggtaatttgggtagcagtggaaagttagtgtatttacattctgatattacactatgaaaatgatatttattggctttgagtactttcctatcaggtatcatagctatgcagatgtttcacaatataatttatcattttccacttaagccactgaagcactcattcactatctcagtgcctctctctacggcaggcttgagtgttccatgcattgtttttcaaggctctctgggaaagacactccttctttgggaggctggcgtctggctggagaaagactgagtgcctactggttgtttctaaggctactaatcaatacttaccattaggacgacaactccatgcatcactaagctttgacctctgtgccccagagcagtcccaagatgccaattgatgcacaggcaatatacatattcctcaaatgccatacccgtttcatagacttccctgaattaaattttagaggctttagtgatggcaaaataatgttgctaatgtaccagcacgcccagaatatttagaaagggtgataggatgaaagtaattatgtttgtgccttttaaaaagatgttttggatggatgctgcatttggattgatggccagctgttcttgtcttctacacagctgggtggtgctggcatagactgtctcttaagtcagccatgaaaataaatacatacctacaagcccaaaacctgaaagcaaacaattggctccct

SEQ ID NO: 34181 - DNA, 775 bp, Bovine  19866881442663
ttggtgatggacagggaggcctggcgtgctgcaattcatggggtcacaaagagtcggacacgactgagcgactgatctgatctgatctgatctgaaacacacacacctgacctagccccttgcctcacattgacagggtgaattagcacaccaacaacaaagcctgtgtggttcaaaactgctgcttccccccttctaccctccaagcctcagagaatttcccttgtggcccacccgaactggaaacatacaaaaggggggattctgtagttcaccctagtcaagctgacacacggcaaggccatcacaccatcccaatcactcctgagactgttggaaggctacactggcctttgacaggtggccttagttcctcactgcattggcctctcactagggatgcttgagcatcttcatgtcacggtggctggctgcccccacagtggattgtccagagagagaataaggagcaagccacaacctcttttctggcatagtcttagcacatactgtcagatcaccatatgcagtttattacaataggtgactgcattaggaacacattcagaatgaggatcattaggctccaccttttgaaaaaaaagtatagaagactttggggatatattttaaaatgcagtaactcaaagagccagagtcaagtgttgaaggcaagggtgacagcaagaggccctgaggactttgatgtgtgcagttcccctcctgagggtcagtgtggccagagattctcaggcaagccctggggaagagcagc

SEQ ID NO: 34182 - DNA, 1487 bp, Bovine  19866881560368
gatatctccaaaagcaagacagaggagctggtcacccgccagggaatgaagatggtaaagcttattccctcggctgtgaacaagcgaatcgatggtgaaggaaagcctcgggtcctccagtgctctaaaagccgataataaaatttaaaatcaatggcaaagctgacagcaaaccgatggcagggccagaggccaggaatgaagtgtctctgtgcaggaagcaggaagacagcctgggcagcgatcctcagaacagcatgctgagcatccaggtgaaagcatctgggtgcctagatttcaccgagatcctgcctcctgggctggcgcccccccatggacgcgggaggtgcatgtgggaaaggagctgtcgaaggagtaagacctggaccccagtactgtgctgccctattcactcagcttttggaggtatggagccagagcctggggaattctatcttacactattaatttcacctacattaaaaaaatatggacaatgcagtccagctacattgttatgggccaaatgcatcctcttcaaattcataggctgaaactctgatccctaacatgatggtgctaggaggtaggactttggggaggtaactgagttatgaggtcatgagcgtgggagccccatgacaggattaatgtcttataaaaagaggaagagactagggctctctctctctgccatgtaaggacacagcaagaaggtggccatgaaaagcaaaccatgaaaagcactttcatcatgaactgcagcaaccagcaccttgatcttgaacctccaaccctgcaaacctgtgagaagtgaatgtttgtcattgaaatcactcagtctctgacattttgttacagcatcctgaatcaaccaacacagtatttctcagattcatctatctgtgcaagcgtttcttgattcccctcgatgttggggactaatggtgaaataggacatttggaaagtagtgagtttgggactggcagggaagacacttagcatccagggtactaggaacaacaatgcccttatgagaccagaggggagtgcagaggcaacactacctgacagggaggggagtgggtaggcagggagatgatgctcgagagatgctaagccttgttgtgcctgttctaaggacgtggtggagcagtggactcggggcggctgccctcgtgatgtgtggtgaaggggaaagcgggccagtcagagggtctcaggaatttcactagtacgtttaagtgtaggaatgaaacctgtaatgggctatgaaagctgaagaatggaagagcgtagaagagaggctcagtgaagcagagaggtgggagcgtgagagggagaaagagggagaggaaaggagagcgagagagcatgaagcagggaaggagagagggagagcatgacctaacttaattttgaaaactgcacagttctatttttccattcccctgcaacatggttatatttggctatttttgaaatg

SEQ ID NO: 34183 - DNA, 1349 bp, Bovine  19866881695925
agaaggcaagtgacttggtcaagacacaagttcacgggatctcaatccagtaacaaattccaaaccaagccccgtgcatgctgcccagtctgcttcccttctagaggctcacacccaagcctgagtcaggcatcccagaggggttcaacccagagagaatcccagagtctcccagcaaaataaccaaacgtttttaccaggatgcttaaccttctggtcaaggaatcaagttccatcatctctgctcttctttgcagtctctggtagaagcatttgcaaacacaaatagttaaaggtcacgtcagaagcagaatagggattctgcatgatccatctgtgctgggataatccagaattggccatgaatatgtggaagggcctacactacaccagtaattctttttcacctgccatccacaccagtcaaatgtgttattcttgtacattctttggagaagagtgtgaggcatgtgcatccacagattgggcactcaagcgaggcaggaaagcaagcctcgaatataaactttttaaattcccagttaaaatcttgagaaaataagcaagtgggtggtgcatcctagttataaactggttgcaagtcaaatctgctcatgtggaaatgatgaagagaagcagattagaaaacgtgtccttttttccacagaaggtagggaatgaaggaaagatcattgattttaacagccacaagatttagggatctgcctgcaactttgccaccgactgtttttgtgaccttacgcaaattctttatactctctgcgtctggaaaacagtgaactaataaggccagtgacttttccatctttttcttaaggctgtagatcctttcctttagaggcaaactcatacagaatctcagacatcagacacattatcttgcctctctgaacctcagtttccacatacagaaagttgggacaacaatgagatctacctcttagagtttcggagtgaaggacattcattaacccatgtgattagagtgcatggaactccatacacgttagctattattttcagtgatatcatagctatgaccagagcagcatacctcagaaggagccttccaaactctgcccaacggctaacttgtagatagcaactgtttacggagtgtcactctacacttaccttttgaagggcttataaataatttttctgaactcaaccttctcaagtataacggagcttctgtacacaaaaatataaagtaaggtttatcacttgggtgataaaaccagaaagaaatgcaaggaagtgttactgtaagtcgcggtaatggttattttagtggggaaggtgggggccgtgaccaggaggagact

SEQ ID NO: 34184 - DNA, 1115 bp, Bovine  19866881731530
tcttgaaaaaaaaaaagagggtgagacttgtggattcatacagctggaaggaaggaagatgggagttgagggcatgaatggagatgcaagagaaactggggaactgagcctttacatggaaagatccgatcagtatttagaaataccacttgccctatgagcatgaaagatgaacttttttttttttttttggttgggagtgcagtggaggaggaaaacaagatgagaagtccagttaggctgctccagcaatccaaggatgaaaaagagacatagtagagaaagatttcaaaaccaaaaccttcaggatgggtccttgccacaaggagacagaaaaatttagaatgttgtctgggatttctggcttcagccagttaaatagatggaggcactattcaacaagatagaaaatcttggctaaaggaagtcctcttaattgagcacaaaatttgattctaagcttcccagcagcaaaggcaaagaaaaaccaaaataaatgacctcatctcactgctcctcacaggatgcagagctgtgcagcacggaaaccaaattttctcatcaggtatatgaggggattccaatgagggaatcttcatggaaaggaccacaaaccaaagacagacaatagttttataaaagaagcagaaatgttcttgcaggactgttctgtgtattgacctctggtaagagctgagaataagatattaaatcacagctgtgtagtcatttgtgcaaggaagtctgtataatggccttggggtctctcatttgctgaagagctttgagttcttggcatctagagaagtgaggggttggatacaaatggaaggaacttgcactgataaaaacattttataaacttgaaactaagagttcatgaccttagtgtataagttagtgccaggataattttaaaggagaaaaatacaaaagctccaattctagcaaacaccattaacaacataatcaagtaacttagagtttcatttttaaatgttgaaacagaatccattgtggggtttcttttaattacatttcttcctgattaacctgggtttattatagaaatttggaaaattcagagaagcagaaacggaaaaacctcaaatcac

SEQ ID NO: 34185 - DNA, 1502 bp, Bovine  19866881940706
attggagctggctgggtgggtgccctactactgctgggatcctttgggctactagtttgggaagtaccagagcacaagggaacatgcccagcctcaccgatgcttctaagcctttgttcgtgtgatacctattaacatcgctttggctagaacaagtcacatggccaagcctgaagtcaggaggtcctcactctatccatgacaggggtaggaaatgggtatttctgaacgatattctaatctaccacataagaagaagggtcagagaaaaaaagaagccaaaggagcccacagctaacttctttcctgagctacacagcattatttttcttgtacccttgattttccaagccctagaaagggtgccattgatttgcttagggttggaaatggcaacccactccagtgttcttgcctggagaatcccagggacaggggagcctggtgggctgccatctatggggtcgcacagagtcggacacgactgaagtgacttagcagcagcagcagcagcagtgtgagtggattagacagaactagctacatggcttggctgcttcctcttcagaagaatgcagatagggatgtcagacaattatggggagacccacctcacagtggacattagctttgaatcccaacttttgcatgccagcatcatgggtgtaatttgagaggccttgcaacttctgagtacagtctctctctccacatggctgagagctgatagagaaggtattggcaaggttaagaaatagggagaattgatgatttggaatagttgttatctcctctttttgtcacaagcattcacaattctttatcttctaaatcttaagtttactaatcagcctgaggcaaggagataaagatatgctgatacaattacggggcgggggtggggggcggtgagctcataattatcatcaaagagtacgattaaaaacactttttatttaaatatttatcttagagaatttcggcttgtgagtttacagtgcttctagggagcatggcagtttgagagacaatgacctcttccttctggttcttttgatgactgtcagagcctggaagttttcttcctggaatctgttttccccagcagtgccaggcacatggtaatgactcgataacgttttcatggagtgaataaactgtaaaattggaacagaaccgtccatggatatagtaaggatatgaatgaaatgacatttaaaagatttttagtcttaaaggtaaaaaattctgaattcttcctgctttgagtgggatgtaaattcaagagtatgtgattttgtacaatgtagggattgtaaatatccccaaattatataaataagctttttcttaccccttgcaacctcaggtacaggattttatgggctcttccaaatagagcatgttttatgcacaaagagttttgttttttgcagtatatattttttattgacagctttgatgatgcagggctgattcctatgttaagagagtgtcagtta

SEQ ID NO: 34186 - DNA, 942 bp, Bovine  19866881988865
tccaactcaggtaattggaaattgtcacatgccctccagaagttattttgtttcttgaaatattattaatgccatattcagatactttagcatccgccaacacaaccaccatggattgggaagatatgatgactgagagaagacactagtaggttttcacttctcaatgaaacactgacattggggtgtgtgaagatttgtgtatcatgtcctgctctacatagagtttccaggtctcggtgatgttaacatttcagtgcaagttgagggttgtagccatggtgctggtggatgactaagctatggttagttataaaggtgatggaagcaagtgtcaagagaatgtaataatcagctgaggcttttgaaattgtcccatgccaagtttatatccccaattttctgcacttagagccgtgtggctgaaatagatggatccaacattattctgcagagataaattccagtatctcccacactccaaggatgtgtggcacactttagcatgcccaagggttgctgcacacttagcatcagcagctcttagatgcctgcctgtaactgagatttttaagacctggcatttgaagattattctgtgtatcaatagaaaatgtttgtcggctcaagatatatcactgtctgaatcccatctaggcagccaatattttacctcttttctcgatcatatttttcctcaaacatcaccagggtaatatgaatagaggcaggtgattttgaaacacacttctaatgcctggttttagacaagacgtcttttcttacttttcaagctcattgatcctcactatgacacatcacatctggtcgtgtctttcctgttctgtttatgtaacatagcatggtgtcaagtggaactgtattctggcacagtcatcagccaaagagatcacaaacgttacttctgaaactgcaatagaa

SEQ ID NO: 34187 - DNA, 838 bp, Bovine  19866880052555
ttttttgggtgttagttctaaaaggtcttgtaagtcttcatagaaccattcaactcagcttcttcagcgttactggtaggggcataggcttggatcacccgtgatattgaatggtttgccttggaaacaaacagagatcattctgtcgtttttgagattgcatccaagtactgcattttggactcttttgttgaccatgatggctactccatttcttctaagggattcttgcccacagtagtagatatgatggtcatctgagttaaattcacccattccagtccattttattttgctgattcctagaacgttgactgtccgtcttagcccctcttaaattccagtcattgctatggaatcttcccagatttctccagctgatagtagtttatccaaactacaaatttctgtagactttcatttgtacttttctcatggaacttagttcaagaaacagtgagtatcttcaatgcactattctattcgtttactttaatatgtgtatttgtcttatatcctgttagctttgctcttcttgaggataaatactcttctttgaacctctttttttcttatattttctctcttctttttcttctcttcaggaatgagcataatcctaaagtgcaatagatattccagaaatgtttgatgagtgaaagacttagtaaatatagtcaatagggtctgttcctaataaacatttctggaatggtgttacttattaagatctattataggataaagtttaaggacctattgtatagcacaggggaactatactcaatattttgaaataacctataaggtagaagaatcgaaaaacagtgtatatata

SEQ ID NO: 34188 - DNA, 668 bp, Bovine  19866880353310
aaattgtaagacacagtaaaatatatgaaaaatcaaaatctaaagagacaatgcaatcatcagaattgataggctaagagaggggataaattgaatcctatgaacttatttaaaaccaaagaaggcagaaaaaaggaggaaaagaacaaaggacaatgcaataaatttaaaagttacaaacatggttggtattaatccaactatatcaataatcactttaaatgtgaatggtctaaatacactaattatagagattatcagaatggattaaaaaaacaacagaatttgactatatgttgtctataagaaattccagggagggaaatgcaatgaaaaatttaaaggatggaataaacatgtttgttcgccatcaaaaaagatatttagaggataaagaatggcatccaatgaagagatgtttaaaagattaaaagtgtagttgtaaagcaagaaatcttgattgggaggtgccagcgaattttgaataggagctagaggaaacatggaggcatggtatttaaagaggtgtagactgagaatttctcaggactgaataaaaggatacgggtgatcagaaacaccaagggcataacaagatagatgaaaacaaatctgcacctgtatacactgaagacaaactgcgcaacatacaaaggtggtcttaaaag

SEQ ID NO: 34189 - DNA, 2900 bp, Bovine  19866880426791
gaagcgtggggcactgtttgaggaactgtcttaagggtgggaacttgtgctcagttgtcctgtttctggtacacagaagagtccctgacacaggggtgcatttgtaggccctcacaaaatatttgaatgcagagcaagttaatttgaactttgagtgtggtgaatgtgaggagaatagcaacaggcccagaagggaggctgggcgcttcgggggagaaatgttctgatatcccatttatgttctatcttaaagtgagagaagataggacttctccgttagtgtctgttgccttgtagaacttatgtaattcactggagttttatgtttcatatgactgtttattaggcatattttatccttttattctgagatttctgtagttggagacagttgtgaggtatttcaaaccctgacactgggattatgaaaatcatatgtcatttctaggagaatagtaaataaagaagattaaggaaacttgtccaattatatacattattgagatgctaagcagttatcaaatactaatggataacatccttgaaatgttcgcctatgtaaattgtttggaactcgaatgcatttttcagtaggaactgctgtgatattggctttctaggtatttcccagtgcttctagaatgtaggagagaactgacaagatgggaatgagaagcctgggttgtagcctcagctgcatacagtgtagcttggctaagacattttatctccgactttctcaatgtctttatttgtaaaaactggagagaatgtctctggcagcttcacagagtagggatatgtaaacaagactgtatgaaatgctacattgcatatgaaatgctttattgatataaggtgttccagtgtcaagtattattttcgtcagtgttgagcattttaaccccagtgtagcagaaccacagttctaattagcacatccgagcatctgaaactttatctaactttggatctttaaccctttctaatgtttaaagtttttcataactgaaggacttgctttcggagattagcctcatgtttccacccggttgttaagttaaaaattataaacttacagaaaattaaaaggatggtacaaagggattttcctggtgctccagtgctgccactgcagggaacataggtttgatcccttggggatctaagatcccacaagctgtgagatggggcaaaacaaagatgaaagatggtacgaagaacaccttagttttttaagacagcaaatcgtatgtagttaagccctcttttaggaagcagtctttaaaaatcttaattttaaatagataaaataagatcacttttttattttacaaaaggaatcacttgaattgtgatttgagtgtgtagtttgttattatcttgaaaagaccaatttgttgaaaaaagtcctgagttggaagccaagagacagaggagcttgtcacagctgtgcctcttgttccttttataacctgaaactgaggttcctaaactccagtcatttgacagtcacctttatatcggcatatcagtgtataatctacactgttatttttctgatactttctttatatgatgcattgtagtatatgtgctgccaaagtgagcattatgtgatgcagaattaaaatagatttagaggtataattgacatgcaataatctgcatatattaaaaatgtacaattcatatactttggcatgcataatgtacttgtgaaaccaccacaatcaagatgactaactttttaaaagcttgtgtttatttaaaaggaaaccatatattattagtttttgctaattatattttctaaatcagattggaacaaatacataaaaatatttatctgggacttccctggtggtctagtggttcagactccatacttctgctgcactgggtacagtcttgaactcttgtcagggaactaagatcctgcatgctatgcagtgtgacccccaaaaaagtatacatgtgccacttaggttataagtccaattataattttttatcacattttgggaaaccccatcttaagaaacttgtatttcttctttgggtcataggttcttcatttgaaaagtaaggtagtggggtcgtttccaacctcagcattttgttatttataaaaagaactgaaatgttaaagacacagaaagtataattttgtttgacaatatagatagtactaggaaggcagggattcttgtctgtctctgggacctattaaaacagtgcctgggacctagtaagccttcaataaatagttgttggatgaatggatagatagttaccaattaggaatgaaattatttctgagaagtatgctgtgagtgaatgagaaaaacctgttatattcattccttcatagaattgtcatagaatcagctcctgggattctataaaattccttaagtaatcaagaaagaattaaggaaacacatccaactatatacaagtgaaattttctagggcatttgttttctcacagttttcactgcaggaatctttatcacaatggaagaagagggaaataggtagagctcagagagatagacattatttcatatttatttacttatttaaaaagctggtaggagaggaagatgcaagtataaaaatgatgatatggaggtgattactaataaacatgatttctgtaggctctcccagtaccatctcagtccagcttactaagagttgattataaattctgtttgtcttgaaatatttccacttgaaatggtactatattgaggagttggggatctctaaatcaggtaggatggtctttgtatttgatgtaaggatttacttctcacccctcctttttcttttttaagcctcactataatgtgactacaaccagattagtgaatccagatcaactcttgaat

SEQ ID NO: 34190 - DNA, 1582 bp, Bovine  19866880471472
aataaagaggcctatccaaagttatttacctggttaagaaacacatttccctgattctcaaccaaacgttcactaacattaaaaaattaacaacttcaaataaagattaaaaaaaaaattccttcaaagctatatatgcattggttttaacacctaaatttatctcacaaatatccactttatttcccagtagagtttaaaaactatgaaagaggcattttaactggaaagaaaagcatacattatcagtttactatccaagaacatcccacgtttgtattcagacaataaatagcaatgccacaaccaaaaaagatggctcttacataagagagaaactgcaaaagcctctcgcctttcaaaagtaggagcagtattcattcactgaaattttttgaactaggtaacttaaagcttatttaagctttcagattttactatacaatctttaaaaccaacatttctactcttacagtctactaactggtcacttctttggaaggaatgatgctaaagctgaaactccagtactttggccacctcatgtaaagagttgactcattggaaaagactctgatgctgggagggattgggggcaggaggagaaggggacgacagaggatgagatggctggatggcaccactgacttgatggatgtgagtccgagtgaactccgggagttggtgatggacagggaggcctggcgtgtgcgattcatggggtctcaaaagagtcggacgtgactgagcaactgaactgaactggtcacttcagtcttgttatttcttttcaaagaacttttagcctatgtttctttctgatgagacagttatccatctcaaggaaatttaaatgaaattcacatcttgattttaagcctagctttcattagaacatgattaacagtttaattttaacttaaaatttctgacttactcttagtgagctatcctgacagtgacagatttgaaacactactgactctagtgttatattttctgtccactcttcaaataagattttcactaggaagtaaatcaaactgagatagagaatccaaatgtgggaaacaatggtcacaaaaaaagtcagaatacaagatgttggtaggagaaaataatgcttaatttattcagacaagtccagctgttcctgagataaagtctttacaggataactaattttatcacaacacttccttcaccctcagcctttttccttttgctacacagttatcttaatctttgaagctattttacaagcctcactttcatgtcttccttggttaattccccactctcagattctcttgaaagcagccatagtgagctgtcctcaaagcacaatactgtctgaaatatacacagcctaaatatttaaaacccaaagagttttggaagagaccctgaaagtcattaaattgaacgctctcattttatacatagagaaacaggctctgagaagcttatttattcattgagcctaaaagatctcctaattcaatcctgtaatctgaaattaaggtaaatacacgctaaaaagatttctaagaattttcgactcgccagcgccgagttggtg

SEQ ID NO: 34191 - DNA, 1818 bp, Bovine  19866880530445
tttttttttaattatgctgactagtataaagaaacacaactgatttgctgtattgttgctttaataatctgggattttctacctgtatgattatctcatctgcaattacttatgacgctatttgctcttttcttattcttaccctctatcatcagtcctggcctgttgttgtttagtcaggtctgactctttcacaaccccatggactgtagcctgccaggctcctctgtccatgggatttcccaggcaagaatactggaatgggttgccattccctttctctagggcatcttcctgacccagggatcgaacccacgtcttctgcattgcaggtggattctttaccacctgggaagcccccagttctggcttagattccaggatactgaatagatgcagtgatagtcatcaccctggcttagtccagctatcagcaagaaagcactctaagttttaccattaattatgttgcttgaaatgttatgtgaactcagtgtggatctatttctattggttttcatttacagtctttctttcctcatgtatttggttaactttgtttcctgcttactgtccttgaaaatttagttgaggaaattctctgaaaactagaatgaagatttcatcctccaaagagaatatgcatgttttctaggcccctgcagtcccaaatactttgagtaacttcacagttgatgtgaatttgactgcaaattacatttggtgccagttacttttattctgctgaagctgaagctccaacactttggccacctgatgtgaagacccgacccactggaaaagactgaaggcaggaggagaaggagaaggaggtaacagaggatgagatggttggatggcatcatcaattcaatggacatgaaactgagcaaactctgggagtggttatcctcaatcagggggaatgctctcaataaccctcactgacagctccagaaaataaaactccccttttccattttaagatattttattggatatgatggcaaaactttatatctttgcatctatcaacaaaataaaacattttccctttatactgaagatttcctagtgttgaatttatcctgcaccatcaggatagactattttactataacactatcgtttattatttaaacatctgcatctgtactcaagagggaaagtagttgaaaggttttgtttgctgtactgtctatgaggtttgattattaaggagcttcacataatatacttggaaaatttctatctgtggctatgatttttggtctggcaaaccctcttctcagctagttcctcagttcctggcaggaacaaagggaaagaaagctcggtacttgtcgtctcagtggagacctaggaaaacttgaaagcaaagctgcacccaactgtcttgcctactgaattactctagaagaaactggaaggaaacagaaaacaggagtatatcctcaaaccaccagctgactgactggcgttgttattaaattctctatcagtcatttgaaatcaactattacaatgaagtcattctgagcttttataaccctgatctaaattttttaaagttcaactttcttttaaggaagctgtgtagaatttaaattttaatcttcaatgaagaacgatgaacttatctccaatagattcattttaggtaaaactatttccttttaggtaaaagtaatctacaacaaaaaacaatcaaactaaatacactgctaccaactttaagcatctgtatttcctggatattctgttactatacctgatcatgtatgtcaaccattactgcattctgctggggtggatgag

SEQ ID NO: 34192 - DNA, 1459 bp, Bovine  19866880614118
cagagcgcagacaaacccacatgagatcccttcttgcgcataatgtgcatccgaggacaaaattagattgagaagtaaatggagccgaaaatttctaaagcatttcccatcaagaagctgtttgattgcgtgttttaattctctgagtcctcctgcccagtgaggttcattttggtggggatggctggagcagaaggagcttgtgatgggagggggagtttggggacctggggcctgggcaggagggagggaggaggccttcgaccacatgctggttctgagtccagactccccgatgacctggttgagacctcaaacagctctgtgaaatgggtgttatatccattttgtagacaaggaacctgagtggcagaaattagggaacctgctgagactacatgaagagtgctgggttggcaggggtggcgtgcaccgacccacaggattttaaaactcaagctggtgccacgtcgggttgcatgcttgaatgtttccatttttcaccagaaagctagacttttcctccttctcattcctgtttcctccatctctccttcctccattctcaaagcctaggaatcctggcggacagagcaaagggtaacatccccattctccagatttggaaagcgaggctcacagaggtgcaatcatttgttgggagtgcagagagaagccagtggcaaattctgggaattctgattcttgtgtgtgttcccctacctggtcctgtctggcaggctcaataaatacaaagatgtgacaaaaatcacacacacacacacacacacacatacatgcacgtgcacacttgcatggcaagtttagatccaggtggacttgttcaccagtgcccacccctgtttggatcacggagctgaggggttgtagggcccaggcctgactgtgcgtggagctctgggcctcaccctcaaagggactttttcatttacctgccaatagtgattttccaacaattgttaagttttagtttgtgtcaagaaaatttttgttcagataagatcttcctgggaagcgtttatgtaaatagtcagaatcgaggttcagtggttgaggggtggccatcctagaggcccccagtgccccagggagccccagggaacatggccggaacccctcctggtcgacctttcatgtcctttggatgctggtgctccccaatgctgatgctccccaaagttccagagtggcctttaagactgtgtgaaggctactcaagaactcgtgtgttctctcctcagcctggctcttaatcccacctctgggaccctggctctccctccttacacctcagctgcccacccaccttaccccaacttctgccagttcctgaggatactcataccagtctcaagcacgttgcccctcgaggctcattcatggtgataggacccaccggtactgcccaccctgcccggctcagcctgagccctgctcc

SEQ ID NO: 34193 - DNA, 993 bp, Bovine  19866880617901
tctgattttagagcctgtgagtttacccgctctgttagtggcagaggtagcatataaccccagcccccagcaactcctctcctgctctcactccttacctagttctacctcctgttttccgagctccaaagctcattctgcatgtttgcagggcagcaggagcactgatttgtcaaggtgtcttttctcccctggctttctgctctttgccttgatgccgatgaccgagaaaagaccgggcaggagagagaagctgctgcagaagctgggtcccgtcttgaccgtcctagctagattattctatctggaatttagtttttaaaaaggaaagggggaatccagtgatgtcttttaggaacaaactcttactattcatgcctaaagtacctttatttatagtcagttttggcatctgtcttcctgttcctgaaaaagggtctggagagctctttctctccctatagctctcccttttcagaaagacagggtgacagtcttgagatagttttagtggacagaactgaaggggccttgaacccagtgagtttgaatcctgtcaattctatctagcctctctaaaacaaatatttcgtagtgcttcctttgctatactaagatgacatttagagaaaatataacctgcctagacacataatttaaaaatcaatacaatgctccaattgtaacaaaaaggggaaagaaaaataaaatcagagtaaaatgatgtatttcattatgtaaatgctcagaagacataataaagtagtcagttgcttgcacttatgcgtagaatcaccatgaatacggcagctacaaatgtggacagctgtgttttctggcaatacaaatgcctctggtggtgttgccatcagcaaactgattttctgacattgtgaacatcttgataaaattccaaccaaaccaaagcataatcttccctcaatttatgtgagggttgcattccggaaaattcaggtaattaaacaccaagtt

SEQ ID NO: 34194 - DNA, 2162 bp, Bovine  19866880714140
ctcaaagtagctttatctttattgcttgtcgatcagaaaaatgccttcttgcatttggttcccagacacaagactcgactgacaatctctgaagagccaagggaaggacaggaaaatcagaaagaatcagacattcagccaaaggggcaaaatctgcctccctttgcacccaggtaattctgattggggcaggaaataatcatgggactccaaggggctgagacaagtctgaaatttcaacattcttaatgagggtagacagttcattttagagactgtaagtaccatcattagaggactcaagaggaagcctccaacagcagccacacaggagaaagttcaaagtcacctcaaagagaaggaatgctggagaacaccagtacttaactatggagtgcaaattaaggaaataattcacggtataaattttaaagtacatatggactttttccttcttctttttataaggaaaggggactgtctctcaaaatgtaactaattgttacttatataaccatttggataataaagaagagattttcactagatttcctgaaatgcatatctaaacaaagaaaggcatcatctaacaggaacatactccaactgcaaacacgtggtcaattcagcattcatactgtgatggcttcccgacactccagtcctgcaaattccctcacagcatacccatggggttttcagcaggaccaaccctggacctagagcagtggttttcaaccttgactacatattaatttcatcaagagaacttataaaaagcgtgaaatttaccattcttctcaatggatgcaaccaggctcactaaatactaaatggaagttagtgtaagataacaggcaagaggtgcactggcaaaggaaataaactcatttttatctctgcacttaccttgggttttgcacagagaccaaagtcaatcagctttaatttatgatattcatcaaacaacaaattttcctgaaaaaaaaaaaaaaaaaaaagacattttcataactatatacagtcttccttatattacatcccacctctagctattcctaaaagcactttaaggttgggtacagggtaaaaaaatcaattgagaaaaaaaaagaatgaagtgacaagaatagaaggaaagagaagaggagaggaatgttgataactatcctgcttcccctcaagtcacattagcataaaccaatttctccttggtactctgaggttcaactacaagcactttgatatgtgccaaaggcaagtttgaacagaaagagtgaacgcgaatcaaagagttggataaaaacaaagggaaaaggacagaaacctccatatcttgttagggaaattctagatctcaaaccctagtaccaaattacattgaaattcatgttcaccagcatgcatattagccaaagcctacacacttaagagtatcaaatttttattctgcccttgaaaagcagagtctgcccatttcattgaactgttcacttctgaagcataatggaattaaaattaaaggaagatgatgtcaggaaaagagtatcaagaggaagatactcaaagacaatattctcaaagaaaacactcaaaactcttctttcctaggaataaaacctgaggtttatattctgcatctgattacaaagacatttataatgtcacacaaaattgacaaagaaatagaatgccaataataagtccatccagaagagcccagcaggagtcaaaagtcaaaaaggaaaaagaaagatacattaggaatggaacaaaaaaataagcaaaagcccagataaattctaaacagaaagaacatttggaaactgactgatggcaggtaagtgatgtcaagttctcaggtgagcacccgtaatgcagtcacttactggttttgaggtccctgtgagcgtagccctggctgtgcacataagcaactgcagacactatctgacggaagacaatgcgggtctcctcctctgacaggcgatcgtgggaaattatgtagtcaaacagctctcctccagggcaatactgcaagagcagcagagtcacataaatatcattattacttgcaaaaatcagaggagtttaaaataaaaaatcatacttataagcaaggaatgaactaatttaggtatattcaaaaatacactctcagt

SEQ ID NO: 34195 - DNA, 1827 bp, Bovine  19866880739463
ccctgaagatggtgattttagaaggtggaacctttgggaggtgattaggacatgagggcagagtcctcgtgaatgaaatcagtcctctcataaaagaggctagagagatccctagccttttccatcatgtaagcacatagcaataaggtatcagctatgaaccagaaaaaggaccctcacccgaccatgctggtgccttgatcttgggattcccagcctcccagaactgtgagaagtaagttgctgttgttcataagctactcagtctgtgatactttttatagcagcccaaacagactaagacagtgacaaataactttaggtctctggaacttactactgacctcgagaaccatgaatattttgttggctgtctctatcacatggtagagttgacatatatgttgatgtctcaggttcttcaaggcatcaatttctgttttgacccgaggcaaatcactctgtgacaaaacattttattaaatgagcaataaacttatttggaaaatattccaagccccaatatcaacaactctaatactaagtagcaaaagcagtcaatggcctcaaaacaatttgctcaacaatacagaaatagagaacagaaacttatttctgtgtacattttcaaaaggccctgaggattttacaaaagaaaagtccaatctgaggcaagagtacaacatccagaaaaaataaaataatctcactccctttagaaggttagcattccaaacaaggaaactgacaggaacactatccagcatgcatgtctaggctaccacttcagtctctacaatgtccattaagaagcatgatgaaacctatggctgatccatgttaatgtttgatagaaaccaatgcaatactgtaaagcaattatccttcaatcaaaaattaattttttaaaaaagcctgctgagctaaaaattggtgaatgtagtaaaaggtattcactatctcagtcttccaacttttcaaggagcttgaaatttttcaaaataagaagttggctgggaggtggatagacaagttgaaaaaattttaaagttcacagtaaagataaaaatccagatatccatgtagtaaacaagtaatattttattataaaaagggactcagtctaatgatcagtggtttaagatccaattaacttaatatcaggccatgcaacctgatattagatcttaaccaagaagttgtaactttaactatgctgatatgatgatctttttttcttcttttttgggtggatgtgggaatctgatgattaaaaccctgaaagtaatcaaaataattttaaagtcctaggaagtaactaaaataagcataataacaataggaaatacaaaaaccagtttagaattaatgaattaatatcatcatattgatgctttagaataagttttgagtactagtatgttatatcttaataataacaattcacattttatctgctattaaggtatttgctgggtcaagtaaataaggtacactaaagttataactgaagtttaaattgcttaagggaattaaattaatcaattttgtaaccaatgtttaaatgatcaggaaaaatcattcttaatatctttttattagtttaataaacataatattgagcactgaaaacaaaaatactgagggagagctgaattatcagttgacaggttatttaaaataattctgatacagatcactttgtgattttggcatatatttcagaaggagttcagagaattgagtgatactgctgctgctgctgctgctgctgctaaatcgcttcagtcgtgtccaactctgtgtgacctctgagacggcagccca

SEQ ID NO: 34196 - DNA, 1800 bp, Bovine  19866880755672
attggcacaagtttatcatttgtattacgccttccttgggctaatggactaaaatggacgtgagggagaaaaagagaatttcccaaagtcacttaggaagaattgaaaaatgccagaagagatatgcttgtagtgagatgagctgatctgtgagaggaaacagaaaggcacagctccttcagagactagaaaagagcaagatgaaaagcaacaagggggtcagacacttcccagtgccagccaccaggtggcaccatcgacccaagacagcttagttgctgtctagggttagggacaagaggggtgacagggcagtgtgtactgaccatttgtgagcttggtatgcttgtaattcggtggagggcagcagtgcctaggcatgtggaccatttgtctgagtttcacttatctgccagcatttaatcagggaagggggaggctgggacattgctgttgggggtcaatcttgtccttcctcacctccatggtggagatgtcttgatgcaaacctttttggggagtccagtcctcggttctcagcttttacttgctggccgtgtgaccttgggcaagtcacttctctctagtcttgttttccttgtgttaaaatgagatttggacagatgagctgagggatcttttgggctctaacattcggtggtgtgccagagaaagcattggagctggagttgcattcaggatagttctccattggctgtgtgatcttgggcagctcacctcctgtctgtggggataatagtaacatctgcctcacagcccattagccaattggaaaatgctttgacatttttttggtgctgtaggagagggaggggttgctatttattatttttcttggcaacttaagttagccagaagcaggcctccatcctcactactcagaaagtttgcacctctgcctgtgaccacaaaccagtccttacagtaggtgttttctcaatgtcactgcatctctggcctaactatctcatgaaactgctgatttctctcagttctcactgccactgtcttggtcaaagcaccatctcctttcctttggattattgctgtagcctcctagcgggtccccacctccaatgtcactgacttctccaaacaacccacctcctgaatagcagccccaggggcacttctgaaatatagttctgatcagtgactcgcctgaagagttttcactcttcaaatctgcccactgttctcagaaatcatccaaacttcttaacaaggctgctagaccttctgtggtcagatccacgcccatctcatgagccctgttcctctccaccctccttttttcctgctcaccccagtcataccaaacctctttccatcccttgaataccacctgttctttcctgcttgcagcctaagggtcacatgcatgggtggtagagccaggcaaccagggtcctggtgctgactccaccagtatctacttgtgtgactttgggcaggttcttgaacttcagtttccctctttgaaaaacaagggcacccattgtgccatgattgggtggttatgtggactgaatgagctaatgcacgccaggtgcctgggaggacccgtatgcataatacgtgctcagtaaaggacaccttttgtgacaatgctgttcccaccacctggaaactgccccctcccccaccctgccatttacccagctgagggcccacaacttcaggatccagctcatgtcacttcctaaaagtgaaggcttccccggggcttactcctaactgtcagctcccctggccccatctgcagcacacagaacctgc

SEQ ID NO: 34197 - DNA, 979 bp, Bovine  19866880791913
cccacaacacctctaaaacacataatttttaatttctaaagtacaacattcagttttgaatggctgaatgcgtgaatgattatacaaacgggcctccatctacagacataaaacagacccatagaggttacctggcttgcccagggtcacccaagacccagggccaaaccaggactgtggcccagccttctgagctaaaatttccccagaaagttgccttgtgtctttctttcgttggctctcccattccctagcagactcacctgcttaacttctttttccataagagaaaaacaataaccctggcataaaatttaaaagaatgtcagattccagaattaactggcaatatgagttacacataagtcaaaacgcaagcaatcaaaaaaaaaaccaaccaaccacaagtcactgcagctcttccagggacctcctctgaggtaaatcgctgtttctaaggacatttccatgctatcagctcttcctcgttaacgcaaataggatgtcagggttttacagtaaaaccgaaaccagggagaagagagccatgaaagatcatttcaggggaaaaaaattacttgatttcttttctgaatctaagccttcactggatgtctctctcaacatttacagaggaatttttgacttcctcttgaaaaggagattatcttgtatttgggaaaaaaatttttttaataaaaaagacattttggagatgactgaaaaaatttaaacctaacgagtttacaataagcaaaggtgggtctatgatgggtaggaaagataacacaggacaatgagtggttccattgaaagagatgctgaaattctcagcttgggtaagtctggttagggccaagttagcgaatatcctagaaacagaagaaaccatttgggaacagtgatatggatgcacaaattttattttccattgagaagactgtcatgtacaaatttgggaccataaagcaaaactcag

SEQ ID NO: 34198 - DNA, 1320 bp, Bovine  19866880826230
cccggcagaacagctgtctctctcccgctcccccacccaatagagcttcagcgctttctccacttctgctcatagtatggtacctaatacagttttcccacctgtgcctctcctgcatagcctctttaccttaattttaacatcccagtcaggtatgccatgccaccaagactcaatttatagatgaagcatttgacatctttcaggcataaatggttaatttttgacctcctacaacttggaagaagaatcagttgttcacttgaaagtatgttgttcacttgaaagtacgctgttcacccagggtttccttgttgagtcctaataatatgatgtgatttggtaggcaggactaggtgtgagattggtgttatttagtataaaaattaaagtttttccaaggctcaaatgagggtgggaactgtgacttctcagccagtggtcgaatggctatcttacgtaaaggttaactcatttctgggattttgagatttgtagggctatttgtactggcaggctaatttctagccttgatccttgaaaagtcatttgttgaactttactaaggtttctctacatagagaggactttacagtgcagcttagtcacatttgcaggttatcagtagtaaattttaaaacttgttttgattttctcatgcatgtttacataatcctcatatgtaataaaccctcagtagcactatagttttctctttcagaatcagagacttagcctcatcttcttccttatcatgcccaatccagccaactggaaaagattttctattaagcattggcggggagtgcactgaactggaagtcaagagacctgcctgggtggcctgccgttggctgggtgactttggatgagccttccttttctgggcttcacactatagaatgagctggttgaactggatgatctctgagttcttttccagctctgtaaagattctgtgtactgctattttgaaatgtgttctgattttttgtcttttgatttttttctcctcaggcagatgtttggagcatgggcatactcttatatgtacttatgtgtggctttctaccatttgatgacgataatgtcatggctttgtacaaaaagattatggtgagtattacaaggcatagaatttcattgtgagagtttattatactgcaaactatatgcttctatttataaaagtacagaaacaggcagaagtaatctatgctgttagaagtaaggatagtggttactctttggaggtggatagtgacggaggaggcaatggcaccctactccagtactcttgcctggaaaatcccatggacg

SEQ ID NO: 34199 - DNA, 1273 bp, Bovine  19866880908067
acttctagtaaaagtcagcctttgcacaggactcgtttttgtttgtttgttttgttttgcctttcttcataaaaagcacaaataatcagttgtaaaaacccttctatctacagagttggtatttttccagacctaagaagaaactaaaagatttgtctttacttttttttttaattcttggcatggcatgaaatttaacttgcatagtagttattagtgctgtttgctaagtactttcggttttcccacctctgggcacaaactgacattgcacttcccagacatcttttagttaggtagggccatgtgactgctttcagccaataagtgagtgctgaaatgatacgttttacttctgcaccaggaccttgaactactactgattcaagagtctccagaactctctttttcctctagcataaccaatttcctcatacattaaccagtgatgcttaggatgaaagttactccatcttcttgtatctctgaatatctacaattaacagagcccttacttctgacccacaatggacatatggcttgaggtagaagtaaaatttgttgttttaagacactgaggtttggggataatttgttacaacagcattatctagcttattctgatgaatacaacttgcatgaagttttcaaagagaggtggctaagcaaaatattaggtagaagcaatgtaaaagaacatattgtttttcttctctaagtgagacaaaggctatatattcccagagaaaccagcagtgaatcagaacttagaatcttactcagatcttgtgtataatcagatccccagtgcccagcacccagcacatagtaggcattcaaacagtatttagttgattcagttaagtcagagttctcctttcaggctctgctttgtaaaatagaagcacagcattttctgtcacttttctccactagcatcacattgcctgcaaatgggagtgacaaaaacaacttgtcctcgagaattgttgggagaaattgagctgatcacaaaacactttgcaaaatgtaaaatcctatctaagtggcaattttctccattgctatgccaattgtaataaatgtttttaaagctggctcctggcttgcttttccatggccaccctgtaaaacactccaacactctgggggttattgtttattctggatttgcgtgtgtgtgcatgacacttgtgtaatactatttttttactgaggagttgagtaaaacccatcttgtagcaataaaacttgagaatgatgtcatacccca

SEQ ID NO: 34200 - DNA, 2842 bp, Bovine  19866880940067
ctgtgtctgactgtttgccatcccacggactgtggcttaccagtctcctctgtccacttcccagacaagaacactagagtgaggtgccatgtccttctccaaggggtcttcctaacccagggattgaacccacatctcctgcattggcaggcagactttttttttttaaccactgaaccactagagatgcccaaagctgggcatacaaagagttaaagaacttatctggggcctcatagctcatccggggagatgagaaatggatggagagacgtccccagccatccaggggttaaggctcctccttccaatgcaggggactcaggtttgatccctggtctgggaactaaagtcccacaagctgtgaggtgcggccaaaaaaaatttttttaaagaaatgaatgcgaatacctgtttcataggtatgaagggctgaatgtcttgagacagggacagaaacaggaaagaggttctgaccagctgggaggttctgaccagctgggaggttctgaccagttgggaggttctaggtttcttggaggagggagtcctagaggtgaacccgaggaccaggcagcgttggaacacatccgcttgtccccgtttggggtttcagtgtccccctcttgctgctgacaagataacttcttactggagggtgaccttttacaggaaattcagaactcaaatcgtcagtgttcagctgcctgcagtgctgagtcctggtggtcacggcctgactgctggtgaaacgcaggcagttgaggcgccacctgcttcctctgcgcactgatcttcagactcatcaggaacagcaagagcttccctctgagtcccaaccttcagcacaggccttgcccacactctgggcacccggattccttggaacctggctcgggggcctgtccagcaaggcttggaagcccaggtccctgcagacttgctagttaatgagttctgcaaaaactaggtctgtctgtaatcgaaatgggagtacaagggtcgtgcagtccctgaattaattcagccctgttagaaaagaagcaaggcagtttcagctgctgcctgcaggatccacagagaggttctgagcaccattacttccatttggggacccgttgtttttcaccacttcagcataatcgggaaaacattctccaagtctattattcttgtctcctgctgccacactgaggcagttgttaacaatgccctctgcccaccccagacccctcctttatttaaataccagtctgatgggcaaagagagcatttaatgactactccaggctaaaaagttcctattattttattcccttcttactttcactcgatttccttccagatggggacaggtgggtataagataaatgaagctggaattacaaatgcaaaaagacagatctagatgtggtgaagaaattggacgtgcctcaaaaatttgtccaggtccttatgggggtgtcctctgtgtgtgtccttggtggccaccagcactaccactctagcctggctatcctctgaatggtctgggaatagggaattagagtgaccgaaactttccctcccattggagtgatcagagtatcaactgaaagggagaaatttactcgggcgtggtgggggcgggggcgggtagggtacttatcctagcagcctacaaccagggcagacaatcctagcctcaggctaccttgatccccaaaccttggacccccagtataatagcacacagcctttgtaccagtcttctctcctgtctttattcaaatgccatctcctctgggaaggctcccttgattacccatcttcagtgctcccttcaaagccctgtttgggtcccacttactggtctatggtgtccttctacattatggggttgtctccacttcccatggctagtgattcttgtacaggggggatttgatgctgctgcttgccatgtgaccttgtgtatatctgtctctggtcctcagcaacatcatttacattgtggggatgctaagacctacttacaaggctgtttaggaggagtaaaccagagcccagcttccctctctgctctggggctctggaaccagactgacccggctttgaatcctggcttcatcattttctgtgtcttcggtcctgttacaatctctctgagcctcaatttcttcatctataaaatgatggcacctaacccctatctcatatacttgtggggaggatgaaaagggataaaacttgcaaagtgcctaccgtaggtctggcacagaataaacattcaaaagctcagccattattgttgctgtctttactaaatttgtgagttggttggggcagcaaagtcagcctataatagtccccaagggccagttagtgttgagtatacaaagaaaaggaaaatgttttcaatctgagctggggagtattgtacaaatgtaatgctccgtgttacacttagtcactcagaagtgattaggacatgatcagagaatatgggcctgagaaggtacctgagggtcccttggtgcccctccccagctgttatagcccccttcagccttccagctctcccaggctctgccagatgcaggtgagcaggaggtgacagaaaatcatgcactgatagccagaaatttaacccagaaggaaagaaaatccatggctgccagctcacaagcagccaggagcaattgctagtgagtcaaggtcgatggccagacagacgggaggaaccaagaggagggttggtatttgctgaggttgctgatttccaggctctagcctgtggtggagcagcggcagcgtgctcatggagactctggccttccttcccggccgagatggtctgggg

SEQ ID NO: 34201 - DNA, 4717 bp, Bovine  19866880957137
catttattgaaaggcatttcccagggctgtatcttctatccagatggcttttccacaaaccttcacaaggcttctcctggctggggtctcagatcaaaaagccacctttttagaggctgtacttcatctcccatccctcttgtcactgccccccaaccccagtttccctctcctcctgtcttctttcttctgtgctatgaactcagacccagacaccagcacttctttcactgccagtatgaaattaccttgtatatcttttttctgtgtttgctgtgaattgtctggctctcaccggcaggtaagctcagcgagaggagggactatccaccaaggcctcgatggtactaccagccaagccccgagagatagcctgatatacagtaagtattaatattatgctgcccttccaaggcaaacaacttggaggaaagcttaatggctgaacacctggttacggagtatcatgctgtattatagcttttattgtcacttttccagcaccttttggcagcctagatacatgaggcattctttgtatttttgcttttgttttttattatgatttcactttgagtgaagaaatatttagttgggtctgattgaaccacataaaggctcataaaacacaggtcaaaggaggtgttccccacagagaggtcattcagagcaacgtggcatctcgccagactttttggtacaagagcccaggaacgtattaatagctgccattcattaagtgtttacgtagccaagaatcaggctaagactgcatggaccatgctcacaggcttcttgcagggagtactatcttgggccccattttacagatgggaccttggacacggaggctagtaaccgtgccccaggtcagagaagctggctttcaagagcagacagtctggctttgctgctgacattcccaattaaatgctaaaagatatgccttctggaaatttaaactgggatttttttggttttagtccatcgaaccacatattggcagcaggctgtggaagccatggccttggatgaaccccagttccagctctaactcactggatgtggccttgagcaggtcacctctgccctctggacctgggtctctccagccatgaagtgagcagttgccctgcaggaccctcccacctgcacatctgtggtcaggatgtttgttctgaagaagactagaaaaagccaatattgggtcgcagacctccagatcccttgtcctgcccacacacactcatatggccccttagtggctctcaaatcttttccattcactctccttatatcctcacaatggcctttgtggcaggtgggccaggaattgtcatccccgtttcacagataggaaaactgaggctcaaagaggacaacctatttgctgaaggataggacagttaggtttgatccctgggtggcgaagaccccgggagggggaaatgataaccactccagtattctttcctgggaaatcccatggacagaggagcctggtgggctacagtctatggaactgcaaaagaatcggacacagttcagtgactaaacaataacaggacagtcaggtagtaaagtccaggcttaaacccaggctgactcctgggtctaagtgctctttcctcagccctcagcttctgttcacatgagaaaggcagaagatagacttacaatcctttctttcaagtaccaagtttgggatactgggggtctaaacattgagcctgggggataccagcaaatcagagctggtggtttggtgatttggaacatctgtctgtctttgtgggtgctcatccactggtccctgtatgggctctgctacttagaggggatgcgtcaagggaagccccagaccctagggcctaggtcattcaccaggcaggtgtttctcaaagttgtttaaccagaagacacctctctcagtctcatcctgccattccaaccgcagatgcaaagcgatggtcctcaggggaaggtgccaataaggacgtgggctggccccattcctttgttctctcaggcaaaatgaggaaacactgccaggtcctttgctggcatccgcccgctgtcctccttggcaggtagggacagtggctgttccatcatcaagcctgtgacccaaggacacacctgtagataactagccccaatcaggacccaaactgctgacgatgcaggaatgggcaggtcatgtcactgctttgcaaatggtgagccgtttctgaaacgtggccccagctggtggagcagtttaacttaatattttatacggcataaaatgatggagagacatggactccttctctaatgagatcttccctgggtggcctggagtgtgaggacttgagtggaggagaacagagtccacccacctcctagatcccaggctggccgtccagctgagcacccactgcactctgggccttgtgaggaggggagaaggggagggtgaggctggaagactcagctcttccccgaggagctcagaactgtcaacacatccacgagggcaggtggaattaaattaacaccacgtggtgacatggagtcccaccctaacagctttcaggggcattccttccaggtgttctaacagctctcggtggggcgtcaactttcccctagaggatgttttgaaaatttgtgggggcttttatccgcttgacaggcatgattgatttggtgtggaacagtcccacacaatgaagaatctgcctttcattctgcatgattgtccttcctgcccaacatacatggaggtgagaaatctgcttataattatttaaatctagaatggaacttcatttacatataaatgtggacttgcagtttccatggtcttaatatacactgaattttctaggaatgcaactaccgtgtaaatcgagtaaagctcctactttgttttacttggaactttgccaagagttcctcacctattcgtaaattcctgctcacagtatgtcagacacagtaaatctgtgttcaggtttgttgctgagttcacggtgattctgtgcaccaggcaagccctgggctactcctttatgtcttgcagtttagacatgcaagagtatttacttatcaaagtacatagcaattaattaaaagcaatttcagttgtttctcctttatctaattagttcagttcagtcgctcagttgtgtccagctctttgcgatcccatggactgcagcacgccaggctttcctgtccatcaccaactgctggcgcttgctcaaactcatgtccattaagttggtgatgccatccaatcatctcatcctctattgtcccctcctcctcctgccttcaatctttcccagaatcagggtcttttccaatgagtcagctcttcgcatctggtagccaaagtattggagcttcaccttcagcatctgcccttccaatgaatattcaggactgatttcctttaggatggactggttggatctccttgcagtccacaggactctcaagaggcttctccaacaccacagttcaaaagcatcaattctctggcactcagacttcttatggtccaactctcatatcctttatctaatagttgagcattatttttattttatttgaaataaaataaagataggctatattttttatgaacttaatttcaggagagtaaaggggcaccatgaatatttgctactgtcaggggacaccgggtgggactgagcagagaaccccggtctcagcacagcaccacagtgcccactgagcaggagaaggggccgagcagcgccccctccaatcatcatacataggcatctgctctgcatacgtgtgtccatgcctttgtgtgtgtgtcctttatatttttccactaatgggatcatactaaacacattattctgcaaaattgtttatttacttaaacgtatatcttgaatacattcatgtcagcacagatagctgtacttaattctttttaatgttgcagagtagtttattgtgtgaaggagccataatttattaaaccaccctcctagtgataaacactgagttttttccatttgtttttcatgataaataactctgtcattattatatagatttaggcatcactgtgtatctgtgtgaaaatatctgtgaaataaagttcttaaagtgaatataaaagttctggattagatggcaggtatgtccacttaaaattttgaaagttattgacaagtttctttccaaaaaacactgcactgatttatatgcctataacagtgtatgaaaatatctatttccgaaacctctccagttgggcctcaagaaacatttcagtctttgataagctgataggttttattagagtctcatgtttattttaatttgtagctttaaagttatgaatacagtgcatatcttcttatatgccatgggacatctgcatttttcctgttcatttgctttacccatttttttctattgatttttttctcttttgtttctaaaaacctcttaatatatattaaggaaattagctttttgtcacctgtgtttcacttaaaaattttttattctttgtcttttgaatgtttttacatacatatgaaacatttatattttaagcagtaatttatatgatttttctttgtcttttgtatttggaacaaattttaaaaggcctttcccactctaaggttattaaaatatttcccttgtgtttttttcctagcttcattatggcctcatt

SEQ ID NO: 34202 - DNA, 1656 bp, Bovine  19866880976072
atggtcataagtgcatgaaaaggtgctcagtgcaattagtcatcagcaaaatgcaaattaaaaccagtgatataccactacacacaattgagtgattaactacaaagactgacaagcatgtaaagcagctagaattttcatacttggctggtgagagcagaagatgatgtaactacttctggaaacagtttgacagtttcttagaaagttataacccaacagtgccattcatagccaggggaaagagacatgaaaactagaagcaaccttaatgtcgctaaaccagtgaatgaatgaataaaccagcatttctcaaagtgtgttctgttttcccaaaaccccatgagattaaaactatttttataataataccaagacattatttgcctttttcactcacaagagtgaatagtgaagttttccagctgctttaaggcgtgatatagcaacagattgaatgcaggggcacatatgaaagtgcagctgtctttttaaagccagacattaaaagagatttacaaaactgcaacagacctacccttctcttccttttgttaacgtgaagtgggtttatcattttaaatggattaataagtactttaaaaatctctcagttttgatttataatatgataatgggatattggtgtatatagtctacataaacaaaagctttttgagaactctttagtttcaaaagtgtaaatgggtcctgagatcaaaaagtttgggaaccactgggataaacaaattatgatacatttattaataaaatatgactgaacaataaaaagaataagcaatttatatgcataacatgagtacatctcaagattctttagctcaagacactagacccagaagactacatacagtatgattccatttgagaattaatctctggtgatctgaatatgagtggtggtggcctctggggtgcagtagcagggaagggcattgactagatggggacacaagggaactttttaacaggatagaaatgctgctcattgatttggatatgcccatatgaatgtatatgtttgtcaaattgaactaaccataagatctataaattttatttttataaattatacctcagtttttaaaacttgaacttatttattttatgagatgaaagaaatagtatggtctgagatgatagtctacagtgttttgaagtttttaagtgcctcacaaaaatctgtattttaaagaaaaatttcaatcagagtcttagtgctgatgtctactttgaatcttcatacattcaaagctgacattctttgatgggttgtatgcactttcttctttaaaaaaatatattttcctgatacactggcatgtcaagattttacacgtagcttctttctagaaaataattgcctcttgattccttctggccttttttctcttcaggccaacagaacttttcaggagttgcaatgctcagtcagatcaaggagccatgaatgacatgaagctgtgggaaaaaggaagcataaagatgccatttatcagcatacctgttcttgacattaaaaagtgccaaccagaaatgtggaaagcaatagcttgttcgttgcagattaagccttgtcatagtaaatcacggggcagtattatttgcgagtaagtttctttcatcataatgact

SEQ ID NO: 34203 - DNA, 1003 bp, Bovine  19866881041532
ctgtttggggcaactctttgggaaaacttcagcagccatcctctcattagcctgcagaggaagctcagcaggttagtcttcactcaccaggaccagccagcaagtgccggggaagtcactactctcaggcccctgcgtctcacccagcggatgggagctctcagcacgcaggagtcaagtctgagccacctgtgcctgtgaggtctccagcccagggcttgtcacatacggggcaccaggaaacagtcgcatgaatcgaatctggtactcaggggaaaccttatccaggccctgagagcctctccctgggcagagcctttctggtccctccgttctctgcagccacaggcagtgactgcttctcagcccaggttagagcaggcggatgctagcaagggatcatcctgctttcttccctctcttgcaaatgacgcagctgtgagtctgtccagtgaaacacttcttcatctccagactcttggattcaattctaaaagcatgacagggcaatgtgacaagagggctgacggtgggggacacgccagtgccatcatcaccgggtttatggccatacgatgcttacgtatttccacctgcatcctgactcacaggataatgacccaagaccacctcaagtggctcaggagatcatcacaccaccctgtgtgaagagccccaggtaagcacagcaccactcagcaatggcagagcaaccagacacagaacacccccgctgggcccaagagaccaggcatcggggccagcaatcgcaagagccccagatgcgtcctccagacatcctggaggccgccactggccaggtatggctctgagtaaaacctggcactctcacccacaccccgccagatgcctttgagtgcgtcacctaggcctgcatacgggtggcggatgttggaggcagcaagtcggggtcatacctgctcgggcttgatgggctctgcggtgtaagatgtccgagtagtgctcctctcaaacacgcggt

SEQ ID NO: 34204 - DNA, 1864 bp, Bovine  19866881056208
caggagaccttttttaaacgagtgcaggctacctggttgcagagcaaggtcactgcacaagccagggtgtacagggaaggaacacaggacggggaggcagatggcctgagctcaaagcctcctggttgggagctactgtacagccttgggcaagacgttcccgtgcaaattagtttcttcatctatgaaagggatgacacgttctgtctgtatgattactgacaagcttattaataaggtttcaatagtacatggcacataaagcaacttaccttagcaatagtatccaatttttctttgtcaaacaaaactcttaacattccagcacataatgggcaacaagcacctgtataacagaaaccattctgtttgtgttcagaattagaaataaagaaaattcaaaacagttggtgaaattaccagcccttcattttgtgctgggaaagttaccgaagtccttcctgatgactgcactttcagatatgttccctgatcaacctggagtctaatgatctacacatttaccaaaatccttcctccattcctgctttcctcctgtaccacttctcaggtggggcagctgtggcttcatatagcacagggagagctggcctttccagagacacggggcctagaccctgccctactcagaactgtgtcatcccaggcaagtgtttcctgtcggcaaaacacaggagcaagtgtttcagagattccatgggtgtttgattcaaactgaattttaaaagttatttaaactgttaaaaaaacaataataacatgtcaaaccatggtctccaggaggaaggaggctatgttagctcactgctgtgcccccagcacctagacacttgtctaggacatagtagatgctcaagaaacatttgctaagttcctggacaaaggaatgaatttgttagactccaggtaatctgttctgtgcagacttgggataaagcctcttctgctacctctgcttaactgaagagtatgaaactgaaaggtaagctgtttgaaaactgttactgcttataatagcctgtttgaaacaagacttcttgattatatgcaactgaaacaattaaattagacgctaaggccagtctaaggcaacaactatcttgtttttctcaatttaaaatgtttgtgttcatcaaaaatacttcaattgttcattaatgtccaattctttattcattaactttataacaggcaaacattatgcctttgaactaataaccataattctagcagttaaatattgctgtttatctattggtgcttgaggtaagactgaaataagttttccatattgttttaaaaccactagactagatgatgtctaagatagatccactactttttaaggtctgcccagagaaatgcatccaatcagcattaggtagagtcaagactttctgagaagtttaaacacacttaagtcagctttatttttagtgactcactctctgaagacagataagtaaaatccacccaatcctgcccctaccccacccccagcattgccagcctaccaggtgggatgatgggtttgcactcagtcacccgagagtgaaggacacttcacagcagcacactcagccacagaactgtactcggagaggactccgacagccttggcagggcccatagtaatcgatggccacccggtccgagtaggcagcacacacgctgctataggtcttccccgttgtgcccacagacgagctccggggccctgcaaaaaggctgagggcaagaaagcatacttagctgtaaacttctatggcacacttttcctaaccaagaaataggtctccctactttcaagaaggagaaaagacagtataaatttttggacact

SEQ ID NO: 34205 - DNA, 859 bp, Bovine  19866881072886
tttgtgtttccctgatatatttgtaagaccatttttatgcaccaggaataaaatggttccccatcatcaatagggttcctcactttgatgatgaggaagctgaggttcagtgagggtaagtgacttgcccaaggtcactttggcaaatcagtgctggaacggagtcctccaccttgagcttagcagtcactctttagtactgtgcccactatgtcacgctgatagatgaccctctcctatggttctgggggaagaaaatcaggcctgccttttttcaatttagtcttgattcttaaaataatctatcctctaacacagtcgtgttagcagagaaaatatgttccaccacttaccgctaaaggagtagagatccgcagtgggctatgaccctttaagagcgtgccctccatcctgataaatcaggtcctggaaggctatgtgggatattagcactgacgtgtgtgagaacagttagcacagttattaacaggacaccatggctggagacagctggctcagcatgcacctgaggtcctagaaaccccagtcacgggctgtcttctgagagttgcctggactgggagactgtctgcccacccagccatgtcccccaggatggctctacagttcccatctatccaccctgttctgctctgttcatcttgtggccacttgcaaagcctggggttagaaagagctgagtcccaaacctggctctgccatgagcttatttggtgccttcagaagccccttgcttcactttgtccctctccagccaacggcctttctgagtcttggttagcctactctctccatctctccactcctgtccaccctggccttttctgctggccacctg

SEQ ID NO: 34206 - DNA, 917 bp, Bovine  19866881106324
tggttagggcagtcagaagccccacccagactcaaggaacaggaacacagacacagtcacattgcatgcagagaatgtacaataggatataaatacactgatgcagccatctttgagaaaaacaatctgctacactctttagcttttgtgttgtagaaaatccgagactaactggcttaagcaatgtagaaatttattgagtcacatatgtgaaaactccaggggtgggcctgactccagataaggcttgactaaatcttaagctgtcatcggaacctggtttctctttcttcatctctgggctcagcatcttctgtactagcttttgtctcagaagctccccctcataatgacaagatgttgccacatatcctccatccacatatcctctcttgctcaactacttcaggaaaagaaaagtctgcttttctgatatttcacacaaatacccaggaaattgagtttctttagctctaattgtcctaaggacttggcttgtgcccatccctcaacaatttaccgttgtcaaggaaatgttctgtatgaaccagctcagacttgaatcacacatccacctctggagctaggggcaaggtcagcatcacccaaagtcacacgtcttctgcaacagagattaaatcatccttacccctggagttttcacatatgtgagtcaatacatctcttctttgtttaagccagttaatcttgggttttttgtaacatgaaactgatagagtctgcagcagactgttttttccaaagagggctgcgtccatctatttatctcattgcacactctcctcttgcaatgtcactgatacaccacccactgaaaagtgaggttttacttctcagacatcaggagtttatatttctcacatcataaaaaccctagagtcatgacttgcctggtg

SEQ ID NO: 34207 - DNA, 1957 bp, Bovine  19866881114185
tgagttttgaactttcagggtatggcctccagtcaactagcagagacctgcatcagtgtaagactgaattcacatccctcccctttttttcttccttccattttcttatctactcccttccctctaaacataccatgtcttcagagaagtaaaactaatgtgggcctaaattatatctatttaattcaggtaacattatttttgctactgtataagaaaactagtatttatactgcaaactgctataatgatagcagattttacttggcttgtggaagtagaattggttctaaatattcttaagtctcctgtttatcctctagagttgggaaatatagaataaggacatgtgactggagttatccagctgctgctaaaagaggtatatgattagttaaatgtggaagggaacctccccatctgtggataaagaaggaaactagaccccaatcagacacctgattgtccttctgaatgtgactaaatagaactggagctatatcaaactgtggtcctgaacttttctgaggaaacaaggaattgcctagatagtgggaggaagtttatcagtaaattttataggatagcaacaaattgggggcattgtcttaccagcatagtcttctttgggcaatgctacttcctgctgtgtagtacatttacgttatctagtgagcttggtaagacactgatgctgaggatatttcaaatgagaagcagcatacagaatgtcttacaatgtgaccttgtaatacatttaattaacatccagttctgctcccttgcagaggcttctgggagcaccaacagagacattcattcccaaaggcagtaagagattgatctgatcatctccttggtccacagcagatatactgaaaggatagatccactggtgagacaagcccatgaaggtgcagtgagggcgtttctgatttatcccacacagcacagaaatagaaaccaaaatatgaacaaaaaagtgaggaacactagtcttagcaaaactccaggcacctgtgatgctgccctaccttccccctttccctttccattaccaaagagaaacagcgatggtgaagctcaatagttactcatcctaggaatgagagaggccggatcactcccctgggatgccctccgttgaagtctccctttccctactggtctttcggtgagggccacttcttttactgctatagcattcggtgtatactctccttttagtgtaagtctcttaagccactactttgagaaggtgaaggaagaggaagcctttggactctgaaagaggggtgataagacataacacatttcctttttcactgaactgccccagtaaattgagttgtacgaacagaaacaacttgaaattcttctttgaatgtgtttctcggagacggccaaggtcgtgcaaacgtggaatgggaattcacatctatccctgcctcctaggtggcaagcgcttccactgcacacctcatcgataacccggaggcgggtacgatcactatccccacttacagcggagaaaaacgcgggtcggaaaggttaattatctcatccagggagccgaactcttaagactggggctccaggaagttccgcaaaactccggtgagccagcagcacactgggcccaagccgctgtcccccacactgcgcactgccgggacctcggccctcacccacgccggacagactgacctgagggcggagggctgggagggactgaacccgggcgaaagacagacgcactggactgcaatcccgaagaaagcgacgagtgcagaaagttcctaagaatctttgggatggtcaggttctggccgcttccgcccgccaagggaatcaaacctcgcgcgccggaaggggcgggggtgcggcgggggcggggctcatcggggacggtgcggtccctgcgaggcggggcggggtcgctcgccggccgacaggg

SEQ ID NO: 34208 - DNA, 697 bp, Bovine  19866881178983
attgatggttgtttgcagagcagttgatcagggaggagtgggaataagagagaggatgatgtcatagaatggatgaggtcatcacaatgcaggccccctccctgaggcctttctcagaggcacagggcttttctcccctctgatggctctgatctgccaaggccagataccctgccaggacctagtccagggcccagaactcaggaggaaactcagagatgggtcacaactcccacctgggaccttcaacctcacttcaagggccgcttctggaatgtcagggccagtctgggcagggctagtatggggagggctattaggaaggctggggtaaggatttttacatcatctagaggaatgtacattgcacaggagggaaaccgaggcccatagaagagcatgaacttgcccaagatcacgtagctagttggaagcagagcagggcctgaaacccagtccttctggaacccaccctcccgggatgctcctaactactcagctttcctctgtctctgattctcaagccccaaagcacctttcactgccaaggctcctggatattagagaagaaaaagctctgtcctttggtttctgacctttacggctacagacatcattcttcacattgggctggcccaaaaggtcgttcggattccgaatgaactctttgacccacccaattaaacgggagaggtgg

SEQ ID NO: 34209 - DNA, 1466 bp, Bovine  19866881215523
tgaattttagcaaactctggaagatagtgacggacagggaagcctggtgtgctgtagtccatgaggtcgcaaagagttggacaggacttagtgactgaacaatgacgaagaagagccactaataaattagcaaaaatatttaaatggaacagtcaacagagagaagattttaagaaagaatcttttgcaacagtaattttacttttcattatctctaagtgttggcaagcactacttatgtgaatcctggctttcttcttcaaatgtcattagaacacatctaaccctgacttgctcttcatgcttggggtttattcacagttgcagaacctctcaccaaatctatatgagaaagctttcaattatttttcctttagcatataatctgccggatcactaactggctattaactaataatctgttccttgaacttccttatccacccaaaggtctgccttgatcccttatttttctttttatcttacctgtttttactttctttgtgacaaagcagagtaacgaacttttcagtggaatggtgtcactaatctctgtcatattccattgctatctttgtccaatgaggaagaatcaacgttttatctttgatgtgactgcattgctctgtgcttcatcttcccatcaggaaccttaactacagggtataccttatggcatttctggtatctactgcttatttttaatagatcaagccccagaggacacaagtaagaaaaagagcgatatattttataactctgccctaaagtgttataatgatcataacctcttattactattagaaaatagggcttcccttgtggctcagctggtaaagaatctgcctgcaaagtgggagacctgggttcgacccactggagaagggaaaggctacccactccagtattctggcctagagaattccatggactatatagtccatggggttgcaaagagttggacacaactgaacgactttcacattcactattagaaaaacctcaaaaacgtgtttcttactaacaggttggtggcttcagcttaatttatatgaaagacagaagttctgatgaagtgcacaaaataaaatattcttcatcttccctctgctttcttttgttgtgaacattgtggaaatggcctgatgttcacaggttataccattgaaagagttgcataaaggatgccaaaagatttcttaagcatgaatggcttgtatagctatgaataaagcacttttctttggagcaagggagaattctgataaagccttttcagctttttttttttttttaaagattctggttcagcttttgggaaaacactagtcatactccatcactaatgcatagctaggtcatctggaaactataagcagtactgcattgcttaatatgaaatcagggttcattttccccactggcctcctagaggcttagaaatctcttgtattatacagaatatt

SEQ ID NO: 34210 - DNA, 1093 bp, Bovine  19866881226459
agaaaagtgaaaggtatttttttttttatttatagtcctaatttaacttaaactttactttgctctaacttaaaaatcaggcctttaatgtactttgctcccacgagagactagagattttctttgtccagttattatccctaccactgttccacatgaagtaaagtaaatccttctcacatcccctttgagatactgtcaggtactttcaactaattctgacaccaaaattgagtgtgatttcctagttccggttatggttctcatcattataaaacctagtagccatatgaaaaggagaacctgtgcagccgtatcctgtcctcaaagtcactgccttaatgcattgtttgctcgcagctttgctccaagttgtttccctcccaactctttctacttttcctttccctttttactccatccattccaaacaatcaccttaccttttccatttttttccctaaaacaccccctctacttcatattttagctgaaactagtctcttttgtgaggactcatttctcctatagccttctctaggagtaaagaaatgattggcttttcttgcttcaagcgtggaattggatatgtgacgagtaagtaggatggtcacagaggtgaaggcaagtgttgacactctcctggatccttgcttttaaccatcagtctttgaacaaaaagttcatcctatttttgatcttttttgtccttgatcttcactacttaaccgagtttgtatcactatccttgtttattactttttactctgctctttttttgctcatttttctagtcagaatatttcaagttttgcgtgctttttaatttttaaaattatgaaatatttcacatgcatgttgtaaagcatgaagatgtatgtataatttttaaaaatctaccatccagcttaagaaatcaactattaccaatattttggaacatttctataaaaatgatggttttgtttttcttgctttgaaatttttttttttcaaaaatggtttaagaagcacatttacatgtctataaaaataagcctatatttaaaattagcatcaaggtgtttcttgtaattttttaataaaattaagg

SEQ ID NO: 34211 - DNA, 876 bp, Bovine  19866881331795
tttcttgaataaaaaataatatcaaaccagtgttaatgttcagtttttatctggcggcttattacatggaatgtgtttagtttgtaaaatttcatattgtacacttaaaaatatgtgcactttttgtgtttatattgcaagtacaatatgtttctgaaataatgcttaagatgatagctggggaaaatgtaactagaaatataaatacttgtagtaataggaaatataattttgacaatttatacacttattaagccactcatagattttgtggttttttgaccaatattgagaattttatagtttcatatatagttgaatagttctgtgttcatagaatcatttaaccctaaattatccctttttaggattttcttctatgttctcttgagatgaagttgcagcaagaagctgtaggaagcattttctcttgggtttttaagatcacttttctatgggtaaagatgaccattctggatttctgggtctctgctataggggagcattatcttttctaatacttagtattttcagtttctgcggataaatacccagaagtggaatttctggatggtatggtagttttaattttttgagaaacctccttaccgttttctatagtggctatgtcagtttatattctcaccaacaatacacaaagtttcttttttctccaagtcctcaccaacagctgttatttgttatctttttgacagcacatgctaaccattttgacagatgtgaggtgatattttattgtggttttgattttaatttccttgatgattggtgacattcagcatcttttcacatgcttgttggccatctgtatgtcttcttggaaaaatgtccatttaggatctcttgccatttaaa

SEQ ID NO: 34212 - DNA, 1290 bp, Bovine  19866881370369
tttgttgggaagccctgaagaaaatgaagggtatgttttaaacatagatttggcctggaactggaaaggataagagtcttcctgtctttccaccagttttatacctctaacaactggctttctcacttccatatatttccaactcataactgggcttacacatagctttgacttgccatggtcttaattcaaactcatggcatccttattttttcagttccactggtcaattctctctgtatttcttagctcaaattcctggtccatggccaggctagggattggctgccatgaatcacatgtccactctagtcctgtcagctatgtgacagtaggtcacgtgactcaaaacaagtctacaggggaggggttggaggtattcagaatcttgagttacctaagatgggaactcagagttattgattaccttagttactggttaagaatcaggcatgagcaacttccctggtggttaagacttcaccttccaatgcaggggatgtgggtttgatccctggtcagggaactaacatcccatatgccttggggccaaaaacataaaacaaaaaacccagaagcaatattataacaaacttgataaaagattttaaaaatagttcataccaaagaaaaccttaagaatcaggcatgaatcatatgggagtaagatattacactaaagattttattgctgtccctgggtgagatgaagggcacagcagaagcctgtgttcacaacagagaccttcaggaagcacgtctcaaagactggcccgcacagactcccagccctgctatctcactacctggagatgtcatgatttcagggactcacagcttggcctttcccacctggaccacatggagtcctgattttagaggactttgtatagtttgaggcaaaatgcagagctaagttagcgcctctaagcccccgcatgggatatctctttggaacacttgggcctgtgacacattcctggaggagcagcagcgcagctgcagtcacagctgccaggaacaggctggggctcccaccctgtgtgggggggagggcacaggctggagggcttcctctggggactctgagtgagctcaccctcacccccgtgctcactgacttcatcatccaaggctgcttggccaagagcccaggcagagtgaggggctttctcccagaacaggccccgggccaccaggcagagtgggggatggggtgagttgcaggcctagcgctgctccccagaaaccaaggtggtggtggaggggcggcataaagagctctgaaat

SEQ ID NO: 34213 - DNA, 608 bp, Bovine  19866881398277
tccccatattgccactacccttgtggccagcccagtttccactggctgtgtgattgtgtgtcgaggtggttgaagacgatatgaggcagaggggctgatttccagaccatttcggaagacgcttcagccaagtctgtgaattgaccatgcagctgaagtaatcacccttctatgggccaggctaatgtactcctctcttgctgcttggatcaataccatacttactgcagattagctaaatgagccagcgcagctgggaatgagcttctagagacaattactatgggaaatgcagccatattttagtgggcaccacatgcaggaagctctctgcaaatatcaatatgtatttgcttgcttgacaaaaacagatcaaacctaagtcaggagattaatccaaatgattggactgtaaatgatccctgtgtgaagtgtggtgaaaccttgacctttttgatggtggctgttgttcagatagtgctggaaataaccagcctggcaagactgactggtggttggcttgtgctgtcctctgccaagtttatctcagtagaaacatggatgatactgatgatggtagccattcatatttgcatagtgtgatctta

SEQ ID NO: 34214 - DNA, 1430 bp, Bovine  19866881402808
agacactgctcagaggccctcagggcaccctctgccaccctgcccttccccgggaccctccaaacacctcaaatccagcataagtttctggagaagaaggactgataatacctgctgttgtttccccatccattcgacagcccttccctgagcacctactatgtgctgaggctgctgaggtctgtctgggtacaggctgccttacaaggtgccagttggtggaggtgagtcagcccaatgcctttcatccagatagcatccaggatggagaccagccatgtcagtcccaaccccagtgcttggtcctgatcgatgcatcagccttgcggcctgttttctaaactgggtgccgaatctgacctcctttggtcaggtggcctgcctgcccctgacacagcagcttggtaaggagcagcgtggcccagtggtcactgtgacctctggaatctgacagtttgtgtttgaaatctggctccattacttaggatatatgtgaccttgagtaaactcctgtgcttctctatggctcagtttttgcatcagtaaaatagggataacaaaacttctcatggagttgttttatagacaagtcaagttaaggtatgtaaagtgcttagaataatgcccattgcctagtgagtgggaagcaagtaccagtggtcattcctgctagtgactcttgacttagtggatcttatccaggattgagatcagctctggaggaggagctcttaccttagtctgcactccagatgccaacccctcaaacagggctacagaccaccctatccttgaagtgggcatgtgacagaaggagccaatgggtctggaaaggcaaacagttctccggatgggcaagttcagatgggcaggcaggtgcccctaaggatttgtgccaaaaccagccttaccaaacatttatagaagacataagggtgggagtagaagttccatagcctctcaggtaatgaaaataaaagctaatagagagaaattaagagatattttttctgggctgtgaacactggcagataaaaagggctgcaaaccatctgaagctaatgcatttgcagggaaataataattgtaataatatcttgcattcaaatgccccttttgctcctcaaagatgtgtgtgtgtgtgtgtgtgtgtgtgtgtgaattatgtcaataaccttgatagtaatatagatggatagggtttggggtgattgtgtgagtgctcagttgcttcagtcctgtccgactctttgcaaccccatggtgtaacacaccagactcctctgtccatgggattttcccagttagaatactggagtgggttgccatgccctccttcaggggatcttcccaacccagggtttgaaccagagtctcctgcgtctcctgcattgcaggcagattctttaccgctagccaccggagaagcc

SEQ ID NO: 34215 - DNA, 829 bp, Bovine  19866881422482
acagccaccggcagagtgtagagatcaacctgcagaaggtaaaggccaacaagacaaccaccttcagtgcctcttttgcccaacaactgcccccttggatgtgtcccatgctatatgctctgttggagacaacaaagtatttgtgtgcggaggtgtcaccacaaccaccgatgtccagacaaaggactataccatcaatccaaatgcctaccttctggaccaaaaggcaggcgagtggaagaccctggcccccccaccggaagcattggactgtcctgcctgctgtctagccaagctaccttgcaagattcttcaaaggatttaaacaactttttaagtgggagaataagtaaatgcattattattcacaatttaatgagagagaaatagagaggaaggtgtcggttcctttttagtctctgtttggccctgaaggtggagatgctgggctctggctactcccagtgtggggagattcagggctgccctgttactgaagggatccaagctgaggctgaaaaagtctctggtgggtgggattgaggcatatctcaggcactggctcccagtcggtgaagattcagggctactccatcattgaagggatccaaggagaggctggaaggggatcctgggtgggtgaaatcaaggcatctcccaggccccggccaaggtgatgtctgaaaggccccctatcctatacccttgaggtcaccttgaagacacatgctagactgacaggtaaagcacctgcttagagttgtgaagcctcaggctcctccaacactcatttctgagtctgcccaggaaggcaggggagggccaatcc

SEQ ID NO: 34216 - DNA, 1094 bp, Bovine  19866881769649
tctagaaaggtggtatggtgttattttgaactgggatggtacacagttgaacgtatttaaaaatgcgctgagacgaacatttaatacgtgcacattttatcccatgtgagttatttctcatcgggaaaaaaagaaacaatatagaattgtgattggttaaagactagttggggagttaacttcacagtcctgactcttctgcatgataattgtgatgttactgccatggtttctggagcctggggttgggccttaggggtttgaggaatgacagggtgcaggccttaaagcaaccagttcagtttagtcgctcagtcgtgtccgagtctttgcgacccatggactgtagcacaccaggcttccctgtccatcaccagctcctggagactgctcaaactcatgtccattgagtcagtgatgtcatccaaccatctcatcctctgttgtccccttctcctcctggtaatatagacagtcacagacttggtatcaggagccctgagtttggatcttaacactctgctcagtatctaacccaggaggaagcactggtgtgtggtaattggtcctgaggtgagttacaaattattcattggtaattataaatcactgaagcttttagtaattttctcttaattcatttgaattcataatacatgcatttggttaaaaaacaaattaaattttatagaagagtatacagtaaaaagtccattttcctctcatccctgagtccaaacactggtccctcattcctcctcttgagagacaactactgtcatcagttttttaaatacccttccagagatagcctatgcatattcatgaatgatttccttgaagaaaattagagcagtttcaaggtatccgtgtaataatgttgctttgcatactgaatattttcaaaatgaaattatgttttcattataaaaataatacaaaattatttaaaaattatataaagtaaaagtgaatgctccctccatccactctgcccatattttactcctcaattacagaattaaccaccgtgaactctctcctataggactcactgataactgatacatggtaaacatacatagactattaca

SEQ ID NO: 34217 - DNA, 919 bp, Bovine  19866881915709
tgctgtgacagctcgagttccttagacctggtgtgctttgatgtgggatcacttttcttttttgttgaatgagaaaaaaattaatataacaggtgtccagaatacttgcagtataaatgaagatttgatttttgtataaaaaataatgctgtagaacaggaattgacctgcatttagttgctctgaaaagaatacatagctgtgtggatttctttgtttttttaataggttccttgagcataattcagatcgtttcaagtcatttttctagcagtgtttgaattcccctctcattcttctagtgtcttcaccattgtctgcctcttcgtgcagttgctgtccttcttctggttgcagtggcacaagctgcagttctccagtcaggactgtgatgacttgctgccaacctcagctttcgtttggctgtgtccgttttctactcagtgttaactacttgttactgccatgctacttgccttcccttgaagactataagcttatcacagcttagagttcagtaaagtcaattcacacagaagcacaattttgcccttttccagacactgttgcctctatctagtcctacaagtaggattttgcatactttgtttgcccctgtatttgtcagtgcatcagaaatacatctaaacagtggtgaaatgcacatgttacttttaaatcattagagtattccctacctgttcctaatgaataaagtgtgttaaagaccaaaattactggcgtaataatcaactacattacaaatcacgtatagtttaatctttattttttttaattaaaaaaatcatgtttaaaatggcaaaagcccatcttatacatagactcttttatatagctgcaaaaaatttatatctgtacagatctaacataacattactacactcagtattcattttat

SEQ ID NO: 34218 - DNA, 1965 bp, Bovine  19866880487744
aatgttcttgcaaaactcatttttattgtcatgggtgtgttccctcctttatgaaaggagctcagttatttccccttgtacttatccaactcttcttcatttatgggaatagtctggttcacgatttaactttggattatgaataattactctacctacttctcttacctcattttacagagaaggaaacaggtaagtgttaggtgacaagaccaagcaatgatgaggatgatcaataaaagaaaaggttgcttttcagaaggactgaccttgtggctagcctgaataggtcatccactgtgtcagggtgattctggagtccattctgctgttctaagagctgaaaggtggggatgcacagtgcctaaaacagaaacgattttaaaacaaatgcttgtaaataaatgccatgggattcagacttgctaaatatcacaacatacacagagaacaaagaggtaaagcacagataagaaaaagactgtgatgagattcagatcaagaaagggaagacaaaaatccttctcagttgacataaacagtcttcacatatgaggcctacatttcagaaagggtttagggtacagacttctgttgatgaaattggatagatgtcatctcaaagttttagaagtttctgaaagtgacaactgtgcttatatactagatatgatctggtcaactaagagagtagctgacattttaataataataattatgaaatggcaattttaaagggaaagacatcttgggaaaaggagcaccatgatttaactccctaatatattttcccctctttgactaggagacggtaaaagcagtatatgagaagccttttccaatgcctgctatttaccctaaggtgagaccatccctgctaagtaaactagttcactggctgttcaggcaagacattaaaaatacaatcatgcttgagctaagagatcctttattttaaatccacttgcccaccttcccaaaaaatcctatctctgaagaacataaattagacagcaataactgtaatgaccagcatatttgtgtggtcaatctctctctcattcttccaagcaggcctgtccacagaataactaggaagatctacctccatattaggaaatcattatgcttgaaaagcaaactaaaagcaacagaattaaagacatggtgaagaacacactgctaggccttcagaccctccaagagaacatacctggagcatgtctagtagtccctgccgacagccctcttccatgccatattcatccacaaggatactaccaaggtacaggaaacaggaatgctgatgtacctggtaaacatttaccatctgccaagggaaaaaccaattagttcaattattcatctctcaaagagtgtcagcttaggtagctgtctgagggaagaaattctgagatagattggtctcttctctttaagacaacgtaataaagcttgttggaaacattttctaaaccatagggctcaataatttgcaagtactctatttagagttctttcaagccttcaacctttcaccttttcaaaacaatgctgtaggagagttgtataatactacagactggaaccattcataagttattatctgaggcttctgttatatttgcaatgccctaataaagtatatctaaacttttctttttttttttttttaaagtatacctaaactttctaaccaacaggttgctcttatatgcattaaagatgattctttaaaaaaaaaaaaaaaatcacagtaggaacaaagtatcaaatgcccctcattttaaaggagacagaaggcattgtttaaattggtttataaactcttttatttaatcttttgggtaaagaacagggtttctaatcaagattatctagacctctagagaataaaaattttaatacaatctaagtatttaaaatatttgtttagaatttttacccttctatcctacaaaaatt

SEQ ID NO: 34219 - DNA, 1717 bp, Bovine  19866880584961
gcctctccttaaatgttcctttttgccatttttctccttagtccctctgttttgattcaagccttagaccttcctccttagtgcatttcctgacttggacctgctagcctggccctgctgttccaaatggtggtttgggtctgaggctacacaagtttcctgcgggaggtggtaagacaaggtgcatgtggtagggggagtttctcttgctgagtttcagaaataaggctttctattgtctcagccctacaaacactggctcaatttcttttgcatatcatactcccttgaaatagagtatcttgttagtacttattatatatgccaaagagaggagacacaggctcaagctacaggtaaatcagaggttccaggctcaaagcataggtaaaatcaagggttcacaaattatagatgaagagagtcactaaggagggtctgctagagagaccatggactggtctctatttaaaatgcacgatattgcatattcaataaaagccagactatacatatttcagaaaaggtacccaaccttccaattggaaagcttttctggacatcttgctttgatttaggctgtcctaggggagggtatttttcttcaatgaagcagttttcagactgaaatggttggaggcctaaaaagtaagttcctcgatcatcattggtcttgccaaggatgagttatgtcctaattcttgatgatttcagtatccacatagatgatccttcccataccctagtcactgtccttgtccttcaccctcctcagccactgaccctccctccgcgatttaccctagagtttgccattaataactgcacccaccccatcatttctactctcctactatatactatctcctatctttccctgagtccgatactcctccgaccccaccaatcctgcaatttcttgctccttctgggttttcatcatcccttcctgtcctcacatcctcattcccttctcctccagcctagattccacgatccatcctgaatgccatcactctcttgcaagtaccctcagcgcctttgcacctcttccgctttattaactgaccgggtcgaactccccaccatgacgctaaactattttttggctgcgctaggtcttagttgcaggacctgggatcttcgatattagttgaggcatgcaggatctttatttttcttcgttcagactcttagttgcaggatctagttccctaacaaggggttgaacccagggcccctgcattaggatcacgcagtcttagccattggaccactagggagttccccacgccactaaacttgcctagagaaaaaatcacatgccatactacccagtttcacctcaacattatctcagttctcaagagggtccttaatattgcctggagctcatactatgtttccctcatcggctctttctgctgaatggctatttcacatcttctcctttgggtgggaggcttcccccagtgcctcctgatgacccagcttcctatttcactgggaacatagtagcaattgaaagaaaactccaagttctcactgaccacccctaccactcacctagaaccagaccagtagatctagattctctccttgttaatctaaaagaactgcctagctctaagcaaagtccaactcttccccttttgtactgggtccccttcccacctcacctactcaaggacattggctccagcaactctccctttct

SEQ ID NO: 34220 - DNA, 1285 bp, Bovine  19866880632281
cacagggaccctggcccatgcacccagttggcatgcagtaaggaggctgcaggtagtgactggcccaggtttcctgggtggctgtgcagagatgtggagggcaaaagttcctgggggcacctgatgagcagcagggtcctatcttggggtctccagaaatggatctgggtcatgaagaagaggtaaaagaggcctgagttccaggttctcctcagaagctgagggaagctggaagccagttttgctttgaggactctgtcttcctgcatatgtctctcctggactggctctgggggaactcggccatcagcatcattgtggagggaaggaactctgccaactcagggggcctagttgtacagagggagttgccccagagcagtcccttcttgtgggtgcctcatttctttgggtaagaagagccaagtgctgggggtcagacctccctggcaggtcctctgcagggcatgggcctgacttcggagttccctagcttaagcgttgataccctgggggaggaaatggcagcctactccagtattcttgcctggaaaatcccatggacagaggagcctgctgggctacaatccttgggttcacagtcagacatgactgaatgactgagcgcgcgtgcgcgcgtgtgcacacacacacacacatacacacacacacagtttgagcctcatttcctcacaacatccagagacagattaagtattacaccagatactaagtctggcagctacctcccttgagaaactaagaacctgggatagaaaggggacatttatgtatttttggattaataaatattaaaaacagactcagtcattatttttcagcaccagttgctcccatgctgttctactgggccgtatttctcctgccagttagctttctttaccccagcacctgccctcctgctctggggctgttgacacagggagggcctgccttccaggctgatgagtcagtgaggccttcacaagcactcggctggctggctgtgctttccaggaggaagccggctgaagcaagggcgtggacttttaaatgtgtgcagagtctaagattctgtccaaatcaattttcccataagaaatggtgaaaaggggctggatctcacctaaggaccattactatctgttagcctcatgtatattcatatgctattaaatatattaggacaatgcatacaaattgggagctcactgtttgaatctggcttacagatgtaattttctgacctgaacaattttgctgttatctttttattatggaatat

SEQ ID NO: 34221 - DNA, 1112 bp, Bovine  19866880718794
ttgtacaaatttaagacaaactgctagggtctgtcacaagttactttctaatggttttcttagacagtgaggagagaaaatgatatgaatggatattaaaaaaatataagctataagcttatattttatagctctcaaaagataactatcactacctaaaactgttatctttcaaaataatttgttttgcaagatggcctgaaatacagaaactatgatgaaatgaaacttagctaataccttcaccacagcagtaatgagtaaacaattcccaactccaaacacagagcctaagtgaaaaataatcataaagcccttagtgagctcccagaaccataaaatacccacgtttgcataaacaactacttttctagaagcaaaaaagctcatttatagagataagttcagtcaatttacatttccacagccatccccataataaccgaacagataattaaaagagagacattatttcccttatgggagggaagagattcctggctaaaaataattatttaaaacatcaaaagctactcaaattccaaaagaaacactcaaacactgttcaagacaattttggaagactgcagtgcccgtatatatcactctatcttgatctcagtgagaggaatcaggaagaccaaatgactacacccactgcacactgtggtctcctcagtttctgattaaatccaagtgtttctgggacaagcgtttcaaacagtcctgagttataaaataaactttgtcaaataaactttggctcaaatctgtagctgttggtcacatatattatgatactgagaaattttgccaatattttttcccaacaactataaagaattcctatccaaattaaaaaccctaagtcacctatacatgtgacttattaaccctcaagactggccctgaaaaaacatatgtctggatctgtaagatcaacttgggttaggagtgactgaagcatacatttcttgaaaatcaattcactgtggaccttaataattacactgggcagccctgctttaaaagtagaaaatgccaagcttgaaaccatttcaagcaaatgagtagcccatacgagggcttcctaaaagctgaaaatatgggaa

SEQ ID NO: 34222 - DNA, 1787 bp, Bovine  19866880739561
gatctttaattgaggcatctgaactcttagttgtgacatgtggggtcttgttctctgaccgggatcgaacccaggcctcctgcattgggagcacagtcttagccactggatcaccagggaagtcccccaaagttggtattttaaaatgtctttattattatctttattagtagtatttatctctctctccccatgccctctcataattgcaagtataaatcaaccccagggtaaattgtggctgcaattaaaatggtatattagcttaatcacaaataaatagcccttctgctgttatctcaagatggaatgtatgtgattatggctagagtaccttttctcctctgtgccactctaagctatggcggcaggctgaaaagtaactgattggttaccatggtttccaaatggaggcaatgtagcatgtaattattgcatacagctatcattactaaattttgtatggcatttgatgtaattcaataaataatttgagtcatagctctagaaggaggtgcaactgcttaaagggtaatgttttaggaaaattacataaactatttatatacagctgtgaggggcgctgaggagtaaaatttggtactggttctaattgatttgctcctatcacaagaaaaattggataaatgaggtttcaggtctgccttgataggtaaagtagtgttgattcaggtaagaaatgaagtaaaacccttcatttggtttttagcatggtacttagtgaatcttatttccctgggtttgcactttaacaatgaaataaaaacgtatgctttgtgaaacatataatcaagaagagagagagagagactttcaaaccagtctcccatctcctccctccctacagattccagagcaagtttccccaatttgtcaccgagtgctaactaattaaggagttgtcactttcctggccttctctcagtgctatgctcactacagcatataaatgtgggtgtgagggtaatccttcattatatattcaagggaactgccaagtgtttccatttgtattgttatcatttgaagataaatcattccaatttattttaataaaaggcaaacagacatgtatctgtgttaatctgctttatgtctttgataacctgcgctcttaatcgattttcccaatcacttgctttctgtattactgtgtgagaaagccaaaggcttaactaagtcacaaattggtactagcacagggaaatggagaaagactgatgcacaattcttggtaacctttttataaaccacatgtccttctgttatgtttgtaattcatcaggagcaatctgggatacttgtgggaatcttctcatggcttccctatctcctgagttcttctcaagcatatgtatgatgttatgtgctctttgttattcaagatgatgttggaggtggggtacagagaaggacaaggaaggggtattagactcagttccttctcaagtctacttgggggaaatgagaagcacacacaacataggcagcatattagtagaaacacattagacattgtagtgtagctaagctgggtttaacaccttctctcagtttatctacagtcctaattcacctctctggacctctgttttcttagatgtcaaatggggatactcaaagctggctaagagtgtacctgcgaggatccatctgataaaatattaaattggccagaaagttcattctggtttttccatacactcttactgaaaaacccaatgaatttttttggccaacccaatagtatgtaaactttataaatg

SEQ ID NO: 34223 - DNA, 715 bp, Bovine  19866880751491
gcctggcactcctccaggcggcactccacatggccccgctgaggacaaacgtcattgctctagggacttccggtagggtttggagtccctgacctcacacttctgcatcagggactgggcaagcaacccttttcctataagggcacccacttcaggtagggggtgaaatcaccttcagctgcttgccctcacacaggggtacctctgccctctcacccagagggggcgcctttttcgaattaccttgaagaccccatgttctctggtccagtgtcctgaggcccttcacttttgcctgtaaggttctccaccccccacccccttcccccagctcacacggcaggtgcacgtgacacaggcgttgctggggtccctccagctctctccatccgccgctgtccggcccgcagcctccaccacacagtctggggacaaagaaatggggacggggaagcactgtcattctggctgcatgagctcaccctgaaggcccagggcaggacggtgcccaccccatccaattagtaccctcagggtgttaatttcttcaaccagcagcaccatggctgactaaatggcagaccttacgccagcgcccaggatatccagagcgtccaggatactgaaagagccagaggctgggactttctctggtctgactgccagctcagcagtgcgatgccctgctaagtgggccttggggtccctgagcccc

SEQ ID NO: 34224 - DNA, 1517 bp, Bovine  19866880831206
tcctctgggcctcagctttcccatccctcaagtgggggaagcggggggcaatgtcaactaccctctcctagatggtttcagagattccaattcccatgtcaaaaagtaattcactcccttgcctccagccacaagcacatttgtaagtatacaaaatatggcttatctacacttaggatggggcttcccagttgacactagtggtaaagaacgtgcccgccaatgcaggaaacataaaagacgcaggtttgatccctgagttgggaagatctcctggaggagggtatagcaacccactccagtattcttgcctagaaaatcccatggacagaggagactggtgggctatagtccatgggggtcacacaaagtcagacatgactgaagcaacttagcacacacgaaaacttaggatacagactctatttgtgctttgtcctctgtaaggcctgaatgcccgtgagggagtgaatctctggaagtgggttgcatttcacggggaagcctagctcagggatgatgacgggagaaggtgccctcctgagggagctgtgttcacctcttcacgtcttctgtgtttgcccagggctgacaccgcaggtgtcttcctggccttggccagagcaagcctccctttcctgaggcactccacctgtcctttctcctcccctcctgcagggggcatgctgacacaccacagagacgggccctgggcttcctggggcccctggctttctcctgctctccagtccccacctctctgcacaggtgctgtgggatgggcggtcccaggtggaggtgagagtgcctggctcctaccggggccacatgtgtgggctctgcggcaacttcaatggctttgcccaggatgacctgcgggaccctgaggaactgctccggtccactgaggctgcatttgggaatagctggcaggtgagttgcacagaagtgagaggttgggggaggcacagttgagcctgagtctcagagcagccctctggtaaggaaaggaggggttgggctttggggctttcaggaaggtttggggtcttcttgcctgttacagtgctggggtggggggggggcgcctgttggaagggatctcatcaactgaatccccaaggcctgcttcatcactcactgactcgaagtctcggacaagacacttaactgctctgggccttgatttgacaatctgtaaaatgggggaaaggaaaagtagctgatgctttctttgctgttcttgtaaggaagtttttgagactacaacaaaacatttggtgcaaagctcttggaagaacatagcacacaaaggtcagctgccaggccgctgacctgatcaaggccgccttccccttctaggtcccagagggcccaggacctgggtcggccctgttccaagggccgtgaggtggatccatgccaggcagcagggtaccgtgccaggcgtgaggccaacgcccggtgtgcggtgcttgaagtccgccccgttcagccgctgccatgctgtggtgcca

SEQ ID NO: 34225 - DNA, 998 bp, Bovine  19866880890370
ttgtatgtctaactaacccctaggcgatgaattccttaagggcaaggagcattggctgatccacgtctgttatctcagtgcctagcattgtgcccagtgccctgtagacactccatgtgtgacattgttttcactgaaggaaaaaatgatcagacttacaaatgtgagtctgtaatttagaagacaggctgaagttaaattgtcagtgaagacggtaaaaaaggagaacatggccaaagagggccacatggtgggcagggagggtttgagaacaggttgtgctgaggtgtgtcagaaaggtatggaagttgaaaattagggaggctctacattacgaaataagggaatgatgaaagcacagccagaaaattatcacaaaactcaggcttgtaagtgtggaattatagtagtagaagggtgcctgttcctgacgtaatttgtgatagggctctgttagagacgttgggctttgcatgaatcttacagcaatctttatttcataaaagtttataagtagagacaaaaatttgaacacagagttatttagagtctttgtataaaaagtttcttagaatccttgctgtttgttgtcattcagtcactaaatcatgtccgattctttgtgactgcacggactgcaatgcatcaggctcccatccttcactgtctcccagagtttgcacaaactcatgtccattgagtcggtgttaccattcaaccatcctctcatcctctgatgcctcctcctcctcctgccctcagtctttcccagcatcagagaatccttgtagaacactgaaattgtctatagccttatacttctgattatatgttcatttgtatttgagttctgagtccttctgctatgatccaagtttatcaaattttgatatatcttttaagattactagtttttgaagaatgtttctttaccttgcaggtgggattcttaatagattctccaaagatatagcagtttggagatcttctgcctctta

SEQ ID NO: 34226 - DNA, 772 bp, Bovine  19866880940382
ctaaagctgtgactaaggagcccatgagtgggcttcagcttcctctctgctcctggcccaacaggccttcggaactcagaccctgctatggagcacctttccctagcatactgctgcccccagaactgtctccctgcctcttgctatggttaccttgttgtgaccacacttcgaggacttaggccatttgggatcctcgggattctccaacacttcccggaagctggactccttgaaacggtgcagcgctccttgcagttctaactgttcttttactatgttctcttggttctgtatcagtttcttctgctcctcctgcatgccttggtagagcatctgcacttcacacaggtcctgtaactttgtgagaagctcctgactctgtgaggtggagtggaaggaagtgggtggcactgtgatagttacagggaaagacctctgcctccttccctctggggacccttccctcaaaggagttggctttgctcagcccacttgggataggaggggagtctttctacacagacctgccagtggaggagttaagacctcctgtgggtggatgtcttttgctttttacaaagtgatttcaaggacattttctccagatggactaaatatctaaaatgctggacagattccagagttgaggttgtatttcaagatttaaagccctaatcggctatattgagcagttttgtgtgaggagactggtgagaaagtgaggagttaagacaaagttccttttgcatcctttcacttctcctcaggt

SEQ ID NO: 34227 - DNA, 660 bp, Bovine  19866880953213
tgcccctcaccccccgccccaatcctcagaggtgacctatggggtgcctgctcctgtagtcacttgggcatgagcctttctgtgacctttgagccttctgcaagctcagggcatcttccctcctcagtcccactgcctaatctcctgatccatgacgtcatttgcctgctcaaaacccttccattggctcaccgtgctttcaaacagacttctcccgatagggtccccgaccacttcccaggtgcctccccccagatttctagccacaccaccctccactccagccgggcgggcctacacactgcctgccccacaaccccagacttcctggccctgttggcccttcacccgaagcccctgcctcactccctggcctcagggacacacgcctgtccctgaccccacagtgcctgctccccacagtgtccaggctgcccctccacggtgccctcccctacctcacagacgcagacttcgcaggggtctgcaccgggctggaagctctctcctggctcatacttccgaccctcatgctcacagtcttgttggagggtgaaggttggggggttgggggggtacgggtggggtggggtaagagtagaacagaaccagggaactttcagactggccgccatgccatggggggggttctctgcccct

SEQ ID NO: 34228 - DNA, 1107 bp, Bovine  19866881123929
cctccttactgcatgccactgggtgcatgggccgggtccctgtgcagcactgaggcctggcatggcaggggtttgggctacaggctgcagatgctgctgggacagccagatgtgatggagctccttgaactgttccaccatgcggtctttgaggtctgggtttgagatctgtagccggatgctatcagctgaccaagaaagctcccccgagaacatctccagcaacatccgggctgctacgggtaccacctaagcgggtgaagaggagacaggatggggtgaactgtctggatcggcagggctgtccgattgagttatgcatgaggggatccaccagagggcaggtggtagtttacatccgccagaagaaggggcaccaatttctacttcgtagaaaggcagcttatgtgtgagcagtgccggtcatcaattaactctgaccactgaattcaccctacccagacagccctgcccctcctggggcaagggcccaggatttcccaatattcaaagcagagttcaggaggttgatgatgggagtatacctgtacagtgatgagcttcttctcccggggtttgcagtcaggccactcctccccaaagcagaagaagatctcgaatggaggtggggtgttggtctggcccttctggaataggatgagctctgcattgacagtaagaccctaagtcagaggcggacaccaggcccctggatgaaaagagacccagaggaacatgaggcagggccctcaccattgaggaagtcctccaggctgaagagcttggtcttgacctcccgctggatggggttggggtgtgagccctgggctgaggcgcagggcccgctccagaacaccttgcactggcacaggcggatggcatacagatcctggccttgtagctgaaggatgagcccacggtccaggacgtccagcagctggttggtataaaagcgttgcttctcgctggggatgtcctcggggctggggaagcgcacttgctccaggctcaccgggccaaagagctccacctgctcctgggtggcttccagttggctgtagaagagccggcagccttgagggttgctgatggtgagagcccggggtg

SEQ ID NO: 34229 - DNA, 1244 bp, Bovine  19866881140648
aaagaaacatctgagatggtttaaaactcttcctcgggtcacccccatttttgcagtcaaatgcaatgatagtagaaccatagtgaagacctagctgccaatgggagaagacttgactgtgccagcaagactgaattacaattggtgcgtgtctcgggatgcctccagtgaggattgtctatgcaaatctgtataaacaagtgtctcagattgagtacaatgccaataacagggtacagatgatgacttttgatagtgaagttgagttgatgaaagcttccagggcacatccaaaggccaagttggttttgcagattaccactgataattccaaagcagtatgtcacctcagtgtcaaatttggtgccacaggtttcttttggaatgggcaaaagagctagatattgatgtcattgttgtcaacttctgtgtgggaagtggctatactgatcctgagaccttcatgcaggtgatctctgatgtctgctgtgtctttgacataggagctaaggttggtttcaacatgtatcttcttgatattggtggtggctttcctggatctgaggatgtaaagcttaaatctggagatcaccagtgtaatcaagccatcattggacaagtattttccatcagactctggagtgagaatcatacctgagccgggcagatactatgttgcatcagctttcacactcgcagttaatatcattgccaaaaaaacccctcatattaaaggaacagacagactctgatgatgaagaggaatcaagtgaacagttatgtatgacatgaatgatggagtatatgggtcatttaactgcattctttaggatcacacacatgaagcctcttctgcagaagagacccaaaccagatgagaagtattattcatccagcatctggggacccatctgtgatggcctggaccacattgttgagcgctgtaacctgcatgtgggcaattggatgctctttgagaacatgggtgcttacactgccactactgcttctaccttcaatggattccagagacctaccatgtactatgtgatgccagggccaacatggcaactgatgaagcagatccaaaaccaggacttcccacccagagcagaggagcaggatgtcagccccctgcaccctgtcctgtgcctgagaaagcagcatgaagcagcattcagcagactgtgcttccacttgtattaacatgtagttaccactcttgtagctgttaactgcgagtt

SEQ ID NO: 34230 - DNA, 1471 bp, Bovine  19866881161213
aagtaattcagaattggactctgaatgtgaaaaagttttaggactagttaaaaacaatttcagaaattggaaatttatttcacttaaattttcctttttacatatttacaaaagcagtatgatcaaaagctgtctaagtaagcctgaaaaagctctttcaataagtataaaataaaaattctaagtgatagtaagcgctatgtcaaagtttatcagtgttttttctttctttgtggcacataaataatggtgcatcctataactcatggtatcacagatatgatgaaatacaggtttgttttagaaacttctacctttctattccaaaatccacagctaaagcctttgttatttcataccaatatgtcactgacaactaactggtttcacaattcaagttaaaaaccacttaaaaaacaaattcagttggtctgcctaccaagctctcctccttcaattcattctctatactactgccatttaaaatttctgaaagattgatataataaaataccatttattgaatacttgctgtgtgtcaagcactgcatacattcagttaattctcacacagttttataaagaaactaccattatatccattttgcagataagaaaattcgggttaagtaacattcccaaatcatataggaatatagcagaaagtcaaattaatttttaagtagttccaaagcctgtatgttcagccacttccgatcgtttatccttttttctcaaaaatagtcctacagtgccccacttcttacaggattgcatttcaaccattctgatcattccttgctttcccaatactctctgccaaggccaccaactacagccgtgcatgctcagccctgtagattatgagaataagcaccctcttgagttccccatgtataagccagagtcctactaggcaattttgttcaccatccttcctctttagccggccagcctcctcactaacttttgcatatagcaagttcttttctatctctatggagaaggaaatggcaatccacaccagtattcttgcctggagaattcccatggacagaggagcctggcatgtttcagtacacggggttgcaaagagttggacatgacttgagtgactaacacactttctatctctgggtctttaattctgtttctaattcaaatactatccattattcaagaccaactcaattcccactttctctgagaaaacttcccaagtgttcttgccctaattcttttactcttttaaatgccaacagactcaaacaatcgtgtgtcacttactctggtctatgttgcacacaaccagtgttatgacatcactgagcacaggaaccagaccttttaacatacattacgaaacatttcacatattaagacttgtacagataaaacattctcataactaccagcgatgctgagtttagggtatttataggagacttaagagttctgggcacagaatgag

SEQ ID NO: 34231 - DNA, 1116 bp, Bovine  19866881166925
tccctagctcaggaatttgatccaaatcagttggtaatgaacactttttttggttagtttttggacaagttagaaaaccctttttatttatttattaattttttgagttggtatgagaaaaattgggtgggccgtcaacctgttttcctggtgtgtttcttgaaaaattaatctcaagagattctctttgtacaaatgattgcctggtaaaataaatttggaatgttattttactttttcttggagattttctatgaacattagaggatctgagaaaattgggaagtatagagttcccatatacctttagcttcccccttccttccctcacagcctaccttgctatcaacatccccccaccagagtggcccatttattaaaattaatgaacttccattgccacatcatttttaaagtacttactttacattaggattctgtcttggtggttgtcttccaagcgtcttgtttagtctctaagtcgtgtctgactctttgcgaccccatggaccatagcccaccaggctcctctgtccgtgggattttccaggcaagaatactggagtgggttgccattcccttctccaggggatctttccaacccagggatcaaatctgtatctcctacattgcaggccaattctttaccattgagcgaccagggaagccaaggtctttctatgggtttggacaagtgtatgacatatacctatcattacagtagcatagagcatagttttagtactgtcagtatcccctatgttttacctattcatgttcctaccctccactccgtcaatccctaacaaccattgatctttttactatctccctagttttgccttttaccctggctacatttgtatagcctaattttgtaatttttaccttgcctatctttccataccaggtttattcagcgtagccctgttactttgctgaggagccaagttgtcatccctatcttacagtgggccattgcctctactaccttggaccaccgggatgccaattgtagtgtcatgaggttcctacgagacctcatccatacaggggtagccaatgatgtaagtacaaacaatgtattaaaatagtttttctacttgtatctcatta

SEQ ID NO: 34232 - DNA, 1668 bp, Bovine  19866881275626
ttgggctgtctgtatggaggtaatctatgtattaatgtaaagaactattaagggctctatgaggagcaatatggagggcataaattgactataaacctgtcagatgtaatatcaaagcttaaatgcatggaacttttcacattttatatataaactgtggctgtattacctgcaaagtttaatgtgttctgatatgtcttattataatgctagacatcatccaccctgagcacagaaagaggatggattcatggaatagaggtgggatttccagatttctgaccacctttctgaattgacacatcacatcatggctcttcctatcccccaactattggataccccttcatcaccctctggctcagccctgaatccttagggctaaataaatgatttctgccaaaattcaagtgagcatcaacatgtatcaatcaggttgttcttgttcagttcaggtacaatatcttaaaactcaaaagcaaagggaagtcacctcagccccccgagaatattgtcttctttcttagagtgaatataaatctgggccatagaaaacacctaaaaggaggccttcatgttggaacatgttggatctgagtctaggaaaagatgcaagagagttacctttctgaaattacccagaacttgtgacttcatccagcgctcaccaagatgccaggctctggatgcatttgaactttagaaaggttgtaattgcccattcttctgaattttctatactatgtcttttagaaattctccatataagactgaaatttatactgtgaaggagatgaatggatggcagtaatacactggtactgtttaacaatgggttcccctgggatagaatggggcaagtcctgattcttttcacttttgcattggtgtaaatactcctgccacagctaattttgctaccaatatgatgctcctggacacaacattgagaacaaatgtgcccaagtcaactctctcaaggtggtaggaagcagctccagcacaccactgatagatagcttaaaatatagtcttgcaatgacttcaagaatagtttagacacatgcaagattactcctaccctgccaaccctgacatgcagttctttcctgttctaaagaaggcaatcttcttgggagctaaagtaaacagcgagaaacccttttctatccccagatgactttggaataattccttctatccaaaagcctacaaaaaacccaaataacagaagttttgacctttagaattatttttcttttccaccaaatacttcaggtactagtatgaatggtgttattaaaaagtaaactcttattataacttttaacttctggaattacagttattaatgaggattatacaatgtcttctataagttaaggcaaagcctacatacaattaaacccgaccacagtaagaataaataacagttactactccaaggttatttcatacactgttcaacgacaactgcagctgtgccactatttaaagtatagctgtgaaattaatataatgtattatgaaaaatgctatgtacagctcgtggagatgaagaactctgagtgggtggtagaaaaaagagaaagtaacagcaaaacacagtctaaatgtaaacttcagctattttgatttatttgtaaacaatctgtaaagtctccttaa

SEQ ID NO: 34233 - DNA, 1489 bp, Bovine  19866881285123
ttctattgttttcctctatttctttgcactgatcactgaggaaggctttcttatttctccttgctattctttggaactctgctttcaaatgggtatatctttccttttctcctttactttttacatgcaatgtattttaaaaataaaatgagttttcgctgagagctgcacttttatctagggagaggtgtctgggttgacatttcattaactgattttccttctgattccatgcgacccattattagagcaaataggccactcctggcccttcctcttggaggatccagagccctccagaagcagaaggcaactctactgctctattaaggagagggatccttggtgccaccatgaagcataggttgaacatctatctcttagctgaccttgttctccatcttcattaaactcattagtctaatgaagtccctggagggcttactggagagcccatctcctgggagctactggactaccagaggtcagcttcccaacaaagagcccccaagggcgttccagaccatctatccagagtggtatgataagacctccgtccaccggctacgaccttagaacagtgtccaaaatacctccagctctaccagtttctgggcaggcattctcaatgtcagtgttatcagagaactaactgttaccaaggccctcaaagggcctcttccattggatactccttgttctgaaaaaggcctgttttatcacagatttgagtgggtcgcctgtggctgtggaatggcgggatctcactctcttccccagactgcgtctgcttagatgtcctgagcagcctggctttgtcttctcttagatgagtacttgtgctgcaactttagctgttgggagatggtgttattttcaaccctactttctaagcatctgccaagaattcctttggacttgggtgtcttatggtcagtttagttggtattcagcttttctctcatgagagctcctctgtgtgcagataacagttaagaggtgttagggttggctgtaggaaggggaaaggtggagtcttctgtgtcctgttctcatttttacattttttaaagttcttcctccaacttagcaagtctgtgtgtgattattggtctgaagtgggcaggggaatgacagtgcctgcttgggacatggacattttggccatcatgtggcttaagtaaatttttctaatgaaataaagttgaatgtatgtttcaaaaaaaatcttgcaggaaaaaaattgatgtttataaatgtctctcaaatgccaactctcctccttattctattatgattgccctagttcagtatctagtttttctcctagagataagaaagtcactgtcctctagtctttcttattattacattctacctcaatcctgattaacttttatactacaatcagcattgtctttctaaatctgatcatgtccttcttctgtggaaactcccttcttatatataatgtgcaataaagggacca

SEQ ID NO: 34234 - DNA, 742 bp, Bovine  19866881441678
cgacccctgccgccgctgcctctgcctggacggctcggtgtcctgccggagactgccctgccctcccgtgccctgcacccacccgcaccaggggccctgctgcccctcctgtgacggtaacgccctggtcatccccctccctgccctgtccccccttctttccaactccacccctcgccttcttggtgcccctcttcctccacgcccctctttatctccaggaggatgccacctcctctccccacttcctcctggcctgcccctcccacatcggggttctcactaagaaaatggggaaacagtgcccacctgatccacagggcctggcagggtggggggtggtctccgggatggcttggcctctagggctgggagggcagcatgccctggtaatgcgcctggtactccacgagcccccagcctctcacctgtcccactaggctgcctgtaccaggggaaggagttcaccagcggggagcgcttcccttcgcccactgccagatgtcacatctgcctctgctgggagggcagcatcagctgtgagcccagggcctgtgcacctgcccagtgccccttccctgcccagggtgactgctgccctgcctgtgatggtgaggggaagggactggggggtgggctgggagagcaggctcaaagtcttctttactgcccagagcgcatgctaagtcacttcagtcatgttcgactctttgcgaccccaggattgtagcctgccaggctt

SEQ ID NO: 34235 - DNA, 710 bp, Bovine  19866881450864
cttacagcatgaagaagactttgaagtacggaaagaactaattggacaggtgatgaaccagcttggacagcagcttgtaagccagctgcttcacacgtgctgcttctgcctccccccatataccctacccgatgtggccgaagtgctctgggagatcatgcaggttgacagaccggtaagactgttttcataaggaacccacttccagtcctggatagtttcttgagaggctgactctaactttgaaactagtcctattgtatgctcttggaacataatttaggcacattgttaagtttaattgttaaataaaggagccaatagaaggattctagagaatacgtttgtgtcactctaagaatctaatacagtagtatttttgtttttcaaaaaagtactctttgagcccttgcggcgtgacaagtttattccaaacgtcattgataagagaaataaaatttctgtgctcttactttttaataaatatatttggtttccaggtaacaaaaaccttattatatacatttaactttacaaaaaacgttgaatttgtaagcctttgttatctcttatctttctgatcatgacctttctaacaggcgttaagatgatatgtctttatagttttaatttgcattcccattatgattggtgacactgagcattttggtgtatctgttggcttttcatgtatcttctttcaagaaacg

SEQ ID NO: 34236 - DNA, 1107 bp, Bovine  19866881504110
ctccgtgggaggagagtgccaagagtaggcccgcaggactctggtcggcggtcagggccttctcagagtgctctgcggcgctgggactgagggcgaagggcaggccgggcgaagggtagggcacttaccaggcattgtggtgaaagacgcgagcggggtcgctcagaaaccggctcccgaactgctgcctcttcccgcagacggccgcaggatcgccttcagggaaggagcagtccatgacaccggaaccggaaacacctactttcccctcacgcgcgaacgctctgcaggccacacccctttcggaaatcgccgggtctgggcgggaaaacacggaggccgggtggggcagtcatgagtcccccgttgaggcggcgttccggctcttcttggtgggacggagctatttgggaaggagactcagcgggttttcgccccagagtcgttagtccttcaacaggcgggcgagaaagtggtagacgttccacttgagcctccttttaattctaggatgctttaacaagttcccagtttgtcttaaggaagaattttgaatcactttaataattagataattacctagctttactgtagagcaatggccaaaataattgagaaaaatagcaagcagggtgaggaaatagggcgattttccagcttttcacggtgtggaaaaggaaagaaaaaagtgtgtgttttatgtgcgtgttttgtgtatccccacaccgtttttctggagaaagatatgaaatgaatttcgagaacacgaagtttaactgtcaaatcaaatatccaaggacaagtttaaaagtgtaaccccaccacctaactttttaaattatccatatgaaagcttatttgtacaatcagaattgtaatacatacacatatacagttatattaatacattttcagccttacatttgtttcgataattgctacaaacttacaaaagaagaaagtatgctgtcaatataagataaagttaattgagaagatttccagaagagggatgactaccatttggaagaagagaagggattagctgtttaagtatacagttctaggtttaacacactggtaaccagtgatagcttattgctgaat

SEQ ID NO: 34237 - DNA, 533 bp, Bovine  19866881763430
gaagcccgagagctcgtctgtcagcccctgcccccgaggtcggtcaggtcactgtgaaggataccagacaggggccacggtggaagggctgaggaggaagtgaccggaccatgtgggcagaagggcatattcatgggcccgccttgcaccaggctctcaggcagtgactccccactttctctccgccactcagagcccctgccgccgccgcccgcccactctgtgcccatcgtccaccaggccaagaaagtggtgccacgttagtacacgccagcagaggcgggccgggcatggccatagctgactggcctcacctgtgctgtgtggcatggcgtgagcggggtggagtcgcccccccttccgtggcattctgtgacaggcccaggttccgcgcctttgcctctgttctgtggcagctctggtctcctgggactggcctggtgatttctgtgggaagggtctgggttccgtgccgtcgcctgttatgtggcagtccccagacgctgtgccgtttgtctgtgttccagggcagg

SEQ ID NO: 34238 - DNA, 904 bp, Bovine  19866881917922
tggtgttggaggggactcttgagagtcccttggactgcaaggagatccatccagtccatcctaaaggaaatcagtcctgaatattcattggaatgactgatgttgaagctgaaactccagtactttggccacctgatgggaagaactgactcatttgaaaagaccctgatgctgggaaagattgaaggcaggagaagggcacaacagaggattagatggttggatggcatcactgactcaatggacatgagtttgactcaactcctggagttggtgatggacagggagacctggtgtgctatagtccatggggtcacagagagttggacacaattgagcaactgaactgaagtgactgaaggtgaaggagaggtaatttgtggaaaaaatgacttgtgtaatatgcaagcatagatagtaatgtcttctatgtgatttaagtcttatgttttcacagtgtatctattaaccaatgggcaatgcattggtcaagttattctttgaggactggctagctctgtgcattttcaaaaggcaagcaagtgctttctacccagaggtacccagtatctctgaagacatatggatagatgcctgtacaacacaagtattttggcccacattctcatatcttttgttgttaaaaatagctttaggatgatgccattcaccaagagacgttaggcagggacacctaaagtataaacctccattatagtgatcatcttaggattcagccacatgtggcttcttcggttgtacagataaaattacaatatttaatgttacctcaagccttaatttagaaattgtaaacttttggtttccacgctggagaaggcatcagtaataactttaaaatacccttgagtttccctctgctcatttatctcccagatctgta

SEQ ID NO: 34239 - DNA, 1607 bp, Bovine  19866880352156
atgtctatttatgtatcgtaagatgtcctactttaaatattctctttttttctagtaatagaccactagttttgctctcattggataggagatttcttctattaatagtacttacctcatggtgcggatgtacggactgaacgaggtaacatatgcaaagcatttggtgcaatgcctggtacacagcaaatgttctgcaaatatcagctattatagttatcttcaaatctaggcctccacttggcagatgagcaaactgaggctcaggggacaaagtaacttgcacgcagtcacaaagtaagcgggttgcatgcacatcaaagcctacaaatggatccttgaatcccaatctgattcctgaattccctggggcctctccccagtcctgaatctcagagggctaacgcttcccagaggaagagtggagggcaggcggcagcgggcaggaagagcccagacagagggtggggcctcgggcacctctcaagagcaggcaccccaccctgacctcccaccacccaccccactccgggggatacaagacttctccctctagttacatttacgttaattgctaagtttatcatctcagtggcccctctgtgttccttcacagatcctgtgtatttttatctcaaagagcttcattcatgtctttaattatttgtctccacggctgtctcctctagcagcctgggagtccccggggagagggcaccagctctgattcatctctaacccccgagcccagaccagtgcctggcaccaaggggccactttacagatgtttgctgaacaaacgagctactgaacaaatgttaagtaatagggcgccccggatctctcattgacttcctggcttgggaagtagcagagacctggaagacatggccctggtctgctcccctccggctcctttttctcctcctccatccctccagcctcctcttcccagggaggcccgagagacacaggtggggtagggcagacgctgggaaacccagcccggggggcgaagctcttctcttcagggatggacggggtgtggtgtggggctttgtcttctctgagtcacctcgttggtgccgtgggtctgactcagaaggagagtgagaaggagaactttgtcagtcctggtttccacgggtcctgggccccgccgggtgggaggaggggagaggcctggcatgggaagatgttaggacacatggagtagacctccgatctcggaagcaccaaagccccacactcggctgcacctggaactgaggcttggaagaggcaactgggtgtggtggagggaggagtcggtcctgtctttatctcctcccctccctgaacctcagatgcttcatctttagccagagacttagaccctggactcctccagccagctcccagctgggggccagagctttccccaaaggccactggggtctgcgagaaaagacccacaaccaagaactgccagagtctgagcgctggctacgtgctgggagctggaatatcgtctgtttacagatctcaccaagtcctcacgccaggcccctggagccccattttgcagacgaggaaactgaggctcacatagtcaatgacgtgactca

SEQ ID NO: 34240 - DNA, 1387 bp, Bovine  19866880433070
agaggagaggactttccaggagagagacaaatcctatggggttgtgggggactcagtagtccaaggttagggacatgttggtgccaagggggaatgggggaccagacaggagagagacaggaagagcttcgaatgccaggcctggatgcagggagcagtctggaaagacctgcccgagggtcccagcattccccagatcacaccgtgatctctcctcccagctcactagtcacctgatgtccacgccctcccagtcaggactgggcctggaacacaggtctcctgactcgcagccctgaactcacctccccctagtctcctgatgtccacgtcctcccggtcaggactgggcctggaacacaggtctcctgactcgcagccctgaactcacctcccccagcttcttccttgtcatggcctccctttcaggctgtggtgtttgctcagagcccaagcccggggcagagagcagagaaatatttatttatgtcaccgccaaccctgcctcctggaggcccccaagggctccctcacagagaagttcagttatgtaaccccgagttgacacagcaggaaggagaaggacataaattataattactcatttttccgcagtcttggacgctctttggatagcttgacactttgggtacctcccttcttcctcatcgaactgacctggggcctccagggggaacttggtggttctcagccgattttagcctcaattggggtgagcctggggctttgaggagaccttcctagaggctggggaagggagagaaatgagatctcaaagggctgctttattccgagcactctgccaggggctttatattcataacctcgtttttgcctcatgaagaaggtcctgtttattacctccatggagtgggaaagggatggaggctcagacaggttcagtaacttcccaaagggcgcccagcagagccaggtcaggagctctgaggctcctagttttcaaacagctcacgtggaatctgcaacgtagggattctggagagattaaagtgtgctagcatctgcctgtgcaggaaattcttccctagcttaatccccaaacatccctcacattcactctccactgtgaccttccctgaacactcagctcctttgtgctgggaccctcacagccccacccggctcactgccccacccacctccccagtctcacacttccctttgtaaagtgttcatcctcaaccccatctcccagtcttcacgcccactgttcttcccagccacaacgtccctcctcctttctccacctgacaaaatcctagcaaaataataatgcaccttcatagagcagaaggtgtagagtggagtggttaaaagaatgaactctgaaaagagttaaaagaat

SEQ ID NO: 34241 - DNA, 1851 bp, Bovine  19866880470551
ttcactcagactcacgtccatcgagtcagtgatgccatccagccatctcatcctctgtcgtcccttctcctcctgcccccaatccctcccagcatcagagtcttttccaacgagtcaactctttgcatgaggtgaccaaagtactggagtttcagctttagcatcattccttccaaagaaatccctaaaagcagtgttatattaccagtgcataaaattcctcctccatgatattctcagagaaaataagtaaattggagaaaacccccttaaaagtctgagcagtatttgttttcattttccatttctatcttaaacattgaaactctcatcctttgtggtgtcactaatttccttctgctgtagaagtctgcgcaccatttgtaacattgtatgagtcagacccacagtaagttgccattatcatggcataaagtttggaagattactatgatagtttaaactttaacaattttgaagtaatttaaaatgttacaatggaactatgaaaatgatagctctgtatatcttaaaaggacttataaactcagaacaaaatctgatttccaagtgtattcttgaggtaatttgctttcattatcatgtctctgtggttccacccttctgaaaatagtctttagcaagtttgagttccaggtatgtctttagtaaacagcagcttgaataacatgtacagagagaccaagtggagtggaacagtccagccttttagagaaatcattcatttcctgctgctggtcaggcaggaaagtacagactctgtcctttccctttgtaaagttgacttgggctacatgaagcccttgttagaatggtcctacagttgaagatacatgtctcatgaatgtgttctgaatcacatgtatactctcggtgtgtgtgtgtgagagagaaacagacagacagggagaatttcattgccatgtgtctttatgttctttttcaagataatttcaaagatggaaatcctgttgaggccactaagagctggattagaaaattggattgtaaatgaaaggctttctaaacctgttatcgtgtgtgtgtgagtgctcagtcacttgagtcatgtccaactcttttcaaccccatggactgtagcccaccaggctctctctattcatgggattctccaggcaggaatagtagagtgggttgccgttcccttccccaggggatcttctccacccagggatcgaacctgtgtctcctgcattgtaagtggttctttactgctaagccactgggaaagccctgttatcagtatacattctgcttataaactataaatctgttaagaattataaaagttgtatttggtaccttttcatagatgttattttgttttaaaatgattgctccacaaatggaccttaaagtagacagggatcagcagtataccacatttgatcacaataaataaaatcctttaactggttgaacggggacacataggcagatgcttagtaactgggatcttggtgtgtgtggtttgatgtccacaacaattcagtcattcagttagtgacttagtattagtcagaatatagcaaatctagtgaagagtaattaataggagtaaagggatctgaaccaaaagatttgtgttgttacttttttttttttttttttgcttatttgccatatactgggtctagcattggagaaggcaatggcaccccactccagtactcttgcctggcaaatcccatggatgaagtccctgaggtcgctaagagtcaaacacgactaaatgaatcccctttcactttcactttcatgcattggagaaggaaatggcaacccactccagtgttcttgcctggagaa

SEQ ID NO: 34242 - DNA, 1498 bp, Bovine  19866880472345
ctctgatggagtgctgagctagagagttaatttggacgggggtgcagggccagtcaatggccaaggtcagggctcttgacttgcctgggttacgaccatctgtggataagattacgggcccattggtggaaggggacaggggaaagagagcagggcggtgatggtcatcttcactggttagctttggggagggaggcaaggactggtactgggcttcggctcctcccagctgctcacctggttggggcatcgtccactctttacactcaaacagcttgctgggtgccgacagctccccaacacctgcccagtttacggcccgggcacggaactcatagaagtgaccttcatggaggttgctgaccttgaagagcagaaacacagactgtgaaggccgaggctggggagacagaggatcgagctgacagcaggaggtgtgtggggactttcggtgagattggtctgcccttgacaatcagctggatcgtgcagaccgaggggcctgaggtctctcagcctcagaacctccagccccgacctctggtctctgcctgcgtaagtcaggaccgcaggccggtggccgccttccagcctcaccttgcaaatctgggtggggacgggctgctggttgacctcgtgccagtccagttcctcggagtcgtgctggtccaggaagtaacccaagatcttgccccctccacgccgcttcgggggtttccatccaatgaccatttcatttttcccgcagttcaggagggcgaagtcatatggcgcagatggtgttgctacagggaggaaagggggtgagggtcactgctcccagggcatgggcagactgggcagtggggcccgagggaggtagagagcctcccctggtgggtgcccaccctgctctgggggcgctgacttagccggcggtgtcccttgataactctgactctgctacatggaggacacctgagcctccacgctggtctcaggccactgttactctctcctcaaaggatcgggtggtcaggggggcttctgccccgtggcctccggattggaccctccaagagatggtcaatgagcccccagctctctcccaggccacggccgcccaccctcaaggcttgcaggctgcacctgccctgtggactcacccagagcctgcttgaccctgatgggttcggtgacggctgagctctccccgactccggcctcgctgacggacctgatacaaaactcatactccttccccgtccttagcccgggaattgtaaacctgggagagacatgtgctgccttcagggacggccaaacagttcggagacatccctgaaacttctagaacaaccctgagcgggctaagtggcccccagcgtggcaggattggagggcctcagttctcacctaaagaccttgtccctgctcccaaagtgatgcctgcatcctggagggtgaggtccttaagattttaaaggctgtgacttctagagcctgtcattaaagtgca

SEQ ID NO: 34243 - DNA, 1454 bp, Bovine  19866880477435
gcagactctttactgtctgagccaccagggatcctacctggcagagctgggctcaaacacagggtgtgaccccatagcaaagctctcagcctgctgactcagcaactacactgcaaggtcagtgtggaattgggaacctcctgcttcccatccttagccaggtcttctaggcccatggttcttaaacttgatcatgcatcagaatcacctggagggcttgttaaaacacatattgctgaaccccacccccagagtttttgattcagtagctctagggtggggctgagaatctgcatttctacggagttcccaggtgatgacgctgatgacgctggtccaaggaccacactttgagaatacgtttttttgttttttaaggtgaaccaatatgactctttcctccctctcctcatttcaaaagtgacacagggtcactttgtaaaacacaatatataaaacatggaatatacagaaaaattggaagcaaagaccagaattcacccgcattcctctactcggagataagcagagttaacagtctggcagtatctcaccagttttcaacatccatgctggtgagaagcaggatgacacattggtgcggagcattctttcggccccttataagatcccagctcttcagcaagatcctggggagtcggacaagcttaaatcccatcacttgcaaaactgtatttatactcccatccttcactggagtgctgggagggttacaggagatgatgtccttctcaaataccggaccctgtgtccactgtgaagtccccgctcaaataaagacttggctgttacttttgttttaaccgaagggtgctttggatacgctctttgcgttttcagccctgagactcttccttcccgtcgtcctccgtgtggacccctgaagaccctctgggctccagacaccgacagggggctcctcctaggagacagcagtagaccgagtggcaggcgccaccgcccttagggtcgtcgcaggggcctctcggctcagtctgcccgttttacagcccggtcttaacgagggtttttaacttttcattcaccagcagagtagctctgacttttaataacacgacaaaaatttgctcctggcaatcatggtttcgaccacaaaaccacagcgggaggcgttcctggttaactctttcagcgctgcaggcagtctggagcccaagcgctctcggagcttgggtggagtggcggcgaggcctgaggtcacagaccgggatgggatgggtcgggtccccctcctaccctcccttgaggctctccaagcttcggggaggaagatggtttcagattcagacagcttcggggaggaagatggtttcagacagctggtgggggccagactgcggctcatgtgtcctggcgtgcctccttcacttccctctctttccttcattccacagacctaccgcgtgctgaat

SEQ ID NO: 34244 - DNA, 889 bp, Bovine  19866880553460
tgtgagatggtgcagcccttctccgaaaacagtttggctgctcttcaaaagttcaacgtagaatcactgtaggacccagaaatcccactcctacccaagggaaccaaaagcttatgtccacttaaaaaacttgtgcacaaccatttgcagcagcattactcaaaatagccaaaaagtggaaacaaccccagtgcccagcagctgatggaggataaacagaatgtgacctatccacacgatggaatagaattcagctgcaagaaggaaataagtgccaatctatgtaatacggatgagccttgaaaacatgatgccaagtgaaagaagcctgacacaaaaggccaattggataacttcatttatagaaaatgtccaaataggcaaagtcattgagacaggaagtagattattggttggttgcctggggctgggaggaggggagggatgggggaatgacagctcacggacacaagatttgtttgggggcgacaaacacgtcctagaactagacctgcggcctgtggtctacaccaccttgtgaatatattcagaataccacagaactatatgattttaagcggtgaattgtatggaatgtgaatcatagctcaataaaaaggaaaaaaagaagtgaaggggagcgggagggtcagttagcaccgtctcctgctaagtggttgctggctcaccccctcggtgggcagctcgaaagggggctagggcagggtctatgcacccatctgctcaccctgctcccacttctggcagctcacatcactgaggacacctcagatctccttcagcacgtgaagttccagtccagcaacttcgaaaacatcctgacgtgggacggcaggccagagagtgcccccgacaccgtctacagcgt

SEQ ID NO: 34245 - DNA, 986 bp, Bovine  19866880554008
acttggaaacatgtaaattgtttttacaatgggtatttccaatgtatttttagctgatctgaacttccttgataactcaaccaggaaaagaagggttatcatcattaatcttagacacggaaaatttgactcaaaggagtaccttatctacagacatcaaagcagagaaatcagaactagtatgcagtcagggctgggctgaggataaggtgagtctgatgtagatgtaaagtgggaccttatattgttttttaattttgaaattttgtccatcaagaatttctttgttaattttgattttttcaagtattgcattaaatattatttatcttgattactgagtcttttggcagtcttagattttacatccaaggcaggtgcctcaattgcttctgttaatcctgactctattaagtaatatgattcttgcaccagtgctattaaatgactctgtactactgctagtcaaatactctgctccctcaaattctggatgcaagagaaatatacaatataggcaaatacaatgcttgccctgattgttcagtgccttaatataccaagtcattgatataccttaaaaacatacaaggtgttgtaatctattaaccacatgctaatcacaatccaatttagcataataggaaaatattggttttagcaggtttagaaaggttttcagccacatttctccaataagataaaagtttataattataatttgattgaatacataacctttgtcaagtctttcatggttaacttaatagaattccccagacttaatgtaaacaagcccaaccaaatagaccatgtacttaagagtggttttgtctatttactataataaagaacaaaatgactttagaaactgaaattaggttcccaagaagcccaagtattatgaccactatggcactgataaaagattttttttgaattataagaacttgttatgctaatgttttaataaaagctactttcaa

SEQ ID NO: 34246 - DNA, 1095 bp, Bovine  19866880566247
gtgtctggcagacggtcggtgcccagcgtacctcatgcatcaggcattgtgctaagcctttgcataccttgtctcccccttaaaaccgctgtatgccatagggccttgtgttatccctgttttagagatgaggagacggaggtatgaagtgattaaataagttcctcaagctgcatggcctaggaagggtagcgctagagttgggatctgatcagagagcagagcctggatgcccaagcccttggcagggtttattggtggcaggagggccattggtgccagttgtaactgcagagcttagtactgcccgaaggatggcacacttgtctgtgtccctgtctgcccgcctcctggaaggctgtgaagtttctttcagctgtgttgcaactcccaggtaaagggccatgggggtgactcatgctggctgggctcaggtggagactgggaacccaggcagcatgtctgtgctcgctgggctttttaaatgggtcctctctctctacacctgtggatcatgtctctttaatcgccctcacccatctacagagatcagcaggtcgtggggcagagggtttttaacgtctccacacacggaatgtccagaaggcacctggatgagatggaaggactgtggtccagggtaggtcagcagggtaccatgagccagattataaggtcgctaggaccctccagcaggagctaagcctcccagtctgagggcgtggtctgttctaggcctttgctgaaggattcagaggtgccaggttttttagagagacgctacccaagctttcccccactcctgcccatttcctactcctgtgtggcgtgggcacagcccagggctcagctgggctggcatctcttccccttcttggattggcccagttcttggtttcttggcagaggagattgaaaacagagactcaccaatcatatgtgacataatgattgtattcacaataataacagtaagtaatgatgactgtaatttatttcatgtttgtatattgcaagcatagtgctaagagttatctgggctggctgatagctttactctgagactggctgacctgggttcagatcccagcccaa

SEQ ID NO: 34247 - DNA, 1348 bp, Bovine  19866880600207
aggcagacctgagacagtaatccagggctattcacaatcaatgccagcctcctcttttaggacagtcatgaggacgtttgaacatgtctgcaagcttggaagagtcagggagagaaaagaaccagggggaaacatcagaagtggacattgccgtgaaggagcaggacccctggcctccagcggtcctagatttgagccttttcttggcagctgcatggtcttgaggggttcctttccctctctcagcctccgtgtccccatgtttcacatggaatcataatagtgcccaccccaaagagtggatgtgccagaaagaacttctgtgagttgctggtcatacagcaaatagtcaaccgctggtgctcctggccttgtaggaaatcctcagggaggctcagagaggagcctctgttttgaagatggacattgcaagggactgagctcttgggggcatgagtaagagcttagaaagtaccaagctccagtgcaaatgagccgacccagagggcgtgggtgaagggactcgcatttgactgacaggagcttcagttctcttcttctgctgttctttccttacagccagcgccatcataggaatcatattcatcaaagaaaaatggaaacctaaagacttcctgagtaagttcattggtttgagcctgtgttcatagttttattcttgtgtcttttttcactataaatccagctcctcccaatctagagatcatctgtctccttctcctccgtgtggttctatatcccaccctcagcaggctactgagggctgggttttctaatcagtgattcccaaacctggctatccatcagaaccatctgtgagactttttaaaatgggctttcattcattgcatataatcagtatttattgaacatctattgttgggattttagtaggcccggtaaaaggctccctctttccctgagttttaaagcaatgggaactaaacaaggaagccaaacaggagatcagaagttatgccttattactaacgaaagttaggttagaacatgcagccgcatgaacttgtttacattctcctccggtatgccccagcccccacctagaccttaggccagcctcccaaggaaatatttaggtttacagaatggaacacttatccagaattactgccgtacattcatatcgtgtggcagagaagggagaaaaaagaacaaaacccgagtgtttaaattcttttcatagattatctgcattcagttgagaaatgtggaccaatggggcaagaagcagaagtgtgtgtccattggaggcccctccacacagaaacccaaggggtggggaagaagttacctactaagttccact

SEQ ID NO: 34248 - DNA, 895 bp, Bovine  19866880639816
cacactgctgtcacgcttcaagtcacctataaatggccaagccttgaggggctgaccttgtgaacctccccctctccaaaaggggcctcaggggctgggctccatctcatacactcacagctaaagaggtggaggcctcgggctcaggaaagggctcatcttcttaatggcagaactgtggtccgtccgtgcttctgggtcagagccacactgggcctagaaacttctgcgctcaccccagtcaggccaactcgaagccccccaagtcttcccattgcttggtggtccccacagagagatcagaatccccttcagcagggtgattcttgttcctccaggtcacgcttccatttggcaagggggtgtgctttgggggagccacgtggctttgatttaaatctcaccctggaaaaacaatggtttggattaagggaagaaacagttggtgaaaagtcatgaaaagaaaggagggcagaagcgggaccttgtagcaaaaatgatccccaaacttttaaaccctcattccagaggtttctcaaagcctgccatccagccatgacctcccacgccagcacactcctgccccttcagtagctgggcaggtgacgctgtgtgtggggtgtcccccaggcctctgtctctcctcttacagaggagtaaactgaggctcggagagggtgactatggattctggtggcttccatgcagtgaagaataaaggtggggggaactgggggctctggtgctcccattttgttggcagggagcttgccctctttaggccttcttcccccctgagaaagggaagaaaaggggattaccgtaacttatcaccactggagctgagtaaagcccaggaagcccacacaaaggcagcctgttcagctctgacctg

SEQ ID NO: 34249 - DNA, 1055 bp, Bovine  19866880701489
ctggcaaacaatatttgtgtagttataacaactaaactatctattgttgaagctatttttaaatttagtttacttttcaaaaacaaatttgatgtagtaacaaaataaatacccatactgaagctggcccttgagaatcagaagtatggtggtggaaatggaagactggtgcaattacaggagggcacccatggataatagaatcatcttatcgtaaggtctgtgtgttcactcagtgtctctgattctgtgactctctgggtctcaggtgtgaaaatagtttatctggctcttttgacaaagtgaggactgtatgcaaaaattctttggattctgtacaatgaaatgcattaaagacactgttatttttgcttaaaaatataaagtaaaaaagtaaaagtttcttgcaattctactttcttgtttccattaatagtttggggtatatccttccagatcttttttcttaatgtacactattatccactcacaaatacccactcttgccctcaccaggaatgactcagtacagtaattttaatgtggggacatttgactccggataaggaatgaataaactttccgttttttaaatgaccaagtactgtaatggataaagcaggcatttgccccctgaaccttgatcctgtacctggttcctccctgcttctccctgtgacacgttgggcccactgcagtatctcatctcaggcatgttgcgaagacctaacgttaccttggattaaagaaagtcaatatgtcagtgtgatggtcaccctgcaatccagccaaggaccccctcgaggctccgagaaaagaggtgtacccacttacccctcctctctctcctcaggtactaccatggcatggaatatgagatggacctcaccccccttgaaagtcccacgcacctcatgaaattcctgacagagaatgtgtctggaaccccagagtacccagatgtgctcaagaagaataacctaatgagtgtggagggagctgcacccacgccgggcaaggcagctctgctccctgcaggccccagcaagctggaa

SEQ ID NO: 34250 - DNA, 4019 bp, Bovine  19866880705636
gaaatcggcaaatgtgtcaactttttaaaagatgtttattcttgctcaactggcactgatattttttccctttggtattcttgctcatttggggccataaactccacccaaagaaccccaccgaagctaccaaacagtctaaaattatgatggattatatatagtgtctttaggaattggcgctttggtaattactgttacttttaattaaacactaatgctctctctatatagtttttggcagaaagaacaatgcttaatatcccaaagaaaaggcgaagtgactgaacggtgttgttaggacaaggttcattcaatgggacctcttttaaagagactttccttttactatatgtaagtttgctaaatgaaataagacagtgtcctttaataaataaaagaaggaggtagcatctgcactacacaaaccattctcaccaggaaaataggacttgaagtgaaaaccttagttttagcatacagagacctttgcaaggctggtgtgtccaaatgctctcttagaggaactccaaaaactccaattaaccataagggtaattagcacaaaaatccacccaggctgactttaggttcctggcacccaacaatagtttaaattaagctatatcaatctattccaaccactacaaccacccaatccattgtttctgagacactgtaattttctgtatagctcccttcatggtaacttctcagaagaatataagaacaaatccattcaataaatatttaatcacacacccactttatgctaggcacagttaatcaaaaagaaacagaaaaagaacaatttaaggacttactctggtttatcatcaaatctctgatcaactctgaaagctagtttttaatactttaaggaatggcctccaaagtaatcatttataatcactgtcataatagggttttctgatctttgttcctgtttttgttttgttttgttttggaggttttttggggtgtaggtaggagggactggttctacattgctaattcaaccacttgtttttgtttttttttttaccttcattagcctctggcctggaattcttgatatatgcagagaatttggcaaagatgtccattccagcagtatttgattctgggtgttttggtgaaagctttaagtacctaaatgaaaaatgtaataatggattatacagcctctaaagatatattagcataaatcctctcaatcaaaccattgtgctagcagttactagacatcttttaacagttattaccctaagaaatgccatcaccagttttccacagtacttttaagatgtacttttccttaggaaacaaagttctgcacagtgcttttgttcatgtattaatattcttggcatccaaagggcatccgcaccccatctccattttataaattaaaattctgggaaaacagtctacttgttcagagagtggtgccaagtcaatgggcgtcttagtaagagaactctagagcagagctgtccaagagaacgttctgtgctgacagaaatattatatatcagaattgtccaatatggtagccattagtgacttgtggctatccaaataggaatctaaattaatcgtaataaagttaaaactcatttcctcagttgcactagccacatttcaactgcagagctttctcagataggaatgccaaacagacatctttggtatgccatgcactgagccagccgtgtacaacagtgccacagaaccctggcagtaggaaaagaatctagactggccaaatttaggtcaaggacaaaaacagcaggaggctgatcattcactttagccctacattcaggattttccaaaacttcccatatatgaaatactgtaagggtaacactgagcaacagaaaactaagacagaagaatttttctaacaagtgctctgttgtgttattacaaagtctttctactttgagaagagacatttcatgacacaacaacttttttaaaaagacacacacgtgtattttatatacttaaatttcaaatacatatacttaatttttatttcttccttaaattggaaaatatacatgaaaaagcccaattctttacttttcccttcagtagagtttgcagcaactcatcagaactagagaaattcagactcttagcaccactttaggaaagactgttctattcttaaaagccctgcaacacttccctggaaaatggactgggggcagtaaaactacagaaaaaaaatcttacattgaattagttattcagatttattcatacattttaagatgctttcttaccacttgtctttaaattgaaaacaaaaaatttttaggaaaaaaattagtccagttgcaagttgtagtttcaggctagtttttatagtcatattttttatgtttaccattttaaattcaagaaaagatatcttctaaattagacatagtactatactgggaaggagaatataaaatatctattgaatacctatatgctcaagttatttcctttttaatatctatttttaagcttgaaaggttctttataattagaagttaaattaactacataatgagcttttcagtgaatgattacagtaaataaatttcacctgagtgtatgtaatgtatattatatgtgtgtgtgatgtgtgtgtttatatataaatatacatatataacatgttttttttcctgttaactacagaaaactttatcatctctctctctttttttattcccctctgcctgagctgaaacagttaattccagcttcaacatccctggatttcccttgactatgaaaataaccagcctgtagtttaaatagttccaccacttttaatacagtaccttcattgactcattccaaagaaaatatatagtgcaaggaacaaaagcgcctcttcagtacacctatgtcttcctctagccaagtttccaaatttactcttcttttccccaaccaatatttaagagtacctactttttctaatgaagtaaacttcataattctcaaagtaacttatagggaagtagatttgaattatagattatttatatattcattttatgcatatatttatttattctaataattaggtacctactatgtgtcagaagttgtactagggttataaagacgaacacacagaatcatacttaccagagacctattttaatgagcaggtaaaaatgtaggacttgcaatcagcatatcctttattacatggaaacatatactattacaactctttaaaaaaaacaaaacactactgttctctaaaacagggttaaacatgccctattcttctccaagacaaacccattaaattttgtagtattaatttaatgcatataatagtataggcacaccgcgagggtacaccggagtacaccgaagactactcaacctcaatctctcattttgctgaaaggaaattatatttcggaaaacttacatagttaccctcaaatcactggactaattaaaagtatcatcaaactcacatctcctgtccccaagtccagtgctgttgtttttgtattattacagatcaagttcaaaaagataaatcaaatactaaaccattaggcccaaaatcagttgtcaacttttttgcatttcccccaaacactggattttaataattcattagtagtagtactggcaaactgcttgactaagcaatacttttcaactattatgaacatttactttaacatttaataaaacaaaagtaaatgattaataaaaggctatgtgtcaaccacagaacagacatgcacatccagggcattgagactttaagatcagtcctttattacatcctatatcacatcactgactagtatttatggcagactagctaagagtatttccatcctttaagaaaaatctcagacattttctcctttcttgtgttaatatgagaataaagtgtggttatacaagtctattaaataactcctgtaaattcaagtttcattgttatttctcttaaaaaaagaaagaaagaaaaa

SEQ ID NO: 34251 - DNA, 1652 bp, Bovine  19866880730583
acgtgcttacctggggagacgtggatgtctgggcttcacatgccgcccagaggccccagtcatagtcaccctgtccttgtcgaggggtgggatggggaatgccaccacttagagcttctttaaaaacagcatcaccttctctagcctggggagtcaagctgtggttgtcaccatgggagagggggatgactcatcagacttttttttaatttaatttttattttaaattagagtataattgctttacaatgctgtgttagtttcaagggctacagcacagtgattcagttatatatatatatatagtcactgttttcagattcttttcccatgtagtttattccaaatgttcaatagagttcactgtgctatgcaataggtccttgttgattatctattttataaatagtaatcaatcagttcagttgctcagtcacgtccaactcttttcaaccccatggactgcagcacaccaggcctccctgtccatcaccaactcccggagcctactcaaactcatgtccatcgtgttggtgtgttaatcccaaactcctaatttatgcaggacttctaaagaaacgtggtgcaattcacaatcagtgaccctcatctcacttaggtcttcaccaggaactgccaaatgccaccttcagcttactccttctggagcccagttacttcggcgttttcatcacctctccaagcgaccttattccacaacacagggaaaatcaatggtgtgcttaattattaatcaatgtcatgaggaattaaactaaaaccccaagacactctgttttgtctggagacgtcacagagctgcttcctccgggaggagggaactgggccttttgtttggtttgtttacttacctgcacacatctggcctactaactacacggcatggtgattcatttcaggagaggctgatcagatgggatggcatccaaggaggaaccgggctgggaaaggaggctggcatcccagaattgccttcccggtaaccgtgacagcaggagtctccagctttccattcaccctctgtctctttcataatgagtttcctccccagaaacctcattaaccctgagacttcctgaacattttccgcaggtagatggggctggtctttgggggggaggggggtggtttccaggaaaaccctgcgtgctctgcatgcaccagggaaggcgacctaacctcctcgaacctcagtttcctcacctgcgagaggagtttccttgtggagtgttgcagggtttcagtgcattgacaccgcgtcccaggcttgcttctgggcctcagcacatgctgcggactctccctgagacacagttcccctctgcccgccacagccgtggcccctccacttgactgacactgtaacaatccttccagccggaagcaaaagctgtttcttcagagaacacccacagcccggtcaggcgctgggtaaagaacacacacagtccctccttctttccctcccagcctcagcacagctggggtttgagtaacgcctgcctccttgtcccagactggggaccctgcggaggagggttggatctgcgtagctcatccctccgtgcccagtccctgcacaggtctgagcctcggctcacactcaggaaacatcagcgtccctttcaaaa

SEQ ID NO: 34252 - DNA, 1293 bp, Bovine  19866880740016
ccttgagacgtgaaatgtcaggcagaaaccacgtgtcagaccccaagtgaggacctctccactgagtccgctcaaccttagagctatcaggccactaagtcttggagcagctggttacacagggacagacaatcagcacattggcctttcctccagtgccgtcttcccaatgctaccccaatctaaaccttccttggtcatgacacccgactgtcttctcctccccaggatacctcttccacctctgactacttataataattgtttgcaccaattatgatggcttgagatccctggaccgacttttcttttaaaacattaaaaaataacctgtaaacagaaatgttttattatttctgaaaatggaaaacttgccatcaatagaaagcaacaaaataaattagatgaaacagatcaatgtcattctagctggacagtgttacctcccaaattgtctggtcccaaggcaggtcttctgtttaaaaagatggagtgagtgttgtagccagactctgagattcagaatccaggcagttacagcagaccagcgtctggatccctggatcacatgaccgtggtcatgtatccttaaattcagtagttccacgaagcttcatgattccttcgccttcctgactatggcaggtgccagagctctccagtctgcagtgttttggaagcctccggcctttccaatattttaaaagaatcgggtgcataaaatcccttcctaccaaaaatgctgatttctatttctgtttcttgcattgaccccctgacttcccgacagctcctgcagcagctcctgggtttgtttcttttattatttaagtagttccttcagagtattttcaatgtgggtctttgtgtgttccaccttctaaggctttatttgtctaagaatatttttagtatgacctcaatgtttgaatgacgatttggctgcctttaaaattctggattgaaagggctgtcttctttcaattcttataataacattattctttgacttccttgatcaagtgttgttattgagatgtataacatcagtctaaatcttggcactttgtaagggaggctatttctctctgcccttcctctttgtctttcagattttcaattttatcacgatattttgtgtggatttttctgctgttggcgactccatgagtcctttcagtctgatttccttcattttcctttaatcctggaacatttaatctccattatttcttcagttcttccttattctgcattttttgtcttctctccttcaggacacctacttttact

SEQ ID NO: 34253 - DNA, 1017 bp, Bovine  19866880870898
tgggtgaggggtggggagcttcctggtagaggtggcaaacgacggtgagcagaggagggtctgtgtgcaagcccagagacctctcttctctagtctagcagtcaagtagccagagttccctaaaactccagctgcacggactgaaagggcagcacagctggctgtgaacatctgtgaatacatctgagaaccagagatggaaggggcttgggtcaagtcacacagggagtctcctggcaattctcccctccctggcctcagctgctggcacgtcccgcagttgaaagctctcctagagccacttcagatgtctgctctgctctctcccgctccctcctgctccaggcttctctgcccccgacggcccgctgggacactaggcatcctctggacagggaaatttgagggcagaatgctgagggccgaatgttcccctcacctggccactgagagatctgtgctaggattctggaaacttctcagaggatgaaagactctagtctgctccatcaagaaaaaggacctcaggaagtgaggccaggagactgtgatttcaactagcatccttcccccgccccctgctgctgtcctcctgttcctctctagcacccctctgggtcttccagccttttccttcctccccttcaagggggcccttgggcaggaataaacagtctctctgaaatagagaaccatggaaatagacaaagttggcaagccagcccagctctgcctgtggctagctttgtgccccagggtatcgggttcctatctcctagccttagtttccccacaagtccagtggaaatccaccccctgggagcctcatgagacagtggctcagaagtgctttggaaaacgtggagcgaaggacagccagggctggcgagcgtctgccagggaccacacaccctcccgccagacgcctctggccgtgggctgtccaaatgggtgtctgcaaagcagcccggctgggccttgttctggtcaaggaagagaaaggctgagttaattaaa

SEQ ID NO: 34254 - DNA, 1612 bp, Bovine  19866880903948
aggaatcatggggtctaaagtcactcctgagagctcccttaaaagaaaaaaagaaaaatctggaaacagagaagcagggttgttgtttttttcttccacttatcaagttgataaagatgaaagaaaatggtgttggcaagagtgagagaaagcacgctgtctccttgctggagggagtgtgaatcagtctagactttggagttagatttcaactcatcctttgatcttacattttcactcataggaatttagcctaagcaaataatctgtgtgtggaaagttatctgcaaggatatgcatcagagcattgtttataattctgaaaaattagaattaatataaatacccttcagcagagtctcagtaaagtaaattaagatccttgaatatagttggatattgtgtcactgttcaaaaggatgctacagaaagccccttaacaccggggaaattacttcctatgcttacagcacgattgttagcatttttgagtctttactgtgttcgaggcactgagctcagttgtttagtctcctttaatcctcacaacaaccaagtgaagtaagtactattatcttgattttacaaacaaggggagtgaggcctcgaagtgaaatgtctggtggtcgttcagtgtctcagtccaactcttagtgaccccagggacctgcagcacaccaggcttccctgtccttcaccatctcctggtgctttctccacccaaggtcatttccagggggggcctctgagctggtctcgaatgaacctgggtcagattcccaacttttaagtctttcagctactctttaccgttagtaaatgagtcctttcctatttttaaaacccatttccatgagtggagaaagaataggaaaggtacgcaccagagagtatcaggggtggtaggatcaggggtgatttataaaaagtttattcttttcgtgtatctgtcaacattatttctcccattaataggggcaaaaaagagagagagagagactctttatagttattaaggaatagcaagtcagagaaggcttatccctgaactgagaaggaagaagcggccagactgctatctggagattctttctctgttgccaggaaccagccagaacaggaggcagccagagagagccgtgccaggaagaatgtggccgctgtcctggaaggagaggacccacttggaagaacagaacccggctggctcagcccctgaggctcactctctccagggacctggcctcgggccctagtagcccacctcctaccactgtgggccatcaccagcccacttcagaaaaagggcattaaaccagatactgcccacttccaaataaaagagagcttcaagtaaaagtaagtgagaagcaccttagtccctaccaccaccctggcaagcaaggctgaaaatgcattttcttctgtatttcatctatctgaaggggtcacactggggacttgggtattcagatgacagtctctttgaggaactacagaggaagaatgtacaaggcctggtttggacagagaggatcctggaaccccggttgctgaatagaagaagcgagtgtctggggtcagggctgccatcctaggttagagggagctg

SEQ ID NO: 34255 - DNA, 1667 bp, Bovine  19866880907177
ccctgagattgagactcctcttcctgtgaagcccaggtctttcgggagcacagtttgagaagccctggaagtttgagaagcttttccagatcattctctcaatgctatacctttatgctgacttctaaacagcacagccctgtggctacaaagcttatgaagatgttttttgcatcaatggaaaaatgtattaagtcctggcaggtgaaatggcagaggcaaggtttgctctgatctctgtggttcttgcagggccacaaagctgacaaaattaggttaccgaatcagttgtttgagaacatccatcactacccccgggcaagaacctgtttccagagacagtggtttctcaaaatcggaagggaaatgggacacctttacaaccagaatgggcaactgaagggtctaaagtgctaagctggggatcacaggcccggggcccagttccctgctgggctgctccccaccaccattaatcagactccctagacagtgcaccatttggctctttgccatgaaaagggagagggaccagagacgcccctgactgggcttcagtttttgagaactcagtttcctgaccacaagacggggggcagtgggggcaggaggtaggtgggagacttggagtgagaagccagtcactctgagtttggggtcacaggtgggagatgcccagtggtgcccacacccgcccggagcctgggtggatgggagaattctctggtcaccgcgtgatgagtgccaacgatgcggcaggcaccacgcatctgtcggacctctcgccacgccccagggggtagctgcagtggggagactcaggcacagaggaggagggtgtctccccgccggccacacaactggtgaatggcagggctgggatctggacccaggtctgtctgatattctagattgtgaaacgcgtgactcagagactgggccttcaatgacgacgcccttccccttcctctgcctctccaacaccctcggccaactagatttttcttcaccggggcccaccctagggaactcataaaccagaaggctgagttctgcggaggcggaagcccagcggatgctggagaaagctgcgagtctccgctccaccaggtgcgctccaagtccttctctccccaaagccggatgggcccttgtgctgtcggccttcatgtccgctgggacctgacgttgcccgtttcacggtgtccagagataatatttccagctggcctatcaccccaggggcagtggggtgatctacacccaaccaacctctgccctccacccattcttgtctccacccctcctggtgcttggtgcaaagcaagcaggtcatagggcaggtggcttctgacggctcaggctggtggacggcttctaatagctggggttttccgaggtgctctgaggaccctctgctgccccagcaatgatgctcccgggatttcaagtcttgatgatgtcttgggtccccagaaagctcagcagcaaccagactcggaggcacagctcacctggccaagtaatgccccaagggtctgacctcggtcctctggaggctcttagccccccagctgccagcaccgctgtcctcactttctgactccctccagccctcttcctcctcttcttcctccccctcatcatcctcaggactactgtcccag

SEQ ID NO: 34256 - DNA, 924 bp, Bovine  19866881020602
ctgaacaccctccctttcgtccccattgtacagatggggccactgaggcttcaagatgaaccctacgctaagtgactggtctgggatataaagcaggtaatgtggtcccggagcacatgttccaaccacatgctaccctactttcgcaaagggcagaattcctggaggggagttttcacggcacgtcggggaaccgcttccatgttgctgtggaacccccgagtcaaggcctgggaggggcgaaggggagcccaggcggctccatggggccagggtgccagagagtctcagagccacagggccccggccttcacactgggagaacagaactccctgtgcccgaggaaagaagatgggccttcagaatagacctctttcattccgccacccacagtgagagctgggggcggggagctctggcccagttcaccgggtcaccaggggcccagccctttcacgccgggactcagtttcccctctgtacatactgctccctgaggcccctccagcttcgaaagtccctgactttagactccaagaactagccactggcgaggaagcgggggtcgctggctcggggcccctccgtctgctccttctgttcgcagggtttctctagtattctctgcctcgcacacttcagggcagcggctcaggtacagcctctgtcaggagtcttcctatcctttggggctcagtccaagagccccccaccccatctaggaagccaccttctcccagcacggagccccacagctcctctgcaaggctaagagcagtagctagcagggatggaaagaaaaacggtggctgacacttactgagcgctttctccactgcagggtctcagcagctgccacactctgccttgtttcacctgcgtcatccccatggcgcagggcagggggtggggggcagcggggg

SEQ ID NO: 34257 - DNA, 1545 bp, Bovine  19866881070904
agcacacccacagacccagcctgccctctggctggactcctgctcagagaagactccgctggccctggggcagaaggggtgctgcagggcagaggggcggggatcagggtttggctggggaaaggggaacttcctgctgggtgttgggtttcgggcagaccaatctaactgaacaaggcaaagtcttgggattagcttttgaagtctttttgctcaaaaataaggtctgttttatgaaatttcccctccacaagccccagctggacaggcacggcgggccaggcctcctcgctggtgggatggggagggaggcagcccagccgggtccccacaccatcacacccacgggccccgccatagaccacaaacaactctgtggagaggcggagccagatgacaccccctctttgcacctcagtcccctcatccgcatgctggaggagctgctggcgccccttgctttgtacttctgactgctgccaggttgtcaagtgttgcagcaaacagttcccattgaggggccctcaccgaggccacttcacagacccgccttggcccctccctaactcagggcctgggggacgagctggaggaggggctctgtttgtcctgtggactcgtgagaagtcatgggtcgcctgtgacgggaggagggatgttggcacctgcagacgtcagtttccctggtgttccagccacaccaggaagaggctcgcgagctgcccttgccaagggtggccattcctggtggagctgggtgcagggaggccagggtgctgtaggcgggtgggtctccaagacagcgaggtaagtcctggtcttgccccctggctctgcccttttcctccttggtcatggtggggaggggtccatcctctcccactgccccccacccccacccccaagccaatacacacagccctggaggtctggcactaggctcctttgacacctctcagagtcctattattgtaacaaatcagccaaaattccatgttacagttaaatagtatagaagacggtttactgtacaagcaagttgtgcattaaaaacaaacacaccaagcaaattatagtgcaaagcaagtttccatccctcccccaccctcttcccggccctgggacggttttaaggaaggtatgcgtatagcaagtatgaacacctcagcatgacaatatgtcacaaccaatctgtacccatcaccaataggcttacagtaatatggtacccaaaccccttgattccttgtgctctctgagtcagtgtttgcctcgtatgactttaaagcagccttgtaccaccccaagctgtctgcacccaccatgggcattaaaaaacaagactcagcactgctactatcacttttaatcggggactgggcagggggcgagggggtcaatttattttccggtccctgccccagccagggcttggatatcaggaagcgggtagtcatctgttggggggggctacaaagtgctgggccctggggacccaagggtgcctccccctggggcctggggcccgtctacaaccacagggaa

SEQ ID NO: 34258 - DNA, 836 bp, Bovine  19866881088868
gggtgataaccagaccttcagaacagtatgtttgcaggtgagtacatcaaggtttgcagctcagaaatgacctgcccaggtccatgctgtgctgctattgagaggggttgcatcccacaagggcttccctggtggctcagaggttaaagcgtctgcctccaatgcgggagacctgggttcgatccctgggtggggaagatcccctggagaaggaaatggtaacccactccaagtactcttgcctggagaagcccatggatggagaagcctggtaggctacagtccatggggttgcaaagagtcggacatgactgagcgacttcactttcactttcactttctttccacctgatgaggcagggctgggggatgggaccaaggagagggcgggaggcctgcccaggggctcaatcctggctgcacgagggggatcaggctctagttggagacctttagccctgaggggcattggtcacagacagctcctgtctggacccagctggattctgcaactcacgaattgttgatctagaaaaaaaaatgcctgtacttccaagagcctcttgcccagagaaatgtaattcttgatggtctgaaactttacaggcctgtaatcatgttgcttcttggctttgtgataggtagagtggtcaggagcagagaaatgtgtgtggctctgtccctgcagccaccgggggcccgaggcttgggtgctgacagcctggcttggcctgcgcccgtctcctgcatcccaggtacctggcttccccctcaaggcgatgggctcgctgggctccgagggatcgctcatgccgtacggtttatcgcccgcactc

SEQ ID NO: 34259 - DNA, 1508 bp, Bovine  19866881089152
cgcttgcttaaaagacgcttgctccttggaaagaaagctctgacaaacctagacagtgtattaaaaagcaaagttgcgactttgccgacaaaggtccatatagtcaaagctgtggtttttccaggagtcatgtacaaatgtgagagtgggaccataaagaaggctgagaacgaaagaattgatgctttcgaattgtggtgctggagaagactcctgcgaatcccttggacagcaaggagatcaaaccagtcaatcctaaaggaaatcagtcctgaatattcactggaaggactgatgctgaagctgaagctccagtactttggccacctgatatgaagagctgactcactggaaaagaccctgatgctgggaaagactgagggcaggaggagaagtgggcaacagaggatgagatggttggatggcgtcactgactcaatggacatgagtttgagctaactctgggagatagtgacggacagggaagcctggtgtgctgcagtccatgaggtctcagagagtggtgtataacttagagactgaagaacaaaggcccagtaatgccacttacagtgtgcacaccagagaaaccatgcatatgggcaccaagaatgttcctaacagcattgtagtaacaaaaactgaaggcagtccagattccagcagcattagcgggattgtggtatagctgtacaatggaatattatacagtcctgaagagggtggctcacagttacagcaacaaggaagaatcttaggaaaaaaggcaagttatagaagaatacatgcaacacgattcagtctttaggggagcttataaatgttgtaaaactactaaagaaaaacaaagataagcttgaaattccagaaaataattactttgaagctaaaaaggaataggatggtggtaaaaactctggcatgctgaggacttcaaaatgataggtgatgttcttgttctatcattgggcatgttcttatcattttataccttacattcattttataatactttacatttgattttataatatgaactctacataatataaccttcaataaacttatttttaaaataagtgcaaactgcagaatttagcatatgactaacaggacacctgttcttgtgcacctacaagaaaagaatgcttctttggggaaaaaaacaaattataatgaattctactccactacttatgtttaatgatttagatttcctcttggtaaaaggttttccttctccccccaacccttattctctctgctgtgctgcccctcactttgtaggagagatttgaagcgcttttcaccatctatgatgaccaagttcattttcagttgttcaaaagctttagaagagtccgaataaatttcagcaagcctgaggcagcagcaagggctcgaatagaactccacgagacagacttcaacggaaggaagctggaagctgtatttcgcacaggtacttacttcattgtgcagagggcagagtgggctgaacttgtttt

SEQ ID NO: 34260 - DNA, 1079 bp, Bovine  19866881105178
cagcaaagacccagcacagccaaaagcaaagaataaataagtgttttaaagagggatatgcacacccaaatgctgctacaccttgctgatcacaagtgaggttttcgggaggagtctactcagcacagagcaagttaaggccaacctgccagccggacctactgccaacttgctgtgtgaccctggctaagccacaccccctttttgatcctctgctagtaagtgagggcagtgatgtcctggagtcctgccatatcctgtggcagggcggggactcaccctcaggtgggtgtcagagatgaggtctggagtgactggcttccactgctcagagccttcctcctggacgctgatgcggtagcctgtgacaggtccagcccctcggtagagagggggctcccacgccagcatcagggaggtggcccgcacctcagacacccgcagatcatatgggggccctgtgggaagaggggcgagagaaggagaagggcagccaggcacccagccagacagccaaatgccagccacacagtcaggaggcaagcgggtggtaagtcagcaagcttgtccatcttccggtccctcccaggcctggaagagcctgctcagggcctggtggagacctgacccaccttggcttcatggcaaagcttggtctggctcagaaatagagttaactcttcagagtgtatccagtagcacttcctctgggaaacatcccctaatcctcctcattcccagcccctacacggcattcatctgtttgatctctttggcatttcagtgtttaatgtagaagttcagggtgtggggttcaggtcccagctccaccctttcaggccatgcagactctgggaagttacttcacctctatgttcttgactcctcatctgtaaaatggggataataatagttcttatagaagagtgctgttgtgagcattaatgacagaattgatgggaggtgtcaatacaccttattgttagtacccagtaagtatcagttgtttataatgttgtctcaggcttcacacagagtgactatctgccatttaggtaaaaggtttgtgtagaaaacag

SEQ ID NO: 34261 - DNA, 1304 bp, Bovine  19866881136342
tcttaatatgtagggtaacaattactttatcttaaattctttttgttcaatactggtgtgatttctgtctcctgatcaaaccctgatagtcaagcaaaatcaaaataatttgaactcctgggctattcatgcagctgctggcatgaataataatgttccattttcttcctttgctctgtgtcccacccccttttctgattagggtcatctagttcttattatcttccacccatctgcagctcaaattaatcaggaaataatatctcctcctaacaaattccaggaatgaaatgtttaaagaatggctccttccagcatggagtggttctgcttctcctgaaccaatctgcagttaattttgcagcctttgagtctgcaggtaaataggactgattctttctaatttgaagaacataactggatgaaatctttcaaagcattcaggcttcataagccactaatatacctcatcttacaaaaagattgcaaagaaatatagcaaactattgaataatctctagaccatggggttgtaagtgattttcattttcttatttatccttttgctttcaaactagccataaaagccaagtctagctttgataatgagaaatttctaaatattaaaaattgacatcactcatcctccaaccggtgttgaatacggtgctggttgcgttgtaactccttcttgggggaatgactgatttttccagggggagacaaattaaggtgttaccagggaagcaggctaatttaaggctcttcaggaaaaggtgagatctagtgtgtgtggcaggtcatgaatttaaatacctactataccccgctactatgagcctttgagacagagactgagaccaactggcaggcacatttctattttcaggcctcctgctttatcagtacgtactctcagaagcagctgtttcctccctccctttctctcttccacatttattagcacctaccatacacagagccccggtggctcagacagtaaagaatctgcctgcaaagcaggagacgtaagagacgagggttcagtccctaagtgaggaagatctcctggggagggaaatggcaacccatcccatttttcttgcctggagtattccatgggcagaagagcctggcaggggtccatggggtcgcaagagttggacatgacttagcaactaatactttctcttactacttacttaccatatactagaaccagatattgttatagaagctgagtatgtatcaggaacagattactccctgcccccatagaactgatattccagtaatgtgtgctt

SEQ ID NO: 34262 - DNA, 1173 bp, Bovine  19866881165054
ttggttttctccgggcagcctggaccgccccatgaggggaggcggggaggtggggaggcagggataagctctccggctttcccaggccagaagggcctttgccatgagcctgacccaaacttggtctgatggggtaagcctggccccgaaaggtgatgggacaggcccaaggtcacccagcccctgaccctctgactagtgcccgttccacgataccacctgtctaaacagaagacagagacacagagggacccggcagcaccggtgagtgtgaggctggtctcaagcactacatggcttcatcactggcatgaaaaaaatatattgctgaggctccatttctcaggcctctccaatgggcttggcatagaaggtgcccactgctccatccttcatgatctccttggatcttcaccacaactctagcaggcagattgctcttcccttcctatgggctcctcgagtgaggtaacagacttcagccttcatctaccagactccacagcacttctgcaacactctgcacgggcccacgtgtcaggaaaccccgtcagcagcagcaggggctttgctgtgcggcttgcacaagactcagttttcccatctggcaaataggtggactggactaataacagcagccaccacttctgtgccaggctgtgctctacccttctcttatctcacctgagcctcatgccaacctatccatccatgttaaggttacactcccaattttcagctaaggcacttgtcgaaggtcacgaaggcgggataagggcccggccactctagctgagagcctgtgcttctccttcactcctgtgccctgcctcctccctggcgccctcactgggggagctaccacaatcctagggacagtccctttcctgggacttgctggcagcccagtcccatcccagccatgcccccagcactgaccttggcctcctcatggacattccacacgaaggacagtgcattatacgccacctcttcaatgtgctggacaggtttgaagttttctttgcagtcggctgcaaagagaccacaggagaccagaggagagtcaggagacaagggatttgggggcaccatgggggagggggtcattagggcctgggccccgttcttggcagggacttggatcctctcccccaagaaccgtgcttcaaa

SEQ ID NO: 34263 - DNA, 1826 bp, Bovine  19866881198149
gaaggaggccagttatccggggtggcccgtggggtgtaggagggaagctgggtctctgagacagcctgtggagtgtaggaggggggtttagcttccagagctccctgaggtgcataggacgagggcctgccctcgggagcagcctggggggcataggagagcacggggagtgcctggtgaggtggtcctccggagggccggaggacggggaggtctggctgcccaaggtaggcaatctcaggcaggctgtgccgcggtgggggtcccgggggctccgtggggttggagaccttgacttcggagtactggacaggctgggccagaccgccggagccgctgaggtcgaagacggggatcagggtgtgctcctggatgaactgcagaggccggaagggcaggatgtgctggacattctaggcagggagaacagcatgcccattagagtgccttctcagcccccgcccccgaggatgccatgggcgccacggtcctccccaggggtgggggcgagggcaaggccagaccgcctgagggcttttccaagatccacaaacccttcctcctttcccagggcttcctctaagtgctggggcctctgtgaaggaacagggctctggccctgttagctgagggccacttccagagtctggcttggccagggagagcggtgagtcaggctgtgatttctccaggaggtgggtattctggaaggagttgactcagatttgcaatgaccttgggtgatgctccccgggaggtgcttcaactgctcttcagctcccgaagggcctcatggagggagaaaggaggggaagggtgggggaaagcggaggcggggagagtttacaggaaacggctcagatgggctttgactcggaggggcttatgggtccaactcctccagccccagactgttcaggctctgcattgggcagagatgccgtgctgggggccagactcaggctgctgatgtgacacgtgtggtttgctaaggcttaatttagaaaaattagttgccaagacttgaaacgtgggagagttcacattaccatctgaacttctgacttcattggtaaaaaatgcaaagatgtggccacgctgggcctgcgatcccaggtggcagagcctgcctgggctgcccattcagacggggcgtgtgcccccttgaaaacgacatggcttttctgttccataccttctcttcctgatcccctagctcttgtcagtccaccccaggggctgccagccatgtctctaggttggcgggagaagagaaggagagccgggagtccctgggcccatgccctccccggggcccctgctcaccagggagctgggaggtggaggcggcttggtgatgtatctgtagctcaggtagcagagccctgcgaccaggaagcccagggagaacaggaaggcaccggagaaggagtaggtccacgtccgatctggttcaatgagaggcagagcaggaagactgaggctgtcagtgtgggtgctggcaactcgggcctcaatccccaaccccacctctcgggacaggcttgggaaggcctcttctaaccccaagacttacggggccagggtgagggcacaaatggagggccacacaccatacgtctaaatattaagaatttataaatcgtgtttttgcattgttaagtaaaatatgttatgtgccccctccttgacaaatatacttttcataacaacctggaaggcttgaagcttgcttcttggactcctcggggtgcagagtggaaagaaggaagtgcaggggggagttcctgcaagcccagccggctccagtccaccctgccaggggc

SEQ ID NO: 34264 - DNA, 790 bp, Bovine  19866881269452
gggggttgccctggagacggccttctcagggcctgggtgccttaccccgaaaggaccagcgatggctgcaccagatgggcagtggcaggtgcacaggagggcttgacaaggctgcctctcccccttccacttgctttgcctcagctccaactacctagttaccagctgcaggccagcctgcagtcccagccctcctgggtgagctcggactcactgattctgccccgattcctttagcacctcgtgtgttcaccgagtcctgactcatccaacttgggcttggtgcttcctttcaactcaagatctcagctcacttgaggggacttatctgagaagaatgagctggagaggcattagaattgcctccctgccgcaacccctcacaaagattgtcccagaaagcctccagcagctgagggctcgcctcgtcttcccgtgtgtctgtgtgtgatggaaaatgtgtctctcttccttgcaggcagtgctctcagcgggacacggcagctccaacaggtatggagagaagcagccaagggcctcgcctccctcctgctgcccctcgtttgctcccagcctgccctcccctttgctgtcccccaagccagaggctgggcccagaggaagtacccaggagactctgcccccagcccccaagctagactcacgctcctttctcactgaaactgcccgagtttttatggggtttgttttatttgaaaagttggcgaatctttggcgggacacctgcttgtaaaacgggaaagaaaaagcctctgagatggtgatgcag

SEQ ID NO: 34265 - DNA, 764 bp, Bovine  19866881289497
tgcaggaagacagtgaaaggcttgaaaactcggtccccttctttagcccgctgtcagctttatgttttactgggttagcaaaacttctttcttagagtgggaagagatctcagtgcttttggagaaggcaagattttttttccactattgaattataacatttgtaaaacttttaaacatgtgcatgttacaagtgagtacagattttgtatggggccggaggatatagtggttgaaagacttcagcaaagcatcatgaaaaatagggtgatttggaaatccattagactgaagtctgggaaataatgggagctctaaagttcaatgccatttattatttagacccagagaactacaggaggtgaaggtcagacagacagtggatctccactttttccctcgaatgtaaaggttatagtgaggggaaatgaattatatgctgcgaaagaaatagcatcagtccttatatctgtacttcagttattctttaaaaccagttatcttcatttgttctgccagttggttattcttacttccctctcccgctggaaagtacttcactgcattgcagtaattataacaggaccctttctgaattacatatgaaaagcgggcacaggtcattgaaacatacaaaattcaaaaatctaattttcacctttactatggcaccggtttttttcctcaccacaactactagaaaggagtaagattttctgcctgtaaccagtgaatggggaggaagtgataacagctttgcagga

SEQ ID NO: 34266 - DNA, 1264 bp, Bovine  19866881419832
ggaaagacctgaaggtgggagaagaaggggacgacagaggatgcgatggttggatggcatcaccaactcgatggacatgagtttgagcaagttccagctgatggtgaaggacagggaagcccggggtgcttcagttcgtggggtcacaaagagttggacacgaccaaaagactgaacaacaaatgcatataaagtgcttggaacgtggcctagctgatgctgctgtcagcatcataggagtgtctgagagcgccgtatattaggcaatgtatccaagttactttagttttgctacatgcaaaaatttctttgctgagttgcgatatgatactctccctcggtttttatagagggtggatatgacaaacagccgctgaagaatgtgtcggtgttactggtgagcatgctattcaccaagttgcacaatttcctttatctcaagattcccatgctttattttgcccagagccaaactctagaagagattgtgtctcttgggactaatacacatgctgccttgggacagctccatacctccttggaaatgaaaagttgagaaatgagatgaaatgtgatgttcacatggtaagcccaaattctaggtacaatgagacttctttttttcctgttggttgctctatttttttttttttaacagagtttttaaacgtcattttgttcaaaatagaaattgttttataggttgtttctgatcttaaatatgtgtatcttgactgtaaacaaaaaacagtcaactttttgatgtgtccccttgcagatttacatacatatatgggtgtgtaaaattttacttgtatctgtgtgctttggaaatgaaagtttaggaaaaagagaatcacaacctactgttttatttattattatttggaggctgtgatgagtcttcattgcagcatgcagggtttctctttagttgtgaagcaaggacttagttgccctgtggcatgaaggatcttagttctccgaccagggaataaactcatgtccctgcactggaagaaggattcttaaccactggaccaccagggaagttcccacaaccttctgtcttaaaatccaccttttactcctagtctatcacagacattttaatatattaacaataacaatatcttaattgattcaggaagatatttatgatatccataaatattttccaggccctttgtctagacactgagaatatagaaatagaccaaatagaccaggtctcttcctctctggagttatcaggctataacca

SEQ ID NO: 34267 - DNA, 1837 bp, Bovine  19866881507287
atggcctctttgtgtgtgtgtgtgtgtgtgtgtgtgttttaaatcattccagtgtcaggtatcataatacatttttgcaagaaattattctaacttttaaagggacagatggcataggcatcttattgatgctggagtttggatttgctttctttttcactttcctacctcagcgagtcttaccctactttgactgcccttgttgtatctattttatcttgccaacagatagatgttcaaataaagactatccttgcccaggtctggtcagagacactggcacttcatttagctacttgaggtttggaaccatcctcaaagataaagacccacatcttacaaagaagagaaatggagaggagaggaatattgccaaattcccggcctgctgtctgctttctttcaggtcccgtcagatttctcagtaacgtgaataacccagttagactaagaggtgtaaaaagtcctgctggggcaagatgcatcataagaattttgtcttggtttgggagtccactccatgctgacaaaattggtgatcaggttctgaatatgcttctagcttctcttcccactcagggagtgggtagcagtgggggaaaaaaattacttaaagatctaggctccagtttacctgcatgaaacctgggcagaccattactctcctaattagaaccacaggtctttggagagaagggcccggatgtccaatatatgattaagccatgaaggaagcaaagtactgagcgattagtgcccttattcagagaaggttctcaccatagaagggaaagtgcatgtccctttcttggacaacgacacgctgtcgaacacaggggactgatgaatgacgttgtagaaccccgggcctgggatatcatcctgaaagggaagagagcatggtgtcatcgcaagactttccatccacggtgcttttctgcgagttttacatccatttaaccctaagcttcattggaatcctctgggacaggcggagatgttgcctcccggatgacagcccagctccaccaattcctgacctgcccagtcaccatctaagttcacaagtgccggggctgggactccagctcaggtctggggccaccccccacccccaccaaccacagcccttgttctttccactactctgtactgcattctaggacgatgctatggtttctgcgtgccaacagacgcacgagcagaaaaacggatcccgagtgcatcagcggctgtgcaggtgagcgtgggttgatgggtccgccaaatccagggcgagggaagggtgaccgatttcacgttcaccacaccccacctgactcagcttcctccccagcctttcaaaggagaaaccagggagtgtttctgtttataaagcaaagtgaaacaaaaaccaccttcatcccaaacaagaccatctctaactctcagacaaaaagaggtgggctcatggggctcaagtgctcagtgatgtgggtgtgttacaccgaaacaaaagcttgatttctaagctcatttctgctgctgcagttaattgggtttgcatctcattttccgtgctggttaccagggggaggtaaatgttgacagaagttggccaaacaagtgacgtgaaatgacaaggatgctcctctgtctcgagggtttactgggtgcctccttggtgccaagagcttttcaaaggttgtcccatttaatctccaatgagaaagggatgcccccattttatagatggagacactgaggcccacggagatgaacttgccccagggtcccactgctgtcagtggcggcgcctgagttcagtgttacgtgacggtgtacagccttttgcagt

SEQ ID NO: 34268 - DNA, 1837 bp, Bovine  19866881510243
acgaagagggcctggggcctccggccaagagccaggtgagtgcaccactttgggaatggatggccagccccagtcaagccttcagatgactgcagccctacccaacatctcaagggcaaattcatgacaggccccaaaccagaactgcccagttaagctgctcttgacattcttaacagatagaaactatgagagacaataaatgccattgctttaagtcactaggatttgggtcatttgaaagcaatacacatgatggaattcaaacaggacgaaagtaaaaagtgattaaactattgttactcacacaatagccgtagtttcacaaacacgatgaatttcacaaatacaatgttaagccaaagaagccagataccaaagaggacattctctgtgattttattggcacaaagatcctaaatgtgcaaagttaatcttggctgtctgcatagtggttcttttttgggaggggaagcatggtggccaccgggagcagttagcagggggcctccaagtgctgataacgcttcacttcttgggctgggggctatatggtttagacaagatcggccacattcagggtggtatggccacagactgggggctgtatagttgagatcatgggtatgctttttttgtaaaaactcatcaagctgtacatttatgactcatgctctagtctgtatgcacactatatttcaacatgaaatatttctaaatgatcattgtatggatactgtttgaaatctagagaccaaaaatgaggttctgggccatgaaaagggaagaacttcaggagagtctgtacaatgatttgcagtcctgtaaaacacacatatggaaggcaagatggaaaaaagatgaaatgtttgtgttgcgaggcagggattctgggcaacttaaaaatcttttaagtatttcatttaggaatgtattagactgtcttgtcagagagaatgaataaagggccaagaggtttaatacattttcacagggggtctaaccagagactaaaatacgatcctataaggagtaagctttttattcacccaaaatttgaccacccagaataatgccttcccagagatttcacaagctgttcaagtgcggtttctctagcagaatcagttattgaaactgccgtcctcattaagcagaaaagtgggcgcccgtgctcaaggttcgcggtccggctgggcgtggagagaagctaggccaggtggacaggaggtgttggcgacgtggtgggcaagcagagcagcaggtattaatttgctgtaaagtaaggaaatttgcgggcctggaggaactctcccagtgctgatagtaatagaatcagaaatatcaccttcaaatccccaaacagctgcaggctcagaagacagtggagaaagttctccaatttcactgagctataaattttggatttcccataacagctttccagaacaggttccacattgttctcagtagaaatcacacattacagtattcggtagcatcctgaagacacagactctggcgcactccttccgtatgccctctcccagctcaaaaaccgtcagtggattcccccactaacccccagcacaaccttaaaaagtgtctctggcccagcacggtaaaaagtaacaactccaacccaggcaccccagactgtgtcaccgccggccacctggccaagagcccactgtatctatcacctgggaactcccttcaccagatgatctttacatggggaagggctttctaagcttcaaagccgtggaagaaaccacagaggaaatgcttgacagtcccacgctacataaaaacaagaaattccggtgcgattaag

SEQ ID NO: 34269 - DNA, 705 bp, Bovine  19866881524397
ggaggctgctgaggtcctccggccgccggcagatcctctacgctgaccgccaggcagtcctgaaggtggcctgcgcctacaaggaggatgagggcctctacacagtccaggtgccttcgccctttgggctccgggagcagagcgcctacgtgtttgtgagaggtaaggggtggctggaggagggcgcccaaccagagcccagggaccaggactctgccttgaccgacttgccgtgggacacgtgggcgagcccccagctccttggggcctcggtgtcccagctatatagtgaatgcgcgtgttgaggcagagtctttctaagactgcccatgaccctccaaagggacccagcctgagattctcaggcttggagctagctggagaggagggctgagcgtgggctggcatccttctagtcctgcttgatttctgcttccgggttttgccgcttcactggctgggtgaccttgggcgattggcttttcctctaggagattcagtattcccacctgcaaaacagagagttgctctgggactcaaagatgaattgtgccaattgctcaggcagatggtatagaatgggcccctaataaactgggactcccacccacccacccctagatgctgctgtttaaaagaacaggctgtcattcaggtcttggtcttcaagatcaactgcacccctgggggattcgtgagaagaag

SEQ ID NO: 34270 - DNA, 855 bp, Bovine  19866881562291
gtagaacatgcctgtcattctacagccaaagaagttgaggactagaggcggagtgtgtgggtaagccagaaggaaggaaggaaggaaggaagggcgggaggaaggaaggatgatttgtccattctccagggaaaatgaagaccgatttgtagcccctgtcaagtcctggggtgtaaacactctctcctgcatactgacatcactgacctcagagctggggggagctcacgattgagtctgtaagcaggtaggagccagctccaggaaaagtgagttggtggagagcttgggtccacgactctctgtcctgggctctgtctgctgccccgctgtgaggtcctcagcgagggcatcctaggcctctttcacctccagagtcagtgaccctgaggtggtgacgtccgcctgtggggccagacaggacaggcctcacagggcccatgctgggaatcaggacccgtggccttgcaggggggcacctctggttcaccgggacccagcattgaccaccatccttcaagtccgaggaaactgctcacaggatagaggaggagagagtccctgtttcctttcaccctttccttctggaagactctcacaagaggagccagtgtgacatttgaagtaatatatatggagaattttattactaaatagcatatgagtatacaaaatgcataactgaataacagctaaaaaaataatccaagaaatgtgaaatacacattttttgaaatgataaaaatgtatccatgaaaaatataaaatgttgcttatatatacaatatatacttatatatatatatatataacataagtgaaaactgtaaataagaaatgtatgcaacagtgagt

SEQ ID NO: 34271 - DNA, 1060 bp, Bovine  19866881675192
tcctgggcctgttgacgtcagctttaatccacggtcggtttttgatttaaaacaagacatcaatatctttggcgactgcttcacaagggattcgttgacatcataatgccctgagaggaaagaaattttaagacagaataaagaacccttctcaaataaataaaaagcggtgccttacgcctaagaatgcatttaatgactctaaggcagtatcgctccaggacggtcaagtaatagggtccgcctggaataactgaaaataacattcaccatttagagaacatgtgtccatgcagcacagacttaactcatttaatcctcacagcagccctgcaaggtgggtgttagcacatccattctgaacatgaggaaacagactcacagacattcagtaccttgtgaaaagacattcatctaacaagaggctaagcctagcgtcttcctgtataaactaaggacaataattcttcgaacaaccgggaggctatggtagtaaaagaaccttttaggttcctggaatgtggtagttgttcagtaactattatgcagtttgttgctgttatttagttgctaagtcacacctgactcttttgggaccccatgaagtatagcctgccaggctcttctgtccacggaattttccaggcaagaatactcaagtgggttggcacttccttctccaggggttcttcccaaccgagggatttaacttgtgtctccagcactgcaggcagattctttactattgagccacctaggaagtccagtaattcttaattatgtaattcacaaatatttgttgagcaccttctgtgtggacccagaaccatctgccttcagtgtccactcattcctataataccctgtctcaacaaactgtgtcagaagaaaagtacattgtgcacatgctataaggaagaagagaatgatccgggccgaggtgaagagggggcagtctcgcccctaaggagctggtggatgagttacttagttgtgtccgacgctgcggccccacgggttacagcctaccaggtcccctgtccagggattctccaggcca

SEQ ID NO: 34272 - DNA, 742 bp, Bovine  19866881817328
ttggtaaaccctgtctgctggctgtttcaaattctactcctccctcttccgtgcaaaacccctgatttttttctggaagtagcatcttcatcaaattgtgttaagagactcttcgtccccattgagtatgtctttcttgaagaccctacagatcagatgtcaccttagattatttatcatgttatgttagatcagcgcagagaaataggaaggtcagctttatactctggtggcaggctgagggtagcatctaagtatgttccacagtggatcactggttctacaggttttatagatatatagtagagatgaggggagatgatctcatggtcagctcagtttgttgaaaaaacaaacaaaacaggctttctcactgcagaactctttggtgacttggcttgatagctgtatacggttaatttctagaagagtctggtatgaagctttccccaaatgtttcgatcctagcaccttttctgcctggagcatcttgggcattcttgtgtctcccaggatacatttctgggattccctgaaatgacttcagaggatttggaaacagtttgggtccaggagagttatggagcaaacggcacaggaaactggagccagagcagggcagagccacctgctgtgaagaaaaggcagctacttcctcgggaaggcacagggacaggagggaaggaagtgggcttgccgggggcagagcagttacacaaaagcaggaagaggaagacacttc

SEQ ID NO: 34273 - DNA, 1553 bp, Bovine  19866880411740
tgtcttaagattgaagtcataattgtagtaaatttagatgtaaattatatggttggatatcaggtgggtttaagaggagtgatcaagactatatctaaaatgtgcaagccagcatatgtaaagcccagtgagagtatagataaaaatagaatatccacactgagtcttaacatccaaaggctcggtagagaaaaagagtcaccaaaggatattcagaaagaacagccagagtgaagtgaaagaaaaacaaaaagaagagatagcactaagacctggaaatgaaagtgtttcaagaaagatagtgtggtcagctccactgaaagctactcagtgtcaagaagagtgcaaaaaatgatatatgcatcattattgtacccttaataaaaagcatttctgggaagtaattgggagagtggccacatgggaattggttaaagggtgactgagacttgtagctctggaaaaaaaaaaaaaagatagattaaggtaatgtgaggaatatttacagatgcctaacttcctacaagttacgttttaaactttaaacataaagaacagaagtcataaagatggcaatgatacataagaatggtcagcataagaaccgatactgtggttgccctttggaacataattaacataagaacataccagtaacataagagcctaaagtttaaaggcaggaacaaaaatttaggtccccaaactggtgagatattaccgatacacttgcagaaattcttcacccatgaaggactttatttcaggaagttgtttttgtgtgatggaaaataatctccccagagaaagcaaaattaaaagcagatatttcacattatccaaatgatccagatcaatataaacattaacttcaacaccagagatacacctattatgtctgaaaaaaacaattattaaaacaaacacagatgcaattgaaaattcagcctgcaagaaaattcttccatggaagggaggagagggggcactacaaacatgagtccattatcttaaaaaaggcaagaatgattgtattaactttcaagaatataatatcatataatgaatttagcaaatggagattggagaaaaagtatatttaaaacaatgtcccttctatagatatatgaaaggttatatactctgaaaattcctcaaactatagatattttttcatgcttgtgaggcacaaaagaacttttaaaatatataactattacttgaataagaaattggaattgtagggaccagtatagaaaaaagataaatgaaaccagagtggtaaagtaacactgaagctctgtttagtggagaaatttaaaacattaaggattttttccctaacatttttattatgaaaggttttgaacatactaaaaagatgaacagggagaattcacattttcaccacctgaattttgccattaacatttataatatttgcgttcttacatatccacccgtttatccacttatcctttattctatcttatttttgaagcctgccaaagggcttcccctggtggcacagatagtaaagaatctgcctgcaa

SEQ ID NO: 34274 - DNA, 1470 bp, Bovine  19866880418022
aaatccatataaaacaaacattcaaataatttctatggaaacacagttaagtgtgaccgcatctcccagtcttccacattgttgcatctgggccaatcctacgcacataggcatatcaaaactcgcagtaattaagtggtctccccaaaatcctactgctgtgaataaaagcattcaaaattagatattttttctttcttctctacaatgagaaaaacatcacaatcattaaaaatttaaatcaagtgaaaaattacagtctggtcaacacggaagcataccttctttgttgtcttatatttacttattaacaattggagaaaaaatcaaattaaaagttaatgaaatatgaaaggaaagcaaacaagataagcactgaaatcaatagaaactgttttgacatgaagaggaaaattgtaaaaataattttgtcaaatcgtacccaaggtaataatttatggaaaggatggagatggatttatgaatagcgttaataaataagacttcggtgttgtttggtaatccagttaatgaagaggagtgaatcatataaaaacattgcaaatgagtttaatttcttgctgacttgatgcttaaataataaaacaatcatgttattcttcctgattttgaaatgcttgagctatttgtcaacttttaatcatatgcatttagatttgtatacactgtattaagaaatgagtatccccctgatggaagagtatttctcttttgaccaggtatcagtgagaatggaatccagggcttgcaattccatgtcttagattgagaagaattttccacagatcagctcctggccccatgtatattaaacatgcttctctctaactgctaatgaacttccagtgcaagctatctcacaacctcaagttctgaacttttgtttcacgactttggttgagtcaggacagtgggtagcaggagtattcctggaaaccattcccacaccagggtgactagcaataatttaactggaatccatgttcacatgacccactaatgtcaaatcaaaagcctcctcttagaggataccataaaggtcatgacgcctccaacaccacgcaacaggaggggaggaacaatggtgggagaaaccggagcagaaagaaacatgagctgtgaggatgaaaaatgtcacctgccacgtcaataaacaaaggatgctgccgtcaccaagccaacgacactgtagcctctgccaacattgagccctgaggggacccaggacggaaaacaacaggatgggacactgggcctcgaaggttacggtgtctcaaaagaatgatttcaacgagcccaaactcttcccgcacagaaaaaagcactgaaatccttaacttgagatatctggttttccttaattaacagtaaccttctgatgttccaaccacctggtttttgttgcaaaaactgtgtatcctaacgcctttcttacctcatcagagcagt
